United States Patent 11,866,728 (ENGINEERED RETRONS AND METHODS OF USE) - sequence listing, part 5

SEQ ID NO: 11685 - RNA, 951 nt, unidentified
  source 1..951: mol_type = other RNA; note = synthetic construct
atgaggatctctgacgcgtcgctgttcgagcgcataatcgagaacacccctttctccgaggctgaattggtactcctgatactgacgggacccacacggtacaaagaccactggattaacaagaggcatggcagaggcaagagattaatcagccaacctactgcagagcttaagttggtccagcgctggctcgtgagcagcgaactttcctcccttccagtcgacgttcatgccacagcatatagaaaagggttatccattcgtgatcacgtgagtccccatactaggagccacttcctattgaagctggattttaaggacttcttcccttctttgactgattccgccctgagatacagacttgaacacgacgccaactatacggagctggaggtgctcatcctgaccaagctcctgtttcggaaaaaacagagcgaggagacatataggctatctatcggcgccccctctagtccatttatttccaactacctcttactagactttgatcgccgcctggcagattactgtgaatcaaattacctgcactatacacgatacgccgatgacatcgcaataagtgtgaacagggctgggaccctcgatttcgctaaagtttttgttgaacgtctcatctctgaactcccgtatctggggttacggctgaatgaagagaagaccgtgaatgtcagcaagaagtttcgccgacagctggtgggtctggtgatttctaatcagggcaaagtctcgttgggacgggaagagaagagacgcctcagggccgctgtacatagcctggctttgggtaaacttgacgtgcgacaaagtgtccagctgcggggccagcttgccttctgcctgtcaattgacagggactttgttattaccctgtgcaatcggcacggattccagagagtgtgtgatctgccatcagggtcagatgcgtcctga

SEQ ID NO: 11686 - RNA, 948 nt, unidentified
  source 1..948: mol_type = other RNA; note = synthetic construct
atgaagctaagcagcacgcccctgtttctccggctgttggagcttactccttactcagaatatgagcttgccaccctcatcctcacggctcctacacgatacaaggaacactacatcgtgaagcgacatggcagggggaagcgtttgatttcccagccaacagccgaacttaagctgctgcagcacaccaccataaacaaggaactcaacaagcttgagatacataatagtgcaactgcatatagatgcggaagctccatactccatcacgcacaaccacacgctaactcgaactttctactgaaactggactttaaagatttctttccatcactgacagacaaggcactgaagcacaaattaagggcagatacaaactatagcgaactggagattgacattttgcgcaacatcttgctgaagaaagacaggaagtctggtaatttcaatttgtcaattggagccccgtccagtccctacgtatccaattacctgatgaacgagtttgatatgttagtgagcatctactgtaaaaccaagaaacttgcgtatagccgctacgctgatgatattgctatcagttctaccaagccctacctgttagacgaggcgaaatcatacatcgacgatgttctcctcaaactggactatttaggactgattctcaatcaggagaaaactgtcaacgtgagcaaaaagcaccatcgcgaactggtcggcctggtgctttctaatgacgggcaagtttctctcggcagagacggtaaacggaatttgcgggccggcgtgaacgccctaatcaatggcaagctggatgagattgccgcctccaaactcaaggggcagctggccttctatatggctatcgatagagacttcgtcctaaacatgtgcaagaagtatgggttcaatagtatcgtggagctgtctaagaaatccaaaccttga

SEQ ID NO: 11687 - RNA, 981 nt, unidentified
  source 1..981: mol_type = other RNA; note = synthetic construct
atgagcttcctggaaaccaacatgtttgctcggatggtggaacgctctccattttcctataccgatttggccatcctcatactgactgcccctaagcgatacaaagaacaccatatcaagaaacgttcagggggtctgaggctgatcgctcagcctaccaaagaactcaaattcgtccagcggctgctgatctcaaacgagctctcccaccttaaagtctctgaggccgccgctgcatatgtgaaggaaaggagtatcaaggagcatgcagagaagcatgccggcaatcgttaccttctgaaactagatttcaaggattttttccctagcatcactaaagatgctattaatcgcctcttgatccagcaaaccgacttgtccgccgacgagcgctacatagcgtgccaactgctcctaagatctccgaagaaagaggagacactccggcttagcattggagcaccatccagcccattcatctcaaactgtgtaatgtacgaatttgacgagaaactccttggctattgccaagctaacggcattacatattctcggtatgcagatgacatagctctctccacgcagaatcccagaactctggatcctgcgaaggcgtttgtggaaggcctgctatcacagttggactacctcaagctgagcctgaatcccgccaagaccgttaacgtgtcaactaagaacagaagaacactgaccggactggtacttagtaatgaggggactgcaagcattgggagggacaagaagaggttaattcgagcccaggtccactctatgattaaaggtcagctgtcgaccgaggaagccgtgtctcttaagggccacctgtccttcttgtacagtgtggacaagagttttgttgttaatctggctagaaggtatggattggacgccaaatccttaatgacgtaccgcacaagttccacagattcgttacccccccagccagacaaaagcagctga

SEQ ID NO: 11688 - RNA, 1026 nt, unidentified
  source 1..1026: mol_type = other RNA; note = synthetic construct
atggccgagttcgataacaataaccttttcttgacattgctgaaccagagcccattcagctcgggggaattgaagaccctgatcagtaccgccccacagaggtataagaatcactttatcgagaagcgtaacggccgcggccggagattaatatctcaacctactagggagctcaaaggactgcaacgcagtctgctgagtataattgatgaagttattgcgccaagcgccgtggcagtcgcttataggaagggaaagtcaatcaaggatcatgcagccccccatgctaaaaattcctacctgctcaaacttgatttcaaagacttctttccgtcaattgattggtttacaatcagccactgcttcaaagagacagggaagttctctgacgatgagatcaagatcatgaacttcatcctgtgtcgctacgactccgagcccatcagccttcggggatcttttaagctgtctattggtgccccctcctcccctcctatctcaaattttatcatgagggacttcgacgaaaccctcgaaaacttttgtaagaatgagtctgtgacgtacactagatacgccgacgacttagctctttcctgcagtattccccgtaaacttgacgaggtgaagaattttatcgcgtcgattctggacgagaaaaagtacctaaatctgttcctcaacgaggggaagactgtgaacgtctctaagaagaacaagcgatccctggtgggcatagttttgtctaacgaaggcgtcatttcaatcggacgcgataaaaaaagactaatacgggcaacactgcataaagcatcccagggattgttaaccgaaaagcagctcgagaaactgaaaggtcacctcagctattatatcaatattgatcgggactttgtgtatagcctcgtagggaaatacggcttcgggtcagtatcccaggtgagtttcgaaaccattaagtaccctgaagtttttagcgctagagacaatctgttctttggccgagatgatggtattccattttga

SEQ ID NO: 11689 - RNA, 936 nt, unidentified
  source 1..936: mol_type = other RNA; note = synthetic construct
atgagccagttgctgcctctgttcgtggcagagagtggaatggatccccatgacattgtgcggatcattaggactgccccgcgccggtataaagttttcttcatccccaagcgttctggcgaacccagagagatcgcccagcccgcacgcgaattaaaagttttgcaacggattctcgtcgataaggttctatgcaagctcccagtacacgatgcagctacagcctacaggaagggactgagcatcctggacaattctgacccacactccggatccacccctatcttgaagctggatttcgagaacttttttccttcaattaccgagagcgattggttgcgatattgtcgagagaacagcatcctgagggaagacgacagggaaatcgcggcacgcatactgtttcgcagagccaaaggggagagaacactgaagttatcaattggcgctccatctagccccatgctctccaatattctcctttatcgtttcgactcacttgtggaagcggctgccctgaaacggggtctgaagtatacgagatacgccgacgacatgtccttttctggccagcgagcaggtatgcttaaggatatgattaaagaggtggccgaggctgctcgcatagctcggtaccctagacttaagttgaataagagcaagacaactttcgtgaccaccgctacgagacgctcggtcactggcgtcatcctttccaacgatgggacagtgggcattgggcacggtcggaaaaggctcataagttcaaaagtgcatcatgccatgttaaataaactcagtgtagacgaagtcagacagctagccggagaactggcctttgtgaacgtggtcgagccgatatttctggcatggctcaggaataaatacggggagcaaaccattgataacatcaagaggctgatcctgccaatctga

SEQ ID NO: 11690 - RNA, 930 nt, unidentified
  source 1..930: mol_type = other RNA; note = synthetic construct
atgagtgacttggtcaacctctttgttgctgaaagcggaatggcccacgacgacgtgctgaggattattcggtcagctccacagagatataaagttttcagcattcctaaacgctccggcggaactagggagattgctcaacctgctcgggagctgaaagtgctccaacgggtcctggtggacagcattctgtgcaacctccccgtgcatagcgccgcaaccgcctacaggaaggggagaagtatcctggataatgcaatccctcacaaaggcggcctgcccatcctcaagctggatttcgagaacttctttcccagtatagtagccgatgactggatcaactattgtaacgaccacgatatcttcgataacaacgaccgtcttatgtctgcgaagattctatttcgcagagcaaagggcgaacggatcctgaagctttctattggggctccttcctctccgatagtctccaatatactgatgttcgagttcgataccttagtgacagagtcggccaataaaaggcgactaaattacacgcgctatgccgacgacatgaccttttccggtcagagagctgggatgctgaaagatatggtaaaagaagtggcgtctgcagcccgatcagttagctaccccaggctgaatttaaaccgatccaagactactttcgtaacagctgccacacgtcgctccgtgacaggcgtggttctctctaatgacggagaggtgggtatcggccaccagcggaagcgcatcatcagtgcgaaagtccattattcaacccaggggaagcttaatatcgatcagttgagaaccttggccggagagctcgcatttataaatgtggtcgaaccagcatttcttagctggttgtcagccaagtacggtgaaccagccattgagaagattaagcatctggaaatctga

SEQ ID NO: 11691 - RNA, 939 nt, unidentified
  source 1..939: mol_type = other RNA; note = synthetic construct
atgctcagtaaatttctcaagcaattaagcgtccacacgggcctctctgaggctgatctcctgaagatctggactaacgctcctgaccgatacaaggtgtttaggattcgcaaaaggtcaggtgggtggagagagattgcccaaccggccagggagctgaagctagtgcagcgtgccttggtggagatacttctgtctcagctacctgttcacgacgcagccacggcttacgtccgcggaagaagcatcttggacaatgcaactcctcacagaggcgacacacccatcctgaagcttgactttagggacttctttccctctatcttggcagaagattgggaggcctactgtgcggctcatgatgtaattcagggttccgacgttcacctgaccagtcgtatgctttttcgacggccacggtcatccacaaagctgcggttgtccattggcgcgcccagcagtccaatgttaagcaacgtgctgatgtatgagttcgatgacgccatagataagattgctaaggataaggggatcgcttatacacggtacgctgacgacctgaccttcagcggccaaagaatcgggatgttgcaggatatggtcagggccgtcaaaaagactctgagaaaccagtcaagccccaaacttcggctgaaccagtcgaaaaccgtcttcgtaaccatggcatctaaacgcactgtgaccggtgttgtgctcgccaatgatggcacagcaggaatcggacgcggccgcaaacgagaactttccgccgcggtgcatcatgccaaaatgggaaagttagagaaatccgaactcaaagaactgtgcgggcacctcgcctttgcaaatgcaatcgatccagacttcctgaagttcctggccaagaagtatgggagtgaagtgattagggctattcagtcagcggtggagctgaaatga

SEQ ID NO: 11692 - RNA, 933 nt, unidentified
  source 1..933: mol_type = other RNA; note = synthetic construct
atgtctgaccttataagactcctgtcagccgagacagggctgagcaattcagatcttattaggatcattcgcacagcccccaggaggtataaggtcttttacattcctaagcgcactggtggcatgagagagatcgctcagcccgcccgcgaattaaaggtgctgcagcgggtcctggtcggaaggttactgggggctctgccagtgcatgacgcagccagagcttacaggactggtatgagcatccgcgataatgcagccccacacgcaggctcagggcccattctgaagatggacttccgagacttctttcctagcatcaggagcacagactggcaacgttactgcagagatcacgacatcctctccgaggaagatcgcgaaataacgtccctgatcttcttccggcgaaacaagggagaaaagatttttcgcctgtctattggagccccatctagtccggtactgtctaacgtgcttatgtacgattttgacacccaggtcagcgctgaagcagagcgtcgaggcatcgcctataccagatacgcagatgacctgacattctccggccagagggccgggatgctcaaggatatggttggagaagttgaaaaagccgcgcggaaagttaagtacccccgattgcaggtgcacggggagaaaaccacctatataactgcaagtcggcggcgtaccgttacgggggtcactcttgccaatgacggtgccttgtccctcggaagagataaaaaaagattgctgtcggcgggcgtacatcatgctagcctgggtaagttgagtgcggagcagatggaggagctcgcaggccaactcgcttttgctaacgtggtggagcctgagttcctagataggctaagagccaaatatggcgaagctgtggacttagtgcgccggtcagtgcggtccagttga

SEQ ID NO: 11693 - RNA, 936 nt, unidentified
  source 1..936: mol_type = other RNA; note = synthetic construct
atgtcaagagtggtatctctgattgccgtggaaaccggactccctaccgacgacatccaccggctcattcgttccgctccccgtcggtacaaagtctttcacattcctaaacggtccggcggcactagggagattgcccaaccggcaagggaagtgaagctcctccagcgagtgctggttacgcatgtcttatcttccctgccagttcacgacgcagctatggcatacaggaccgggcggagcatcttgacaaacgccacgtgtcacgctggccacggccctatactcaagatggattttaaggacttctttccatccatccgagccgaggactggatggtgttttgccgaaacgcacagctgttcgatgagtcagatgctgagctgtcagcccagatactgtttagaaaggccaaacacgagcatgtgcttaagctgagcataggcgccccaagtagccccgtactgtctaatgtcctgctcgttcctttcgacgtaatggtggctgcagaagcaagcaaacgcgggatcaagtacacaaggtatgctgatgatttaaccttctcagggcagcgcattggaatgctaaaggacatgattgacgtggtgcgcttaaccacaaaacaaatcagaagaccgaagctgactattaatagtgagaagacaaccttcgtgacagcgaaacattgcagggtcgtgactggtgtcactctagccaacgacggagccctgtctctgggtagagatcggaagcgtatgttgtctgcgcgcgttcatcacgccgtgttggggaaactgaatcccgacgaattgcttcgcctcagtggagatcttgcctttgctaacgtcgcggagccctccttcatcgatcggcttagcaataaatatggtagtgaagctatccagactatcaggcatgcaccaagaagctcgtga

SEQ ID NO: 11694 - RNA, 936 nt, unidentified
  source 1..936: mol_type = other RNA; note = synthetic construct
atgtcaaagctggtggacctgattgtgtcggaaacaggacttccacccagcgatgtactgcgcttaatcaggtcagccccacgacggtataaagtctacaggatacccaaaagatcaggaggcgagagagaaattgctcagcccgcccgcgagataaaactgctgcagagggtgctggtcgacaaggtgttgtcttctctgcccgtgcatcgcgcagccacagcctacatgaagggctgcagtatcgctgcgaatgctagttatcacgccggctctggtcctatcctgaagatggatttccgagacttttttccgtccatccgggccgaggattgggtgctcttttgtcgtaacacacatgtgttcgacgagaatgacgcagaacttagcgcacagattttattccggagagctaagcatgaacacgtcctcaagctgtccatcggcgcgccatcttcccctattctgagcaatattctcttgatgcctttcgataccatggtgatggctgaggcttcaaaaaggcacatacgctatactcgctacgccgacgacttgaccttttccgggcagcgaatcgggatgctaaaggatatgatcgatgttgttagacttactgtgaggcaagtccaacgtccaaagctcaccgtgaacctcgacaagactacgttcgtaaccgctaaacaccggcgggttgtaaccggtgttacactcgcgaacgacgggcttttgagccttggtcacgacaagaaaaggcggttgtctgcagccgtccatagagctattcatgggggactggatagcaaagagctgttaagtctaagcggcgatctggccttcgccaaggtcattgagcctagttttctggatagactcgccaggaaatacggaccggaagcagtgcagatgatccgccacgcacccagacagtcctga

SEQ ID NO: 11695 - RNA, 936 nt, unidentified
  source 1..936: mol_type = other RNA; note = synthetic construct
atggggaacctgatcaatacacttagtgtccagacgggcctaagccccagcgatgtaagattgatactccgaactgcacctcgccggtacaaggtttataccattcccaagaaaactggcggtgagagggttatcgcccagcctgctagagaagtgaagctgcttcaaagggctctgatgtctgcactcctagagaaacttccagtccacgagaatgccaaagcctacaaaatggggacatctctcctgggaaacgcgcagccccactcgggtcagagcccaattttgaagatggactttgctgactttttcccttcaatccatggtattgattggcttcggtactgcgcccagagcgcaattttagacagagaggactccatcttttccgctaatctgctcttccgactagccaaacatgaacgcactctgaagctgagcattggcagtccgagctcaccgttgatatccaacattctcatgtatggcttcgacgaaataatcctccgggaggccactaagcggaagatctcttacacccgctatgctgacgatctgacattttccggacagcgtgtggggatgcttaaggacatgccttccatcgtcgagaaggccattcgcgaagcgaaaggccccaggctgtcgatcaataagtcaaaaaccacatacgtgacgagtagattccaaaggcgggtcaccggactggtgctggctaacgatgggaccgtgggaatcgggcgagataaaaaacgtctgatcagatctaaggtgcacagggcaatcaatggcaaactggatgttaaacaggcctcagaattggccggttacctcgcatatgtgaacagcgtagacccagaattaattttgtctctggagtccacctatggcattaagatcttcggagagctcataccaaagttactgagtaagtga

SEQ ID NO: 11696 - RNA, 921 nt, unidentified
  source 1..921: mol_type = other RNA; note = synthetic construct
atgaatagcctcacctccctcttggcatcccagagcggactgtcccatgctgatgtcctccgaattttgaacacagctccgaagcggtataagatttactcaatcccaaagagagggggcgggatgcgagagattgcacagccatcaagagaagtcaaactgctgcagcgcatatttgttgacgaggtgctcacaaagctccccgtgcattctgccgcgacagcctacagaaaaggctgtagcatcagacaaaacgcagaggcccatctcggagccacccctatactgaaaatggatttcaaggacttcttcccatcgttgcacggagtagattggcttcgatattgccggcacaatagaattctgaacgaatcagatgcagcactgtctgccaacttattgtttaggaaagcgaagaaggatcgtactctaaaacttagtatcggtgccccctcaagcccagcgctgtgcaacgtgctactttttgacttcgacagctatgtggccgaagctgcatcccgtcggaacattgtttacactaggtacgccgacgaccttaccttctctggtcagaggttcgggctgctcaaagatatgcctgagatagtccgcacggccatcagggaggctaaaggccccagactgagggtgaatgaagacaaaacagtctttgtttcttccaagtttcagcgccgcgtgaccggcttagtcttaactaatactgggaccgtgagtatcggccgcgaacaaaagcggaagatccgggctagcgttcaccgggccttgctgaataagctggagcctaatgaagtggctagtctgaaaggatacctggcttatattaagagtgtagagcctgagttcctgcaggtgatctccaggacgtactctgattttgacaccgagtggcttctgccctga

SEQ ID NO: 11697 - RNA, 948 nt, unidentified
  source 1..948: mol_type = other RNA; note = synthetic construct
atgatcgacgatctgatcgggttgctttctcggatgacgggattacctccaagcgctgtgcgtcggatcatcctctccgccccacgcagatacaaggtatactatatagacaaacgctctggcggtaagcgcgagatagcccaccccgcacgagaactgaaactcttacaaagggctttcctcgacgccgttcttgaagatctgcccgtgcacgtgtcagccacagcctacatcaaaggtaaaagcctgaaggataatgctctgcctcatgtgggagcaggaccgattctcaagatggattttagggatttcttcccctccattagggctaaggactggattgcgtatgccagggaacatagagtgttcagcaacgatcatgatgctgagctcagtgctcttttgctttttaggaggcctaaaggagaatctgtacttcggctaagcgtgggcgcgcccacatctccagccctaagcaatatactcatgtacaactttgaccaggcagtttgggcatccgtcggagagagatttgtcacttacacccgatatgccgatgacatgactttctcggctgctagaaccggctttttgcaaggtgtgcagacacgagtgtccgccattattcgggagatgtcataccctaagctggaactgaatcaccagaagacaagattcgtcaccgagaagtatcacagggacgtcactgggttgactctgtcactcgacaaccgggttacgatcggccagttgagaaagcgcaacatccgcgcggggctgcatcaagcaaaactggggcagctgagtcgggaggaactgcagaccctgagtggccacattgcctttgccgcagatatcgagccagaatatattggcaagatgaaagagcgttacggggaggacttactggactggatcaccaaaggcagacagtccgacgatcgctga

SEQ ID NO: 11698 - RNA, 948 nt, unidentified
  source 1..948: mol_type = other RNA; note = synthetic construct
atgagaagcaagttagttgatctcctgatccgcgagctacgcattggtgagcgagaactggcagccttgatagctactgctccagataggtacaagacatattttatccccaagcggagcggcggacgaagggaaatagcgcaccccgccttcgaacttaagattgcgcaacgggctatcatcagcggctttcttaatgagctgcctgtgcaccattgtgcaacggcttacaagaaagggagctctatacggcagaatgctgaacgccattgccacaacagggccatccttaagtatgactttaaagacttcttcccttcaatcaccgagcaggcctggctgagttactgtgatcggcgcaaggtgatggacaggtcagacgctgtcttggcaggaagattgctgttcagacgccccaaaggcggcaggatcctgagactctcaattggtgcacccagttccccaattctgagcaatgtactgctgtacgactttgactgccaggtgcacgagcgtgtcactgcccataaaattacctatacgagatacgcagatgacatgacattctcttccgaacgaacctggaacctgcgcgaagtcgataagatcctcaggtctgtgattaattccctgggcaccccaagtctcactatcaacgggtccaaaacaacactggtaactcctaagtaccatcgtcaggtgacaggcttggtcctcaccttagacggacgggtgtccctcgggagagacaggaagagattaattcgagccagagtgcaccacgcggtttcgggtaaactatcaaaagccgcccttgttaatctggctggaactttggcctttgccaaagatgtcgagccggagttctataaccggctcgagctgacctatgggcgtgagaaccttgaaaccataaagtattctgtgagggattaccatcgggagtga

SEQ ID NO: 11699 - RNA, 948 nt, unidentified
  source 1..948: mol_type = other RNA; note = synthetic construct
atgacttcaaaattagttgagtttctcactagagagctgaggattggcgaacgggagctagctgccttaatttcttctgcgcctgatcggtacaagacctatttcattcccaagaggtcaggtggaaaacgggaaatagcacaccccgccttcgagctgaaaatcgcgcaacgggcgatgattaatggattccttaaggacttgcctgtccacccctgtgccaccgcctataggaaggggtcgtccatacgacagaacgctgagcggcattgccataaccgcgcaattctgaagtacgatttcaaagagttctttccatctatcaccgagagagcatggctcacctattgcgacagacactccgtgctggacagatctgacgccatcagcgcaggtcgcattttatttcgcagaccaaagggcggccgcattctgaggctgagcattggggccccatcaagcccgatcctctccaacatccttctgaatgactttgaccgcgaggtgcaccagcgagtgagtgctcataaaataacttatacccggtacgccgatgacatgacattctccgcagaacggacgtggaatctgcgtgaggtggatggcatcctgcgatcagtcattcgcctaatcggtactcccagccttacaatcaacagtgccaaaacaacattggttactcctaaattccatagacaggttaccggcctcgtactgaccctcgatggccgtgtaagtttgggaagagaaagaaagaagctcatccgcgcccgagtgcactacgctataaatgggaagctggataggcacgctatggctcatttggctggaacgctggcatttgccaaggatgtcgagcctgaattttacacacgtctggaacggatctatgggagggacaacatggaacttatcaaacacagcgtgagggggtactccaggagctga

SEQ ID NO: 11700 - RNA, 948 nt, unidentified
  source 1..948: mol_type = other RNA; note = synthetic construct
atgacctctcccctcgtcgagctgcttattcgcgagttgcggatttccgagagagaggtcttgcatctgatcgctactgcgccagagagatacaaagtgtacaccattcccaaacgaaatgggggtcgaagagagattgcccacccggcgaaagaactgaaagtggctcagcgggccgtggttaattcctacctcaacaatctccctatccacgatgccgccatggcctataagattggacggagcattaaagataatgcagcttatcacgcaggttccggctcaatcctgaagtatgatttcgtggaattttttccttccatcaccgaatttgcctggattgcctattgcgaccgtcacgccgtgatggacagggctgatgctataagaagcggacgtatcctgttcaggaggcctaagggcggtagaatccttcgattgtctataggcgcaccaagctcgccaatcctgagtaacatcttaatgcacgacttcgacgaagaggtgactcagctcgtagcagaacataagatcaaatacacacgctatgcggacgatctgaccttttcagctgaaaggactggatatctgaccgccgtggataagatactgaggggagtaatcgcccggagtaaggcccccaaacttaagattaacgacagcaagacagttctcgcaacgcctaaggttcaccgccaagtcacagggcttatcctaacactggatggcaaggtttcaatcgggaaaaacaaaaagcgcgagataagggtgaaactggactacttccggaaggggctgttaggggaacgtgaggtcgcacccctagctggctatatgagttacatctgggacgtggagcgggacttctacattaagatgcagcgccattacggagaggaagtcctcgctagattgcagaagcagggccaacataaaatttctccatga

SEQ ID NO: 11701 - RNA, 981 nt, unidentified
  source 1..981: mol_type = other RNA; note = synthetic construct
atgacttctccgctgatcacattcttgatgaacgagctgcacctgggtgaaagagaagtcgtgaggctgatcctgacagcaccagagcgctacaaggtataccagatttctaagcgcaatggtgggaagcgggagatcgctcagccagcccctgaagtaaaagctgcacagagggccatagtgagggcgtatctgctaagccttcccgtccatccttccgccactgcatacagtcccgggtcatccatcattaagaatgccagtgcgcactctgatgcaggccccatcctgaagtacgacttcaaggatttcttcccatccattactgagaaggcatggatatcatattgcctgagagtgggcctctttagtaaggaggacgccgtcaggtccggccggttgttatttcgtaggcctaaaggggggcggatactgcgactcagcattggtgctccctcatcacctatcgtgtcgaaccttttaatgtacgacttcgatgagcgactctctaaactgttggagggccataagattgtgtatacccgctacgctgacgacttaacattcagtgctccaaggaccggaaacctgctcgaagtccccaaggccatccgcgctgccatgaatagcatgagccaccccaaacttgcacttaatagccaaaaaaccgttctcgtgaccaagcgctaccaacggaatattaccggactgatcctgactctagatgggaacatctctgttggtcggagcagaaagcggctgatacgtgctggcattgatcattttatcagaggcaagctcgacgttgaccagacagtgaaattggcgggcattattgcctttacgaaaggagtggagccaaccttttttgccaaactcacgactagatatggaaacgacgtcatgggaaagatcatggcctccacaaaagattataaacgcccgaggcctgaaacagtgaaccgaaccaaaagaagatga

SEQ ID NO: 11702 - RNA, 957 nt, unidentified
  source 1..957: mol_type = other RNA; note = synthetic construct
atgacttcaaagctgattgaattccttgtgagcgaggttggattgagcgcaaggaacattgagaggctgatccaaactgctcctgagcgatacaaagtctatcatatccgtaagagaagcggcggatggcgagagattgcccagcctgccactgaactgaaaattgttcagcgtgccatagtcgagaagtacctgaaacatttgcccattcacccagcggcaacggcttatgtcccgggaagtagcatcagacggaacgctgctatccactccgtgaatggcccaatcctgaagtatgacttcaaggagttcttcccatcaattaccgaacgggcctggttacgctactgcgaaattcatggcatatttgatcgagttgaagcaatacagttcggcagactgctctttcgcaggcctcacggtgggacgattctccggctctctatcggggctccctccagtcccatcctgtctaatgtgctgatgtacgagtttgacaaaatgttgcacgagagggtggcacagcatagcgttacatatacaaggtacgccgatgacctgaccttttctgcaagaaggaccggatatcttaactctgtgaatcggatcctacgcagtaccatatcccaggtgcaacttccaaaaatcaagattaacgaggagaaaactgtggtcgccacagaaaagtataggcggcaagtgacaggcctgatcctcaccaacgacaaacgcgtctcactaggtcgggaacgcaagagaaatctcagggcggccctccaccacttcagagaggggaaactggatatcgatcagtccgtgaagttggccggtctgatggcctttgctagagacgtagagcccgaattttacacccgtatggaactcacatacgggaaagatcttttatcgcagctgaagtatttagtaaagggctaccggcgccctgagtaccgatga

SEQ ID NO: 11703 - RNA, 951 nt, unidentified
  source 1..951: mol_type = other RNA; note = synthetic construct
atgtctgcactgatttccgtgctgcagcagtccctcggcatagatgctatgagtgtgagacgtatcatcgcaactgcccctgaacgatataaggtatacagtattccgaaacgcgggggagcgggacgcaggataatcgcacagccagccaaagaagttaaagctctccagagaatcctgctgaaaaccttcctctcagacctgcctgtgcacccatctgctttcgcttacgtccctggtaaatccatcaggactaatgccgtcacccatgtggcgaatggccccattcttaagatggacttccagaactttttcccttccatccgatcttacgactggctatcgtattgccacgacaacggggtgtttgacagcgaagccgacgcgcgtatggcttctaaaatactgtttagaagggagaaaggcgagtcaatcttgagactcagcattggggcccccagcagtccccatgtttcaaacttgttaatgtacgaattcgaccgcgcaattagtgataaggtcgccgaagattacgtgacttacactcgttatgccgacgatctaaccttttcagcagaacggacgggctatctgacacgggtggagaaggatgtcaggaagacactcagagatttgcggtatccacggttattcatcaacgaccggaagacagtcctggccacaacgaaataccgccgagaggtgacaggcctgattcttaccaatgaccaccgcgtgtctctgggaagacataagaaacgcctccttagggcccaaattcacagatacagcaagggtgagttgaataacatcgcaaccgccaagcttgccggaaacatggctttcgcttccgacgtagagcccaccttttatacccgaatggagagggtgtttactaaggaggttatggataggctgaaggatagcgttaatcggcaagatcagagctga

SEQ ID NO: 11704 - RNA, 945 nt, unidentified
  source 1..945: mol_type = other RNA; note = synthetic construct
atgagtaggctgctggctgtgcttacggaggccaccggcctgtctggttacgacctggcacgggtaatcgccacagccccgcacagatacaaacaatttacaatcccaaagaggcaagggggaacccgccttatagctcagcctgcgagggaagtcaaagctatgcagcgtgccatcgtgagagcctatctcagcgatctacccatccaccccgcagtaactgcttacgaaccgggcacttccattagggagaacgcctcgcgccatgccaccaatgggccaattctcaaactcgatattgccgactttttcccttctatcagagcagatgatttcctgtcatactgcgccgagcatagcttgtttgatgatgagtccgaaaggatcgcggccaccaaaatattattccatcgacctaaaggcgctagggtgctccgcctggcaataggtgctccctcctcaccccatattagcaacctgttgatgtatcatttcgacagagcagtcgctagtgaggtcggggaccagttcgttacatatactcggtatgctgacgacctgacattttcagcaaagcgcacgggttatctgaatccagttgagaagatcgtgagaaaagtgttacgggaaattggataccctcggcttaagctgaacgacagcaagaaggtggtggctactaagaaatatcaccgccaggttaccggccttgtcttgagtaatgacgggcgcgtgtctttaggccgtaaacgaaagagggaactacgagcagcgctccaccactttgccggcggaaagctggagcccaaggcacagaagcacttgcacgggatgatggcttttgccaaagacgccgagccagatttctacgccagaatgcaggcccggtacggaagaaacgtcttcgaagcactgtccgaagccctccgggaggcggatgagtga

SEQ ID NO: 11705 - RNA, 999 nt, unidentified
  source 1..999: mol_type = other RNA; note = synthetic construct
atgagcgaactgctcccagtgctgattggggcaacgggtctgtccgatagcgatatccgaagaatcgttagcaatgcccccagtcggtacaagcattttactattaagaagaggaacgggaaggatagacatatctcacaaccgtctagggagctgaaagctctccagcgcgcactgatggaattcaagttgtcacaattgcccgtccatccagccgcaatggcctataagcacgatgtgtctatcctggagaatgctacagcacacgctggaaatggccctattcttaaatacgacttcgtggacttctttccttcgattaggtccaaggactggcagaggtactgcgattattactccattttcgaaaaaagtgaggacaaatggatctctgagcggatcctgttccagagagacaaaggatcgcgcattcttaaactaagcataggggccccgagttctcctatcctgagcaacatcataatgaatgagttcgacacagtgatttcccaaaaggtcgcctctgataacgtcgtgtacaccagatacgcggacgacattaccttttcagctcctcgggtagggtatctcaaccgaatcgaccgcatcatccgcaggaccattaaggaagtcccctggccccgattaaagataaacgaggaaaagactgttctcgcgactagtaaataccgtaggcaggtcaccggactcgtgctggcaaacgatggaagcgtgagcatcggtcgtgatagaaaacggtccgttcgcgccgcgcttcatagagcccagcacgatcggctgacagaccaggaaaccgcctatctgtgtggcatgttggcttttataaattccgtggagccagagtttttagcccggatggagaatcactatggcgtagaattgctacagcgccttagacgtcacgcctctattggtagaaggccaacagaacggtcaagggctaaaggcgaggacctccgaatcgatggctccgactga

SEQ ID NO: 11706 - RNA, 945 nt, unidentified
  source 1..945: mol_type = other RNA; note = synthetic construct
atgagcaagctgatatccattctgatcgagtctaccggtctgactgagagagacgttatgaaaatcatctctaatgcacctcggaggtataaacacttcaggatcaagaagcgaaatggatctctcagggatatagcccagccagcaagagaactgaaagccttgcagaaggtcattgtggagaagtacctgctggaacttcctgtgcatcaggccgccatggcataccggaaggggagatctattagagagaacgctctcgcgcacgtggacaacggccctatcctcaaaatggatttcaaggagttctttcccagcattcgggtccgagactggcaagcttactgcgaggatagaagtctttttatggatggggatgaccttcatcacacctccaaaatcctgtttcaccaatcgaagggtgagagctatctgaagctggccatcggagcccccagtagcccacacttgtccaacctgttaatgtacaaatttgacgcacttgtttcacagctcgtccagaaagactacgtggcctacacgaggtatgctgacgatctgactttctcagctaagaggacaggatatctgaccggcgtggaaaaagctgtccgccgtgctataaaagaggtgccctggcctcggctctccattaatgaaaacaaaacagtagtggctactccacgatatcatcgccaggtgaccggactcgtattgacaaacgatcaggaggtgagcttagggcgcgaccgcaagaggaaaatttcagccgcagtgcaccatgcgaagcatggcgaattgaccgtagaagccgccgcgcgtttatccggcacactggcattcgttaatagtgtcgaacccgaatttctactcagactggagcggaagtacggccgcgaggttatcgacaatctaaaacaattcccgtggaagttggagaagtga

SEQ ID NO: 11707 - RNA, 975 nt, unidentified
  source 1..975: mol_type = other RNA; note = synthetic construct
atgtctgagattcttaaggccctgtcaactgccacaggattgagtgaccgcgacctcagagcgataatcagcaattcccccgaccgctataaggtttatagcatcgctaaacgaaggggcggtcgccgggagattgcacaaccagctcgtgaacttaaggttctgcagcgggctctaaatgatatcgtcttgagcaaactgccagtccatcccgcagctatggcctaccgacccggcattggactcaaacagaacgcccaggcccattcccacaacggcccgatcttgaaatttgacttccaggacttctttccttccctgagggctgaagattggcaagaatactgccaccgacataaggtatttaatgacgaagaggatgtggagctcagtagtaagatcatgttcagacggaagaatcgccatagcaccgtgctgaggctcgctatcggtgctccttcctctccaccactgtcaaacatcctgatgtttgactttgacatcgcgatgcaggcatattgtgcctcacagaaggtaacttacaccaggtatgccgatgatattaccttttccgcccagagaaccggtttcctaacgggagtgcctaaagccttagagcgcattgtgaaggatttacgtagcccccggctgaaaatcaaccacgacaagacagttctggcaactaagaagtacaaaaggatggtgacagggcttatactcacaaatgatggctctgtgtccttgggccaacagagaaaacggaacatacgggcaggcgtccacagatggaccttaggggtcctttcgaatgcagacatctgcaggctcgccgggcacctgtctttcgctgaagatattgagcctgcattcattagtagactggccaacaagtacggggcgcaggccattgctgacatcaagcgtgcctacctgcaacagggatcagattctagccagaacccggtgaaaatatga

SEQ ID NO: 11708 - RNA, 951 nt, unidentified
  source 1..951: mol_type = other RNA; note = synthetic construct
atgagcgagatccttagggcattgtctgaggccaccgggctgagtgactgggatttacgggctattatatcaaatgcccctgatcgctataaggtgtatcacatagataaacgcaggggcggtcggagagaaattgcacagccagcaagagagctgaaggtcctacagcgggcgctccacgatatcttcttagcgaagcttcccgttcaccctgccgccatggcatataggcctgggatcggcctgcgtcaaaacgccttggctcacagtcataacggacctatcctgaaattcgacttccaagatttctttccctccctgcgcgctgaggattgggaggcatactgccgcagacataacgtgtttataaacgaagaagacgtgaatctcagctccaagattatttttaggaggaaaagccgtcattcttcagtgttcagattggctatcggagccccatcctctcccgctgtgagcaatattctaatgttcgactttgacaaaacggtgcagtcctactgcgagtcacagtctgtcatatacaccagatacgctgatgatctgacatttagtgcccagaggactggctatctgactggagttccgaaagccctggagagaatcatcaaggaccagaagtcgccacggttgaagattaattctgaaaagacagtgctggccaccaagaaatacaaaaggatggttactggacttatcctcaccaacgacggcgacgtcagtctggggcagcttcggaaaagatccatccgcgctggcgtacatcgttggacactcggcggtctgtcaccagcggacacatgtcgcctcgcagggcacctgagctttgccgaagacatcgagccggccttcgtagcacgactcgctcgacgatatggggcccaagccattgctgatattaagaatgcataccggcagagcggtgcgccctga

SEQ ID NO: 11709 - RNA, 948 nt, unidentified
  source 1..948: mol_type = other RNA; note = synthetic construct
atgtcggaattgatctccgtgctgagccaggctactgggctgtctgattttgacttgagagcaattatcagcaatgcccctgacagatacaaggtctactatattgcaaagcgcaagggcggacgcagagagatcgcacaacccgccagagaactgaaggttttgcagagggccctcaatgatagcattctgtccaaattgccggtccacccagctgctatggcttaccggcccggcgtgtcacttaggcgtaacgctcaggcccactctcataacggcccaatcctcaaattcgattttcaggacttcttccccagccttcgggcagaggactgggaagactattgcagacgacatggggttttcaaggatgacgaggacatcgagctatccagtaagatcatgtttcgaaggaagaatcgacgctcctctgtattgaggctggccattggtgcgcctagtagccctcttctgtccaatatactgctctttgatttcgacgagaatttagcaaagtattgcgattcacagaagatcacgtacacccgctatgccgatgatctcactttctcagccaagcggactggcttcttaaacggagttgagaagttccttgtgaaactgatcaaagacgcagatcacccacgcataaagctgaacctgaacaaaaccgtgctggcaacaaaaaaatacaagcgtatggtaaccggtctgatcctgaccaacgacggtaaagtgagtctcggccaactgcgcaagaggaatatgcgggccggggtccaccagtggattcttgggaacctctctgaggccgatacatgtcgtctagcgggacatctcgcttttgccgaagacatagaacccgactttgtggccagattaacagtgaaatacggagctcaggtgattgctgagattaaaatggcgtatcggcggagggtcctgtga

SEQ ID NO: 11710 - RNA, 945 nt, unidentified
  source 1..945: mol_type = other RNA; note = synthetic construct
atgagcgagctcctgcgtatgctgagcgaggatacaggactaagcgaaatcgacttacgcaccattatcgccactgctcccaatcgttacaagacttacgagatagacaagcgcaggggcggaaaacgcgaaatttcgcagcctgccagagaactcaaagtcttgcagcgggccatggtacagaggattttaagcggtttagccatacacagtgccgccatggcataccggccaggaatatccatcagaaacaatgcagcatatcacgcgggggacgggcccatcttgaagtttgacttcaaagactttttcccgaacattcaagccgttgattgggaaaagtattgcgagaagcactcaatttttgaccatcaggaggacgtgaagctctctagtcgaatcctctttcggaagtcatctcgatattctcccgtactgagacttgctattggagcccctagttccccaatgctcagcaatatcttgatgttcgaatttgatgagtacatgcagtcatacgcggaaagtcaaaaagctaagtataccaggtacgccgatgatttgacattttccgcaccccgaacaggctatctgaacggtgtggagaaagtgctgaggcaagccatacataagattaaaaaccctaagctgcagcttaacgaagataaaacggtccttgcaactcggaagtacaagagaatggtcacaggcctgatcctggctaacgatggttccgtgtccctgggccaccagcgcaagagaaatatgaggagcgcggtgcatcactggctgctggggaagctgtcaagcgctgagcaggcaaatctcgctggccttctcgccttcgcagaggatgtggagccatccttcgttttcgctctggctcggaaatatgggacctctaccctgaaagacatcaaaaaactagccgacatcgaatcttga

SEQ ID NO: 11711 - RNA, 1026 nt, unidentified
  source 1..1026: mol_type = other RNA; note = synthetic construct
atgccacagagctcgaagcagctgaaaggatgcaatgtctccgacgtggtccaagccctggtcgctgcaagcggactctctgagagggacgtgcggactattatcgcaactgctcccagccgatacaagacatactccatcccgaaacgcagaggtggagagaggattatctctcagcctgcgcgcgaggttaaatttttgcagcggattatcgtagaggagatcctctcccgcctccctgttcacgacgctgccatggcctatagagagggtcgctccatacgcgataatgccgcagttcacgccggtggcggggcaattctaaagttcgatttcgccgactttttcccaagtattaaggccgatgattgggctgcctactgtcggcggcactcagtgttcaaggatgtggacgatattcggctgagtgctaatctgttgttcagaagaacaaaatatgggagtgtactgcgtcttgcgatcggggcaccctcctcaccccatctgagcaacatcttaatgcgagagtttgaccagagggtaacagaagcggtggccaaggagaaggtgaaatacacgcgctacgccgacgacctaacctttagcgctaaaagggcgcacaacctcataggcatagaacgtgtcttaagaaggattatcagagaggtcgcttcacctcatctcagactgaatgaagataagaccgtgctggccaccaggaaatatcgccgagttgtgacaggactcgtgcttgccgacgacggcaaggtttctctgggccgagatcgaaagcgggatataagggctgctttgcaccattacgcactggggcaattaaacggccacgaaactgcaaggctttctggcttgctggcctttgtcaacgccattgaacccgagttcctggaacggctggtggacaaatatgggccagctgtgatcgagcgtattaaggcccggcttcctcccaccgcaaactgccagcagccacatgatccgatcatcgaattcaaatttagagaatga

SEQ ID NO: 11712 - RNA, 909 nt, unidentified
  source 1..909: mol_type = other RNA; note = synthetic construct
atgtcggaatcagacgtcaggttgattgtcctgacagcaccttctagatacaagacctatacgattcccaagaggaacggaggggagaggattatctcccaaccggccagagaggtgaaattcttgcagagagtgctggtcaatgacgttctcagccagctacccgttcattctgctgccatggcctatcgcgagggacgcagcattaaagacaatgctgctgctcatgctggcggcggtgcaatcctcaaattcgatttctccgattttttcccttcaatagtggcctcagactggcgggcctattgcgagcgccatggggtgttcgataacgaagaggatattcggctcaccgccaaccttctgtttcaccgtacaaaacgatcaagtaagctgagactggcgataggggcgccctcttccccaacccttagcaatgtgctgatgtttgactttgatcagtgtatcgcgggcttagtggctaaggacaaagtccgatacactagatacgcagatgacatgacttttagttccaaaagggccgggaacctcagcaatgtggagcgggtgctgcggaaggtattgaaggatctcgttagcccaaggttgagaataaatgagaagaaaactgtgctcgccacaaagaaataccggcgcgtagtgacaggactggtgcttagcgacgatggtaaggtcagtctcggccgcgacaggaagaggatcatccgtgcaatgctgcaccactacaccctgggtcgattaaacggcgaggaaaccgctagattatccggactgctggcatttgtgaacgccgtcgaacctatgttcctgaagcggcttatcgataactatggcgttgaaatcgtagaccgcctgaaagccagtctacacccaaattctattttctga

SEQ ID NO: 11713 - RNA, 1014 nt, unidentified
  source 1..1014: mol_type = other RNA; note = synthetic construct
atgagcaaactgctcccactactcgttgcaggtacaggcctgagtgaacctgatatcattcgtattgtgtctaacgctccccttcgatacaagagttacaggatcccgaaaagacgcgggggcaatcggacgatctcccaacctgcacgcgaactgaaggtgttacagcggatactgaccgaagagttcttgtccaagctgcctgttcatcagagtgccacagcgtatcgggccggcacctcaatcaagcataatgcattggctcatgccctcaatggacccatcctgaagtttgactttgccaacttcttcccatccattggcgcgcgagactggactgtctattgcgaacgtgagggattaatgctggaggcccgcgatatttggatctcctcgaacatattctttcacagatggagcagacaagggagactctcccttgctattggggctccttccagcccctgtttatctaatgtcttgatgaatgagttcgacgaaaaaatcgccaacgcagtcgcctcagaccaggtcacctacaccagatatgctgacgacctcgctttcagcgcaaaaagaacgggctacctgaaccaggtggaaaaaatactgcgcaggacaatcaaagagatcaagtttccaaatttgactctcaatgaaagcaagactatactagcgaccaagaaatacaagcgcttcgtgactggactgaccctaacaaacgatgggaaagtgtctttggggagggagaggaaaaggaagatccgggccgctcttaagcactatgccgatgaccggctcaacattcacgagcaggccaagctcgccggcctgattagcttcgctcacgacgtggagcgagattttgtacttcggatggagaggacatacgggtctgaactgcttcaggcactgaagctggttcgcctgccctctactcgtggtggcggtggaggtggagtggagtttgacagtgatgtatcagatgcatcagaccccgacgatgatttttga

SEQ ID NO: 11714 - RNA, 957 nt, unidentified
  source 1..957: mol_type = other RNA; note = synthetic construct
atgagcaaactcctgccactcttcattagcgacactggcctttcagaacatgatgtgctaagaatcgtgcgagacgcacctatccggtacaaaacataccggatcccgaagagaaccgaaggtactcgtgttatttcccagcccgctagggaacttaaggctttgcagcgaatcttgactgcagagctgttgtccaaattaccagttcatcccgctgctactgcataccgccccggagtgagtatccgagcaaatgcggcagctcacgccccaaacgggcctatcctgaagtacgactttaaggatttctttccttccattacctcaaaggactggcgcaactattgcgaaaacaaccatgtctttgacaacgatgaggacctgtggatatcaaccaatatcctgttccagaaaagacgcggggaaagccgtctgacactggcgatcggcgcaccatccagtccgtcgattagcaatattctgatgcgggatttcgattctacagtcagcgccctcgtggccaaggattatgtcacctacaccaggtatgccgatgacctcactttttctgctcgcaggaccggatatttgacggttgtggacaaaatcctgaagaagactctcagggacatgaaatctccttcccttacactgaatcccagtaaaaccgcgattgccaccacaaaatataagcggtttgtgacgggattggtgttaaccaatgatggcgccgtgagtctcggtcacgacagaaagaggaaaattcgggccacggtccaccacgtaacacttgggaagctgtcagagaggcagttagccgagctggctgggatgctggcctttgtaaacgatgtcgagccccaattcctagccaagctggagcgcacatacggcgtggacctcatacaaaagataaagactggcagaggatctagcaaaaatttcgatcttgactga

SEQ ID NO: 11715 - RNA, 957 nt, unidentified
  source 1..957: mol_type = other RNA; note = synthetic construct
atgtccaagatcatccagattctcatggaggagacagcgctcaatgagccagctcttcgcaggatcatttacactgcaccttccaggtataagaccttttatattcccaagcgcaatggtaaaaacagacggatcgagcaacccgcgcgtgaattgaaggcaatccagcgggtgctggtgcagaagcttcttagtacattgccagtccatccgagtgccactgcctatcgaccaggcctcagcgtccgtgataatgccgcccgacatgctcacaatggtcccgttcttaaattcgacttcgaagactttttccctagcatccgcgcaagagactggagggtatattgcgagaaaaaagggctgctcgaaactgaggaggatatttacctgacccagcagatttttttccggagggagaaaggatcaagcgtcctgcggttggctataggcgctcctagctcgcctgcattgtccaacatcctgatgtgggacatcgacgccgcaatcgctgagatgatagatggcgaacaggtttcttacacgagatacgccgatgatctgacgttttcagccagaagaactggttatctcaatgggatcgagaaggggctacgtgctattctgagatctgcagggggcccgaggctcaagataaacgaagaaaagaccgtcctggcgaccaagaaattcagacgacaggtgacaggcctgatactggccaacgacggacacgtgtctttgggacgggataagaagcgccttattcgggccgctgtgcaccgcgagacattaggcttactcgaaacctctgagcgagagcaactggccggaatgctggcgtacgtgaacgtagcagaacctttatttctagctcgcctgaagaaaaagtacggagttgaagccattgaggagctgaaaaaagccgtgaggcccgggaacgaaccagaaaggccctga

SEQ ID NO: 11716 - RNA, 915 nt, unidentified
  source 1..915: mol_type = other RNA; note = synthetic construct
atgattgaacatacagggctcagcagaagtgatattctgtcgatcgcccgaaacgcaccgcagaggtacaaaacttacacgatcagcaagagaaatggaggcaaaaggaccatttcacaacctgctcgagaagtgaaggtgctgcagaagatcttgctggaacatgttctttataagctgcccgtccactcagccgcaactgcttacaggcaggggatcagcctgaaggaaaatgccaccaggcacgtgcacaatgagtctattaagaagtttgacttcaaggacttctttccctccatcaaaggccgggactggatcaaatactgcggagatcacggagttttcgccgataccgtagacgtcggactatctactcatatactgtttcaccagccagccaatagtaccatactcagattagcaataggcgccccatcctcacccgctctgagtaacgtgttaatgttcgagttcgataagatcatcacagacgaggtggcaaaggatgaggtgatttatacacgctatgccgacgatcttacattttccgcctctcgcatgtggaacatgatagacgtgcctaaggtgatcgcgagggcaatcaaaaataaccattatcctcgtctgaacatcaatccagacaagacgatttctgccaccaaaaaatataaacggcaggttaccgggcttattctgactaacgatggtaaagtaagcttgggccgcaagcgcaaaagagaaatcagagctgaggtccatcgagcgttgattggccagctcacaaatgaccaactgatgcacgtccaggggatactagctttcgttgaggacgtcgagcccgattacctccgtcggctggaatcctactacggtgctgagtttattaggaacctccggaagcgcgtgcgggagtga

SEQ ID NO: 11717 - RNA, 936 nt, unidentified
  source 1..936: mol_type = other RNA; note = synthetic construct
atgagcaaaatcatcaggctcctgactgctgagactggccttccaacgcacgatgtgcgggcaataattaatcgagcccccatctcctataagcactacaccattaaaaagaggtctggggccgatagaccaatcgcacagcccgccagagaggtgaagcgtttacagaagatactgatggggttcctcagcgatctccctgtgcattcagccgccacagcatatgcacctggcgcttctatcaaagataacgcggaaagacacgcgaagaacggtcctatactgaagttcgacttcacgaatttcttcacatcaatcagggagagagactggaagaactactgcgctaaatacaatctctttgacgatcccgacgatgtgactttatcgaccaaactgtttttctgtcgtgtaccaggcagtaccctgttgcgcctagctattggcgccccgtcctctccatggctgagcaatgtcctgatgtacgaattcgacgatttgattagtcggcgggtcaggcaggaccaagtgacctacacaagatatgcagatgacctgactttctccgccaggcggaccggttatctcaccagggttgagaaaatcctgaacagaactctctccgagatggagaacccccgccttaccctaaaccaggagaaaaccgtgctggccactatgaagtaccggagggttgtgacaggattagtactggctaatgacgggcgcgtcacattgggaagagagcggaagcgacgcattcgagccgcgctgcatagcgcttttgctggaaagcttgacgcagaagccatgacacgcctggcgggaatgctcgcctttgtgaagagtgttgagcctgaattttttgaacaaattgctgcccgctatggcgaaaatgtcatcagcaaacttgcagggtcacagtctcagttgtga

SEQ ID NO: 11718 - RNA, 930 nt, unidentified
  source 1..930: mol_type = other RNA; note = synthetic construct
atgggtcatttgatagaacagttagcctccggctcaggtttactcgaaaatgatgtacgcaaaattgtggccaccgcacatcggaggtataaacattacacaatcaagaagcgcaacggggaggatcggccaatctctcaacctgccaaagaggtcaagctcctccagcgtctgtttcagaagcagttcctgcaaaacctcccagtgcaccccagcgctacagcttatgagaaaggtctgtccatcaaagaaaacgccggacggcacatgcataatgggcccattctaaaactggactttaagaacttcttccctagcatcaaggcttcggactgggttgcttacactgaggcgcacggcctcctggacgaccttgaagaccgcgaactgtccgcgcggttgctattcaagagcacccgaacgagtgccggaatgcgcctggctattggggcacccactagccctcacatttcaaaccttctcatgtacgacttcgaccgcctaatggctgagcgagccgctagagagatggtgacctatacaagatacgccgatgatcttactttttctgcaaagagaactggctacctgcagcccatagagaaaatcgtgaggaccacattgagagaaataaatagaccgcgattgactctgaatgatgagaagaccgtctttgcaaccaccaagtatcgtagggttgtgacaggactcacgctgacaaatgatgggaccattagtatcggaagagagaggaaaaaacttattagggccatgatccaccactacgagaagggcttactggacgccgagaacctgaggaagctggtgggccttctggcatttgcgaatgacgccgaaccagccttcgtcctgcggatgaagctgaaatatggcgagaagttgatggcagaaatcctggatctctcttga

SEQ ID NO: 11719 - RNA, 951 nt, unidentified
  source 1..951: mol_type = other RNA; note = synthetic construct
atgtccaaactgattcggctcttgagtatccagaccggcttgaccgagcaagatgtagaacggatcataaatcgcgcgcctgacacctataaatcttatacgatccccaagcgtaatgggaaagggaacagagtgatcagtcagcccgcccgggaagtcaaggttctgcagcgggttctcaccgaaagactccgttcacttcctattcatgatgccgcgatggcttacaggaaaggcatctccatccgtgctaacgccctaaagcacgcacagaacgggccgatacgaaagtacgactttgagagtttcttcccgtctataaagggacttgattgggaacagtattgtcttcaaaaccccgttttttcagaccccgaggatattctgaggtcaatcaacttgttttttcacagggcaaaacgacataacgtcttacgcctggcaatcggtgccccttcctcgccatggcttagcaatgtggtgatgttcgagtttgatgacgcggtaagcagagcagtggcaaaggatcgcgtcacttacaccaggtatgccgacgacctaactttttccgccccccggacaggtcacctgactgttgtggacgatattgtcagaaaggctatccgcaatattcagtgcccacgcctcaagctgaatgaagccaaaactacggtcgccacaaagaagtacagaagggtggtcacaggactgatcctggctgacgacggcgaagtgtctattgggcgggataagaaaagactggtgcgcgccgaggttcatcacgctctgacaataggcgtgggttgggagaaggccgacaaactgctcggctacattgcacatgtgagaagcgtggagcctagcttctactacaggttattggcccactatggagaggatttcgaggctcgagtaagggctaaaaatggaccaccagtgttcgacctctga

SEQ ID NO: 11720 - RNA, 942 nt, unidentified
  source 1..942: mol_type = other RNA; note = synthetic construct
atgagtgatctgatcaaacatctgtcttccgagactggcttaagcgatgctgatgtggagcggattatagccagggcacccagatcttacaagttctataccatcgacaagcgcacaagggggaaacgactcataagtcagcccgcacgagaggttaaagcacttcagcgcgccctggtcaaataccttgatgccttgccaatccacgaaagcgccaccgcgtatagaaagggtaagagcatactcgataatgccgcacctcatagtcaatccggccccatcaaaaagtacgacttcaaggactttttccactctatcagggctcgcgactgggaaacatattgcgctgaaaagggagtgttcgaggaccaagaggatgttgcactaacggcccgattgatgtttcacgtgaccccaggatcctccatcttacgtctggcgatgggcgctccctcaagcccttggctgtcgaatgtattgctgcacgatttcgacaagcgcctcgccgacgagcttgcaaaggagaagattatctacacacggtatgccgatgacctgaccttctcagcacctcggactggccacctcaactcagtcgatggtattctgaaggacattatacgggacacggatgccccagagctgactattaacgctctgaagaccgtggtagccactaccaaatatagacggaccgtgacagggttggttcttgcgaatgacggcagagtcacaattgggagggatcgcaaaagatacatcaggtctgcgatttaccatgctctgaagggagccaatactgctgaagaaaatcagatgctgctcggttacatcgcctttattgggtccgtggagccggactttgtggaaaaactcaaagccaaatatggacctaactttgtcgaacgtctaagcgaggctcatatcgctaacaaccagtga

SEQ ID NO: 11721 - RNA, 1017 nt, unidentified
  source 1..1017: mol_type = other RNA; note = synthetic construct
atgatgaaagagcacctggtcaccgagggagagcccgctgtgaggttccctgacgtgcttcagatcttatctgaggaaaccggcttgctcatttccgacattcgccacataatctcctcagccgaggtgagctacaaaacatacactataccaaagcgatccggagggatgagagtgatttctcagccgtcccggcaggttaagattttgcagcaggcgattatcaatcggattctgctcaacctgcctatccacgaaagcgcaacagcctaccgaaagggtaagtcaatactggacaatgctcatccccaccaaggggcagggcgcacaattctgaaaatcgatttcagccagttctttccatccattaaatcggccgattgggtacatttctgcaagaaaaacaagcttatgaacgacatcgatcaatattacacgagcaagattctctttaagaaagaacccaatatgaggggactcagacttgccatcggtgctcctagttcccccttgatcagcaatatcttaatgtacgatttcgacaacgccgtcaatgagttaattgttagcgaagaggtggtctatacacggtatgcggacgatctgaccttttctgcccctcgtacgggctatctcgttgatgtagagagtaagctccgcaagatcatcagaaagaacgtccacccaaggcttaaaattaatgaagagaagaccgtttacgcaacttcgaaatatcgcaggagcgtgactggcataatcctgactaacaacggtaatacctccattggccggcaaaagaagagaataatctctagttgtgtgcatcatgctaaatgcggactactgtcagcagaggacctgaagaagctgagtggctacctggcctatatctcttcagtggagccagactttctgcagtacctgcgtaagaagtatggcgatgaaatcatcgaattgctcaaaaaaatcgggaatccgaacaccaaagtcgaactaattcccaaaatatctgtgtga

SEQ ID NO: 11722 - RNA, 993 nt, unidentified
  source 1..993: mol_type = other RNA; note = synthetic construct
atgtccgaagagaattttgtcactgcccaggagtacaggtttgacaatatcctgcaaattttgagcgaggagacaggcctgctgttgaacgacattaactacatcatttcatccgcacccaagagttataagacctataacataccgaaacgaagtggagggacccgcaccatatcccagccggctaggcaggtcaaaatcctacagaaagccctcattaagaacgtgctccttaatttaccagttcaccccgcagcgactgcttatcagaagggcaagtctattttaaacaatgctcagccccatcagggagagggacggagtatcttgaagattgacttcagcgagttctttccatcaatcaaacacttcgattggatagactattgcaagaaaaatcgaattctgaatgagcaggaccaacattacacgtcgaggatcctgttcaagaaagaagtggggatgcggggcctacggttagcaataggcgccccttcaagcccactcctcagcaacatcctgatgttcgactttgattccgccgtgaacgatctgatcgtaacggacaaaatagcttacacaagatatgcagacgatttgacctttagcgcaccaagggcgggatattttggggaaatcgaaaaaaagcttcgcaccatcatcagaggtatgtcccaccctaagctgaagatcaaagaagagaagactgtccgcgccacacccaaattcaaaaggagtgtgaccggcctgattctgacaaaccaaggcaagacttccatcggtcgtgataaaaaacgcattatctctgcctctgttcaccacgccaagaacaacaatctcagccaagaacagatgaagaaactgtctggttacctcgcttacattaagtcaattgagcctagcttccttgactatcttagaagaaagtacggagaagccatcatggattctctgcggaagatggggcatcctgattaccgtgtggagaattga

SEQ ID NO: 11723 - RNA, 1011 nt, unidentified
  source 1..1011: mol_type = other RNA; note = synthetic construct
atgaaaaatcaggcaccccactctattactgatcgctttaataggagcgctatcgaaaactttgatctgatccagattctgtcagaggaaacggggtttctctcatctgacattaagcgtataattcactccgctccaaaatcctacaagacttacgaaatccctaagcggacaggggggaaaagaattatctctcaaccagcaagagaggtgaagattctgcaaagagtgatcatagagaaggtcctatctcatttgcctattcaccagttcgccacagcctacagaccgggcatatcaatcctcaataacgctcttcctcataagggggctggtaggagcattctaaaaatggacttcgagaactttttccccagcatcaaatctcatgattggataacctattgcgaagaacttgagattttatccaacgaggatcgcgctctcacagcatccctctttttcaagtcccagccacccaaacgaggactccgtttggccatcggtgcgccaagttcaccgatcctgtcaaatatcctcatgtatgaattcgacaagaaaatcgagaaagagatttacggcaaagagattatctataccaggtatgccgacgacctgacctttagtagtgagaggacaggctacctgctggatgtccgatcgatcgttcggaaggcactgatggagattaagtaccccaagctgaagatcaacaaggaaaaaaccaagtacttcactagtaagtatcgccggagtgtgactggcctggttctgaccaatcagggagaggtaagccttggacgggataagaagcgctctataagcgccggtattcacaacgccttgaacggaaaattaaatgacgaggaaatgaaaagcctttccggctatctggcctacgcgaacagcgtggagcctaatttcctgaagaagatgtccgaaaagtatggcgacgacatcatgaagacgttgaaaaaattcgggaaccccgaagtgaatatcaaaatatga

SEQ ID NO: 11724 - RNA, 948 nt, unidentified
  source 1..948: mol_type = other RNA; note = synthetic construct
atgtcagaccttatcgcactgtttgtccacgagacagggttaggggagcatgatatacggaaaattgtagcgacagcccccgccaggtacaagacctatgcgatcaaaaagaggaatgggatagatcggaggattattagccaacctgcccgagaactcaaactgttgcagcgcaccctaatcgatgcagttcttaagaacctgcccgtccatcgctcagcaaccgcctacaggacagggatgtcaataatcgacaatgtgcgccctcacattaattccggtgctatcctgaaactcgacttctccgatttcttcccgagtctacgggagtctgactggagagaatattgcgttcgcaacgaaatcttcagatcagaagaagacattgaggtcagtggattagttcttttcaagaaagagaggcagagacgtgagttgaggttaagcattggcgctccatctagccccatcgtatccaacatcctgatgtttgatattgactcggagatcgagtccaagatagtcagtgaggaagtggtgtatacgcggtacgcagacgatatgaccttttccgctagacgaaccggatttctgaacaaggtggagaagaatgtgagagaaatattgaggggaagtcagagcttgcggctgcagcttaatgacgataaaactgtctacgccacaaaaaagtataagcggcaggtgactggactgatcattacgaacgatgccacagtgagcgtgggccgagagcgtaaacgcaacctcatggccgccatccacgctgctctgtccggtaagctcagcggtgaccaagtaagagaaaccctgggcatggtgtcttttgtgattagcgttgaaccagatttcaaaaagagaatcgagcgcaaaaatggcgaggacgctctggccctgctctctaagctcgcatctactaagggcacttga

SEQ ID NO: 11725 - RNA, 933 nt, unidentified
  source 1..933: mol_type = other RNA; note = synthetic construct
atgggcagcttgtacgatctgctgaaacgcgagacagccctacctgaccgggacctgcagaagattattgcgactgctccggcccggtacaagacctacaaaatacccaaacgtaattccgaaaagatgagagtgatctctcagcctgctaaagaggtaaaactcatgcaaagagtgctgatgcgggaattcttgtcgaacttccctattcacaaagcagctaccgcttacaagtcaggcagcagcattcgagataatgccgctgcacatgtcgggcgtggacccatcctgaagtttgacttcaaagatttctttccatccattacagagaatgattggagaaaatacgccgagggtcgcggcattgccgaactcgacatcgaaatctcaactaagatcttcttcaaaaaggagttcaacaggagtctgttgaggctctctataggcgcgccatctagccctattcttagcaacatccttatgtttgggatcgacgaacggatctccgcagaaattgcatccgacgaggtgtcatacacgaggtatgccgatgacattacctttagtgcccccaggactggatactttaacggcctggaacggcatttacgcatgatacttcgagagatcgaatatccagctctgaagatcaactctgagaagaccgtgtatgcgacctccaagtttcgccgtcaagtgacagggctggtcctgacaaacgatggtcagatcagtgttggaagggatagaaagcgaaatctgttcgcagccgtacaccatgccttaaatggaagactcaatgacgagcagatcgaggaggttctagggttgatagcctttgttagctcaatagagcacgacttcaaggatcggctcgaaaagaaatatggtcccgaggtggtccgcaggctttatagatgcaagcagaactga

SEQ ID NO: 11726 - RNA, 978 nt, unidentified
  source 1..978: mol_type = other RNA; note = synthetic construct
atgatgtcttggatcactaggatgctggccctgcacacgggcttacaagaaagtgccatccatcgcatcatggtgaccgctcctgtgcgatataaaaccttcttcattcccaagcgtaacggtgaattgagacagatttcccagccagcccgcgaggtaaagctggtacaaagggcatttagcgagattatcctgaagaagcttccagtgcacccttgcgcaaccgcttatattgatcggaaatccatcctgcataacgctcaaccacacgccgggcacggccagatcgtgaagatggactttaagaacttcttcccctctattcggagggtggattggatacactactgtcaggaaaacagtatatttgacagccagattgacgccgatttatcctcatcccttttgttccagaaaaacaagaatagcggactaatgaggcttgcgattggtgcaccttcgtcccccattctgagcaatatcctgatgtataatttcgactacctagtgagcaaggccgttcttaaagatcatgttacatacacccggtacgcagacgatatgactttttccgcccctcgtacaggacatctcgttaacgtggtgagaattgtcaaaagtgtctgccgctcactgaattacccccgggtcgagatcaacgagaataagacagtctatgcaactgcaaaatacaagcgagccgtcacaggcttgatactgaccaatgacgggcgggtgaccatcggcagagatcagaaacgcctcatccgcgctatggtgcatcacgctatcaacacaaatttgacgaaggaggccctcgaacgactcgctggaaatctggcgtacattaactctgttgagccggcttttatggaaactctgacaagaaagtatggggccgagaacatccagaggatcaggtgtatatggagaaaagactcacccaaaaatagcacttcaaagaaatctctcacctga

SEQ ID NO: 11727 - RNA, 954 nt, unidentified
  source 1..954: mol_type = other RNA; note = synthetic construct
atgtctgaattagtccggaagcttgcccaggaaactggggtgccggaacccttagtccgcgagatcatgctcaccgccccagttcgttacaaggagttccatatcgttaaaaagagcgggggcctaaggaagatctcccagcctgccagagaagtgaaactgcttcaaagaatcgccactaaaatcctgctgaatcaattgccagtgcacccctgcgcaacggcttatcgaattaacagcggtctgctcaataacgttaagccacacgctaagaattcacagatcttgaaactggatcttaaagagtttttcccctcactgcggctcgtggactggtatcagtactgccgccgaaattttatgaacatcagctcggaagacatcacactcgccgggcgcctgttcttcaggaagacccccaaaaaggtaagcctgcggctggcgatcggagctccttcttcccctagtatgagtaatatcttgatgtacgagtttgataccttagtgcacaagtactgtcttacagagaacatagtgtatacacgttatgccgatgacatgacttttagcgcacctagaaccggatatctggtcggcgtgatcaaaaacgtgtctcggattattcgaaagctgaagtctcccaacctggagattaatagtggcaagactgtgtacgcaacacaaaagtataaaaggtccattactggactcatattggccaacaatgggtcaattaccataggtagagacgcaaagcggcttacccgcgccagggtacaccatgctattaaaggcaggctgaccgaagatgagataatcaagctaagtggatacctgagctttattatgtcagttgaaccatccttcgtctacacgttgcaggtcaaatacggcgcgcaccagattaaccagatcctccatgcttccctcacaccgaaagagagaattgagtga

SEQ ID NO: 11728 - RNA, 954 nt, unidentified
  source 1..954: mol_type = other RNA; note = synthetic construct
atggatctcctgatcttggagacaggtttaggcgaaagggacgtaagagccatagcagccaccgcacccatccgttacaaaacatacgagattgaaaagaggaatggcgggaagcgtctcattagccaacccgcccgtgagcttaaggccctccagagggtaattgttaatgaagtgctcgataaactgcccgtccacccagctgctactgcgtatcggccaagtctctcaattaaggacaatgcaaagcctcatacggttagcggcgcaatcttgaagctggactttaaggatttctttccgtcactgagagaagtcgattgggagtcatattgcaaacagcacaacattttcgagactccagaagacatccacctaagttcccgcatcctgttccaccgcaaaaagacagcgtctactctgcgattagcaatcggagcgccgagcagtcctaccctctcaaacgttttgatgttcgagctggacacccatatcagcaaactggtcgcctccgacgggattacatacacacggtatgcagatgacatgactttctcggccccccgggcttggaatcttgttggcacccttaggaaagtgcgcaagttgcttcgagatacagcttcccctagactacagcttaacactgataaaacggtgttagtgaccaagaaataccggcgcgtggtgactgggctggtcatctctgacgaccagcgagtgtccctgggacatgaaagaaagagattgctgagagctgccgtgtacaggtttatccaaggcaagctgtctatacgggagcaggctaggctggctgggaacctagcctttgcctatagcattgaaccagagtttatacagcggctggaggataggtacggtacctctaccatcaccgacataaaaagagcccctcgcctcctgcaaagctccggagataatcagaaccgctga

SEQ ID NO: 11729 - RNA, 915 nt, unidentified
  source 1..915: mol_type = other RNA; note = synthetic construct
atgaagttatccccctggaaacaaggttggatgtggcatctgtcacgagcactctgtgaagtgcacccactggacatagaaccaatcgcttttccgaacgtgtcgcaacctgccgttgaggtgaaggcactgcaacgggggctgatcgagatcctactgcgcgatttacctatgcatcatgccgccactgcttatagggtggggattagtatcaaagacaatgccatgcgacacgctggaaatgggccaatactgaagatggatttcaaggacttctttccttcaataaagccccgggactggtccgcatattgcaaacggacaggggtcttgagcgacagcgtggacattcatcttacctccctcctccttttccagaggccgaaaggctctagcgttcttcgccttgccatcggagcgcccagctcaccattcttgtccaacgccctcatgtttgattttgatcaggccatcgcagaagcagtggctaaagatcacgtgatctacacgagatacgccgacgacctcactttcagcgcacctagaacaggccacctggtaaacgttgagaaaatagtgagggccactttgagggctctccagtatcccagactaaccgtcaatgatgataagaccacacgtgtcaccagaaagtacggtcgtaaagtaacaggtctgacgctgaccaacgacggcaaaatttctattggccacaagcgcaagaggttgattcacgccgctgtccaccatgcttctctgggcaaactgagtcctgccagtctcggagagctgaagggattacttggcttcgcaaactctgctgagccacagtttatcaataccctgcgacagagatacggggccgcgctgattcagcggatccagacttttgatattcccaagcgcgcgcggtga

SEQ ID NO: 11730 - RNA, 948 nt, unidentified
  source 1..948: mol_type = other RNA; note = synthetic construct
atggccgccatcatcgagaggctggctttagccactggaatggacgttggcctggtgggaagagtattacgctccgcgcccgtccggtacaagacataccttattccaaaaagaaccaacggttttagggaaatttcccagcccgcagttgaggtgaaggctctgcagcgaggcctcatcgaaatcctgttgcgggatctgcctgtacacgaagcagccaccgcctatcgcgtgggcatgagtataaaagacaacgcacaacgtcacgccggcaatggccccatcctgaaaatggacttcaaagacttcttcccctctatcaagccgcgagattggatttcatactgcacagaaaccggagtgctgattgaccaaaccgacatccacttgacgactctacttctgttccacaggcccaaggggacatctggcatgcgtctggctataggggccccaagctccccatttttatccaacgccctgatgttcaactttgataaagcgatcgctgaggctgtggccaaggatcatgtcaggtatactaggtacgctgatgacctcacatttagcgcgcctaggactggacatcttgtcaatgtcgagaaaatagtgcggtcggtccttcgcgggctggagtatccgagactgctagtgaatcaggataagaccaccagagtgacgcgaaagtatggacggaaggtgacagggctcaccctcactaatgatggccgcgttagtattggacatgggcggaagcgtcagatccgcgccgcagttcatcacgccagcttgggtaagctggacgaacggtctttggcagagctcaaagggctgctcggctttgctaactcagctgagcctcagttcgtgattaccctcattgagaaatacggtgcagacattatccaccagatacagaaaagcccaaatagacctagaaagatctga

SEQ ID NO: 11731 - RNA, 951 nt, unidentified
  source 1..951: mol_type = other RNA; note = synthetic construct
atgatggggaagattgtcgaggccctcgcaatcgaaaccgggatggatgtgggtttggttgaaagaattatgaggagcgcacccgcccgctacaaaacatatcggattcctaagcgaacaaagggctttcgggagatcagtcagcccgcagtagaagtcaaggcactgcaacgcgggctgatagaagtcctgctgaggaaccttccaatgcacgaagccgccactgcctatagagtgggtatgtctattaaggataatgcgctaagacacgctggcgacggtcctatcctcaagatggacttcaaagactttttcccatcgattaagccccgggactggtccgcctattgcaaacagaccggcgtgctgatggaccctgtcgagatacagctgacatcactccttctgtttcagcgtccaaaggatagctcagtgctgaggctcgctataggagccccaagctcacctttcctgtctaacgccttgatgttcgagttcgataaggcaatcaccgaggctgtggctaaagatcatgttgtgtactctagatacgccgacgatctgacttttagtgcgccgcgaaccgggcacctcgtgaatgttgagaaaatcgtgcgcgctaccttacgagccctggaatatccgacgctgacagtgaacgatgacaaaacgacccgggtgactcggaagtacggcaggaaggtaacaggactcactcttactaacgacggcaaagtctccatcggacatgagcgcaaaagattcattcgcgcagcagttcatcacgcctccctgggaaaacttagcacagcttccttaggggaattgaagggtttgctaggctttgctaatagtgcggagccccaattcatcggcaccttaaaggagcgttacggagctgagctcatccagttcattcagacctttgacatccccaaaagggaacagtga

SEQ ID NO: 11732 - RNA, 957 nt, unidentified
  source 1..957: mol_type = other RNA; note = synthetic construct
atgtcatccaacatagttaaagcactctctctgcagaccggcatggacgtgctccttgtcgagcgtattatccagactgcccctattagatacaaaacttacaggatccccaaacaggcgggcgggtttagagagataagccaacctgcgattgaggtaaaggcactgcagagagggttgatcgaaatattgttacggaacctgccactacacgaagcagctacagcatataggacaggaatgtctattagggataacgccctacgccatgctggggatggtcccatcctgaaaatggacttcaaggactttttccccagtatccgccctgccgattggtccgcctactgcgagaaaaccggagtcttaactgaagctgacgacgtcaaggcaaccagcctgattctgttccatcgcccaaagggtagtagcatccaccgccttgccataggagccccatcctccccgtttctgagcaatgccctgatgttcgactttgataagctggtgactgatgctgtaggacgcgaccatgtcagatatacaagatacgcagatgatctgacctttagtgctcctcgaaccggccacctggtgaatgtggatcgaatcgtgcgggccgccattaaatctatcgatagaccgcgcctcaaaattaacgacgacaagacgacccgggttacacggaagtatggcaggaaggttactggtcttacactcaccaatgacggctcggtgtctatcggaagagagaggaagaggttgattcacgctgcagtgtatcgtgcgagcaaaggggagctggacttgccatcacttgctgagctcaaggggctgctcggcttcgccaattcagctgagcccgccttcataatgacgttacgggaacgatacggcgatgaagtgattaagtatatccaaaggtaccgtatccctaaacggatcccccagcagtga

SEQ ID NO: 11733 - RNA, 960 nt, unidentified
  source 1..960: mol_type = other RNA; note = synthetic construct
atggttgggatcatagagctgcttgctatcaataccgggatggacaccggtttagtcgaaaggataatggtgactgccccagtccggtacaaaacgtattttatcccgaagcggcatggcgggctaaggaagatttcccagccagctctggaggtgaaagtgctccagagagcactgatcgaggtgttactcaacgaactccccgtgcatgacgctgccaccgcatacagaaccggaatgtccataaaggataatgcgctgaggcatgcagggcacggtcctattatgaagatggatttcaaggagttctttccctccattttcgccagagattgggatcagtactgcgagactacagaagtgctgacagagccacgagagatctatctgactacccggcttatgttccagcgcccgcgtgattcatcactgttgaggctggctatcggcgcccctagttcgcctgtactgagcaacgctcttttgtttgagttcgacgaaatgctgacagccgaagtagccaaagaccacgtcgtgtacacccgctatgcggacgatctcacattctctgccccacggacgggacatctcgtgaacgtggaaaaggcagttagaacagtcattaaggcgattcgacgccccaaactcaccatcaacgaggacaaaacacaacggatcactaccaaatttggacgccacgttactggactgacgttaaccaatgatggagaagtcagcgtaggccacgaaaggaagaggcaactgcatgccgcagtgcacagagctctccacggcaaactggacgtcattgagctggggaagttgaaaggcattcttggctttgtgaatagtgccgagcctgagttcattgttactttgcgcaagaaatatggttctaaaatcatagacagcatccagaagacacccgtgcccctacgaccacgtccttttaagaagtga

SEQ ID NO: 11734 - RNA, 960 nt, unidentified
  source 1..960: mol_type = other RNA; note = synthetic construct
atggttggaatagtcgaaattttggccatcgaatcagccatggacgtgggcctagtcgagagaatcatcagaacggccccagtcaggtacaagacttatcagatccccaaaagggctggaggcaatcggactattagccaacccgctaaggaggtgaaactgctccagagatctctgattgacgtcctgttgcgaaacctgcctgtgcatgacacggcaacagcctacagagaaggcctatccattaaggacaacgccctcaggcatgccggtgatggccctattctcaagatggacttcaagaatttctttccatcaataactccgttcgattgggcggagtactgcaaagagagcggtaccctcaccgacccgcaggacatccacatgacaagtttacttatgtttcaacggcctaaggggtcgagcgctctgcgtttaggcataggggcgccctcaagccccttcgtgtccaatgctttactgtacgaatttgataaaagggttaccgcggcagtcgcaaaagatcacgtgaaatatacacgctatgccgatgatctgacattttccgcaccacggactggacacctggtgaacgtagagaagatggtgagaagtacgctggagggacttaagtatcccaaacttgccatcaacgacgaaaaaacaacacgagtgacacgcaagtacgggcgcaaagtaactgggttgaccctgactaatgatggccaggtgtctatcgggcacaagcggaagcgtctcctgcatagtcaggtgcacaaggcttctcttaaccagctggacgtggatgaaatggttgctctcaaaggcatgctgggtttcgttaactccgccgagcctcagtttttgaaggtcctcacccgcaggtacggagagggagtactgaccaggattcgacggtttgaaaccgagccagcagggcgcggcaccttcaattga

SEQ ID NO: 11735 - RNA, 951 nt, unidentified
  source 1..951: mol_type = other RNA; note = synthetic construct
atggccggcatcatcgagatgttagccattgaaaccgcaatggacacttctctagtggaaaggattatccggaccgcccccatccggtacaaaacatatcagataccgaagcggtctggaggataccggactatctctcaacccgcaaaagaggtgaaactcctgcagcgcgcactgattgacgttctgctgcgcaagttgcctgtacatgataccgcgaccgcttaccgggaaggcctttccattaaggacaacgcacttcgccacgtgggggacggaccaatacttaagatggatttcaaggacttctttccctcaatccgtccaggggactgggccgagtattgcaaagaaactggcgccttgactgacgcacaagatattaagctcacaagtttccttatgtttcagcgccctaaagggagctcgacgctccggttggctattggcgcgcctagcagcccattcgtctccaatgctctcctgtacgattttgacaatagaataaccgccgctgtggccaaagatcatgttagatacacacgatatgctgacgatttgaccttcagcgcgcctaggaccggacacctagtcaatgtggagaaactggtcaggagtactattcatggtcttaagtacccaaaattgatgatcaacgctgagaagacaactcgcattacaaggaagtatggccgaaaggtgacagggctgaccctgacgaacgacggtcaggtatccatcggacacgatcgtaagagactgctccatgcccaggtgcaccgagcctcattaaatcacttagatgccgatgagctgctcaacctgaaagggatgctgggttttgtcaactccgcagaaccccactttctggaggttctgaggagaagatatggcgacgctgtgctcacgaggatccagagatacgaggtcgaaccgccccagaagccttga

SEQ ID NO: 11736 - RNA, 948 nt, unidentified
  source 1..948: mol_type = other RNA; note = synthetic construct
atgtcagacatcgtacgcattctcgcaatcgaaacgggcatggagatgtctctggttgagcgaatcatcaggaccgcccccgtgaggtataaaacataccagatccccaagagatcagggggccaccgaaccatttcgcaaccagccagagaggtaaagctactgcagagggcactgatcgaagtgctgctcagacggcttcctgtccatgaggcagctacagcctatagggagggcatgtctattcgggacaatgccctaagacatgtggggggaggaccaatactgaaaatggacttcaaggacttctttccttccatccggccccacgactgggtggaattttgcaaggagacaggagctattagcgatcttgttgacattcagttgactagtctcttgatgttccagcgcccgaagcgttccagcacccttcgcttagccataggtgcgccgtcctctccattcgttagcaacgcactcctgtttgaattcgataagcgaataagcgaggccgtggctaaagatcacgtcatctacaccaggtacgcggatgacctgactttctccgcaccaagaacaggtcacctcgtgaacgtcgaaaaaatggtcagatctaccctccggggcttagggtatcctaagctcacagtaaacaatgaaaaaaccacacgcgtcaccagaaagtacgggcggaaggtgactggactgaccttgactaatgatggcaaggttagtgtgggacacgccaggaaacgccttttgcatgccacggtgcatcgtgctagtcaggataaactgaattcaactgaactgggtgtcctgaagggcatgttaggttttgtgaacagcgtggagcctcaatttatagagaaactgcgcgagaggtacggctccgctctgatcgggcggattcaggcttatgacattcccaagcgtaaatggtga

SEQ ID NO: 11737 - RNA, 957 nt, unidentified
  source 1..957: mol_type = other RNA; note = synthetic construct
atgagcattatcgacattctctctttcgaatcagggctcgaggccaccacagttgagagaatcatcaggaacgctcctcttcgctataaaacttaccagatcccgaaacggagcggggggtccagaaccatctcacagcctgcgagagaagttaaagtgttgcagcgagccctgtcggacgtgctactgcgcgttctgcccgtgcatgaggcggctaccgcctacaggcccgaaatgagtataaaagacaatgcattgaggcatgcaggagacggtcccatactcaagatggactttaaggattttttcccatccatcaagccaagggattggacactgtactgcaaagagactggcgccctcacggaccctgtagatgtccgccagaccgcccttctcctgttccaaagaccgaaagggagtgccgtgatgaggcttgccattggagcaccatcctctccattcgtctctaacgctctgctgtacgaatttgacaagcgcattgccgccgaagtcgctcgtgatcacgtgacttatacacggtatgccgatgatttgactttttcagctcctcggacgggttaccttgtcaacgtggaaaagatggtgcgtactactctggcaggcctggaatatcccaagttattgattaacggacaaaagaccacacgcatcacacggaagtacggacgtagggtgaccgggctcaccttaacgaatgatggccgagtttccataggccatgagcggaagagaatcctgcacgctcaggtccactctgcaacaaaggatcttctcgacaatgatcaaatagcggagctgaaaggcatgttaggcttcgtgaatagcgtagagccacagtttctggacgtgctgcggagacgctatggtcacagcattattacctttatccagcgattcgagagtaaccctcccacactggacctattggagtga

SEQ ID NO: 11738 - RNA, 1071 nt, unidentified
  source 1..1071: mol_type = other RNA; note = synthetic construct
atggccggagacggcaataggttgctagagcgggagcgaccaggccaggtgcagcaacaccctagcgggtttgagggtcgcaatgccatgagtggcatcatcgagacactcgctgttgagacagggatcgagcctgggctcgtggatagaatcgtgagaaccgctccgtctcggtacaaaacctatcccatcgataagaggggaggcggcactcgcttgatttctcagcctgcgaaagaagtgaagattcttcagcgcgcactgaacgatgtattgcttaaacacttacccgtgcatgcctccgcaaccgcctatagggaatccctgtcaattagagagaacgccctgccacatgctggaatcggacccatactcaagctcgactttgcggagttcttcccctctataaaacttcacgattggaaaaagtactgcgaaaagacaggatgcctgacggacgtgcacgacgtagagatgagcggcagactgatctttcaccgacctaagggccggagtaccctgcaactggcgattggctcaccgtgtagccccttcgtctccaacgctctgatgcacgagtttgattttctggttgtcgaagccgtagcagctgataaggtggtttacacccgttacgctgacgacctgacattctccgcccctaggctgggacatttacgggacgtcgaaaagattgttagacgaatcctccgtggtctttcatttccacgcttgaggctcaatatcaacaaaactacctatgtcactagtaaattcggcaggcgggtcacagggctgactctgacgaatgctggtggtgtcagcattgggcacgcccgaaaacggaagttgcataccgccgtgtaccgtgccagccagaataacctcaacgcagacgaactagcagagcttaaggggatgttagggttcgcacattcggtggagcccgaatttatagaaattctgaggcggcgcttcggaaatgatatcgtgtccttcatccagtcttatccaatagagcgcaagagatcagccaaagtgattgctgtggaaccagacgaaactagatga

SEQ ID NO: 11739 - RNA, 984 nt, unidentified
  source 1..984: mol_type = other RNA; note = synthetic construct
atgaccaacctgctaaggagcatggctatcgagacaggcctcagtgaagtcatcgtgcaaagaataatgcagtctgcccccaaccgctataagcactactcaattgagaaacggtctggtggcaaacgtctgatatcccagccggccatcgaggttaagctgctgcagcgcgcctttgtcagtctttacctgagcaaactccccgttcacgcggccgctatcgcatatcgccccaataaatccattctggacaatgccctccctcatgtgtccagtggctctattctaaagatggacttcaaggatttcttcccatccatccgcaaggctcactggatgaactattgcgccgagttcggaatctttgaaactcagagtgaacgggagttggcagctagcctgctcttccaccggccaaaaggaagcagcgtcatgcagctggcaattggcgcccctagctcacctaccttgtcaaacgtgctgatgtacaagttcgatgagataatctcttctgaggtggctactgataaagtcatatacacaaggtatgcagacgacctcaccttttccgccgatagaagttggaatttggtggacgtggaacgaatcgtaaaaaagactctccagaacatttcttacccaaaacttcagctccatccttccaagacgatccacgtaaccaagaagttctcaaggagcgtgaccgggctgatcctggcaaacgacggcagagttacaatcggtaagaaacggaagaggattatccacgctgcaacacatgccgcatccttaggaagactggatgaccgtcagcttcaaaaacttgccgggatgctggcttttgtgcattcggtggaaccctcatttattgcgttgctggagagaaagtacggttttgagacgattaaagggttacaaaagattggcgcgaatgatcggaggaatttacgagctgccgtcggggaagccgacttcggaacttga

SEQ ID NO: 11740 - RNA, 966 nt, unidentified
  source 1..966: mol_type = other RNA; note = synthetic construct
atggtatcgctgctccgggccatggccatcgaaacaggactgagcgaggtggtggtgcagcgaatcatgcagagcgccccgcatcgatacaagcagtacaagattgacaaaagatccgggggcaaaaggctgatctctcaaccagccaccgaggtcaaactgcttcaaagggcatttgtggagctttacctctcaaagctcccggtccacccagcagctatggcatatcgtcctaacttatccattttcgacaacgctacagcccatgcgggttccggatccatcctgaaaatggatttcaaggatttctttcccagcatcagaaaggctaattggatgagttactgcgccgagttttcaatactagagaatcacagtgaacgcgaactcgcagcctcattgctcttccagcgacctagaagcagcaacgccatgcagcttgccattggggcaccatcttcccctgctctgtccaatgtcttgatgttccaatttgacgagataattagtgcgggcgtggccaaggacaaagttatatacaccagatatgctgatgatctgacattcagtgcggacagaagctggaacttggtggatgttgagaagactgtaaaaagggcgctgcgtgaaatcgcttatccccggttacagctacacccagataaaaccactcacgtgacgaagaaattttctcggtctgtgactggcctgatcttagcaaacgacgggcgtgtcacaattggtaagcgccgcaaaagggccatccatgcagctacccatgccgcatcacagggaaggctcgatgatcgccagcttcaaaagctggctggcatgctggcctttgtgcactctgtcgaacccggcttcatcgacgttttggaaaggcggtatggactcgagacgattatgcggctgcagaccattggggctaaggacagacggaatctgcgccctcccgacgcctga

SEQ ID NO: 11741 - RNA, 981 nt, unidentified
  source 1..981: mol_type = other RNA; note = synthetic construct
atggcgagttttcttcggacaatggccgttgagactggactgagcgaggtggtggtgcagagaattatgcaatcagctccacatcgctataagcactacgaaatagataagcggtctggaggtaaacggcagatctctcaacctgccaccgaggttaaactgttacagcgcgtgttcgtggaactctacttgagcaaactgcccgtgcatcctgcagccatggcctacctgcccaacaaaagcatccttgacaatgccaatgcacacgccgaagccgggtcaatcctcaagatggactttaaggacttcttcccatccatcaggaaggcctcgtggatgtcctattgcgctgagttttctatcttagagaaccacgcagagcgcgatctggcggctagcctactctttcagaggagcaaaggaagcggcgccatgcaactggcgattggcgcacccagttcccctgctctgtccaacattctgatgttccagttcgacgaagtaatctcgagtgaagtgtccaaggataaggtcgtttataccagatatgcagacgaccttacattctctgccgatagatcatggaatctggtggatgttgaaaaaactgtgaagagggccctccgtgaaatagcttaccccagactacagttgcacccagataagactatccatgtcaccaaaaaattcagtcggaccgtaacgggcctggtactggctaacgacggccgtgtcactattgggaagagaaggaaacgagctattcacgcagctacccattctgcctctctgggtcggctcgatgatagacagatgcagaagttggctggcatgctggcatttgtccactcagtcgagcctgcctttatgggggtgttagagcgccgctacggatccgagacaataatgcgattgcagaccgtggggagccgagacaggaggaaccttcggccgattaatgagacactcgacaagaagtga

SEQ ID NO: 11742 - RNA, 987 nt, unidentified
  source 1..987: mol_type = other RNA; note = synthetic construct
atggtgactctcctccgtgccatggccattgaaactgggttgtccgaggtcatcgttcacagaatcatgcaaaccgcgccccaccgttacaagcagtacactatatctaaaaggagcggcgggaaacggctcatatcccagcctgccacagaggtgaaactgctgcagagagcctttgtggacctctacctgagtaagctgccggtgcatccagccgctatggcgtatcggaccagtctctcgataagcgacaatgccaaggcacacgctggatcaggatccatactgaagatggattttcgcgacttctttcccagtatcaggaaggcttcctggatgacctactgtgccgaattttctatcttggacaactcctttgaaagagaactgagcgccagcttgttgttccagcgccctacgggctcacatggaatgcagttagctatcggggcccccagctccccagcattaagcaatttactccttttccagttcgatgagattattagtgccgaagcagctaaagataaggtgaaatataccaggtacgcagatgaccttacattctcagctgatagatcatggaatctagtggacatcgagcgcacagttaaaagggtcctgcgtgagattgcatatccccggctccgcctgaaccctgataagaccatccatgtcacaaaaaagttctgcaggaacgtgacgggcctaatcctggctaacgacggtcgagttaccattgggaaaaagagaaagcgcactattcacgctgcgacccacgccgcatctcaaggtcgcctggacgatcggcagctgcaaaagctgggcgggatgctggcctttgtaaagtctgtggagccagccttccttgacgtccttcgaagacgatatggattcgagactattatgaaactgcagacaatcggcgcaaaggaccggcggaatcttaggcctcagattgatgctgtagagatctctggcggttga

SEQ ID NO: 11743 - RNA, 987 nt, unidentified
  source 1..987: mol_type = other RNA; note = synthetic construct
atggtttctctattgcggaccatggccgtggaaaccgggttaagtgaagccgttgtacagcggatcatgcagtcagctcagcaccgctacaagcagtattacattgacaaacggagtggggggaaaagattgatctctcagccagccactgaagtgaaactgctccagagagctttcgtcgatctctacctgagtaagctacccgtgcatcccgccgcaatggcgtaccgtcctggtaggtccattctggataatgccagcgcacacgcagattctggcagcatacttaagatggactttaaggacttctttccatccatccgcaaggcaagctggatggcctattgcgctaatcatagcctttttgactcgcagtctgagcgcgagctgagtgcctccctcctgttccagaggccgaagggcgcttcctctctgcaacttgccattggagccccttcatcaccagctttgtccaacgtcctgatgtttcagttcgatgagattgttacgggcgaggtgagcaaggacaacgtgacatacacccgctatgcggatgatctgacattttctgccgagagatcctggaacctggtggatgtcgaaaaaaccgttaaacgagctctgcgcgagatcgcgtatcctagactggtcctcaacaccgacaaaacaacccacttgacaaagaaattcgggagatcagtaacgggcctcgtgctggctaatgacggacgtgtgactataggaaaacggagaaagcgggaaattcaagcagcaactcatgccgccagcctggacaggctcgatgcacgacagatgcaacaactagcgggcatgttagcttttgtgaacagcgtagagcccgacttcttaggagtgctcgagaggcgatacggtatcgagactatcatgaggttgcagaaggtcggtgctaaggaccggcgtaatcttaggccccagacacttgaagaagatgccggccacctgtga

SEQ ID NO: 11744 - RNA, 948 nt, unidentified
  source 1..948: mol_type = other RNA; note = synthetic construct
atgtccgcgttggttgcaaagctggtgctggctactggaattgatcagtcttccgtgaggagaattatgctgtctgctccacggcgatacaagagctattatatcgcaaagagaaatggtggtcttagaaagatctctcaacccgctcgagaagtgaaagttcttcagcgcgcccttatagacctcctgctgagcgatttaccagttcatcggacagctatggcctaccgggtgggaacatcaatcaaagacaatgctaatgcacacaaaacctccgggcccattatcaagatcgacttcacgaacttttttccaagtataaagagaagcgattgggctgattactgtcaaaagaccggttgcctcaacgatcctactgagatagggcttacaagttcgctgctcttccagtaccaaaaagaacacgcctcacagaggttggcaatcggcgcaccctctagtcctatgctctcaaatatactgatgtacgagtttgatagcgagatcgagtcccgtctacagggaactcgcattgtatataccaggtatgctgacgacctgacctttagcgccccaaggaccggctacctccatgatgtcatgaaaattgtgcgggaaactatgcgtgccatcccttatccccgcctcaagattaaccctgacaagacgacatacgtgaccactaaatatagacgcagtgtcacagggctcaccctgtctaatgacgggagggtcacaattggatggcgcaagaagcgggagctacatgcggccgtgcacaacgccaaactggacaaattgaatgccaagggcctgcaggccttagccggctacttggctttcgtccagtcagtcgaaccgagcttcttatccgtactgaggaacaaatatggcaccgagattatcatgaaaatcaaggcagccaacgtgaaaaaggcgctgcgatga

SEQ ID NO: 11745 - RNA, 978 nt, unidentified
  source 1..978: mol_type = other RNA; note = synthetic construct
atgtcccagttgctggacaaactctcattcgagacaggaatgagagcgaatgagcttcgccgcatcatgtacaccgcccccaatagatataagatttactcgatccctaagcgtgtggggggctttaggagtatagcccagccagcacgagaggtgaaactcctgcaacgcaccctggcaaagacctttctgacgaccctgccgacacacgcggcagctacagcttataaacccgagacttctttgcggtcaaatgcactgcctcatgctggtagaggtcccgtactcaaactggatttccgggatttctttcctagcataagggatagagattggattgcctactgtcgccagactggctgccttaccgaagacgaagatatctatttaaccagccggttgctttttcaccgtaggaagggggaaagtcacctgcggcttgcgattggagcaccaaccagccccatcctgtccaacattttgatgtatgagtttgacgtccgtgtggtagagacagtcgtcgccgacggcgttacatacactcgatatgccgacgatatgacgttctctgctcagcgcactgggaacttaactcatgtcatccgggacgtagggcgagtgctgcgggacattcagtacccacgccttgccctcaaccccgaaaaaacaacgttagtcacagccaaatatggaagaagagttaccgggctcaccctggccaatgacggacgagtgaccgtgggcagagactccaagaggaagataagggccgcagtgtaccaagccgttaacggaaggctggatcctgagcaaatgcaggtgctgactggtatgctcgcttacgttaacgctgtggagcccgaatacctagatgtgctccggaggaagttcggcactcaggcaattctgaagatccagcgcgctccgagaggcgaaaagatcagaaggcgatctccagccctagctcagaatcggtga

SEQ ID NO: 11746 - RNA, 987 nt, unidentified
  source 1..987: mol_type = other RNA; note = synthetic construct
atgactgagctgctgcgccaactgtccactgaaacaggattggcagagagcgctgtgaggcggattatcgcgaacgcgcccgaaagatacaaagtgtaccatatcctgaagaaaaacgggggaaagcgcaaaatagctcagccagctagggaattgaaactgcttcagagagcactggttgaactgctccttagcaaattacccgttcaccctgccgccaccgcctatgtaaaaggtcggtctattagggataatgcagagcgccattgtcacagtggcccagtgctcaagatggacttcaaggacttttttccttcaattactgatcgagattgggccgcgtactgctcacagactgggtgcctcacggacgcagaggatatccgcctcaccagtctgctgctgtttcaccgtccagtcggcggacgagtgctacgcttagccattggagctccttcttcccccatcgtctctaacttgatcatgtttcccttcgatgccatgatttccgaagtggttgccgtcgatcacgtgatctacagcaggtacgcagacgacttgactttcagtgggccccgcacaggccatcttaccggagtggcccggtccgtgaagagggcattaagggagataccatttccgaccctcaagataaatgccgaaaagaccacatatgtcaccatgaagtatcaccggcagatcacaggtcttacgctggctaacgatgggagagtcaccattggccgggacaacaaacgagccctgagagcgcaactggatcactattcgaagggtacaatgcctaaagctgacgtgccgcgtctcgctggcaggctagctttcgtaaagagcgccgagccatctttctttctgaatcttttggaaaaccatgggtgggagagaatccaggagattctcagacagtcaaatcagaaggccagacgggccaaacctctggctagcgacgagaatgacttcgcaggctga

SEQ ID NO: 11747 - RNA, 978 nt, unidentified
  source 1..978: mol_type = other RNA; note = synthetic construct
atgacagagctgctgaaacagctttccattgaaaccgggctggtggagtcgactgtacgtcaaataattgcaaatgcccccgagaggtacaagacctatcacattagtaagaagaacggcgggacacgcaaaatagctcagcctgctagggaggtcaaactgttgcagagagcactcacagctctcctactgagtaaactaccagtgcacccagcagccaccgcctatgtgaagggaagaaatattcgcgataatgccgagcttcactgtcatagcggtccaatcctgaagatggacttcaaggatttctttccctcaattacggcacgggactgggctgcctattgcactcgcactaactgcctcgccgaccctgaagatataaggctgacgagcctgctcttgtttcacagacctgcaggagggcgggtcctgcgattggctattggcgccccctcctctccaatcgtgtccaacctgatcatgttcccttttgaccagatgatctcagaagcggtagccgtcgatcatgttatctacagccggtacgccgacgaccttactttttctggccctcgaaccggccacctgacagttgtggctaaagctgtgaagaatgcgttaaaggaaatccaatacccgagcctcaaactgaatcccgaaaaaaccacatatgcgactatgaagtaccatcgacaggtgaccggtcttaccctggcaaacgatggacgcgtcacaattggaagggatagaaagcgggccttgagggcccaattagaccactactataagggtatacttccactgaaagagatccctagactcgcaggcaacttggctttcgtgagatcagccgaaccgagttttttcttcaagttagttgagcgtcatgggtaccagaagatccatgacatcctgcgccagtctaaccggaagaataaaaaactcccctccggcaggaacgagtctcccatctga

SEQ ID NO: 11748 - RNA, 981 nt, unidentified
  source 1..981: mol_type = other RNA; note = synthetic construct
atgcgagaaatgacggacctcctgaagcggttgtcggtggagacaggtcttcctgaaagcaccgtaaagagtattataagtaatgcacctgagaggtataaagagtacctgatccacaagaaaaacgggggataccgtaagatagcccaacctgcgagagagttgaagctaatccagagggcttttatcgatatcgtgctctccaaactgccgattcactcagccgcaagcgcttatcggcggggaaagaacattcgcgacaacgctatgccccactcacactcagggcctatactgaagatggactttaaggacttcttcccttccattaccgagagggactggagcgcttattgtcagcagacaggctgcctcaccgatcccggcgatatacgtttgtctagcctactgctgtttcacaagccctctggaggaagaattctcagattagccatcggtgcaccgagttcaccaatcctgagcaacgtcatcatgtttcagttcgatgaggccatctctaatgctattgcaaagcatcaggtcatttacacccgatacgccgacgacttgaccttcagtgcaccacgcactggccaccttaattccgttgctaaggccgtgaagaatgctttaaaagaaattccctacccccaacttaaaatcaatcacgagaagactacgcatgtcacaatgaaatatcatcgccaggttactggactcacactggccaatgacggccgcgtgaccatcgggagggatcacaagagatccctgcgggcccagttgcattatttcattaacgggaagctggatgaagcagaaactgcgcatctggccggcaaaatcgcgtttgtgaaaagcgtggaaccagagttttacttctctctgcttgagaaactgggcgccgaaaagatcaatttcctcttatccaaaagcaacaggaaaaagctgtcccttaaaaaatctccaaagctcaactga

SEQ ID NO: 11749 - RNA, 981 nt, unidentified
  source 1..981: mol_type = other RNA; note = synthetic construct
atgacagacttattaaagcaattgtccattgaaaccggcttgccagagtataccgtgaagagcattatatccaacgcaccggataggtacaaagagtactatatcaagaagaagaacgggggatcacggctcatagcccagcctgcgcgggaactcaaactgattcagcgcgcatttgtagacatcctactttcgaaattacctgttcatagtgctgcgacagcctaccgtaaaggcaagtctattagagacaatgctctgccacactcccattccggaccaattctgaagctggacttcaaagactttttcccaagtatcacggaatccgattgggtagcttactgcaaacatacgaagtgtctgaccgacccaaatgacgtgagactgtcctcattgctgttgtttcaccgaccctcaggcggacgcctgctaaggctcgcaataggtgccccttctagccccgtcctttctaatatcatcatgtttcctttcgatgaagccatcagcgctgcggttgcacacgatcatgtgatctattctcgttatgctgatgatctgacattcagcgggccgaggactggtcaccttactggggtcagcaaagccgtgaagaaggccctcagagagatcccctaccccaccctcaaaattaaccacgagaaaactactcatgtgaccatgaagtatcacagaaaagtcacaggcctcactctgagtaatgacggccgggttacaattggtcgggataacaagaggacacttcgagcccagttgcaccattaccttagcggcaaactgaacgagagtgaggtggcacacctggccggacgcatcgctttcgtcaagagcgtggagccttcattttactttaccctgatagaacgccactctgacagagtgatccaaatgctcctgaccaaatctaatcagaagcatgccaaggagaagaggcagcccatttcgttcgaaggagggtga

SEQ ID NO: 11750 - RNA, 948 nt, unidentified
  source 1..948: mol_type = other RNA; note = synthetic construct
atgagcgaaattattgaaaagctcgtggctgcatctggcctgaatcctttcgtcgttagacgaatcctggccactgcccctcggcgctacaaagagttctccgtgccgaagagaaacgggggcaagcgtaaaatagcccagcctgctaaagagttaaagattctgcagagagccttcgtggatgagttcctgtcagaattgccaatccaccccgcggctaccgcatacagagctgagacatctattaaagacaatgccgaaagacatgcaggctttggtcctatcctgaagatggatttcaaggacttttttccctgcataaccgatcgcgactgggagcattattgtcaacggaacaatctcttcgaggatcccctcgagagacgcctatcaaccttattgctgttccaccgcccgaaaggcggaagcaaacttcgcctggctataggggctccatcaagccccacactttcgaacgtgcttctctttgaattcgacaggtatatcagtgagctcgttgcccccgataaggttctctatacaaggtatgcggatgacctgacgttcagtgcccctcgtactggccacctgactggtgtcaaacgagcagtgagcagggccatcaaccatgtggattttccaacccttcggattaatagggagaagacgacttacattacaaccaagtttcacagaagtgtgacagggttgactttagcgaacgacggacgcgtcaccattggcagggacaaaaagcgggagatcagggcctccgtacataggtttacattgggtaagctagacgaagattctatcgaacggctgcacggatacatcagcttcataaattctgtcgagccagaatttatcgacgtgctgaccaagaaatacgggtccggaatgatgcagaacctgcgtgacgcctccgtagcaatccggcgagcttga

SEQ ID NO: 11751 - RNA, 918 nt, unidentified
  source 1..918: mol_type = other RNA; note = synthetic construct
atgtcagagtattctatccgtaaaattcttgccactgcgcccgaaaggtataaagagtatcgcatacccaagaagagcgggggctatcgagatatcgcgcagcccgccaaggagctgaagattcttcaacggggcttcgcaaacaattttctgatgaagctaccaatccatcataccgctatggcctaccggcacaaacagggtatccgcgataatgctcagcgccatgcaggcttcggacagatactcaagatcgattttaagggcttcttcccaagtattagagttgaagattggaggtcctactgcgccgccactgggtttctcatagaggcagaggacattgacctgagctcgctgctgctgttccaccgtgctcgcggtacgaggggactacggttagccatcggggcccctagctctcctatcctgtctaatattctgatgtacgagtttgaccaacgggtcagcgagatagtcgcccaggataaggtgatctacacacgctatgcagacgacttgacatttagtgctccgagaacagggtacttgctggacgtgaagaagaatgtttccaaaatcctggacgaactgcagttccctcggctggaaatcaaccacaaaaaaaccactcacgtcactaccaagtatcaccgagtagttacgggcctcacactggctaacgacggaagagtgaccgtgggcagagagagaaaaaggctcattagagcaaccatacatgcatacattcaaggtcgacttgtggctgaggatgtggggaggttagcgggactcattgccttcgtaaaatccgccgaacccgaatactttggcctcttgaagcaccagtacaccccagaaaagatcatcgagattctaaaatggtcatccggaacattgaaccttttcgacgattga

SEQ ID NO: 11752 - RNA, 948 nt, unidentified
  source 1..948: mol_type = other RNA; note = synthetic construct
atgaagttcctaattcaggagtcaggcttgtcagagcaaactataaagagaatcgccatagacgctccccagcgctacaaggcttacgagatcaaaaaaaagaacggaggcgtgaggcagatagcacatccagctagggaactgaaaatccttcagagagctatcgtgaaacacgtaattagcggattacctgttcacgacgccgcgatggcctatcgcaagggaaggaatatcagagacaatgccaagcgccacgccggcaccagtattattctgaagatggacttcaaggacttttttccgtctattaaggcgcaggattggcatcagtactgtgaagataacagaattctgacatcctcggaagacatctggctcactagccaaatcctgttttatcgggcccgggggacacgacttctgcgtttggccataggggcaccttccagtccagccctcagcaacgctctgctgtatgattttgataagagggtgacagagcttgtgtctcaagaggaagttgtctatactcgctatgctgatgacctcaccttctccgcggcacggacaggttacctcaccgggatccagaaattaatctccagggccctgcgcgagatggaaactcccaagattaaactcaaccacaaaaaaacaacccatgtgaccactaagtactctcgcaacgtaacgggtctggtgttgagcaacgacggacgggtcaccatcgggagagagagaaagcggaaaattagggctatgattgatcatttcatcaaaggccggctgaataataggcagaaagcccacctatcaggcatgattgcattcgcaaagagcgcagaacccgagtattacacctacatatccgagaagtacaacaatgtcctgcgagagatccttaatagtagagctaaaaagacgtgccgtatcgaagcctctcgatga

SEQ ID NO: 11753 - RNA, 978 nt, unidentified
  source 1..978: mol_type = other RNA; note = synthetic construct
atgactcccttgattagggcactttccgccagcagcgggctgagtgctgccgatacactcaaactggtgaaggatgcccccgatagatacaaaatcttcgacatcgacaagcgccggggctctgaaaaaagaaaaatcgctcagcctgcagcagaggtgaagtacctgcaaagaatcgtcgtcgagattctactgtccagacttccggtgcactcagcggccactgcctatataaagggagggtccctgcgggataacgctgctccacatgcaggtgttggccggccaattctgaaaatggaccttaagcagttttttccaagtatccgctctagggactgggaaagttactgcagcgacaatgaggtattttctgatgcacaggacgcatacttgagttctaggctgctctttcacagaccacctggtggccgtgtcctgaggttggcaattggggccccctcttcacccatgatgtcgaatatcctgatgtacgaattcgacaagcggattagcgccgcggtagaggaggacgaggtcacctataccaggtatgccgatgacctcactttcagcgcccggagaacggggtatctcgtcgatgttcgcaaaagagtttaccgagtggtgcgagagttaaattaccctaagctcgatattaacaggagcaaaacagtgtatgcgacctcccggtaccaccgagaagttaccgggctgatcctatcaaatgacggccgcgtgaccattggccgcgataagaaacgtgtgatctattctatggtacataggtacttgaagggtggacttaacggagctgaaatacaacacctggctggcatattagctttcgtgaaatcggccgaacctgatttcctcctgaacattgaccgtaagtacgagataggaacagttagcgacatcgccaagacagctggacgaatccatgtgtcagatcgccagtcctattggcagtcctga

SEQ ID NO: 11754 - RNA, 978 nt, unidentified
  source 1..978: mol_type = other RNA; note = synthetic construct
atgctgacccaatatcttgctcaggcaacaggcctaagcaccttagagatcgagaggatcgccagatcagccccacgccggtacaaagactatatgattcctaaagccaatgggggccacaggttgatctcgcacccggctcgcgaagtgaaagcccttcagcgagcactcgtggagtggctctcagataaattccccgttcatcattgcgcaacagcctacaagaagggtgggagcatcgcgctcaatgcagatcagcacgcacaaaacggtcctatcatgaagatggactttaggaacttctttccgagcatcaaaagccacgactggattaaattcatcacggagaacaatttcccactgaacgaattcgatcgtgagctgactcgcacgattctgtttcataagaggccttctatgcccgacctgagattagctattggcgctccaagtagtcccttcatcagcaatatcatgatgtatgatttcgactgttacgtacacgacaagacaaaagctgaaaagatcacctatactcgttacgccgacgacttgacattttcctccgcccgcgcctggaatctacgcgatgtggagcccattatcaagaaggccgtgagggaccatgctttttccaaactggagataaacaacgaaaaaacccgggtcgttactactaagttccgaaggatagtcaccggagtgaccctggcgaatcagggccacatatctgtgggtcggaacgctaagcgggagttgcgggctattatgtccagactttctctgagacaaaccccaaaacagaacccttcccagattgtcgggattttgggattcctgggatcaatagaacccaagtatctccagtctctgaaggagaagtacggcaaggatacatttgactttctttacagtctcgcgggggatctgcgaacagacaatagacagggacaggccgatgcagccactgaagattga

SEQ ID NO: 11755 - RNA, 969 nt, unidentified
  source 1..969: mol_type = other RNA; note = synthetic construct
atgtccaagatcattcgcgaccttgttttggagactggaatctcagcaagcactctgcaggtaatcatcaattctgccccagaatcctacaaggttttttcaattcctaagaagacagggggaactcggatcatagctcaacctagcaagcagctcaagatcatccagagagccttaattgaagttctgctgcacgacttccccatccatgaggcagccaaggcttacgtgaaagggtcatcaatccgtgtgaacgcggatcagcatgccggcagtcaacccatccagaagtacgacttctctgatttcttcccatccataaccagctctgactggcgcaagtattgcgaccacaatcaggtgaaccttagcacagccgacctgcatctgtgtacgaaaattctctttcggcgggctcacggagaaaggaccctgagactgtccataggcgccccgacctccccaattctgagcaatattctgatgtttgacttcgacaagaagatctcggaaaaacttgcaggcgacgaggtgaagtatacccggtatgctgatgatctgacattttccgcacccaaaactgggtacctgaacgctgtcccgagggcgctacgcgaatgtatccaggagatacagttccctacactcaaattaaatgcgaaaaaaaccgccaagattacagccaagcacaggaggatagtgaccggtttgacactcgccaatgatgggcgagtcaccatcggtagagataaaaagaggctcattcgcagcaaagtacacaagtttaagctaggtcaactggatagactggccttagataaacttacgggcgagttggcatatattaacgctgtggagccagagtacatttctgtcttgaaacgtgtgtatggagacgagtgcattagtaaaatcacccgaaacaaacctctccggaagtacactccccccagtagaaacggcagttga

SEQ ID NO: 11756 - RNA, 912 nt, unidentified
  source 1..912: mol_type = other RNA; note = synthetic construct
atgctcggggccaatgacctgctgtctcagatgtcaagtgattttgggatgctgccaaaccaccttcagagtattgtgaggaccgcccctatcaggtacaaggtcttctatatccccaaacgatcgggaggcttgagagaggtggcccaacccgctagagaagttaaagcaatccagagatggctgatggcgcattttggccctctcctgcccttgcatgaggcagctactgcttatcgaccaggagcctcaataaagaataatgcgctgcggcacgtggacagcgactaccttttgaagatggattttcgcaacttcttcccaagcattctgatgacagatataatccggcacttgaaaatccactgcggccagcagtacgatgcctctgcaatcaaacttattgcctacgtgtgcacttgggctcctgggaggcaagggcctttacgactatgtataggtgcaccgtcctccccgctgctgagcaattccgttatgtttgacttcgatacccaactgagctccgtggcggccgctgatggagtgaggtatacacggtatgctgatgacctggcattatccgtatgtcgttctggtgcactgaagaactacccctctctcgtatcaaaaatcgtcgccgacctgaaatatccacagctcaagcttaacgaagggaagaccgtcttcgccagtcgcgctggaagacgggtggtgacgggagtcaccctcacagccgaccaccagctctcaattggtagaactaggaaacgcgagatccgggccatgtaccatcgcatggttttgggcaagctcagcgctgaggaacagcgtgaactagcaggcttaattgccttcgctgacgacattgagcctggctttgccgcgtggcttagcagtcccaagaagctgtga

SEQ ID NO: 11757 - RNA, 918 nt, unidentified
  source 1..918: mol_type = other RNA; note = synthetic construct
atgctctctgccaatgacctgctgtcccagatggccagtgacctcggcatgctgcttagccaccttcagtctatcgtgcgcactgctcctatccgatacaaggtcttccatattcccaaacgcagcggcggtttacgcgaggtagcacaacccgcgagggaggtgaaagcaattcagcggtggctgaccgctcatcttggtcagttactcccactacacgaagccgcaacagcctatcgtacgggggcgtccattaggagcaacgcactgcagcacgttgactcagactacctcctgaagatggattttaagaacttctttccctcaatactcatcactgacattatccagcatctggaggtttactgcggacggcaatacgactcaagcgccataaagcttatcgcctatgtatgcacttgggctcctaagcgccagaagccgctgagactgtgtattggagccccgtcaagccctctgttgagcaattcgataatgtattcctttgatatgaggctttcttctgccgctgcggccgacggcatatgttacaccagatatgctgatgatctgacactgtccacccaccacccaagagtgttggcaaactaccccgctctagtggctgacatcgccgcgagtctgaactatcctcggctgaaattgaacgagaaaaaaagtgtctttgcaagccgatctgggcgacgtatcgtgaccggggtcacgttgacaccagatagacacttgtccatcggacgcattaggaaaagagagattcgggctatgtaccataggatgacactgggccaattaaatcaggaggaacagcgggaacttgccggcctcatcgccttcgcaaatgatgtggaaccagggttcgctgcctggctctccggcagtaagaagctcgaaacctga

SEQ ID NO: 11758 - RNA, 912 nt, unidentified
  source 1..912: mol_type = other RNA; note = synthetic construct
atgctgcgggccaacgacctattgcaccagatgtcttccgacttcggaatgctgaccagccacctgcatgggatcgtgagaaccgcccctattcgctacaaagttttctacatcccaaaacggagcggcggacttagggaactcgcccagcctgcccgtgaggtgaaggcaattcaaagatggctcatggagcgcttagaacccctgctccccttgcatgaagcggctaccgcatatcgcgccggagcatcaataaagtctaatgctctgcgacacgtggagtctgattacttgttaaagatggactttaccaacttcttccccagcatactgatgaccgacatcgtgcgccaccttgagacgcattgcggccagcagtacgatgcatccgctataaagctgatcgcctatgtctgtacctgggcccccaaaaggcaaggcccgctgaggttatgcattggggctccaagtagccctctgctgagtaattcggtaatgttcgattttgacaggagactaatggatttcgccgctcacgatcagattacatatacacggtatgctgatgatctctcactcagcgcccgaacttccggggcactcaatgcgtaccctaaacttgtggccgagttgaccgagagtcttgaatacccaaagctggcgctgaacacaaagaagacagtctttgcttccagggctggtaggagaattatcacaggcgttactctgacgtcagaccatcaaatctccattggtagagcacgtaaacgagaaatccgcgccatgcaccatcggatgacaatggaccagctcaacctggacgagcagaagcggttggccggcctgatctcatttgccgaggacattgaaccagggttttctgcatggcttactaaaactactgaggcttga

SEQ ID NO: 11759 - RNA, 912 nt, unidentified
  source 1..912: mol_type = other RNA; note = synthetic construct
atgctctgcgcgaacgacctcctgttgaaaatgtcttctgacttcggaatgcttgccggccacctgcaatcaatcgtgcgcacagcaccaatccggtataaagtgttttatatccccaagcggaccgggggcctaagagaagtggcccagccagcccgggaggttaaagctattcagcggtggttgataaagaggttgaaaccacttctgcctctgcatgatgccgccacagcatatcgcagcggtgctagtatcaagaagaatgctcagcgacatgttgagtccgactacctgttaaagatggattttcgtaacttctttccttcaattctcatgactgatattgtaagacaccttgagatacattgcggccagcaatatgatccatctgccattaagctgatcgcttacgtgtgtacttgggcccccaaacgccaaggaccgttgcggttgtgtatcggagcgcccagcagccctttactgtcaaactcagtgatgttcgacttcgacaagcagctgtccagcgccgcagctagtgatagcgtaacctacactagatacgctgacgatctggcactgtccagtcgtaccagcgggacgcttaataactacccgggcctcgtcgcgaagttagctggctctctgaattatcctcagctcgagctgaatgaacgcaaaactgtctttgcatcgagggcagggcgaagggtcattaccggggtgacactaaccgccgaccgccagacaagtatcggcaggaagagaaaacgggaaataagagctatgtaccaccgaatgattctgggtaagctctcccccgatgagcagagggaactggcaggactcatcgccttcgccgacgacattgagcccggtttttccgcctggctttctaaatccatcgatacgtga

SEQ ID NO: 11760 - RNA, 912 nt, unidentified
  source 1..912: mol_type = other RNA; note = synthetic construct
atgctgagtcaggccgacatcctgcagagaatggccgcagatctggccatgctccccagccacttggccaagatcattcagactgctccacttcgctacaagctattcgagatccaaaaaaaatctgggggtcgcagagaggtagcacaaccggctagggaggtgaaggctatccaacgttggttaattcgcgaactgggcccacgattaccagtgcacgagtgtgccacagcttatcgggaagggtctagcatccgcaagaacgctgaagcgcatgcctcaagcaggtacatgctcaaactggattttaccaacttctttcccagcattgttcgcagcgacctgcatgctcatctcgatcggcactgctccgattacctggatccgtcagctagaaagctcattgcacacgtctcttgttgggcacggcaccgagaaccacctctgaggctttgcatcggggcgcccagttctcctctactcagtaatagtctgatgtttgagttcgacaatcggctggcggccgttgcaaaggacgatggggtcgtgtatacccgctatgccgatgacattacactgtcctccagggatagaggtaaaattgacagatacaccgagatagtgcagacccttctggaaagcctgcagtaccccaagttgactttgaacgagggcaaaacggtcctcgcctcacgagcaggcaagagagtagtgactggactgatacttacccctgaaggatccgtgtccatcggacgtgacaggaagcggttaatcagagctatgtatcataggtcgctgacaaaacagcttgactcaaaggagacacaggttctcgccggcttgattgcattcgccgactctatagagcccggatttagccagcggttgaaaggctccgtgaggccttga

SEQ ID NO: 11761 - RNA, 909 nt, unidentified
  source 1..909: mol_type = other RNA; note = synthetic construct
atgcagcgtgaacctgacataattcttcagatggcggccgacctgggcatgctgccttctcatattagcttattgatccggacagcgccactccgctacaaggttttttatattccaaagaagagcgggggtatgcgggaagtcgctcaacccgccagggaggtgaaaaccatccagagatggctgatacgatacctaaaagacaggctcccgatccatgaggccgctaccgcctatacaaccggaagttctatccgggccaatgcagccgcgcactgccattcccgctacctgctgaaactggacttttcaaactatttccccagcatcgtcaagcatgacattcagatgcacctcgagcgctattgcgccgatttcctgggagaatcagctagggagctgattgcacagacttgctgttggatgccccgcagagagcaccctttgcgactctgtatcggagccccaacaagtccaatgctgagtaattcggtgatgtacgatttcgatcggctcctggggaacatcgccaatgatgagcacgtgacatacaccagatacgctgatgacatcactctttccgctgaggagccggggaaactcgatcgatacgtggaagtagttatgcagttactgagggaccttgcttatcctaggatagaattgaacatggcaaaagtcgttagagcctctagagcatccaagagagtggtaacgggtctagtcctgactccctctggatcaatctccatcggccgcgacaggaagagattaattcgcgcaatgttccacaggaaaattcagggcaagcttaacgcagaggaagctcaagtgttggagggcttcgtggcctttgctgaaaatatagaacccggctttcggaagcgtctcgagcggagcatgctgtga

SEQ ID NO: 11762 - RNA, 912 nt, unidentified
  source 1..912: mol_type = other RNA; note = synthetic construct
atgacaagtttactggacgatatggcaattgcatttgggatgcctaggaagcggcttttgaatatcatccgcaccgctccgctgaggtacaaggtcttcttcattaagaaaaaagccggaggtttacgagaagttgcccagccggcgaaagaggtgaaggctattcagcgttggcttatgtcatctctcgctgagcatctaccactgcactcagctgcaactgcttacacacctggcagctcaattaaacggaatgcggaagcgcatctgggtagccagttcatactcaagatggatttcgagaattttttcccaagtatctccgaagacaacattaaagctcacctcaggaacttttgttctgattattacacggaaaacgacattgccatcatcgccagggcctgcacatgggcacgcaaaagaagtcccccattgcgcttgtgcatcggagcacccagctcccccctactgtccaatagcgtgatgttttcgttcgatgacatgctgtttcaacacgccaatcaagacgaggtaatctatactcgttacgctgacgatctgactctctcaagctctcaccctgacgtcttgaaggaatatcctaagattgttgccggaatcctggagaaactcgcataccccgccctgagtattaaccagagaaaaaccgtgcacgcctctaaggcagggaacaggacagtcaccggcttagtgcttgcctccgatgataagatctccatagggcgggagagaaagagactgatacgcagcatgtaccatcggtataagaccggcaagctggacccagagcttatacctaaactcttcggcctgctgaattttgctgaggatatcgtgcccggcttccgagccaacctcgaaagagggtatgagaacgtggacatctga

SEQ ID NO: 11763 - RNA, 930 nt, unidentified
  source 1..930: mol_type = other RNA; note = synthetic construct
atggcttacccggatctgctgaggaagatggctggcgacttgggtatgctcccccgccagctggccagtattatcaaaacagcccccttgagatataaggtctttgccatcccaaagcgtgatggatcacctagagtgatagcccagcctgcgagagaagtaaaggcaatccagcggtggctgatcaacgaactgaggccacagcttccagtccatgaggatgtgatggcatacgagccgggaacgtccataaagaagaatgcagaacgccatctcggctctcgctttatgctcaaaatggacttctccaactttttcccaagcatctccgccgaggccttgcacatgcatcttgaaagctattgcggtaacacatacactctggtggacagacaactcattgtgcgagcgtgtacttggctgccccagaggacgcgtgctactgcattgcagctgtgtatcggggcacctagttcacccctccttagcaattccgtgatgtatgagtttgactgcgccgttagcgagaaggcccaatccgagggggtggtgtacactcggtatgctgatgacattaccctgagtaccactgaacggggcatcctgtctgagtacgctgattttgtgtctgacaccctggctaccttggcttaccctcgagttacagtgaataggaggaaaacagtccacgccagccgggctggccttcgaatggtcaccgggattgttctgacaccagacggaggcctgtcggtaggacgcgacagaaaacgccttgcacggagcatgttccacaggcggaccttagggctactgaccgcggacgagagtgccgagctagatggcctgttagccttcattgattcagtcgaacctggtttctctgcaaccctcagaacatcattactcaacaaaaaaccccacccctga

SEQ ID NO: 11764 - RNA, 933 nt, unidentified
  source 1..933: mol_type = other RNA; note = synthetic construct
atggcccacgccgatattttactgcgtatggcagccgactttggcatgctgcctacccagctcgccagcataatcaaaactgcgccactgcggtataaggtctttgaaatacccaagagggatggatccccccgcactatcgcccaaccagcaagagaggtgaaggccgtgcagcggtggctcattaacgaactgcgccctcatttaccgattcacgatgctgtgatggcgtacgagccagggacaagcattaagaagaatgccgaaacacatttgcggtcacagttccttctgaaaatggacttctcgaacttctttccctctatcagtgccgaggccctgcgattacatctggagctgcacggaggctcaaggtacacactcgctgacagacatgccatagtgcgagcatgtacctggctgcccgagcggacagagtggacctcatccctgcaactttgcattggagctccatccagccccctcttgtctaatagcgttatgtacgaattcgactgcgtcatcgctgagaaagctcagtttgacggcgtgacatacaccaggtatgctgacgatatcaccttctcttctaacgaacgcgggatcttgacactatattccgatttcgtcaacgacactctcggtaaactcgtttatcctagaatcacggtgaatggcagcaagactgtccacgctagcagggcaggcaggcgtgtggtaactggtctagtgctcacgcctgacgggcagatctccgtaggtagagatcgcaagcgcctggcacggagtatgtttcacagaaaaaccttggggctgttgagtgctgaggaagcagccgagctggacggacttcttgcgtttattgactcagttgaaccgggattctctgatagactgcgagatggcaccaggaatagtcagcagcacccttga

SEQ ID NO: 11765 - RNA, 924 nt, unidentified
  source 1..924: mol_type = other RNA; note = synthetic construct
atggcacatgcagacattcttgctcgaatggctaatgatctgggaatgcttcctggtcagctggccaatattattaagaccgctcccctgcgttacaaagttttcacgatccctaaaagagacggaactcggaggactatcgcccagccagccagagaagtgaaggcaatccaaaggtggttgattaatgagctccgtccccagctgccaatacacgatgccgtcatggcctatgagcctggcacatctatcaagaagaacgccgagatgcacttgcgctcacaattcatcctgaagatggacttctccaacttttttccaagtattagcgccgaagccttacggttgcaccttgaactccattgtggcaatcgctactcgctcgccgataggcattccatcgttcgggcctgcacatgggcacctgagcgagcacctaccctgcagctgtgcatcggtgcaccctcttctcccttactcagtaacagcgtaatgtatgaattcgattgtgcaattgcccagaaagcgaaatccgagggggtcacatatacccgctatgctgatgatattactttctcagctactgagagaggcatactggccccatactttatttttgtcaaggagatgctgcagcagctggcctacccgaaaatcaccatcaacgaacgcaagacagtgcacgcttcaagggccgggagacgggtggtgacaggactgatacttaccccggatgggaagatctccgtgggcagagacaggaaacgtttggcgaggagcatgtttcaccgccgggctctcggcctattaagcgcagacgagagtatcgagctagacggactgctggctttcatagactccgtggaaccagggtttagcgaccggctcagagctgcggcacgaaactctcgcccccatccctga

SEQ ID NO: 11766 - RNA, 930 nt, unidentified
  source 1..930: mol_type = other RNA; note = synthetic construct
atgcgcaacagccgaatctttcaggagatggcagaagctctgggcatgttgcccggccatctcgaaaagatagtgaggaccgctccgctgcggtacaagaaattcagtattccaaaaagggatgggacccctcgccttgtagcacaacctgcccgtgaggtgaagttgatccagagatggttaataagcaatttgcgggatcatctacccgtccacccgagcgccacagcatatgagaaggggtcatcaatcgtgatcaatgctagtgcccaccaggaaagcaactactttatcaagatggacttccagaatttctttccctccatcaaaggaaaggatattgacctacatctgcaatccctcagtcggattaatttgagccaggaggaccgagacgtggtggtaaggagttgtacttgggccccacaccggattcctccacttgaactgtgcatcggggcaccctcttctcctgtcttatctaactccattctgttcgaatttgattgcgccgtggagtcttacctcatcgaggagaaactgcccgtcagatatactcgatatgcggacgaccttaccttttctagcctatcaggaggctggctgcacgacgtgcgtaaccaggttaagatgatagtgcgcggcctcgagtatcccaaactccgcattaaagaagagaagacagtgttaggatccagggctggtagaagggttgttaccggtctggtcctgacaccagacaagaagctgtcggtaggaagagagcggaaaaggacggctagagcgatgtaccacagattctggaagggggagctggatgaatccgaagtcatgcagctggaaggtctgctcgcctttgtggagtccgttgagcctggcttcaaatcacgccttcaagattactaccggaaaaagaacccagccgcctga

SEQ ID NO: 11767 - RNA, 930 nt, unidentified
  source 1..930: mol_type = other RNA; note = synthetic construct
atggataaacttgagtcctctcatctcatccgggtgctcagcctcgagagcggactgctgcctgaacaggttgcaaatatcgtgaggacggctccctttagatacaaatccttcaaagtgaagaagagaacaggcggtttacgccagcttgcccagccagctaaggaggtaaaatggatacagagtagggtggtcgattttttgcgacctttactgcctatgcacgacgcagtcaatgcctacgaggtcggctcgtcaattaagaagaatgcagggatccatgcctcttcccggttcttgcttaaaatggacttcagcaatttcttcccaagcatactggaatccgatatcgttgcccacattaattgctttgctccatctattagcgaagttgacgcttttgttatcaccaggtcttgcatgtgggctaacggcaggaagttcccactccagctgtgtattggggctccctcatctccctttctgagtaactcagtcatgtatagcttcgacgacctgatctcaaagaaagccgcggaacgggacatcacttatacacgttatgccgacgatctaactttttcctcccggagagaaggcatactggcggactttcagtccatggtggaggtggtaatcagtgaaattctctacccccgcctgaaactgaacaccgccaagacactccacgcaagtagagcgggtcgccgagtagtcaccggcatcgtgatcacccctgagggcgagctttcagtgggacgggatcgaaagagattggtgcgcgccatggcccatcgcgacagtatgtctcaactagatagcgatggagtggacaagctggagggtttgattaacttcattgatggaatagagccggggttcgcacaaaaggcccgtaggtggaggaacaaaaaagtggcaggggcttga

SEQ ID NO: 11768 - RNA, 909 nt, unidentified
  source 1..909: mol_type = other RNA; note = synthetic construct
atgaagatctcagaatcccagttatttgggcgaatgtgccaggacctatctctgcagagcgagtccctgaagagaatcatctcgacggcccccctcagatacaagaaatttcggatacccaagcgatcgggtgggtggcgggaagtagctcaaccagcacgggaggtaaaaaagttacagtactggatcattcgcgaactgggtgatatcctgccggtttccgaccacgcgacagcctaccgtgactccattagcatcaaaaacaatgcccttgttcacgacggctctaattacctgcttaagatggatttcgctagcttcttcccctctattaaattttccgacctgtcacagcatctgagcaagtatgtgaaggagctgaccgctgacgatattggcgtgattgccttgaccacactgtggactccaaatagggaacctccactgagactgtgcataggcgctcccagttcccctctcttgagtaattccatcctttttgatttcgacgctttggtgagcaagagcctcccagactctgttaaatacactaggtacgcagatgacttgttctttagtacccaggagtcaaaccaattatcttatgtcgagaggcttgtgagggaaaccgtgcacgagctagcatatcctgcccttagcttcaacgataacaagactgttaatgtgagtaggaactcacgccgctcagtgacaggcgtcgtcctcaaacctgatggaggactgagtgtcggaagagagcggaaacgaattgccagagcaatgtgtcataagttgtcaatcgggcgcctgagcgccgatgaagaggcgaaactccgcggcctcctggcatttataagctctattgagccccgtttcgccgaacggctcaagtctaaatattccatctga

SEQ ID NO: 11769 - RNA, 927 nt, unidentified
  source 1..927: mol_type = other RNA; note = synthetic construct
atggacggtctgatcagtaatgtagccgccctcgttggcgtgtccagcgcaagttgtaggaggattgcgaacggcgcccacaggaggtacaaggtgttcaccatcgccaagagaggcggtggtaggcgagttgtcgcccagcctgctcgcgaagtgaaagcagtgcaacgagccgtgtgtcagctcctttcagagaacctgcccgtgcacgatagcgctacagcatacaaggcaggcaccagcatagcggctaatgccgctgcgcatgccggagctcaatttctcaccaagttggacttctctgacttttttccatccattagtggggacttgattagcgatcttctgcgcagacgctgtgaacatttgacggaagctgaaatcgagtttgttgtcgatgtgtgcacatggcgtcctgacggccgtaaagtactttgcatcggcgccccctcttcccctctgctagctaatgcagtcatgttcgagttcgactgcgaggcgttcgaggccgcctctgagatgtgcgtctcatataccagatacagcgatgatattgccctgtcctctatggtgccagacacactccggcaggcagagactgcagtgagacgtatcatcgcttcaaggcccgccttgagagtcaacgagcggaaacgcgtggcagtggggagaggcacttccatggtgataaccggactaacgctgactaaccaggggggcgtttcggtaggtcgctcacggaaacgaggagttcgggccggggtgaatcgctatctccttggggaactcgacgaggctgatactctgaagttaaagggagaagtggcctttgtcctgagcattgagccggaattcaggggagtcctggtacggacctatggactgagagtttggacattactgccacggatggtggctggcgggtga

SEQ ID NO: 11770 - RNA, 924 nt, unidentified
  source 1..924: mol_type = other RNA; note = synthetic construct
atgatcgggcttgtgagcaaagtgagctcactggtcggggtttctactagcagctgtcgcatcattgcacggggggcataccgtcggtataaaatcttcgccatcccaaagaataatggcggtagaagggtagttgcgcaacccgctcgggaagtcaaggccgttcagcgagccatttgccagatcctgtcagacaagttagaaatacatcagtctgcaactgcctacaagccaggctcctcgatattagccaacgccgcggtacacaagggagccaaatatctgacgaagctcgactttaccgacttctttggctccattgatggcgagtccatattccacctggtggagtccagatgccccgacttgtccgctgccgagctgaaattcatagtcgacgcgtgcacctggcgacctcaaggacgtgctgtgctatgtattggggctcctagttccccttttctcgctaacgccatcatgttcgaattcgatgccaaagccttcgacttggcaaacagagtggatgccaagtacacccgatattctgatgacatcgctatctcgagtctaaagccggatttgctgaaaggattagaggagaacatcaggaatctggtgcgcggctctcggctcccatatattaggctgaacgatcagaaaagagtggcagttggccgcagcactagcatgagtattacaggtcttacactgaccaatcagggcggcgtatcagtgggtagagaaaggaagagaggggtgcgggctggagtctctaggttttttaatggacagctgagtcccgcagagattgcaaagctcaagggggagattgcgtttgtgttgagcatcgaacctaacttccgcggagtccttatcaatacatacggtctgcgcgcttgggagctcctccccaaatcacagtga

SEQ ID NO: 11771 - RNA, 918 nt, unidentified
  source 1..918: mol_type = other RNA; note = synthetic construct
atgaacggtcttgtagcacaggtcagtcagatggccgggatctcctctagctcctgtcgactgattgccaggggcgctcatagaagatataaaaaattcaccatccggaagaagaatggggggatcagggtggtcgcccaacctgctagagaagtgaaggctattcagcgagcgatatgcgtcatactgtctgaaaaactgtttgtccatgccagcgccaccgcctacaagatcggcagttccatcctgtcaaatgccgctgcccacgcagagagccgttatctcagcaaattcgacttctcagatttcttcccctctattggggcagactcgctgatcaatttgctggctatcagagtgcccaatctctccgaggccgaggttcgcttcgtggtcgatgcctgtacatggcaacccaacggccgcgccgagttgtgcattggagcaccgtcgtcccctctgctgagtaacgctgtgatgtacagcttcgatgaaaacattttctccgcgttggctgagatgggagtgagctatacacgctactctgatgacatatcaatctcaagtaagcgcgaaggaattcttgctgacgccgagctgttactcagggctgcagtggcacgatcccgctttccagttctcagaatgaatgaggagaaaagggtcgccgttggccggggagtgagcatgacagtgaccggccttactctgacgaaccagggtggtgtgtctgtgggaagagccaggaaaaggggggtacgggcgggtgttgaaaagtttgtgagatttggcgctaccgaggtagaatttgcacgcctcaagggcgagttagcatttgtcctgtctgttgaaccagagtttcggcaggtgttgatcaggactcacggggaacggattctacgtctacttcctcggtga

SEQ ID NO: 11772 - RNA, 951 nt, unidentified
  source 1..951: mol_type = other RNA; note = synthetic construct
atgataggcctggtcagtaccgtgtcattcttagccggcattagtacggatagctgcagacgcattgccgcttccgctcaccgtagatacaaagtcttcactatcccgaagaagaatggcagggacgtgcgcgttgtcgctcaacccgcacgcgaggtgaaggccattcagcgggcgatatgcgctgcccttaacgaatacctgcatgtgcatccaaccgccaccgcctacgtcaagggcagctcgatcattgcgaatgctgggatgcacaaacactgtaagtacctgactaagttggatttcaagagcttctttccctccatagacggtgagagcatcgagcgagccctccgctctaaaatcgctgacctatccgaatctgagatacagtttgttctcaacgcatgcacatggcgacccgaagggcgccaggttctgtgtattggggctccttcttctcctcttatgtctaatgccgtgatgtatgattttgaccagctggcaaacattgaatgtcgtaacatgggtgtcatctatacaagatatagtgatgacatctcaatctcaagtgagcaaccagataagctgtctctggcagagaatcggattagagaaatcatccagatccagagccaacctaggctcttcttcaacgattcaaaacgagtagccgtgggtaggggaacagcgatgcgggtgactggactgacactgagcaatgaggggaaagtgaccgtaggcagaacgagaaaacggggagtgagggccggcattagccggtatatgcggggactcgtagacgaagaggcattgcagaagttaagaggagagatctcctttgtgctttcggtcgagcccgaatttaggaaagtgctaatccgcacttacggcatatccgtggttaggatcttgcctccaaggattgcatccaaaaccggggacattaagtga

SEQ ID NO: 11773 - RNA, 936 nt, unidentified
  source 1..936: mol_type = other RNA; note = synthetic construct
atgtccgaattcatcgatcaggtggcagcatctcttggtctgagtagaggggtgtgcgaaaacatcgcaaggacagcacaccgtcggtacaaggtgttcttaattcctaagaagaatggaaggggatttcggacagtagcgcaacccgctcgcgaggtgaaggccattcagcgcaccctggttctcatgctcgatcagctgctacctgtgcatcctgccgccacagcttaccgaccagggtcaagcatcctcaggaacgccagagcccatgtgcgggccaagtacatcacaaagcttgacttcgaagctttttttccgtatatagataggactagcctgggtcgccacttaaggcagcacttgtcacacctggacggcgatgatattgccttcattctgtctgcctgttgctggacccccaaaggaactacgacccagcgactgtgtatcggtgccccaagcagcccaatgctcagtaactctataatgcacgacatagactccgacatccagacctattgcgaagaggtcggagctgtttatactcggtactctgacgacatctgtatctccgccacaatgcctgatgtcttggcaccattagagcaacgcattcgtcatcggattagagagagcactagacccactcttaccctgaacgaggccaagagagtagcagtcggtcgcgggtcggctatgaatgtcacggggcttgtgttgtccaatgaaggaacagttaccgtgggcagggagagaaaacgcggcgtgagagctggggtcatgcggtatctgaaaggcgccctggacctgaatgaaaccgcaaggctaaaaggggagctggcttacgttatcagtatagagcccggcttccgatttgtgctcgctaaaacctacggcatggagatccaggcgttgctcccgtcagcgggcatttga

SEQ ID NO: 11774 - RNA, 936 nt, unidentified
  source 1..936: mol_type = other RNA; note = synthetic construct
atgatcggactcgtgtctcaagtggctgagaaagttggcatcagctcacaagcttgtcgaagaatcgccagctccgcatatctgcgctacaagaaatttgtgatccctaagagcaatggccgcgatttcaggttcgtcgcacagcccgcgaaagaggtaaaggcaattcagagggccttagtggaaattctaggagcgtatctccccgtccacgactctgctactgcttataggattggcctgtctatctgcgataacgctcggcgccacgccagtgctaagtttatcaccaagcttgactttagtgacttcttcccctcgatagacgcacctgcgctgagcgcacatttacgggcccacattgccaatatctcagacgcagaggtgatgtttattatgaacgcatgtctgtggcgacctgaagggagacaggtgctttgcataggggccccatcttcacctatgttgtccaactccgtgatgttcgagtttgatacactgatctccgggctagcttcacaggccgatgtcgtgtatactcgctacagcgacgatattaccgttagctcgagagaaccggacaagctcaggggcattgagatagctatcaggaaagcttgcgccacgatgtcccatccaaaactcgaaatcaacgagaagaagagagtagccgttggtagaggtaacgccatgcgggtgacagggctcaccttgacaaatgccgcggatgtaagtgttggtcggctgagaaaacgtggagtgcgtgcaggaattaaccgatacgtcaatggcgatctggacgacgatcaggtggagaggctgaaaggggagttggccttcgttttaagcgtcgaaccaaattttgctgaagcccttctgcgctcttacggcgccatgtccctgagtaagatacttccacggaaggtcctgccctga

SEQ ID NO: 11775 - RNA, 930 nt, unidentified
  source 1..930: mol_type = other RNA; note = synthetic construct
atgaatggcgatctcctcagctttgtggtggctcagacaggcctgtctcgccaggccgtcatccggatatcagagacggcgcggcatcggtacaaggtcttctcaattgataaaaaacggggcggaaaacgcatagtcgcccaacccgcgagggaagttaaagccgtgcagagggccatcgtagccgctctgtctagcagactgcctgtgcacgagagcgcaaccgcatatgtcccagggtccaagttgattaacaatgctattccccacgcggggcagaagtacctgttgaagtttgacttcgaaaacttttttcctagtatcgacgatagcgccataaggaaggcactttccggcgagacacaaaacggcttctctcaggatgatatcttgctggtggtggggtcttgtctctggaggccccctggatccagcctccttggcttgtgcatcggggccccaagtagcccttttctcagtaatgctgttatgttcgaatttgacggcatcgtatcccgattagcccgtgagctgggtatttcgtatactcggttctcagacgatgtgaccttctctggccccgacgctagttctctgtccaaaatggaactggggttcagggagacatgtagagagttaaatgccccaaagctagtcgtcaatgagaagaaacgcaccttctgctcacggggagcagcaatgagagtgaccgggctaacactttcgaacggaggaggagttactgttgggagggctcgtaaacgaggagtgcgcgccggtgtcgacaactacctgagaggtaccctggacctgaagaaggtggaaagactgcgcggtgaggtagcttttgtgatttccatcgaaccactttttcgtgatgtgctcattgcaactttcggcgaccgagtgagagacgttcttccgagctga

SEQ ID NO: 11776 - RNA, 942 nt, unidentified
  source 1..942: mol_type = other RNA; note = synthetic construct
atgacactgggactgataagtgctatcgcatcagaagccggcatcagcaaggggtcagctctgcgcgtggccgtaagtgcgtataagaggtacaaggtgttcaagattaagaaacggtctggcgacggaacacgtactgtggcccaaccagctcgggaggtgaaagccattcagagagctatcgtccagttcctttcttcccgtttgccagtccatgacgcagctacggcatacgttggcgggtcttctatatatgcgaacgctaactttcacgctggggcccgctatctcctgaaaatggactttagcaacttcttcccctccatacgacccctggatatcgaacgccacctgctgagacacctcgggagtgagatttcgccagcagaggtttcctttgtgatccaggcatgcatttggagggatccagagatgggtggctttggattgtgcatcggcgcccctagctcccccttcatcagcaatactattcttcacgagtttgatacatcagtcaggtccgtgtgtgacgagtatcttgctaagtacacccgctacagcgacgatatgaccttttccgcagatggccctgatgtgctcgccgaagttgaaagaagggtgcgcgccgtggtaaaggaaatgcgaagccctgtcctgttgctgaacgagaataagcgggttgccgtgagcaggtctgcagccttccgagtgaccggactcaccctacctaatcagggaggcgtgtcagtgggaaggaaacggaagagaggggttagagcgggtgtgcataaattcgtcttagggcagttggacgccaagggcgtagaaaaactaaaaggtgagttagcgttcgtcctcagtattgagcccgagtttcggtacgtcctggtagaaacttacggcggagccatccaccaacttctgccgggtaaatggcattga

SEQ ID NO: 11777 - RNA, 957 nt, unidentified
  source 1..957: mol_type = other RNA; note = synthetic construct
atgaccactagactggtgaaccgcctgtctcagcaggtaggcctccctgcgggtgacatagagaggattatctcctcagctccccggaggtacaaagagtttaagatccggaaacgcagtgggagcggtttccgtgatatcgcgcagccttcccgcgaactcaagattttgcaaaaggctgtcgttgaggagctgaagcctcacctgccaatacatgactgcgtgcatggctacgttattggccgggggataaaaagtaatgctgcagctcaccggaagggccggttcatcctgaagatggactttgccgatttcttcccatccattaaacccgtagatttccgtgcccacctccgagaatcccttcctgacagatacgatgatatcgaagctaggcagctggagcttttactcttttggctcaagcggggcgagagaaccttgcgcatgtgtataggagccccgagtagcccaagcatctcgaattacctgatgtatgcaatcgactcacgaattacggagaactgcaggttaaacgcagtgacttatactagatatgccgacgatctcaccttcagctgtggagaagagggaatcttaggggaagtggaaggtgccgtgtctagaattgtcggagagacagtccatccaaggcttcgcattaatccggataagaccattcacataagccgcaagcagagacgcaccgttacaggagtgaatatcacacccacaggagaactgtccatcggccgagatcgtaaaaggctaatcagagcaatggtgcataggcacattcgggggctgctggacctgagaggtcaaaacgaactgatcggcctattggggtttgctcacgacgtcgagccctcttttgcccagaagatgtgggcatctttgaaaggcgcccccgcccttaaacgatcaaggcgggtggactatatgctggaggggtga

SEQ ID NO: 11778 - RNA, 939 nt, unidentified
  source 1..939: mol_type = other RNA; note = synthetic construct
atgacaaccaacttggtgcatctcctgagcagagaagtagggcttcccatctccgacattgaaaagattattgcaagtgcaccgagacgatataaggagttcaagattctgaagaagaacggcaggggcgttagggacatcgcgcaaccgtctcgggaactgaaagcgctccagagagccgttgtgtccaaaatagcaccacgactgcccgtgcacgattgtgtccacggatacgtcctgggccggggcatcaagagcaacgctcaatctcatctgggaggaagcttcattctcaaaatggatctgtcagacttttttccaagtatcaaaccagtggatctgcggcaccatctgaacaaattcttacctgaggagtttgacgatgtggagcttcgccagttagaattgatcctgttctggataaagaaaggcacctctattttgaggatgtgcattggggctccctcgtcacccctcataagtaatacaattatgttcgacgtggacctggaaatcgacaatctttgccgccagtatgacgtcaagtacacccgttacgccgacgatttgacatttagctgtagtgagaagggtgtgctctcactaatccagaggggggtcagcctcatcgtgcggtcatccaagagccctatcattaaaatcaacgaggagaaaactcttcatctaagcaaacgggctaaaataaatgtcactggggttaatctgaccccagatggttccctgtctatcggaagggagcgcaagcgactgattcgtgtaatggcccaccaccactccctgggctctctggatgccgaaggccagaataagcttatcgggttgctcggttttgccttcgatatcgaacctaactttgccatgggagtgtggggggctttagccggtgcacctaagctactcagaacggagagacgctga

SEQ ID NO: 11779 - RNA, 927 nt, unidentified
  source 1..927: mol_type = other RNA; note = synthetic construct
atgtccacacctctggtcaaactcctgagcatgagcgttgggcttaccccaacggacgtgatgaggatcattagtagtgctccaaggcggtacaaagagttcctgattcccaagaacaatggccgcggccataggaagattgcccaaccttcacgggaagtgaaactgctccagcgtgccttgtgcgagtctgtgctgaccggctttcctgtgcacaatgccgcacacgggtatgtacggggaagggggataagaaccaatgctgaagcccaccagtctgcgaacttcattctcaaaatggattttgagaacttcttcccaagcatgaaacccaacgacctgagactacatttgcagatgtacgccagtacgagatttgatgagaacgaagtccggcagcttgaattaattctgttttggcttgagaagggttctgattccttgcgaatgtgtatcggagcaccgtcctcccccatgctaagcaacacatttctttattctatcgacgcgcagttaacagcagtctgcgacaaatcgggcgttacctacactcggtacgccgatgatttaacattcagttccagcgaacccaatctgcttaaggaaatccagaatgagactgagctgatcataggtaaggccgattatcccaaactcaaaataaacaaggacaagaccatccatatcagcaagcgacaacgcaggactgtgacaggcataaatattactccttccggaaaattgagcatcggccgcggacgcaagagactgatgagatcaatggctcatcgtcactcacagggaatcctctctaccgaggaccaaaagatgctcgggggtttgattgccttcgctgcagacatcgaccccgggctcgctgtggatattaagctgtcactgctgaatcacccaccgctggcaaagtga

SEQ ID NO: 11780 - RNA, 945 nt, unidentified
  source 1..945: mol_type = other RNA; note = synthetic construct
atgacaacaggtcttgtccagatgctcagccaaaggagtggcctacctcaggccgacatagagcggatagtggcctctgctcccagaagatacaaagaattcactattcccaagaaaagtggaagaggcctgcgggaaattgcccagccttccagggaacttaaactgctccagcgcatcattgtggacgcggttctctctaggatgcaagtgcacgagtgcgcacatggttacgttgcaggccgcgggatcagaaccaatgcagccgcgcacgccaggtccaagtatatcctgaagatggactttaaggacttcttccctagcctggtgccactggatctgcgcagctacttgcagaagcaccagccctccgggtttaccgaacaagaagttaggcagttggagcagatcttattttggaggaaaaaggggagtaacgtgctgcgaatgtgtgtaggagctccgagcagcccagcactgagcaacgcactgatgtacgagctggatcagtcaattagcgatgcctcatccacacgaggcgtgacgtacactcgttatgcggacgacctgacctttagctcaagacaaaaagatgtcctcggctcccttctgaccgaggtcatcgctatagtgagtgagtctaagtctccctatctaaggattaatccctcaaagactatctccatctctagaggtcagcggcgaaccgtcacaggcgtaaatattacccctgacgggcgcttatccatcggacgggagtcgaagcgtctcatcagatcaatggtcaactatcatgcctcgggcaaattggacgaggaagggcaggctcgcctcatcggacttattggattcgccactgatatagagccagatttctccgcccgcatgcggattgctttgctcaacagtccacctctgttagctacgccgtctcggtctgtgtga

SEQ ID NO: 11781 - RNA, 936 nt, unidentified
  source 1..936: mol_type = other RNA; note = synthetic construct
atgactacaagactggcctcatccttatccaagtggtctggctttgcactcccagatgtggagcacatcatagcaacagccccgcgtaggtataaagtgttcactatccctaaaaagagaggcggcctaaggcagatcgcacagcccagcagagagttaaaaagtttgcaggtgctgctgattggccgcgtcctccatcatctgccagtgcacgacgccgcccacggatacgtgattgggaggggaatcaagaccaatgcgcaggcccactccaaatcaaactacctgctaaaaatggacctcagagatttctttccaagcattcggccccgagatctgcgcgcccatctgaaggtgcaagcagagggatatctgacagacgaggaggttggtcagctgtgtaatctcgtgttctggcgaccaaagggacaacggggcctgcgtctatgcattggtgcaccctcttctccttttctcagtaatacgattatgctcggggtagaccagaagctcgcggaggttgccaggtccttaggggtcctgtataccagatacgctgatgacttggctttcagcagtaacgaggctgacgttctccctgctctggaggcaagggtgatagatgtcgtggaaggcagtcgattccctaagatcttcgtcaaccgggaaaaaaccgtgcatatctcccgcgctcaaagacggatgctgaccggcctgatcttgaactcagtcggtgacgttagccttggacgggatcgcaaaaggttgatacgcgctatggtgcagagctctcgctacgggaggctggatgaaaaggaattggaaaagcttaatgggcttctttcgtttgcccacgatgtcgagccgggctttgccatgaagatgagagcccggatggctctgccccaggtagacgacggacttggggaagtatga

SEQ ID NO: 11782 - RNA, 963 nt, unidentified
  source 1..963: mol_type = other RNA; note = synthetic construct
atggacctcatactccaactagccaacgatttggggctcgctaatagagatattttactgattgccaactcagccccgtatagatataaggaatacaagatccccaagaaaaagccaaatacctttagagacatcgcacagcctgcccgggaggtgaaaatattgcaacggtgggttattgagaatgtgctgaccaagctcccaatccacaacgccgctactgcgtatattaaggaccgaaacattaagtacaacgcaatgctgcatgcaggcaatccgttcgtgctgaagatggacttttctaacttctttcctagcattgtcccaaaggactttaagacccatttgcttaggcacttacccaacatgtacactgaggatgagattaatctgctgctccgcattcttttctggaggaacaaaaaagaagagcggtttcagttgtctatcggtgggcctagttcccccaatctctcaaactccataatgttcgaatttgactcactgatcagcgatgagtgcaacagcttgaatatagtgtacagcaggtacgctgacgatctggttttctcctccattgatttcgaccttctgaagcgtatccacaatcaggtggccatttatctgaaaaagatcccttaccccaagctcaccctgaacaatgacaagacaatgttcctatcgaaaagaggaaaccgcacggtaacaggagtcatcatcactaatgatgggagtctgagtcttggacgggatcgcaaacgtgagatcagctgtcagatcaattggcacaaaaagggcaacttaaaaaggtctgatactctaaagctgcatggcatgctgtgcttcgctaatgacattgaaccaggttttatcgatcgaatgcgcacaaaatatggcatcgataccattcacgaactgatacatcttgacacgtctaaagaccagaagacaatcaaaatctga

SEQ ID NO: 11783 - RNA, 924 nt, unidentified
  source 1..924: mol_type = other RNA; note = synthetic construct
atgaagctgctccgggaggtggctattgagaacggcctcgcccccgaggaactgatctacataggcccctccttgcccagtcgatatcgagaattcgccattatgaaacgtgacggaacacctcgctggatcgcacaccctgctagagaacttaaaggcatacagcgctctattgtgagatcactaatatcccagtttccaattcacgactccgctactgcctacaggctggggtttaatattagaaagaacgtggagccccacgtgcgccaggagttcatcgtaaagatggactttgcgaatttctttccgagtatccgccctcatgacttgatttcctatctttcgaacacccagtttaagctctcagatacggagataaaattcctaactcacgccctgttctggaagccaaagaaggcttctgacctgaggctcagtattggcgctccaagcagccctccgctgtccaatgcccttctgtacgattttgatgtacatgtggacgccttatgcagagtcaatcaagtcaaatataccagatacgcagatgatatgacgttcagcgctactaatacacagagcctggaagtggttcacaagcagatcgtcaggtttgtcaaagagatgaagtctccaagcctgcgtttgaacacaactaaaaccatctggttgagcaaggcacatagacgcaatgtcacaggtctgatcgtgacccctaacggagagatctcaatcgggagggaccggaaaaggttaatctctgccaagctgcatcactactcattaggacggctcggcgttgcggaaaccaaacacctccatgggctgctcgcattcgccaacgccattgagccccagttcgtggatcgaatgcggcggaagtatggtgttgaagtgcttgcactgaggcaccaaaaatga

SEQ ID NO: 11784 - RNA, 954 nt, unidentified
  source 1..954: mol_type = other RNA; note = synthetic construct
atgtctctgctttcagaactcatctgggccacaggtttaccacagccggagctgatgagaatcatcacgactgctcctagccgatacaaagtttaccagatacctaagcggactggaggatggcgggaaatcgcccacccagcaagggagttaaaagcccttcagcggctgatgcttaacaagtatctgattaacttccccgtgcatcaatcagcaatggcctatgtgaaaggccgaaatataggagataatgccgcgattcataccgactcaaactttttcctaaaactggacttcgagagattttttccaaatattaaggtcaaggactggattcggttcctgaaaaataacaacttccaacctttcctctcggacgagatccccattacttcccagattctgttttggggcagcggacaccgtaagccacagtgcttatcaatcggggcaccgacaagtcctatcctcagtaatatcttgctgtacgacctggatgttgaactcagtgcccacgcgcaggccatgggggtaaggtacagcaggtatgccgatgacattaccatatccggccagaccatcgaccagatcattgctttcgagtccttggttcggcaacgcatcagacacctggcatctcccaagctgaaattcaatgatagcaaaaggggcgtatacgggcgtagcgtcaagaggatggtgaccggtttggtggtgacacctgctggcgctgtctccataggaagagatcgcaagagggctatctcttcccttgtgcatcgcttttctctcggccaattggatcaggatcagctggggtacctaaaggggatgttgggctttgccaaggctaacgagcccgaatttctcgatcgcctccgagcgaaatatggtgacgctgtgattgacgccgcaacaaaactgcacctgccacccagaaaccgcaaggactga

SEQ ID NO: 11785 - RNA, 966 nt, unidentified
  source 1..966: mol_type = other RNA; note = synthetic construct
atgaggctccttgaggagttggccatcaatctgggattagggactgccgaaatagaaaccatagtcgaaactgcaccggctcggtacaaagtctacgacatacctaaaagatcaggcggcacaaggactattgcccagccatctagggagctgaaggcccttcagagatatattctgtccacgaaactggtaaagttcccagtgcacaagtcggctatggcctacttacccggcaaaaatatcgctcgaaacgccgaggagcacttaaatggtaatatcctcctcaaactggatttcgaaaacttcttcccttctatcttggttaaggattgggagagctttgctaagaagcaccccgtgcaagtcattcccgtcgaggacatcaagctgtactctaaaatcctgttctggggtcagaggagcaggacacccagatgcctgagtattggtgcgcctacaagcccgatgctgtcaaacttgctgctgtttaccctggatgagcagctggatgaggctgcccggaagtgtagtgtgaattatacacgttatgccgacgacatcaccgtgtctggatccactgttgagcaggttaccgcatttgagaaacttgcaaggaaaattgtgaagagcctccgcagtcctcggctgatttttaatgaagaaaagcgcggcctttatactcgtggacaacggcgaatggtaaccggactcattattacccccaacggcaccctgagcatagggcgagaacgcaaacggacgatctccgcgatgctccataaggcacttctgggtgagctcgacctagagtccacagggcatctaaaggggcttctcggcttctcactcgctaacgaaccattgtttgtgaacagaatgagagagaaatacggagatgcaatcgtggaccgcgtgctgcgcttgaagttgccagaaagaatcctacaggaagggaagcagggctga

SEQ ID NO: 11786 - RNA, 969 nt, unidentified
  source 1..969: mol_type = other RNA; note = synthetic construct
atgagtctgttaacagagctcgtgcaggaattcggccttgggcaatcggacctcctgcgtattatcgacaccgccccagctcgatattcagtctatcctatccgaaaaaggaacggaggcttccgcactatcgcacagccctcacgtgaggtgaaggcaatacaatactatatcctggagaagaagctgggtgtgtttccagttcatccctctgccatggcttacgtcaaaggtaggaacattcggcagaatgcggctagccacgccagttctggacctatcttgaagctagactttcaggaattcttcccaagtattggggtgagagattgggaacggttcgtgaagtcccatcctgtggacgctattgatctttccgacctcaaatactacagcaagattctcttctggggtcaacaccggaagtcaaacgtccctaaatgcctgtccattggcgcccccacctctcccattatctctaacatcctgctgtatgaccttgatgtgaagatgtctgccctggccgagctgctgggggtagtatacagccgctacgccgacgacatcactgtgtccggccagtgtgttgatgaggttctggagtttgagaggctagcacgccgggaagtcaaatcagctaagtccccgaaacttactttcaatgaggagaagaggggactctattttagagggcagcgtcggctggttaccggtctggtactgacaccaaccgaacgcgtcagcttggggcgaaaaagaaaacggacaatatccagtctcctacacaaaagcacgctcggccagttagatccgaagagaagagggtacctcaagggcttattgggatttagcgtggctaatgaacccgagtttttgggcaggcttagaaggaaatacggagatgaagccgtcaatgcggcactggtgtatttcgtgcctaagcgcatagatcaggaagcattgttttga

SEQ ID NO: 11787 - RNA, 984 nt, unidentified
  source 1..984: mol_type = other RNA; note = synthetic construct
atgtctctgatccttgagttagctgaagcgactggactgtcatctggggacatcgaacgggtaattcgcacagctccagccaggtataagacctacccgatcgaaaagcggagcggcggcatccggatcattgctcagcctagtcgagagctgaaggtgatacagaactatatactgaaagagaaactcaaggactttcctgtccatagctgcgccatggcatatgagaagggaagaaatatcttcgataacgcagcctcacatgtcggcagcagagtcctcatgaagcttgacttcaaggatttctttccaagcattaaggtgaaggactgggaacgttttatcgcggcttcatccgtggaaaccatttcccccacagaggtctatctctactccaaggtgttgttctggggcgagaaacgccgctcatctgtacccaaatgtctgtccattggtgccccaacaagccctaaggtgtccaatatcctgctgtacgattttgatatgactatgagcggtaaggctagatcgttgggactgtcgtacacaaggtatgccgacgatattaccattagtggagatactgtggagcagatccttctgctggagcgggaggccaaacagattttaagaaagatggcacaccccaagttgaccttcaatgaagcgaaacgaggtatttactctaaagggcaacggcaaatggttacgggcctaatagtcacgcctcaggcagtggtgagcatcgggagagaaaggaaacgcgaaatatctagtctgctccacaggagtttactggggcagctcgacaatgaccgccggtccctcctgaaggggctacttggtttttgcgtggccaacgagcctgagttcatcggccgtttgaggaggaaatacggcaacggagctgttaacgccgccatgaaattccacgccccaaaacgagcaagagttcagccgcccccccctccaaccctcttttga

SEQ ID NO: 11788 - RNA, 951 nt, unidentified
  source 1..951: mol_type = other RNA; note = synthetic construct
atggagctggttgaggcaatagggttgagcgtggccgacatcaatcatgtaattgacacagcccctgccagatatcgcgtgtaccctatcgaaaagagatctggcggcgaaagaatgatcgcccagccatcacgggagctgaaagccatccaaaggtttattcttagggagaagctttcctccttccctgttcatcactgcgcaatggcttatgaggagcacaggagcatttacgcgaatgctcagatgcacaagaatacccgggctatccttaaactcgattttcaggagttcttcccgtcactgaaggtagcagattgggagatgctcgtgtcaaagcttaagcccaacgcaattaatatctctgacattaagctgtactctaagatcctgttttggggccagcagaagggtagcaaattccccaggtgtctgtcgataggagcacccacttcacctaaaatgagtaacctactgatgttcgactttgatagcattgtggccgaaaaggccatcgagcacggactcaactattcccgatacgccgatgacatcaccatttctggcgattctactctcaagattaccactttggaacgcgatatccaaaaactggtcagaagtatgaagtccccacggctgacatttaatgaagagaagcgaggcctgtacacgaaagggcaacgccggatggtcacaggtttgatcatcacgccagctaaagatgtgagcatagggcgtgatcgcaaacgaaacattagttccatgctacatagagacaccctgcgcaaattagacgtcgacagcaggggtcagttgaaagggttcctcggattctgcgcggctgtggaaccacagtttatcgaccgtttaaggcacaagtacggagatgctgccattgaccgggcgatgaaatatcatacccccaagagaagtataaacgaaacatga

SEQ ID NO: 11789 - RNA, 957 nt, unidentified
  source 1..957: mol_type = other RNA; note = synthetic construct
atgtctctgctgctcgaattagtccaacatacagggctctccgccgctgaattgcgaaggattatccagaccgcccccaagaggtaccgcgcatttcctattagtaaaagaaacggaactgagcggatcatcgctcagcctagcagggaggtcaaggaactgcagcgctacctactggaccagaaactcacagggttccccgtgcacgatagcgcgatggcctacgaggcaggtacttcaatcagaaaaaatgcctaccgtcataaaaacggcaactatattttgaagctagacttcaaggagttctttccctcaatcaaacccagggatctggagaatctgattaggcggtcaaaacgggaggagattgctgtttccgacatccctatctaccttaagatactcttctggggcggactggataagtctaccatcccacagtgtctttctataggctccccgtcaagtcctcgcatcagtaatatactgatgtttgacattgacgagcgcatctgctccgaggttcagaaattcgacgtgatgtatacacgctatgccgatgatattactcttagcggcaaaggattggaagtggtacgggccgcagaagacaaagtggtccaagtcgttcgaaagtccagattcccaaagctggaatttaaccgggataagagagggatctattcgagagctgtaaggcgaatggttaccggcctggtgattacaccagtgggcagcattagtataggacgtgaacggaagcgggagataagcgccctgctgcaccgctctagcttgaatcagctcgtgaccgaggagagaggtcacttaaagggtcttctcggattttgtgtcgcatgcgaaccagagtttgtggggcgaatgagggaaaaatatggccacaagacgatcgacgaagcgatgaaataccatgtgccgaagaagcgtgggagatga

SEQ ID NO: 11790 - RNA, 951 nt, unidentified
  source 1..951: mol_type = other RNA; note = synthetic construct
atgcctattctggatgatttagtgagtgacctcggttttagtttcaaggacgtgagccggattatttccacggcccccgccagatacaaagtatatgggattccaaagagggatggcggatttagaattatagctcagcccagtcgggaattgaaactcatccagaggtatatcctggagaacaagctgaacaaatgtaaaatccacgaatgtgcaacagcttacgtgaagaataagagcatttatgagaacgccgaagtgcataagtctgcggacaagattatcaaacttgacttcatcaacttcttcaacagcatcaaacctcgagattggcgcgccatggcccctaagcttgatgggtgcctgtttgaagcctcggacttggagatctatatcaagattttcttctggggccatgtgaaaaatagctccgtcccgcgatgccttagcgttggcgctcccacctccccatctatctcaaacattctcatgtacgatttcgaccaagcagtttttgcagcggcaaaggaccttaatatcaactatactcggtacgccgatgatattaccctgtctggcgactctatttcccatctccacaaaatggaatcacacgttagaaagtccctgaagatcatctcatttcccaagatctcaatcaatgagaagaagcggggtctgttcaccagggcaggtcgaagatcggtcactgggctcatcataacccctgacggaagcatatccatcggccgcgataaaaaaaggctgattagcgccatggtacaccacttcgtgacaggagagatgacagaagaaggaaaagctaaactgaaaggctggttagctttttgcgtggacaatgagattgagtttgtcgagcgtctgcgcataaagtacgggaatgaggctatatctaaggccctaaagtactacataaaaccattgagttga

SEQ ID NO: 11791 - RNA, 981 nt, unidentified
  source 1..981: mol_type = other RNA; note = synthetic construct
atgactatcgggctcctgaaagagctcgggattaaactcggaatggggaggtccgacctgctgaggattatttctaccgctcctaagcgttacaaggtgtatcaaataccaaagagaagaggaggcacacgaactatcgcccagccctcacgtgaactgaaggctattcagagagtgcttctaaaggccgtgctgtcaaagtttcctgttcacgccgctgcaacaggctacgtggagaatcggtctatacttgacaacgccgtcgctcacatgtcttctcgggttctgctgaagcttgatttccgcgatttctttcctagtatcgtcccggatgactggaggaggttggcgagagcaaagttcgttgatctggacgaggatgaggtgtggttaagcactatgatcttgttttggggccaaaaaagcaccaccccccggtgcttatccataggggcgccaacgtcacctatgctgtctaatattgtgatgtatagccttgacgtgaggctcgctgaagccgctgccgctactaataccacatacactaggtacgcagatgacatcaccgcaagcggacccacgatcgaggatgtgcgccagtttgaggcctacgcgcgggagatcgtgggcagatccgtaagcccacagctgacattcaacgaccagaagagaggtatctactcttcggggcagcgacgcatggtcacaggtttagtgctgaccccgagtaatagcgtcagtatcggcagagaacggaaacggttgattagttccatgctggaccattggattaaggattccctcgacaacgaacgcaaggccaggctaaaaggtctgctcgctttttgtatcgcagccgaacccgcattcgtttcacgcctccgtgccaaatatggcgacggccccgtcaacgatgtattgcgatatcatatagtacgcaaaggaccacctccacgacaggccggaaaatcgagctcctga

SEQ ID NO: 11792 - RNA, 963 nt, unidentified
  source 1..963: mol_type = other RNA; note = synthetic construct
atgtcgctgttcgaggatctgctgtttttcaccggtctgagcgccccagacctcagaagaattattgccacttcacccgcgcggtacaagcagttcactatcgccaaaaagagtggtggcgagaggttaatcgcccaaccttctagggacctcaaggtgctccagcgttatatccaggggaatatcctgtctaagggtaccatccacgcctccgctacagcatataaaaatggagcgtctataaagcacaatgcgaacatacataagtacaacagggtgatcttgaaatgcgatttcaaggactttttccattccatcaagccacgagattggattctttatgcccaggagaatttccacagcttgtcacaagacgacgtggggctctgtgcccgcgtcttattttggggcaggggcaccagtaagcccgcttgtctttccataggcgccccaacttctcccgtcctctccaacctgatcatgtttgatctagacgagaaactgacacggtctgcagaaaagatcggggctacatacacacgctacgctgatgatatcaccctaagtgctgacaagattgaaaccgttctgctgcttgaaaaacgtcttaaatccgctgtagcaaaaagcaagtatccgaaactcacttttaacggggataaacgaggactgtatacgaccgcacatcgacgcaatatcacgggactgaacattacacctgatgaagaaatcagtataggacgggacagaaagcgcatgatttcatcaatgatacacaagtacagcatcgggcagttgagcgagaaggacgccggcaaattgaaaggctatctggccttcgcatacgactgcgagcctgactttattgagcggatgattagaaaatacggagaagagcagatcagcattattcggcagttacacctgcctcccaggcaaagagatattgaattcccagagtga

SEQ ID NO: 11793 - RNA, 954 nt, unidentified
  source 1..954: mol_type = other RNA; note = synthetic construct
atgacgcttttcgacgagttatcaatcctgactggcttgggagcgtcagatctgaaccgactcatatacaatgctcccgctcgctataaggaattcccaattaagaaaaggagcggagaggaccgtatcatcgcccagccgagcagagaacttaaaattgtgcagcgatatatagcaggactcgtgctcaacagactgcctatccatagcgccgctaccgcatataaggagggggccaacatctttgccaatgttcagtcccactcggccaatagaatcatcctgaaactagacttcaccgatttctttcacagtatcaaacctactgactggaggaactacgcaaaggtgcatatccccagcctctccaaggaagatgtggaactctctgctaaggtccttttttggggtatgaagagtaatagacccatttgcctgagtatcggtgcaccaacatctccagtgatgtctaatctcattatgtatgacctggacgagcagtttttccaaattaccaatgatatcggcgtaacgtacactcggtatgctgatgacatcaccttgagtgggtctaataaagaaagcgttatcgaagcggaaaaagccatccgcgtcgcagtgcggaaatgtaagtccccaaagctgcttttcaacgagtcaaaacgcggcatttactccactgggcaacgcaggcatattacagggctgaacataacaccgtccggaaaaatctctttaggccgtgagagaaagcggatgatatctagcctgattcacaagtactcactgatgctcctggacgccaacgatgtcgggaagctgaaaggctacttggctttttccctagcctgcgagcctgagtttctgggtcggatgaggattaagtacggctcgacattgattgaggaaatacagaagacccacattcccgccaggaccttacctgagagctga

SEQ ID NO: 11794 - RNA, 966 nt, unidentified
  source 1..966: mol_type = other RNA; note = synthetic construct
atgtccgagctagaccttctgcgcacagtggccctgaatgtaggcctgagtgaagagtctacgcttgagatcataagggacgcaccccagcgttacaaggtgtatccaatcccaaaaaagggcaaaggtcaccggatcatggcacagcccgcaagagaactgaagcccattcagcgcagcattgcagacattgtgctggagaagtttccagtgcacccgagcgctatggcctacagaagaggagttagcattgccgataacgcaaaggtgcacgccggcaagaatagtatccttaagctggactttgagtcattcttcaattccatttcagcggccgcctggcggaggttcatgaaagctcaggagatcatcgagctggaatctcatgaactcgccttgctgactaaggccttgttctggggcgccggccaaaggacaccatactgcttatccatcggagctcctagcagtcctctggttagcaacatcatcatgttcgaatttgaccgccagatgcacgactttgcggaaaaacatgggattcgatataccagatatgctgatgatatcaccgcatcggctcgcgaatttaaaaatttagctgccttcgaacgtcatcttcgaacttacatatctaggaacaaaacacccagcctgaagattaacgaggagaaacgcggtatttattcatcgtctgacagacgactcgtaaccgggctagtcctcacccctgatgggaaggtcagtctgggcagggagcggaagcgagagatcagctccttagtgcataaatctactctcggtcaattggatatagagcagttgggatatctccacggaatgctggcgttcgccatttcttccgaaagggattttgttaaccggctccggataaaatacggggaggacgctatctcatccgtcctgagatacagagtgcctaggcgcgatggaacagctcggtga

SEQ ID NO: 11795 - RNA, 921 nt, unidentified
  source 1..921: mol_type = other RNA; note = synthetic construct
atgagtgacgcctcagtgctggagattatccagaacgcaccaaagagatacaaagtgtatcgcattccgaaaaaaggaagtggatttcggataatagcccaaccagcacgtgaactgaagacaatccaaaggtccattagcaagcttgtactagagaagttacccgtccacgcttcagccgctgcgtaccgacctaaaatcggcattttccataatgccgcggtgcacgcagggacttccccaattttgaagctggacttcgaacggtttttcaactccatcacggctgaggcctggcggcgatttgtggcttcacaggaggagctaaggctctccagaagtgagatggccctggttacccgtgcgctgttttggggtgagggcagtaaaaatccctcttgcctgagcatcggcgcacctacatctcccctgatctccaatgccatcatgtttcagttcgatgtcgaaatgagcaactttgctgaagaacgcggattgaggtatacacggtatgccgacgatatagtggcttcggcaaaggacttcaaggtgctgcaccacttcgagcggcacgttcggcagtacattaaaaagaacaagactccgagccttaccattaatgaaagcaagagagccatctattcacctggcgaccgccgattggtaaccggtcttattctcaccccagatgggaaaatcagcctcggtaggcatagaaagcgagagatatcatctctgatccatttcttccgcttaggacagctcgatcatgagaggctcgggtaccttcaggggctcttgtctttctctctgtccgtcgaacacgactttgtgagccgcatgagcagtaaatacggcaatgatgtcgtgtctgccatcctgaactacagggttcccagacgtgatggctcccctagatga

SEQ ID NO: 11796 - RNA, 960 nt, unidentified
  source 1..960: mol_type = other RNA; note = synthetic construct
atgagcttgttagaggagcttcagacttacagtggacttgggtacggcgaactgggagctgtgctgcgaacagccccgcgtagatacaaggcctatctgattcctaaaaggagcggaggccacagaatgatcgctcaaccggcacgggaactgaagaatcttcagtattttctcatcgataggactttatcaaagctccctgtccattccgcagccgccgcctatagggagaacgtcggaattcgaagtaatgctgccgcgcatgcccgcaatgaggtaatcctcaaactcgatttttcagacttcttcccttccattaaaccaagggactggatgctgttctgcggctctctggatccagaagtggctgaggcatcaggcctagcaaccggggcagacgtcatgttagctaccaggctgctgttctgggggcgtgggacattcgagcccaagtgtttgtctattggtgctccctcatccccagtgctgagcaacgtgctcatgtttgcgtttgacacagcggtcgccgcccacgcaatccagaacgatgtggtttatacccgctacgctgatgatataactctctccagtgaccggtctaagcagattctgctagtggaggccgccatacggcgctacatcaagcggtaccgttcccccgctctcaccatcaacgaggaaaaaagaggtctgtataccagcggtcagaagaagatggttacgggccttgtggtcacacctgagaagcgggtaagcctcggcagagacaggaaacgaatgatctcttctctggttcacagatttacgcttactcaactggaattgccaaaaatagcctacctgcagggaatgctggcattcgcgcgcgacgtggaacctagtttctacgcatcgttggaacggaaatatgggcagcccaccatgagagctctgttggcctttcgcctacccaagagctga

SEQ ID NO: 11797 - RNA, 936 nt, unidentified
  source 1..936: mol_type = other RNA; note = synthetic construct
atgtctgtcgaacccaaacattctctgattagaacttgtgccttggccacaggcctcacaatcaatgaagtggtgagaatagccggcattggccccaagcggtataaaatctaccaaatccctaaacggtccggtggccagagaacaatctgccacccatcacgcgagctgaaggccttgcagtatgttttcttgagagatatccttgcacagttaccagttcactcagccgccacggcctataaaagtgggagttctatcaagcagaatgcctcacgacatcttgcatctcggatcatcttgaagctggactttgagaacttcttccacagcattaaagtggccgactggatggcctatgctaaggcaaccttcccccactggactgcccacgacattgaatttagcctcttcgtgatgttttggggagccggtgggtacaagcctgtgtgcttgtcaataggagcgcccacttcccctctggtgtccaacgcccttatgtaccaatttgacggagtactgagcaattttgccgctgctaatggactcgtgtataccaggtacgctgacgatattacgatatccgcggagggccgtctagataaggacgcaataatggctgagattcatagcgctctcgacttaatcgaatacccgaggctgaaactgaacaccgctaagacaaaactggcttctaaggcaacctccaggcgcgtgaccgggctagttctggcgaacgatgggagcctgagtctggggagggagcggaagcgactgatttcggcaatggtacatcgcgcagtcaggggtcttgctgagcctgatgcgatcgcacatctccgcggcctcctggcttttgccaacgacgtcgaaccaagtttcgtcgcaatgctgcgtaaaaagtacggaagcttcgtcttagatattctccactga

SEQ ID NO: 11798 - RNA, 903 nt, unidentified
  source 1..903: mol_type = other RNA; note = synthetic construct
atgtcaagtctcattgagaaaatttccgctgagactcgaatcagcattccagacgtgaagctcaccgtgcggacggcatcaaggaggtataaggtgtactctatccctaagagagacgggacagcccggataatcgcccaccctgcgcgagaattaaaagccatccagcgggccctgatcagtgagtctcccgcaagcctcagggtacattccgctgcgagtgcctatgaagacggatcatccattgcaaagaacgcaaatatccacgttaaaaattcttggcttgctaagttcgacctggagaatttctttaatagcatcactgtctccgcctggcagatgtatttgagcaaactggaggtcgatgacgagtacgtggaattgtcgtccaaagtattcttttggaaaccagagaggagaaagtctgacctttgtctaagcgtcggggctccatcaagcccgttcgcctccaacagatacatgttcagctttgaccagtacgtttccgactactgcaccaaaaacaacttggcctatagccggtatgctgatgatattgctatttcctctcaatctgaaattgaactgatccatctgcaggaggtgatagaggaaggcctgaaggagagtcggctcaagctaaattcacgcaagacattactgctgggacccggtcaacgccgcgttgtcacaggtgtgatcctgaaaaacgataagaagatttcacttgggcgtggcagaaagcgtataatcgaatccatggtgcacaattacgcaaaaggcaagccttcgtctagtctggaggtgataagaggccatcttgccctgttgaaaatgattgatcccgatggatacaacaggatccgaaagcgctatgaaaactgcaccagcctctttaaatga

SEQ ID NO: 11799 - RNA, 954 nt, unidentified
  source 1..954: mol_type = other RNA; note = synthetic construct
atgtcacgagttctgaccgatatcgctgagcacctgggtgtcggaactgaggatgtgaggaagttcatctttgctgctcccgccagatacaaggtcttcagcatacccaaacgacgcggagggcagcggaccattgcacaaccgagtgccccgcttaaggagatccagcggttcgtggccgccaatcaactggccaccttccctgtccatgacgctgccgcagcgtacataacaggcaagtctattgcagacaacgctgcaagacacaggaaaggcaaatatctgctgaagctggatttcgaaaacttcttcaactctattactgtgaaggactggaggcgcctagtggctctgacacctaaccacgggattaccccacaggaccttcctcacctggaccgcatactgttctggggcggtggaacattttcccctatcatgttatcggttggggctccatcaagccccactatcagcaatatgattatgtttcggtttgataccgccgttagccagaaggccgcggaggtaggtgcagtatatactaggtacgcagatgacatctccatcagtgcccctactgccaaaacctgcttagaggtggagagatttgccgtgtccgcgctccgtgcactcaaatatccaggcttacgctttaaaacggacaaaagggggttgtacgggccaggtcagcgtcgactcgtgacaggcctggtggtaaccccagataatagagtctcacttggccgcgaaagaaagcggaatatttcttccttggtgcataaagccagtctcgggaagctcgatgcccccgagatgcttgaattgaagggactcctgggcttcgtccattctgctgagccccggtttttgcagacgctgaagacaaaatatggcgctgaactggttcagagaatcgcagcgtttgaagtgaagaagctaggagacggatga

SEQ ID NO: 11800 - RNA, 945 nt, unidentified
  source 1..945: mol_type = other RNA; note = synthetic construct
atgagtcttagggatgaaatttgcattgctacaggcatcgggttaagtgagtttgctaggatcgagaattctgctcctgtccgctacaagtccttctctatcgctaagaagagtggtgattaccgcatcatcgcccaacccagcagagaactgaaaattattcagcggtggatttgcgaaaattatctggctagcttccccgtgcacaatgcagcctacgcctatcgcctgggcagaggaatcagtcataatgccagggtacatgcaggatcgaggtacatccttaagatcgacttcaaggactttttccattcaatcactcctaacgatctcttcgtgcgaatcaagttggccaataaggatctctctaaggcagacaaacggacattgtctcagtgcctgttttggggaaaaggtgttaacatgccactctgtctatccattggggcgccaagctctccaatgctgtcaaacattgtcatgttcgactttgatgaacgaatcgcccggatatgtaaggacaagggggtgaaatatacccgttacgccgacgacatcacagttagctccgagggcatagatgagctgttattcgtggaacgcggcatccgggagactgtcaagaactcgaaaaatcccaaaattgagataaacgaggacaaatccagacggtttggtcctggacagcggaagctcgtgacgggcctcaaccttacctctgagggcggcgtgtcaattgggcgaggtagaaaaaggaaaatccacagcatgatgaactccgcaaaatatgggatattgccggatcacgacatcggcatgctgaaaggactaattgcgttctccattagctgtgacgatgatctggtcacccttctgcgcaagaagtacggatcagacgttgtggataggatactgtcctttaaggtacccagcagacgtagatga

SEQ ID NO: 11801 - RNA, 1005 nt, unidentified
  source 1..1005: mol_type = other RNA; note = synthetic construct
atgggcaccttttttgatccagagaactccaagctctgcctacgtttggcccgcgaaactcggatgccttacagcgcactttaccgactggtccttaccgccccgtaccgctacaagacttataagatacagaaggtgggacggccaggacaggttaggatcatccatcaccccgccagagagctgaaaaccattcaacggtggctcgtaaaaaatgtcctctatagcatgcccgttcacagcgcagcctgcgcttatgagaaaaatactgggattaagctcaacgcctccaaacacgtcaataacaactacatcctgaagatggattttaaggacttcttcccctcaatagtgccccgtgacatttttttaaggatgccggctgacacaccttggaacagcaacgatttttattttctgtctagggtgctgttctgtaagaaggataccggcacgaaactctctctcagtataggcgcacccagctcacccaaaatcagtaacatcgtaatgtacgaattcgaccagaaagtgagtgagtattgtaatcagaagaatatcacctacacacgatatgcggatgacatgacgttcagtacaaatcgcagggaaattcttcaggagtgcgaagatttcatcaacggtttggtgagggagatggattccccacatctggaaatcaatgcttcaaagactttgcacacatctaaaaaacaccatcgcagaattacaggactcgtgctgtcgtcccaggggttcgtttctttaggtcgagagagaaagcgcctgattagagccatgctgcataactataagtacaatcagaactcagacgctgacaaaacccaaaagcttaaagggctgttagcttttgcctgtgattgtgagccaatcttcatagacaatttgaaggcaaagtacgaggcggaaattgactgcctactgagcatgaaacctgaaaaaccttacatccggcggctgctgggctctagatccaagtcctga

SEQ ID NO: 11802 - RNA, 1014 nt, unidentified
  source 1..1014: mol_type = other RNA; note = synthetic construct
atgaagtcgctctacgatatttcagaattcacagagaagtctgttgaggagataattgctaactatctaaccgcacccagaaagtataaggagttcaaaatcaagaagcggaatggcggactgaggaccatatctcagccgtccaaagacgtgaagttctatcagtatgccattattgagaagatcctcaaaaacttatcgatccacgattctgcaaccgcctacagggacagcaaatccatttaccataatgcacttcctcacaaaggttctagttggattctgaaactggacttcaaggatttttttcattcaatacgtcccgaacatctgaagagttttctcctggacgcctatgaagacattagcagcattgaggtggatattctcaatcactacctgttttggctggatcggacagatcgaaagctgaaactgagcataggagcgccatccagcccaatcatctccaacatcgtgatgtacaactttgacgagagtgtttgtgatatttgctccaagtattccgtcatttacacgcgctatgccgatgacatcaccctctccgccagttctcgcgagtgcttattggaagccgaggaggagcttaaagttttgatcgaagagacacagactcccctacttgtgctgaacgataaaaagagggtgttgatcgggcggaatagaagcaagcgcgtcactggggtcgtgatcacgcatgaaaacaagctgtcagtcgggagatacaagaggaaaaaagtgcgagctatgctgcacctttactccaatgacaaactgaatgaacaggatatccctatactgcacggtaccttaagctatatcaaatcaatcgaggacaacttctatagaagtctccgggacaaatacggcgatgctgtatttacaaagttggctaaggaatctttcaaaatctcaaagctcaagtactacggcaaggaagagtctgaggaagaaaagactcaaagcaaagacgacaatgacatcgtattctga

SEQ ID NO: 11803 - RNA, 987 nt, unidentified
  source 1..987: mol_type = other RNA; note = synthetic construct
atgctttgggggttgatcttcgatatgaagagtctcctcgaaatcagcaaattcaccggaaaggacgtgacggaaatcatctctaattatttaaccgccccacgaaagtacaaggagttcaaaattaagaagagatccgggggcttcagaacaatcagtcaaccctccaaggacgtaaagatttaccagtatgcaattatcgagaacgtcctgaacaatctgagcattcacgatagcgccacggcttaccgtaaaggcaaatccatctatcataacgcctttccgcacaaggattctatgtggatcctcaaattggattttaaggacttcttccactcaatcaggcccgagcacctgaaatcctatctgctggacgagattaagggaatctccagtattgaagtggacatcctcaatcactatctcttttggatggacaaaactgatcggaagcttaaactctccataggtgctccctcaagcccaatcgtaagcaacatcattatgtacaagtttgacgaaaacgtgagcaacatatgctcgaagttcaatgtgatatatacccgatacgctgacgatctgactctgtctgccaattctagggagtgtcttctagaaaccgaaaaagaactgaaagccttagtggaagagacacagattcctctgctcgttctgaacgacaaaaagcgcgtgctgattggagagcataagtctaagcggataacaggcgtcgtgattacacatgagagtaagttgagtgtcggcaggtacaaacgcaagaaagttaaagctatgctgcacctttatgcaaatggtaagttaaacgaggaggatatccctattcttcatggcaccctggcatacataaaaagcatcgaggacaattactaccggtccctaagagataagtattcagatgcgttctttactaaactgtaccaggagtcattttcaatttctgagcgcaaatacttggggaaggaatga

SEQ ID NO: 11804 - RNA, 975 nt, unidentified
  source 1..975: mol_type = other RNA; note = synthetic construct
atgaaaatcctatcagatatctctgagtgtctgggaaaaggcatcggagagattatctctaactatcttacagccccccgaaagtacaaagagtttaagataaagaagcgcaatggcggatttcgccagatctcccaacccagtaaggagattaagaactatcagtacgcaatcatatccaaagtgctgaatgaactccctatacacgacgccgccaccgcctatcggaataagaagtcaatctatcacaatgccttgccacataaggacagcgcatggattctgaagctggacttcaaaaatttctttcacagcattaggcccgagcatttaaagagttatctgactgaggcttacgaagagatcagttcaatcgaaattgacatacttaaccactacctcttttggatggataagaccgataggaaactgaaactgagtataggtgctccttcctcacctatcatttcgaacatcatcatgctcaaattcgacaatgcagttagcgacatttgctccaagcatgatgtgaattacacacggtacgcggacgatctcaccctgtccgcccaatctaaagaaagcctggagaaagctgaagaagagctaaacgcgcttgtcgaggagactcagacgccattccttattctcaacgacaaaaagcgtgttctcatcgggaacaaccagtccaaaagggtgacaggcgttgtgattacccacgagaataagttaagcgtaggcagacataaaagaaagaaggtaagagctatgcttcacttatacgtgaacgaaaagttggaaaagaaggatattcccgtcctgaacgggttgctctcttacatcaaaagtatcgagctggagtattatctgtcattgaaggacaagtacggtgatgtggtcttttctaaactgagcctggaaagcttctctatttccgggatgttgaagaaaccggaaaaaaaaatgaaggcatga

SEQ ID NO: 11805 - RNA, 981 nt, unidentified
  source 1..981: mol_type = other RNA; note = synthetic construct
atgaaataccttctcgacattttggagcacagcaagaaaaccatcgacgatctgattttcaattacctgactgctccaaggaaatacaaggagttcgagattaaaaagcgctctggtgggtttcggaaaatctctcagccctcatttgatgtgaagctgtatcagtatctgataatggaaaacattctggcaaagctgcctatacatgatgcagcgaccgcctacaggtaccataaatcgatctatcataatgccttaccacataagaactctgactggatactgaagttggactttaaggatttcttccacagcatcaggcccaaacatctcaagtctattctcactgatgtctataaagatatcagttccattgagattgacatccttaatcactatttgttctggatggatagaggggaccaaaaactcaagctgagcattggagctcctagtagtccgatcgtctccaacattgtcatgtacaagtttgatgaaacagtgttcaatatgtgctcagaaaacaacgtgatatacacccgttatgcagacgacatcacgctgtctagtgatagcagaaacattctgttgaaggttgagtcagagctgaaaaagatcattgccgatacccaagagccccttctcatcttgaataataacaagagagtgctcttaggtaaacagaagtcaaaacgcataactggcgtggttatcacccacgaaaaaaaactgagcgtggggcggtacaaacgaaagaaaacgaaggccatgcttcacctctacgtaaataacaagctaaaaaaaggcgacatacctatcctacacggaacactgtcctacatcaatagcatcgaatccgagtattaccagctgttagaacttaagtatggcaaggctacatttcggaaactgacaaaggacgccttttatatctccaagatgaagtacaagaacattaacaagaacgacatggacaattga

SEQ ID NO: 11806 - RNA, 1005 nt, unidentified
  source 1..1005: mol_type = other RNA; note = synthetic construct
atgaaaatcctgaaagacttaagtgagaaacttgatatcgatgttgacgatatcatctcaagttatctgactgccccacgaaagtacaaagaattcaagatccccaaaaagagaggggggtttagggatattgcgcagccttccaatgagataaagatctttcaatacggcctaattgacacctttcttaaaaacttccctatacacgactgcgctaccgcctatatggagaacaagtccatttacgataacgccctaccccacaaggacagtaagtacctgctgaagttagatttcaaggacttcttccattccattagacccgaacacctcaagttctatataaacaagtacaatgagggcatctcgaatatcgagatcgacataatcaataacttcctgttttggatggataaggaagataataagctgaaactttgcatcggagcaccatcctcaccgatgattagtaacattgtcatgtacgactttgacctggagttggaatctctgtgtaacactaacaatgtgatctatacccgatatgctgatgatcttacactgagcagcaactcaaactcatctctgatggaggtcgaaggattcctgaataaaatcgttgagcggacacagatccctctacttgaactgaacgattccaagcgtgtgtgtataggggacaaaaaaagcaaacgcgtgacaggcattgtaattacgcacaataatcagctcagcgtgggacggtataagaggaaaaggattcgggccatgctccatttatacaactgcaataagctcaatgagaacgacatcccaagactccatggtctgctctcttttgtgaaatctattgagcccgactattacgatttgctcaagttgaagtacaatgaaaatctgctgaagcagttggcaaaagaatcctacattatttctcgcaaatggtatgtaagctttaataacgacagcttgaacgtgggtgacgaggacgatatagtcttctga

SEQ ID NO: 11807 - RNA, 981 nt, unidentified
  source 1..981: mol_type = other RNA; note = synthetic construct
atgaatatcttaaaaaccctcatagaggtgctgggcgtttcgtatagctctattttcaaggactccctgacagcctcaaggaagtataaagaattcaccatcccgaaaaaaaagggagggcggcgtaaaataagccagccctcagaagatgtgaaaatcgtgcagtctgccattagctcagttctactgaattccctgccagtgtctgattatgcttacgcatacattagaaacaggtcgatttacgataatgcattcatacacaaggaatcctctttcctgttgaagctcgattttaaggattttttccactgcattcggccagagcacctcaagtattacatcaagaagaacattagtgacatctccgatatggaagttgacatcgtcaacaatttcctgttttggttcgacaatgacgacaacaagcttaaattatgcattggcgcccctactagccccctaattagcaatatcgtaatgtacgagtttgacgagaaaatatccaagatctgtgaggattttgatgtaatctacagtaggtatgcggacgatattacactgtcttccaataacagagacgacatcgatacagtcgagatcaagataaacaacctgattaaggagactaacatccctcttctcaagctgaacaaaaaaaaacgagtgtttgtctcacagcatatgagcaaacgcattacgggaatcatcattacccacgacaataagctttctgtggggcggtacaagagaaagaaaatcaaagccctgctgcatctgtacaataaccgcaagttaaaagacaaggatatcccttatcttcacggtttcctcagttttatcaaaaacatcgagcccgagtatttcaataagttgaagtccaagtacaacgaaaagttgtttcatcaactcgctaaggaaagttacatactgagcaaaaaggagaaagagaaggaaatgattacccatgaaaaattgtga

SEQ ID NO: 11808 - RNA, 1008 nt, unidentified
  source 1..1008: mol_type = other RNA; note = synthetic construct
atgaacaagttgaacatactcaatgagatttccaacgacattgacgtcaatatcggcgagttctttaattttagttccatggcaccaacagcctatagtacgttccaaatcagaaaaaagagcggcggtactcgcgagatctctcaacccgcccagtggctaaaaagcgttcagtatgcgattatccaaaaactgttagaacagctccctatccactataccgctactgcctatcagaagggaaaggggattaaacagaacgctgaagcacacatcaacaaaactttcatactcaagaccgactttgagaacttttttccaagcatcctgcagagcgatctggaactgatcttgaaacggaataacatcgagattaattcctttgagtactctgtcatttcacgattccttttcaagaagaagaatgactcgaataaactggagctctgtattggagcacccagcagccctatgatctccaatgtggtgatgttcgaaattgattctttattgtccgagaagtgcaatgagttggatatttcctatacacgatatgccgacgacatgacgttcagtagtgacaagtacgaaaacgtagagttcatactcgagtttctgaaacagacaatcctgaaggtggaatcaccgcagctgatcctaaacaacaaaaagaccaagatcatctcaaagggaaggtcccaacgggttacaggtgtgattctttctaacgacggccgcgtatcaatcgggaggaataaacgtcggagagctaggaccttgcttcatctgctggaacttgataaggtggacgataaatctctggtggaactgtacagtatagtgtctttcatgagaaacattgagcccgagttctacgagatattaaaggaaaaatacgggtacaatctgtttaagaagctctacaaaaagttcagcctcctggtcgaaaaacataccgatcagtcaactggcatgaagcttaagtttaaaggctttaacgttgattga

SEQ ID NO: 11809 - RNA, 1038 nt, unidentified
  source 1..1038: mol_type = other RNA; note = synthetic construct
atgaatattgttaaagtgatctccgatctgatcaaccaggacattacttatatgttcctgttgagtgcaacggcacctgaggcttacagcaccttttacattaacaagaaatcgggagggataagggaaatttcacagcctagtaaggaagtcaaggaagtgcagtacgtcattattaaggaaattctttccaagctccccgtgcacgagtgtgcgaaagcctataagaagggtgtaggcattaagcagaatgccgttgaacacctgaacaaagagttcatcctcaaaaccgacttcagcaacttttttcccagcatcaaaccggctgacctggaatactatttcaagaagaacaacatcgagatcaacaatctcgagttcgacattataagcaagatcctcttcaagaagaaagaaaattccaataagctggaattgtgcatcggggccccttcctctcccattatttctaacatcgtcatgtacgagattgatgagcttctgtactctcattgcaaggaacgcaatatctcctacacccggtatgccgacgatatgacctttagcagtaattccatagaggacctaaaggagatcctgtcaactctcaaaaaggtgatcatcaagaacaaaaacccagagttaatcctgaatcaaaagaaaactcgactgatctcgtcaggaaggtctaggcgcgtaaccggggtgatacttagcaatgaaggcaaactgtctgttggtagaacaaagcggcgtagaactagaaccctgttgcacttacttagtaagtcatccattgacgacaaatctataatagaactgtacagcaacatctcatttattcggaacattgagccagagttctatcaaaaactattgtccacacatggccagagtacgttcaacaagctgaataaatcttttcagagcctcatcgagaaaaacacagacaataatggctttacatggcgatttggaataaatggcgatagcttagtgaaaaaagtgatctatgaggatgatgatatccagttctga

SEQ ID NO: 11810 - RNA, 966 nt, unidentified
  source 1..966: mol_type = other RNA; note = synthetic construct
atgagctatatagacaacctctcccgggtactgaactgcagtgtcatgtcgctcatttctggctacattaaagcccccaagaaatataaggtgttctacatcaagaagaagaatggtaaaggacttcgcgagatagctcagccagcccccgatatcaaggaagtgcaacgagctatcgtttctactctgctggctaagttaccggtccatgagtgtgcaaaagcctatatcaaggaaacaagtatcctgaacaatgcggagcctcataaggaaaacaagtatattctcaaggtcgacttcgagaatttcttctatagcattaagccacaggatctgtacttctacctcctgcgcggagaaataaagttgacccagtttgagtacgagatcctgtcccactacctgtttagaaggaaaaagggggaaaaaaaactgagattatgtataggcgcgccatcatcccctattattagcaacatcgttatgtacgacttcgactgcatcttgtctgactattgccacctaaacaatattgcctacactagatacgcagatgatatcacactatcctcagagtcatacggcaaaatcaaagatgcttacagctttattgcccgcgtggtgagcgacctgaaaaaacctgaactgaagataaacagtgacaagaccaagatcataggaaaaggccggagtaggcgaatcacaggcgtgatcatctctaatacgggggaattaggagtgggtaggtttctcaggaaaaagattcgtgcactgacccacctgtattcaaaccacaaactttccgaaagagacattccctacctcctggggatgttggcacatattaaaaatatcgagccctcctattatgaggccttggtatctatccacggcgataatctttttaagaagcttgggaaagacagctatcggattctcgagaacaagcggggtaatgataactga

SEQ ID NO: 11811 - RNA, 954 nt, unidentified
  source 1..954: mol_type = other RNA; note = synthetic construct
atgtcttacattgacgaattgtcaaaaacccttaattgcactcctaagaccataatctccgggtacatcaaagcccccaagaaatacaaggtattcttcatcaagaagaagaatgggaaggggttgcgggagatcgctcaacccagcccggatgtgaaaaaagtccagagggctatcgttaatagtctgctgtctcttctccctgtgcatgaatgtgccaccgcttatatcgaggagaaatccatctttgacaatgcagaaccacataagaagaacgagtatattctcaagatggactttgagaactttttctacagtataaagcctcaggatctgaattacttcatctccaagaacgacattaaactgaaccacttcgaatatgaagtgattagccattatctgttccgcagaaaaaagggcgagaaaaagctacgactgtgtatcggagcccccagctcaccaattattagcaacatcgtcatgtacgattttgatgagaagctctttaaccactgcaaagagaatgatgttatatacacgcgctatgcggatgaccttacattctcctctgacagtttcgataaacttaacgacgtaaagaactttgtgattgacttagtgtcactgcaaaaaaaaccagaactcatcatcaataccagcaagacaaaattcattggcaaaggtcggtctaggcgtatcactggagttgtgataagtaatacaggcgacctgggcgtgggcagatttctaaggaagaagattagagccctgttctacctctattccaacaataagatcaaccacaaagatattccttacctgttgggaatgctgagccacataaagaatattgagcccgactactattattcgctgattaagatcaacggtgaagacaagttaaaacagctcgggaaggattcatttgcagtcttgcagaagaaacagtga

SEQ ID NO: 11812 - RNA, 969 nt, unidentified
  source 1..969: mol_type = other RNA; note = synthetic construct
atggggtacttgaatgatctggccggcagtttagacagcagcgttgctagcctcatttccggctaccttcaagccccaaggaagtacaaggtcttctatatcaaaaagaaggggtctgacaagttacgggaagtggctcagccttctccggatgtaaagaacgttcagcgcgccatcgcctcaacactgctgaaccagctcccaatccattcttgcgcaaaagcctacatcaaggacctaagtatatatgataacgctaaagagcacaaaaccaacacatatatccttaaaatggactttcgtgacttcttcccctcaatccgacctaatgatctgctcctgtgtctggagaagaatagtataaagctcaacgattttgagtacaccattctcaagcactacttgttctggagaaaaaggggggacaacggtcttagactatgcattggagcgcccagcagtcccattatcagcaacattgtcatgtatgacatcgactgtaaaattgatagcatatgccaagctttgaatatcccttatacacgatacgcagacgaccttactttttcaagcaactcaatcgataccctgaatatcgtgttcgacaaggtcaaaaatattatatcgtcccaggaatctccacgtctgatcatcaaccacaacaaaaccaagtttattggaaaaggcaggtccagaagaattactggtgtgatcattacgaatgatggacaggtaggagtgggcaggtacctgcggaaacgcgtgagggcactgctgcatctctactctaataaccgcatcaaggtgaatgatattccttatctgcaggggatgttatcccatgttaagaatatagagcccaagtatcacgaagagctgcttaagaaatacaacgagtccctcattaaacgcctgaatttggatgcctcccggattatcaaggaaaaccggagaaatggcgtgatatga

SEQ ID NO: 11813 - RNA, 960 nt, unidentified
  source 1..960: mol_type = other RNA; note = synthetic construct
atgtcgtacctggagcacctcgcgctttcactgaattcttctgtggcaagtttgatttcaggttatctgaaggctccccaaaagtataaagtgttcaagatccgcaaaaaaaacaataagtccttccgggagattgcccagccatcccctgatattaagaacatccagagagctataaccagcacactcctgaagaatatacctatccacccctgtgctaaagcctatatcgaagggctgtccatctacaataatgcctacgagcatcgggagaataactacctgttgaagatggatttcaaaaatttcttccccagcattaccccaaatgacctgttactctgctttaagaggaacaacatcgagctgaacaattttgagtacaacattttgaagcactacctgttttggagaaaacgcggagaaagatctctgcgactttgtatcggagctcctagtagccctaccatctcaaacatagtgatgtacgaatttgactgcaagattcacgagtactgcataactcacaatatcccctatacacgttatgccgatgaccttacgtttagctccaatgaaatcgaaaagctccatgccatctatgattacgtaacctctgttattctggagaacaagtccccgaacattacaattaacgattcaaagacacggtatatcggcaagggtagaagtcgacgggtcactggcgttatcataaccaacgaaggcaaattaggggtcgggaggtatcttaggaaaaaagtgaaagccctcctctacatttacaacaataaggacttacgcaaggaggacattccgtatctgcagggaatgcttgcgcatatcaagaacatagaaccatcttattacgagaaactgctacagaaatacgagccaagtctactgagcaggttgggcaaggaggcagcaactattatcaaagaacgtagcctcaattga

SEQ ID NO: 11814 - RNA, 972 nt, unidentified
  source 1..972: mol_type = other RNA; note = synthetic construct
atgtcctatctggatgagctggcaaactatttagagaagtctgtcccatatctaatcaggaattacattagtgctccaagaaagtacaaggtcttttacatcgacaagaaaaatggatccaagaaacgggaggtagcgcagccgagcaaggaaataaaagagatccagagagctatcgtgaaaacccttctggagaatattcctattcactcttgtgccaaagcatacatgaagaactcctcaatctacgataatgcactgcctcataaggacaacgtgttccttctcaagatggattttagagatttctttcctagtatcaagccctccgatcttctgtacttcctggagcgaaatggtcttaagttcgatgccttcgaaggcacaattgtgacaaattatctgttctggcgacgtaaaggggaaagaaaattgagcctgtgtattggagccccaagtagccccataatctcaaacatcataatgcacgacatcgacagcgaaattaacacttactgcgaaaaggaggacattatctatactcggtatgccgacgacctcacatttagcaccgataatattgttaaactccagaagatccatgactttatttctaacctcaccaatcgcactgagcatcccaagctgctcatcaacaaggaaaagaccaggtatataggcaaagggcggtccaagagggtgacaggtgtggtcattacgcacgaaggagaattgggggccggccgctacctcaggaaaaaaatacgcgcaatgatctacctgtatagccaaaagaaactgaagaaagaggatatcccctatttacacggcatgctatcacacatcaacaacatagagcatgactactacatcaagttgaaaaagcagtacggagccgcgatgttttctgctttgtatcaagaatcgttctgcatttcaaaaaaggagaaagaggctgacaaagttatttga

SEQ ID NO: 11815 - RNA, 975 nt, unidentified
  source 1..975: mol_type = other RNA; note = synthetic construct
atggaacttatcagcaaagtcgccgagcaccttggactgcctatgcatgagctaatttccaatatgcgctccgcaccaagcatgtacaaggcattctctattaaaaaacggaatgggggggatcgtatcatacgccagccttcccccttcgtaaaaaatatccaacgcgctattgttgatattgtgttttctggtatcgaccggtcagaattcagcatggcatatgagaagggcaggtcaataaaggacaatgccctgatccataccggagccgactttctgctcaagatggacttcaaggattttttcccgtctataaaacctagcgacctattccggactttgggtgatctcggatacgattttaacgatcttgaccggatgtttctgagtagatatttgttcgtggaggtcggctccttgctggagctgagcattggcgccccctcatctccaatgctctccaatcttgtgatgaagcactttgatattgctatcggggacttctgtcataaaaactccatcagatactctagatacgcggatgacctcaccttttctggttgttgctataaggatctcaaaaaagtagaagctcacgtggtccatattatttcgttagacaacaagagtaacctcctggttaacgacaagaagactaggctgatagggaaaggaagaagccagcgcgtgacaggcgtgatcctgacacacgacgggaatatctcggttgggcgaaatttgaggaaaaagatcaggggactggtccacttgtactcaaataagaagctgaacaacagtgatatcccctatttacacggcatcattagtcatatgcgtaacatcgagccagaatattacgaaaagcttatagtgctgcacggcgacgtgctgttcaaaaggctggccaagcagagctacgctattggcaagcatctccgatgcgcccacctgaaaacgggtttagtcaagtga

SEQ ID NO: 11816 - RNA, 960 nt, unidentified
  source 1..960: mol_type = other RNA; note = synthetic construct
atggaaatcatctctgatctggcggaggagttaaatgtgtcgatcattgagctgataaatcagatgcagcaggccccaaagaaatacaaggtgtacagcatcaagaagaggtccggcgggtctaggattatagcacaaccaacagccttcgttaaaatggtgcagaagggcctatgcacatcttttctgagtcagtttaagtattccaacagcgccatggcttatgtaaaagaacggtcacccatctcgaatgcaaacgtccatgtcggagccaaactgatcctgaagctcgatttcgaaaatttcttcccgtccattaaagctgctcatttcattgagttcttagagcgcaataaggtgaccctggaatcacttgagattgactttctgattcgatatctctttagaaaagtgaaaggcagctatgaattaagcatcggggcgccttcctcccccctgatcagtaatgtgatgatgtatgattttgacctcgaaattgaagaagccctcaaggattctctaatcaattatacccggtacgcagatgacctgactttctctgccaacagctttgaggagcttaacgaagctaaactcttcgtcgaggctgtaattctgtctaagagatacagtttcttgaagatcaacgaagataagtccaagatcatcggccgcgggcgatcacaaagggttacaggaataaccctcactcacgacagtaagattagtatcggaaaatcattgaggaaaagaatacggggcatgcttcacctttacaaccagaaaaagttgaagaagaacgacatcccctacctgcacggtattattagccatatgcgtagcgtggagcctgactactttaagaaactgatcgacgtttacggtgcagagttgttttcacgcctggccagacagagcttcatgatatccaaggagacgaaaatgaaactcatggagtga

SEQ ID NO: 11817 - RNA, 957 nt, unidentified
  source 1..957: mol_type = other RNA; note = synthetic construct
atgtcaaacgagagcattaccgatataatttgtaagagcttgagtcttctcgcccacgagcttctgatcaaagcgatgaaggcccctctgtcatacagagtttatactatccccaaaaggagcgggggtaaacgtacgatcgctcagccaactgctgaaatcaagaagatccaacgctgcatcgtaaagacagtgctggaccccctccctactagcgacattagtacagcctacaagaaggacatatcgattaaagataacgctgaacgccatctgggcaagaagttcatcctgaagatggacttcaaagacttcttcccatcgataaggcctgaagatctcataaactctctggaaagaaataatgttcggctgtcttccgccgacagaaagattctcatcttattcctatttcgacggaacaactatggacgttttgaattgtcagtgggcgctcccagctccccgattgtgtccaacataattatgtacgagtttgatatcgcagttaaagagtactgcgagaagaataacatagtgtttacacggtatgcagatgatcttacgttctcctctaactccattgaggacatcaaaaaaacccccgccattatcaagagcaatctaatgctgatggattctccaaaattgtctatcaacgagaaaaagacccatattgtgtctaagggtagaagtcagcgcgtgaccggagtcacccttacacacgataacaaattatccatcggccgaaatctgaggaaaaagatcagggcaatgctgcacctctacaagaataacaaactggaacacaatgacattccatacttgcacgggattatctcccatatgcggaatatcgagcctgagtattttaataagctgctcgaatcatatgacgatgtcttatttaaggacctggccaaagtcagtttcaatgtaagcaaagtgtacaagtga

SEQ ID NO: 11818 - RNA, 966 nt, unidentified
  source 1..966: mol_type = other RNA; note = synthetic construct
atggagaatctgcttaaggaaatctgttcctcaagcgacctgtccattcaggatgtcatcaaggggctttctacagcgcccttggcttataaagtctacacgatccctaaacgcaccaagggcgagcgggtaattgcacagccttctccttttgtgaaggaagtccagcggactctgatttctgttttcctcacgaagtacaaaccgagcgaagtgtctaccgcctatgtggagggcaagagtatcattgacaacgcagaggcccacaaggacaacgactggatcctgaaattggactttaagaatttcttcccctcgctcaaacccaatgaccttttcacattcctggaaagggagggggtggtgataggtgaatttgacaaaaagattctctcctcatacctctttagacgaaataaccgcaaattggaacttagcatcggtgccccatctagccccttggtaagcaatctcataatgaagtccattgacaataagatcgagggctattgcaacgataactcaatcgtgtataccaggtatgccgacgatctaaccttttccaccatggatctggataagatcgacgctctaaaacaatacatagccgccgtcttaagtgagacaaagagccctaaactgtctatcaacgatagtaagacaaaggtgattggccgcggaaggagcagaagagttactggaattgttctgactcatgagaataaactgtccgttggacgatatagtaggaaaaagatccgggctatggtgcatcactactcgaaccgtactatcaaaaagagtgatattccatacctgcatggcgtcattagccacatgagatcagtggaaccagactactaccagaaattagagataaagtatgggagcgattttttctccaagctggctatggattcctacaaaatctcaaaagcagtgaagctcaagaagctggtaaaatga

SEQ ID NO: 11819 - RNA, 966 nt, unidentified
  source 1..966: mol_type = other RNA; note = synthetic construct
atgaccaatcttctcaaagagatttgtgaaaactctgagatccagttgaccgatattattaagaacctgaacacagcatctatttcctataaagtgtacgacataccaaaacggaccaaaggcgtgcgcactatcgcccagcccagttcatttgtgaaggacgtgcagaaagtcatcacaaaagttttcctctctgagtttaccccaagcgatgcttcattcgcctatatcgagggaaagtcgattgtggataacgccgctatccataaggacaataagtggatactgaaaattgacttcaaggatttcttcccgagcattaaacctgaggacctgtttaatttcctggaaaaggaagagatcaagctgtctgaatttgacaagaagattatctcctcttacctgttcaggctgaacaatagcaagttagaattgtcaatcggggctcctagtagccccgtaatcagcaatcttgtgatgaaagaattggatcaggaaatcatccacttttgcgaggaaaaatctattgcgtattcccggtacgcagacgatctaacatttagcacaaataacatagcctacttttcggacctcttaccctacatctatgagcttcttagctacactcaatcacctaagctcagtataaacgacaaaaagaccaagattatcgggaaaggtaggtcccaacgaattacgggagttgtcattactcacgaaggaaaactatctgtcggcaggtactttagaaagaaaataagagccatgttgtactcctataactcaaacaagatcaagaagagtgatattccatatctccatggcctggtaagccacatgcgtaatgttgagtattcctactacgagaagctggaggagaattatgggaaagagttcttccgcaaactggcaatggattcctacaagatcggtaaggctatcaagctgaacagtataaaatcctga

SEQ ID NO: 11820 - RNA, 912 nt, unidentified
  source 1..912: mol_type = other RNA; note = synthetic construct
atgtcgactgctatcgaaaaggtgtgtaaggacctggggtttaccgaagagaaattcattgagttctgttccctagcccctcaccggtacaagaagttctttatcccaaagaaaaacggtgccggactgcgcttggtggctcaaccggctcggccactcaagaaggtgcagcgttggctggtcagcgaatacctgtccaaattaccaatccatgaggccgccgccgcctatgtgtcagagaagagcatcctagacaatgccaagaagcacgcaggcaacaaggtgctcgtgaaatacgacttcaaggatttctttccgagcatcaaaccctctgatttccttaaactgatatcaaagaacgatgtaggaatcagtgcatatgaggcagaaatatttagccgccttatattctggtcccctggtaaccggcctggccttgagctttgtattggggcacctagtagccccgttatcagtaatgcagttatgttcgattttgacaatgctgtctctgagttttgctcatctgaatccctgatttacaccaggtacgcggacgacatctgcatatctggctacgacaattcaatttttgagcatgtggataggttcattaagaaacaggtgtttgaaatcgaaagtcccaacttactgctgaaccccaataaaacgcaattcattaacgaaaacaccgtcaaaaaggtcacaggactcttcattacacagaatgaggagatcactgtcgggagaaaactcaaaagaaaggtgagggcgatggttcataattttcacaaaggcaatctctctgctaaggataaagagcgactgaagggctatctgtgctatttgtccgatgttgacccctcctatttgagaaaagtagccccagactttcagagctgggatctgtga

SEQ ID NO: 11821 - RNA, 1941 nt, unidentified
  source 1..1941: mol_type = other RNA; note = synthetic construct
atggatactattatcgaatacttcagcaagatcgatttcactaaagtgagaaccaatcagcctcctgagttgatttttctgtgtggaggcaatagcgaccaaaaggcaaataactttcgcccgaaattgcaaaacgagctcattaaaaagcagagaaatgtggtactggccgagaatgcgatgaactggcagggcggccaagttttcgctaaagaccttttggagttagaaaagtactacgccgccctggtaagcattattccacttatttgcgagagttatggggccgccgcggaattcggagcatttgtgactgatgagttcataaggaagaagctcttcattattatcaaggagcagttttactcaggggagaactcaagcagttttattcggtacggccccattaaaaaatatgaggactcggagaatagagagacatactgcattaacaacgagaaccccgaagaagacttggaggacctctgtgaaacactgctggcctgtaaacccaaaacctcaaaatgcaatttcgatgaaggttacttccggatattgttactcatcgatatcatcaacgtgctaagtatctctacacataaagagatcaagtccattttcgaaaaagttttgtcaatcatcggattcgatcagctctctatcgacacgtattgcgtggacctgaatgagatgctgtttgtcctggaaaagctccgcctgattaaactgcgacagaaggggcagaggagcttctatctgtctgtgtctcaggagttttacctagagtaccgctttatcaaagattctaacgacaccaaactgtcaaccatacgaaaaaatgttctggactatatctacgctcaggaaactcgcatccaaaaaaccaaggtcagtatactcaaggaagaattgaagaaaggcgaaataaaatggctgcaaaccaacatttcccttgacgacattaatattgacgagcttctaaagacggctccattacaatataaggtgtacgagattccaaaaaagtctggagggaaacgaaccattgctcagccaactgccaagcttaaaatactgcagagagagaagatcctcgaattggaaaatacattccctgtgcataactgtgccaaggcatacaagaagaacaataatggtatcttcgagaatgctaaggcacaccaggacaactcgtatttttataagttcgacttcgaggatttctttgaatccatcaaagcacgggattttaaccagtatctgctgcagttcggttactctctgaatgagcggatcgatctcatcatgctctttttcaggtttaacaagcagtccgataagcgtaagacaaacaagatctataagctgctatacaacagcgacttcaacaagtctaacaacatgagccttcttaatgtcatggtgaatgagttttctaacgagtttcagctgtccgtcggagcaccttccagccccttcatatcaaatgctatcctttatgagttcgatgatatgacgcagaaatgggcttccgaaattgggatcacctacacacgctacgccgacgatattacccttagcagtaggtctaagtttgagatcgcggacctcgaaaaagagatactgaacatatcctccaagatgaattttcccaaactgaagctaaataagaggaaggagaaatactgcagctttaaaaatagagtctccataacaggcctgaacatcaccccggatcataaaatttcgatcggtaggaagaagaagagagaaatcagttcaatgattcaccactttaagttaggaaagctcagcaaggacaaaatgaaccggctgcgtggctggctgagttattgtaaagccgttgaaaattccttcctggataagatgaaaatcaaatatagcgaggacactatcttagaaatcctcaagaagaactga

SEQ ID NO: 11822 - RNA, 1941 nt, unidentified
  source 1..1941: mol_type = other RNA; note = synthetic construct
atgcagataatcacagattatttcaagaaggttgacttctctaaagtgcgcactaatcacccgccggaactcattttcctctgcgggggcaataacgacgaagaagcaaacaatttccgccctaaactacaggacaaactcgtaaagaaacagcataacgtgatattggccgagtcagcgatgaactggagaggcggccagaaattcgccaaggatctgctcgagttagaaatttactttgctgccctcgtttccattattcccttgatatgtgagtcatatggatcggccgcagaattgggtgcttttgtggcggaccagtttatccgcaagaaactcttcatcataatcaaggaacagttctactccggagaaaattcatctagctttatccggaacggtcctatcaaaaaatacgaggacagtgagggccggaaaacttattgtatcaatgacaagcaccccgagcaggatctggacgatctttacgaggctcttctgtcatgtcgtccaaagactagcaagtgttattttgataaagggtactttcgaatcctcctgcttatcgacatcattaacgttctgtcaatatccaccttaaaggaaattaagatctcctttcaggaggtcctatctatcatcggcattgatcagcatgagatagagagttattgtgacgacatcgatgagatgttgtttgtgctggaacagttgaatctgatcaaatatcgcaacaagggacagcaaggattttatctggctgtgagtcaagagttctatttagagtacagatacgtcaaagacagtgacgataccaaactgagcaccattcgtaagaacatcctcgacacaatctattctcaggatagcaggattaacaagaccaaggtcagtattctgaaagaagaaagaaaaaagggggagatagcatggctccagacaaatatcagcctggatgacatcaacgtacacgagcttctcaagacagcacctctgcagtataaagtctacgaaatccctaaaaagtctggaggcaaaaggacaattgcccagccaacagcagagctgaaagcccttcagagaaagaagataagtgaattagaggacaaactccccattcataactgcgcaaaagcctacaggaagaataagaacggcatactagataacgcgaaagctcataaagacaactcgtacttttacaagttcgatttccaagatttcttcgaatccattaaggcttgcgattttaaccagtttttagagcagcacggatactctttttccgaacgagtggaccttatcaaattgttcttcaggttcaataagcagagcagcaagcaaaagaccaaacgggtttaccggtacctgactgacaactccttcaatcggaataataatcccgctctgcttaatctgatgattcaagatttcgccaatgagtttcagctgtctgtgggcgcaccctcctctccttttatctctaatgccatactgtttgagtttgacgacatgatgcaaaattgggccaacgagaacgacatcacctatactaggtacgctgatgacattacgctgtcatccaagagtaagattgatattagcagcatggagaaggagatcctaaacatatgctccaaaatttcctttccaaccctgaagctgaataagaagaaggaaaagttctgctcattcaagcaacgggtgtcaattaccgggttgaatattacgccagatcacaagattagcatcgggaggaatatgaagcgcgagattagcgccatgatccaccatttcaaatccgggaagctgactgtggataagcttaacaaactgcgaggttggctcagttattgcaaggtggtcgaaagcgagttcatcatcaaaatggaaaacaagtacagcaaaaacaccatctctgccattctgagaaaaaaatga

SEQ ID NO: 11823 - RNA, 1515 nt, unidentified
  source 1..1515: mol_type = other RNA; note = synthetic construct
tacattattttctccgatattaatcctcacgatgaacttgacgaaatctgcacgatcattaacaattataagcctgagactatcaacagcaatttcagccacaactatttcaaaattctcctggttctggacttaattaacgttctcgcaatcagttccatagacgaaattaagatacatgcggaagcagtgctcaagaagtttgacaaaaactatgagatcaacagaaagaccgttaaggagatgctgtttgtactaaaaaagctcgatttggtcgtggagattaacaagatcaaccagtctttttacctgagtaaatacgacgatctgttcctggactataacccccatcagtataagctgttcaacattaagaaggacatcatcaatagcttctatcagtcagatgagagtaacactagcaactatcggaaatatcaaatattctccaagtactaccgttactataaagaccaggagaacaattcgaccaaaaaagatatcgagaaagaggtgaaatggatcaataagaccctggattacgaacatattgataccgatcaagtgattcagatcggaccaatgttgtacaagaagttcaagatcaagaagaaaaacaagggttatcggacaatctgtcagccaacagctgagctcaagcaaatacagaggaacgaacttaaaaagctttacaagcaattcctgatccatgatgccgccaaagcgtacaagaaaaacattaacgggatcttagaaaacgcctcggaacacctgggtaacaactttttctacaagtacgatttcaccgactttttttctagcataaaagccgacaatttcattggctttctcaaacgcaattcttttgaagacaataagatccttcgcctaatcaagctgttttttgtgttcgacaagaataacaagtctgagatcaagaaggcttatgagattctaaaaagcaaccgatccgacataaatgcctttccgcgatggtttaaagacaatctctctctgtccataggcgctccttcttccccctttattagcaatatcattatgctcgagttcgatagcatagtctttgattgggccaaaaagaatcagttggtgtatactagatacgcagatgaccttacattttcaagcaaacacagtttcgagtccaaactgattcagaagctgatcaacgacacaatcaaaaatatagactacttgaacctgagacttaatatttccaagatccggcacttcaacattaaagagcatgtgtccataaccggcctctcaatcactcccgataataaagtctcaatcggaaaaaagaggaaaaaggagatcaatgcattgatccaccagtataagaataacgacaattacagtctgtctaggcaacagatcctgcgcattaaaggcttactggctttttgcaaaaatgtcgaaacggatttcttcttgaatctccagaaaaagtacgggaataaggtaattaaagacatcctgtcagaaaagtga

SEQ ID NO: 11824 - RNA, 1041 nt, unidentified
  source 1..1041: mol_type = other RNA; note = synthetic construct
atgtcttacctcataaaggtcccttcatatgttgagttcctaaaaaaggtgtactctctgatcagcaagatttccaacgatctgcttatttccgaggagaagattaagaacgtcattgatagatcatccctgctgtatcatgagttcacaatcgttaagaacaacaagtcccgagtaatccataacccagctaaggagttaaaggctatccagatctacttgactaatatgttcatcaaacaggcaccaatacacgactgtgcctttgcgtatcgggaaggcatctcgattaagaactgcgtggagaagcatattgatagtaactacttcttcctgacagactttaaggacttttttcactccattatgttcgatgacatcttgaggttcctgaaattaaccaacatctcgcaatatctgagccgagatgaagattgcagtgactttgccaaagtgatgtgtaggtacaaacggctgaccattgggtccccttctagtcccagccttagcaatgcactgtgttttcggcttgacgaagtgataaacaggttttgctgcaacaataacctcatctattcacgctatgccgacgacatttgcatctcatcagagaataagatcaattgtaacctcgtccgcaaaagcatcctctcttctatccaggaggccaatgtaattcgcagattacgggtcaaccccagtaaaacaagaactcttaatagggctaaacgtgttaagattctaggtctgaatatcaccagtgatcgaaaaatctctataggaaggagcaaaaaacgcgaaatcaaaagcatggtgaatatgtggaagtacaaccggatcaacaacattgagcgttcatatctgagcggctatatttcctattgtctggctgtggaggaagatttcgtgatgggactgtaccagaagtacgggtccacgttgattaatagaatacgcgaatacaatgcctcttacgcaagagaaaagaatctcctcttggaaaatagcctcatggacataaatcactccgactacaattga

SEQ ID NO: 11825 - RNA, 924 nt, unidentified
  source 1..924: mol_type = other RNA; note = synthetic construct
atgatttcaccatttaacctcatcttgaaggattgtatgatcactaacgtcaagattatgaacattgctcaacgcgcgaaacatatgtataaaacatacgccatcccaaagaagaatgggggaaggcgcataattgaccaccccgcaaaacctctgaaggcgatccagaggtctattgtgagcgccgtgttaagggaccttcccgtacaccagagttgtaccgcctacgaacccggccggtctgcactcttgaacgctcagactcaccaagattccagatacttttaccagctggatttcaaggattttttccactccatcaaacatcgcaatgtcagtgccttcctggagagctcaaccagactcgatacagaggaaagcgagattatttctatgatatgctgcaaaggggaccacctggttattggagcaccgtcttcaccaatccttagtaatcggataatgtttcgattcgacagcgaagccacaattataagccagtccttgggctgtatctacactagatatagtgacgatatcacgatctctacgaaaaatgacaccaccgccatcaacgaatgcatacgagctctgattgattttatcgggtcacccgacaacaactggctgcgcatcaacgaggccaagacacgtcattcctccctcaaacgtagagtggctgttactggttacaatatcacaaatgaccacaggcctgtcgtgcctaggtcgtataagcggactgttcgggctctaatccataaggcaattatttgcaacaacgacgaaatcgagcttgataaggtgctgggcatggtagcctatattgagggaagcgaacctggcttcatcgagtccttaaaggggaaatatggtccagaggtgataaatcggctgagaaaacacaataccaccggccattga

SEQ ID NO: 11826 - RNA, 918 nt, unidentified
  source 1..918: mol_type = other RNA; note = synthetic construct
atgacagaaattattaaagagatcatgaggcataccggattttggccttctgatatcgtacggatttctagggacgcccctcgttcatacaaggtgttcagtatccccaagcaaaatggctcttctcgaacaattgctcagcccaccaaggagctgaaagcaatccagagagccattgtagaatgtctccgtaaaatactaccagccgagcacaccacagcaacggcatacgttaagggtaaatccatcatagataatgccaaaccacacaggaatagcaggatcttcctgaaaaccgattttcagaacttctttcctagcatcatgccctcgcatttcgaccagcttttaattcagaacgagatccactgggagcctgaaatctgcaacctcattaagagacttctgtttttcgggaaccgcactagcaccccacaatgcctcgctatcggggcgccctcaagtccgtacataagtaatgccatcatgtaccaatttgaccttcggttctcccagtattgtgccagcaacgaactgatttatactaggtatgctgacgatgtgaccgttagcgggaatggaaaaatgaatcagtcagcagtgctcaacgagatcgaccgcaatttggcctccgtgggactgagtgcgttgaaaattaacccatccaagacacgggtcttctcccacaagcatggcgtcaagatcacaggcataagagtcacttccgatggtgagataaaggtggaccgcgagctacggagagagattcgagccagattacataagatccgcattcagtcagcttcgactgaaatgattgctgaaacgcacggcttgctgagctttgtgcacatgatcgacgaagagctggaagagaacctcctgagccagtacaagctggattcttatgactggtga

SEQ ID NO: 11827 - RNA, 954 nt, unidentified
  source 1..954: mol_type = other RNA; note = synthetic construct
atgtccgaatacaacttccgcgagcacttgagcgacgaattcctaatttctgaacacgacgtaacacgacttttgctcagggcaccatacgcctacaagaggtatactatccccaagatgaatggaggcatacgccaaatcgcccaacccgccaaagaaaccaagatatttcagcatttcatgatgcgcgagtggttttcaaaaatgcctatccatgagtgtgccgcagcgtataagcatggcgcaagtatcaaagacaacgctgagcgtcacgccgggagtacatacctgtcgaaattcgacttcgtgaactttttcggaagtattacagagcggaacattaaagtcctgttgtccaccgtttttaagggagagctctccgaaaagagtatcgtcgacatggcccgtatgtcctgcattagagatcgcgcgactggtaggttagtgctcagcattggcgccccgtcaagccctgtcctgagcaatgctgtgatgtttaatttcgactcagttgtccacaaatggtgtgtagagcagggcatcatctattctagatacgccgatgatctcaccttctcttgcaatgagaagggcaaaacctttctggtggaagaattcctccaggtgactctgaaacagcttcccgaacctctgctgacgctaaacgctgataagaccatccacgcgagcaaaaagaaccagagaagagtcaccggtttggtgctgtcaaatgagggatccgtgacaatcgggcgggaccggaagagattaataagcgctatggtgcaccgatttgcaattggcgcactcgataacaagtctattgctcatctgcaggggcttattggtttcgctcaggatatagagccactttttgttgccaagctgagggagaagtatacttctaaagtgatcacggagctgatgcgggttagggggaagaaacggaattga

SEQ ID NO: 11828 - RNA, 954 nt, unidentified
  source 1..954: mol_type = other RNA; note = synthetic construct
atgtccgagtacaattttcgtgagcatttatcagctgaattcatgattagtgagcatgaggttgtaaggctgcttgtcagggctccatacgcatataagaggtacacaatcccaaagaagaatggcggaatccgccctatcgcacaacccgccaaagagactaagatcattcagaacttcatgatgaacttttggttttgcaaactgccagtgcacgagtgtgcggccgcttacaagcagggcgcatccatcaaggataatgccgaacgccacgtgggaagtagctatatttccaaattcgactttgtgaacttctttggctcaatcaccgaatttaacattcagacactgctgagccgggctttccagggtcagctctcagagcgcagcatagccgatatggcccggatgtcttgtattcgggacaaggtcactggacgacttgcactttctattggggccccgagtagccctatgctgagtaatgccgtaatgttcaactttgactccgtggtgtctcagtggtgcttcgagcgtgatataacctattctagatacgcagatgatctcacattcagcagcaacgaaaaagggaagacgttcctggttgaagagttcctacgcggagcgctgaaagaactgcccgaacccggattgttgctaaatgctaataagaccttgcacgcgtcgaagaaaaaccaacgaagggtcaccggcctcgttttatccaatgacggcaatgtgactataggccgggacagaaagcgactcatctcagctatgattcaccactttatacaggggcagctggatagaaagagcattgcccatctgcaagggctcatcggttttgcccaggacatcgagcctcttttcgtggccaagctgagaggtaaatatacatccaaagtcatcaccgaattgatgagatctcggtgcgagaaaaggaactga

SEQ ID NO: 11829 - RNA, 954 nt, unidentified
  source 1..954: mol_type = other RNA; note = synthetic construct
atgtcagaatacaatttcagagagcatcttagcgatgagtttctgattgcccaacacgacgtggtcagactcctgctgcgggcaccctacacttacaaaaggtatacgatccctaagaaaaacggaggcgttaggcacatcgctcagcccgctaaggaaacgaagattatacagcgcttcatgatgggcgagtggttcagcaaactgcctgtccacgaatgcgccgcagcctataaagatggagcttcaatcaaggacaatgccgagagacatagcgggagcatttacatttctaagttcgactttgtgaacttctttgggtccatcaccgagggtgacatcaagcgtatcttatctcggacattcgggggccagctgagtgaaatatctattgctgacatggctaggatgtcctgtatcagagatcgggccaccggccaactagtgttgtccatcggggcgccgagtagcccagtgctttccaacgcagttatgttcaactttgatagtgtcgttaatcagtggtgtagcgagcgtgatatcacctatagccgatatgcggatgacctcactttttcctccaacaaaaaggggaatactttctgcgtggaggaatttataaagggagcacttaaagagctctccgagccatcgctgtcattgaattctgacaagaccatccatgcctctaagaagaatcagcgcaggattacaggactggtgctgtcaaacgacggcaaagtcacaataggtcgggaccgcaagcggctaattagcgctatggtgcacaggtttgcacatggcgaactggatgataagtgcgtagcccacctgcagggactgcttggtttcgcccagggcgtagaacccttatttatcagtcgcttgcgatcaaagtacacctctaaagttattacagacctcatgcgattcagaagtaaaaaactcgattga

SEQ ID NO: 11830 - RNA, 954 nt, unidentified
  source 1..954: mol_type = other RNA; note = synthetic construct
atgagcgaatataactttcgtgaacatctctccgatgagtttgtgatctcggaacacgacgtgtccagactcctgttaagagctccttacgcatacaaacggtacaccattcccaagaaaaacggcggagtaaggcatatcgctcagcccgccaaggaaactaaaatcatccaacacttcatgatgagtgagtggtttagcaaactgcccgtccacgaatgcgcagcggcctacaagagtggcgcttctattaaagataatgcgcaacgccatagcgactgtgcctacatttctaagttcgacttcgttaacttcttcgggtctattactgaggtggacatccggaatcttctggtggaagtctttggaagccagctgtccgagaagagcatcgctgatatggctcgcatgtcttgcatccgggatcgagtgaccgggagactggtcctgtcaataggagcaccgtcctccccagtcctgtcaaacgccgttatgttcaatttcgatagtgtggtgaatcagtggtgtagggagcacgacatagtttattctcgatatgccgacgacctgactttttcctcaaatcgcaagggtgtgacattccttgtagaggacttccttcagggaacattgaaggaattacctgagccaagtctctcactcaacaccgaaaagacagtgcatgccagcaaaaaaaaccagaggcgcgtgacgggcttggtcctgtcgaacgacggtaatgttacaataggcagagacaggaagcgtttgatttccgccatggttcaccgatatgcactaggcgagcttgataacaggtctatcgctaatctccagggtctactggggtttgccctcgatgtggagcctttgtttgtagcaaagctgcgggggaagtacaccagcaaagtgattaccgagctgatgagagtccgggccaagaaagatgattga

SEQ ID NO: 11831 - RNA, 948 nt, unidentified
  source 1..948: mol_type = other RNA; note = synthetic construct
atgtcgcactacaatttccgaaagcagattagcgaagagtttatgatctctgaacatgacgtgtcacgtcttattttgagagcaccttatgcttacaagcgatacaccattcccaagaaagggggaggtgtgaggcacattgcccagccggctaaggagacgaaaattatccagcaccacatgatacatgagtggttctctaaattgcctatccatcattgtgccgctgcctataaaactggcgccagcattaaaaagaatgccgagttgcacagcaacagtacatatatttccaagttcgacttcgtgaacttttttggcagtattactgccctgaatatcaagaacctcctgcagaacgagttcaataacattatcagtgaggcatcaatcgaggatatgtccaggatgtcctgcatccgcgataaggccaccgggaggttagttctctctattggcgcaccctcttcgccaatcctttccaatgcggtcatgctaaacttcgataccgtcgtccaccaatggtgcagcgaaaggggaattatctacagtcggtacgctgatgatctgacattcagctccaatgagcgtggggcaactctcaagatacaggactttatccagggcacgctgaaagagctgcccaacttgaatctgatccttaacaccgataagacaatccacgcctccaagaaaaatcagcggcgggttactggcctcatactcagcaacgacaacaaagtgacaataggaagagacaagaagcgcctaattagcgctatgatccatagattctcacataacgaactgaattccaaagaaatcatgcaccttcaagggctggtgtcttttgcacaacacatcgaaccactgtttgtagcgaaattacgcggtaagtattctaccaagctgataaccgaactgctccggtcaagaggagacaaatga

SEQ ID NO: 11832 - RNA, 948 nt, unidentified
  source 1..948: mol_type = other RNA; note = synthetic construct
atgtccctgtatgatttccggaagcatatgtccgagatgctgagccttagcgaacatgatgtggccagactaatcgtgcgcgctccctacgcctacaagcgctattttattcccaagaaaagtgggggaatgaggccaatcgcacagcccgctaaagaaacaaaggttatccagaacctcctcgtaaatagctggttctctcaactgccagttcatgaatgcgccgccgcctataggcaaggctcatctattaaggccaacgctgagcggcacaaacagaatagctatatcgcgaaattcgactttagcaattttttcgggtccattaccgaatcagatttagtcaaccacctctcatacgtcctgtgcgggaaactgagcgttcagtccataaaggacatcgcaagagtgagttgtattagagatagagcaaccgctagacttgctctgtcaatcggtgcaccttcttctccgatactttccaacagtattatgtactacttcgacctggctgtagaatcgtggagcttggagaggaatattgtgtatagtcgatacgcggacgacttaactttcagtacaaatgataaaggagccacttcggagattgagaaatttatcctagaaacgttggagtccataccttaccctcggctccacatcaactctgagaagaccgtctacgcatcaaaaaagaagcaacgccgaattaccggcctgataatttccaatgataacgaggtgagcctcggtcgagacaggaagcgtctcatctccgccatgatccacaggtatgcccatcacgaacttgatgagaagtctatcctgcacttacagggcctgatgggatttgcccaggacatcgagccactgtttgtggcgaaaatgcggggaaaatatacaggccgcctgatatctgacttgttgcggcagcgtggcaagaagtga

SEQ ID NO: 11833 - RNA, 954 nt, unidentified
  source 1..954: mol_type = other RNA; note = synthetic construct
atgatcttgtacgacttccggaaacacatctccgaggtgctctcactcagcgagcacgacgtggctcgactcatcgtcagggcgccatatgcatacaaaaggtactttatccccaaaaaatctggtggaatgaggccaatcgcgcaacctgctaaggaaaccaaagtgatccagggcattttaattgagtctctgtttgctcagctccctgttcacgaatgcgctgcagcctacaagcaaggctcatcgattaaggacaacgcagagcgccaccgacagaactcttatatcgccaagtttgatttctcaaacttcttcggaagcatcacagaacttgatcttatcaaacatctgtcctatgtcctgtgtggaaagttgacggcccagtctattaaggacattgcccgggttagctgtgtgcgagaaagaagcacctctcggctggcactctccataggtgcccccagcagtcccattctgtccaatagcattatgtactactttgatttggctatggaaggttggtgccgcgaccgctccatagtctactctaggtatgctgacgacctgactttcagtaccaatgataagggcgttatgtttgatgtagaggccttcattttggaagtactggaaaacattccatatccgagactaaagattaacagcgagaagactgtctatgcatccaaaaagagacagcgccgtatcacaggcctgatcataacaaacgataataatgtgtccctgggcagggataagaagagactgatcagttcgatgatacatcactacgtgcagaataaactagatgaggagagtatccttcatctccagggattaatggggttcgcccaggacatcgagcctctgtttgtggccaaaatgagagggaagtataccgggaagattatctcagacctgcttcgtcaacgggggaaacggataaaatga

SEQ ID NO: 11834 - RNA, 954 nt, unidentified
  source 1..954: mol_type = other RNA; note = synthetic construct
atgagtctgtatgagttccgtaagcagatcagcgtggcactcagcctttccgcccaggacgtggcaagactgattgtgcgagccccttacgcctacaaacgctatactattcctaagaaagggggcggtgtgaggcccatagctcaacccgccaaagaaaccaagataatccagtccattctgatctccgattggtattgtaggctaccggtgcatgagaatgcagcagcgtataagagcggcgcgtcaattaaagctaatgcggaacggcataaaaacaatacatttgtcgccaaattcgactttaagaacttcttcggatcaatcacttattctgatcttgtcaaccatttgtcatacgtatttgtgaacgaagttacgaagcagtctatcctcgacatggccagagtgagctgcgtgcgcgatcgttcaagtggagatttgaccctgagtattggcgctcccagcagtccagtgttaagcaattccatcatgtacaattttgacttagcagtggttgaatggtgcgctgagcgagatgtggaatactcacggtatgctgatgacctgaccttctctgcaaaagacagaggggtcctgttcagtgtcaaggactttctgctctctaccctggaggagataccataccctaagctgtccctgaacgaggaaaagacaatatacgctagcaagaaaaaccaacggagagtaacaggcttgatcatctctaatgagaacaaggtttccctcgggagggaacgcaaaaggctaatctctgccatggtacacaagtactcgcaccaggatttggacgagaaagccgtcactcagcttcagggcctcctggcttttgcccacgatattgagccacttttcattgccaagctgaggggtaagtattccagcaaagttatcatggacctcatgcgcaagcggggaaagaaaattaagtga

SEQ ID NO: 11835 - RNA, 951 nt, unidentified
  source 1..951: mol_type = other RNA; note = synthetic construct
gatgtgtacgatttccggaaatacgtcagtgacacattagccattccgatccacgacgtgttaagactgttggtgagggcaccttacacctataaaagatacgagatccctaaaaagtcgggtggcagcagatccattgcccagccagcaaaggagacaaaaatcatacagcgcctgctgatggacgccatcttcagtcagcttcccgtccatgagtgcgctgttgcctataagcacggcgcgagcataaaaacgaacgcacaacagcatagatataaccagtacctcagcaagtttgatttctccaacttctttggatcaattacatccgaagacatcgctgctcacctgggccagtgtctgggagacgagttgtccgaacagtccgttgcagacatcgctaggatctcctgcataaggaataagatcaatagcggtttgtgcctgtcaattggtgccccatcttctccagtcctcagcaactctatactgtacaatttcgacgtaagcgtcagtgcctggtgtctcgaaaagggcattgtgtatacccgatatgctgacgatctttcatttagctccaaccagaaaggactctctgggagtattgagccctttctccgccaaactctaaaagatatctcttacccctcactggtgttaaatgagcgcaagactatacatgtatcaaaaaagcaccaaaggcgagtcaccggacttgtgattagcaatgacggctccgttagtctcgggagggaacggaaaagacttatctctgcaatgattcaccgttgtatcaacgataagctggaggaagcggatatttacatcttgcaggggctgctaggctttgcccaagatgccgagcccatcttcgtggcccggatgagggctaagtatgggtcgctggtgatccgcgaaattctgcggaagcgtgtgaagctgcctcggtga

SEQ ID NO: 11836 - RNA, 948 nt, unidentified
  source 1..948: mol_type = other RNA; note = synthetic construct
atggacatctacgactttagaaagcatgtcagcgaaaccctggccataccttctcacgatgtggcacggttgatagctagggctccccacacctataagaagtatgagatcaagaagaaagacggaggtagccgatccatagctcagcccgcaaaggagacaaaagtcattcagagattgcttatggaggcactcttttgcgatctgccagtgcatgagtgcgccgttgcctacaaattaggatcctctattaagaagaacgcacagctgcaccgccagaatcaattcatatccaagttcgacttcagcaacttttttggctcaatcacagaaaaagatgtggccgcccacctgagacatgtcttcattggcaagatcagtgaacaaagtattctggatatcgccagaacctgttgcatccgtaatagtctgacggggattttgtgtctgagtatcggggctccttcctctccaatcctatctaactccatcctgtattatttcgacatcgcgattcaaacgtggtgtaatgagagggacattatctacacaaggtacgcagatgatatgactttttcttcaaatgaacgcggtgtaacttcgttagttgaaaagttcctgacccatactctgaaaaacatcaaatacccccatcttattcttaacgaaaagaagaccatccacctaagcaaaaaacaccagcgacgcattacaggactggtggtgtcaaatgacgggttagttagcctcggtcgggagaaaaaacgcttgattagcgtaatgattcaccactacctcctcaagaagctcgaccataaagacatacctatcctgcagggcctcctgggctttgcccaggatgccgagccacttttcgtggcgcggatgcgtggaaaatatgggtccccggctatttcagagataatgaggggccggatcaagaagtga

SEQ ID NO: 11837 - RNA, 978 nt, unidentified
  source 1..978: mol_type = other RNA; note = synthetic construct
atgtccattttcgattttagaaaacacttgtctgagagcctcgccattccaacccacgacgtggtaagactgatcgtgcgagcccctcatacatacaagaaatacgagatccctaagaagagtggaggtgtgcggctgatcgcacagccagctaaagagacgaagctcatccagaggctgatgatacaggaaatctttactgaattgcccgtgcatgaatgtgccgcagcttacaaagagggggctagcataaaggcgaatgccgaacagcacaagaacaaccaattcatctctaagtttgatttcgtcgactttttcggctccataaaagaagccgacgtggcaagtcatctggcgtatgcgttgccaggaaaggtttccgagcagagtatcaaagacattgcacggattagctgcatcaagaataagacactcgggggtctgcagctttcgattggggcccctagctctccgatcctgtccaacagtatcatgtattacttcgatgtggctgtagccgcttggtgcgctgacaagggcgtcatctacacccgctacgcagatgatctgaccttttcatcaaatgtcaagggcttacccgcccagatcgagcccttcctgactgaaatactcaaggaaatcccgtatcccactctgtctctgaacaagaaaaaaacagtgcacgtgtcaaaaaaacaccaacgtcggataaccggactcattattaataatgatggggctatttcccttggacgcgagaggaaaaggctgattagcgctatgatccaccgatttattctgggcacacttgaggtggaagccatcctaaacctccaaggcttactgggcttcgcccaggacgccgagcctcttttcgttgtccgcatgagagacaaatatgggcatcaggtcattaccgagcttctaagacataggggtgttagcaaggacaagccaaaagcatatttgaagaactga

SEQ ID NO: 11838 - RNA, 957 nt, unidentified
  source 1..957: mol_type = other RNA; note = synthetic construct
atgagcgtttacgactttcgggggaatattagcaatgctctcgtggtgagctccaacgatgtgagccgcctaattataagagccccccacacatacaagacctatgagattgataagaagaatggcggcaagcgatctattgcccagcccgccaaggaaaccaagtacattcaaaggcttctcatgacgcaattgttctctagactgccagtccactcatgtgcagtcgcctataaagatggtgctagtatcaagaaaaacgctgaactgcataaaaacaaccagtacatctccaaattcgactttacaaacttctttggatccatcaaagaacctgacatctccgcacacctagcgtctgtgtttggcgacgagctcagcgatgagacaataaaggatatcagccgcatctcatgcatcaagcataaagacttgccagggctctgcctgtcgattggagccccctcctcgccagtgttgagcaacacaatcatgtacctttttgaccagatagttcatgaatggtccgtagaacgcgggatcaccttcactaggtatgccgacgacctgaccttttcttcaaatacgaaaggactgttcagtgaaatagagcccttcctgagtcaggtcctcaaaaaattgccttatcctgtgttaagtctcaatagcaaaaagactatccacgtcagtaagaagaatcagcggcggatcactggcctggtgttagataacgatggtagagtttcattaggacgtgataggaagcgcctgatttccactatgattcaccattactcctgtggaaggctctcagacgaggaaaccatgagactgcagggcctgctggggtttgcagaggacgctgagccgcttttcgtgtctcgtatgcgggggaaatatggcatcctggtaatttctgagcttttccagaagcgaggtaaaaagctggagaagtga

SEQ ID NO: 11839 - RNA, 963 nt, unidentified
  source 1..963: mol_type = other RNA; note = synthetic construct
atgtcttcatacgaatttagacaagacgtggtggaattcttctccgtctcggagcatgatgtattcagattgctgcagagggcaccccacacctataaacggtatgagatagacaagaagtctggcggtaaacgcctcgtcgctcagccagccaaagagacaaagattttgcagcgctacctcatgcgagtggtatttaacgacctgccaatccacgagtgcgcgactgcatacagctctggtagctctgtgcgaaagaatgctgagcttcacgtggtcaatccttatatctcaaagttcgacttcgttgatttctttgggtcaataaaggaatccgacctaattttgcatttttctaggttcctgggaggaaaagtgagtgaacaatcaatcaaggacattgcaagagtgtgctgcatccaacacaagggtagggccgaccattgtctttccatcggtgccccttcctcacccgttctgagcaattctataatgtacgatttcgacgaacaggtggaggcctggtgtaaggaaagaggcatcacatacagtcggtacgctgacgatctaacgttcagcactagcggaaagggcgtatcggctgagatcgagcccatgatccgtggcctgctgaacgacctcccttatccaagactcagtctcaacgataaaaagacccttcatttaagcaaaaaggtgcagcggagggtcaccggggttatattaaataacgaggggaagctcagtctggggcgagaacgcaaacgtaaaatttccagcatgattcacaggtttagcctgggccagttagatgaaaaagatgtgtttcagttgcagggcctgctgggatttgccgaggatgttgagccgctgtttgtgtcccggatgcgcgggaagtatggaattggcgtcattagtgcccttttccagaaacgctccgagggacggatcaacaaactgtga

SEQ ID NO: 11840 - RNA, 966 nt, unidentified
  source 1..966: mol_type = other RNA; note = synthetic construct
atgtccaagttcgaattgaggttgaggctttgtagagaactgctgctcaccgacaaagaggtcgcccgcctcataagccgagccccttacacttacaaggtgtattccattccaaaaaagaatggaggacgaagggtcgttgcgcaaccggcacgggaaaccaagattcttcagaatttcctcatcgaaaacgttttcaaagaactgccagtgcacgagtgcgctaccgcttacaaggcggggtcatccatcgccattaatgccagcgcccacgtaggtaacagctacatatccaagtttgatttcagcaatttcttcccctctattacaatgctggacctagtgcggcatatcaagagcttttttgacggacggctcgatgatttggagattatcgacattgccagagtatgttgcatcaaagaccgcgtgacggataggttccatctgtccatcggcgctccaagttctcccatcctgtctaacagtatcatgtattttttcgatgtcgccgtgcacaaatggtcgtctgagcggggagtttcctacacaagatatgccgatgacatgactttttcaacaaacgagaagagtatgtctcgggagattgagctatttctggtccgccaagtggaggctatgaagtcacccagattaagtataaaccacgagaagactatccacctgtctaaacgtaatcagcgaaaggtgacaggcttagtgctgagctcagagggcaaagtgagcctggggcggaataggaaacgcgaaatctccagcctgatccatagattcgctcttgggcagctcgatcccaccgacgtttttcgcttacaggggcttttgggctttgctaacgacgcagaacctgacttcgtagtgagaatgaggaagaagtatggtgacctcgtgattgcagcactgtttgaaaaacgtaaagcaccttcagtcataagtgatggctga

SEQ ID NO: 11841 - RNA, 951 nt, unidentified
  source 1..951: mol_type = other RNA; note = synthetic construct
atgaccatcaacctgcgcgagtctcttcaagaatcactggggttgtctgaggcgcagctaaatcggcttatcgtgcggtcaccacatacctataaggtctacacgattcccaaacgtacgggcggcaagagaactattgcccagcccgcaaaggaaacaaaattcatccagaactggctcattgaaaacatctttaacagtctgcctgttcattcttgtgccagcgcctatcagccaggctccagtataaaacgcaatgctgatgctcataaggctcagagatacctgactaagttcgacttcaagaatttcttcacctccattaaatcggacgatcttatagagcacatgagagtgcacctgggggaagtgctggatctagatgccatccacgacatagcgagagtcagctgtattcaattaaaggctggcgaaaagttgtgcctcagcattggtgcacctagctccccgcttttaagcaattccatcatgtttgagttcgatagtctggtaaatgaatggtgcagccgagagcgcgtggtctatacacggtacgcagacgacatgaccttttccactaatgagaggaacaagtctgccgtaattgagaagtttatccgaggcgtggtgcgtgacgttgggtatccaagcctgcggttcaacaacaaaaagacaatctctctgtcaactaaacactcccggagggtcacaggaatagtgatcaataaccagggacagctgtcgctgggacgagacaggaaaagagaggtcagtgctttggtgcacaaatttatgttgtccgagctcccccaagccgaggtttacaggctccagggtttactcgggttcgcctgcgatgtggaacctgattttctggcacgcatgaaaaggaaatactcagacgaactgatcaggaccatcctcgagattcgcaagaagtctgacgcctga

SEQ ID NO: 11842 - RNA, 951 nt, unidentified
  source 1..951: mol_type = other RNA; note = synthetic construct
atgactatccacttgcgaggggccctcagggattcacttgggctgagcgacgcccagctcaatagacttattgtacgctcaccacacacgtacaaagtgtacacaattccgaaacgtaccggcggaaagcggaccatcgcccaaccagctaaggaaacgaaattcatacagcattggctaatccggaatgtcttttgccaccttcctgttcacgcctgtgcaagtgcttatcaggacggtgcttccatcaaaaagaatgcagatgcccatcgactgcaacggtacctggcaaagtttgatttcaagaacttcttcacatccattaagtccgacgacctgatcattcacatgcgccggcatttgggctcgatactggaagagagcgctatcgacgatgttgcgaggatatcatgcattaagctcaaggcaggagggaagttatgcctcagtataggtgccccttcttctcccttgttgtctaatagcatcatgttcgacttcgacagtctggtgaacggatggtgtaaaaaagagggtgtgatctatacaaggtacgcagacgacatgacttttagtaccaacgagcgcgataaatcaagagagattgaagagttcatccgaagcgcggctagagacgtagaataccccgccctgaggtttaacaccaagaagactgtgttcctatctacaaaacattcccgtagagtgaccggcattgtcattaataaccagggcgaactgagcttaggccgcgatcgcaagagagaagtctccgccttagtgcacaaattttcttttgaagagctccccgagaaggaggtttataggctgcaggggctgctgggattcgctaaagatgtcgagcctgattttcttgaaaggctgaaacgtaagtatagcgacgagctcatcagacagatcctggccattcggaaggagcgggatgtgtga

SEQ ID NO: 11843 - RNA, 942 nt, unidentified
  source 1..942: mol_type = other RNA; note = synthetic construct
atgactatcgcactgaggaaagagctccaggagagcttaggcctgagtgaagcccagcttaacagactcattcttcgggcaccccatacatacaaggtgtacaccattccaaagcgtactggaggcgtacgtgtgatcgcgcagccagcccaggaaaccaaattcatccaaaactggctcatcaagcgggtgttcggagaactgccggtgcattcctgtgcaaccgcctatcaggcggggtcatcaattaagaaaaacgctgccgctcacaaggaccaccaatacctagcgaaatttgactttaaagacttcttcacgagcattaaggcagatgacctggtggctcatatgagtcgacacctggcaggcctgttgagcagatcagaaattctggatgccgccagaatttctagcattcagcaaaggcagtctgagtccttgtgcctgtctatcggagccccttcttctcccttgctgtcgaatagcgtgatgtttgaattcgactccctggtttccaactggtgtgtagataggggaatcatatatacacgctacgctgacgacatgacattttccacgaatcggaagggtcgctcaggggagattgaggaattcattcgaaatatcgctcgcgggctcgattatcctcgacttaggttcaattccaaaaagaccgtcttcctgagcaagaagcaccagcggcggataactggcatcatcttaaacaacgacggtgagctcagcctagggagagatcgcaaaagagagataaaagctttagttcacaagtttacctgcgatgagctgcccggcgaggaagtgtatcgcctccagggcctgctcggttttgccctggatgttgagcctacttttcttcaagcccttaatgtcaagtacagtgaccaggtcatagagacaatcttgagtatcaggaaagaatga

SEQ ID NO: 11844 - RNA, 945 nt, unidentified
  source 1..945: mol_type = other RNA; note = synthetic construct
atgaaaatcgcattaagaaaggcactccacgattcgcttggtctgcctgaggatcagctaaatcgattaatactgcggagcccctactcatacaaagtgtatactattcccaaaaggtcaggcgggctgagagtgatcgcacaaccggctaaggagacgaaattcctgcaacattggttaatggcaaatgtgttcagaaatctgcccgtccatgagtgtgctaccgcttatcaggccgggtccagcatcaagaaaaatgccgaactccacaaaaataactcttacctggtaaagctggacttcaagaacttttttccttccattagcgcccgcgatctgatatcccatatgcgaagacatctggacggatcacttgacgaagaagcccagcgcgacatcgctaggatttcttgcattaggttgccagatgcccctggcctgtgcctctcaatcggagccccatccagccccatgctgagcaattccgtgatgttcgagttcgacacagccgtccacggatggtgtaacgagcggggcgttagatacagccggtatgccgatgatttgtccttcagtacaaacgagcgcggcgcaagtggtgacattaaggagtatgtactgagtgttgtggaacgcctcgaataccctcgcctcagtttgaatgacaagaaatctgtctttctgtcgaagaagcaccagagacgtataaccgggctcattattaacaacgaaaaccagatcagccttggccgggataggaagcgtgagatctccgctctcatccacaagtttagtgtgggagcgcttccggactctgaaatcttccggttgcagggtctactggggttcgcgagggacgttgagccaaggttttttgtgtcaatgtccaaaaagtacacctctgatactataagcaacatcctttctacacgaaaaaagccatga

SEQ ID NO: 11845 - RNA, 954 nt, unidentified
  source 1..954: mol_type = other RNA; note = synthetic construct
atgaccgaccatttgcggcacggactgcaagagtcactgggtcttagcgactgtctgctcaaccgtctaattcagagagctccacactcctataagatatatacgatcgcgaagcgcacaggcggacagaggaccatcgcacaacccgccaaggaaaccaaattcatccagcggtggctgattcagaatatcttcaacaagctccccgttcacgagtgcgcaagcgcctacaaagatggagctagcattaagaaaaacgcgaatgcccacaagaaccattcatacgtaatcaagctagatttcaaagacttctttccctctataacgttttccgatttagtcaagcacatcgccaaacatctggggcacatcctcaggactcaagacatccaggatatagctcgaatttcttgtatcaggctccacgggaaatcggacctgtgcctttccgtgggcgcccctagcagtcctgtgctgtccaatacaattatgtacaacttcgacagtgaagtgtctgcttggtgtactcaacagtgtataacttacacaagatatgctgatgaccttaccttcagcaccaatttcaaggggggcagctctgagatcgaagcctttgttaggtccattactcagaagctgacttacccaagtttacggctgaataacaataagacaacacacctgtctaagaaacatcagagacgcatcaccggaattatcattaataacgagggtaacttgtcactcggccgcaatagaaagagagaaatctgcgcactgattcataaatttagcctcgatctgctgccagaatccgagatatttcgcttacagggcttgatcgggttcgccaaagacgtcgagccgttgtttgtggcacgtatgcggggcaagtatagttcaaaacttattgaggaggtgctgcagaagaggaaacctggtcgactctgctga

SEQ ID NO: 11846 - RNA, 939 nt, unidentified
  source 1..939: mol_type = other RNA; note = synthetic construct
atgacggaccacttacgacacgacctggaagagagtctcggactttccgactacttaattaatcggctcatcgacagagcaccctacagctataaagtgtacacgatcccaaagagaagcggcgggcagaggacaattgcccagcctgccaaagaaatcaagttcattcaacgctggctaattcaaaacatttttgacaaactcccggtgcacgagtgcgcctctgcttataaggacggcgcttctataaagaaaaacgcaaattcccacaaaagtcactcatacatcatcaagttggactttaaggattttttcccaagcatcacctccagtgatctggtgatgcatatctctaagcatcttggacgaacatttggagcgcaggacatccaggatattgccagagtgtcctgcatacgcctccatggtaaaggcgacctgtgcctatcagttggtgccccctccagtcccgtgctgtcaaacaccatcatgttctccttcgatagcgaggtcagtgcttggtgtgcccagaatggcattacttataccaggtacgcggatgatttgactttttcgaccagcactaaagggatttgttcagagatcgaatcattcgtaaagggggtcacccaggagttggactaccctaatctgacactgaactttaataagactacacatctcagcaagaagcatcaacgtcgcatcaccggggtgatcataaacaattttggagccctgtctctgggccggaacaggaagcgggaaatcagcgcattgattcacaaattctctctggatatgctgccagagagcgagattcttaggctgcagggtctgctcggcttcgctaaggatatagaacctcttttcgttgcaagaatgcgcaggaaatattcttcccgtttaatagaagaggtcctgaaaaagcggaaatga

SEQ ID NO: 11847 - RNA, 966 nt, unidentified
  source 1..966: mol_type = other RNA; note = synthetic construct
atgatgataggcttagacatatcggagcagataagtaaggatctctatgtcagtgctttccaggtagaccgtttgatcaacagggctccacatgcctacaagattttctttatcccaaagaaaaccgggggccaacggaaaatcgcccagcctgcaagagaagtgaaatacattcagaggtggttggtggataatatctttaatcaactcccggtccacgaggctgtgaagtcataccgcgaaggcctggggataaaggataacgccacatggcataagaaaaataagtacctggttaagcttgatttcaaagacttcttcacctccattaaggaggccggactgtttgacttccttttgagaaaactgtctgacagctattctgacgagtcgctgaggaagattgccagggcatcctgcatcaagtataaacacagagaagacctgtgcctcagcgttggcgccccaagctcacctgccatctccaatgcaattctgtatgccttcgatgaagcggttaacaattggtgttttgagaacagcatctcctatacaaggtacgcagatgatttaacgttttctaccagcgtgcccaacgtgtccagcctaatcgaacccaaagtccgccaaatttctagcgatttcccctatgtgaatctcagattcaataacgcgaaacgaactcacctttcaaaaaagtaccagcgacgtgtgacagggattgtgctgactaaccagggagagttatcagtcggacggcttcgcaaacgggaggtaaaagctctcatccacaagtttaagactggtctgctgcctatgaatgaagtccatcgcctgcagggcctgctcggttttgtgtctgacgtggagcccatgtttctagagcggatgagagtgaaatacagttctgctaccatcgacgatattctgaagtccgttaagcaggacaagttggtaaacagttga

SEQ ID NO: 11848 - RNA, 945 nt, unidentified
  source 1..945: mol_type = other RNA; note = synthetic construct
atgaacaagtctctgctgcaggaaatctctgagagctttttcatgtccgagatccagatcgaacgcattttcgtcagggcaccatatgcttacaaactgtacacaatacccaagaggtccggaggtctacgaaacatcgcgcaacctgccaaagaaaccaagtacgtgcagtcctggttgattcacaatgtgttctcgagcctcccggttcatgactgtgccatggcatataaaagcgggagcagtattaaggagaacgctctggctcatgtggaaaaaccctacttggttaagttcgacttcaaggatttttttacgtcaatcaaggaggccaatctgatagcccactttcaactgtacctgggcggaagatttagctcagaggaaatcaagtacttagcgaggatctcatgtattaagtataaacacgccacagaaaagtgcttgtctgtaggggctccctcttcccctatcctctccaatagcatcttgtttgagtttgacaaatccgtgcatgagtggtgcgtcagcaagaacattgtttatacccggtatgccgatgaccttacattctctctgagggagaaaggcatggctagtaccatcgaagccgaggtccgaaacttcgcaaaaaccaagtgcgtggtgaatctgcggttcaaccagaagaagactacccacctctcaaagaagtgtcagcgcagaataactggtcttgtaattacgaatgaggacaaaatttctctagggcgtgatagaaagcgggaaataaaggcacttatccatcagcacctgttaggcatgctgaacgccgatcaagtgagtaatctgcagggccttctcggatttgcaaaaaacattgagccatcgttcctcttctccctctacaaaaaatatacctttgaggtcgtgaatggcattatcagaagtcgcaaaactaaatga

SEQ ID NO: 11849 - RNA, 945 nt, unidentified
  source 1..945: mol_type = other RNA; note = synthetic construct
atgactaatagtccgctggtgaacatctgcgccgacacattgcacatctccacaagtcaggtcatgcggttgattctccgggcccctcatacctataaggtgtactcaattccaaagaaaagcgggggaaggagaatcatagctcagcccgctaaagaaaccaaatacttacaggacgttatcataaaacgctatctgaatctgctgcctatccatgaggcagcctctgcatataagatcggatcttcgataaagaacaatgccaacgcccacaagcataataagtatttcgtgaagcttgacttcaaacgattcttcgagagcataactctggacgatctagtgactcactttgagaaatacctcccaacacctcttagcaaagaggatacggtgtatctggctagaatttgctgtaggtcctcagatggacgagcagcgctgacaatcggcagcccggctagtcctgttttgtctaatactgttatgtacgactttgacaagattatcgagtcgtggtcaagccagaacggctttacctacacaagatacgccgatgatttaactctcagcaccagtacgccaggagcctccgcgcaagtaatccccgcagtccttaatgccctggaaaaaattgaataccccaaactactgctcaacaacgagaagaccgtgtttctgagccgtaaaaataatcggcggattaccggtatcgtaatcaacaacgatggccgcctttccctcggcagggagaagaagcgtctgatttctgcaatgatataccactatcagcaggggaggctctccgaggaaaaccaattcaagttacagggcctcattggttttgctttggacatcgaaccaattttcgtctccaggctgaactcaaagtatgggcgcgacgtgatttctaagatcctgcagagacgccagcccaaacaatga

SEQ ID NO: 11850 - RNA, 933 nt, unidentified
  source 1..933: mol_type = other RNA; note = synthetic construct
atgatcgcacacaagacactcgaaaaaatgctggccgatctcagtctgtccagtgagcagctcgtcagagtcgtgtccagggccccttattcctacaagacttacagcattcccaaaaaaaatggaggcctgcggatcatctcacagcccgctcgtgaaactaagtacgtgcaacattggctgattcataatgtttttcatctcttgcccattcacgaagccgcatccgcgtatgtaaagggagcctcaattaagaagaacgccgaggctcacaggactaatgagtacatggtaaaactggacttcaaggactttttcccatctattaagatcgacgatctgattgcccactttcaaaagtctttgccgttcctcgacctactggagatccgctacatagctagactgtcctgcatcaacaggggtaacggaggcgctctgtctatagggagcccagcctcacccattctttccaacagcataatgtatgagttcgacagtgtcgtggccgattgggcgagccagaataaatttgtgtacaccaggtatgctgacgatttgacgttctctaccagcctgccttacgcaagtgaatcggtggtgcctgttatcaaggatttactgagcagcctgaaatacccacggctctctttaaatgtggacaagacaatccacttgagtaaacgagggtcacggagaataacaggcctggtgatcaccaacgatgataaagtttcccttggacgcgacagaaagcgagagatttcagcacttgtccataagtatggccttggcttgctagagcagaaagacgtgtttcgcctgcagggtctgctgggtttcgcagctgatgtcgaacctctgtttctctctcggttagggaaaaagtatgggatgaaaaccatcctaaacctccttcgcaagcgtcagtga

SEQ ID NO: 11851 - RNA, 951 nt, unidentified
  source 1..951: mol_type = other RNA; note = synthetic construct
atgagcaataaccccctcattgatgccctgctatctgacttagccctctcgaaagaacagttcttaagaattgcgagtcgcgcccctcgtacatataagatctatcccatactcaagaagaacggcggcattcgggtaattgcgcaacctgctcgtgaaaccaagtacatacagtcatggctggcgaataatgtctttgggctgcttcctgtccacgatagcgctaccgcataccgcaaagggtcttctatcaaagtgaatgctcagatgcatgctgccaacccgtacatagtcaaactagactttaccaatttcttcccatccatcaagtccagtgacgtctttgctcacctcaagcagtttttgatcggagccacagattctgagttgaagatctttactctgttgagctgctttaataacaatggagaactctgcctgagtatcggtagccccctgtccccaggactgagcaacagcattatgtacgagttcgactcaattatctccgattgggccgccgggaacaacttcatctatacacggtatgcagatgaccttacgttctcaactcctattaagggcgccagcgaagccgtggtggacaaggtgagagaggttattggcaagatcgcatacccaagacttagcctgaatgaaaaaaaaaccatccatctcagtcgaaaaggatgtcggagggtgactggcctggtccttagtaactcagggtccgtgtctatagggagagacaaaaagagagagatctccgcaatggttcaccggttttcaatcggtaagatttctcatgatgatctgaggaggctccaaggtctgctgggcttcgttcaggacgttgagcccctgttcatagctcgcttacgagccaaatactcctccgcagtagtggtggacttgctgaggaggcgcgtgaagaaagagtcggataagtga

SEQ ID NO: 11852 - RNA, 957 nt, unidentified
  source 1..957: mol_type = other RNA; note = synthetic construct
atgtcaaaccagagtactctcagcagactcctggatgaactggctttagaaccccaccagtttcgacgtattgccctgagagcgccgtatacctacaagacatacacaattccaaagaagaacggcggtgcccgcgtaatatcccaaccagcccgggaaaccaaatatattcagtcctggctgattgaaaacatcttcaagaaactgcctgtgcatagcgctgccgccgcatatgtgaaaggcgcgagcatcaagaaaaacgcaaatgctcataaggacaacccatttctggttaagatggacttcgagaatttctttccgtctatcaaatctctggaccttcacttgcactttcgcaagcatcttagtttcctttccgaagaggaaatcctgctcgttgcacgtctctgctccgtcagggggatggtgcatgacggtctatcaatagggagccctgccagccctattttgtccaattctgtcatgtacgagtttgatagtctggtcgcggagtggtcccagcggaatggctttgtatataccaggtatgctgatgatctgactttcagcacgtcgaccaaagaagcatcggctgccgtggagcccatgatcagggacgtgataggggcaattggatacccctctctgactatcaataataggaagactttgcacctcagcaaaaaaacaaatcggacaatcacaggagttatcatcaacaaccaaggacagctgtctttgggccgcaccaaaaagagagagatttcatctcttgtccaccggtacaccctggagcaactagatgtgagtagagtgcacaaacttcaggggctcttgggatacgcctatgatttagagcctaagttcataaacgccctctcaaagaagtactccttaggcgtgatcaatgagattctgcgccgaagaccacccaggcaggaggctaacacggactga

SEQ ID NO: 11853 - RNA, 972 nt, unidentified
  source 1..972: mol_type = other RNA; note = synthetic construct
atgacaatcgcactgattgaagagatacaagcctctcttggactgagtagcgagcagatggttcgcctgattgtaaggagtccatacacatataagacctacacgatccctaaaaaatcaggggggtttcgagtcatcgcccagcctgcgaaggagactaaattaattcagaggtggctgatttctaacctgttcaataagctacccatccacgattgcgcaactgcctacaaggagggctcctctatcaaactgaatgccaacaaacatcgcgagaacgaatttctctcgaaattcgacttcatcgattttttccaatcgattaaggaagaggatataaaggcccatcttatggagtgcttaggtgggtttttgtccgaaaaggaggttgcgtgggtggctaggttgtcatgcatcaaaacccagaccagcaagaatttgtgtctgagcgtgggagctccatccagtcccctcctcagcaattctgcaatgttccagtttgacagtaagctgaacaactggtgtcaagagaatggcataatttacaccagatatgctgatgacttaaccttctcttcctccatcaagggagccagcgccgagatagaaggcgctatacagaacgtgctgacggagatggcaagaccgaaactgctcttgaacaacaagaagacaatccacgtgtctaaaaaacaccagcgaagaatcacagggattattatcaataacgaagacgagctcagcctgggtcgggaaagaaagaggatgatctccgcccttattcataagttcactcttaatcagctagcttcctttgaaattttccggctgcagggactcctgggcttttcaaaagacgtcgaacccgcatttctgattcgtatgcgggacaaatatgggagcggcgtgatcgagatgatcctcaagatccgcaaggataacaacggcaagaatggtgatttcaattcatga

SEQ ID NO: 11854 - RNA, 942 nt, unidentified
  source 1..942: mol_type = other RNA; note = synthetic construct
atgaactcaaacgacctaatcggtcggttaattagccacctgggattgaatgaaaaagatgtgctcggcctcatccgacgagctcctttcacctacaaggtctatactataccaaagaaaacgggcgggaacagggttatcgcccagcctgcacgcgagactaaatacatacagaattggctcatcgaccatatcttcctggctctacctgtgcacgaaagatcaatggcttacaagaaaaagatcggattgatcaacaatgtcttaccccacaaaaacaacaaatatctcgcaaagtttgactttaaggatttctttcactccatcaagttcctggatctggttaatcattttaataagcacctccatcacctcctgtccgaggccgagattcaatatgtggcaagggtagcctgcattaaacagagagattcgggctctctgtgtttgtctgtgggggccccaagctcaccgcttctctctaattcattcatgttcgaattcgatagcgccatggacgagtggtgccaggagaatgagatcatctatactcggtacgctgacgatctgaccttttccacaaatattagtggcgcgacgaataagatccagcagacaattgtaggaattctgagcttaaagtatcccaacctgtttttgaatcacgacaaatccatccaactgagtaacaagaacagaaggcgggtgacaggacttatcattacaaaccagcaacgcattagtgtggggagagacaggaaacgtatggtcaccagcatgattcataagttttccataggtgagctgcgtgccgaagacgttttctacctgcaggggatgcttggcttcatcaagagtgtcgaacccacctttctggtgtctatgaaccgcaagtacggccatgatcttctgaccaaaattataagcatacggaaagagtga

SEQ ID NO: 11855 - RNA, 954 nt, unidentified
  source 1..954: mol_type = other RNA; note = synthetic construct
atgatcgacaacttatctgggctcatccacctgtcattgggcatttccactacgcaactggatcgaataattcagaggtccccattcacttacaagatctacaccataaagaagcgtagtggagggtaccgcaccattgctcagcccgccaaggaaactaaattcattcagaattggctaatcgagaacattttctctaccttcccagtgcatgaatgtgcctcagcctataagaatggagcgtcaattctcaagaacgcagagctgcacaaaaaaggagaattcctgtccaaatacgacttcaaggacttttttagttccatcaaggttaaggatcttgtgctgttttttacacatcagctggcccatcgcttctccaaattagatatattgcggatggcgcagatttcttgcgtaagacacacagagctgtcagggctgtgcttgtctataggcgcacccagtagccctatcctgagcaatgctattatgtatgactttgacgccaagatatacgagtggtgtaacaaaaacaacatttcctactccagatatgcagacgacctcacattttctacgaatgaactgggcaggagcgatgagatcactagcctcgtgaatgccgctatcttagagaataaaatcgtcaagctccaaatcaataagaagaaaaccgttcacctgagcaagaaatatcaaaggagaattaccggtctaattatcaccaatagtaacatcgtctcaattggtaggagccgaaagcgcgaaataagcactcttattcacaagtttagcctgaacatgctttctgatgatgagaaatatagactccagggcctgttgggcttttcgaagaacatcgagcctctcttcatcgaacggatgaatgtgaaatacggaaaggatcttatcaaccagatcttcaaaatccggaaaagtacagacacagcttga

SEQ ID NO: 11856 - RNA, 948 nt, unidentified
  source 1..948: mol_type = other RNA; note = synthetic construct
atgaaatattcactgccacagctgctacaggagaatattggccttcacccgagtcagtttgagagactgatccgtagggccccagacacttacaagcactacaccattaagaaaagaaccggcggtgatcgctggattgctcagcctgctaaagagactaagtatatccaacattggcttatagacaacatcttcctgaagttccccgtgcaccggtgcgctatggcctacaaggcaggaactagcatagccatcaacgccgcagctcattccaaaaatagctatctcgcaaagttcgactttagcaatttcttcaactccattaagtaccacaatgtcaatgacttccttagcttgctcctggaagacagcttctctcccgacgatatcgataacatggcaagggtttcctgtgtgagagagcctgatttcggtctatgcctgtccgtgggagcccctagctctcccttattgtctaacgcgattctctatgaatttgactcccgcatcgagtactggtgccaagaaagaagtataacatatacacgctatgctgatgacctgaccttttctacgaatgaaaaaggggcgtgttcagagattcataagttcttggtggattcactcatagactttgactgccctgtcctcaggttaaatgataaaaagaccatccattcctctaaacgtttccagaggcgggttacaggccttattatcaataacgatgggatggtatcactgggccgcgggcggaagcgagagattagtgcaatgatccacaaatttcggtgtaaagacctggccgaatcagagagctacagactccagggcttgctggggtttgccagggatgccgagccatcctttgtggaatctatgaacaagaagtacggaaacgagatcctgtcgagcatctacagtctgcgaaagcccaaagaaagttga

SEQ ID NO: 11857 - RNA, 957 nt, unidentified
  source 1..957: mol_type = other RNA; note = synthetic construct
atgaactctaaattactgacccagatccgtgccgaactcggcttacctgtggcacagatagaacggttaatcgaaagagctccctacacatacaaagtttacaccatccccaaaaggtcaggaggggatagaacaatagcccagcccgccagggagacaaaactgattcagaagtggctcatcgagcatatcttctgtaccctgccgatccatgacgcagctgccgcttatagacctggcgcaagcatcaagaagaacgcagaacggcatgcgaattccaagtatatggtgaagctagattttaaggagttttttcccagcatcaagtaccaagatttggtgaatcacttttgtgtgcacttgtcagacgcctatgaagacgacgatattaagaggatggctcttatatcctgcctgcacattggtggcagggatttcgccctgtctattggttcccctgcctcgccttgcctgtccaatagtatcgtctacgagctcgataaaaaaattaagtcctggtgcaaggagaacaaggtggcctatactcggtacgcggatgacttgacgttctcaacgaatcgcccagatatctccagcgaggtggaaaagatggtcagtttgactctgaaggagattgagtacccacagctcaagctaaacaagaaaaaaagcatacacctctcaaaaaggcataaaagagttgtaactggggtcatcattaactctgaaaacaatctgagccttggccgggatcgcaagcgtgagatcagctctctgattcacaagtacagtattggactgctgtctaaaggcgacacatatcgaactcaaggactccttgggtttgctcgagacattgagccagacttcgtagcacgcctcaacaccaaatatgggaataagctgctggaagagatcttcaccctgcgcaaagctgaggaagaggacgacctttga

SEQ ID NO: 11858 - RNA, 948 nt, unidentified
  source 1..948: mol_type = other RNA; note = synthetic construct
atgtcctccaagttgctgactcaaatcagggctggcacaggcctgccaattacgcaaatcgaacgacttatcgtgcgggcaccttacacctataagatctacacaatccccaaaaggagtggaggggagcgcattatcgcgcagccagctcgcgaaaccaaactgattcagaactggctggtcgagaatgcattcgggtctttacccatccacaaggcagccacagcctatagatctggggcctcaatcaaacataatgccgagatgcacgctaagtcacgctatatggtcaagctggacttcaagaacttcttccctagcatcacgtacaatgatctagtggctcactttagccgacacctcagcgaacagtatgaaatcgaggacattaaacggatggcaataatctcctgtttgaacattggaaggctagatcttgccctctcagtgggaagccctgcctctccctgcctctctaataccgtcatgtacgagctggataacattatacagaattggtgcgacgacaaacatataacttacacaagatatgccgacgatctgacattctccactaaccagaaggatatttcgaccgaggtggagataatgatagcttccagtattgctactgtgcagaacccacgtctttccatcaatagtgaaaaaactgtacacctgtcaaagaagtttaagagaatggtgaccggcgtggtaataaacagccagaataacatcagcctcggtcgcgaccggaaacgtgagatcagtgcccttattcataagttcagcattggcatcctgtctccggacgaagcatttagaacccagggtttactggggtttgcgaaggatattgagcccgactttgttgttaggatggataaaaaatacggcaatcaattgctggagcagatctttaagctccggaaagttaccgaaatttga

SEQ ID NO: 11859 - RNA, 966 nt, unidentified
  source 1..966: mol_type = other RNA; note = synthetic construct
atgaagatagacctgtctcagcggctccaagaaagtctgggagtaagcagcgatcagctagcccgcttggtggccagggctccttatgcctacaaggtgtatgagatcaagaagcgtagtggtggcatgcggacaatcgcccaaccagcacgagaaacgaagtttattcagatttggctgatcgagaacatcttcaaagagctccccgtgcacgaaagcgctacagcatacggtaaaggctcctcaatcttgaaaaatgcagtggctcataaagacaatagatttatcgcgaagtttgatttcaggaatttcttcccgtcaattaaatacgaggaccttgtcgagcacttcactagacatttgtcgggtgtcgtgtcagacgcagacgtcaagatgatggctagaattgcctgcatgcgctcaaagaccaacggaaggatgcagctcagcatcggggcaccttcttctccaatcctgagtaactccattatgttcgaatttgacagccagatttccgcatggtgtgtcgagcaggggatagtatatacccggtatgccgatgatctggcttttagcaccgatgtgatcggggcgacagctaaaattgaacccattattcgccaagccctgagaggcatcaattaccctgctcttcagataaacaacaaaaaaaccgtgcagattagtaagaaattccagcggcgcgtgactggcctggttatcaataacgagggcgacatatccttagggagggaccgaaaaagggaaatctcctccctggttcacaagtttactctgggcggactggccgacgatgacattttccgtcttcaaggactactgggatttgccaaggatgtggagccacagttcatcgtcagattgtctgccaagtacacagcggagatcataaacgttatcttaaagctccggaagccccccaagctcaaatctgattttaattga

SEQ ID NO: 11860 - RNA, 951 nt, unidentified
  source 1..951: mol_type = other RNA; note = synthetic construct
atgaacttaagtctaaaaatgcaggaggaattaggaattactggcgagcagtttaccaggctggtcgctagggccccctacgcatacaagatatacgagatcgacaaacgctcaggaggtactcggacaattgcacagccagccagggagacgaaattcgttcagagctggctgatcgagcatgtgttcggagcgctaccaatccacgagtgcgccaccgcctatggtaagggcgcttctattttgaagaacgtggatgcccataaagaaaatagcttcctggccaaatttgacttccgcaattttttcccatcgatcaagtatgatgacttgttgcttcactttagtattcacttatctaacatcgcctccgtggaggatgtgaagatgatggctagaatcgcttgtatgagatcaaaagctagcggccaactgcagctttccattggtgccccgtcttctcctatcatcagcaacagtgtcatgtttgaattcgactgtcgagttgcggcttggtgcgcagaacaaagaatagtgtataccagatacgctgatgatctcgcgttttccactaacgtaaaaggggcaacggtaaaaattgagcccataattcgtaaagtgctgcgtgaaatcccctaccccctcctccagctgaataacaagaagaccatacatgtttccaagaagtatcaacgccggatcacagggctggtcataaataatgcagacgaagtctcactggggagggagcggaagcgggaaattggggccctggttcacaagtccaccctcggcctgttgaatgacgatgacgtctttcgactccagggcctgcttggattcgctaaagacgtggagcctcagttcgtgatccgcctcagagccaagtacacatgcgaagtgatcgatgcaattcttcagctgaggaagcctagcaaagccaagtcatga

SEQ ID NO: 11861 - RNA, 981 nt, unidentified
  source 1..981: mol_type = other RNA; note = synthetic construct
atgtccatcctggaaggactcgcaatggcttcttcaatattcagccggatgcaagaggcttacgctctctcagacgaacagctgaatctgcttgtgaagagaagtccccactcttacaaggtatacagtatcccaaagaagagtgggggcaataggcagatcgcccagcctgccaaggagactaagtacctacagtattggttgattgaaaacgtcttttccctgctccccgtacacgaatgtgcctccgcctaccataagggggcctcagtgaagagcaacgcagccgcgcactcaaaaaaccagtatctatccaagtttgacttccgcaacttttttccctcgatcgttttttctgacctcgtgcggcattttgagaaacatctgaatgatcatgtgcaagccgccgacattctgctcatcgcacggcttgcgtgcatcagaccaaaaggaacgagcaatttgtgtctgtctataggtgcaccgtccagtcctatactcagtaactccattatgtacgagttcgatgaaaggattagcgggtggtgcaaggatcacggcattgtgtatacaagatatgctgacgacttagccttttccaccaacataaaaagcatttcttacgcggtcgagaaggagctgagggaggtgctggcaggtctgcaatatccaaaattagttttgcatgctgagaagaccatccacgtttccaaaaaatatcagcgtaaaatcacaggcgtcgtgatcaataaccagaatgcattaagcattggccgagaaaagaaaaggatcgtctcgtcactcatccaccgattcgctcttaatggactgagcgatgccgatatttctcgggctcaaggccttctggggttcgcccacgatgtggaacctttgttcgtggtcagaatgcgccagaagtacggattccgtgtgattgaccagctgctgagcttccgcgttcagtctgaggagaaaaaatga

SEQ ID NO: 11862 - RNA, 942 nt, unidentified
  source 1..942: mol_type = other RNA; note = synthetic construct
atgtctactaacctaagacgcgaaatcactggctccttagggatctcagacttgcagatcaatagaataatcacacgcagcccctatgcgtacaagacctatagtattaacaagaagtcaggcggaaaacggataatttcccagcccgctaaagaaactaaattcattcaacgatggctagtcgaaaacgtgttttcaaagcttccaatccatcagtccgtaacggcctatagagcaggttctagcattaaaaagaatgcctctattcacaagaacaacaagtatttcgccaagttcgatttcaaagatttctttacctccattcgatccgatgacttaatagcacatctgaataagtacctcagcgacaaatactcatacgaggagattatggatattgctaggatcagttgtaagaagaataaaaggagtggaaagctgtttcttaccatcggagccccttcttccccaatcatcagcaacacagtgttgttcgacttcgacacactgctctactcttggtgctgccagaataacattacgtatacacgttatgctgatgatttgaccttttccactaacgagaaggagagcaccaaaaacatagaaaagaatatacggtcgatcatccgggccattgagtacccgcggctgattatcaatagcaagaaaaccgttcacctctctaagaaatctcagatcagaatcaccggtctgatcatcgacaataacaaaaacgtctcaattgggaggaaacgtaaacgcgaaatttcgagcctgatacacagcttctcactcggcgcactgcccaatgacgaggtgtacaggctccagggcctgcttgggtttgctaacgattccgaacctcaatttctggagagaatgcgcagtaaatacagcagtgagaagattgacaatatcctgaagatcaggaagcagtga

SEQ ID NO: 11863 - RNA, 945 nt, unidentified
  source 1..945: mol_type = other RNA; note = synthetic construct
atggatgaatcccgatttaggcagttactcaaagacgagttgtctatctctttctctgaatccgcacggcttattgctagggctccgcatgcctataaggtttaccgtataaagaaagtgggcggagggtatagggaaattagccagcctgcaaaggagactaaatttgttatgcactggcttgtgggaagattttttgagaaactgcctgtgcacgaatgcgccaccgcgtatagctccggctcaagtatcaagaagaatgctatcattcacgccgagaaaagttacatcgcaaaattcgatttcaaggattttttcccctcaataactaagttcgacgtcgagaaacatctcggctgctttaacagggaggaacttgacggcaaaagcctgtcggagatagccagactgtgcacagtggcgaaagggggatcagataatttgtgtttatctatcgggagccccgctagtccagttctctccaattctatcatgtacgccttcgacaggcgcatttatgagtggtgttgtgacaattccgtggtatatagcagatacgcagatgacctgaccttttccaccaacgtgaagggtctaagcttcgaactgccagagctggtccgcacagtattggacggtatcgagtacccatcaatcagcctcaacaacgagaagacggtcttcgcctcgaaaaagggccaccggcgggtgacaggtctagtgctgtcaaaccccggcaaagtgtctctgggccgaaagcgcaaacgcgagattagtgccctcatccataagtttagtgtgggagctctttccaaggaagacctgctgcggttacaaggattgctggggttcgtcaaagatgtggaacctctgttcgtcgaaaagatgatttccaagtacgggtacagagttattgtaaagatcctcagctttcgtaaggattga

SEQ ID NO: 11864 - RNA, 939 nt, unidentified
  source 1..939: mol_type = other RNA; note = synthetic construct
atggatgaatccaaattcaggagactgcttaaagaggagctcagtatctcttacagcgagagtgccaggcttatcgccagagccccccatgcctacaagaaatacaggatcaagaaggcagatggaggcttcagggagattagccaacccgctaaggagacaaaatttgtaatgcactgggtgattgaccgcttcctgaaaccactacctgtgcatgagtcggccgctgcctatcggaagggtgcatccgttaaaaagaacgccgcgatgcacagtagcaatagctacctggccaagtttgacttcaagaactttttcccctcaattaagatttctgacatcgaacgtcatttagcattacatggcgacagaggtcttgacgagagatcagtaagcgagatcgcccgattgtgcacgatagctcacatggaggggaaatgtctgtccatcgggtccccggcgtccccattcctgtctaatagtatcatgtacgacttcgacgaaaaagtgagccgctggtgcgcggaaaatgctctgacctatacacgttatgcagatgatctcaccttctcaactaacgttaaaaacctctcctttgaggtgcagggcttcctgattgaggtcatacagagcctggagtatcctgcaattgaactgaatgaaaacaagaccgtctacgctagcaaaaaggggcaccgccgggtgactggagtcgttctctctaatgccggcaatgtgtctctaggcagggaacggaagcgggaaatttctagtctgttgcacaagtttcgcataggagagttgtcccgcgaagaagtctataggctccagggtctgcttgggtttgctaacgatgtcgaacctgtgtttgtggagcgaatgcgaaaaaagtacggacacgatttgctctggcggatcatgtcactgtcaagagagtga

SEQ ID NO: 11865 - RNA, 948 nt, unidentified
  source 1..948: mol_type = other RNA; note = synthetic construct
atggatgaaaccgtctttcagtcacttctgcagaaggagctggccatatccacttcagaatcaggacggctaattgcccgggccccctatgcgtataaaacctacagtatcaagaaggctaatggcggtcgcagaaccatcagccagcctgcaaaggagacgaagtttgtgatgaggtggctggtggatcgaatcttttcaaagcttccaatacacgagtgtgcatccgcataccagaagggaagtagcatcaagagaaacgccatcacacactctaacaatggatacatcgccaaattcgacttcaaagattttttcccctccatcaaacgtgaagatatcgagacacatctctaccagtatttacctaaggacctggaactggatagaaaaagcattagccaaattgctagattgtgcaccatatcaactggtggaggtaggctggccctatctgtaggctctccggcaagtcccgctctttctaattccatcatgttcgactttgatactattatcgccaattggtgcttctcgaattccatattctacacgcgctatgcggacgacctcacatttagcacaaatcgaaagggcttgtccttcctgattctggaacagattcacaacaccttgagcgaagtcaactaccctcaactgagcataaacgacaggaaaactgtttactccagtaaaaaaggacatcgccgtgtgaccggggttgtgattaacaataacgggaagctgtcgttaggccgcgagagaaagaggaaaatcagcagtatggtgcacaagtcttgtctcggcgtcctctctgatgacgagacacggcatcttcaggggctcctgggctttgctaaagacgtggagccattgttcatcattcggctcaagaacaaatatgggaagagggctatccaggagatcttcaattcccaaattatttga

SEQ ID NO: 11866 - RNA, 960 nt, unidentified
  source 1..960: mol_type = other RNA; note = synthetic construct
atgacgctccaagaatttctgcttaagatatcaagcgccctcgcaatttctaacagcgaacttctccatttaatagctaaagccccgtacagttacaagtcttacaaaatcaagaagaagtccgggggagatcgggtgatcagtcagcccgctaaagagatcaaatatctccagaacatcataatggaggccttcctgaataaattgcctatccatgagtgcgccacagcctacaaaaagggcggctccataaagaaaaatgcagcagctcacacatccaacacatacatcagtaaattcgaccttaaggatttcttcggatctataaaggccaacgacgttagtcaacacctggagaaacacctcaatggagatttacccccagcttcatatcagctgatcgcgcgaatttgttgcatcaaacataaaggtctagaagaactgtgcttatctatcggtgcaccctcatctccactgctctccaattccattatgtacgaaattgatcagaagattagccagtggtgtcgtgagaatcaggtaacctatacaagatatgccgacgacctgactttttcaagcaacatcaagggaatcagctttgaaatcgaaggtctgctgagcgacattctttctacttcgcaatcccctagattgaagattaacgagaagaaaaccatccacgtgagtaagaaaggcaccaggagagtgactggcatcataattaccaacgacaataagatgtcactcgggcgcgagagaaaacggctgatttccgccatgatccaccggaatctggtccagaggctggaggagaaagatattgagaggctgcaggggcttctggggttggcgaaggacattgaacctattttttgtgccaggatgcgcaagaagtatggcgctgcagctatcagcgagattctacagtaccgacgcgaggaattgaaggaggattga

SEQ ID NO: 11867 - RNA, 960 nt, unidentified
  source 1..960: mol_type = other RNA; note = synthetic construct
atgacttttcaggagttcctgctgaacatttcttccgcactggcaattagcgactcagagcttttgcatttagtggctaaagctccctattcatacaagtcctataagatcaagaagaaaacgggaggtgaccgagtcatttcccagccggcaaaagagatcaagtacatccaacacgtattgattgagttcttcctaaacaagcttccaatacacgagagcgccactgcctataagaaaggcggctccataaaaagcaatgcggcagcgcaccgtgagaacacttacattagcaagttcgactttaaagacttcttcagctctatcaaggccgccgacatctcactgcacctcgaaaagcacctcggggatgatctgccacccgagtcctaccagcttataagtaggacatgttgtatccgacataagggcgccgaagaactgtgcctgtccattggagccccctcgagccctctgctgtcgaatactatcatgtatgaacttgaccagaaaatatctgaatggtgccaagaaaatcaagtcatttacacccggtacgccgatgacttaacgttttctagcaatatcaagggcaaatcttttgaaatagagaatgtgctgagaagcattctcagtgccacccctagtcccaaactgagtattaacaacaagaagacaatccatgtgtcaaaaaaagggacaaggcgggttaccgggctcatcatcacaaatgatgataagatttccctcggtagagagaaaaagcggctcatttcttccatgatccatagaaacctgacccagggattgaagtcaaaagatatcgagaagttacagggcttgctagggctcgctaaggacatagagcccattttttgctctaggatgcgcaaaaaatacggagctgctaccatcagtgaaatcctgcagtatcgccgcgaggagccagaagaagattga

SEQ ID NO: 11868 - RNA, 951 nt, unidentified
  source 1..951: mol_type = other RNA; note = synthetic construct
atgtctcatcacgatttcttgcatgatattgcatcaacactgacgctgagcctccaagagttggtataccttatcgcaaaagctccccacagctacaaggtctaccggattgaaaagaagactggaggaaagaggatcatcgcccagcctgcaagacagatcaagtatctgcagcgggccctaatacacagcgtttttaaagagctcccaattcattcttgtgccacagcctatgctcacggctcaagcatcaaaaaaaatgcggagccccacaaaaacaacaagtttatctccaaattcgacattagtgatttcttcggcagtattaaggagcacgaccttataaaacacttcaaccgtcatttggccgaaaatattaacccggactactttagatacatcgccagatcctgttgcataaattataagggaacccaggagctggttctctctgtgggggctccttcctctccaattctgtcaaacagcatcatgcacgagtttgactgcatcattcacgattggtgcacctcaaaaaatatcacctacacacgatacgcagacgacttaacgtttagttcgaacactaagggcgtcagtttcgaaattgaaaaagccatcaccgaggcactgaatagtctggactatcccaccctgaaattaaatactaagaagaccttccatgcctccaaaaagagccaacgcaggattacaggcctcattatctccaatgagggtaaaatctctctcggccgcgacaggaagcgaactatttccgctatgatccataaattcagcaacggagcgctgcctgaagaagatataccaaagctacaggggatgcttgggttcgccgaggatgtggaacccgtgttttcctctaggatgcgggctaagtatggtgtgaaggctatctcagagatatttcagtatcgcaaacagaagaagtga

SEQ ID NO: 11869 - RNA, 945 nt, unidentified
  source 1..945: mol_type = other RNA; note = synthetic construct
atgaagcaggagagccctattatagccgccctctgttcggagctcgggtttagttctaaccagctgatgcgcctgatcgctcgggcaccccatacctataagacttacaaaatccctaagaagacttccggatttaggacgatcgctcagccagctcgcgagacaaaaattctgcagaattggctgatccacaacgttttcaaggatctgcccgtctctgaaagcgcatccgcctacaagaagggagcgagtattaaaaaaaacgcgtctcaccataaagactccagctacctcctgaagatggactttaaaaacttcttcgaatcaatcgacatcgagatgatcaaaaatcacctcatctcatgcttagacgtgtcacgattagatgctagtgccatagcccgtatatgctccattgacacacaatccagcccaaaccatcacctgagtatcggcgccccatcttcacctattctatcgaacagcttccttttcaatttcgacttggaagcagagcaatggtgcaaggaaaacaactgtatatacactcggtatgcagacgatattttcgtttccacaaatgccaagagcaaaacaaaagaggcagaacagttgattgaaaagttggtcaatgagctgctgccgggccttaagttaaatcacaagaaaaccaagcatctgtcaaagaaattcaatagaaccatcaccggacttgtgatctctaacgataatgaagtgaccctgggtagagataggaaaagggaggtgcggaagagtgtgttcctctatactaaagggctgctcgaacatgagcaggtcgagaaacttcagggtaccttgagctttgccaagcacattgatcccgtatttctgtctagcctacaagagaagtttgggtccgacatcattggcgagatatttaacgctcgaagaaaaacgaagtga

SEQ ID NO: 11870 - RNA, 936 nt, unidentified
  source 1..936: mol_type = other RNA; note = synthetic construct
atgaccactactcctagtttcctgtctaaactcgctaaggcctataagctgactgaaaccgacataaagaggctcgtggctcgggcacctcatacatacaaaacctacgaaatcccaaagaagagcgggggtaagcgcacaattgcccaacctgccaaggagacgaagataatccaaaattggttgattaagacggagtttaaaggcctgccagtatctaactccgcgtcggcctataagcccggcagtagcattaaaatcaatgcactgaaacaccggaagaacagatacttgctcaagatggatttcaagaacttcttcgagagtatcgacgaaacaatggtcaaagagcacttattcaagtacttacagattcccgagtcagacgcagctactatttccagggtttgttgcttccagaagaaacactcaaaaaagctgagcttgtctattggagccccctcttcccccatactgagtaactccattatgtacgagtttgacgccgaaatcgaaaattggtgccgcctgaatgcggccatctatacacggtatgctgatgatctgttcataagcaccaatcaatcaggcagaacagcagatgctgagcagtttatcctgactctgaccaaagagctcttgccgaaactcgacatcaataagaacaagacaaaacacctgagcaaaaagtgtaaccgaaccatcactggacttgtgatcaccaacgaaggcggagtgtccctagggcgtgacaaaaagcgaaatatcaggaaatcactgtttctccatcagaaaggacttttagacaaaaagcagctgagcacccttcagggggagcttggtttcgcaaaacatatcgatccagactttattaccacgctaaatgataagtttggcaaccagttcattcacgccatatttacacatagagaatga

SEQ ID NO: 11871 - RNA, 945 nt, unidentified
  source 1..945: mol_type = other RNA; note = synthetic construct
atgaaatctaagctcagggagattatcaaaaagaagtttgccctctccgatgctgaagtcgccatcttgatctctcgagcaccagtctcttacaagtcctataagatcaagaagaagaacgggggacatagaaagattcatcaacccgcacgcgaaataaaggctctgcagagatggatcctggatgctgtattcagtaagttaaaggttcatcctagcagtacagcttacgaaccagggtccagcattaaagagaatgcaaagcggcacctcgacaactcttatttcatcaagcttgacttcaaggatttctttcacagcattaaatctgaggacatcattcagttcctcacggataagggtatcaagctgaataaccgtgacttgtccgacctggtgcgaatcctgtgtatcaaagacggcgagagcctatgcttatcaatcggcgccccctcaagtccgaaggtgagtaacgtgattctgtatgattttgacgaggccgtcactaattggtgcagcgaaaatgaagtaacttacacaaggtatgcggatgatcttacattttccaccaaacgcaaggggatcggacacctgatagagaagcaagtgttggagattatttccgagattcagtaccctaaaattgagctgaaccttagcaaaagagtgtctgtgtcgaagaaggattgggttagcataaccggcctaaccataactacccagaactccatctcagtggggaggaagcggaaacggtttgtcaaaagcctcatatacaaacacctgtcagacggccttcaggaaaaaaaactgggtgaactgaatggcctgatctcatttatcgaaaatattgagcccggtttcaaagacaaaatgctggagaaatacggagatgttcctggattgaacctcaaaaaggccaaagacgaggtgagtgacttatga

SEQ ID NO: 11872 - RNA, 945 nt, unidentified
  source 1..945: mol_type = other RNA; note = synthetic construct
atggaaaataagctgcgcgagatcattaaaaaacaatttgcactgtcggacactgaagtcgccatccttatatccagggcaccagtgagttataaggggtacaggattaagaagaaaaatggaggacacagaaagatacatcagccagcccgggaaatcaaagccttacagcggtgggctttggatgcagtttttagcaagcttaaagtccatccttcaagtaccgcctatgaacctgggtccagcattaaagagaacgcgaacagacacgtgaacaacgactattttattaagctggacttcaaggactttttccactctatcaagtctgaagacatcgttcagtttctcagtgataagggcatcaaactcaacagcaaggatctgaccgatctcgtgcgaatcttatgtatcaagcatgaggacagcctttgcctttccattggcgctccttctagccccaaagtgtctaatgtgatactgtatgacttcgatgaaaaggtcacatcatggtgtaatgagaacaacgtaacgtacacccgttacgctgacgacttgacattttccaccaaacaaaaaaacatgggtcacctcatcgaggagcggatcctgaagattatctacgatatgaattaccccaagctggagctcaatatctccaaacgagtgagcgtttctaagaaagattgggtcagtattacaggggtgaccatcacttgccagaagactctgagcgtgggtcgcagaagaaagcgcttcgtaaagtcaatgatatataagcacatgtcggagggcctaaaacagcataacctgtcagaactaaatggcctgattgccttcatagaacacattgagcccggcttcaaaaggaaaatgattgagaagtacggaaatgtggctggattgaacctgaaaaaggagtccgacgaagatccggagatctga

SEQ ID NO: 11873 - RNA, 930 nt, unidentified
  source 1..930: mol_type = other RNA; note = synthetic construct
atgagtgaaagtaaactgcgccaactgatctcttcatctttattcatccctgagaaagacctcagcctattcattgcaagggcgcccgtcgcatacaagagtttctttatagccaaaaaggatggagggttcagaaaaataaaccagccggcgaaggagacaaaaaaactgcagaggtgggttatagagaaggtcttctcacacctggacatccatgattgcgcaatggcctatagagctaaagtgagcataaaagacaacgctctcgtgcactccaataacaagtacttcctaaagctggacttcgaaaactttttcggaagcatcaaatccgaggacatacagaatttccttcacgacaagaaaatcaagctggatgatgatgatgtgagggacttggccagaattttatgtattaaggacgagggcaagctttgcctttccgtaggtgctccatcctcgcccgctgtctctaatgctatcctgtacgcctttgacgaggagatctccttttggtgccttgaacgcaagatcgcatatactcgatatgccgacgatttgaccttttctaccaaagaacaagaagcctgttacagcatcaaggagaaagtgaagtctatcttggaatctatggcctatcctcggctgaagctcaacgaaagcaagaccctcagtctctcaaagaagaataatattaaggtgacaggcattacggtaacttccgataacaagattagcattgggcgaaaacggaagaggtttatcagatcacaggtgtacaaatacaaaaaaggagagttgaagccctcaagtgttcctcgtctgcgcggcctgattgccttttttgaacatatcgagccaggggcaattagcaaactcgagatgaagttcggcaaagagctgatggttcgggtcgtgaagggttcctga

SEQ ID NO: 11874 - RNA, 981 nt, unidentified
  source 1..981: mol_type = other RNA; note = synthetic construct
atgcatatcctggagaggatttcccatgacctcctagtgccccaaagcttgcttgaagatgccctcagaagggcccatgttcggttccggaagatcaagatacctaaaagaagtggcggtgagagagtgctgctgcagcccgctgccgagctgaaattaattctctcatgggccgactcctacgtgctgcgcaaggctcccgtgagcaatgtcgccacagcctttgagccagggacctctatcgtgcgcaacgcccagatccatagtaaaagcgattatagcgtcagagtggacttgtctaatttctttcctagtatcaggagccacgacttgcttagggctttgagcaaggcacgacagcactttcccgaatgggtgttcgaaagggatttcgaagacatgctgagaaaagcatgctttgatagagccgattccctcccggtagggtacatgacgtcaccaaggatcgctaacatcgtcatgctggacgtggacactaccctgcagactaccatatcatccaatcctgaacgcttcggacgcgcttacatcactaggtacgctgatgacttcgtcttttctactaatcggaagggagcatgtaacgagtttgtagaggagttacgtacactgctcgcaagccgaccgtcgccaaagctcgctataaatgaagcgaaaacccggtttatgtcacgcaagggcggcacaacgctgattaccggactacgggttaacaatgatggggacgttggggtccacgcaaactatagagatcacattcgactgcttctgaagctgttcgccacaggccggttagagcaggcggaaaacgagtccttgcgtggacacctcgctttcattgaacacgccgacccaagtcttttcacacgcctgtcctatcgttatcacgccgagattgccaagttacgaggccatgcgggtctgaccgcactccctgcaccccaaaaactttcttcttga

SEQ ID NO: 11875 - RNA, 957 nt, unidentified
  source 1..957: mol_type = other RNA; note = synthetic construct
atgaacatagtggaaaggatgtccaatgaactcagtgttccccagtccttgctggagagcgcactgctgcttgcccacgtgcgatttcgcaagattaaggtaccaaaacggtctggaggtgaacgcgttatgatccaaccggccagtgagctgaagttggtcctgagttggctggacagtcgagtattgtccaacgcccctgtgagcccaatcgcaaccgcatttgagcccggcacatctatcgtgaagaatgccagaactcactcaaagtccctttattccgtgcgcatcgatctgtcaaacttcttcccaagcattcgcagccgtgatctcttattggccttatcaaggtcgagagaactcctgcctgagtgggcctcaggaggagattttgagacgttggtgagaaatgcctgtttcgatcgggctgacaggcttccagtcgggtacatgacttctcccagaatagctaatatcgtgatgctcgagctagacacagccctggcgacggctgtgagtagggacactgtccggtttgggcaggcggtgctcacacgttacgctgacgattttgttttctctactgacaaaaagggcgcttgcaacgaattccttagcgagatgcgttcccttctcgcgagcacacccagccctaagctgtctattaacgaagcaaagaccaggtttatgtctagaaaagggggcaccaccttaataaccggactgcgggtcaataatgacggtgacgtcggtatccatgcaaactaccgggatcacatcaggatgctgctaaagctgtttagcaccgggcggctcaaacctgcagagaacgagaaactgcgcggccatctggccttcattgagcacgctgaccccgatctgttcacacgcctctcattccgatatcacgctgaaattgccaaactaagaggccatccttccctgaatccggcctga

SEQ ID NO: 11876 - RNA, 921 nt, unidentified
  source 1..921: mol_type = other RNA; note = synthetic construct
atgctcgatgacgcaatccaggcggcctacttcaggtttaagaagtttaccataaagaagcgatcaggcgaggatcggcacctgattcagccagccgcggaactgaaactcgtaattgcttggctggacgctgtcgtcctttccaagctgcctgtgtccgaccttgctactgcattccaaccaggtacttctatcgttatgaatgccgaggcacatcgaaagtcggcctattcagtccgcttggacgtcagtggctttttcccgtctatcaggtcaaaggacctgattcgcgccataaatgacgctaaaccccgttttgaggagtgggtgtttacccccgcattcgaacaactcgtgcgcaaggcttgttttgaccggagcgataggctgccggttggctatcccagctcccctcgaatcgcgaacgccgtgatgtatgaactggatatgcggttaaaccagctcattgcagccgctcctgaaagattcggacaggccgtgcttacacgttacgccgacgattttgtgttctccaccgataaacagggagcttgccggacattcgcagatgagcttcagacaattttagccagatgcgccagccctaaattgagtataaacgtcgcaaagacacgctacatgagtaggaaagggggctctactttaatcaccggtctacgcgtaaatatggacgggaaagtgggcgtgcatgctaactacagagatcacatccggctgctcttgaaattgttctctgtgggaaagctagactttgaagagcatgagaaactcagagggcacctggcctttattgaacacgccgatccaaggctgttcacgaagctgagcttcaaatattacaaggagatcgccagcctgagaatgaaaaaggctgttcccgaacaggagtccccacaatga

SEQ ID NO: 11877 - RNA, 954 nt, unidentified
  source 1..954: mol_type = other RNA; note = synthetic construct
atgacagacttccctgccctcatcggcgagaagactaacgtccccacagagatcatcaaatccgccgtggatttggcgcacatacggttccggaagattaaagtgaaaaagcgatcagggggtgagaggatcattatccagcctgccgccgagctaaagctggtgctggcttggctcaataacgaagtcataagcaagcttcccatttctccgatagcaacggcctttcgaaaagatgcttccatcctgaagaatgcctcggaacacaaggccagcttgtacagtatcagggtcgatatcaaggagtttttcccatctattcgcagcagtgacctggtgctcgcaattaagagctctccaattgaacttcctcctttcaccgccgaggcaggctttttcgactttatccaacgttgctgtttcgaccgcgatggacggctgccaatcgggtatcccacatctccagccatcgctaacgcagtgatgcggaacatcgatgtagcactgctgaataaaattaacattgaccccaccaagtttgggcaggcgaggctgactcggtacgctgacgatttcgtcttctcctccgacaaacctggtgcttgccgatcatttcttgatactttgcaggagacgctcattagaactacctccccacgtctggcaataaatagtaaaaaaacccgcttcatgtcacgccgtggaggcagcacattagtgacaggactaagaattaatcaggacggattagtaagagtgcatcccaaatatagggaccatgttaggctcctgttaaagcattttgctaacggctcaataagcgccgacgatgttccgcgccttgttgggcacttggctttcgttcaacacgccgatcccaggctgttcaccagactcagttttagatactttgaggaaatcgcgagactgcggggcaagcaggaaaatacctga

SEQ ID NO: 11878 - RNA, 942 nt, unidentified
  source 1..942: mol_type = other RNA; note = synthetic construct
atgacaaatttccctgtgctcattgccgatcagatgaaggtcccagttgtgttagtagaggacgcccttaagctggcattcatacggtatagaaaaatccgtgtccccaagaggtccggcggttaccgcacaatcatacagccggcagcggagctgaagctagtgcaggcctggctgaacgagaaaattttcaaacacctgccccttagcagtgttgcaaccgcgttcagacccggcgctagcatcacaaacaacgctgctatccacaggaactccttgtactccgtgcgcgtagatatcaaggacttctttccatctataaggagtgtggacctcattcgcatcgtgcggagcaaccgatcggctcttcctccatttgtgatggagacggggtttacgaatttggttcgccaggcctgtttcgatcgagaggggagactgcctatcggataccccacttccccttctattgccaacgccgtgatgcaccaaaccgacaagatgcttattaatgaaatcaccagcgatgtcagcatctttggcaacactcaattaacacgttacgccgacgactttgttttttcaaccgacaaaagtggggcttgccatgagtttgtgcgcaaattggagagactcctctcaacactcgaatctccgcggctgaaactcaatacttccaaaaccaagttcatgtcaaggcgggggggaagtactcttgtcaccggtctgaggataaatcaggaaggactggtcagagtccatgcaaattatagggatcacgtacgcttgctgctgaagcacttcgcagccggctctctccagtcagacgatgtgattcgactggtgggccatctagcctttgttgaacatgcggatccaaggctgttcactagactgagcttcagatattttgaagagattgctcggctgcggggaaagtga

SEQ ID NO: 11879 - RNA, 951 nt, unidentified
  source 1..951: mol_type = other RNA; note = synthetic construct
atggatagcatcgtgtcaaaaattagcggagatctgaaaatacccattgccactctggagattgctattaggctcgcaaagactaggtgtaggaaattctctatcttgaagaagaatggcgacacccggcaaatcatccaaccttcagtgaaagtcaaacccatcctgtcctggctcagccttaatgtcctgaactccttaccagtacacgacgcggctacagcctttcgaagggggaagtctatactcgataatacttctaagcacaaagaggccgactactctgttcgattagacctgaaggattttttccctagcatcaagccagaggacttgtggagagtgatgctcgacagtcgccacttgatacccgaatggtcgattaaggaagacgcgttttggcttattagtaacgtatgctttgaccagaacaaccagcttcccatcgggtattctacgagtcctgctatagccaatgctgtgatgcatcggattgataccacgctggccaacgccgtgatggacgactcacgtttcggagcagccacagtgactcgctacgccgatgatttcgttttttccacaaataagcggggggcatgcaagaacttctcagatcttctgcatgatgtcatcaaaaccacaaacagcccaagcctccagattaatgaaaacaagacacgctatatgtcccgtgcgggaggcagtaccattatcaccggtctgagagtcaataatctgggcgccgtcgttgttcacggtaactaccgcgaccacgtgcggctgctcttaaagctgtttgactccggcagactggcattggatcaggtgccgcagctggcaggccatcttgcttatatcgaacacgtggatcctgctctattcaccaaactgagcttcaaacattacaagaggatcgaggagatcagatccctaagactcgtggagtga

SEQ ID NO: 11880 - RNA, 936 nt, unidentified
  source 1..936: mol_type = other RNA; note = synthetic construct
atgctcgctaaaattagcgatgacctcaacataccaaggccgcttctggaaaatgctttggccttagccgcgacacggttccgtaagatcacattcaaacggagatctggcccacctagagtggcctaccagcctgcggttgaactgaagcccatccttgagtggttggacatcaccctgataagcaagctgcccgtcagccgcatcgcaacagctttctgcgcaggttcatctatagttcagaacgctcaagtacaccgagactccctgttttcaattagggtcgatatctcgaacttcttcccaagcattaccagttctgaccttgtgactgctatcgaagcaacttctcacctgccagaatggagcaatgcaccgactaccctcagggtgctgaaacaggcctgttttgatatcaacgaccgactccctattggatattccacgagtcccaggatcgcgaatgccgtgatgttctccctggataacctgttgatccaagctattagcgatgagcggcgatttggtaactccctacttactcgttacgctgacgactatttattttcaaccaatcagcgcggggcatgcgcagagttcctgaaggagatcagaaaaattctcaatagtgtccagttccctaaactgcagataaataacgagaagactagattcatgtcccgcgccggcggatccaccttaatcaccggactcagaataaagcagacgggcgagattggggtgcatgcccattatcgggatcacgtacgcttgctaatcaagctgtacgccgccaataggctgcgggccgaagagtttgatagccttcgcgggcacctcgcctttgtggaatacgctgaccccaaactgtttacacacctgtcattccatttttctgacgagattacaaggattagatcgaccgatagtttgtga

SEQ ID NO: 11881 - RNA, 939 nt, unidentified
  source 1..939: mol_type = other RNA; note = synthetic construct
atgagcaacattatcgacttaattgcagatgatctacagctgccaaaaaccttagtcaaatctgcggtcgatttcgctcgatccaataaccgcaagataatcttccccaagaaaactgggggcaaacggactgccctgcagcctagcgtagagagtaagcctattatgcattggctacggctgaagctgattgaattgttgccgattcacatgatcgcaacgggattcagagctaatcactctatcctcacaaatgcggatcgacacagacaatctgcatacagtgttcggatcgacattgaaaacttcttcgagtcaatctcctttaacgactttaagaaaacacttgaatcgaataaggccaccctgccaagttgggccctggaggaagccactctgtcactggtcgagaagatctgtttcgatcgcgacggcaggcttccaatagggtaccccacttcccccggcattgccaacgccactatgtttgagatcgactctgccctcgaatcccttatcctggatacaaccacattcgggcaggctatagtgtcccgctatgcagatgacttcaccttttctaccgaccttagaggaagttgcagggcttttcttgaaaagttggagctcctgctggcttcacagaccagccctaccctgaggatcaacgccaaaaaaacacggtttatgtccaggggcggtggaagcacgttggtgactggtttacgtataaataattgcggggtggttgtggtgcatccagagtatcgcgaccacatcagattgctcctcaagctgtactcacgcaataccctcaagcaggaagatattcccaggctcctaggacatctggcacacattcaaaacgtggaccctggctttttcacaaaactgagctatcgttaccatgaggagataagccggatcagaaaaaagtga

SEQ ID NO: 11882 - RNA, 939 nt, unidentified
  source 1..939: mol_type = other RNA; note = synthetic construct
atggacgatattttagaactaatggcagcagatcttagcctgagcaaaactacacttaagtccaccatcttctccacaaagcggaaatatcgcaaattctcaatcgaaaaagcttctgggggtcaacgagttattcaccagccgagcattgagcttaaacccatcttgtactggatccagatcaatatactcgataaactgcccgtccacaaaatctcaaccgcctttaaaaagggcagtagcatcttgaacaacgcctcattacatcaggaatcactctattccattagagtagacattgacaatttcttcaacagtatacaaccccaagacttgattagcgcgatccgggaaaatcaggcaaacctgccagagtggactaaagatgggtacgtggatgagctggtgacactgtcctgcttcatttcgagatcctacctgcctatcggatacctgacgtctcctcagatcgccaacagtgtcatgtttaagattgacagcctgctcgacgaggaattttctaatgaaggcaagtacggcgtggccaaaatttctaggtatgcagatgacttcatcttttccaccgacaagaagggggcctgtaaggacgcgctggaaaagttgaaaagtataatcgaagagtcgaaacacccaaatcttgctataaacaagaagaagaccacttacatgtctcgaccaggaggctctgctagggtgaccgggctccgtatcaataatcagggaaagattatagtgcatgcctgctatcgcgatcatgtgaggctcttactgaagctgtataaggagaatcggctgaacgaggagggtggaaaggagaaactagtcggtcacctggctcatattcagaacgttgatcctggcctctttacaaaactttgtctgaagtactccagcgagatccacgagctcagaaagtga

SEQ ID NO: 11883 - RNA, 939 nt, unidentified
  source 1..939: mol_type = other RNA; note = synthetic construct
atgtcctctctagctacacttgctgctgccgagtgctgtgtgccagagtcttgggtgaacgatgtggtcagacagggaccgtcccgcgtaaagacgttgcggatcgaaaagagtacgcccggaaaatttcggatcatctctagacccagtgcagagctggaaatcttacagcggtggttggttttgcgctttttcgaaaaaatggaggttcacgacagcgctatggcattccgacgtggccgctcaatccttactaacgcccaggcccatgctaagtcaaggtttttcgtgagagtggacttctccaatttctttccatcaatcagatatgcggatttcagcttcgctctcggaaaatcaaagaaccttgggtattttttctcagagtatgcagatgcaggcaattttatccaaaggatatgcttcgattcgaacctgaggctgcccattggttatataagctctcctacaatttccaatgcagtgatgtttgaatttgatgtaagaatggaaggtatggtcgcggccaacggcggggatcttggcaatgccaaggttacacggtacgcggacgacatagtgttcagcaccgacaagaagggcggctgcgcaaaatttgtcgagctgctgcgtgagctggtgaagacctgggcctccccactcttgagtattaatgagaataagaccatcttcagttccagctctggtgggagtgccattgtcactgggctgcgggtctgtagcgatagccacattaccataacaagggaatacaaagacaaaatcaggctaatgctgtctctccacgccaagaaatgcctgcgccctgaggacctccctaaactgaagggacatctcaactacattcgatacgttgctcccgcctttttcagcactctgtgtgccaaatacacctccgtgatcgacaagttaatttga

SEQ ID NO: 11884 - RNA, 939 nt, unidentified
  source 1..939: mol_type = other RNA; note = synthetic construct
atgccatccatcgttaccctggcggccgctgaatgctgtgttcaggaatcctgggttaacgacgtggtgaggcaaggtccatctagagtgaaaaccttgagaatcaagaaaagtacaccaggcaaattccgggtgatttcccgtccctctgccgagctggaaatcctccagaggtggcttgtgctgaggtttttcgagaaaatggagatccatgagagcgccatggcctttagaaggggacggagcatcttaaccaacgctgaagtgcacgcccagagtcgcttctttgtacgtgtcgatttttccaacttcttcccttcgatcaggtatgctgactttgcatttgcgttggggaaatcaactgagctggcatacctgtttaaggaatactcggatatagggaatttcattcagcgcatttgctttgattctaacctgaagttgcccattggttacatctcctctccggtgatcagcaatgctgtaatgtttgagttcgatgcccggttggaaaatatcgtagctgcaaacggagaagatctgggctcagctcgggtgacacgctacgccgacgatattgtcttctcaactgacaagaaaggcggctgtacgaaattcgtcgagattttacgatcacttgtgaagtcttgggcgagccccagtctcagcatcaacgaggacaagacaaatttcagctctagcagtggaggcagcgccatcgtcactgggcttagaatatgttctgacaatcacataaccgttaccagagagtataaggacgaaattcgactaatgctgtccctgctcgtgaaaaactccctacgccctgaggacctcagtaagcttaaggggcacctcaattatgtgcggcatgtcgcacctgcattcttttccacgctgtgcgccaagtatacatcagtcatagccgagctgatttga

SEQ ID NO: 11885 - RNA, 939 nt, unidentified
  source 1..939: mol_type = other RNA; note = synthetic construct
atgagctccctggtcaaacttgccgctactgagtgctgcgtgcaggaacggtgggtgaatgacgtcatccgccagggccctagcagagtgaagacactaaaaattaagaagccaaagtcagccaaatttcggatcatctctcgtccttcagccgaactggagatactgcagagatggcttaccatcaggtttttcgaaaagatggagattcacgactcggctatggccttccgcaccggaagatctatcctcaccaatgctcagttccatgcgaagtccctgtatttcatacgcgttgatttcttaaacttctttccatccattcgatacgcagacctcaacttcgccatcgggaaatctaagattatccgcaatatcttcactgactacgcagatgctgggtcttttatagagagggtctgtttcgactccaacttgcgactacccattggttatataagtagccccattatttcgaatgcagttatgtttgagttcgacgtgcaactgcaaaagctggtaacggcaaacacaaacgaactgggcgacggccggatcacccggtatgctgatgacattgtgtttagcacagacaaaaaaggcggttgtgccaagtttttggaattaattcgcagtttcgtcaagacatgggcgagccccagcctgtccgtgaatgagaacaagactaccttttcatctagaaacggcgggagtgccattgttacgggactgagagtgtgtaatgatagccacgttactatcacccgtgagtacaaagataaagtgaggctcatgctctcacttcggggaaaacaggtgctccgaccggaggatgtgagggtactgaagggacatctggattatataaggcacatcgcccctgccttcttttccacattgtgcgcaaagtacactggggtcatcagtgaatttatctga

SEQ ID NO: 11886 - RNA, 939 nt, unidentified
  source 1..939: mol_type = other RNA; note = synthetic construct
atgcctaattttgcaagccttgccgcaactgagtgccacgtccctgaagactgggtagctaatgtggttaggcaggggccacgtcgtgctaaaatcttgcgcatcaagaagaagaacagcgataagtttcggagtattgctagacccagcgctgaacttgagatgctacaaagatggctgctgttgaagttcttcaaccaactcgaactccatgatagcgccatggcctttcgcgatggccattctatactgacaaatgccgtccggcacaaggggtccgcctacttcattcgaatcgactttaaagacttcttcagcagtatcaagttgcaggatttcatcatggccatgtcccagaccaaattctttggctttcacctgaccgagtattctgactacatggagttcatcggaaaaatatgctttgactccagaggaaggttaccaataggttatgtgacttcacccatcatttcgaacgctgttatgtaccggtttgacgtcgccttatcaaacgcaatttccgcccgaaccaaggaatttggtgtttctgtgctgacaaggtacgccgacgatatcgtgttttcaacagacctgaaaggcggctgtgccgctttcttgaaattctttcaggagttcgtgtccgcatgggcatcgcccagtctggtaattaatacggagaagaccatattctcctctaaagcgggcggaagcgcgatggtgactggactcagaatttgcaacgacaaccacatcacggtgacacgggagtataaggataagatcaggctgatgctctccctttatcagaaatctaagctgaatgaagatgagctgccggcacttcgcgggcatctgtcatacgtgaaacacgtctctcctgcgtttttcagtgccatttgtagcaaatacctaaccgctatcgaaaagctcatttga

SEQ ID NO: 11887 - RNA, 939 nt, unidentified
  source 1..939: mol_type = other RNA; note = synthetic construct
atgcctagtctcataacgctcgccgccactgagtgtttcgtccccgaaatttgggtgagggatgtcataaggcttggcccaagccgggtaaagagactgcgtatccgaaaaaagagtagcgctagctatagagtaattaagcgaccttcagctgagttggaaattctccagcggtggctgacactaaaattctttgagaatctggagatgcacgatgcagcgatggccttccgtaggggtaggtcgatactgactaacgctcagcatcacgtggactcaaagtactttctgcgcattgactttaccaatttcttcccgtctataaaatacgatgaccttaagaagtccgtggataaaagcagtaagaacaaaggaacctttgatgcctatcatgacgctgacctgtttatcaagcgggtttgcttcgatgagaatgagcgcctgcccattggttacatcagctctccagcaatttccaacgccgtgatgctggaatttgatgagaaagtccacaggcttatcgaaagcaacgaggaaaaacttggcgcgggaaagtttacaagatacgccgacgatgttgtcttttccactgacaaaaagggggggtgtaccgaattcctcaaaatcttctccagtctcgttgacggaacgacctctcccaagttgtcaatcaatgagaaaaagaccatcttctcttccaaattaggcggctcagccatcgtgacaggcctacgcgtctgccgggattcgcacattacagtgaaccgggagtataaagaccaaatccgcctgatgttgtccctctacgaaaaggggaagttagacaaagaagagcataagaatttgaaggggcacctgtcttacgtgagaagcgtggcacctgcattcttttctagactgtgcgctaagtattttaagtccatcgaggaattcatgtga

SEQ ID NO: 11888 - RNA, 972 nt, unidentified
  source 1..972: mol_type = other RNA; note = synthetic construct
atgtccaatcttgtaaaactcgccgctaaagattgttatgtgagtgaggagtggattaaaagcgtcatcgacagcggtccaaacaatgttaagatcatccacatcaagaagaagggagatcctaacaaaaccagaataatccataggccctctgcagagctggagacgttacaaagatggctcacactgaccatcttcaaccagttagccaaccacgagatcgccatggcattccttcgcggcaaatccattctgtctaacgcagaacgacacaggaagagtaagtactttattagggtggatttcaaagacttctttaagtccattaaggccgatgacctattcaagacaatcaagttctacaacaagagtaacagcttaatttcgctgtctgaatccgaccagttttttatcaagcgcgtctgctttgacaagctggggcggctgccaatcggatatatatcctcacctgcgatcagtaatgcggtgatgtacgactttgacacccggttgctgtctttggtgaatgataataaagccaaactcggggctggtattataactcgatatgccgacgatattgtgttcagcacggataccaaaggcggctgcttggagttccttaatctcttcaaaatcatggtcaacaagaatctgtcaccccgcatctttatcaacgaaaagaagaccatattctcctcaagagctggcggaagcgcaatagtaactgggcttagggtttgccaggactcgcacattactattacacgggactacaaagataagattcgtctgatgttgagcctcttcgaaaaaggcaaactcatgcaggaagacacagctaccctaagagggcatctgtcttacattgagcatgtggctcccgcctttttttcaaagatttgtgccaagtacctgtatggaatatctaaaatcctggatccgactccaagccctcaacagaacaattga

SEQ ID NO: 11889 - RNA, 951 nt, unidentified
  source 1..951: mol_type = other RNA; note = synthetic construct
atggagatatatagcattatcgatttcgaaaccctgatgcgaagcggctttacatctgaagtgatgcggtcccccgagccgcctaaaaaatgggacatccctaaaaaaaatggaggggttcggactatttaccatccagcatcaaaagtcaaactcattcaatactggcttataaacagcgtcttgataaatctgcctattcacgaagccgcttatgccttcatcaaaaaccggtctattaagaagaacgccctgcgtcacgcatcagcgcgcaacaaatactatgtgaagatagaccttaaggactttttccccagcattcactatgacgattttgagtacgccttcaagaagtacagggatcatatcgactaccccgaaaagcttgattctgaattattgccactcatcaaaggagtatgttttatctcagatctaaccctccctataggcttcccaacctccccatttattgctaattttgttgccagagagttcgacgagaaactaacgaagaatctgaattccatcgacaggctgaacgccacttatactcgctatgcagatgatattatcatatccacgaacaagaagggtgcttctaagcagatcatcaacagcgtcaagtccaccctgagaaatattaagccggactttaagatcaaccccaaaaagatcaagatctgcagtgcttcaggcgggagtatcattgtgactggattaaaagtgtgcgacgatttccatattaccctgcacaaaaagacaaaagataatgtgagactcttgctgtcgctcctgagtaaaggtaatctgaagaaggacgattacaacaagttgagcgggtatattctgtacacaaaaagtatcgacccccatttctacacaaagcttaataggcgattctttaaggagatcaaattcctcgagaattaccacaacaaaaagaactga

SEQ ID NO: 11890 - RNA, 951 nt, unidentified
  source 1..951: mol_type = other RNA; note = synthetic construct
atggaaatatacaatattatcgacgtggaaacactgatgcgaaaggggttcacaggcgaggtaatgcgaagccccgaacctccaaaaaaatgggacatcccaaaaaaaaatggcggagttcgtacaatctatcatcccagcagtaaaatgaagctcatccaatattggctgattaatagagtgctcaccaatctgcctgtgcatgacgccgcttatgctttcattaaggacaggtcaattaaacacaatgcgctgcggcacgctaccaccaagaacaaatactatgttaagatcgatctcaaggacttcttcccttctatcaaatataacgacttcgaacatgccttcaaaacgtaccgcgacaggatcgacttccccaataatttggataccgaggtgttgtttcttataaaaggtgcctgtttcattcctgatttaagtcttccaatagggtttccgacttccccaatcattgccaactttgttgcccgcgagtttgatgaaaaactgacagtcaagctgaattccatcgataggctaaacgcaacttacactcggtacgccgatgatatcattataagcaccgggaagaaaggatgctctaagcagattattaatgcagtcaagtccactttgaaggacattaaacccaactttaagatcaaccttaagaaggtgaagatctgttcggcttcaggcggttccatcatcgtgaccggactgaaggtatgcaacgatttccacataactctgcacaagaagaccaaggacaaagtcagactgcttttgagcctcttagcgaaggataagctgaaaatagaggattataacaagctgtctggctacattgcatacacgaaaagtattgacccccatttttacacaaaactcaacagacggtattttaaggagatcaagatgctagagaaccaccacaacaaatcagagtga

SEQ ID NO: 11891 - RNA, 951 nt, unidentified
  source 1..951: mol_type = other RNA; note = synthetic construct
atggaaatctacaagctgatagacagtgagacattaatgaggaaagggtttacctctgaggtgatgaggtcccctgagttaccaaaaaagtggcacattcccaagcggaacggaggcgtcagaaccatctatcatcccagttctaaagtgaaattgattcagtactggcttatctccaacatatttagcaatctgcccatccacaatagtgcttacgcgtttgttaatggtcgtagtattaagtccaatgcacttctccatgctaccgccaagaacaagtattatgtgaaagtggatttgaaggacttttttccgagcattaaatacagcaatttcgagtacgctttcaaactgtaccgggatcggattgaattttccgacgtttatgacgctgagctactgcagctcattaagtcaatttgcttcataagcgacgaatcactgccaataggattccctacctccccaattatcgccaatttcgtggccagagaattcgatgagaaactcacacttaagctcaacagcattgataggctgaatgccgtctacacgcgctatgccgacgacatcatcatttctactaacctgaagggggcaagcgtgaagatacttaacgcgattaaatcaactatcaagagaatcgagcctaacttcaagataaacaacgacaaaatccacatctgttctgcatccggcggttcaatcattgccacagggttgaaaatctgccacgattttcacgtcactctacatcgctctatgaaggacaagatccgactgtatatctctttgctgtcgaaaggaaggctcaaacaagaggattataataagctgagcggctacatcgcatatgccaagtcgattgatccccacttctacacaaagctgaatcgaaagtacttccaggaaattcgcggcatcgaaaactcccataacaaagtaatctga

SEQ ID NO: 11892 - RNA, 951 nt, unidentified
  source 1..951: mol_type = other RNA; note = synthetic construct
atgagaatctattcactgattgactcgcagacgctgatgactaaagggttcgcctctgaagtgatgcggagtcccgagcccccaaaaaagtgggacatagcaaagaaaaagggagggatgcgcactatttaccacccttccagcaaagtgaagttgatacaatattggctgatgaacaatgtgttttctaaattgccaatgcacaatgcagcgtatgcgttcgtgaaaaaccgctccattaagagcaatgccctgctacatgccgaatccaagaataagtactacgttaagatcgacctcaaagatttctttccctcaatcaagttcaccgactttgagtatgcctttactcggtacagagatagaatagagtttacaaccgagtacgacaaagaactcctgcagctcatcaagactatttgctttattagcgattcaacacttcctatcggtttccctacctccccgcttattgctaacttcgtcgccagggaactcgacgagaaattaacccaaaagttgaacgctatcgataaactcaatgctacctacacacggtatgctgatgatattatcgtctccacgaatatgaaaggcgcctcaaagctgattctcgactgctttaagcgtacaatgaaagagattggaccagacttcaagattaacatcaagaagttcaagatctgtagcgcaagcggagggagcatcgttgtcactggccttaaggtatgtcatgattttcacataaccctgcatcgaagtatgaaagataagatcaggttacacctaagtctgctgtctaaaggcatattgaaagacgaggaccacaacaagctgtctggttatatcgcatatgccaaagatatcgacccccatttctacacaaagcttaacaggaagtacttccaggagattaaatggatccagaatctgcacaacaaggtggaatga

SEQ ID NO: 11893 - RNA, 951 nt, unidentified
  source 1..951: mol_type = other RNA; note = synthetic construct
atgtcgctgtacacactgattgataaggaagtgatgatgagagacggatttacccaatccgtcatagatagcagtgaaccccctaaaaaatggagcatcccaaaaaagaatggcggttacaggtctattcatcatccaagcagtaagaataaactcctgcagtattggctgctgacgaaagtatttgacaaattgcctcagcacgatgctagctacgcttttgtgaagaaccgttctataaaggacaacgcgcttcgacacgccaaggagaaaaacaattactacgtcaagctagacatcaaggatttttttccatctattgagttctcggacttcgagaagtgctttttaaggtaccgcgaactcatatcaatccccacaacttgggatgaaagcctcttgtttctgatcaaggagacttgtttccttaaacctcagaaaaatcttcctgtgggattccccagctccccggcaattgcaaatttcgtcgctagagagcttgacgagctgattttaggtgagcttgccagttacgaaaagtataaccccatctatacccggtatgccgacgatctcgttatatccgttgcggagaaggggttatccaaggagatcatcaaagcagtgaagaaagccatcaagaactgtacctgtaatttcagtctgaacgaacagaagataaagatttgctcagcctccggagggtctattatcgcaaccggcctgaaaatctgcaacgaccaccatctaactctccacaaaaagatgaaggatagcattcggctcaaactgtccttgtattctaaagggaaactgaacatcgacgagttgaacaagctgtccggctatattgcttttgccaagtcaatcgatgaacatttctacacaaagctgaatcgcaaattcttcaaagagttgtcttcactcgagaatgtgcacctgaaggaatga

SEQ ID NO: 11894 - RNA, 948 nt, unidentified
  source 1..948: mol_type = other RNA; note = synthetic construct
atgatcctgtacaagattatcgacacggacatcatgatgagagacggcttcacagaatccgtaatcaagagctctgaacctccgaaaaaatggacaatacccaaaaagagtggaggtgttaggagtattcatcaccccagcaccaagaataaacttctgcagtactggctcttgaccaaagtctttaataaccttccccaacacccagcaagctatgcatttatcaaagggagatctatcaaggataatgctctgcgacacgcagagtctaagaacaattactacgtgaaactggacatcgaagactttttcccatcgattacctacgacgacttcgaacgctgcttcgtcaagtatcgggatctcattaccacgccgactaagtgggataaagatctgctacctctgatacaggacgtttgtttcttaaagccacagaagatcctgccaattggattccctaccagtcctgccatagctaacttcgtagcccgagagttggacgacatcataaacgcggagatggcctcttttgagaagcataaccccgtctatactaggtacgctgatgatctcatattttccgtggctgataagggtctatccaagaaaattattacagccgtgcggaagtccctcagaaaatgcagcagcaacttcaagttaaatgccaacaagatcaaggtttgctcagcgagtggagggtcagtggtggtgacaggcctgaaaatctgtaacgatcatcacctgactctgcacaaaaagatgaaagactcaatcaggctgatgctttccttacactctcgcggcaagctcaaagaggaagatttcaataagctctccgggtatattgcctttgccaaaagcattgatgagcatttttatactaggttgtcacggaagcattttaaagagttgcgcacccttgagaatcgtcacctgctgtga

SEQ ID NO: 11895 - RNA, 978 nt, unidentified
  source 1..978: mol_type = other RNA; note = synthetic construct
atgatgttatacgatcttatcgagaatgatctcaaaatgaagactggattcgtgagtgatatcctctcgagcccggaggaacctcggaggtggaccatacctaagcgcaacggcggcatcaggtttatttatcacccatctgccaaacgcaaggtgcttcaatattggctcttgcagcgggtcttctgtctgatacctttgaacgacgctgcgtttgctttcataaagaacagatccatcaaggataatgccctgagacactctaagtctaaaaacaagtacttcgttaaggcagatataaaggacttctttccctcaatcaacttcgacgattttctgtatagctttaaccgatatcgtgccgatattaactttcccaaagagtacgacaatgatctcctgcgaatgatcagggaagtatgcttcatcggacccaaaaaaacactacccatcggctttccaacctctccattcattgctaattttattgctcgtgaactcgacgagatcatccacttggagctgaagaacattaacgatgccaatccaatttacacaagatacgccgacgatctggttatcagttcatgcaagaaacggatgcattccgagctgattagtattatccgcaagagtattaacaagtgcaatgcgtcattctccctgaacgagaagaaactgaaaatttgttctagcagcggtgggagcgcaatcattaccgggctaagaatttgtcatgacgggcacctgactgtgcataaaaagatgaaggacaagattaggctttacctctcacatatcaacaaaaagggacttgaagagtccgaaatcaatatcttaagcggttatctggcctatgtgaaaaatgcagacgccaatttttacacaaaaatctcccggaaacacttcaaggagataaaggagatagaaaatcactatacgtacgcagacttgaaacctcatgacgaagtctcctga

SEQ ID NO: 11896 - RNA, 942 nt, unidentified
  source 1..942: mol_type = other RNA; note = synthetic construct
atgagtataatcagcgaagtatcaagggagctggatatggtcgaagattccttcagagaacagattcgactggctagagggaagattaagcacatcaagatcaagaagaagaacggcaaagggttccggaggatcgtgattccaccctgggagtttaagattgtgcagtattggacgatcctgaactatttacgcaatgtgaagatacaccgcagcgctactgcctttcacgaaggagcctctatccgtactaatgctctctgccataggaaaggaaactacttcgtgaaaatggacctgtccgactttttcccttctgtcggcgtagacgacttcaagaatgcactctacaaatatcaccccgaatttatctggttggagaaagagttatccgatagcgagtttctggagagtatgttccacaagggcgtgtgcgcaatcggttttccggcctctccctacatagcgaacatatgtatgatcgaaattgatgagctgattgaatcaaagctgaaaaataacgtggagcggtttggtcggttcagttataccaggtatgccgatgacctgacaatctccattgaaagaaaggggttcaaacgagaggtcgagggcgttgtctatgaggctgtccgggaagcctctctgaagaacatcaaggttaacaaggagaaaacaaaatacggctcaaaaagcggcgggagcgcattcgttaccgggatgcgcatctgcaaagatggacatattaccctccatagaaaatacaaggaccatgtgcgtctgttgctcagtctctacagcaaaggaaaacttaaacctgaggacaagggcaagttgcttggtcacctaaattattgtaagtcctctgacccagagttttacaataaacttgtgctgaagtacttccaatcgattgaaaagctaaagaattcaaacggatga

SEQ ID NO: 11897 - RNA, 936 nt, unidentified
  source 1..936: mol_type = other RNA; note = synthetic construct
atgggaatcattaaaagcatcgccaaagaactgggaatgcctgagccagtgttcagggagcagctgaatactgcagcaggcaagatcaagcacattcgaattcctaaaaaatcccagaagggttacagaaagctggtgatccccccctgggagttcaagatcgtgcagtactggctcatatacaatcacctgaaaggtttcccaatccatccaagcagtacagcctacaagcccggcgcgtcaatacgcaaaaacgccttaaagcatgcagagggaaagtatttcgtgaagatggacctttctgactttttcccgtcaatcggcgctgaggaattccgtaacatcattgaggagtactaccctaaacacaattggttgattaaagagctcgaagattccgactttgtctctagcatcttttatgataagaagtgcgccatcgggtaccctgcaagcccctatattagcaatatcatcatgttcggcgtcgatcaacacattgacagagctctgcaggacaagcagcagaccttcgggaactattcatacacccggtacgctgatgacattacgatatcgattgagaacaaagggcataagaaagaagtggttcggctagtccatgattccataaagaagtctgggattaagaacttgaaggtgaaccagaataagactaagtatggctccaaaaaaggaggttccgcgtttataacaggcatgagaatttgcccggacggacacatcaccctccacaggaaatataaagataacgtacgcttgctgctgagtttatacaatagggggaaacttgacgttgctgaacggtctaaactggccggccatctaaactattgtaaggatgccgacccacttttttataataagctcgccctcaagtacttttcaagtatcaagaaactgcaagaaagctga

SEQ ID NO: 11898 - RNA, 933 nt, unidentified
  source 1..933: mol_type = other RNA; note = synthetic construct
atgtcagaagaatcagtcagaaaccagatacacgagggtagacgtcaaatcaaaatcaagaagattccgaagaaagatggcaacttccgcaagattaccattccacctcggatatttaaactcgtgcagtattggaccatcaagaatatcctccattctctgcctgtgcatgaggccgccaccgcatttaaaccaggtagctctattcgtgagaacgcttttcggcaccgggacggccagtacttcgtaaagatggacgtcacaaatttcttcccaagtatcaagtccgacgacttctttagcgttctctcgaggatgcagcacgctgaagcggaccccctgctggattccaaggacgatgaagattttctggatgctatgttccgcaaccgggcctgcgagatcgggtatcctgccagtccacacattgctaacatcgttatgtttgagaaagatacgcgaatcgacaatgcattgcgggatcgcaagcaagagttcggaaattccacttacacaagatacgcagacgacattaccgtgagcattgaccagaagggatataaggacgaaatcactaggctggtgagcggcgtggtcgaagatgattccgaacccacattgaaaatcaaccccaataaaaccaggttcggcacgagaagagggggaggggcctttgtaaccggactgcgagttctgcccgagggtcgactgactttacataagagttacaaagacgacgtgcgcttcctactaaaactttacgaacaagataggcttgagcgctggcagatcagcgccttgcagggccatttaaactattgttcatttgcggaccctgatttctacactagactcatgattaagcaccttgattctatagaggagataaaaggggaggggctgaggtctacagacggcactacagagaattga

SEQ ID NO: 11899 - RNA, 945 nt, unidentified
  source 1..945: mol_type = other RNA; note = synthetic construct
atgaagctgatcagggacttctgccacgagatgggcctacccgaagaggagtttacggtctatgttgacgacgcacgcgagcgggttaagaaggctaagattaaaaagaaggacaaaacaactcgggaaattatcatccctagttgggagctgaagattatacagtattgggtgatcctcaactatttgaggaaactccctgctagcgaatctgccaccgcatactataaaggcgcttccatcattaaaaatgcccaggcccatagaaagggaagctactttgttaaagtagatatagagtccttcttcccatcgcttaccctcgacatctttatcacttcattgaagaaggatctggagtcaaacccagagaacgaagtgatacgatatctacttgaagcaactaatgacgccagcttcaaccagtcaattttttataacggtacatgcgtcatcggctaccctgcttctccctatatcgcgaattacatcctcaaggcctttgatgagaatgtggtggccgaattgaatgagataagcggcaagctcgggattttcaactttacacggtacgctgatgatattgtggtgagttgtgaaaacaaaggaaataagactgaagtgctgaaaattcttcacaattgcttagagcaaaagttcgatggagccctcaaactgaaggccaccaaaaccaaatctacaaccagaagcggaggtagtaccatcattactggggtcttgatatgttctgacgggcgcacaacactgcccaggaagtacaaagacaaagtccgtctgcttttctccctgtacgcaaaggagatcctggaaaaggaagagattccggcgctgacgggccatctgaattatatcagatcagtggatccagtattctacaacaagttatactccaagtactacacccagatcaaaaaactgtcctga

SEQ ID NO: 11900 - RNA, 954 nt, unidentified
  source 1..954: mol_type = other RNA; note = synthetic construct
atggaaaaagagatgtcgattattgatgaaatcgccaaggagttacgaataaacaagaagatcattgagagccaactcttcgcaagtcgaaagcaggtcaagaagataagggtgcccaaaaaaaatggcgcccataggagcatctatgtggcaccgaaaagctacaaaatattccagtactacatcctgaacaactacataaagcacgttaagaaaagtcacgctgcttctgctttttggaagggaagttccatcctgaagaatgcgaaaaagcatagagaaagaacctacctggtccgtattgacattagtaatttcttcccttccatccacatcaacgattttatctccgtactggatgactccgagaataatatcattgacctgtttagcaaccccgaaaacgccgaagtgatcatggaaacgtgtctctctgacgaggggtacctccgcgtgggttatccaatctcacctttcatagcggatatcgccatgcgtgagattgaccaggaaattgccaaatatttggaggagaagtttcaggagggcacattctcttattctcggtacgcagacgacctcgtgattgggtttgacgaaaaatgcggcaaggagatcgagattgctatctccgagattatagagaaaagggaccaccctaaattgtctatcaaccacagcaagactcggtattttaaccggaacgttggcaatgcaattgtgactggggtccgcatttgccaagatggaagactaacacttccaaaacagttcaaggatgatttacgatttcgcttgtcactacttaataagggtaatctggccaacgaggagctgagctcactcgaaggatgtctgaatcattgcagagacatcgatccctcattctataccaagcttcagaccaggtacttcaagtccatcgccgaactgaaaaatcggaacaaaaactga

SEQ ID NO: 11901 - RNA, 942 nt, unidentified
  source 1..942: mol_type = other RNA; note = synthetic construct
atgcacattaaaaaggctattgccaatgatctgtctatacctgatggactgatcgacgaggccatctccgtggctagggctcacgtcaaaatcttccacattcaaaagcgcagcggtgggtcgcgggagatatgccacccttcaaagaaactgaagaccctgcagtattggcttattcactctgtgttttcccagatgcaggtgcatgatgcctctatggcttatcgagatggcgtcagcatcctccacaatgcggagaagcatcgtagtaacaggttctttctgaaaatggacttagagaactttttccacagtatttctttcgaagatttcatccccatcctgcggagctggcatagaaaatccaacccaaagtggatcttagatgcagaatgcgaggacatgatacgcagaatttgcttttacaagaatgacagattggcaataggctacccatcatcgccgattatcagcaacattgtgatgaatgaattcgattccaaggtgagtacacttatttcagataggaaatatgggaaggtcatttacaccaggtacgcagacgatttggtgctctccactgacaaaaaaggtgcctgtagcgaaattataaaggagatcatcaatctgatccaaggcacatccagccccaacatctccgttaaccatagcaagactaagctagggtccagcaccggaggctctgcctctgtaacaggtctgaagatatgttcaggcggacacattaccatccatcggaaacagaaagaccatatccgattgcttctctctctgtacagaaaaggaaaacttgagcaggaagaggaaaatagcttgctggggcacctgagttattgtcattatgttgcccccgacttttacacgaagctcagtaagaagtactttaaagagatctatgacctccgctcaaaggacctatga

SEQ ID NO: 11902 - RNA, 942 nt, unidentified
  source 1..942: mol_type = other RNA; note = synthetic construct
atgcatatcaagagaactatcgctaacgagctttccatcccagacaatttgatcgacgaggcaatacgcgttgcccgatcccacgtgaaaattttccacattgagaagaagagtggcggatctcgagaaatctttcaccctagcaaaaaactgaagaccatccaatattggctgatccatagcgtgtttagtcagatccccgtacacgatgcttctatggcttaccgtaatgatatatctatcctggataatgcccgcaagcataggagtaacaggtttttcttaaagatggatctcaaggatttctttccctcaattagctttaatgacttcataccgatcctacgggactggcatgctaaggcaaaacctaactgggtccttgatgaggaagcggaacatctgatcaaaaaggtgtgcttctacaaaaatgactgcctggccattggctatccatcaagccccaccatttcaaacatagtgatgcgcgattttgactcgaaagtgagcacactgatttccgcggaaaaatatggcaaagtcgtatacacaaggtacgcagacgacttggtgtttagcactgagaagaagggtgtctgctctgaaattaagaaggagctgcagaccctcattcaggccaccacatctcccaacatcaaggttaacaaccttaaaaccaaactggggtcatctacaggaggtacggcctccgtgaccgggctaaagatctgtagtgatggccacattactatacataggaaacagaaggatcacattagactcctgctcagcttataccggaaagggaagctgcggccagaggacgagaaatcgttgcttggacacctctcctactgtcactatgttgcccctgacttctatacgaaaatctccaagaagttcttcaaggagattcacgaactgagaactaatgacttgtga

SEQ ID NO: 11903 - RNA, 942 nt, unidentified
  source 1..942: mol_type = other RNA; note = synthetic construct
atgcacataagagatgcgatcgccattgacctctccgtccctgtctctatcgtcgatgaggctctcaaagaaagtcggatctacgtgaagaagttcaccttacccaagaaatctggtgggagtagggaaatcttccaccccagcaagaagttaaagactgtccagtactggctcatcttcaatattctcagtaaactgccaattcactcatcggcggtagcctatcgcgacggaattagcattctgaataacgcaaagaagcattgccacaataggttcttcttgaagttggacctaaaagagtttttccattccatcgtcttttccgacttgctgcccctgatagaggattggtaccagaacatttccgtggattgggtttttgggccagaagagaaggatttgattaggaagagctgtttctacaaggaggaccgactggccatcggatatccttcaagtccagtgatctcaaacgtggtgatgtaccaatttgacctcaacgttgagtctttagtttccagcggccgctttggggatgtatgctatacccggtatgccgacgaccttatctttagcacagataagaaagggggttgcaaagtgctgcttcgagaaatcagcgacctgataggcaggcataaatcccccgacattactttgaattctgctaaaacaagactgggttcttcaaccggcggcacagcatccgttaccggactcaaagtgtgtaataacggctatataacggtgcatcgtaagcagaaggatcacattagactgcttctgtcactatacgccaaaggagaactgaaaccggatgagtacagaagtctgcttggccatctcgcttattgtcactatgtggcccctagcttctactctcgcctggcacagaagtactttaaagagatccacgaactgcgggctagcgtgttctga

SEQ ID NO: 11904 - RNA, 942 nt, unidentified
  source 1..942: mol_type = other RNA; note = synthetic construct
atgaatatcaagtcaatcattagcaacgacctaggaattcccgaaaagttaatcgaagaggcgctgtccagctcgcgcacctacgtcaaagtgtttaagattaaaaagcgaaacggcggctttagagagatccaccatccttctaaaaaactgaagaccctgcagtactggctgatccataacattttcaagaacctctcaatacacaagtcttccgtggcatatcaagatggcgtcagtattcttgataacgccaagatgcatagttccaatcggtttttccttaaaatagatctggagaacttcttcccatctatcaagtacactgatttggaacccattgtcgacaagtggcacagcgagaataaaatcagttgggagctggaccaagaagctaaagaactcattaggaagtcatgcttttataaagaggatcttctgccaattggatatccttcctcccctatcatttctaacgctgtaatgcatgactttgacactgcaatcaaccagatcattctcgataaccggttcggcgaaacagtttacaccaggtatgccgatgacttggttttttcgactaataaacacggcgcctgtagcaaactaaaagacgttatccgtacgtttatcgggggatacaatacacccaacataaagatcaatacaagcaagacgaagatggggtcttccactggtggttccgcaagcgtaacaggactgaaggtgtgcgagaatgggcacataaccattcacaggaaacagaaagaccacatacgcttgctgttaagcctgtatgccaaggggaaactcccggaatctgagaagtccagtcttgccggtcatctcgcttatgtgcagcacgtggctccaagcttctactcaagtatctcaaataagtacttcaaggagatcttcgagctgagagccaccaatgtgtga

SEQ ID NO: 11905 - RNA, 942 nt, unidentified
  source 1..942: mol_type = other RNA; note = synthetic construct
atgcgcatcgaggaagtcatctctcgagatctaaaagtgcccgagtccctcattaacgaagcaatatctggcgccagagtacgggttaaaaagtttcagatccctaaaagatccggcggcagccgcgagattttccacccaagtaagaagctgaaggtcattcagtactggctcatgcatagcgtgttttgtaatatgccactgtcagatgcggccatggcataccgggagggaatctcaattctgcacaatgccagggtgcacagtctgaatcggtattttctcaggatggatttcaaagacttctttccttccattcggttcgaggacgtggaaagccatattaaagcctggcatcgtaactttaagccggaatgggaccttaacgacaagtccctggagttcattaatcagagttgtttctataaggacgctagattggccgtcgggtaccctagctctcccgctatctccaatatcgttatgagagactttgacagcaaaattttgaacgaaatcggatctgaaaagtacggtgatgtggtttatactcgatatgctgatgatatggtgttttccacaaaccaaaagggggcctgcaaggaaatcatcaaagcagtcaaggagatcgtttctgtgtgtaagtcgccagtcctggagattaatgagtcgaagacgaggcttgggagttcaactggtggaagcgcgagcgtgaccggccttaagatatgctcagatgggcgcataacaataaaccgtaaacacaaagaccacatacgcctcatgttgtcactgttcagcaaaggaaaattagatcctaaggaagtgccctctctggcaggccatttagcctactgccactacgtagctcccgactttcactccggtctatccagtaagttcttcaaagagatccatcagatcaggaccatggacctgtga

SEQ ID NO: 11906 - RNA, 945 nt, unidentified
  source 1..945: mol_type = other RNA; note = synthetic construct
atgaacatcaaacagctgatttcagagagtatcgatgtcccactgagtatggtggacaacgccataatactggcccgctcccacgttaagaaattcgaactgaagaagaagaatgacaagttccgtattattcaccagccaagcaagaaacttaaggtgatccaatactggctgatctacaacatctttaaagagatgcccattcacgcggccgctgttgcttacagaaatgagctcagtatcctggataatgcagagaggcacaagcgaaacaagtatttcctgaagattgacttcaaggactttttcccttctttaacatttaacgacttgctcccttttcttgagtcatggaaaagttcccggaccgatttgttcatcaataacgagctaaaggaaattatcaggaaatcatgcttctataccaatgacaaactggtgattggttatccctcatccccgattatctctaacatcataatgttcgacctagatgaaaacattcagtctatcatctctgacaataaatacggcaatgtcatatatacccggtatgctgatgatatcatcataagcacagataaagccggcgcatgtaaagagatatacaaggaaatttccaccctgattaagagcacgattactccttctctgagcattaacgtggaaaagacaaagttttcctcaagcagtggaggctctgcaacagtcactgggcttcgcgtatgtcacgaccaacatatcactatccataagaaacagaaggatcatatcaggctgcttttatccttgtacgccaaagggatactcaatgagaaagacgagaaatccctcatcggacatttggcgtattgccaccatgtggatcccgctttttacagcaagctcagcaaaaagtactttaaggaaattgccaccatcagatcgagccacatgaaaaactga

SEQ ID NO: 11907 - RNA, 969 nt, unidentified
  source 1..969: mol_type = other RNA; note = synthetic construct
atgagggatctggtggaggtgtgttctgcggatttaggcatttctaggcaagagactttgcacttagccaagtccgcaccctaccgaatgaagaggttcgaactgtcaaaacgcgggggaggtagacggacaatatggcgggccgctattgagactaagggtcttcagtatagcctgatcaaaaactacctggagcacctcccagtgcacgcagcaagccaagcctttagcccgggatcatccatcaaaaaaaacgcctcaattcacgtgggaaaccattatttcctgagagtggacctcaaggatttcttcccctccctcacattcgaaaatctgcgaaaggcgaccctgagcagtaacgccaagtttgactttagcctggaggggtccgacagttttgccctcatccagggtgcttgctttgatcgcgatggtaagcttcccatcggatactccacctcaccttttatcgccaatgtcgtgatgtttgaattcgacgagtcgctcgaagttaccctccagtccgagttcggggccgggaacttcaactacactcggtatgctgatgacatggttttctccacatctacaagaggcgtatgccgcaaggcttatcgtaagataaagaatttcgtcgccgacttcgatggagcgagtctgagtgtcaatgacagaaaaactcactttggcagcacaggcaagggcacagcatttgttaccggcgtccatatgctacctaatgggaagttggccgctacgcgtcagttgagggaacgggtgaagttcctattatacctgctgacgaaaaaacgaattccagaaaaagagtactctcagctgatcggcctgcttgctcatcttcggtcagtggatcctgcttaccatactaaactcagcaccgacttttatagtgtatttccaagattggggaaagacaggactgcaaccacctcttctgagcgcacctga

SEQ ID NO: 11908 - RNA, 936 nt, unidentified
  source 1..936: mol_type = other RNA; note = synthetic construct
atgctggatttgctggatatctgttctagcgcgttgggtaccacccgcgagaatgccctggttattgctaggactgcaccctatagattgaagaggatcgagatacccaagcaggatggctctaagaggataacttggcaggcggcaattgaaactaagggactgcactacccactcattcaatattatcttcgtcagttaccagcacaccctgcttcacaggcctttagcccaggaagcagcatcataaaaaacgccggaatacatctggggaataagtacttcctccggattgatttctccgatttcttcccctccattaagttcaactccttcaagaagattatcaaccagacaaagtccatcttcgaaaactttaacaccgccactcctgaaagtatgttgctgctagagaaagcttgctttgccaaggactcttccctccctatcggctatgcaacaagtccctatatcgctaactgtactatgttcgaatttgatcgggagatcatagacctgcttcgggcaaaattcgcttcagccaatgtcacgtatacaagatacgccgacgacctggtgttttcgaccaatatcaagaatgcctgccgagacatttacgatgtgattgtacagtttgtgaagaagtacagagctattgacctgaccatcaatcataaaaagacacactttgggagtgtgccgaaaggtaccgcctacgttacaggcgtgcatatgctagaatcaaatcgcacggctgctaccaaaaccttaaggtctgaggcgcgctttctcctgagcctccgaaaaaagaacaaacttgatgacgacgagcagaaacggctgtttgggcttctggcacatatcagacaaatcgaccctgcattctacactaaactcgcctcagacttccacgtcgcctttccacacacaaaatga

SEQ ID NO: 11909 - RNA, 942 nt, unidentified
  source 1..942: mol_type = other RNA; note = synthetic construct
atggatctcaagtcccggatatgcaaagatctgcagataccagaaacactgtttgactcctccgtcagtaatgcacgacgcgccgtgtatcagttcaagatccctaagaagaatggagacgagcggactatctatcaggctgctgcaaagacgaagaccatccagtactggctgctgaagaacatatttgagaaagtgaagagccatccttcttccatggcatttagtcagggctgttcgatcttgaaaaacgccgaatgccatagaaacaaccggttctttctgaagatcgacttactgaattttttccctagcgtgacattcgaggacgttaagggggccttgatcaaaaactgggagcaaatcgacagtcttcccccggacaaagacctcttcgaattgattaggaccgtatgtttcttcaagggcgatattctgcccattggatacccaacatcaccaatcctcagtaacattgctatgctaaacttcgatgagatggtgatgtccacccttgagagctctttcggaggtgatgtaacctatactcggtatgctgatgatatggtcttctctactaatgttcccggtaggacccacgaagtctttaaactgattcgccaactaattacaacgaatacatcacccaaaatctctatcaaccctgacaagacaacgtcagggagctcaagcggcggcagtgcgatcgtgaccggcattaagatctgcccaaatcacctgaccattactaaaaaacagaaggatgagattaggttgttactctccctttacagcaaaggacgtctgaggtcttccgattacgagagaactatcgggctgataagctttgcccgaaatgttgacccgtctttttttactagagtgtcagagcgcttctttcgtgaaattagagccataaaaaaggaactcagcgacacctga

SEQ ID NO: 11910 - RNA, 942 nt, unidentified
  source 1..942: mol_type = other RNA; note = synthetic construct
atgaaattttgggaacagatcgagacatccttcgggctaggaaaacctgagatcaacaggatcattaatgattctcgccggtgtgtcaaacacattaagatacccaagcacaatggaggtttcaggctggtagtgcagcctaccagaaaggtcaaactgatccaatactggctgatagataacgttttcagcaaaatggaggtgcactcatctgccatgagctatcgcccaaatatatccattcggagaaacgccgaagttcataagaacatgcgatactttctgaagcttgatttcatcgacttcttttggtctttgaactactcagactttgtcgtcgtcttcgacagttttctcggtcgtaaaaagatcctgtggagcgataataagttcgaccgaaatctgatgcggtgttgctgcttttataaggacgacgctctgccaataggatatccttcatccccgattatcagcaatatcattatgtacaacctggatgtggcaattaagaacaaactcgaggtgctggaggagaagatcggcggcaaaatcgtgtacacccggtatgcagatgacttagtgttttcaacgaatattcccggtgcttgcgaagagataaagaatagtatcatttcgcttgtgtccgggtgtaacagccccaaactaaagttcaactacaacaagctcaaaatgaccagcagttctggcggatccgccgtggttactggcttgagaatctgccatgatgggcatatcacacttagaagggaatacaaggaccaggtgaggtttttcttgaatctcatggccaaggatggcttaaaaaaggaggacatttttgtgctgcgcggccacctcgcgtatgtgcaggacgtagatccagttttctatactaaattgcaggagaagtacttcaaacaaattgaaggggtagaaaagtga

SEQ ID NO: 11911 - RNA, 921 nt, unidentified
  source 1..921: mol_type = other RNA; note = synthetic construct
atgtccgaagagcttaatatacccgtggacagcctaagcgataccatcgagcagtctcgttctttcgtgaagcggatcaagattaataagaaaagcggaggcgagcgaatagtttaccagcctgccaggaagataaaggtgattcagtattggctcatgagaacgatattttccaagatcaccattcactccgcttcgatggcatacaggaaagaaggatcaatcaaggagaacgccctcaaacatagtaatggtgggtactttctaaagctcgatttcaaagacttctttccctcgataaaatttagcgaccttaacaaaagcatcattgcgtttaggaagaacaacaacgcaatttttaagtacaccaaagctgaccaggaactgatcaggcgagtttgcttctacaaaaatgataaactgccaatcggatacccttcctcaccgattattagcaacatcgtcatgtacaaattcgatattagagtgacagatgagatgcccaagtttagaaaatacgggaatgtggtttatacccgctatgctgacgacatgatttttagcaccgatcggaaaggcggttgtgaaaagatcttcagtttcctgtccgtgctgattaattcttggtctactccatccttgctgttaaacgaggccaaaactcggttcgtgtctagttcagggggcacagccatagtcacaggcttacgcatctgttacgatggccacatcactctccatagacattacaaggacatcgtccgccttctgttgtcactgtataagaaggggaatctgaaagaggaagacgtatatgtgttgaagggacacctgtcttatatccaaaacgtagatagtgtcttctatacgaagatctgcaagaagtatttcgacattattgacgagatcaaaacaaagtga

SEQ ID NO: 11912 - RNA, 954 nt, unidentified
  source 1..954: mol_type = other RNA; note = synthetic construct
atgaacatcagggagcgaattgccgctgatctgcatgtgagccatgagctcatcgatcgagccgtgtgggagtcgcattcgaaagtgaagaagttccggattaaaaagcgtaacggtggcaccaggccaatattccatcctagcaagaaaaccaaattaatccagcagtggataatccacaacatactaaaccatctccctgtgcacgacgccgctatggcttacagaaagggattgagcaccgtcgataatgccagaaagcatcgccagaaccgttacttcctgaggatcgatctgaccaacttctttccatcaatcacctacaacgacctggagcctcttattagggaatggcactctcacgccgagacagactggacgctggacccgacaagcgaactattactgaagcacacctgcttttctcaagatgaaacgctgcgcatcggggatccttcttccccaagtatctccaatgcagtgatggcatccctggacgaaacaatctccaatactgtacgcgcactcagcaagaatccaattgcctacaccagatatgccgatgacttgatttttagcacaaacgagaggggattatgcaaacccatccacgaacacactgttgctgttatagaggagtccaccagtccccttctctctgtcaatcgaagaaaaactcggtttttgtctcgctccgggggatctgcaattgtcacaggtatcaagatcaatcccgacggctcattgactctccccaagtcatacagaaatgaaattcggttcaagctggacctgtacagaaaaggcaaactgggagacagtgatgtgcgcgagctgcggggccatcttgcttattgtaagcacgccgcggcgggctattatagtcggctctgtgggaaacactatagggaaattgaggaaattacaacttcacttcaggaccacagctgctga

SEQ ID NO: 11913 - RNA, 966 nt, unidentified
  source 1..966: mol_type = other RNA; note = synthetic construct
atgatctaccgcgaaattagcaaattctataacatcccccaggaggaagtgcaggacttcattagctccaacaagaccaaatactttagattcgaaatccctaaacgaaacgggaagtttagaactatcacccatccgcgtcatgaattaaagatagtgcagtactggttggtagagaaggtgttctcccggatgaactacgtctcttgcagttcctacgcatacatcaaggaaagggacatacttaaaaatgcacgtaaacatcaacgcaattcgcacttcctgtcagttgactttagcaactttttcgagagcatcaccttcaagctactagagcccttcctggagaaattttaccactccacagaggttgagtattctttggaggaactgaaaaatgtggtgaaacggagctgttttgatagttatggccgcttgccagtggggtttgtcacctccagcatcatctcaaacatagtcatgttcgatttcgatctgagaattaacgtgctcctcatgtcaaggaagatgctcggtagggtggtatatactcggtatgctgacgatgtgactatttcaacaaacaaggagggagccattagggaaatttacgaactgttttgcaagggactcatcagtgaatttaactctgagattaccctgaatgcttccaaaacgaaggtgagacataagcggtgtggtaacgttcttgttacaggcctccgcataacaaaggacagtaggatcaccattcacaaaaattataaggaacgagtcaagaagctgatccacgataattacaagagtgaggatctttctgtcgtctctagaataattggccacctgaatttcatcaagtatgtagacgccaactactcacacaaactgaatatcaagtacttctctgagatcaatgagctgaaactgcggtatcaggcgttatttagcgccaaatcctatatttga

SEQ ID NO: 11914 - RNA, 972 nt, unidentified
  source 1..972: mol_type = other RNA; note = synthetic construct
atggccaaatctttgatcgatatggtggcaacctacctcggccacacccgggaacaggttctgcatctttcctacagggcacctatgacctatcggcgatatactattcccaaaaaaaagggcggtcgcagacttatcaatcaccccgccaaacagaccaaaagcctccagtacgctcttatgaacatctttctgagtcaattacccatccacagctgcgccgccgcgtacaaaaagaaaaccgcgtctgaacatattccaagccccctgctgaaaaatgccatcctgcatgcaccttatagctattctgtacggattgactttacagacttcttccattccatttcaagtctcgatctgttcaatcgcatcagtaacaatgacatcaacttgtcaatatccgataaggagtttattgagaactgcctattcgttcgcgtgccagaaggacagaagggcctcgcaataggagccccgtcatctccaataatctccaacattgtgatgtattctctagacgagcagattaatgcaatcgccaacgggattagtgacagagtcgcgtatagccgctatgccgatgatattatatttagcaccaacttaagggggggctgtaattacttttacagggctatgtccgagctggtgactagaacaagtagcccgaagctggtcattaatcggtccaagacaatgttctccagcagggcttctcgacgcgtggtaacggggttgtttatcagacctgacggtggcacttcgctcggacgacaaaacaagcgttatatcaggaagctgttattcgacctcaaaagagacaatatcgagcctcgtaagttgacttacctttcaggttacctggctttcgccctggatgtcgagccagacttctacaaccggctggctcacaagtacggggcagaactgctcgctgttgccatcggaaagacacaccacgatgtgtcatga

SEQ ID NO: 11915 - RNA, 972 nt, unidentified
  source 1..972: mol_type = other RNA; note = synthetic construct
atgagtcgaatcattaacctgaaaaatgacgtggccaagtatgtgggcatcactctggagagggtcgaatccctagcggctgtcgcccccaagagctatagaagggatgaggggagtaaaagaagcggacgcggcagcagagtgatattccacccttctaaaaagactaaggccctgcagtacgggctgatcaagattctgttagacgacttgcctgtacatgcgagcgcctacgcctatcggaaagggttgaaggcaccgctgctgaaaaattccatgctgcatcaaaaatacagtttttccattcggattgacttcaaggacttctttccatcaatagtcccagaggacttgtttaaggtaattgatgaatccggacttttccctgcagctcttgacagtgccgataaacgattcttggaaaatgtgcttttcatccgtcaccacggactcatgcatctggcaatcggcgctccctccagtcctagcatttcgaacgctataatgcattccctcgatgtgctcttttcagcatttgctcgggacaaggattctgtttactctcgctacgtcgacgatatcatcttcagcacgaaccgaaagggcatgtgcgatgagtttctgagattcctgtcaacaaccctctctggtaccccctcacccatccttcaggtgaacgccacaaagacactggtaatgtccaggggcactaggcgctgtgttaccgggatgtttattaccccagagggtggagtctcgatcggtcggacccggaaacgtaagctgcgcacattgctctacaggtattctaaacaccttaagggggaagacgtgctcagcaaagaggatctgaattatctaaagggcaacttagccttcgtgttagatgttgaaccagactattacaacagactcgtgcagaaatacactgccacgatggttaattctgcactgcacgcttcagtgagctga

SEQ ID NO: 11916 - RNA, 942 nt, unidentified
  source 1..942: mol_type = other RNA; note = synthetic construct
atggacttgattgagaagattgccctgtacctgggcttctcaaaggaacagatcgttaaacattctaaaaggtgcagcaagacatatcggctttataagattcccaagaagggcaagcttacgggatttcggaccatataccaccccgccaaggaaactaaagctatacagtacgctctgatggagatcttactcggggattttaaagtcagcgaaagcgccatagcatacaaaaggggcctcagcagtcctttgcgcgagaacgccttgctccacgcgccctataaatactccgtgcggattgattttgaaaacttcttcctaagcctgcagcctagagacttggcacgaatggctaagagtaaattcgatctgaacgataaagagatagacttcctgatcaaaagcctgttcgttgacttggggagtggtcgctctggcttaggtgtcggagcaccatcttccccaatggtcagtaatatcattatgtatgagctggatgaggagatccagaaaatcgccctgaagattgacccgaaatctgtgtattctagatacgccgacgacatcatcttttcaaccgaccagaaaggagcgtgtaagcaattttatgaccagctggcatcagtgattaagtcctcaaaaagccctagattaaagatcaacgatctcaagaccatctttagctcgcgcggttccaggagaatgattacaggcctgatcgtgactccaaacggcgacgtgtcaattggacgtcgaaataaacggtacatcaagaaactgctctttgacttctcgaagtccaagatatccgataagaataagagttacctcaaggggtatctttcctacatcgaagatgtagagcccgatttccttaattccctgtctctaaagtacggggccgctctcctggaaaaaattaggatggatcaattctga

SEQ ID NO: 11917 - RNA, 918 nt, unidentified
  source 1..918: mol_type = other RNA; note = synthetic construct
atgagcttaatcgagaacgtctctcgttatctgagctttaatgaatccgagcttttatcattcgctcagaaagcaccaacaacctacagaacctaccagatccctaaaaagaacggtaggctgcgcacaattcatcatccagccaaggaaacaaagtccctgcagtacgccttgatcaatctgatcttcaagaattaccctattcattcatcagcagtggcatatcggaaaggggttaaaagccccttgaagctgaatgctgagagtcactctaagtatctctacaccatcaaaatggactttaaagatttcttccactcgatagtgtttgaggacctgaaaaacattctagattctccttacacgcaacaagagcttgaattcctcaaaaatgtcctcttcttaaactaccagggaatctattgtctggctatcggagccccatctagcccaattctaagtaatatcgtgatgcacggctatgatgagtccatccttaaaatagtcacgaagattgaccccgatgctacatataccagatatgccgatgacattaccttctccagtaataagaaaagtcattgcctcaactttgccaaagaactgaacaagctgaccaaggacaaactgactccgtctctcaagctcaattccaagaagactattctgttgagcaaggcaaatcacaggatggtgactggccttgtgatcaccccccagggcaatgttagcgtagggcggcacaacaagaagtacataaaaaagttgctgaacgatctgaagtacgacaaaatctcacctattgcctttaagtaccttaaggggtactttgccttcgtacgagacgttgaacccaagtttgtgaactccctcactaacaaatatggtgcggcgctgataaacaaaataatcatttga

SEQ ID NO: 11918 - RNA, 915 nt, unidentified
  source 1..915: mol_type = other RNA; note = synthetic construct
atgaagattattgagaagatcagcaacatttacgggctctccttcaatgagacaaaaaatttgatcaacaccgcccagaacaattatcggatttacaagattcccaagaaaactacaggcacacgaaccatctatcatccaagcaaacaggtcaaagcagtgcaatacatcctcatagacctgatactcaagaaactgcaggtgcataacgcagccgttggctacatcaaaggagtaaaggcaccaatcaaaagaaacgctgagcaacacgctaagtttccctattcaatcaggatagactttaagaacttctttagctccatcagcttttccgacctgaagaaagttttggaaaactctagcctggaactcagtctggatgactataaggtcctggagctagtactgttcaaaaacggtttgccaataggggctccttcatcccccctgatttctaatatcgtgatgttcgaactcgatgaattattagccagagaggccttgaaagtcgactccaatagtctttatacccggtacgcggacgatattgtgttctcaacaagcaagaagaatggatgcaaagattttctcaagaaactgaagagcgtcctgatcaattacaatcaccctaagttaacgatcaacagttcaaaaaccaagttcatgtctaggaagtctaaacgcatggtgactggcctcataattaccccgcagggcaaagtttccatcggacgtgaaaacaaggagttcattaagatgctgctttaccagtataacaagaagctgctgaatcccgagcaggtgtcttatctaactgggtacctgtcgtttattattgatgtggagcctgccttctttaatacgcttgtcatcaagtacggcgctgtggtgagtaaccttcttaaaaaaatctga

SEQ ID NO: 11919 - RNA, 942 nt, unidentified
  source 1..942: mol_type = other RNA; note = synthetic construct
atgccagataaactgaacttagtgggcaaactgtcatttttcctgggcgcctcagaagaggatatcaagacttctgcgaattctatgagccggaaatataagcagtacaaaatccccaagaaaaatggaggtagccggactatcctgcacccttgcagacctctcaaagcactgcagtatgccatccacgaggtacttcttaataaattggaagtccatcctatagctcatgcttatgttcccaatcaaaagtctccgctgaagcagtccgctaaagcccacacgaactataagtacacaataaggattgacttcgagaatttctttcccagcatcaggccggaggacctggagctgcagatcaacaagaactttattctgtcaaagacagataagtacctgctgcgaaccgtgttattttaccagaagaacagaggaagcaggcccatcctaccaattggcgcaccaacctctcctactataagcaatattgtgatgttcaacctggacgagctcctattgaagacatcaaaagaacatgatcgggattccgccctcaccaggtacgccgacgatatctactttagtaccaacattaagggctgctgtaagcttttctatgacgagattttccaactcctaaaacgcattgacagtccccgcctgaagatcaatacaaacaaaacgttgttcctctccaaaggtactaagagagtggttaacgggcttttcgtgacccctaacggaaaggtcagtattgggcgtaagcgaaaaacacagatcaagagcctgatctacaaacactcccagaccgctcttatgggcaaggaattgctccagactcgcgggttgttagcattcattcaagactgtgagccagaattttataataccctcgccctgaaatacggggtccacttttattccataaaggaatcgtga

SEQ ID NO: 11920 - RNA, 930 nt, unidentified
  source 1..930: mol_type = other RNA; note = synthetic construct
atgtcccggatcatcgatatcataagcaagtacactgggcttgacccgcacaaaatcctgaagattacctatgactcccccaccaactataagctttactacatcaagaagaagaacggagactcaagagcgatctttcacccatctaaagagacgaaaatgctgcagtatgcactcatggaaaaattccttaagaagattccagtccatgaatttgcaatggcctacaaaaaaggtattaaaagccccttgaaaaagaacgctttataccatctgaatactcagtataccctccacatcgattttactaacttcttcccctcaataattcctgaagatttttggagagctgtaagcgtggcctttcctggaaaagagttcgaaacaagtgacatcgaactcatcaataatatcctgttcatcaaggttaaggggaaatgcttcctgtcaattggcgctcctacttcaccaatcatcagcaacatagtcatgaaagagatggatgcccagtttttgaaactatgcaaaaccctggacgaatatagtgtgtatacacgttatgccgatgatattaacatctccacgaatattaagggtttctctcagaagatatactactcgataaagcaacacctcagcgagacagagtctccaaaactcaccattaatgagaagaaaacctacttcctgtctaagaaggggaatcggctgattacaggcctatgtatcacaaatatgaattccgtggttattccccgcaacaaaaagaggattatcaggagcttgattcatacagagctgacttccaacaaaaaggacaaaacccgactgagtaagatcaagggataccttgccttcattaaggacatcgagcctgacttttttaacaagctggtgataaagttcggcgacggcattaacgatttatga

SEQ ID NO: 11921 - RNA, 951 nt, unidentified
  source 1..951: mol_type = other RNA; note = synthetic construct
atgtccatactgaagggcctcctcagcaagtacacctcattgtcgattgacaatatcagcaacatcatcaagaaggcccctgcgtcatacaagacttacagaatcgaaaaagccaatgggggctatagggaaattaaccatcccgctaaagagacaaagaccctgcagtacgccctcatggagatcattttcaaaaaaaacgacgtacacccaatcgctatggcctacaagagaggagttgagagtcctacattcgaaaatgcacggctgcataaggactacgaatattcactccggctggacttcaagaacttttttccttctatcaaacccgatgatataatctccatcgttaaggattcttccaaatacgagttcgatgacacagattattctgacctaaaaaggatctgtttccgcaagaatcacattaaagggtaccagtatggacttgcagtcggagccccaacaagtcccatcataagcaacatcgtgatgtatgactttgatgaggcaatggagaagatttctaaggaactggataaaagctcgaccgtgactcgttacgctgacgacattgtgtttagcactaacgaaaagggtatttgcgcgaaattttattccagcgtacgcgaccacctgaatgatcaggaccttagtttagagtttaatgaggaaaagacggcattcatgtccagagggaccaagaaagtcattaccggcctggtgatttctaataagggtaacgtgtctatcggatacgataaaaaagagaaggtgaagcgaaaagtttacaagtatagtaagggggatttagaagactcagacatacttagcttgaaaggctatctggcttatatccaagatgtcgatccggatttcttcgacaagctgaatattaaatacggcgccgacatattggacgatattatgtcctttgagaacgagtga

SEQ ID NO: 11922 - RNA, 942 nt, unidentified
  source 1..942: mol_type = other RNA; note = synthetic construct
atgcacaagttgttcgacgccatgtatcatggaaaataccgctttgatgaatttttagctctctctcccgaggagaattactcccctgtacattggaaagctcgaaccatctacaaaccaagtaggactcttcgggattttcatacttttttgagtggctttgtgcttgagcagcttcccattaatactagcgtgtcatttgcatatcgcaaagggacgacactagctcaggcagttgcccctcatgcaaagtcgagagccttcttccaaacagacttggagcggtttttcgattccataacaacccccctcataagaaggatcttgatcgaaaaccagaccccggtcctcgatctgcaggctcacttggatcacatcctaaagctgctcaccatcgacgacaaactgccaataggatattctaccagccctctggtgagcaacgcctgcatgcacagcttcgaccagcggttagcacagatctcacatgataggggttggatttacactcgctacgctgacgatatcatgctgtctactcaggacagagccgatctgtctgatgcatccaccgtcataacaggctgtcttgcgacggaactcgggtacggcttcaacctcaaccctggcaagtcaaaactgaccaccattggacgcaaggtgaagctcctggggctggtgatcctgccaagtggggacattgcgattgacagagacgttagaaatcgaattgaaagctggatttacttctacctgagggacagggcccggctgtccaagattttcgaagagacatataaggacggcctcgaagagggcttggagcggctgtctggtctgatcagttatgctcacgccgccgatcccggatatctggagaagctgcgttcaaaattcggtactacagtcatcgatagcttacttcaccgttccgcccaatga

SEQ ID NO: 11923 - RNA, 957 nt, unidentified
  source 1..957: mol_type = other RNA; note = synthetic construct
atgacaccacagcccttacacaagctcttcgatgctatgtaccatgggaagtatcgttttgacgaattcctggccctttcgccccgtgagaattactcccctgttagttggaagagcagaacaatctacaaaccgtctcgcatgcttcgcgattttcacactttcttgaacggatttgtgctggaacatcttccagtaaatacatcagtgagcttcgcttataggaagggtgcaactctgatccaagccgtggagccccatgcgaagtctcgagccttcttccaggctgacctggagcggttttttgatagtatcaccacccctctgattaggagggtgctcctggagtccgaaaccccggtagcagacttgcatgatcacctcgaccacatccttgggctcctgaccattgatgggaagcttccaataggatatagtaccagccctattgtcagcaacgcatgcctgttgtcattcgaccatagactggcccaggttagccaggaccgaggctggatatataccaggtacgccgacgacatcatgctctccactgaggatcgcgctaatctgagtaatgcaggggctgtgattgagacgtgtctggcgtccgaactgggtgatgaatttaagctaaaccctgccaagtcaaagctgactacagtcggacgaaaagtgaaactgctcggtctagttattctcccaaccggcgacattgctattgatcgggacgtgagaaacaggatcgaggcctggatccacttctacttacgggatcgggcacgcctgctcaaaatattcgaggaaacttactctcagggcatggaggaaggcttagagcgcctaagcggcatgatctcatatacgcacgccgccgaccccgcgtacttggaaaaattgcggagaaaatttggaacaacagtcatcgattccctgctgcacagatctgcccaatga

SEQ ID NO: 11924 - RNA, 957 nt, unidentified
  source 1..957: mol_type = other RNA; note = synthetic construct
atgacgccacagcctctccacaaactgttcgatgcaatgtttcatggcaaatacagattcgaagagttccttgccctgacacctgaagagaactgcagccaggtgagatggaagtcacggactatttataagccttcaagtactctgaaggatttccacgtgttcctgagtcgcgtggcattggaccacctactcgtagacacctctgttagcttcgcctatcgtaagggggctactctcatacaggccgtcgctccgcatgcgaaatctcgggccttctttcagacagacctcgagcggttttttgattctatcacaacaccccttatccgacgcgtcctcgtcgagaatgaaactcctgttaccgatttgctggaccatttggatcatattctgcgtctccttacgatcgatggtaaactgcccattggctactccactagtcccatcgtgtcaaacgcctgtctgctgagcttcgatcagagattggccaagatttcagacgaccgagggtggatctataccagatacgcagatgacatcatgctgtctacccaggatagggcagacctttccgatgcgggagccgtggtagaagactgcctggccagtgaactaggagacggttttaacttaaaccaagccaagagcaagctgaccaccattgggaggaaggttaaactcctaggccttgtgatcctgccaagcggagacatagcaatcgatagggatgtcaggaataggatagagtcctggattcacttttatctgcgcgacagagctaaactccttaagattttcgaggagacaccaaatcaggggatggaggagggactggaacggctcagcggcttggtgtcgtacgctcacgctgctgaccccgcgtacttagacaaactgcgctccaagtttggcaccacagtgatcgactctctgttacaccggtccgcccaatga

SEQ ID NO: 11925 - RNA, 957 nt, unidentified
  source 1..957: mol_type = other RNA; note = synthetic construct
atgactccacagcctctacataaactgttcgacgctatgttccacgggaaatacgggtttgaagacttcttggccatctccgccgaggagaaccactcacttgtgaggtggaagtcgcgaaccatttataaaccttcttccactctgaaagatttccatgtttttctgtctcgcgtcgttttagatcacctgcccgtggacgcatccgtatctttcgcttacagaaggggcgcaagcctgatacaggccgtggagccacatgcaaagagtcgcgcttttttccaggccgacctggagcgcttcttcgatagtatcacgacaccacttataaggaaggtgctcgtcgaatcacagacccccgtgaccgatctccatgaccacttagagcacattctgaagctcctgacagttgaaggtaaactgccaatcggttttagcaccagtcccattctctcaaatgcctgcctcctgtccttcgaccagcggctagcccaaatatcacatgataggggctggatctacactcgttatgctgatgatataatgctgagcacgctggaccgctctaagcttagcgatgcgggaacagtaatcgaagactgtctctccgcagagattggagacgagtttaagctgaacccggccaagagcaagctgaccactatcgggagaaaagtgaaacacttgggcctggtgattctgccttccggggacgtcgccattgatcgtgatgtccggaaccgaatcgaatcttggattcacttttatcttagggacagagctaagttgctccggatctttgaggagacacctaatcaaggcatggaagagggattggaaagactatcgggccttgtgtcttacgcgcacactgcagaccccacctatttagacaagttgcggagcaagtttggaaccacagtcatcgatagcctcctgcatagaagtgctaaatga

SEQ ID NO: 11926 - RNA, 957 nt, unidentified
  source 1..957: mol_type = other RNA; note = synthetic construct
atgactccgcagccgctccagaaactcttcgacgcaatgtttcacgggaaatatcgttttgacgaatttcttacgctgagtcccgaggataattatgtgcctgtccgctggaagacccggacaatttacaaagccagccgaactctgaaagattttcacaccttcttatcctctttcgtgctcgagcatttaccttccgacaccagcgtgtcattcgcttatcgcaagggcgccgctttgatgcaggccgtagagccccatgcaaagtcaagagcattctttcaagccgacttggagcgattcttcgactcgataacagccccactcatccggaaagtgctgaccgaaaatcagacaccagcagctgaccttcaggaacacttggagcatgttctgaacctactgacaattgacggcaagctgcctattggatactctacttcaccactgctcagtaacgcgtgcctgctgccatttgaccggcgcctggcacaagtctccctggaaagaggttggatttacaccagatacgccgatgatattatgctctccacgcagcacaggactgatcttagcgaagctaaaaccgtgatcgaagagtgtttggccacagagttgggagcaggtttcaacctcaaccccgcgaagtcaaagcttacgaccattgggagaaaggttaagctgctgggcctggtaatactgcccaccggtcacatcacaatcgacagggctgtccgtagccggatcgagagcggcatccatttctacctatctgacagggctcgccttggcaggatatttgaacgagagaatgatgaggggatggaagaggggttagaaagactgagcggactgatctcctatgctaatgccgcggatcctgcctacctcgagaagcttcgccggaaatttggaactactgtgatcgattctttcctacacaggagtgcccagtga

SEQ ID NO: 11927 - RNA, 957 nt, unidentified
  source 1..957: mol_type = other RNA; note = synthetic construct
atgacaccccagcctctgaggaagctgtttgacgctatgtatcatgggaaatataggttcgaggagttcctggctctttctcctgaagaaaactattctccagttcactggaaaaaccgcaccatatacaaacctagtagagcgctcaaagatttccacttatttctgaatggattcgtgctcgaacaccttccagtaaatacctctgtaagcttcgcttacagaaagggtaccacccttttacaggccgtcgagccccacgcaaagtccagagcctttttccagacggacctcgaacgattctttgactccatcacaacaccccttgtgcaaaaagcattggccgaaaatgagactccagtcgccgacctgtcagaccatttggatcatattctgaagctgcttactatcgatggccagctcccgattggctacagtacttcaccaattttgagcaatgcttgtctactgagcttcgaccaacggctagcccagattagcgcggagagaggttgggtctacactcgttatgccgatgatatcatgctgtcgacacaggaccgagccgagctcctcgatgctcggacggtgatcgaagactgcctgaccactgaactgggtgatggctttaacttgaaccctgcaaagtcaaagctgaccaccactgggcgcaaaattaagctgctcggactggtgatcctgcccaccggaaaaatagccatcgaccgggacgtgcggaacaggatcgaatcatggatctacttctacctgagggatcgctccagactctcccgcatatttgaggagacatacgacgagggaatggaagagggcttagagaggctaggcgggcttgtgagttatgcatacgcatccgatcacgcttatctcgagaagctgcgccgtaagtttgggacgacagttattgatagctttttgcgacggtctgcccagtga

SEQ ID NO: 11928 - RNA, 957 nt, unidentified
  source 1..957: mol_type = other RNA; note = synthetic construct
atgacacctaggccacttcagcaactttttgacgccatgtaccacggtaagtatagattcgaggaatttctggccctgaagccgcaggagcactactcactgataaggtggaaaactcgcactatctacaagccaagcaaaaccctgaaagactttcacttctttttaaacggtttcgtcctagaacacctgcctgtggatacgagcgtaagtttcgcttatcggaaagggtctaccttgatgcaagcggtggaaccccattcccgaagccgggctttcttccagaccgacctagagagattcttcgactctatcacgactccattgatccagggagtgttgcagagaaatcagagccctgtggctgatctcgccgaccatttacatcatgtgctgggcctgctgacaatcgatgggaagctgcccattggttacagcacctcacctttactctccaacgcatgcctgcttggcttcgaccagaggctcgcggccatttctcagacacgcgagtggatttacacccgctacgccgacgatattatcgtctctgccaacgatcgtgctaccatagcagatgctagtgctgtaattgaagagtgtttggccagtgagctgggggacggatttaacctgaataagggcaaatccaagttgacaactattggacggaagatcaaactcctcggacttgttatcctccccaccggcgccatcgttatcgatagggatgtgagaaatcggattgagagctggatacacttttatatccgtgaccggagtcgactggcgaaaatattcgaggaggaacgcggagaaggcatggaagagggccttgggaggctctcgggcctcatttcatacgcctatgcagcagatcccggttattttgaaaagctgcgatcaaagtttgggacaactgtcatcgactccctactgcacagatccgcacaatga

SEQ ID NO: 11929 - RNA, 921 nt, unidentified
  source 1..921: mol_type = other RNA; note = synthetic construct
atgtatcacgacaagtacagattcgaagagttccttacgctgtatgcaggagatcattatagccaagtgctgtggaagaatcgtacaatatacaaaccatctgccaaactgaaggactttcaccattttatcggcggattcctcctggaacacctccctgttgaccagagcgtctcttttgcctacagaaaaggcgcaacacttcttcaggccgtccaaccccattccaggagccgtgcgttttatcagacagatctggaaaggttcttcgactcaattaccaacaacttgatccggtccgttcttgagcaagccgccacgccagtgtctgacctttcagaccatttggaccacattttgtcactgttaactatcgatggccgcctgcctattgggtacagcactagtcccatactctcaaatgcctgcctgtatggctttgataagaggctggcggccatcagtcacgaaaggggatggatctacactagatacgcggacgatataatcgtatcggccgctgaccgactcgctattgaggatgctcctcaggtaattgaagactgtctagggaccgagctcggcgacggcttcaagttaaacagttccaaaagcaagctcaccaccattgggcgcaaaattaagttgctcggtctggtgatactcccgacaggggcaattgtgatcgatcgggaggtgagacacaggatcgaagcttggttgcacttttacgtgagcgatagaccacgcctagcaaagatctttcaggaggagcggaaagagggtctggaggaagggttacagcggctgtccggactgatcggatatgcccatgctgccgatcccctgtacctggagaaactacgagctaagttcggtaataccgtcatcgattctttcctgcggcgctccgcacagtga

SEQ ID NO: 11930 - RNA, 921 nt, unidentified
  source 1..921: mol_type = other RNA; note = synthetic construct
atgtaccacgagaaatatcggtttgaacagtttctagagctcaaacccgaggagcactacagtagtgtgctctggaagaataggacaatctacaagccaagcagtattctgagagagttccactacttcttgaacggattcttgttggaacacctgcccgtcgatacagtagtatccttcgcgtatcgtaagggagctactctgttgcaggcggttgagccacatgccaactctagagcattttatcagacggatttggaacgcttttttgacagcattacctcagatctcatccgaagtgtgctttctaggtatgaaacacctgtttctgacctgtctgactatatcgaccatataatcggtctgctgaccatcaatggctcactgccaatcggctactcgactagccccatcctctccaacgcttgcttactgggcttcgataaacgacttgccgcaatttcggacgaacggaaatgggtgtacactaggtatgctgacgacattattatcagcgccgacgatcgtttatcaattaaagacgctgatcaagtcataaaggagtgtctcaaactcgaattcggcgatggttttagcctgaatgagtccaaatcaaagcttaccacaatcgggagaaagattaagatcctgggcttcaacatcctgccgaccggggccatttctatcgagcgcggagtcagaaatcggatagagagctttctctacttctatgtgaaggataggcctaagctagcccgcattttcgaggaggaacagggtgactccatggaagatgggcttctgcggctttccgggctgatcagctacgtgtacgcagccgaccctgcatacctgaaaaaattacgcgttaagtttggcaacaccgtgattgatggattcctgcatagatccataaagtga

SEQ ID NO: 11931 - RNA, 957 nt, unidentified
  source 1..957: mol_type = other RNA; note = synthetic construct
atgactcctcagccactcgagcagctgttcgatagcatgtttcatggcaaatacaggttcatcgagtttatggaacttaaacccgagcaacaccgtgtgcgggtcagctggaagggcagaacaatctacaagcctacaggcgtgctcaaagccttccataggtttttgaaccactatgttctcgatcatctacaggtggatgaaactgtctcttttgcttaccgccggggcaccacattactccaagcggtagagccccacgcccattcccgagcattctttcaaacagatttagagcgtttctttgacagcattaccaccgaccacatccgaacggccctggaaactagcgatatccctgtggaagatctgggtcagcacctgggacatatcctcgagctgcttaccatagacggcaagttaccaatcggatacagcacttctcccattctgagtaatgcatgtctcctgggttttgacagtagactgaagtctcagtcacgcgatcgcggctgggtttacacacggtatgcagacgacataatcctgtcagctgccgacagagagtccttggccgacgccgtggctgttgtggaagattgcctgtccagtgagctaggtgatggattcgcactgaacccgaccaagtctaagcttacgaccattgggaggaaggtaaaattgcttggaagggtcattgtgccaaccggggtcattgttattgaccgagaggtgagaaatcgcatcgagtcatatctgcacttctacatcactgaccagtccaaattggctaggatatttcgcgaagatcgggaagaggaatgggaggatgggcttcagtcattgagtgggctgattagctatgtgcacgtagcggacgtggcttatctcgacaagctgcgggccaaattcggagccacagtcatagactccttcctgcacagatcggcaaagtga

SEQ ID NO: 11932 - RNA, 957 nt, unidentified
  source 1..957: mol_type = other RNA; note = synthetic construct
atgacacctcgacccctgcatcagttgtttgatgctatgttccacggcaaatatcagtttgatgagtttttggccttaaagccagaggagcaccgaacacgcgtcagttggaagggacgtacaattcacaaacccagcggcatactcaagaattttcacaggttcttgcactcattcgttctggaacatttactggtcgatgagaaagtttcgtttgcctatagaaagggtaccaccctgttgcaagcagtcgagccacacgcgcagtccagggctttcttccaaactgaccttgaaagatttttcgactcaatcacctccgacctcgtgcgaaacgtgctcaaacaggcagaggtggctgttggcgacctggatgaccacctggaacacatactggcccttctaacgattgacggaaagctgccgatcggatattctaccagccctattctgtctaacgcgtgcctgtctgggttcgacgctaggcttagtagtataagcatcgacagagactggatatacacgcgctacgcagacgatatcatcatttccgccgacgatcggacagccctgatcgatgccgcagcagtgatcgaggaatgtctggctagcgaactaggggagggcttcactctcaaccttgcgaagagcaagctcacaactgtgggtcgcaaagtgaaggtcctcgggcgggttatcctgcctactgggaccatcgtgattgatagagaagtccgcaatcggatcgaatcctggctacatttttacaccagtgatcgcccacgtctcgccaaaatttttagagaggaacggaatgaggagtgggaagaaggcttggagcggttatccggacttgtatcatatgtacatgtggccgatccctcttacctggagaagctgagggctaaattcggtaccactgtgattgactcagtgctccataggagcgccaagtga

SEQ ID NO: 11933 - RNA, 957 nt, unidentified
  source 1..957: mol_type = other RNA; note = synthetic construct
atgaatcctcagcctttgcatcagctctttgatgccatgtatcacgacaaatatcgttttgacgaattcctggcgctgaaaccagaggagcattatagccccattccatggaaaagtcgcacgatctacaagccctcgcccactctgaaagacttccacaagttcattacaggcttcctcctggactatctgccagtcaacgattctgtgagctttgcatacaggaaaggggcctcattgcttcaggccgtgactccgcatgcttacagtcgcgcctttttccagacagatctagagagatttttcgaatctatcaccagctccctcattcgaagagtgctggaccaagcgtccacccctgtcgctgacttggcagagcatgttgaacacattgttcgcctcctcaccatagaaggcgcgctgccaatcgggtacagcacgtcccctatcttaagcaacgcctgcctcctggggttcgatgcacggcttgctgccacctcatgcgcccgaaattggatctataccaggtatgcagatgacataatcatatccgctggctcacgcgctgccattaacgatgtgggacaagtcgtggaagaatgtcttcgggccgaactgggtgattctttcagattaaatcaggataagaccaagctgactaccatcggacgtaaagtaaagctgctgggattcgtggtgcttcccactggtggcattgtcgttgacaggaacgtcagagatagggtagagacattactctacttttacgtgacagacagaagtaggttggctaagatttttgctgaggaaaatgatgaggtgatggaggcaggcctggagcggctgtctgggttgatctcatacgtgcacagtgttgacgaggcctaccttgagaagatgcgaatcaagttcggaagcactgtaatagactcctttctacacaagacagcacggtga

SEQ ID NO: 11934 - RNA, 957 nt, unidentified
  source 1..957: mol_type = other RNA; note = synthetic construct
atgacgccacgcccactgcgccagctctttgatgccatgtaccacggcaaatataggttcgaagagtttcttgagctgcgccctcaggaacactacaatatagtccggtggaatagtaggaccatttataagccttctaaaaagttgaaggcgttccactacttcctgaacggcttcctgctggagtatttaccagtgaaccagtcggtgagcttcgcttaccggaaaggcgccacgctgcaacaagctgttgccccccacgccaggtcaagagccttttatcagacagaccttcagcgattctttgattcaataaccagcgatctgattcgttccactctagaaggagcgtcaactcctgcttctgacttgccagagcatattgaccacatcctcgaccttcttaccatcaacggaaagctccccattggctatagcacttctcctatactgagtaatgcatgtctcctgaggttcgacgagcggctggcagccatttccaaggatcgtcagtggatttataccagatacgctgacgatatcatcatttcagccgatgataggaagaccattggtgacgccaaggaactgatagagagttgcctggctgcggaactcggaggtaacttcgcacttaacccctctaagagcaagttaacaacaattgggagaaaagtaaagcttctggggctggttatcttgccgaatggtgccgtcgctatcgaccgagatatcagaaatcggatcgagactctgctccatttttatatctccgatcggagcagattggcaaaaatctttgaggaggagcgatccgaaggcatggaagaggggctacagcgcctctccggactagtgagctacacatacgcagccgaccccttatacctggaaaaattgcgcgctaaatttggggccaccgtgatcgacagtctcctgcataggtctgcagagtga

SEQ ID NO: 11935 - RNA, 957 nt, unidentified
  source 1..957: mol_type = other RNA; note = synthetic construct
atgacaccgcggccccttcatcaactgttcgacgcaatgtatcacgggaagtatcgctttgaagagttcagcgagctgaacccccgggagcactacacttctgttcagtggaataatcggaccatttacaaaccttcgaagaaactaaaggattttcactcattccttaacgggttcctgctggagttcctgcccgtcaaccagagtgttagttttgcctataggaagggagccacgctattacaggcagttatgcctcatagccggagcagagctttctacaggaccgatctggagcgattctttgacagcattaccagcggccttgtgaggtcagcgctggaaagggctgtcaccccaatcagcgatttggcggaacacattgaccacttactcgatctcctgactattaatggaaagctccctatcgggtattctacatcgccaatcctctccaatgcctgcctgctcggctttgacgaaagattggcatccatctcccgagaacgccagtggatctacactagatatgccgatgacattatcataagcgcagatgataggagtgccatagaggccgcctccgacgtgattaaatcatgtctatcaaccgagctgggcgatgaatttgctctgaacagttccaaaagtaagttcactacgatagggcgtaaggtaaaactgttaggtcttgtgatcctgccaaatggaaccatagctatcgatcgcgacgtgcgtaacagagtcgagagctggttgcatttttacgtgtctgaccggtctagactggctaagatttttgaagaggagcgatctgagggcatggaagaaggattgcaacgcctctcaggtcttatctcctacgtgtacgctacagaccccagatatctggagaagttgcgcgcaaaattcggcacaacagtaatcgactccttcctccataggtctgcccagtga

SEQ ID NO: 11936 - RNA, 957 nt, unidentified
  source 1..957: mol_type = other RNA; note = synthetic construct
atgaatccaaggccgctgcaccaattatttgacgccatgtatcatggaaagtacaggtttgaagagtttctagccttgaatcctgaggaacactacacgccggttccctggaatcggagaacaatatataagcctagtccaacacttaaggaatttcaccggtttctcagcgacttcctgcttgattaccttccagtggaccagtctgtatcattcgcctatagaaagggagccactctcctgcaggccgtgacaccccacgcacatagtcgcgccttcttccagactgatctggagcgttttttcgattccattaccctgaacttaatccgacccgttctcaaccgggcggcacatcctgtgtcagatctgcctaaacatatcgaacacatcctgaggctcctgaccatcaacgggaaattacctataggttatagtacttccccaatactttcaaatgcctgcttgtttggcttcgataaaaggctcaccgtgatcagcaacgagagacattggatttacactaggtatgctgacgacatcatcatttccgcaggggatcggctcgctatcgaggatgctagctctgtcattgagaactgtctatcagcagaactcgggaagggctttgtcctgaaccagagcaaatccaaattgaccaccattggacggaaagtgaaattgctgggtctggtcattcttcccacaggagccatcactattgaccgtgacgtgcgaaataagatggaatcgtggttgtacttctacgtaacagaccgcagccgcctagcgaagatattccaggaagagcgcaacgagagcatggaggttggcctgcaaagactctctggcttcatctcttacgcttacaccgctgaccccgcatatctggagaagctgagaaccaagtttggcaatacgatcattgatagtttcctgcaccgatccgctcagtga

SEQ ID NO: 11937 - RNA, 957 nt, unidentified
  source 1..957: mol_type = other RNA; note = synthetic construct
atgacaccccgtcctctccaccagcttttcgatgccatgtaccacgaaaagtacagatttgaagagtttctggccttaaagcctcaggagcattacagcccagtttcttggaacagacggaccatatataagccttcaccaaaacttaaggaatttcaccacttcttgtctggcttccttctcgagtttctacccgtggacaggagtgtctccttcgcttacagaaagggcgccaccttgctgcaagcggttgctccccacgctcaatcccgcgcattttttcagacggatcttgaacggttctttgactcaatcacttctgatctcattaggtccgttctggaccaggcagagactccggtatcagacttgggcgaccatgtggaacacatcctcgacctgctgacaatcgacggaacgctccccattggatacagcacatcacctgtgttgtccaatgcttgcctgtttggttttgataagaaactggcggccatctgtcatagtcgtcagtggatctacactcggtatgctgatgatatcattatatccgccgacgatcggctgagtatcgaggatgccgaccaagtcattgaaaattgcttggtcgccgaactcggcggaggtttcaaattaaaccagaagaaatcgaagctgactaccgtaggcaggaaggtgaaactcctagggctggtgattcttccaaccggggtgatcgtcatagatcgcgagattaggaatagaattgagacatggctgtacttctatatcaaagatcgatctcgcctcagtaaaatcttccaggaggatcgaggggagggtattgaagaggggctgcagagactgagcggcctgatttcttatgctagcgccgcagacccaatctatctggacaaactaagggcaaagttcggaaacaccgtgatagacagcttcttacatcgcagcgcacagtga

SEQ ID NO: 11938 - RNA, 957 nt, unidentified
  source 1..957: mol_type = other RNA; note = synthetic construct
atgactccgcgcccactgcgacagctatttgatgcaatgtatcacgagaagtaccgcttcgaggaatttctggccctgaagcctgctgaacactatagcccagtccattggaatagacgaacaatctacaaacccagctcgaagttaaaagaattccatcgattcctaaacggcttcctcttggattatctacaggtcaacgaaagcgtgtcttttgcatacaggaaacggacgtccttgctgcaggcggtagcccctcacgctcattcacgtgccttctttcaaaccgaccttgagcgcttcttcgactctattaccagcaacctgattaggtctgtgctggagagagccgatacacccatagcagatcttgctgactacatagaccatatactggatttgctgaccatcgacggtaagctgcccattggatatagtacttcccccattctctctaatgcctgtctcctgggctttgacaaacaacttgccgccctgagcgccgaaaggcagtggatctatacaagatacgctgacgatgtgattatctccgctaacgacagggcgtctatcgaagacgcgagtcaggttatcgaaaattgcctcgcaatcgagttaggggacggttttaagctcaatcagaagaagagtcggcttacctccattggcaggaaagttaaactcttgggactcgtgatactgccaaccggcgcaatcgtcctcgatagagacgtgaaaaaccggatcgagacgtggctgcacttctacgtgacagatcgggctcggctggcaaagatctttcaggaggagaagaatgaggggattgatgaagggctgcaacgtttatccggcctgatttcatacgccttctcagctgatcctgcctatttggagaagcttagagccaagtgcggaagtactgtaatcgacagctttctgcaccgctcagctaaatga

SEQ ID NO: 11939 - RNA, 957 nt, unidentified
  source 1..957: mol_type = other RNA; note = synthetic construct
atgaccccacgacccctgcatcagttcttcgacgccatgtaccacgggaaataccagttcgaagatttccttgaactagaacccaaggagcattatactcccgtgcctctttccggccgcaccatatacaagcctagcaaggtgctcaaagagtttcacacttttttgaacggatttgttctggtccatctgccggtgaatactacagtgagtttcgcctatagaaagggcgtgagcttgctagaggccgttaccccccatgctgactcacgggctttttatcaaacggatattcagcacttctttgaatccataaacgtgaagctgatcaaatccgctctcataaaagcagacaccccagtaacagatctcaacgatttttttgaccacattctggatctgatcacagtggacgggtctttacctataggatactctacctctcctatcctctcgaatgcctgccttcacgggtttgacgagcgtcttgcctacatctcctacaagaatgaatggatctatacgcgatatgcagatgacatcattatttcaggcgcggataggaaaagtgtccagaacgctcagagcgagatcaaaaactgtctgctcgaggagctgggtgagggtttcaagctcaacctgaataagagcaagttgaccacagttggcagaaaagtgaagatcctgggtctggtcattttgccaaatggagacatttccattgatagaagtgtccgggacaaaatcgaagcaaggttattcttctacatcaacgatcggaagaagcttgcgaaaatttttgtcgaggaaaaaaatgacggcatggaagacggcttgcaacgcctgtctgggctcatcgggtacgtacacacaatcgacccactgtatctggagaagttaaggatgaagttcggaactactgtgattgattcattcctgcatcgcagcgcccagtga

SEQ ID NO: 11940 - RNA, 1026 nt, unidentified
  source 1..1026: mol_type = other RNA; note = synthetic construct
atgcctgacctgaaagcctcctgtcgggttggccattttgtgtgcgcgccaatctccaccatgactgatccctccgtatcagtcaaggcacggtctttagagtacctgtttgaaatgatgcaccacggtaggcacagtttcgacgatttcctgcgtctcccggtcgataaacatttccagagagtggattggcgcaccagaacaatatacaagccttctaaaactctcagggcttttcatagcttcctcaatgtgtttgttttggggtatctccccgtgaacgaacgcgtctgcttcgcctatcggaaaggcgctacactgaccgatgcagtcgctgttcacgctgaaagtcgggcatttttccagacggatttggccaagtttttcgacagtattacatcccaaatggtgcacgatgcacttgcccgtgcgtcaacccccgctgaagaccttccacagttcatagaccgaatcgtcgagttgactaccatcgatgagcgcttagccataggctttagcacgagccctctgcttagcaattcatgcctgattgccttcgacaatatgttggaggatgtgtgtcgggatagacaactcatttatagtcgctacgccgacgacattgtggtgtcaggacagtcccccgacaagctggacggaattgaaaggctaatcgcgcagctgctagacaaggctctggggccgactttccaaatcaacactgcaaaaagcaggatgctccgtgttggtagaaaggtaaagatactgggcttgaacatcctgccatctggccgcattaccgtggatcgggagattcgcgacaaggtagagacacagctacacttttatctgaccgacagggcccgacttatgcgaatcatcgacgccgaacctgatgaggcattacagaagctgtcggggtacattgggcacatccattctgccgatccactgtaccttgagaaactgaggagaaaattcggagccacagtgatcgacagctttctccatagatctgctcagtga

SEQ ID NO: 11941 - RNA, 987 nt, unidentified
  source 1..987: mol_type = other RNA; note = synthetic construct
atgaccaagaagcccttgcagatcctctttgatgccatgtatcacaacaagcaaaatttcgaggacttcgccaatggagacatagcatcccatttctctcggaagcctgtcactgatgactctgggaaaacgcgcgtcgttagcgtgcccgataaagttctgcggaaatatcattcctttctgaatctcttcgtgtttaatcagctccccgtgaatgaagaggttgtattcagttaccggaaaggtacgaatgtggccgccgctgtacagaaacacgcagcgagcaagcatttctatcaggcggactttagtaactttttcgagagcatcacaagcgacatcgtgagacactctatcttacgcggcgaagataagatccccgtggccgacatccaccaatatctggaccgaatagtggacctggtcaccttcgaggggagactcccacagggcttctctacctcacctgtcatctcaaacacagctctgctgccatttgacaaggacctggctacatactgtcaaaacaaacatttggtgtataccagatactccgatgatattaccatatcctccaatgacaaggagccgctgtttgagcttgatcacgtcattgccgaaattcttagttcttgcggctacagtgaaatgaagctgaatgaaaacaagaccaagataagctcaaagggaaggaaaattaaaatcctgggcatggtaatcctaccaaacgggcaggtgtcgcttgatgctaagattaaaaacaggatcgagactttgctccatctgtacgtgaacaaccagcagggattgtcagatattacagaaagcgacctagaggacggcctcgcaaaattatccggactgctgaattatgccaacactgtggatcaaggttacttagacaagcttcgtaggaagtacggggttacagtggtcgatattctcattcaccagcctaagaagactgatgctaaaaaagcagactga

SEQ ID NO: 11942 - RNA, 987 nt, unidentified
  source 1..987: mol_type = other RNA; note = synthetic construct
atgaccaagaagtcactgcaaacactatttaacgctatgtaccataacaagcagaatttcgaggatttcgcgactggcgaaataaagcagcacttcagtaaaatgcctgtaactgatgctagcgacaaggccagactggtgttcattcccgacaaggttctgcgaaagtaccacagctttctgaatctgtttgtctttaaccgtctgccggtatataatgacgccgtcttttcatatcggaaaggaacaaacgctgccgcggctgtccgaaaacatagtgcatccaagcatttctatcaggctgactttagcaacttcttcgggtccattacgtctgatatcgtgagacgctcaatactgcacggagcagagcaattaccagtcgccgatcttcatcagtaccttgaccgtataatcgacatggtgacggtggagggcagactcccccttgggttttcaacctcacctgtgatttccaatactgcacttttgcccttcgacgaagatctcgccatatactgcagaaggaggcagttagtctacacacgctacagcgacgacattacaatcagttccaatgaacgggagagcttgctcgagttagacgacgcaatttctgatatcctcagcagtcgggggtacagcgaaatcaagctgaacgagaagaaaaccaagatctcgtccaaaggtaggaaggttaagatcttgggtatggtgattttgcctaatgggcaggtttccctggatgccaaaatcaagaacaggatcgaaacactgttgcacctttatgtaaacaatcaaccaggactctctgacgttactaaatctgacctgggcgattccttcgagaaactatctggcctgctcaattatgccaacactgtggatcagacctacctggataaactgcgccggaaatatggcgtgaccgtggtggatattctcatccaccagaacaagaaaaccgattctaagaaagccagttga

SEQ ID NO: 11943 - RNA, 987 nt, unidentified
  source 1..987: mol_type = other RNA; note = synthetic construct
atgacaaagaagcccctgagagtactctttgatgcaatgtaccacaataaacagaacttcgatgacttcgccaccggggagattgacaggcattttactaagaagaccattaaggatgatgctgggaaagagcgattagtttttattactgatcgcaccctgaggaaataccatagctttctcaatctgttcatattcaaccggctccccgtgaacgaaggcgtggtgttctcctaccggaagggaacgaatgctgccgccgctgtaagaatgcacgcgggtagcaaacacttttatcaggccgacttcagcaacttctttggtagcatcacaagcgatatcgtccgacaaatcatcataaacggcgaggacgtcctgcctatcgcagacactaaccagtatcttgatcgtattgttgacctggtcaccgtggacgggcggttgcctatgggctactccacttcaccggtcatctcaaatgctgcactgttactcttcgacaaagaattggcgcggtattgtcaatctaagcagcttgtctatacaaggtactctgacgacattattatttcctctgatgaaaaggagccactcatggatatgagtcaggtgatcgccgacacgctgtcagactgcgattattatgacctgaggctgaatgaggagaagaccaagatttccagtaaaggacgcaaagttaagatcctaggcatggtaatcttgccaaacggacaggtgtcgctagacgccaagatgaagaatcgcatagaaacactgctccatctgtacgtgaataatcaagacagactttccgacgccaccaaaatcgattttgaagactcagtggtgcagctttctgggctcttgaactacgcaaacacaatcgaccaggattatctggataagctgagacgtaaatacggcgtgactgttgtggatatattaattcaccagcccaaaaaaaccgatagtaaaaaggctgagtga

SEQ ID NO: 11944 - RNA, 987 nt, unidentified
  source 1..987: mol_type = other RNA; note = synthetic construct
atgactaaaaaacccctgcacgtactctttgatgcgatgtaccataataagcagaactttgaagactttgccgccggccaaatcagtcatagactttcaagcaagacagttactaatgagtccggcaagactcgattgatatgtattccagacaaggtcctgcgtaaataccactcattcctgaacttattcgtgttcaatagactacccattaatgaagaggttgttttctcctatagaaagggaacgaatgtagccgcggccgtcaggaagcattcagctggaaaacacttctaccaggcagacatttctaattttttcgggagtatcacctctgacatcgtgaggcggagcatattgcgtggcgaggagcaacttcctgtcgctgatatgcaccggtacctggacaggatcgtcgacttggtgaccgtcgaagggcgcctgccacaaggattttccacctcccctgtgattagcaatacagctatgttccctttcgataaagagctcgtaacctactgcctgaaaaggcagcttgtgtatacccgatactccgatgacattacaatatcgagtcaggaaaaagagccactcttagacttagacagagtcatcgccgatatcctgtgtgattgcgcctatcccgaaatgaagctgaacgagaacaagacgaagataagctctaagggtcggaaagtgaaaatcttgggcatggtgattttgcccaacggacaggtgtctctggactctaagatcaagaatcggatcgaaacactcctgtacctgtacgtgaacaatcagccggggctgtcagacattactaaaagtgatctaggtgacagctttgagaagctcagcggtcttctgaactatgcaaacacagttgatggcaactatctggataagctccgccgcaaatatggcgtgaccgtggttgatgtgctcatccaccagcctaagaagactggggctaaaaaggcaaactga

SEQ ID NO: 11945 - RNA, 984 nt, unidentified
  source 1..984: mol_type = other RNA; note = synthetic construct
atgaccaagaaacctttgcagatcttatttgacgccatgtaccacaacaaacaagattttgccgatttcgccacaggcgacatcataaggagagttagctcgaaaaccgtgacaaacgacagcaccaaggagcggctcgtgttcgtgccagacaaggtactcaagaaatatcactcattcctgaaccttttcgtcttcaactacctaccaattaatgaggatgtcgtgtttagttatcgcaagggtactaatgttaccgccgctgttcgaaaacatcgcaacagcaaacatttctaccagaccgatatttccaattttttcgattctatcaccgtggatatcgtgcgcaggtgtattttgcggggagaggaacagacccccgtatctgacatgggagaatttattgaccggatagtagaactggtcacaatggagggcaagctccctctggggtttgcaacctcccccgctattagcaatactgcactacttccttttgatgattctctggccgcttattgcagccataagaacctggtttacacgaggtatagtgacgatataactatcagttcctccgagaaggaacccttgttcgcactggacgacgcgctgagggacatcctctctgcccacgggtttccgaatatgcagtttaatgagcataagacaaagatttcctcgacaggtcgtaagatcaaaattctgggcatggtgatccttcccaacgggcaggtgactctggactcaaaaataaagaatcgaatcgagacactcttgcacctttacgtcaacaaccaaagcgcgctcttcgatctcaccaaatccgatttagacggctcatacgaaactctgagtgggttcttaaactacgctaatactgtggaccagagctatctggacaaactgagaagaaaatatggagtcacggtgattgatacactgatccaccagccaaagaagtctgagtcaagaaagggctga

SEQ ID NO: 11946 - RNA, 987 nt, unidentified
  source 1..987: mol_type = other RNA; note = synthetic construct
atgaccaagaaacccttacagtttttgttcgacgctatgtatcacaataagcaatcttttgcagatttcgccacaggcgatattggccgccacctgagcgccaggcaaattaccgacgatgctggaaagaagagagatgtttttgttcctgacaaagtgctgcggaagtaccacagttttctcaatctcttcgtgttcaactatttgtccgtcaacactgcggtggtattctcatatcggaaaggaaccaatgctgctgatgcggtcagatctcacgcctccagccgacatttctaccaagccgatatctcatccttctttccatcaataacagcagacattgtgcggagaagcatccttagggacgaagctcagacacctgtggaggatctgggggactacctcgaccggatcatagacctggttacaattgatggtaccctgcccatcggtttcagcaccagtccggtaatatctaacaccgcactgctgccatttgacgatgcctttgcagcccattgtcttaggaacggcctgatttacacccgctacagcgatgatatcacagtgtcgtctcaggagaaggcccccctactggcccttgacgcagtgattcaggacctcttatgccgctgcaacttgccagaaatgaggctgaacgagcgtaagacgaaaatctcctccactggaagaaagatcaagatcctgggcatggtggtgcttcccaatggggtcgtcacactcgacgctaaagtaaagaatcgcattgagactctcttgcatttatacgtgagaaaccagctagccctccaggaggttatgaaagcagaccttgtggaaagtgctgaaactctgtcagggttgctgaattacgccaataccgtcgatcagggatatctggacaagctacgaaggaaatatggcgtcactgtcgttgacacgctggtgcaccagcctaagcgtactgatagcaaaaaagacaagtga

SEQ ID NO: 11947 - RNA, 987 nt, unidentified
  source 1..987: mol_type = other RNA; note = synthetic construct
atgaataaaaagccgctggagacgctgtttaacgccatgtaccacggcaaacaatcatttcaggacttcgctacctgcgacgtcgcgcaacgcgttaccagaaagacgatcagcgacaatagcgctaaagaacggattgtctacgcggcagacaaagtcctcgcaaaataccactccttcctgaatctatttatattcaaccacttgcccattcgcgaggatatcgtgttctcatataggaaggggacaaacgccgccgacgccgtcaaaaagcacgttaattcgagacatttctatcaggcagacatcgccaacttcttcccctctataagcgcagatagcatcaagaaagccattttgcggggaattcaccaggtgccagtttcagatgtggctgagtacctggaccgcatcatagacctggtcactgtggagtccgcattgcctttagggtttgctacttctccctcaatctctaacgccgctctgctgctgtttgacgatgccctttctaacgtgtgcctggaaaagggcctcgtgtatacccgttactccgatgacattacaattagtgcccaagaaaaggagtccctgctcggcatggatgcgaccattactaggctgttagccgaatgtgattaccctcagatgcatctcaacgacaggaagacaaagctcaccagtattggccgaaagataaagatcctcggaatggtgatccttccaaatgggcagttgacagtcgatagcaagatcagaaatcgtgtggagacaatgttacatttttatgtgaggaacaacgacgctctggttgacctgactaatactgatcttgatgaatccgtagatgtactcggtggactagtgaactatatcaataccattgatcagcggtacttggacaaacttcgacgccggtatggtgtgacagtaatcgacaccctgatccatagacagaaaaacaccgatagtaaaaggaataagtga

SEQ ID NO: 11948 - RNA, 942 nt, unidentified
  source 1..942: mol_type = other RNA; note = synthetic construct
atggagcagctccggaatctgtttgatgaaatgtttggcggggaactgtccttcgacgatttcctgcacggtgatatctctaaccgggtgattaaaaagatagatggaactagagtcgtatactcggccgaccagacgcttaggagctatcaccgcttcttgcaacgtcacgtaatctcctacctgtatttgaactctgacgtggtgtactcctatcgcaaaagctttaatgttgctgacgcagttaggcagcatgcacaaagcaaatacttctttcagacagatctctctaactttttcaactccatcactagtaagctgatccatagtaccctgtttaagagtagtgagcgaatgaagttcctcaattctaccgaatattttgaccggattgtgatactgctgactgccaatgatagactacctcctggcttcatcactagccccagcatttctaacgcatgtttatctgagttggacgacgtcttccagaagttctgcattcataagaacctcattttcacgcgatattgtgacgacgtcatcgtttcagggcaaagccaggatgatcttcggattgctgctcaggagctgtcgaatctggttgagatctgctacaagggtgaattttcctttaacgtgaggaagtccaaattcaccaagatcgggaggaaaatcaagttactcggaatggtgattctcccaaatggcctagtgacaattgactcaagcttgaaaaagaaaatcgaagtgctgctgcactactacataaccgattcctttacatttcttagaatggtggacaatgatctgggcaagggaacacgctcattatgtggctatataagcttcgtcaatgcggtcgacccaacctatttccttaaactgtgctcaaaatacagttcagccgccatcgagaaccttctcagaatgcccaagtga

SEQ ID NO: 11949 - RNA, 969 nt, unidentified
  source 1..969: mol_type = other RNA; note = synthetic construct
atgaccaaaaaaccacttgccgaactcttccgcgccatgtaccacggaaaatatgattatagggacttcataggcgaagctctttccagtaggtacaagccgctgaacgtcgggggtgctcaggtttcaaaagagcgattagtgtacgcccccgataagactttgaagatttaccattccttcttgaaccttttcctctttgaatacttagacgtgaatgaggaagtggtgttcagctatagaaagggagtgaacgtggtgggagccgtcagaaagcacgcacataataaacactttttccaggccgatctgcaggatttttttctgaacatcaatagtacgatggtaagagcggtgatcgaaaatgtggctgcaaggactccaatctctgatgttttagatcacgttgaccggatcatcgagctcgtcaccattgacggcacacttcccattggtttcccagcctcacctttgatttcgaacgctgtactgcgctcttttgatgaccgtttcgaggattactgcgcactcagaggcatggtctatacacggtactcagacgacctgatcgtctctagccagaatagggacgagctaactaacctggcggctgtgattgaagagatgctgcaaagcgttgggctggcccaatttaagctgaatcctgaaaagacaaagatcacatccgtggggcgaaaaataaagttgcttggcctcgtgatcctccctaacggagtcgtgtccgttgacattaagctcaagcagcagatcgagacaatgctgcacttttatataaccgacaatgcaaaattccgggactttagtgagaaagacctgactaaggccaccgagcaactaagcgggtacgtgaactacgtaaatacggttgatcccgcatatctggataaactgcgcaagaagtatggcgtcaccgtaattgataccctgatgcatcagggttctaaatga

SEQ ID NO: 11950 - RNA, 969 nt, unidentified
  source 1..969: mol_type = other RNA; note = synthetic construct
atgacaaagaagccattagccgagctgttccgggcgatgtatcacggcaagtacgaatatcgagattttatctgcgaggccttagacgctaggtacaaacccatcaacgtaggcaggactcagacatcaaaggaacgcctggtctacgcacctgacaagactatgaagatttaccattcatttctgaagcttttcctcttcgagtacctggatgttaatgagagagtggtcttctcttaccgcaagggcgtcaatgtggttgaggccgtcaagaagcatgcacacaataaacactttttccaagcggacattcaggatttctttccctctatcgactctatgatggttagactcgttattgagtcggccgctactaggacccctattgcagatcttatggaccatgtggatagaataattgaattggtgacaatcgacggggcactgccaataggcttcccttcctcccccctaatttccaatgctgtgctccaccgctttgacgatagtttcgaagaatattgtgtaaatcgtggtatggtgtacactcgatactcagacgacattattgtatccagtcaaaatcgggacggattgaacaacttggccacagccatcgagaacaccctgaaaagcgtggacctggggcatcttacactgaacccggaaaaaaccaaaatcaccagcataggcaggaaaatcaaactcctggggcttgttatcctcccaaatggaaccgtgagcgtggatatcaagctgaaacagcagatagagacaatgctgcacttttacattaccgatcgggctaaactcagagattttctggagacggatctaagcaaggccaccgaacagctcagtgggtatgtcaactatgtgaacaccgtggatcccggttatctggacaagttgaagaaaaaatatggagtgacggtcatcgacactttaatccaccagggatctcggtga

SEQ ID NO: 11951 - RNA, 954 nt, unidentified
  source 1..954: mol_type = other RNA; note = synthetic construct
atggtgaatagagacttcaagtcagctttcgaagctatgtatcatgggaagtatgacttcgaagatttcaagtctggagatataagcgagaagtttaggaagcttgacttgaacaagaaaaacgtgtacgaagctgaccagaccctaaagatctaccacaagtttctcaatctgtttgtgttccagtggttagaattcaacgagaattgtgtgtatagctaccgcaaagggatgaatgttgccgatgccgtcaagaagcacgcccacagcaaacatttttatcagacggacctcaacaacttcttcggctctattcgaagtgactttgtgaaaggctcaatcatagcatctatcgaccggatgccaattacagatgtcttgttatacgttgataggatcatcgagatttgtaccgttagcaataagctgcctgtggggtttagcacaagtccgttgatctctaacgcctgcctgctccattttgataatgaggtcgagagatactgcgaagaaagtggactgatctatacccgctactctgacgatattatcatctcaggcggagataagaaactatacggcactggcgagattattgctgaggtcctgtacaggcagttcgagggtcacctgagcattaattccagcaaaaccaagtattcctcagccggcaacaaactgaaaatcctggggatgatgattctccccaatggaacaatcactattgactccaagctcaaggcggatatagaagttttgcttcacttcttcaccaaagacaagcaaaagtttcttgacaagatagaggccgactccgcaactgcactggcaaaagtgtccggttatcttaactacatcaacacgacagataaagtgtacctgaacaaactgcgtaagaaatatggagcgagtgtagtagatatgtttgtccggggttccgtgaaatcgctctga

SEQ ID NO: 11952 - RNA, 954 nt, unidentified
  source 1..954: mol_type = other RNA; note = synthetic construct
atggctaaccgcgatttcaagagtgcatttgaagccatgtaccacgggaagtatgactttgaggattttaaagtcggagatatcgccgacaagtatcggaaactgaacttaaataagaagaacgtctacgaggccgaccaggtgctcaagacataccacaaattccttaaccttttcgtgtttcagtggctatccttcaatgaggattgtgtcttttcctatcgaaaagggattaatgtagcagacgccgtgaaaaaacatagtcagagcaagcacttctaccaagcagacctgaacaattttttcgggagcataagatctgacatcgtgagatcctgcattggcgccagcatcgataaggtcccgatctctgacatttctctgtatgtcgatcgtattgttgaaatgtgtactgttgctgacaggctggcggtaggcttctcaacaagccccctcatctccaatgcttgcctatttaggttcgataatgagattgagcatcactgccacgccaacggcttgatatacacgaggtattctgacgatataatcatcagtggtgttgaaaacaaactgtacggcatgggcgatgtggtggaatcaatactttttcagcatttcaacggagtactgtccattaatctccctaagactaagtactctagcgctggaaataaagttaagatgcttgggatgatgatcttgccaaacggtacagtgaccattgattcaaaactgaaagcggacatcgaggtgctgctctactttttcatcaaggacaagcaaaagttcctggacaaaatcgacaccgactccgccactgcactcacaaagttgagcggctacttaaactacatcaataccaccgacaagatttatctggataagttgcggaaaaagtatggatcgtcagtgattgatatgtttgtgcgcggtagtgtgaaaagcctgtga

SEQ ID NO: 11953 - RNA, 921 nt, unidentified
  source 1..921: mol_type = other RNA; note = synthetic construct
atgtaccatggcaagcatgatttcgaggacttcaagtcgggagaaatcctgtccaagtatcgcgcacttgtgttcaagaagaagaaggtttacgaggccggtgccgacctgaaggtttaccacaaatttctaagcctattcgtctttcagtggttggagtttaatgagagatgtgtttactcctataggaagggcatgaacgttgtcgatgccgtgaagaaacacgcaaattctaaacacttcttccagaccgatctgaatgatttttttgggagcatacagggtgatttggtcaaactctgcatccggggaagccttgaccgaattcctatttcagatgcttcttcttacatcgacagggtagtagacctggtgaccgtggagaataaattaccagtagggttctcaacatcccctctcatcagcaacgcctgtctgctgccatttgacaacgcgctggaagcctactgcaatcattcagggctcgtgtatacccgttattccgatgacgtgatcatcagtggaggggactctaagttgtatggcatagaaaaagtcgtggagtatacactcgctcagtgctacggcggggactttactattaacagcgccaaaactaagttctcttccgctggtaacaaggtgaaaatcctgggcatgatgatactgcccaacggaacgattacaatcgacactaagttgaaatcagatattgaagtgatgctccactttttcatcaaagacaagcaaagattcatggacaaggtcgatgccgaaggaacagcagcggcccttgcaaaggtcagtggctaccttaattacattaataccaccgatcccgcttatctgaacaaactgcggaaaaagtacggtgctagtgtggtggatatgtttattcgcggcagtgtgaaaagcttatga

SEQ ID NO: 11954 - RNA, 957 nt, unidentified
  source 1..957: mol_type = other RNA; note = synthetic construct
atggcatcccgcgacttcaagtcagcttttgaggccatgtatcacgggaaacacgactttgaagacttcaaatctggagatgtcagtagtaaatatcggacctttgtcttcaacaaaaaggatgtatatgaggccggagctgaattgaaagtgtaccataaattccttagcctgttcatcttccaatggttagagtttaatgagaggtgcgtgtacagctaccggaaaggaatgaatgtagtcgacgcggtcaaaaagcatgcaggatctaagcatttctttcagaccgacctcaataatttcttcggctccatctcagggaagctggtgagggaatgcatactgaggtcgcttgaccgagtacccatttctgatgcaggcctgtacatcgatcggattgtggagttggttacagtggaagacaagttgccaatgggcttctcaacaagcccctctatctccaacgcttgtctccttcctttcgataatgccgttgagaaatattgtgaggagcagggtctggtgtatactagatattctgacgacgtgataattagcggcggagataacaaactgtatggcacagaaaagatcatcgagagcattctcgaggaactatttcagcgtgaaatcacactaaatgcctccaagaccaaattctccagcgtgggtaacaagctgaaggtgctgggcatgatgatcctgccgaatggctccattaccatagataccaagctcaaaagcgacattgaagtgatgctgtacttttttatcaaggacaagcacagatttatcgacaaggttgatgcggagggtactgcagccgccttagccaaagttagtgggtacctcaactacataaacacgactgatcaggtgtacctgaacaagttgcgcaagaagtacggggcttcggtcgtcgatatgtttattagagggagtgtgaagtcactttga

SEQ ID NO: 11955 - RNA, 912 nt, unidentified
  source 1..912: mol_type = other RNA; note = synthetic construct
atgtaccacggaaaatttgactttaagcacttcatttcctggccggctgccgagctgttcaaacctattcagatcaaagacagagtagtgtacgacgctgataagaacttgaaggcataccacaagttcctgaaccttttcgttttcgagttcctcgaaataaacactgatgtcgtgttctcttaccgcaaaggagttaatgttatcgacgcagtgaagaaacatgccacaagtcggcatttttttcagaccgaccttaagaacttcttcggaagtatatcgagcggcatgatcaggcgatgcttggaggagaacattgccaatttccccgtcagcgatattggcgaacacctggatcggattctggatctcgtgtcagtagagaacattctaccacctggcttttctacttcacccctcatctctaatgcctgcctttaccatttcgacaataagctggagctcctgtgtgattcaagaggtctgatttacacaaggtattccgacgatatcttgatcagcgggtccgaaaagaaactctatgggttagacgtggagatctccgcgatgctagaaacctcatttggggggcgcttccaaatcaacagggggaagagtagatataattctgtcggcggaaaagtcaagatgcttggtgttgtgatcctcccaaatggtgaaattacaatagacaccaagctgaagagtaaaatcgaggtgctgctccacttttttaccagcgaccgagccaagtttaatagcatgttagaggcagaagacgtgaacggcttattgaaagtgagcggatatctgaactacatcaatacaactgatcccctgtatctgaacaagctgcgttctaaatatggcgctacggtcatagatatgtttatgcggggctccgtgaaatga

SEQ ID NO: 11956 - RNA, 948 nt, unidentified
  source 1..948: mol_type = other RNA; note = synthetic construct
atggccaaacaaaaacttgaatcagtattcgaagcaatgtatcatggcaaattcgattttaaggacttcatcagcggcccgacatccgagctctacaaaacaattaagttcaagaaccgtactgtgtataatgctgacaagaaactgaaagcctatcacaaattcctgaatttgtttctcttcgaattcctcgagctgaacacgcgcgtggtctacagttaccgaaagggtgtgaatgtcatcgatgctgttaagaagcatgccactagcagacacttttttcagacggacttaaagaacttcttcggttccatcgatctggacatgattagagccgctatacaggaaaatactgaaaacttcccagtgtctgatgtgaatgagaacatcgaacggatcttagagctggtgtcagtgtcaggggttctcccccctggatttgcaacctcccctctgattagtaacgcctgcctttaccattttgacaatctagtggagaacttttgtctgaactcgggactgatatacacccgctatagcgacgatattataatctccggctctacaaacaagctgtacgggcttgacacccacatcgagagcatgctgaagaaaacattcggagagaaagtgttgattaatgggagtaagtctaagtatatgagcattggcgggaaaatcaagatcctgggagttgtcatcttgcccggcggcgggatcaccattgatactaagctgaaatcaaagatagaggtgctcttacactactttacttccgataggcagaagtttaacgtcatgctggatgacaaagacgttaacggactccttaaggtatctggctacctcaattatattaataccaccgacccagcgtacttgaataaactacggaccaagtatggtgcaacagtggtcgatatgtttatgagggggagcgtaaaatga

SEQ ID NO: 11957 - RNA, 948 nt, unidentified
  source 1..948: mol_type = other RNA; note = synthetic construct
atggcaaagcagaccctggaatcattgtttgaggcgatgtaccatggtaagtatgactttaatgacttcatcgaagcccctctctccatgttgtgcaagaaaatcccgcttaagaacaggatcttttataaagcagacgaaaagctgcgggcctaccacaagtttattaatctcttcatcagcgatttcctaaagataaacacgaacgtggtgtactcctacaggaaaggaatcaatgtggtcgacgctgtgcgccagcatgctcactcccgccacttttgccaggtggatctgaagaacttcttcggctcaatagacgctgccttgattgagagttgtattcttcagaacattgtcaatctgcccgcctccgatatcgctactcacataggcaggatcgttagtctcgtgagtttggacgggactttaccccctggatttagcacatctcctccactgagtaatgcatgtctgtttgagttcgataaccaagtggagaactactgccacaaaaaaaatctgatctacacacggtactctgacgatatcattatttctggttctagcgagagactgtatggtctggacagcattatcgaggaatttatcaaggagtacttcaatgagaaactcgaaattaacccagccaagaccaaatatactaccgtcgggggcaaaattaagcttctcggcctggtaatactgcccaacggcgaaataaccatcgatacaaagctgaaaagcaaagtcgaggttatgctccattattatttaaccgacagaccccaattcaacaagatcctggaaaaggattcaactaaggggatcagcacgctctcagggtacctgaattatattaataccacagacccatcctacttagataagcttcgtctaaaatatggagccacaatcgttgatatgttcattcgaggatcggtaaaatga

SEQ ID NO: 11958 - RNA, 972 nt, unidentified
  source 1..972: mol_type = other RNA; note = synthetic construct
atggctaaaaaggagctcagttctatctttgacgcaatgtaccacggaaaacacgactttcaggacttccttgctggcgacatcaccactaggtataaagtcacaacacttaaggggatggaactgtataagaccgacgaaaaactcaaggcctaccataagttcctgaatctgtttgttttcgagttcctgaaggtgaacgaaaacgtggtttacagctacaggaaaggcgtgaacgtagcttctgccgtgcagaagcatgccgggtcaagacattttttccagactgacttgaagtcctttttcaatagcattgattccgctctggtgcgcgagacagttaagaacaatttcgactccattccagtgtcagacatcgacagatatctcgatcgaatcatcgagatgagcacggtgaatgatatgctgccgattggctttagtaccagccctattatctccaatgcatgcctgcaaaagtttgactctattctggaggattactgcatagcccagaacctgatctatacacgttacagtgatgatatcattctcagctcctccggggataccaggttatatggaatcgataccacggtgggggaaatgctgaaagagtgtttcggtgagaaactcaacctcaacttcagcaagactaaattctcctcagtaggcaacaagataaagatattgggtatggtcattctacccaacggcgcggtgacaatcgactcgaagcttaagaatactattgaagtactgctgcacttttacgcatctgataagacgaaatttaacgaccggttggaatctgagagctcgaaactaaaaggagataattctgtgggacttttacaaatctcaggctacttgaattacgtcaataccacagatccccactatttaaacaaactgcggaagaagtatgggactagtgtcgtcgacgccttcatacgcggtaccgttaaatga

SEQ ID NO: 11959 - RNA, 972 nt, unidentified
  source 1..972: mol_type = other RNA; note = synthetic construct
atggttaagaaagaactggggtcaatctttgaggctatgtatcacggaaagcacaatttccaggacttcctcaccggaaacatcgaacctcactacaagattactaccctcaaaggaatgaaaatctatagaccggatgagaagttgaaggcttatcacaagttccttaacctctttgttttcgactttctgaagattaacaaggatgtggtgtactcttaccggaaaggggtcaatgtcgtcagcgccgttaagaaacacgcgaataataagcatttctttcaaacagacctcaagaacttcttcaattccatagacaaagaacttgtgaggaacactatccatagcaacttggaacatatccccatttctaacctggataaacaccttgatcggatcctggaactgagcacagttgaggataagctgcccattggtttcagcacgtcaccaataataagcaacgcatgcctgcagaaattcgacagtgtgttagaggattattgcgcatccgaagacttgatctacacaagatatagtgatgacattatcctatcaagcggcgggaacactcgcttgtatgggattgaagccaaggtgtcagagattctgcgtgagtgttttggaggaaaactcaaccttaatccctctaaaaccaagttctcgtccgtcgggaacaaaattaaaatcctcggcatggtgatactgcctaatggcaccgtaacgatagacagcaagctgaagaataccatcgaggtgctgctgcatttttacgcgagtgataaagagaagtttaaggaccgattagccagtgagtcttccaagttaaaaggcgagaactccatcggccttctgcagatttctggttacctaaactacgtaaatacaactgacccaaattacctgaataagctccgcaaaaagtatggctccgtggtggtggatgcctttatcaggggtaccgtcaaatga

SEQ ID NO: 11960 - RNA, 969 nt, unidentified
  source 1..969: mol_type = other RNA; note = synthetic construct
atggccaagaaatctctttccttgttattcgacgccatgtaccacggcaaacatgattttctggatttcatagagggagatgtagcagacaagtataaggtggccattgtaaagggtatggaagtgtgtaaacccgatgacaagcttaaggtttaccacaaatttctgatcctgtttgtctttgaattcctgcgagtgaatcaggacgtggttttttcttatagaaagggtgtcaacgttgccagcgcagtccagaaacatgccggcagccgccatttctttcaaacagatctcaggagttttttccgttcaatcagcaggagcttggtgaaacaaactcttctgaataacctcgatagcatcccagtggctgatctgcaggagaatctggagagaattcttgatctcgtgaccgtcaatgggggcgtgcctataggcttctccacatctccaatcatctcaaatgcttgcttgtacgactttgacaatcagctggagctctattgtaaggctcacgacctggtgtacacgcggtactctgatgatataatcattagtggtgtggagaacaagctgtacggggtggacggtgtagtcggggaagtgctggggaaatgcttcggggagatgctctccgtgaatgtgagtaaaaccaagttctcgagcgttggcaacaagatcaaaatcctcggaatggttattttacccaacggagtgataaccattgactccaaactgaagaacacaattgaggtcctgcttcacttctattcaagcgacaaggtgaaattcaatgaccggttggaaactgaatcagccaaactaaagggagacaactctttggggctcctgcagatctccggctatctgaactacgtcaacaccactgaccctgcttatctaaacaaattacgcaagaagtacggcgcagcggttgtcgattcctttattaggggaagtgtaaagtga

SEQ ID NO: 11961 - RNA, 951 nt, unidentified
  source 1..951: mol_type = other RNA; note = synthetic construct
atgaacaagcagccactgagagatctgtttgatgctatgtaccatggcaaacaccagtttgcagattttatgagctgcgacgtcaccgcacgggcaacagctttccaactgaatgagcggactatgtattcacctgacaagaggctgagggcgtaccactcattccttacgctgttcctgttcgattacttcccggtcgagagcgaagtggctttcggatatagaaaggggagctcagcctatgacgccgttagtccccacgcccgctctcgacatttttttcaggctgatatcacatctttcttcggaagcctagactcgggtgtggtggctaacgtgatagatgaacataaggaacgcagtcctatagaggacgttgagaaatatacggcacgagtgcggtctttagtgcttctcaacgggtccttgcccatgggattctccacctcccccgtccttagtaacgcctgtttgtataaatttgacagagcactgagggagcgttgccagacagcggggctgcatttcaccaggtacgctgacgatctcatcatctcctcaggagacttagagctgactcggagcgccaaggcgattgtggaggaggtcctgctgcatgaatttgacggcaagttgcagttgaatgccgaaaagactaaacttacctctatcgggaggaaggttaagatcctgggcatggtcattctcccaaacggccgaatcaccgtggaccagagaaccaaagatcgcattgaggttctgattcacttctacagagtcgatcaagagcggtttctggccctcgtaaaaaatgatcgtgccggcgggttagaacaccttgccggcctcgtgtcctacgtgaatacagtggaccaggaatacctgggtaaactacgccgcaaatttggtgtaacaatcgtagacagcctcttgcacaagactattctctga

SEQ ID NO: 11962 - RNA, 957 nt, unidentified
  source 1..957: mol_type = other RNA; note = synthetic construct
atgaatcggcgccctctcgaacagctgttttttgctaccttccgaggcaaacaagagctaaacgaactactggagctggacgtgcgggctgcctattccgaaaaggactttgatggtcgtgtggtctacagcccagacaagaagctgaagctatatctggggttcttgtctcgcgtgctgtttgacaggcttcccgttgaggctgacgtggttttctcctaccgaaagggcgtgaatgtggtgaacgcggtagagaaacatagcgagggcaagtacttttttcagagtgatatcaagaacttcttcggctcaattgacagagagatgataaggaggtcggtcctggccgcactcgaattatgtcctattagcgatatagaacactggcttgacagggtgctggaccttgtgactgtggatggagtccttccacccgggtttcctacatccccggtgatctcaaatgcatgtttgtacgagttcgacaagaaatttctgtcctggtgcaaacagaatagcctgacctatacacgctacgctgatgatctgatcgtaagcggtggagttgaagagaaaatgcacctcctgatcccctgcattactcaattgctcgacaccgaatttggaggcagaattaaactcaacacacagaaaacgaagtttattcgtccaggtgagaaggttagaatgcttggcgtagcaattctgcccaacgggaaagtctctgttgatgggcggctgaagaaacattccgaaaccgccatgcattgcttattgaaggataagcagatcttcacatctttcttaaaagagaaagacttcgagaaggccctcaaaaagttctctgggcagctgaattatatcaacactgtcgatcctagtttcttggataagctcagacggaagtacggagccaccgccgtcgacaaaatcgtccacatatcagtgggaagttga

SEQ ID NO: 11963 - RNA, 957 nt, unidentified
  source 1..957: mol_type = other RNA; note = synthetic construct
atgaacaaacggcctctagagcagctgttttttgccatgttccgagataagcaaaggttcgccgacttcctggagattgacgttaatagcgcctatactaaaaaagactacgatggtcgtgtggtgtactctccggacaaacttttgaagcagtacctgggatttttatcccgcgtcctcttcgacaggctgcctgtcgaatccgatgtggtgttttcttatcgcaaaggtgtaaacgtcgtcaatgctgtggaaaagcacagtgcaaatcgatacttcctgcagagcgacatcgaaaatttcttcggcagtatctcaagatcgacaattcgcaaaagcatcttaagtgccttagatacctgcccaatatccgacattgagcagtggttggagcggatcctggatatggttacagtgaatgatgtgctgccacctgggtatcccacctccccaagcatctcaaatgcatgtctgtactcttttgataagagattccttgactggtgcaagaagaacaactttatctactctaggtatgctgatgacctgattatcagtggcggaggcgaggatgaaatgcaccttatcgcacctaaaatcattgaactcctgaactgtgagttcgagggccaaattaaactcaacacggggaagacaaaatttttgaggcccggtgaaaagatccggattctcggagtggccatactgcccaatggaaaggtttctgtagatgggagactcaaaaaacatagcgagactgctatgtattgcctcctaaacgacaaggataagttcatatcattccttaaggagtccgattttgacaaggcgctgaagaagttttcagggcagctgaactatataaataccgtggaccccagctttctcgacaagttgagacgtaaatacggcgccaccgctgtggaccgggtcattcatgtttccgtaggcagctga

SEQ ID NO: 11964 - RNA, 957 nt, unidentified
  source 1..957: mol_type = other RNA; note = synthetic construct
atgaacagacgtcccctggagcaactcttctttgccacctttcggggaaaacaagacttcgcagactttagcaatctcgtggtcaacgaggcctacagtaaaaaggagttcgatggccgcacagtgtattccccgggaaaggcactgaaactgtatcttggcttcctctctcgagtgttattcgacagactgccaatagaaaaggatgtggtgttttcttacaggaaaggggtgaatgtggtcgacgcggtagagaaacactccggcaacaagtatttctttcagtccgacattgctaacttcttcggttccattacgaacaagatgatcgcccggtcagtgctggcagctgtagaccagtgtcccatcagcgatatagaggcctggttggaccgggtcttagagctcgtcactgttgatggggttctgccacctggatacccaacttcacctgccatcagtaatgcctgcctttacaagtttgacagggtattcctcgcatggtgtcatgataacagcttgacctacactagatatgcagatgatcttatcgtgtcaggcgagtccgaagacctgatgcaccaggcttgcaagaaggtcatcgaatttctgtatgctgagtttgggggtgacctaaaactgaatcccaaaaagacccgcttcattaagcctggggacaaggttaggatcctgggagtttctattctccccaatgggaaggtcagtgtggatggtaaattgaagaaggatagtgaaacagcgatgcacttcctaattaaggacaaaaagatgttcacaagctttctgaaagaaccagatttagaacgagcccttaaaaaattttcgggccagttgaactacatcaataccgtggatccttcttttctggataagatgcgcaagaaatacggcgctgctgccgttgacaaaatgatacatgtgagcgtcgccagctga

SEQ ID NO: 11965 - RNA, 957 nt, unidentified
  source 1..957: mol_type = other RNA; note = synthetic construct
atgaacaaacgccctttagaccagttatttttcgccacatttcgcggctctctggatttctcagagtttgcttctctgaacgtctcccaggcatactcacgaatagagtttgaaggtcgtgctgtgttcagtccaggaaagaccctgaagaattatctgtctttcttgagcagggtgctttttgatagactgcctgtggaaaaggatgtggtttatagctacagaaaaggggtcaacgtcgtcaacgccgtcgaaaagcacgcgaataataagttctttttccagtccgacatcgagaacttcttcggcaatattactaaggagatcatcaagaagacaatcttgtccgccatagaccagtgccccattaccgatattgaaacatggatagaaaggattctcgatctggttacagtagagggggctctgccgccaggatatcccacttctcctgcgataagcaatgcctgtctcctctcatttgacaaacggttactggcctggtgcaatgaacattccctgacctataccagatacgcagatgatattatagtgtcgggcactaatgacatctggatgaatagcctgagttacaaagtaacggagctgcttaacgaagagtttaacaatttcatcaagctaaacccacaaaagaccaaaatcattcggcccggggagaaaattaaaattctcgggatcgctatcctccctaacggcaaagtgagtgtggacggaaaacttaaaaagcggacagagacagcaatgcacctcctgcttaaagacaaaaagatgttccaatccttcttcaaggaggctgatttggataaggcattgaaaaagtttagcggccagctgaactacatcaacactgtggacccctcctttctcgacaagctaaggaagaaatacggtacggccaccgttgacaagattatccatatcagcgtggcctcatga

SEQ ID NO: 11966 - RNA, 957 nt, unidentified
  source 1..957: mol_type = other RNA; note = synthetic construct
atgaaccgcaggcctttggagcagctgttctatgctacgttccggggaaagcaggagttcgctgacttctctaaagtgaatgtcaacaccgcctactcaaagaaagattttgatggacgaagcatttacatcccggataagactctaaagctttatctcgggtttctttcacgcgtcttatttgatcgtctgccagttgcgaaggaagttgtgttttcctatagaaagggcgttaacgtggtggacgccgtagagaagcacagtgagaacaaatacttcttccagagtgacatcgaaaattttttcgggtcgattaacagggagttaatttccaacacaattctggcagctgtagaactctgtccaatcgcagatatcgaagattggctggacagaattatggaattggtgactgttgacggtgtgctcccccccggttaccctacatctcctgcaattagcaatgcctgcctgtacgcctttgataagaaattcatagggtggtgcgatagcaactctcttacttacacccggtacgccgatgacataattgtaagcggcaaatcagaagagcaaatgcacctcctgatccccaagatcaccgagttactggatgcagaatttggaaaaggcatgaaactgaactccaataaaaccaagttcatcaggcctggcgagaaggtgcgaattcttggagtggctatactacccaatggcaaggtcagtgtggacgggcggctcaaaaaacattccgagacagcgatgcacctgctgttgaaggacaagaagatgtttgccagctttctgaaagaggaggacgtggaaaagtctctcaaaaaattcagcggtcagctgaattatatcaatacagtcgacccaagtttcttggacaagctgagaaagaaatatggcgccgcagctgttgacaagatcatccatatatccgtcgcctcatga

SEQ ID NO: 11967 - RNA, 957 nt, unidentified
  source 1..957: mol_type = other RNA; note = synthetic construct
atgatcaaacgtcctctggagcagctctttttcgccacttttcgggggaaacaggatttccaggatttcatcaagttagatctggccgctagttctataaagaaaaactttgaaggccggagcgtgtacgcccctgaaccaaagctgaagttgtacctgggctttctgagccgcgtccttttcgatagacttccactcgcagaacaagttgtatattcataccgaaaaggcgtgaatgtcgttaatgccgttgagaaacattcatctagcaagtacttctttcagaccgatatagaaagcttcttcggttctatcaaccgcgagatgattcgaaggtcaattttgtggtcattggacttttgccccatcagcgacattgacatttggatagataggatcctagatatcgttactgtggacgggctgctgccacccggatttcccacgtctccggccatcagtaattgctgtctcgtgaagttcgacgaggagtttttatcttggtgtgatagtcagggattcatctacaccagatatgcggacgacttgatagtgtcctcgaaggtggaccctggtgtcgacctcctcatctccaaaatcacagagattctgaacaagatgttcgatggcgactttaaacttaacctgaataagaccagggtcgtcagacctggctccaaggtgaaactactcggtgtagtcattttgcccaatggaaaggtgagcattgacgggaatctgaagaaaaacgccgaaaccgcaatgtatcacctccttaaaaacaaggagaagttcgttagtttcctgaaagagcaggaacttgaccgcgcactgcaaaagttttccggacagctgaactatatcaatacagtggacccagattttctggataagttacggaggaaatacggggctacagctgtagataagattattcacgtgtccgtggctgtgtga

SEQ ID NO: 11968 - RNA, 954 nt, unidentified
  source 1..954: mol_type = other RNA; note = synthetic construct
atgattaagcgccccctcgaacagctgttctttgctactttcaggggaaagcaggactttgcccacttttcttctttggatcttagtgagatgtatgaggcaaagaaattcgatggccggactgtttattcacccaacagaactctgaaatcctacctgacatttttaagtcgaatcctgttcgggcggctcccagtagcggaagatatcgtgtattcttaccggaagggcgtaaatgtggtgaatgccgtggagaaacacgctcataacaaatactttgtccagactgacataaagaacttcttccagtcaattaaccgtcaacagatcaaacagactattgaggatagcgagcatacatgtccaatatcagaccttaatgaaagcctggaaaggatactggacatcgtcaccattgatggcgtccttccccctggctatcctacgagccccgccatcagcaatgcgtgcttgtataaatttgaccaggaactagccagcgtttgcaaagaggaaaaaattatctactccaggtacgcagacgacttgattttttccgccaacgctatatcggtgacagagtccatcatcccaaaggccacaaagattttagatgaggtgttcatgggacacttgaagattaatgagtcaaagaccaaagtgaccctgcctggccaaaaaatcagaattctcggtgtcagtatactacctaatggtaaagtcaccatcgacgggaagctcaagaagaacatcgaaacctgtatctactatttcctccgcgataagtctgtgttcattaagctcatgaaagaagcagacaacgagaaaagcacaaaaaagatctccggacagctgaactatatcaatacggttgatccgagttttctggataagcttagaaagaagtacgggattgctaccatcgaccaactgctgcattactctgcagagtga

SEQ ID NO: 11969 - RNA, 975 nt, unidentified
  source 1..975: mol_type = other RNA; note = synthetic construct
atgatcaaaagacccctggatgttctgttttctgctatgtaccggggtaaactgagcttcgataacatgaaggccgcatccgccgaccagatgtttgaatcttttacagtctccgggcgcgaggttgtccgaccaaacccagagctgaaaagttatctgggtttccttggccgtgtgttatttaacaagctgcctgtggacgtggagagcgtgttttcctacaggaagggagtaaatctcttaaatgcagttgagaagcacgcagcctcaaaattcttcctgcaagtggacatcgcggactttttcggtagtatcgatagttctcttatagagcagacagtgttgagaagcatggatgcttgccccatttcagacgtggaagaacatctcgagatgattgtgaaattggtcacggtgaattctagcctgcctgccggatatcctacctcacccgccatctcaaatgcgtgtctctacgaatttgacaggaaattcaaggatatctgcgggaatcggaacctcatatacactcggtacagtgacgacctgattgtctctggcacaaccagcgaatccattaacggggtgtacggactgcttcagaacaagctggcagatgagtttgggggaaaactgcaagtcaaccagtccaagactaaattcaccagaccaggccagaaggtcaagctgctaggcattaatattctgccgcatggggccgtctctgtggataagaaattcaagaaagatgctgaggtgaagcttttctattacctcaaggaccgcagcattttcatcaagatgagtggcagcacaaacttggataaagctgtaaaaaacttgtcaggcaccatcaattatatcaacaccgttgattccgtattccttgacaagctcaggaaaaagtatggatcgactttagttgacatgtttctacaccgatccgccaagctcgtggacgaaaataagatatga

SEQ ID NO: 11970 - RNA, 957 nt, unidentified
  source 1..957: mol_type = other RNA; note = synthetic construct
atgaaaaaaagacccctggaggacctgtttttcgccatgtaccggggcaagcagtcctttgagcactttgcgaactgctccgttgagggtttatacgaaccggttatggttaacggacggttggtgtataaaactgataaggatctacgcgcataccatcgctttctgaataagttcctatttgaacgcttgcctgtggtagacgatgtcgtgttcagctatcgaaagggtgtaaacgctgtcgacgctgtagagaaacatgccggtagcaaattctactttcaaactgacctccgtgactttttcagttccctgactaaatcggatgtgcggaggaccctggagtgggctaaggacgtttgcgtgatttcagatcttgacgtctgggtggaaagaatcctgaaactggtgaccatcggggatagtctcccaatgggattctctaccagccctgcaatctctaatgcatgtttgtattctctggatgggatcctcaagacgcactgtcttagcaatggcgtcatttacacaagatatgccgatgaccttatttttagcagttcaaataagcaggccctggatccactgttcggagtggtctgcaggacactccagtccgagttctccggccggatgggcattaattcacagaagacaaagtatctcaggaagggagggaagatcaaactcctgggattgaacgtgcttcccaacggcagagttacagtagacatgcgacacaaaaaagagatagaggtgcgtcttttttactatgtgaaggacagggctagattcctcaagatcatgggcgaagtcgacgacgaaaaagccatcaagaagttctcagggttaattaactacgtgaataccgtcgatcccgcctacttagataaactgcgcaagaagtatgggctgaccatagtggacatgttcatacataaatctcctaagctgtga

SEQ ID NO: 11971 - RNA, 954 nt, unidentified
  source 1..954: mol_type = other RNA; note = synthetic construct
atgaacgctaagccgctcaaaatcctctttgaggccatgtatcacgggaagtatgattttcaggatttcttacaaggggatatttgttccgacttcgacatgtttaccgtaggagaacggaccatttaccgtcccaataagaagcttaaaacgtaccacagtttcatcaacctgttcgtcctcgaaaagtttccagtgaatgcagaagtcgttttctcatacaggaagggcgtgaatgtgtatgacgcggtgtctaagcatgctttctcaaaacatttctttcagaccgacatttctaagttctttccctctataggggtggatctggttagagacactttcctccaaaataagaattgcactcctgtctctgactttgacacctgcatagaaaggatcgtagagctagtgatggtggatggattcctgccagttgggtttagcacaagtcctcttatcagcaatgtctgcctgttcggcttcgacaatctggtgcagaagtattgtagtgagaacggtatcatttatacacgctattcggatgacttaattttttcaagcctggagaagagcaaattaatcggtatattcgagttcctacagcgaacaatgctggatctctttggcggcctcatcagcttgaacatttccaaaaccaaatttactcacgccggctccaaaattaagctgctgggaatggtgatactgcctaatggtaaggtgagcgtagataagaaatttaaggacaacatcgaggttcttttgcatttctacgtgaagaaccggacaaagtttttcaacttggtcgaatcagatctgaaaggaggaatggagaaaatctccggctacctttcctacgtgaacaccgtcgataaggactatctgaacaaattgagaaagaaatacgggatgactgttgtggacatgtttctgcactacacgcccaaaaaatga

SEQ ID NO: 11972 - RNA, 954 nt, unidentified
  source 1..954: mol_type = other RNA; note = synthetic construct
atgaacaaaagacccttgaaggagttgttagcagctatgcaccaggggaaatttgagttccctgagcttgacacaggcgatgtgagtgatctgtacgaaaagaagatttacaatgatcgcgagatatatatccctaacaaaaggctgaagaccttccattcgtttctcagcctgtttttactggagtatctgcacacaaataacgaggtcgttttctcctataggaagggcgtgaacgctgtggacgccgtctccaaacacacctcttcaaagtacttctttcagactgatataaccaacttcttcaattctatcgacgcagatttagtcactagtacgattctgaattctatcgaaacatgcccaatttccgacattcagtctcatattacgaacatcgtgaagattcttactatcaataactccgtacccgttggttttagcacaagtccattgctatcgaatgcctgtctgttcaattttgacaacgaacttcaaaagtactgcatagaaaacaaactgatcctatcacgttacagtgatgacataataatctccagcctggaaaaagctcccatcttggaggccgaaatctatgtagaacggctgctgtccaagcacaccaacaacaagctctctatcaataccaaaaaaagcaaacacacccaaacaggtaataagattaaactcctggggatggtgatcctgccaaatgggaaggttagcgtcgacattaaatttaagaaggacaccgaggtgaagctccatttctacctgactaataaggagaaattcaacgagatttcaggaccggaccttgattcagccatcgaaaaaatgagcggacagctcaactactacaatactattgatcctagctatcttgataagttgcgaaaaaagtatggcgcgacaatcgtggacatgtttctccataagtctgacaaactctga

SEQ ID NO: 11973 - RNA, 954 nt, unidentified
  source 1..954: mol_type = other RNA; note = synthetic construct
atgaagaagaggtcactgaaagacctactggatgcaatgtaccagggcaagtttgagttccctgaactcgacactggcgacatttcaacactgtacgaaaccaaaaactataacgatcgagagctgcacattcctaacaaaaaactcaaaactttccacagctttcttaacttattcctcctggagtacttacagacaaataaggagattgtgttcagttaccgtaaaggtgtgaacgctgtagatgccgtgtcaaagcatgctcattccaaatacttctttcaaacggacatcacgaatttctttaactcaattgatgcggaccttgtcactagtactatcataaattccgccgatcgctgccccatctctgacattgataatcacatcaccaacatcgtaaagaccttgacagtgaatggcagcgtgccagttgggttttccacttctccaccgctgtccaacgcctgtctgtttaatttcgacaacaagctgcagaaatattgcctagacaattcgcttacattctccagatacagtgacgatatcatcattagctctctggataagacccctctcttggaggctgaaaagtacgttgcacagtgtctctctaagcatacagataacaagctgagtattaacaccacaaaaagcaaacacacccagacagggaacaagattaaattactggggatggtgatactgcccaatggaaaggtcagcatcgatatcaaatttaagaaggacactgaagtcaagttgcattattatctcaccaataaggagaagttcactgccataaccggacccgactttgataatgccatagaaaaaatcagcggacaactgaactattttaatacggtggaccaggactatctggacaagttgcggaaaaagtacggtgcaaccatcgttgatatgttccttcacaagtctgacaaactctga

SEQ ID NO: 11974 - RNA, 954 nt, unidentified
  source 1..954: mol_type = other RNA; note = synthetic construct
atgaaaaagaggcccctgaaggaacttctgtccgccatgtaccaagggaaattcgatttcccagagcttgataccggggacatcagtgcactatacgagacaaagaattataatggacgcaagattcacattcccaacaaaaagcttaagattttccatagcttcctgaacctttttttgttagagtacctgcagacgaataacgatattgtgttttcatatcggaagggtgtgaacgccgtggatgctgtttccaaacatgcacattccaaatacttcttccagactgacatcaacaacttcttcaattctatcgacatcgagatggtaacctctactatctttaacaatatcggcttattccctataagtgatatcgagagatatatcccgaatattgtcaagattctgacagtgaacgattcggttcccgtcggcttttccactagtcctctcatttcaaatgcgtgcctgttgagctttgataacaagctccagaagtattgtttggccaactctctgatatacagtaggtattctgacgacattatcatatcctctagcgaaaaggcttcgctgctcgaagctgaacagcgagtcaccacatacctggccgaaaataccaacaacaaattaagcatcaacctgacaaagagcaagcacacacaaactggaaataaaatcaagctgttgggtatggttattctccctaatggcaaggtgagcgtcgatatccgttttaaaaaagaggctgaagtgaagtttcactactacctaaccaacaaggataaatttactgaggtgacgggcagcgacttcgactcagccatagagaagttctccgggcagctcaattacattaataccgtagacccatcatatctggacaaactgagaaagaaatatggagcaaccatcgtggacatgtttctccacaaatctgacaaactctga

SEQ ID NO: 11975 - RNA, 954 nt, unidentified
  source 1..954: mol_type = other RNA; note = synthetic construct
atgaacaaaagacccctgattgatttgctgactgccatgcaccaagggaagtttaatttcccggaactgggcacaggaaacattaacgacttatacgaaaccaagatttacaacaatcgcgagatccacatcccaaataagaagctcaaaacattccatagcttcctcaagcttttcctcctggagcatctgtctacaaacgaagaagtggtgtttagctataggaaaggcgtcaatgcggtggacgccgtctcaaaacacagtaatagcaagtactttttccagacggacatcaacgactttttcaattctatagatgaggagctagttaaaaccactattatcagagacattgagaaatgccctattagcgatataaatctgcacattgacaacatcatcaaaaccctaacgattaaaaactccgtgcctgttggtttttctactagtcccttactgtccaactcgtgtctcttcatatttgacaacagcttgaaggagtattgcgacaaaaattcccttaccctctcacggtactctgatgatattatcgtgtcaggaaagaagaaggaacccatcttggaagctgagaggtatatagctcagctcttgagtgacactaccaagaataaactgagtctgaacatcaaaaagtccaagcatacccagacagggaacaaaattaaactccttggcatggtgatactgccaaatgggaaagtgaccatcgatattaagttcaagaaggatacagaggttaagctgcattactacctgacgaataaggagaagtttatcgagatcgtagattctgacatcgaaacagccatcgaaaagttaagcggacacctgaattattacaacactgtagatccttcctatcttgacaagctgcgaaagaaatatggtgcaaccactgtcgacatgttccttcacaaatcagatcgtttgtga

SEQ ID NO: 11976 - RNA, 954 nt, unidentified
  source 1..954: mol_type = other RNA; note = synthetic construct
atgaacaagaggcctctgaaggaattgctggttgctatgcatcaaggtaaatttgagtttcccgaactcgatacaggggacataacgtcgctgtatgagacaaagaaatacaatgaccgtgaagtgcacgtcccaaataaaaaactacggacctttcatagcttcatcaagctcattttactggatcacctagacactaacgaggacgtggtgttttcttaccgaaaaggagtgaatgccgttgatgctgtgtctaagcactccagatcaaaatacttcttccagacggatataaagaacttcttcaacagcatcgatgaggacatggtcaaagagacaatccttaagaacatagaacagtgccccattagtgacatccaggaccacatcgagaagatcgtgaaaaccctgaccgtaaataattcagtccccgtcggattttcaacaagtcctaccctgtctaatgcctgtttattcaccttcgacaatacactccaggaatattgcaaaagcaatagcttggtattctcccgctattcagacgatatcatcatctccagcatggagaagaactccatttttgaggccgaaaaatacattagccagaaactctccgaaatcactaagaataagctgtctattaacgacgcaaagagcaaacatacccagacaggcaacaaaattaagctgctgggaatggttattcttccaaatggcaaggtgagtatagacatcaaatttaagcaagacactgagataaagctgcactactacttgaccaacaaggaaactttcaaaaagatcgtggggtctgatttcgatggtgcgattgagaaaatttcgggccatctcaactactataacaccgtcgatccgtcctatcttgataagctgcggaaaaagtatgggactaccactgtggatatgtttttgcacaagagtgacaagctttga

SEQ ID NO: 11977 - RNA, 954 nt, unidentified
  source 1..954: mol_type = other RNA; note = synthetic construct
atgaataaacggcctctgaaggacctgctgaacgctatgtaccagggaaagttcgaattcccagagttagagacaggggaaatcagctcactctacgaaacaaaaaagatcaatgaccgagaaattcacatccccaataagcgcctgaaaacttttcattcctttctccggttcttcctgctggaacacctcaagacaaataatgatgtcgtattcagttaccgtaaaggcgtcaatacagtagacgcagtttcaaaacatgcgcactcaaagtattttttccagactgatatcaggaacttcttcaacagcattgatactgaactggtgatctctacaatcgagaacaatctaacgaacactccgattgaggatatccaactgtacatcgagaaaatcaccaagaccctgaccgtgaacaacttcgtgcctgtgggattttctacttcaccccctctttccaacgcctgtttatttgacttcgacaataagcttcagaagtactgcctggagcagaaactgatctatagcaggtacagcgacgatattataatcagttccagagagaaacaagccatactcgacattgacgaatacataagtcaaaccttgcagaccaccaccaagggtaagctcaccatcaatacgtccaaaaacaagcacactcagactgggaataagattaagttgctgggaatggtgattctaccaaacggcaaggtgagcattgatagaaaatttaagaaggacacagaggttaaactccactattacctgtccgacaaaaagaagttttatgagttgaccggcccagatacgaacaatgccattaccaaaatctctggtcagcttaactattataacaccattgatccctcgtacttagataagttgcgcaaaaaatatggggctacaatagtcgacatgtttcttcataaatctgataagctctga

SEQ ID NO: 11978 - RNA, 957 nt, unidentified
  source 1..957: mol_type = other RNA; note = synthetic construct
atgaaaacgaagccttgcgctctgctgttcgaagctatgtatcacggtaagtatgactttcaggatttcatccaatccgacatttctaactactttgacgtgatctacgtcaaggaccggaagatccagaaaccaaacaggaaactgaaggcataccattcgttcctcaatctgttccttttcgagtacttgcgcaccaatgagcgcgtggtcttctcctacaggaaaggcgtcaatgcctacgatgccgtctcagctcacgctaacaacaaacatttctatcagaccgacatctcagattttttcagcagtatcgattcacagctcattaaagaaacaatcatcgcatctgccgaactgtctccaatagaggatttgaatgaacatcttgagcgggttctcagcctggtgacagttgatggccgtctacccatgggattttctactagcccccttatatccaacgcctgtctgtacaagttcgacgcagcgctcgaggagtatagtataagcagacacctcacttatacacgctacgccgacgatctgattataagtagcaaaaaccgagaagatctggaagggatccaagagaaaattagcgagttgctgcttaaaacctttaacgggagactgtccttgaatcacagtaagtccaaactgacgcacactggtcgaaaggtgaagattttgggaatggtgattcttccgaccgggaaggtgtctgtagacattaagtttaagaataaggtcgaagtgctgttacatttctacatgaaggacagagagaagtttttagacaaggttgatggcgatatgagggggggaatggagaaaatctccggctatctcaactatattaataccgtggacaagtcatacctggataaactacggaaaaagtttggaggcactatcgtagacatgtttctccacttacctacaaaaaagccctga

SEQ ID NO: 11979 - RNA, 954 nt, unidentified
  source 1..954: mol_type = other RNA; note = synthetic construct
atgataaagaaaccactgaagactctttttgacgccatgtaccacggcaaatacgaattcgtggatttcgctcagtgtgacgtctctctgtgctacgaaagggtgaagtttaaaaaacgagaggtcatcagaccgaacaagcgtttgaaggtctaccattcattcctgatactgttcctactggagtacctcaaagtcgacgatgaggtggtgtatagctaccggaagggagtgaacacctatgacgcagtttctaagcacgcagcgagtagctatttctttcagaccgatctctccaacttctttaagagcatcgacgtagagatggtgcgcgctgttattaatgaaggtatctcaagagctcccattctggacggggaggactatatcgatcggatcattgagttagttactgttgatggctctctcccagtaggtttcccctccagtcctgtgattagcaattcctgcttgtatgccttcgatgagaaacttaaatcttattgcagacagaggggattgatctacactcggtattcagatgacataattgtatcgggtaaagacaaggacgaactactcggcgtgaaggaaagcatcacggcctttctcaatgactgtttccaaggcaagcttagtattaatcacgggaagtccaagtttacacatacaggaaataagatcaagctgttgggaatggtaatcctgcctaaccagaaggttacggtcgacatcaagtttaagaaagatctggaggtgatgctgcacttctacataaacgacagggagaaatttcttgataaggtggggggcgggtatcgagaaggagtggaaaaaattaccggctacatgaactacgtgaacacagtcgataaagactatctgaataagctccgcaaaaaatacggggccaccgtggtcgataccttaattcatcaccccacaaaaaagtga

SEQ ID NO: 11980 - RNA, 954 nt, unidentified
  source 1..954: mol_type = other RNA; note = synthetic construct
atgaccaaaaagccactgaaagatcttttcgatgcaatgtatcatggcaaactggacttcaccgacttcgccgagtgtgatgtgtctctttgctatgagcgtaccagaataaaaaacagagaggtggtacgacccaataagaagttgaagacttatcacagctttctcaatctgttcctcttcgagtacctgaagatcgacgaggaagtggtttttagctatagaaagggggtcaacgcgtacgatgcagtggctaaacattccggttcgtcctgtttctttcagaccgacctcaccgatttttttaagtctattgatgccaggctggttaaggatgtgatcggagactcattacacttagctcctatcctggacgccgacaattacatcgataggattgtggaactggtcgtggtagacggcgctttgcccgtcggtttcccatcttcacccctcatatctaattcatgcctatatgggttcgacaagaagctcaagagttactgcgacaagcgcaatcttatatacacacgatacagtgacgatatcatcattagcggaggctcccgggatgccttgcttgggataaaagaatcagtcgcaggcctcctggatgaatgttttcaaggcaaactatccgtgaattgcgataagagtaagttcacacacagcgggaacaagattaagctgctcggtatggtgattttaccgaaccagaaagtgactgtcgacatcaaatttaagaaggaactggaggtcatgctgcacttttatatcaacgaccgggagaggttcgtggacaaagtcggaggagactttcgcgttggggttgagaaaattacgggctacatgaactacgtgaatactatcgacaaggattatctgaacaaattgcggaaaaaatacggaagcacagttgtagatacactgattcatcacccttccaagaaatga

SEQ ID NO: 11981 - RNA, 990 nt, unidentified
  source 1..990: mol_type = other RNA; note = synthetic construct
atgagtacaacccaaactcacagtcttcctcgacgccagccagtcgaagtcctgtttaatgcaatgtaccacggcaagtggagatttgctgacttcgcaggtgccagcgtggaggccaacatcagtagcaaaacctttacccaagctgggaaaacacggaaccttcttgtgccctcagaaaagcttaagagtttccatgacttcctcaggttgttcctgttagactttctccccttgaataacaatgtggttttctcgtaccggaaggggctgagcgcatatgacgctgtggcccagcacgctgcatctaagagcttcttcgtttgcgatatagcagacttcttcccttccattcgtaggccacgtgtgaagtccactctgctgactgccaaagatctttgtccaatccaggacttggatacatggttagataggattgtcgacctcgtgtgcgtcggcaattcactacccgtgggatttagtacctcccccgctatctccaatgccgtactgatggcgtttgacaacgccctccaaacttactgtacgtctaaagagctcgtcctcacccgatattctgatgacattattgtgtccgcccaggattccgccagcctgaaaggcatccaggagcaggtagctgcctccctgcaggacgccatgaaaggggagttttcgctccatcctggaaaatcacgcttcctgcactctggaagcaagataaagttactgggaatggtgctgctgccgaacggcgcagtatctgttgatgcgagcgtgaagagcgagatcgaggttctgattcacttctatctcagagacagagataagtttgctgacagggtcgaaggtgaccagcggaaggcggaagctagactgtcaggcctactgaattacgtgaacacgatcgataaggcctacttggataagctacggaaaaaatttggggtgacagtcgttgattattttttgcatcgctcattctcttga

SEQ ID NO: 11982 - RNA, 993 nt, unidentified
  source 1..993: mol_type = other RNA; note = synthetic construct
atgagtactcagcctactccccaattttccatcaaaaaacagcgaattgatgtcctctttgaggcaatgttccatggaaagtggagcttcggcgattttgtgagcgcctcagtgcagacaaataccatttcaaaatcattcacgcatggcggaagaacccgtaatctcctggtgccctcagaaaagctgaagtcttttcacgaatttctgaggctatttctactcgatttcttgccattcaacgaggatgttgtcttctcctataggaaaggaatgtccgcttacgacgccgtaatcaaacacgctgcttcaaaatccttcttcgtgtgcgacattgccaatttcttccctagcatcaaacgcgatagaattcggaccgcgttactgcgagctaaggagtgttgcccgattgaagacctcgagtccgtgattgaacgcatcctggaccttgtgtgtaccgacagcggactcccacaggggttttctacctctcctgtgatctctaatagtgtgctcctggattttgacaacgcatttcatgcatatgcccttggcgaaggtctggagtttacacggtacagcgacgacataataataagttccagaaacagcgaggctatccaaggcattgaggccatcgtaagtcactgcctgcacgatacgatgggaggggatttcagcctgcactacggcaagagtcggctgctgcatagcggggtcaagataaagctgttagggatggtactcttgcccaacggtaaagtttctgtggacgccaatgtgaaggacgaaatcgaggtcttaatccatttctacctgcacgaccgttccaagtttgcagataaggtcgatggggatactcgcaaggcggaggccagattgtccggtcttattaactacgtgaacacaatcgaccagtcgtatcttgacaaattgaggcggaagttcggcgttacagttgtggattatttcctgcacaggtctttttcgtga

SEQ ID NO: 11983 - RNA, 993 nt, unidentified
  source 1..993: mol_type = other RNA; note = synthetic construct
atgagtaccccgatatcccccttacctgccagtcccaagcagccaatcgaagccctttttaatgcaatgtaccacggcaagaagtccttttccgattttgcaaacctgtccatagacgaaaatttcaccaggaaatccattaaccgaagcggcaaaactagggagctgctgaagccaagcgacaaactcaaaggatgccatgagttcctcaggcttttcctgcttgatttcctgcctctgaatgacgaaattgtcttttcatacaggaagggctctaacgcgtacgacgcagtggctagacatgcaaagtcgaagtctttttttgtgtgcgacattgaacacttcttcccgagcctcaaaagaacacgtgtgaagagtacaatcgctactgcccgcgactcttgtcccatagaggacatagatacttggctggagcgcatcgtagacctggtgtgtgtggacgatgccctgccaatgggcttcagcaccagtcctaacatcagcaatgccgcactgctacccttcgacaacgccttgcagtcctattgcgagtcaagaaacctgatcctcacacggtatagcgacgatttgatcatctctggagagaactttgccagcctcgatggcattgaggcgcaagtcgctacccatttacaggaaacaatgaacggggaactgaatctccacccaaagaaatccaagttcctgcatggaggggttaagattaaacttttgggtatggtcctcttgcctaatggtaccatctcagttgatgctggggtgaaagaggaaattgagatcctaattcacttttacctgcgggacaaatctaagttcgccgatcgagtcgagggtggccttcagaaagccgaagctagattatcgggactgctcaattatgtaaatacggtggatcaagcttatttggataagctacgcaagaaattcgggacgactgttgtggatttttttctgcaccggtctttctcatga

SEQ ID NO: 11984 - RNA, 987 nt, unidentified
  source 1..987: mol_type = other RNA; note = synthetic construct
atgtctattgcggcctcaccaacaactgccaaaagacctatggccgacctctttcgagctgtatatcatgataagagggatttccgcgacttaattgaaatggatgtgctgctcaattgcaaacgtgaacagtataccaaggccgggcaagttcgagccatccttgtccccaatgacgtgcttgccgggtgtctggagtttgtgcggctgtttgtcgtggactatctgcctattaacgaggacgtcgtttactcttacaggcgtggtatgagcgcttttgacgctgttgcgaggcacagagatgggaaacacttcctggtgtgtgacatctcacattttttcccctcgttgaaccggggccgcgtaaggctaaccatcgatcagggaaatgacagaacccccatcgccgattttggccattggctcgaccgcttcgttgatctcgtctgccctgagtccagcctccctgtgggattttccaccagtccgggcatctccaatgcagcactgaagccctttgatgacgccatgtcaatagtgtgcgagtctaggggcttgactctgacaagatactccgatgatataatcgtcagcggccagagcaaggacgctctggacgggatagagcaaattgtggcgggaacactgcagcaggtcctgccaggggaattcacgctgaatcgggctaaaacaaagagaatgcacagaggtaccaaagtgaagcttctgggaatggttcttttaccagacggcggggtatcagtggacgcagctgtgaaggatgaaattgaggtgctcctccatttccacagtcggaaccggtctaggttcctagaacgcgtgggtaacgatttggccaagggagagcgccgtctgagcggcttaattaactacgtaaacactatcgacaaggcctatttggacaaacttcgacgcaaattcggtgcagcaagtgtcgattacttcctgcaccggtccttcagctga

SEQ ID NO: 11985 - RNA, 984 nt, unidentified
  source 1..984: mol_type = other RNA; note = synthetic construct
atgagtacccccttgaagacggtcgctaaacgccccctggaagacctcttcaacgctgtctaccatgacaaatataggtttcaagatctggcccaactggatgttctgttaaactgtaagagggagcagtataccaaggccggacatactagagctattctggctcctaatgaaatcttagcagcctgcttggatttcacacggttatttgtcgtggacttcctgcctatcaatgaagacgtggtatacagttataggaaaggtatgtctgcccttgacgcagtggtgtgccataaggattccaaatattttttcgtgtgtgacatcagccactttttcccctctattacttgggagcgcgtcggacttacacttgcccaggcgaaggatagaacccctatctcagatttcgacctgtggctcgatcgtttcgttcacctcgtatgtcccgagactggcttgccagttggcttttctaccagcccgggaatttcaaatagtgccctcaaaccatttgatgacgcaatgaaacggaactgcgatgaccgatccctgagaataacgagatactcagatgacatcattgtcagcgcaaaaacaaaggagcctctgcatgagatcgagaaactgatagagggcaccctacaggagacttttagtaatgacttcacactaaaccagagcaaaagcaagcacctccaccgaggcacaaaggtcaagctactgggcatggtgcttctgccagatgggtctgtttccgtggacgcctcgataaaggacgaaatcgaggtattgctgcacttccacgcgacaaataggtcacggtttgttgaatatgtggggcatagcctcaccaaaggggaacgccggctgtctggactcattaactacgtgaacaccattgacaaggcttaccttgataagttgcgtaggaagtttggtgtggccactgtggactacttcctgcaccgctccttctcctga

SEQ ID NO: 11986 - RNA, 990 nt, unidentified
  source 1..990: mol_type = other RNA; note = synthetic construct
atgggggcgaagaccgccttattgcctagcggaccaagatcactggaagaactgttcaccgccatgtatagaggcaagagaaaggtcagcgagttcgctagtctcaacgttgccgccagttgtactaggaagtctttcacacacaagggccgaacccgtggaattgtgattcccagtgataagctccgcgggtgccacgagtttatacggctgtttctgctggattttttaccagtcgagatcgatcttgtgtttagctaccgaaaaggagtaggcgcattcgacgctgtaaaacagcacgcttctagcagacacttcttcgttaccgatatcgcggacttcttccctagtataaaacgggacagagtgctgagcattatccaaactggccggggaatttccccaatttcagaccttgacgcatggatggaaaggattgtggagctggtttgtctcgacggagaactgcccgttggatttagcacatcacctgccatctctaatgcagcattgaggccgttcgaccaggccatgcggaaagaatgcggtgctttgggcttagtgtacacgaggtactccgatgatctagtgatctccgggggtgatgctggcgtggtggaaagggcgcaagccttctgtgaatgccatctgcgggaggctatgcacggcgagtttcagcttcgacccgagaaatccaagttcctgcatgtgggccgcaagatcaagttgcttggcatggtgctcctgcccaatgggcggatctcgattgacggtgccacaaaatccgagatcgaggtcttgctccacttttacctgcgcgacagggcaaagtttgccgcaatgggggagggagacgagagaaaggtcgaagcacgccttgctgggctcctgaactatgccaacactgtcgatcagtcatatctggacaaactccgtcataaatttggtgccgctcctatagatctattcatccatcgctcttttgggtga

SEQ ID NO: 11987 - RNA, 927 nt, unidentified
  source 1..927: mol_type = other RNA; note = synthetic construct
atgtaccattctaaaagaagtttcgatgacttcgcacgtggccccgttgcccagaagtatgtgaggcaccgcttttgcaagcagggtaagacacgagaggtcttgtcacccgacgacaagctgcgggcgtaccatgaattcctgagactgtttttactagactttctcccgcagaatgaggaagtcgtattcagctataggaaaggggtgtcagcctacgatgccgttagcaggcacgcacagagcaagtttttcttcgtgtgtgacattgccgatttttttccttcactgaagcgacacagaattaggcagactattctgtctggcaaggattcctcgccagtcgctgacttggatcagtggctcgaacgcatcttagacttggtcagtgtagatgattgtctcccaatggggttctctactagcccaacaatttccaacgcagccctcctgccctttgacaacgctgtgcagtggtattgcgccagtcgggggctgatctacaccagatacagcgatgacatggtggtttccgctaaagagttcgcaagcctggacggaatagaggaaacgcttggggccttcttcgtggagtacatggacggcgaccttgctttgcatcctggtaaatctaagctcttgcgtacaggctctaaaatccgcctgctgggcatggtgctgcttcctaacggaaccatctccgtggatgcatcaatcaagtccgagatagaagttctcattcacttctacatcaaagatcgcgctaaattcgctgacagggcagacggagacgcgcaaaaggtagaggcccggttagccggtctgctaaattatgctaataccgtcgatcaaagttatcttcaaaaactccggaaaaagtttggcgcggccgtggtggatctgtttctgcacagatcctttggatga

SEQ ID NO: 11988 - RNA, 969 nt, unidentified
  source 1..969: mol_type = other RNA; note = synthetic construct
atgcccatcgtgaaaaaaccattgaagaccctgttcgaagctatgtttcacgggaagcgctcctttgccgattttatgcgcgaagcaagcgaggatgacctgggcaggacacatattcggcagggggccaagagacgggaactagtgtcaccgagcgagcgtctgagagcttaccactcctttctcagattgtttctggtggacttccttccagtgcatgaaaagtccgtcttcagctacaggaaaggagtctcagcccgagctgccgtcgagcagcatgctcctagccggcattttttcgtgactgatatcgagtcattctttccttccctgaccaggggaatcgtacgtgagactatcactaacgcaatggcagaaatacccattgccgacctaagcgaccacttagaacacgtgctcgacctgctttgcgtcgacgacgccgtgcctatagggttctctacatctccaggcctgagcaacgccgctttgtaccccttcgatgccgctttccacgcacgctgtcaacagctgggggtgatttatacccgatacgcagatgacatcgtactctcctctggcgagaggagtgcagttcaggagggcgaagtcgctctgaacgagctcctcgatagaatgttccgtggtgaactgcgcttgcaccggggaaagagtaaatacctgcacgtcggcggtaaaattaagcttttaggaatggttctcctgcccaatcgaaccatcagtgttgacacctcggttaaggatgagattgagacaatgttacatctgtatctgcgggaccgggaacgcttcaataaaatgctggaggtggggagtgcgaaaacagaggcgaggcttgccggactcctcaattatgttaacacggtggatcaatcttatctagagaagcttagaaggaagtacggcgccgcggtggtagatatgtttttgcacagatcatttggttga

SEQ ID NO: 11989 - RNA, 942 nt, unidentified
  source 1..942: mol_type = other RNA; note = synthetic construct
atgcttttcgaggccatgttccatggcaaaagggacttcacagactttatgcgaaaagtctcggaagacgacttcggtcgagcccatcttaggcaagggactaaacagagggtgttgatcaacccgtcagaacggctccgtgcataccacaactttctgcggctgtttctggtggacttcttgccagtgcacgaggaagcagtcttctcctacagaaagggcgtgagcgccagagctgctgtggagcagcatgcgctaagtcgctacttctttgtaacagatatcgagagcttctttcccagcattacaagggacattgtcagaaagaccataaccagcgccatggccgagattcctatcgccgacctatctgatcatctcgagcacgttttagatctcctttgtgtggacgacgccctgcccatcggattttccacatctccttctttgtctaatgcagtgctctatccatttgacatcgtcttccacgcacgctgccaggaactcggagcgatctacacccgatatgctgatgatattattctgtcctcaggcgagcgggccactgttgagagtggagaaggcagtcttaacgatcacctcgatcgtatgttcgaaggcgggctacgcctgcacaggggaaaatccaaataccttcaccggggtgagaagattaagttgctgggaatggcactgttacccaatgggaccataagcgtggatacgtcaatcaaggacaagatagagactatgctccacctgtacctgcgcgatagagagaagtttaataccatgctggatgcgggtacggctaagactgaagctcggttagccgggctgctgaattatgttaacaccgtcgaccagctctatttggaaaaactgcgcagaaagtatggggccgctgtggtagatatgttcctgcataggtcctttggctga

SEQ ID NO: 11990 - RNA, 936 nt, unidentified
  source 1..936: mol_type = other RNA; note = synthetic construct
atgtttcacggtaaacagaagttcgccgattttatcggagccgacgtcacaagcctgtacaccaccactacaccaaggatcggtagtaaaaggcgtaccctgcacatgccgagcgataagctgagagcataccacgaatttctgaacctgtttgtgttcgagttcctgcccgtgaatactggggtcgcctttgcatatcgcaagggggtgagtgcggctgacgccgttagaatacacaagcatggccggcatttcctggtgagcgacctcgcggatttttttcctagcattgacgtgagcttggttagagcaacactggttggcggagccatggcatcccctgtcgaaggcttggagtccaatttagatcggattctgcagctggtgtgcatcgacgacgccctcccacttggcttctccacatcgcctgtgctcagtaacgctgtgttgttcgctttcgacaccgctctgcagaaggagtgtgagtcaaggtctttagtgtattcacggtactctgatgacttaatcatcagcggtagtgatcgcgatgaggtacacggcgctggacaaattgttgagggactccttcgcgaacatttcggcgaaaaactaaggttgaaccccttcaagtccaagtccctgcatgtaggatcaaaagttcgcctgctgggggtagtgcttctaccaaacggtaaagtcacggtggacgctaaacttcgtgcaaacattgaggtgttgctgcacttttatctcaaagatcgagcgaagtttgccgatttcgccaaaaaggtcactggcgaacccgacaaggcagaagcccggctctcagggtggataaattatatcaatgctgtcgatcaggagtaccttgacaagctcaggatgaaatacgggtctgccctagtcgacagatttgtgcatcgatctttcgggtga

SEQ ID NO: 11991 - RNA, 1047 nt, unidentified
  source 1..1047: mol_type = other RNA; note = synthetic construct
atgcaatatagcccagtactttacgagagacagcacattctaactatgacaaagcaacctctgcagaagctctttgatgcaatgtaccacgggaaatacagtttcgaagattttctccagtctcccgtggagaagaattatgaagtgattgctcccacagagccaggcggtagaagactcttcaaacctaaggagaatttgaagacataccatcggtttcttaacctgttccttttcgagtttctccctgtgaacgatagggttgtgttttcttatcgtaaaggattttccgcgcttcatgccgttcagaaacacgctaaaagcaaattcttctaccaaaccgatatccaggcctttttcgattccatcgaccgagcattaactgaaaaggccatcttatctgggcaggccaattgtccgatatcggatctggacatccatctagacagaattgtcgatttagtgtgtatcgacaatagcctgccagtgggattgcctgcgtccgctccactctcaaacgcagttcttctggacttcgacaacgaactggaacgttcctgcttggaacgcgagttgtgctatagccgctatgctgacgatataatcatcagcggtcatcggcaggtggacgtccaggagattggccagagtgtccaagagaagctgcatcagttctcatcaaagaatttctccatacacgagggcaaaacgaggtactttcacgtcggaggcaagatcaaaattctgggaatgaccatcctgcccaatgggaagataagcattgactcaaaaaagaagaaggacctggaagtactgctgtttttctatttgaatgacaaagaacgcttccggaaaatcgtcaaccaggccaagaaccggaccgagacaagtagggagctctctgatgatgactacgtggcctacctgagcggtaccattaaccacgtggactccatcgatcccgactatacggataagctgcgaaggaaatttgggactgccaccattgacgcactcaagcactctggctttagtaaggagaaatga

SEQ ID NO: 11992 - RNA, 1002 nt, unidentified
  source 1..1002: mol_type = other RNA; note = synthetic construct
atgactaaacagcctttgcagaaacttttcgatgctatgtatcacggcaagcattccttcgaggattttctacagtctcccgtggagaagaactacgaagtaatcggtaccagcgatttcggcggccgaaaactgttcaagccgaaggagaatctgaaattgtaccataggttcctgaatctgtttctgtttgagttattgcccattaatgagcgggtcgtgttctcgtatcgaaagggattctccgctgtgaatgccgttcagaggcacacacaatccaagtactttttccagactgacatccaaagctttttcgatagcatagaccaggccctgaccaaaagaactattctggccggggagccatactgccccatcgcagaccttacagcacatctcgacaggattgtagacctcgtctgtatagacgactccatacctgtcggactgccagcttctgccccactctcaaacgccgtgctcctcaattttgacaacgaaatggagcgcttgtgccaagaacgtgacctgtcttacagtaggtatgcagacgatattattatctcagggcaaaatcagggcgccgttcaggaagccggtaacgcggttcaagaaaaactgcaccagttttcttccgaaaaattctttattcaccagggaaaaacgcggttctttcaggtggggggtaagatcaagatcttaggcatgcttatcctccccaacggcagaattagtatcgacacaaagaagaagaacgaacttgaagtcctgctgttcttttatctgaacgaccgcgagaaattcaaaaacatcgtgaatcaggccaagcagcggacagatgcaaaaagagatctagtggaggatgattacattgcgtatctcagtggaaacataaattacgtggattcaatcgaccctgattacaccgacaaactgcgcagaaagtttggggctgcaaccatcgatgctttaaagtatagcgggtttagcaaggagaagtga

SEQ ID NO: 11993 - RNA, 1002 nt, unidentified
  source 1..1002: mol_type = other RNA; note = synthetic construct
atgactaagcagcccctgcagaagctgttcgacgccatgtaccacggcaaattttccttccacgacttcttgcattctccagtggagcagaattatgaaattgtcggcgggtccacatctggtagccgcaccttgtttaaacctaaggaaaacctgaagacgtaccatagatttctgaacctgttcctgtttgagctcctcccaatcaacgagcgtgtcgtctttagttataggaaagggtttagtgctgtgaatgccgtgcagaaacacacccagagcaagtatttcttccaaactgacatcaaagcgttttttggctcgattgatcggttgctcacccagaaaaccatcctggctggacacgaatattgtcccatcgaagatttacacgagcatatcgaccggatagtggacttggtatgcgtgggagattcaatacctgtgggactgccggcaagcgctccactcagtaacgccgtgctggttaatttcgacaatgagattgaacggatttgcaaacaacagggactcatctactcacgctatgcagatgacattattatatctggccaaaaacacgagtctcttctcgggcttaagatgctggtccaggaaaaacttcatcaattcagctccgagaagttctttatccaccacggtaaaacaagattctttcaggtaggcgggaaggttaagatattaggcatcatgatcctacccacgggcatcattagcgtggacacaaagaagaagaatgacctagaggttctgatccatttctacctgaacgatcgagggaggttcaaggatatggtgaataaaacaaagaagcgatccggtgctgatgaagaattatccgaggatgactacattgcctatctcagtggtaacattaactacgtcgattcaattgaccctgcatacaccgacaagcttaggagaaaattcggaagcactactatcgatatcctgaagtactcagggtttgccaaggagaaatga

SEQ ID NO: 11994 - RNA, 1008 nt, unidentified
  source 1..1008: mol_type = other RNA; note = synthetic construct
atgaacaaggagccgctgcagaagttgttcgacgctatgtaccacggaaaaatccgattcgaggacttcttgtatagcccaatggagcagaattacgaacagggactgccaaaccataatgggaggagacggattttaaaaccccgtgagaatctgaaaacattccacaagtttctgaatctgttcctgttcgaactgcttcccatcaacgaaagagttgtgtacagttatcgcaaagggtttagtgccgtcaacgccgtggaaaagcatcgcgacggaaagttcttttttcaaactgacataagtgcattcttcgaatcaatagatgtcagtctggcaaagcgggtgatcctgtccggggccgagtttactcctatttctgacgtggattcatatattgatcgtatcatagacctcgtgtttgtaaatgactctctccctgtaggctttcccgtgagcgcgcctctgtctaacgccgtgctcttcgacttcgataatgtgatggagagctattgtctaaacaaaggtttagtgtacacacggtatagcgacgacattgttatttccggcaacgagagagaatggtataacggcgtcgatgactttgtccaaaggtcactgcacgaatcagcatcggacagattctacattaaccggaaaaagacccgcttttttcaggtgggcaataggctttccatcctgggcgtcatgatacttccaaacgggaaagtatctcctgacacccgaaaaagaagggaaatcgaggtgcttttgcacttttacctcaccgataaggataaatttaagaagatgatcgctgagaagcgcgttaaatctggaaagatcagcaaaatcgacgacggtgtctccgatgatgagtgcttagatgtgttgtccggtaacctcaattacattgatagcattgatcccgattacacaaataagctccgaaggaagttcggggttgctacgatcgacatgctaaagcatcggggcttctccaaatga

SEQ ID NO: 11995 - RNA, 999 nt, unidentified
  source 1..999: mol_type = other RNA; note = synthetic construct
atgatggaaaagcaacctctgagggcactttttaatgcaatgtaccacgagaagtttaactttgatgattttctgacgtactcagtgtctgatagctacgaaatatcatctaaggagaagctgttcgaacgcaaattcaagaagccaaaggatatggttaagaactatcatcggttcttgaacctgttcgtcttcgactatttagagactaacccccgagtagtgtttagctacaaaaaaggtttgtccgccctgaacgctgtagagaggcacagcctgagcaaattcttttttcagactgacatctcgtcattcttcgaatccatcgacaaaaagctgattcgcgaaacaattgttgccggctgtagtgcatgtccagtgtccgacatcgacctgtacatcgaccgaattgtcgacatagtgtgcattgataatgccctccctgttggattgccgtgcagcgctcctatcagtaatgcggtgctgctactcttcgataacgagatcgaaaagatctgcgctcagcgcaatcttatatataccaggtactccgacgacattataatcagcgggatggagcggagtagtttagacggcattgataaacaggtccgtggatccctcgaagtcatctataacaacaagttctcgatcaatatcgccaagacaaaattctttaaggtgggcaacaagatttccatccttggggtgaatatcttgcccaatgggaaagtgactccagacaagagcaaaaaggaagagctcgagattctgttacacttttatctgaccgacagggacaaatttatttctagagcctcagagatgaagagaggtaacaagaataccctatctgaggaggattgtctgaacctcctcgggggcaatctgaattacgttgattctatcgataaggactataccgataaacttagaagaaaattcggagtcgtgacaattgataaactcatacatcggggctttcccgtgaaaaaatga

SEQ ID NO: 11996 - RNA, 972 nt, unidentified
  source 1..972: mol_type = other RNA; note = synthetic construct
atgaaaaaacacacactcgaaaggctgtttgacatgatcacccatggcaaatatgacttttccgactttctacactgcaatcttgatgacgaggtgaagatttttgagatcagcagcaagaagcttagcagccagtcgaggatcgtctattcagccagcgcaaagctcaaagattttcattccttcttgaatatggtggttttcgaacagctgtcctcgaacgaggatgttgtttattcctatagaaaaggtgtgaatgccctggacgccgtgattgatcacaggaatagcaagtacttcttccagacagacatcagaaaattcttcccgtctattgaccgagaattaatcgcaaagactatcaatcgcaataaagaacggatacccgtcagtgattttgacaattatttcgatcgagtccttgatatggtctgctatggaggatctctcacaactggcttctcaacgtcccctctaatttccaactctgtgctcatagaattcgacgactacttttacaagtattgtaagagtaaccacctcgtatacaccagatactctgacgaccttatcgtctcttccagtaaaccatttgagatcgatatagagtcaaccatcatcgagaagttagataagctctatcgtggcaattttgggattaacaagaacaaatctcgctacagtcatattgggcaaaaagtaaaactgttgggtatggtgattctgcccaacggagatattacaattgacaggaaacagaagaaagagattgaggtgctgctgcactactacaaagaagacaaaaagcgcttcgatgaactgatagacggcgattatttgaagggaatggctcggatcagcggcatcctgaactacattaagatgatcgacgaggagtacttgaacaagctgatgaagaagtacggggtgactctgatagataccctgatccggaaggctgcgtcaaagtga

SEQ ID NO: 11997 - RNA, 972 nt, unidentified
  source 1..972: mol_type = other RNA; note = synthetic construct
atgaaaaaacacaccctggaaaggctctttgatatcattatgcacgggaagtataatttctctgacttcctcttctgtaaacttgacgacgaggtgcaggtgtttgaaataggttcaaagaaattgtcctcacaatcccgtattgtctacagcagctccacaaagctgaaggattttcacaactttttgaacatggtcgtttttgagcagctgccaagcaataataatgtggtctacagctatagaaagggtgtcaatatcctggacgccgtgatcgatcaccgaaacagtaaatatttcttccagaccgatatcagaaaattcttcccttcgatcgataagaagttagtaagcgagactataaagaagaataaggaaaagatcccggtttctgatttcgataaatattctgatagggtgctcgacatggtgtgccacggcgaccatctgaccactgggtttgcgacatcacccttgatttccaattcggtgctgatcgagtttgacgactacttttataactactgcaagaacaaccatcttgtctacacacgctacagcgacgacttgatcataagttccaacaatcctttcaaggaggacattgaattactgattacaaaatctctcgacgaaatctaccagggcagtttcagcataaataaatcaaagagtcggtattcccatattggccagaaagtgaagcttctaggcatggtaatcctgcccaacggagatattaccatcgatcgcaaacagaagaaagagatagaggtgctgcttcattattacaaagaagacaagaaccggttcaacgaactcattaatgacgactatcaaaaaggaatggctagaatttctgggatcctgaactacatcaagatgattgatgaggagtacctaaacaaactcatgaagaagtacggagttactctgatcgatacgctgattaggaaagcagcctctaagtga

SEQ ID NO: 11998 - RNA, 948 nt, unidentified
  source 1..948: mol_type = other RNA; note = synthetic construct
atgaaaaagtcatccctggaacaattgttcactcttatcctgcacggtaagtacagcttttcggagtttctggaatgtgatctggagagcgaactaaccgagatgactgtaaggtcccggactctgtacagccctagtaataagctcaagagcttccactatttcattaacatggtgattggcgaacagctgaacatcaatggcaaagtcgtgttctcatatagaaaagggaagaacgcattagccgcggtccaggtgcacaggaaatccaagtacttttttcagacagacatcagagcttttttcagcagtatcaacaagcaattgattaaagaagcacttctcaggagccgtgacaatatacccgtcctagacctggatatctacctggaccggatcgtcgacatggtgagtgtggggaattccttggccactgggttttccacctctccactcatttctaacagcgtgctcgtggaattcgacgacgcccttgttaactactgcacgacaaataatctcatttacacacgctattctgatgatctgataatctcaagtcagaatacgatcgatcatagtattgagaacgtgatagagagcttcttatcacagtattactctgatacattctctctgaacgatcgcaaatcccgatattcacacatcggtcagcgcgttaaaatccttggcatggtaatcctgccgaatggcgacattaccattgacagaaaacagaagaaagagatagaggtcttgctccatttctacagagaggataaaaacaagtttcgggagctgcttaacgacgatatggataagggctttgcccggatctccggaatcttgaattatattaaggttgtggacgaaggatatctccataagctgatgcgaaagtacggagtgaccgttattgacaccctgatgaggaaggcttctttatga

SEQ ID NO: 11999 - RNA, 948 nt, unidentified
  source 1..948: mol_type = other RNA; note = synthetic construct
atgaagaaatttcccctcgagtctctgtttgacattatcttacatggcaagtacaagttttctgaattcgagaactgccagctaaacgaagaggtcacacgcatccaggtgcgaagcaggactgtatattccccgtcctccaagctgaagagttttcattacttcttgaacatggttctatgtgaacagttagcgctcaacgagttcgctgttttctcttatcgtaaggggatttccacgttggacgccctgaaattccacgtgagcaataagtacttttttcagaccgacatcacctcattctatagttcaatcaccaggagcattatcgatagagtgattgaggtaaataagcccaatctgcctatttccgatatcgacaagtttcacaaacggatccttgactttatttcttacgatggtatactccctacaggcttttcaacatcaccactgatctccaattcagtgcttatcgatttcgacaatttgttcgcacagtattgcatgaataagggtctggtctatacccgatacagcgacgatataattgtctctagcaaaaacgaattcgatatcgatgtcgagaaggtcattagcggattccttaaagagctctatggagatactttcaatctcaatagcagtaaaagtcggtattctcacattggccaaagaatcaaagtgctcggcatggtggtgctgccaaacggggacattaccattgataagaagcaaaagaaagagatcgaagtgctgctgcacttttacagggaggactactcccgcttcagagacataataggagacgatttggataaagggatggcccggatttcgggcatacttaactatatcaagaacatcgacgaaagttactaccataaactgatgagcaaatacggggtgaccactgttgacatcctgacaaagaaagctggaaactga

SEQ ID NO: 12000 - RNA, 984 nt, unidentified
  source 1..984: mol_type = other RNA; note = synthetic construct
atgactaatgccgtcacctcgggtcccaagatgcctctcgaatcattgtttagggccatgtatcacgacaagttcgatttccaggactttgtgaatggcgaaataagccgaaactatgagcgcactcagtatctcgaccgtgagaagacgcgcgagatccttaagcctaaccaaaagctgaaaaccttccacacttttctgaatctgttcctcttcgagcatttgccagtgaatagagatgtcgtgttcagctaccgcaagggggtatctacatatgacgctgtcatccctcacgctaagagtagacattttttccaggcagacattagttccttcttcaccaacattaacagggaaatggtaaataaaaccatctcctttggatacgactcagtccctatttccgatatcgacttctacaaggaacggattctcgatttagtctgcgttggcgatacactgccaacaggttttcccactagtccaactatcaccaatgcagtgcttagaccctttgatgaccagctacaggcgtactgcaacagcaactctgccatttacacccggtactcagacgatatcattatctccgcactcgatagggaattgccgtcagacataaaggattacgtgacccagactctaagcgtgattacggccggccgtctgcagcttaatgagagaaaatgtcgacatttccacattggagggaaggttaagatcctgggaatgctgatactgcccaacgggcaaatttctgtggatagcaaaatcaggagggagacggagacactgctctacttttatgtgcgggacaaagataaattcctgaacaagacaggcttggatttcgacaaaggaatgaaacgggtttctgggtttctgaattacataaacacaatcgaccaacgctatttagagaagcttagacgaaaatatggcgctaccgtgatcgacatgtttctgcaccggtcctttgactga

SEQ ID NO: 12001 - RNA, 951 nt, unidentified
  source 1..951: mol_type = other RNA; note = synthetic construct
atgaagaaacagagctttgagcatatgtataatgctatgtttcacggaaagtatagtttttccgactttcttaactgcgatatagattccgaatacacaactatcaatctgagggaccgtgttatctacagctcctcaaagaaactcaaggatttccacaagttcttgaatctgttcatcttcgattttcttcatatcagcattgactctgttttttcttaccggaagggttataatgtggtggatgccgtgcagatgcacaaaaatggcaaatatttcttccagtctgacattgtagatttcttccctagtatacatgagaatctcgtgaaaagtaccctgaaacattcattggaatctactcccattctagatctcgataaatacctggacctgataattaagctgaccatgattaacaacaacttacctataggctttagcaccagcccactcatctctaacgccgttctactggactttgatgaagagattttatcgtactgtcgaaagaagaacattcagtatagtagatactccgacgacattatctttagcgccgagaacatcgaggagattattgaagtaccaatcgtggtcgagaaatgcttgatctcacactataacaatacgttcaagatcaacaagagcaaatcaaaaatcaagcacattggggggaaagtgaagatcctgggcatggtcattatgcccaacggttccctgacaattgactccaaactcaagaatatcatagagacactccttcacctgtataggaccgacaagcaaaaacttaaagaaatctccgagaatgacctcgaaaatggaatcaagaagatcactaattacctgaactacatcaacgcggtcgatgcaaactatctgctgaagttgaaaaagaagtacggaccggctatcatagactacttcattcataaaaagcgcaattga

SEQ ID NO: 12002 - RNA, 951 nt, unidentified
  source 1..951: mol_type = other RNA; note = synthetic construct
atgaagaagccggatctggaatccgctttcaacagtatgtttcacgggaagtacaaattcagtgagtttatcaacctcaacaccattgatgagtacacaattattcagcacaataacaggatcgtgtactctacaactaagaagttaaaggactttcacaagtttctgaacctctttgtgtttgaatatctgcgcatcaatgaggaggtagtgttttcctatagaaaaggacataatgttgtggacgccgttaaaattcatgccaagggtaagtacttctaccaatctgatattatcgacttcttctcatgcattaatgaacagcatatcgatcatagcctgaagatatctctctcaagtattccagtaagcgatatcgaaaagtacgcaatgcaggtcaaaaatctcatcctaatcgacggcaaattacctatcggcttcagcacatcaccccctatttctaactcagtgctgttcgattttgacaagattatcaagcagcactgcacactgaacgatattaaatattcccgttatagtgacgacatcatattctccgcgaatagcttgaatctgttggacgacatcgagaaaataactgaagaaaccctgttgaaaaccagcggaaacgctttccacattaacaccaagaaatccaagataaagagcataggtgaacaagtgaaaatcctgggaatggttatcatgcccaacggcgaactcaccgtcgactcgaaaattaagaataagacggagatcttgctgcatcactaccggactgataaagagaaattcaaaaagatctccgagaatgagcttgagaagtctatccttaacctagggagccttcttaactatatcaatgcagtcgacaaaccatatctctacaaactgaagaaaaagtatggcgccacgactatagatttctttattcacaagacccgagggtga

SEQ ID NO: 12003 - RNA, 1002 nt, unidentified
  source 1..1002: mol_type = other RNA; note = synthetic construct
atgttcgatgagaatcagaaaagatccctgcgggagatattcatctctactttccatgaaaagatgtcctttcaagactttatacagctggacgtgggttccgagttccagaaatttaacttgaaacgtaggaccctatatgcaccctcatcaaagcttaaaaggatccaccgctttctgaacaacactatattcgaatttgccgattacaacaccgacgtggtattttcttatagaaagggtgtcaacatccgagacgccgttgaaaagcacgcaggaaacaattttttctttcagaccgatctttccaacttttactccaatattcatgagtccgacgtccgacgcgctttaagtaatcagctcactaatactccagtgcttgacattgagaagtacattgataagatcatcgagctggtagtttttgataatcacattccagccggattttcgacatctcctatcctgagcaacatttgtttgtttgagttcgataaccagctcaacaaatactgcaatgaacaccacttaacctacaccagatactcagatgacctcataatttcaagcaagactgaccatttcagcgaggatatagagtctgttgtgagcaatctgctcagcgagtatatcaatgctgggatcaccatcaataagttgaagacaaagctgcacaagaaaggccataactttaagatgttgggattcaatgtgctgcctaacggggtggtgacaattcccagcgtcgacaagaaggaaatcgaaacactactctatttctaccttaccgacagcaacaagttcgaaaattatttccaatctacgttctgcaacaccgaggctgaactgggcgaaaaatctctgcgcgagctcgccatcggcacattaagtggcaagctgattgcgttcaacagtatggacaaacagtacgtctcgaaactgaggcggaaatatgggaatacgatgattgatatgttcatccggaaaagtgtgaaatga

SEQ ID NO: 12004 - RNA, 936 nt, unidentified
  source 1..936: mol_type = other RNA; note = synthetic construct
atgtttaaagacttcatgcagatcgatgttaacggtgagttccagaagatcaatcttaagaagcgcacagtatacgccccaacacccaagttaaagctgctgcacaggtttatcaataacaccgtattggaattcgccgattataacgctgacgtggtgtttagctatcgcaagggagtgagcataaggaatgctgtcgaaaaacattcccacaacaatttcttctttcagactgatctttccaatttttacggaaatatccaccaatctgaggtccagaccgcattaatgaaccaattgaaaaatacccccgtgctcgatgtggagaaatacatccagcggatcgtcgaacttgtgattgttgacgaccatataccagcagggttcagcacttcgcctctgctctcaaatatttgtctctttagcttcgacaacgagctgctgaaatattgccaggcccacgatttaacttacacacgatactctgacgatttgattatatcaggtcagactaacgagtttgcaggagacatagagcctgtgatcaacaatctcctggcggaatacgtcaataccggcatctccatcaataaatccaaaacgaaactccacaaaaagggccacaagttcaagctgctaggctttagtatcctgccgaatggggtcgttacaattccctccgccgacaaaaaggaaattgagagtctgctgtacttctatctcacggataacaacaagtttgagaaccatttcaagaacacccaaaatcctaaagacatcgaaagttacgacaagtcattgcgggagcatgctcttggcacactgtcagggaagctgattgcctttaactctatggataaacagtatgtgtctaagctacgtagaaagtatggcaacaccgttattgatatgttcattagaaagagcgtgaaatga

SEQ ID NO: 12005 - RNA, 1002 nt, unidentified
  source 1..1002: mol_type = other RNA; note = synthetic construct
atgaatgagaataatatcaataggaacctgaaggacatctttaatagcacctttcacgggaagatgtcctttgaagacttcctctctctggacgttcagtccgaatacggtacaatagcactcaagaagagattggtttatgtgcccagccctaaactgaggctcgttcatagattcatcaataagaccattctggaatttgcagactgcaataaaaacgtggtttacagttaccggaaaggagtatcaactagggatgctgtcgagaagcatagcggccacacttacatattccagaccgatttgacggatttcttcaataacattcgtaagagtaacgtggtgaactcgcttaaaaagcaactgtcaagcgtgccaatcaaggatatcaacacatttattgacgtgatagccgacctggtcgtcatcgatgatcacatccccgctggatttagcacatcaccacttctgagcaacatttgtctattcgactttgacaatgagctcgagaagtattgcctctctaataacctgaagtatactcgctattccgatgatttaattatctccggctcttccattgattttacaacaacaattgaggccatcattgagactttcctgaagaagaacgtaaataatgccctttctatcaacgaggctaaaaccaagatacacaagattgggcataacttcaaaatactcggcttcaatatcttaccgaacggcatagtcaccattcctagtgctgacaaaaaacaggtcgaaagtcttttgtactttttcctgactgacgaaaaaaagttcgaggacttcttcctggggtttaccaacaaaatcaagcagggtagcgacgataaaaccgtgcgggagaaggccatctcaatgctatctggaaaattgatcgcgtttaacgcaatggataagaaatatatcgccaagctgcgcagaaaatacggcaacaccgtgattgaaatgtttattcgaaaatccgtgacgtga

SEQ ID NO: 12006 - RNA, 1002 nt, unidentified
  source 1..1002: mol_type = other RNA; note = synthetic construct
atgaataacgaaagcaccaagcgaagtctcaaggatattttctcttccacttttcacgataagatgagcttcgacgattttctgaggctggacgtcaatcgggagttcaagacaattaatcttagaaagagactggtctatgctccctccgccaaattaaaacaggtgcaccgcttcattaacaagaccattttagagtttgcagactgcaacaccaatgttgtgttttcttatcggaagggagtcagcacccgggatgcagtagagaggcattcgcatagcaactacatatttcagacagacctcagcaaattcttcaacaatatccaccgcgatgatgtgatgacggcattgaagagccagctatcaaacgcccctgtatctgacatcgacttgttcatcgaaaaaattgtcgatcttgtggttatcgacgaccatatccctgccgggttttccacttccccactgctcagtaacatttgcctctttagattcgataatgctctggaagcttattgtgaggccaatgaactgaagtacactcgttactcggacgacctgatagtttcagggagtttgaacgactttacagagagtatcgagacggtgatcgataacttgctgattgaacacgtgaataacagcctttgtatcaataaggcaaaaaccaaaactcacaaagtgggccattccttcaagatcctgggttttaatattctgccaaacggcgtggtgaccatcccgtcacccgacaaaaaggaagtggaatcacttctatacttctttctgacagacgaccagaaatttgaggattttttcaagaagtgcgcggattctaaaacccccgagacagatgataaaaccattagggagcgagccataggtatgctctccggaaaactgatcgctttcaatgccatggacaagcaatatgttgcgaagctccgcaggaaatacggcaacacagtaatagacatgttcatccggaagtctgtcacttga

SEQ ID NO: 12007 - RNA, 1002 nt, unidentified
  source 1..1002: mol_type = other RNA; note = synthetic construct
atggacaataacgataaaaatagatcactggaagagattttcgtgagcaccttccacgacaagatgtccttcaaagaatttcttagcctggatatcaataacgagtaccatacgatcgacctcagaaaaagggtgatttatgcccctacccccaaactgaagcagatccaccggttcatcaataaaacaatactggagtttgctgactactcaaaagacgtcgtgtactcttatcgtaagggggtgagtgtcagagatgcagttgagaagcacagtaacaacaccatattttttcagaccgacttttctgacttctatagtagcattcacgccgaaaacgtcaaaacatccctgtataagcaactgtccaacacctacatctctgatattgagaagtatatcgataggatactggaattaacggtaatcgataatcatatccctgctgggttttctacttcaccactcctaagcaatatctgcctctttgacttcgatcaggagttgttgaagtgctgtaatgacataggattgacttacacaaggtactccgatgacatcataatttccggttccgataaaacttttactgacgacattctgtcaattatcaaggaccttctcgggaaacacgtgaactcagaaattagtatcaacgattccaagaccaagataaataagaagggacatgacttcaaactcctgggtttctcgatcctgccaaatggcattgtaacaatccccagtgagtacaagaaagaggtggaactgctgttatacttctaccttacagacaatgagaagtttgaggattatttcaagaagctgaatgagaacaagaagctagaacttgaggacaaaactttgcgcgaacatgcgattaactctttaagcggcaagatgatcgcctttaacagcatggataagaagtacatttctaaactccggcgaaaatatggcaacaccgttattgatatgttcatccgcaaaagcgttaaatga

SEQ ID NO: 12008 - RNA, 939 nt, unidentified
  source 1..939: mol_type = other RNA; note = synthetic construct
atgtccttcgaagaatttctacggctggacgttaagaacgagtttcaccgcattgacctgaagaagagaatcatttacgccccgtcattgaagttaaagcagatccacaggtttatcaataagaccgttctggagtttgctgattataatagtgatgtggtgttcagttaccgaaagggagtctctatacgagatgccgtggagaaacatagctcgaataacattttcttccaaaccgatttttccaacttttacaggtcaatccacttgtcaaatgtagagtctagcctcaacaatcagttgagcgacactctcatttctgacatcgggttctatatcaaccgcatcattgagctcaccgtcgtagataatcatatccctgcggggtttgctacttcaccacttctgagcaatatctgcctgtttgacttcgacaaagaactcctgaaatattgcaacgacaacaacctcacttacacgcgttatagcgatgacattataatttccggcgtgaatgacgtgttcgtggaatccattaaagacttgattaagaatctgctggcaaaatatgtcaacaaggatatccatctgaatgatagcaaaacacggatcaataagaagggtcactccttcaagttactgggcttttctatccttcccaatggcatggtgacaattcccagtagagataaaaaggaggtggagctccttctgtatttctacctaaccgacaactcaaagttcgagaattatttctctaccatagccgataacaaaaaactcgggagcggagataagagtctgagagaatacgccatcaacagtctttccggaaaactgattgcattcaactccatggacaaatgttacatcagcaagttacggaggaaatacggtaacacagttatagacatgtttatacgcaagtctgtcaaatga

SEQ ID NO: 12009 - RNA, 1002 nt, unidentified
  source 1..1002: mol_type = other RNA; note = synthetic construct
atggaagctaaccagaaaagacccttgatcgatatatttatcagcactttccacgacaagatgtcattcaatgagtttttgacacttaacgtgtcgaatgagtttaaacggatccaactgaacaagcgggaagtttatgcaccttcgccaaaactcaaaaccatccaccgcttcattaataagacaatcctcgagtatgccgattataacaccgaggtcgtattctcatatcgaaagggaatttctacaagggaagccatcgagaagcattcagcgagcaattactttttccagactgacatcagtaatttctacaataacgtcagactggaaaatatctatacgagcctgagaaaacagcttaacaatacacccgttctggacatcgagaattacatcgacaacattgtcaacctggtggtggtggatgagcagctacctaccggcttcagtacttcaccgcttttgtccaatatttgtcttctggatttcgataacgcactgttaaaatactgcaaagacaatttcctcatctacacaaggtacagcgatgatataattatctctgggtccgacgatgggtttgctgtggaaatagagtccattgtgagtaattacctgaataacttcgtcaacgagaagattaagatcaactctgccaagaccaagtttcacaaaaggggacatgacttcaaactcctgggtttttccatattacccaacggcatcgttaccattccaagctccgacaaaaaggaggtggagagcttgatctatttttacctgacggacaacgaaaagtttgaggacctatttaagaagatctccgtaaacaaaaagctcgaaaatactgaaggtaagcctattcgggatctggccatttctagtctgtctggcaagctgatatcctttaactctatggataaggactatattagcaaactccgtaaaaagtacgggaataccattatagacatgttcattcgcaaagctgtgaagtga

SEQ ID NO: 12010 - RNA, 987 nt, unidentified
  source 1..987: mol_type = other RNA; note = synthetic construct
atggagaaaagatcactggataaagtttttctgagcatattccacgataaattctccttcaatgactttatcgtctttgacctgtccagcaattacaaaaagctcatggtgaataatcgggaggtgttctccgccagcaaagaactgaagtacattcataagttcatcaactcaagtatcctggcatacgccaagtataacaaggatgttgtgtactcttatactaagggagtgagcatccgtgacgcaatcgaaaaacactccggaagcaaattttttctgcagacagatattagcaacttttatggcagtctcaatagagacaacatcgaaatttcgctccgctatcagatagataatttcccaatctcagatatcgaggactacatcgacttaattgtgtacttaactgtggtagaagataagctgccagctggtttcagcacgagtcctctcctatcaaatttgtgtctgcttgactttgataccgccctcctgaagtacgcgaacgaaaataaactagtctatacccgatattccgacgacctgattatatcttctgttaatgaccggctcgataacgatatcgttctgaagatagagtctttgttgtgcgagcatgtcaatgatagtatctcactgaaccaatcgaagaccaaatttaaccacattgggaactctttcaaactgcttggccttaatatcttgcccaatgggaccgtgactatcccttcctccgagaagaagaagttagagacactcatatacctgtatttcacagataaggacaagtttattgacttcaccaacaacaacattaagtacaacaaagagagcaaagagaggacggtggtagaggtaggcactaggtacattacaaacaaattggtcgctttcaattctatggaccccgaatatgtgaacaagcttaggagaaagtacggtaacaccgtgattgaaatgtttcttcgccagagtgtcaattga

SEQ ID NO: 12011 - RNA, 1038 nt, unidentified
  source 1..1038: mol_type = other RNA; note = synthetic construct
atgaaacactatgaagagaagcctcaggagtttgtgctgactagcattcaaaagaaacgttcactacaggaagtctttttatctaccttccacagccagctcacttttgatgatttcctcaatctcaatgtggctcacgaatataagaaggttgaaatacagaagcgggttatctacattccgtcctacaagttaaagcgcatccataaatttttgaacaacaccgtgttcaaccatgctaggttcaacacagatgtggtgttctcttaccgaaagggtatcagcgtcagagatgccgtaaccccacatgccaagaacaaatttttcttccagaccgacatagtctcattttaccagtccattaaaactaacgatgtcgagagggcccttaagaatcaactgagcgatgttccaatcagtgacattgataggtacatcgatcacattgtgaatctcgtggttgttgacgatcacattcctgctgggttcgcgacctctcccgtgctgtccaatatatgcctggtcaattttgacgatgcactgctggagtactgtaagacgcagcacctgacttacaccagatacagcgacgacatcattatctccggcgagtacgaactggaacataaggtcatcgagattttcgtaacagagctactgaaagccaatctgggcagggcagccgaacttaacatacaaaaaacgaaacggtacaagagaggacacgatttcaagttgttaggtcttaacattctccccaacggagtagtgacaattccccgggagagtaagaatgagatcgaggtgatgctctatctttatttgacagacgctaaaggatttgacgactatgtgaaacatacattcttttcatctgagacagacatcgacagttccaccctgagagagcgcgggatcgccaaactgtctggcaaaataattagtgcaaagagcatggacaacaattatatctcaaagttgcgacgcaaatatgggaacactatcatggaaatgtttatccggaagtcggtgaaatga

SEQ ID NO: 12012 - RNA, 993 nt, unidentified
  source 1..993: mol_type = other RNA; note = synthetic construct
atgccagaaaaaaggcagttcatcgaagtgttcaggagtaccttccacgagaagatctcacaggaagagcttatcacattggagacggagaacgaatacaaaatcttccaacacaagtctagaaaaacctatgcccctacaccgaagcttaaaaacatccaccgcttcttgaataacacagtttttgagtatgcagattacaacaaggaagtcgtgttttcttatcggaaaggcaagtctgtgagagaggccgtcgagttacacgccggatctaagatttttttccagactgacatctccaatttttatggaagcatcactcgagaaaacgtagaacatagtctccgggaacagctgaacaatgtgccaatatctgacattaaagagtatatccctctcatcctgaaactggtcgtggtcgataaccacattcccgctggcttctcgactagccccgtgctgtcaaatatctgcctgtacgaattcgacaatgctctgcaagttcattgtgagaataacgggctgatatactcccgatattccgatgatattatcatttccggggagtcttcagagtttgtggatcgtgttaccaagacaaccgaagacctgttacataagtacatcaacactaacgttagcttgaatcccgataagactaaggtacataaaaagggccggtactttcgccttctgggttttaccattctaccagacggtaagattactattccttcgcaggacaagaaagaaatagagacgagcctgtacttttatctcaccgacagctcaaaatttgtggacctattcaccaagacaaatcaggtagcgctgaatgaggtggatagcgtgagtatccgcgagagagccattgcaagtctcagcggcaaactcataggggtgaactccatggacaaaaactacatttccaaacttaggggcaagtacggaaatacagtcatagatatgttcatcaggaaggcagctaagtga

SEQ ID NO: 12013 - RNA, 1002 nt, unidentified
  source 1..1002: mol_type = other RNA; note = synthetic construct
atggaactgtcaaaggagaggcgatcactcgaagaggtttttataagcacatttcatgagaaggtgaatttcgacgatttcgtaaacttttcgatcaacaaagagtacaagacatttgaggtgaatagacggaaaatttatgcgccgtcaaagaagttaaaacaattccagcgcttcatcaatagctctattcttgaatatgccgattataatcgggacgttgtgtactcctatcgtaaaggggtcagcataagagacgccgttgagaagcacgcaagctcaaatttcttttaccagacggatatttccgacttctttggaagtattactggtgatgacattatgaaggtgattaacacctccctacttaatgtccctgtaagcgatgtgctcgagtataagcaactgctgtttgaactgatggtggtggataacaatctgccagccggctttgcaacttctcctttgttgagcaatattacgctggtcgactttgataatgctctcaagaaatattgcgataggtccaacatcatctatactcgctacagcgacgacttgatcatctcttctgtcaatgaaggattcgtagacaatatcaacgaggtgattaaaagcttcctccatgaacacatgggtgaaaggttcaaccttaattacaacaaaaccaaggttcgacgcaagggccagaaggtgaagatattaggctttaccatcctgcccaacggcattatcacaatatccaaatcatacaaggaggaggtggagtctctgttgtatttctacctgaacgatacagataagttttccgactacgtgaagaacaaaatcaatcccagagataaccagatcggggacagaactttcgaagaattcgggatcagtagtctcagtggaaaactgatcgctattagttctatggactcgctttacatctccaaactaaggaagaaatacggcaacaccataattgagatgttcctgcggaaaaccgtcaactga

SEQ ID NO: 12014 - RNA, 981 nt, unidentified
  source 1..981: mol_type = other RNA; note = synthetic construct
atgaagcggtcctttgaggagatattcattagcacattccacaacaaggtgtcttttgatgaatttttgaccctggatattgaatcagagttcaaaaaaatccccctacagaagagaaccgtttatgcaccatcctccaaactcaaacaaattcacaggtttctgaatcatgcggtcttcgagtacgctgagtttaataaggacgtggttttctcataccgcaaaggagaaagtactagaacggctgtggagaagcacgccaacaatagggtgttttatcaggctgacattaaagacttcttcgggtctttgaagaaagagaacatcctccatacaatcgaagctcagttagagaataccccagtgctggatatcgtggattacagggaccgcctgttagatcttacagtcgtcgatgaccatattcctgcagggtttgccacctcgcccattttgtctaacctctgcctgtttgagtttgacaatgccctagacaacatatgtaagaaagaggaactgacttacacgcgatatgcagacgatatcatcatttcatcccagactgatgccttcctgcccgagatagaggagaaaattcagaagcttctcagcaaaaaggtgaacccagaaatcttcttaaatctggccaagcggaaagtccagctgcaaggtcagcgtatcaagatcctgggcttcaatattcttccgaatggcattgtgactatccctaataaggataagaagtctgtagaaaccatgcttcacttctttatcaacgacgaagaaaagtttaaggactacgtcagcaagaacataaagagtaatagtgacggggaaccttctctgcgggatatcggcatctcaagtttgtccggaaaactcataagcctgaacagcatggataaaaactatatctccaagctcaagaagaaatacggtaacacagtaattgacatgttcatcagaaaaagcgttaaatga

SEQ ID NO: 12015 - RNA, 1071 nt, unidentified
  source 1..1071: mol_type = other RNA; note = synthetic construct
atgagttctaccggatacgcgttcaaaattgtgatccactttaacctgtctattaatatcgggttagcccttctgataaagatacagaagcaaagaactctgaaggaagtgtttaaatccacctttcacgataagattagctttaaggagttcattaacctgaacctggacgaggagtacactatcagcacattcaagaaaaagaagatctactctccatcggacaagctcaaaaaaattcacagattcatcaactccagtatactcgagcatgccgatttcaatcgtgaggttgtatactcttatctcaaaggcagtagtgtgcgagatgctgtggaactccactcccaaagccagtatttctttaagacagacattcacaacttctttggaatcattaccaccaggaatattaagaaatccttggaggaacagttcagcaatgtcccgatttccgatatcgacatgtacaaggagttcctttttaaactgatggtcattgacgacgtacttcctgttggcttttcaacgtcaccccttttgtccaatatttgcctgtttgagttcgacaatcatctgcaggcttattgtagctctaacaacttcaagtatactcggtattctgacgatatagtcatctcctcaaacaagtcctttgatatcgaggagatgtccgaaaacatccaggcattgctgagtaaacatgttaatgagggcgccaaattaaacaaaagcaagaccaaggtgcattcaaaaggtgaacggatcaacatcctgggttataatatcctccccaatgacgaaattactatatcgagcaaagacaaaaaggaaaccgaaatcctactgcacttttatttgaacgatctggataagttcgatgattacgtgacgaaaaatataatcaaccggttccgcaatagcgacaagaaatcaattagggacatcggacttagtagcctgtctgggagaatcattggcatcaatacaatggacaagaaatacctgataaagctccgcaagaaatacgggaacacactaatcgatatgttactcaggaagaccgtgtga

SEQ ID NO: 12016 - RNA, 999 nt, unidentified
  source 1..999: mol_type = other RNA; note = synthetic construct
atgtcttacatcaaaaatcagagaactcttgaggaagtgtttaaatccacatttcacgacaagataaccttcgaagacttcatcaatattgacctgaattcagagtacaagatcacaatctttaagaacaaggagatctatagtccttcagataaactgaagaagatgcaacgcttcataaatggtagcattctggaatacgcggactttaataaggatgttgtctactcttatctcaaaggcaatagtgttagggacgccgtggaactccattcaaaaagccaatactactttcagaccgacattcataacttttttggaacgatcacagggtacaacgtaaaaaaatccttagaagagcagtttagcaacgtgcctattagcgatctggataactacaaagatttcctattcaacctgatggtcgtcgacgggaagctccccgtggggttctcaactagcccgttactttccaacatttgcttgtataacttcgacaatgccttgtacaagtactgtgagtctaatggcttcttatataccagatattccgacgatattgtggtttcttccgactcccatatatcaattgatgagatcagcgagaaaatccagagtcttttgctaatccacgtcaatgaaagtgctaagctcaacaagcggaagactaaggcacactccaagggcgagaagatcaatatcctgggttataacattttgcccaacgacgagatcacaatttcgtctaaagacaagaaagagacggaaattcttctgcacttctacctgaacgatctggatcgctttgataactatgtacgcaataacattagcccaagattcaggaatgtggatgataaaagtagccgggaaatcggcatctcttccctgtcgggccgaatcattggaataaatgctatggacaggaaatatctgactaagctccggaaaaagtatggaaacaccctcatagacatgttcctgcgtaagaccgtgtga

SEQ ID NO: 12017 - RNA, 1008 nt, unidentified
  source 1..1008: mol_type = other RNA; note = synthetic construct
atgctactgctctcctacataaagcataggagaactttggaggaggtctttaaatccacctttcactcgaaacttgctttcgaagatttcatcgggatcaacatttgcgacgaatatagtgtgtctacgtataaaaaacgggaaatcttcagcccttcagacaagctgaagaagatccacaggttcattaacggaagcgtgctggagtacgcggacttcaatcgggatgtcgtctacagttatctgaagggacggtcagttcgtgatgccgtggaagtgcattcaaaatcacaattctactaccaaaccgacatctataacttctttggctcgatcagtccgagtaatgtaaagaagagcattgagaatcagttttctaacgttcccatcagcgacattaaggattaccagggctttctgttttcactcttcgttgtggacgggaaattaccaatcggtttttctacaagcccactgctgtctaacatctgcctccgcgactttgacaacgctttgaaccagtattgtattgagaactcctacagatacaccagatattctgacgatattatcatatccagcgataatcagttctgtatcgataagctgagcaagcacatacagaatttcctcttgcagtacgtcaacgaaaataccaaaatcaataagtccaagacgaaagtacatacaaaaggggacaagttcaacattcttggctataacattctccccaatgacgaggtgactataagttccaaggataaaaaggaagcagagattttactacacttttacctgaatgacctcgacaagtttgatgattatgtgcgaaagtctatctaccctcgcttcaaaacatcctcagacaagagcatgcgcgagattggaacttccagcctgtctggccgactgattggtatcaatgccatggataaaaagtatcttaccaaactgaggaagaaatacggcaacacacttatagatatgtttttgcggaaaactgtgtga

SEQ ID NO: 12018 - RNA, 1005 nt, unidentified
  source 1..1005: mol_type = other RNA; note = synthetic construct
atggaaaacaatagaaactttagaaccttcgaggaagtattcaactcaacatttcataatcgggtcagctttgatgacttcgtcaatggctctataaacacggagtacagcatcgtcaagtttaagaataagagtatctactccccatcacttaatttaaagaagatccagcggtttctcaacaaaagtatcttggagtatgccctaactaatgaacgagttgtgttctcatacagaaaaggggcttcggtgagggatgcggtggaggtgcactccaaatccaaatacttcttccagacagacattaagaattttttcggccaaatcaagaaggacgtggtggaaaatattatcggcacccagttaggatgtgtgcccataattgacatagaggagtatcacgatgtgctcctccgctatctgatcgttgacgggcacgttccgatcgggttttctacgagccctattattagcaacctgtctctcttctattttgacaacgatttggaggagtactgccttaagaatgatttcaaatacactcgttacgcagatgacattattatttcctccacagactacgaaattgatctgcataagaccaaatctctgatcaagagctttctcctgcgcaacaatttcgtgggggaactgatcaatgacaaaaagactagaatccaggtgaggaacggggtcattaagctgctgggtttcaacatacttcttgatggaaccgtcactattccctccaaagataaaaaagaggtagagatcatgttgaacttctatctgaacgacaagtcaaagtttgacgattatgtgagtaaactcaaaacacgaagtggccgcttgaatgaaggaaagtctctgcgggaaaacggcattagctcgctgagcggtaggatcataggaataaatgctatggacaagaagtatatcggtaagctaaagtctaaatacggcaacgccgtaatcgagatgtttctgaggaaaaccgttaaatga

SEQ ID NO: 12019 - RNA, 1008 nt, unidentified
  source 1..1008: mol_type = other RNA; note = synthetic construct
atggagaacatagagcagaaacgttccttagaggaagtatttaactccacctttcacagcaagctgcctttctccgctctgacagaactcactatcgacagtgagttcaagcataagatctttaacaacagagacatctacctcccgactgataagttgaagaagatacatagattcgtgaatggatctatcttagaatatgcggagattaataggaacgtggtctttagctaccgcaaaggtgtttctattcgcgacgcagtagagaagcacacctgcaacaaattcttcttccaaacagacatcaagaacttttatggcagcatttccaaaaagaacatctcagacattttcgaccaccggtttgacatggttccaatatctgatttggataactatcggaagaagcttctggacctgatggtgataaatgatcagctgcctgcagggttcagtacctcacccatgctttccaatatttgtctctttgacttcgacaatgaactggaacagtattgtaacgagagtcacttgacttacaccaggtatagcgatgatataattatctcttcgtcggagaaggagaatctgacagatctcagtgagtttatccagagtcttctgtacaaacatgtgaacaaggaaacactaatcaatgacaataagacgaagattgtcaaacacggatcaaatgtgaaaatcctagggtttagcattttgcccaatggtgaactcactatttcctctaaggataaaaaagagatcgagatccttctccacttttttctcaatgatgccgaaaagttcaacaactatatcgaaagcaagctgtcattcaaacatgacgattcttccgaccgaaacgcctacgattccgctttatcaagcctgtgcggccgaattgtcgccctgaatagcatggacaaaaaatacctggataaactgcggaggaaatacggcaatacgctgatcgagatgttccttagaaaaaccgtgttgaagaactga

SEQ ID NO: 12020 - RNA, 1002 nt, unidentified
  source 1..1002: mol_type = other RNA; note = synthetic construct
atgaatatcgccaattacaatagaaccttagaagaggtcttcaagagtattttccatgacaagttgaagttcgaagagttcttaaagctggatgtgaagaacgagtaccaggtgtttgatatcaaagggcgcaaggtgtactctccttccaaaaagctcaaaaagatccatcggtttattaacgggagtattttcgagtatgcggactataacaaaaatgtggtgtattcgtatctcaaaggcgtctcagtaagggacgctatagagaagcacgcaaagaataactatttttacaggacggacattaaggattttttcggtagcattacaggcgaaaatgtcatacgatctttggaaaatcaactcggcaacgtgcctatctccgacattagcaattatgtcaaccacatcttcaatctggtggttgtaaatggtcggctacccgccggctttagcaccagtccaatcctcagcaatatctgtctcttctcttttgacaaagaactggaagtcacttgccagagagacgacatggtttacacacgttacagcgacgacatgatcatatcatccattaacgagattgatgaggaaaaaatcaccggacttattcaatctctgcttttccggtttgtgggagataacgttttcctgaacgataagaagaccaagatacataagaaagggactcagggcaccctcttaggttttaacattctgccaaacggggaggtgacaatcccgtctcgagataaaaaggagatcgagatccttttgcacttttacctgtccaacagtgactccttcgtaaattatgttagcaaaaacatccagcccaggtacgccaactcagataacaagacacttaatgaaatcggcgtgtcctatctatcaggaaaactgatagggattaacgctatggataaaaagtacctgactaaactgcgctgcaagtacggaaatactctgatcgagatgtttctgagaaaaaccgtgttgtga

SEQ ID NO: 12021 - RNA, 1002 nt, unidentified
  source 1..1002: mol_type = other RNA; note = synthetic construct
atggacaggacaaataacaacagaaccttagaggaagtgtttacaagcatattccacgacaagctaaagttcaaggagtttctggagctcaacattacgaaagagtatgaagtattcgaggttaagggacgtcgcctgtattcccccaccaaaaagctcaaacaaatacaccgctttataaatgggagcatctttgagtacgcagagtacaacaaaaatgttgtattcagctatctcaagggggtcagtattagagatgccatcgaaaagcacgctttaaatcagtatttttaccagacggacattagggatttctttggctccataaacggcgaaaacattaatcattccttgagttctcagttggacaatactccaatttccgacatctcggattacatcaacctgatctacaacattgtggtgattgatcagaaacttccggttggtttcagcactagcccaatcttgagcaatatctgtctgttcaacttcgataatgagcttgagaagatctgcatctcaaataatatgacctacactcggtattccgacgatatcatcatctcatcagggaatgagattaacgagctggaaacaacctctatcatccaatcgctgctgtttaacttcgtgaacaacgagtttattgtgaatgataagaagaccaagacatacaagaaaggctctggcaatagtcttctgggtttcaatatactccctaatggctacgtcacaatcccttccaaagataaaaaagaagtcgagattctgctgcatttctatttgaccagtcccaagagcttcgaagactacatcattaagaacatcgtgaataggtacaaaaaccaggaaggcaagtcaatcgacgaaattggaaagtcttttctctctggaaaactgattggtattaacgccatggacaagaaatatctaactaagctgcggggaaaatatgggaacaccctgatagaaatgtttcttcgaaaaactgtgctctga

SEQ ID NO: 12022 - RNA, 987 nt, unidentified
  source 1..987: mol_type = other RNA; note = synthetic construct
atgtctgagaaaaggtcccttgaggacatttttctgtctacgttccacaacaagtacagctttaaagagtttatcgaactcgatatcagcaaagagtacgagatctttaacataaacgaccgtacaatttactcaccctctgcaaaacttaaggcgtttcatcgatttatcatcagttgcattcttgaatatgccgaattcaataaagacgtggtgttctcgtatcgcaaaggaacaactattcgggatgccgtcgagcggcactcaaacaattcattcttctttcagaccgacatcaagagtttttttacttccatctcaaccaatgatgtgaagtctacactacttcatcagctggttgatatcccagttagcgacgtgaaccacttcatcgatctgctcatcaagtactgcgtcgtagataatatattaccgacaggtttcagtactagccccattctcagcaatctctgtctattcaagtttgacaatcagctggaaaagctggccaaggaaaagcacctgcactattctagatactccgacgatttgattctgtcctccaagtctcttgacacactgaacgagattgaactcaccatacagcggtatttgactcaatacataaactcaaccatcaaactcaatcaaagcaagactaagatcacgaaaaaagggcagaggattaaattgctcggcctggtgattctgcctaacggaatcgtcactatcgataaaaagacaaagaggcagatggaaaccttattccatctgtatctgaccgacgacgagaaattcgagaattacatttccacccatttcaagaacaaaaaggatcaacagacatccctgaaggaatacgggattagcatcttgagtggcaagctgatggctattaatagcatggacaagggctatttaaacaagctgagaaccaagtatggtaacacggtgatagagatgttcttgcgcaaaaccgtaaaatga

SEQ ID NO: 12023 - RNA, 1005 nt, unidentified
  source 1..1005: mol_type = other RNA; note = synthetic construct
atgaaaaccaacactaacgagtcctatcgcactttccaagaagtttttgtgagcaacttccataacagcttgctattcgatgattttctgaatctgagcgtcgataacaatattgctgtgacccaggttaaagagagagaaatcgtacagccttcaaaacggctcaaacgcatcctgcatttcctcgctaagaatgtctttgattatggaaacatagcaaacgaagtcgtcttctcctaccgaaagggcgtgaacgtgagagatgcagtgctaccccactctaaaaaccggttcttttttcagaccgacattgccaacttcttcggatcaatcacaaagcctctggtgagcaaaagtataaggaatggtctgggatccgtgccaattgccgacatacacgagtacgccgacgtgatcctcaacatcgtttcatacaagaattgtttgccgcttggcttccccacttcgcccgccatttccaatatgtgcctactgaattttgacaaggagctgctcatccaggccaacgagttagatgtgtcttatacacgatacgccgacgacatcatacttagtgcaaacaatgatgaggtattgcgcatgctggcagccagggttgggggcttgctgcaagagttcctcggtgctgaaatcaaaattaatgaagcgaaaaccaggtatctgcagcaaggacagaagattaagctgttagggctggtggtcctgcctaacggtcaggtatctatcgacagggcagacaagattgaaattgagacactgttacatcactatctcaccaacgacgataagtttctcgggtacggcgttgtcctcaagaataaaaaggcgaaaaatgacaaggtgttgacgcgggaaaatgtgatctctatgctgagtggccgtctgattggggctaatgctatggccccagagtaccttctgaaacttagacagaagtacggcaatacaatcatcgagatgtttcttcacaagtccgctaagtga

SEQ ID NO: 12024 - RNA, 969 nt, unidentified
  source 1..969: mol_type = other RNA; note = synthetic construct
atgccgtttggcatcgttcagatgaaaaagacatctattagcctgagagaagcatttgactcaacctttcaccaaaaattcaacttcgatgactttctgtcgctcaacatttctcaggaatacaagcagttaagtaatgagaaagtgaatcctagtctcaaactgaaaaagtatctgcgtttcttgaactcctttgtgttcgactacgccaaaataaacgagaatgtggttcactcctataggcacgaaaaatccacctacactgcggtagtcccccattgccactccaagttcttcttccaaaccgacatcaaggacttttttcataagatcagtaagcaggacgtggaaaaaatcgtggacactgctctcgacaaggccccaatttatgacatcaatcggtataagagcgagctgctgaatatcaccacgatcgatgatgtcttgcccgtgggatttccaacaagtcccaacattagcaactctttcctatcctcttttgatgatactctggaggggtactgtatcaagaacaacataatctatacccgatactctgatgatgtcatccttagttccgaatataagaacagcctcattaatatccaggatgtgattagcaactacctgaaagagatttacgatgggcgcattgagatcaacacatataagacaaagcatacgcacaagggttccaagataaaaatacttggcatggtggtactcccttcaggtaagattagcgttgacatcaagttcaaacagcacttggagattttattccacttctacattaacgacaagaataaattcgctgactatctgaagaatcattaccagggcgatttttcaaaaattagcggacagctgaatcatatcaatactatcgacaagtcataccttgataaactaaggaagaaatacgggaatttcatagtcgattcttttcatcaccaatcaatagactga

SEQ ID NO: 12025 - RNA, 948 nt, unidentified
  source 1..948: mol_type = other RNA; note = synthetic construct
atgaagaagacctctctcagtctgcaggaagcgtttgactctacatttcaccacaagcttaatttcgatgacttcctgaacttgaacctacctcaggagtaccagaaaattagcaatgctaaggtaaacccatctcctaagctgaaaaagtatctccgatttctcaatagcttcgtgttcgactatgttaagataaacactaacgtggtgcattcgtatcgccatgagaaatctacttacactgcagtcgtgccacattgtcacagtaaattctttttccagaccgatatcaaggactttttccataaaatcaccaaacaggatgtagagaaaatcttagataccgccctcgacaatgtgccgatctatgatattcaccagtacaagagtgagctacttaacattaccaccattgacgacattctgcccgtgggcttccctacatcacccaatatcagcaacagttttttgtcagacttcgacgatgccttggaaggctactgcatcaagaatgagatcatatacacgagatattccgatgatatctttctgagctccaatgccaaagattccctgatgagcatccaaaacacaatatccgattatttgaacgaactgtatgaccggagggtcaaaattaacgcttacaagactaagcatacgcataaggggtccaagatcaaaatgctgggaatggttatccttccctcaggtaaaattagcgtcgacattaagcttaagcagcaaatcgaagtcctgtttcacttctacataaatgacaaagacaagttcgcagattacttaaagaaccactatcagggggacttttcgaaagtgtctggacagctgaaccacataaatacaattgacaaatcctacctcgacaaactgcgtaagaagtacggcaattttatcgttgattcattctaccaccaaagcattgattga

SEQ ID NO: 12026 - RNA, 951 nt, unidentified
  source 1..951: mol_type = other RNA; note = synthetic construct
atgaagaagctgctgcttaaagaagctttcaatagcactttccacaaaaagctgaatttcgatgacctcctaaacctcgagattatcaatgagtatacaagcttcaacatccggaataaacagattctgaacccgtctgaaaaactcaagaagtaccacagatttcttaattcattcatcttcgactacgccaaaattaacacaagtgtcgtacattcctataggaaagagaagacagcctacacggctgttagcgtgcacgcaaattccaagtacttctttcagtctgatataaacgacttcttcaattctatcactgccaccgatatcaaaaatgttctgaatagcaatctggatgattcccctatttccgacatcgttaactacaaggatcaattgatcaacatagtaacggtcaacaacattttaccaatcggattttctacatctcccaacatcagtaacacttgcctgtataatttcgacaattccctggagacatactgtaatgagcgcgatataaattttaccagatatgcggacgatatcatcctatccagtaatactaaagagtcgatggtgggtattgaagagattgtgagtaagatcctgaacgaattttttaacgaccgatttgtccttaatcagcacaagaccaagcggctgaggaaagggaacaaagtgaaacttctcggaatggtcattttgccctcaggcaaagtgaccgtggacatgaagttaaagaagcagctggaaatattgctgcatttctacattaacgacaaggacaagtttagcgattatctcggtaaagtgtatagcggcaaattgagcaccatatcaggccaactcaactacatcaacactgtggataaaaactacttaaacaagctgcgcaagaagtatgggaattacattgtggacctcttttttcattcaaccgtcaagtga

SEQ ID NO: 12027 - RNA, 939 nt, unidentified
  source 1..939: mol_type = other RNA; note = synthetic construct
atgccgctgcaagacgtgtttacaagcacattccaccagaaacttgacttcaatgacttcctgaacctcgacgtgaaatctgaatatgagccactcaagaatacgcagaaactcattctgaaacccagccccaaattgaaaaagtatctccgtttcctcaatagtttcatctttgagtacgctaagattaataccaacgtagtgttcagttacagaaaggataactctgcctacaccgccgtccgaaagcatgctaattccaagtatttctttcagacagacctttctagctttttctattcaatcactgcggaggatgttaagaacgttttagaaaactacatggggaacagtcctataaatgatctgagggagtatcaggagatcatcataaacatggtcacagtagacggggtgctgcccgttggcttcagcacttctcctaaaatttccaattcctgcctgtacgaatttgacaacgaactggaacagtattgtttagacgatgggattatctatactcggtactcagacgatattatactttcttcgaaggataacgacttgaagacagtggagaaagtgattagcggaatgcttaacaaatttttcggagcacgcttccagctaaatcctaataaaactaaacacacccacaccggtaaaaagattaagctgttgggcatggtgatcctgccaagcggcaaagtctcagtggatatcaagctaaagaagcagatcgagatcctgttttacttctacatcaatgacaagaccaagtttacggattacctggtcaataaataccagggcgacttaggcaagataagtggacaactgaactatattaacaccatcgataagtcctacttgaataagctcaggaaaaagtatggtaactttatcgtcgattcctttattcatcaaactgtgtcatga

SEQ ID NO: 12028 - RNA, 990 nt, unidentified
  source 1..990: mol_type = other RNA; note = synthetic construct
atgaatgaaattacccataccaatttcaagaagaacacactccaaaccatttttgagtccaatttccatgacaagttttcttttcatgacttccttcactttaaccaagaaaaggaatatacgaaggttaacataggtcgtgagaaaataggcagtaaagagattctgaaggcttcggacaaattgcaaagctacttgaggttcctcaacaactacatttttcagtatgcggacattaacaaaaacgtagtgtactcctaccgcaaaggagcaaatacatatcaggccgtcaagaaacacagcgataacaatttcttctttcagacagacatcaagggcttttttaagaatgtgaaatccgccgatatcaagttcatattggaaaataacctgcacaatacccccatctcagacctgaaaaagtacgaggaacgaattctctctattgttacagtgaatgacaccctgcctgtggggtttgcctcaagcccgatcctaacgaactcattactgaaagatttcgacaatgagctagagaactattgcactcagaatgacatcgtctatacacggtattccgatgatctgatccttagctctaaggtgaaagacagtctgatagacatcgagaaaatgatttccaatatcctgaacaagttctttaacgacagctttcagctgaacaaagagaaaactaagctcactcataaaggaaacaagattaagatccttgggatggtgatcttaccaaccggcaaagtcactgtggacattaagattaagaagcagattgagtctctcttgcacttttacataaacgacaaggatatcttcatcgatctggtggggggaaattacgatgatggcctggctatggtcagtggcaaaatcaattatatcaataccatcgatcccgaatacctcataaaacttagaaagaagtacggtaactacgtagttgatctgttcttccaccagagtttcaagtga

SEQ ID NO: 12029 - RNA, 981 nt, unidentified
  source 1..981: mol_type = other RNA; note = synthetic construct
atgaacgatattacgcatagtgaaaaaaagagccttcagagcatttttaagagccactaccatgagaagtactcatttgaggatttcctgaatttcgaccaggaaaaggagttttctaccatcgagatagacacaaaaaaaggggccaagaaagaaatctttaaacctagcgacaaactgcaagattacctgagatttcttaacaactacatcttccagtatgctgacactaatactaacgtcgtgtactcatataggaaaggtacaaatccctatcaggctgtggtaaagcattccgcaaataattttttcttccaggccgacataaaaggctttttttctagtgtaaagcgacaggatattgagtacgtgcttaataacaaactggcacaaagccctattagtgacctgaatatatatatcaaccgtatcctgaacctgatcatggtgaatgatagcctcccaattgggttcgcttcttccccgattctcactaactcgttgttaaacgattttgacaatgagctcgagaagtattgcctcgatcaggatgtcatttacaccaggtattccgacgacttgatactatcagccaaaaccaagaccccattaatcaatctggaagattacatctccgaaatgctggttaaattcttcaatgaacgcttgaagctaaacgaggagaagacaaagctcacccaaaagggcaataaaattaaaatcctcggcatggttatccttcccactggaaaagttacggtggacattaaggtcaagaagaacatcgagatcctgttccactacttcatcaacgataagaataagtttgtggacatttctggcggtaattatgaagccgcgttagacaagttgtcaggaaagatcaactacataaacacaattgaccccgattacctgatcaaactgcggaagaaatatgggaactatattgtggatatgttcttccacaagtcctactga

SEQ ID NO: 12030 - RNA, 951 nt, unidentified
  source 1..951: mol_type = other RNA; note = synthetic construct
atggcgctcaccctgaaaaatgcttttgaagccaccttcaggagtaactacagattcgaagacttcctggcactaaagctggagcagactgccactcggaaaaagttgggcgggcgggagattgtgcagcctaatgcagagctaaaagcctatcttcgctttctcaataggttcattttctcttacgcggacgtagtcgatgaagctgtgttcagttacaagaaggatgcaagtcccaagcaatccctgataaaacattgtcaaagcaggtgcttctataagaccgacatcgccagatttttcgagtcaattacatttgatgacgtgcttcaggtttttacaaataagttgtcccaggccccaataaccgattggcctgattaccaagcccatctgcaatctctcgtcctcgtcgacggtcgtctccctattggctttccctctagcccagtaatttctaactcagtgctgtatgagtttgaccaggcagctcttgcgtgggctcaaagacacgatatcatctatactagatactctgacgatctgatcttcagcgcccagcacgatgaggtgctgaagtccctgccacagcgaattgaaaagtggctgaacgacttttatgatggacgcttcaagcccaacccgtataaaagtttctttacacatacgggcgagaaagtgaaattactgggattggtgatccagcccaacggtcatattagcgtgtcgaggtcattgaagaacaaaatcgagtcccttttgcactatttcatagaagaccaggcagtctttgaccgcctgctcgcccagcactttagcgggaatgctgtcgggctgatgagcatgctgtcctgggttcagtcaatcgatcagccttacatcgaaaagttacggaaaaagtacggaaattacacagttgacctcttcttacacggcgccgctcgactttga

SEQ ID NO: 12031 - RNA, 990 nt, unidentified
  source 1..990: mol_type = other RNA; note = synthetic construct
atgaaacctctgagcctggagaaggcttttaacatagcctttttcgaaaaggattcatttcagaacttcttatccttcgagcccttccaacagaccaagtttataactttcgatgaacggcttattgcagaaccaacatctaagctaaaggagtaccataaattcatcaacgagttcgtcctctcatacctgaaagtcaataaggatgtcgtgttctcctaccgtaaaggatctagcacttatgacgcagtgaaactgcatgcctgcagcaagatcttttttaacaccgacatcaaatcgttctttccatccataacacgcgagtatgccaggtctgtattggtcgacaatctcagcaatgtgcccatttctgatcttaatatccacctcgataaaattctggactacataatcatcgacaactcactgcccgtcggctttccgacatcaccagcctttagcaacgcttgcttatacgatttcgatgtggagatgcagcagtattgtatcaaccacgaatatatcttcacgagatactccgacgatatcattatttcgagtgaaaatgatgagggatttgagaatatacacagtgtggtgtccgacctgcttggtgaattcggcaaagggcatttcaagttgaactcagcgaaaaccaagctgatcaaaaaaggaagtaagattaagcttctgggcatggttattctccctagccaaatcgtatctgtggatattaagatcaagaggaagctggagcacctcatacatttttatgttacagacaaggacaagttcatcgattccattatcaaggaccctaaagttaaaacttccggcctcaatgactctgagattttggaaaagggcgttaacaccgtgagtgggctgttaaatcacatcaacaccattgataagagctacttggacaagctgaagcgaaaatatgggaataccattgtggacatgctattttacaaaaatgtgaactga

SEQ ID NO: 12032 - RNA, 990 nt, unidentified
  source 1..990: mol_type = other RNA; note = synthetic construct
atgaagccactgtctctcgaaaaagcattccacatcgccttcttcgataaggatagcttccataactttttgagttttcagcctttccagcagacgaaattttccacttttgaggaacgcctgatagccgaaccgtcctctaagttgaaggaataccacaagttcattaacgagtttgtgctgtcctacctcaaggtgaataaggacgtcgttttctcctataggaaaggaagtagtacatatgatgccgtgaaacttcacgcaaaaagcaaagtctttttcaacacggacattaagtccttttttccaagcataaccagagagtatgcccgtgctgtgctgttcaataacctaagcaacatccccatttctgacttaaacgtccatctggacaagatacttgattacatcatcattgatgactcactccccgtaggcttccccacctccccagcattcagcaatgcttgtctatacgactttgatgttgctttacaacagtattgcgcggaacatgactacatctacacacggtattcagacgatatcatcatctcttccgaaaatgatgagggcttcgacaatattaacagcgtggtaattgagttgctgggtgagttcgggaaaggtcactttagccttaatcctaccaaaacaaagctgattcgaaaaggctcaaagatcaaactcttgggaatggtcattcttccttctgaaatcgtgagtgtggacataaaaatcaaaaggaaactggagcacctgattcacttctatattaccgacaaggacaagtttctcgattcaatttcaaaagatcccaagatcaagactaccggactgaatgattctgagatcctcgagaaaggggttaactcggtcagtgggctgctgaaccatatcaacacaatcgacaagaagtacctcgataagttaaagaagaaatacggcaacactatagtggacatgctgtttttcaagaatgtgaattga

SEQ ID NO: 12033 - RNA, 987 nt, unidentified
  source 1..987: mol_type = other RNA; note = synthetic construct
atgaaggctctcactctggaaaaagccttttccattgctttctttgagaaggatacattcgagaatttcctcacgttcgagccgctctcccaaattaagtttagtagcaaaaatgagcggctgattaccgagcccggatcgaaacttaaggagtatcacaaattcatcaacgagttcatattcagctaccttaaagtcaacaaagatgtggtcttttcgtacaggaagggagcatccacgtatgaagcagttaaattacatgccaaatcccgtgtgttcttcaatacagatatcaagtcctttttcccttctgtgtcccgcgaatacgccagatacgtgcttgacgataattcatctagtgttcccatcaccgatttctcctcttacatcgaaaagatcttggacttcataattatcgatgacgccctgccagtcgggttttcaacttctccaagttttagcaacgcttgtttgtaccactttgatttgggcatgcagtcttattgctttgaaaaagggtatctgtacaccagatattcagatgacatcatcatttcatccgagcatgagctggacgacgacatttatgcagtagtgagcggttttctgaacaaacttagcagcgcgaactttgaactcaatccttctaagaccaaactaatcaggaagggaagtaaaatcaagctgttgggcatggtgattctgcccaccggcgtggtgactgtagacataaaggttaaacgaaaactcgagcacttaatctacttctacctgaacgacaaggagaagttcgtggattctgtgaagaaggaatcagggaataagcagaaatacctgaatgaaggcgaggtgctggacaaaggcataagtatggtcagcgggctgctcaaccatgtaaatacagtcgacaagagctatctagacaagctcaagaagaagtatggtaacacaattgttgatctgttctttcacaagaacttaaactga

SEQ ID NO: 12034 - RNA, 1062 nt, unidentified
  source 1..1062: mol_type = other RNA; note = synthetic construct
atgtctgatcagttcgttaatgtggatgataatatcctacctaccaattcatctagcccaataaaaccgaagaaatcacttcctttagagaaggtgtttaacatcgcatttttcgaaaaggatacgttcgagaacttcctgaattttgacgttgccagtggctacgaatgtgctgactttaaaggacggacgctgctcaaacccagtccaaagcttaaggactatcacaagttcatcaacgacttcatttttccgtacctcagtgtaaacgagactgtcgtgttcagttacaggaagggctctagaacatacgatgctgttagcaggcactccgagtcaaaagtcttctttaataccgacatccagaatttctttccctcgatcaccagagacttcgcgaagttggtcctccttgacaatctgaagaatattcccatctccgatatcaacaacttcataccaaaaatactggatttcgtggtagttgacaacgtgttgcctgtgggcttttctacttctccctccttctccaacgcctccttatatacctttgattgccggatgttcgactactgccaggaaatcaatgcagtttatacccggtattcagacgacattatcatttcgactaacaatgatagcgacctgaatgatatttataggattgtcgcccattttctgagccaagtaaatgatggtaagtttctcctgaacaaaagaaagacaaaaatcgtgcgccgtgggaataaaattaaattgcttgggatggtgatcctgccttctggtaagattagcgtcgacatcaaaacaaaaaacaaaatcgagcacctcatacatttctacctgacaaataaggagtccttcaaaaatgccgtcctaaagtacgataaggacggcaagataaagaacctcccagaaaatgagatcattataaagggagtgggaatggtgagcgggattttgaaccatattaacactattgaccaggaatacctgaacaagctgcgccgaaaatatggcaacgtggtgatcgatatgttttttcaccaaaacgctagctga

SEQ ID NO: 12035 - RNA, 987 nt, unidentified
  source 1..987: mol_type = other RNA; note = synthetic construct
atgaatactcccgataatcctatcatccctaaaagcaagaagattctcaagttagaaaccattttcagcatcgcttttcacgaaaaaactaaacttgacgacttcttgtcatttaacatcaagtctgagtacaagaaactggaatataacgggaggatcatttatcatccatcaaccaaactcaagagttaccataagttcattaacgacttcattctgttctacctaaatatcaacaaggaggttgtgtattcctatagaaaaggcagctccacgtatgaagccgtgaaaaaacactcagataaaaagtggttcttcaacacagacataaataacttcttctcttccatcacgaaaaactttgcccgagaggtgttagaagataatacaagcgcaatccccattattgatatccaagaatactacgacaagattctggactttattatcgtggacgatatcctgccgataggatttagtacttctcccgctttttccaatgcgtgcttgtacaagttcgataataacatccagtattactcgtctgagaataacctcatatatacacggtatagcgacgatatcattatatcctcggacaacaaagagattattcatagcatctacactaccgtgagtaattttctgagtaaagagaacaacggaaatttttctctgaacaagtacaagaccaagatagttaataagggcaacaaggttaaactgcttgggatggtcgtcctgccatccggtaaggtaaccgtagatataaagatcaagaagaagatcgagtacctcatctacttttatatcacagacaaggacaagtttaaggatgccatcggcaaagacattgataaaggtattgagatgatctcagggaacttgaatcacatcaataccattgataagagctatctgaacaaacttcgcaagaaatacggaaatgtgattatagacatgttcttccacaaaaatgtcttttga

SEQ ID NO: 12036 - RNA, 984 nt, unidentified
  source 1..984: mol_type = other RNA; note = synthetic construct
atgaacaagaagaagttagaagtcctgtttgaagctatgtaccacggcaaatacagtttcaaggactttattgagagcgatattagcgcggagtatgcttctttcaaggctaaggaaagaacaatttaccggacaacgaagaaactcaagaccttccactcttttatatcgctattcatcctcgagtacttgaatatcaaccccagggtggtgtattcatataggaaagggttcaactcattagatgcagtgtcaaaacacgcccagtctaaatatttcttccagaccgacatagaacacttttttgagaatctgacaacccctttaatacgcaagaccatcctaaataattctgataactccccggttcttgacattgagaatcatattgacagaattgttgagctgaccaccctcaataacagcctcccactggggttttccagcagccccgtaatgagcaatgcatgtttgtacgacttcgataacgaacttgagaagctgtgcatccaaaatgaacttatctacactaggtattcagacgacatcatcatatcctcccagaatcaggaaaagatcgaacctatagagagtacaatcgagttcatcttgaacaagcatcacaatggccagctcaacctgaataaacagaaaagtaagcacacaagaaagggtaataaggtgaaattgctcggtcttgccattctgccaaacggcaaggttactattgacatcaagatccgtaatgagatcgaagtcctgctgttccactatgtgaacgatcgggataagtttctggaccatgagaagattaaacaagacatgaccaagggggtggatctgctctttggatatctgaactacgtatccactattgacaaaaactacctggagaaacttcgaaagaaatttggagccactgtcatcgatatgttcctgcatcggaccaaaaaaaaagaggatcgccatgccaacaacttttga

SEQ ID NO: 12037 - RNA, 972 nt, unidentified
  source 1..972: mol_type = other RNA; note = synthetic construct
atgaaggataacagtttagagagcgtctttaacgcgtatttcaacaacaagaaaaacttttccgacttctataccttgcgcacagaagaagaggcttctcttatcccgctctcgaagagcaaggtggaattataccggtgttcagagaaactcaaggtgatccatacctttctaagcctcttcatcttcaacgaaatgcccctccggaaagatattgtcttctcatatagaaaggacgtgaatatcacagatgccgttaggccccactgcaatagtgagttcattttcaagaccgatatctccaaattctttaattccatctctgccgaatgtgtttaccacagccttagtaagtattgcgagaacatcaggacagtgaatagtggcgagattcgggagaatatcgagaggattgtctacctgtgcaccattaacaatcatctgcctgttgggttttcgtgttcaccaagcatttccaacttctgtttctatgactatgacaacataatcgatgcctactgcaatgagaacggatacatttactcccgctacgcagatgacctgattatatcaagccaggacgaaatgaataaggacaagattaccgatgatttaacggccatcctgtcttctgacgcttttctgagactttccatcaatcacaagaagaccaagctcatcactaaaaagtttgagcgacagattctgggcatctcaatactgaatgatggaaaaatgacggtgtctaaagcaactaaaacagacattgaggtaaaactgcaccttctgaagactaatagagaaaagctcgtggattacactgggatggaagaaaaaagctccatactgagcatagctggtgtattgagtcaaattaacaatatcgacagcgactatttgtttcatctgcgtaaaaagtacggcaacgcaatcatatctaaactgctaaagggtaaagagttgctgaaatga

SEQ ID NO: 12038 - RNA, 972 nt, unidentified
  source 1..972: mol_type = other RNA; note = synthetic construct
atgaaagataattcacttgagaacgtgttcaactcctacttcaataataagaaagacttcgctgatttccatacccttaggacggaagacgaggcctcgcttattcccctgagcaaatctaaggtcgagttatatcagtgctctgccaggttgaaagttattcacacatttctgtcccgctttgtattttcagagatgccagtacggaaggatatagttttcagctatcagaaagatgtcaacatagccgacgctgtgcgtcctcattgcaacagcgaatttatctttcggactgacattagtaagttcttttcatccatttcggccgaagctgtgtcacacatgctttccaagtattgtgaaaatatcagaacagtcgatgccaaagaggtgcgggaaaacatcgaccgcatcgtgtacctgtgcaccatcgataattgtctgccggtcggctttagctgctcccccagcatttctaacttctgtttctatgattacgacaacatcatcgaggcatactgtaatgagaagggctacatatacagtagatattctgatgacctcatcatatccagtcaggatgaaatggacaaggacactatcacaggggacttaactaccattctctctagtgacgtctttctgaaactgagcatcaaccataagaaaaccaaggtgattaccaagaaatacgagcgaaaaattctcggaattagcatattgaacgacgggaagatgaccgtttctaaggtgacgaagacagacattgaggtgaagctgcacctgctgaaaactgatcgaaagaaactaatggactatacaaagatggatgaaatggcaagtattctgtccatcgcaggagtgttgagccaaatcaacaatatcgataaagactacctcttccacctcagaaagaagtatggtaatgcgatcatctcaaaactaattaggggcaaagagctgttgaagtga

SEQ ID NO: 12039 - RNA, 972 nt, unidentified
  source 1..972: mol_type = other RNA; note = synthetic construct
atgaaaaacaagtccttggagaacgtctttaacgcttacttcaataacaagaaggatttcagcgactttcacaaaattaggaccgaagaggaagcgcatctgatccccctgaaacgcaattccgcagaattgtatcagtgcagcgataaactaaaggctatccataactttctcgcacgattcgtgttctcagaaatgcctgttaggaaggatatcgtgttttcataccggaaagaagtgaacattaccgacgctgtacgaccccactgtgaatctgactacatttacaagacagacatttccaagttctttccatctattagcgctgatgcggtgagcgagaagttaaaaaaatattgcgcccacatctcaacggtcgacgccgaagatgttagagagaatatcggccgtattgtgtacctttgtacgctcaataatcagttacctgtcggatttgccagttccccaagtataagcaacttctgcttctatgattatgacaacctgatcgagagttactgtagagagaagaactatatatactccagatatgcagatgacctcattatatcgagccaatccgagatccataaagagtctatcacagccgacttgtcagtgatcctgacatcagatgcactattacgcctgagcctgaaccacaagaagactaaagtgatcaccaaaaagtatgagcggaaaattctgggcgtgtctatcctcaataatgggaagatgacagtaagcaaaaccactaagaaggatattgaggttaagcttcacctgctccggactgacagagtgaagcttgtcgactacaccggtatggacgagatgagttctatcctgagtatcgccggcgtcctgtcccagataaacaatatcgataaggactacctgtatcatctgaggaggaaatacgggaatgccataatttctaagcttctccgcggaaaagaactgttgaaatga

SEQ ID NO: 12040 - RNA, 972 nt, unidentified
  source 1..972: mol_type = other RNA; note = synthetic construct
atgaaggataatagcctagagagcgtgtttaatagctacttcaacaacaagaagaacttcgctgacttccatactcttcgtactgaggatgaagtgagactgatacctctcagtagggctaaaacagagctctatcagtgttctgcccgcttgaaactgatccacacattcctttcacggtttgtttttagtgaaatgccagtgaggaaagacattgtcttctcttataggaaggaagtcaatatcaccgatgcagttcggccacactgcaattctgagtttatcttcaagacagacatttcgaactttttcccctcgatttccggagacgtggttagcgataaactgtctaagtactgcgcaacgatccgaacggtagacgctgaagaggtgcgcgacaatatcaaaagaatcgtgtttctgtgtaccattggtaacaggctgccgataggatttagttctagccccagtatctctaatttttgcttctacgactatgacaacttaatcgattcctattgtcacaacaacaactacatctatagcagatacgcggatgatctgatcattagttcccagcacgagattagcaaagatactattaccacagacctgaagtccattctctcatcagaccctctgctcaagctgagcattaatcacaagaaaactaaggtcattaccaagaagtacgagcgaaaaatactgggcatatcaatcttgaacgatggcaagatgaccgtgtcaaaggccaccaaaactgacatcgaggtcaagttgcatctgttaaaaacagaccggaataagctggtaaactacaccggtgccgatgaaatgtcttccatcttatccatcgccggcgtgttgtcccagatcaacaatattgaccaagattatctcttccatctacgcaaaaaatacgggaatagcataatttccaagcttcttaaagggaaagatctcctgaagtga

SEQ ID NO: 12041 - RNA, 972 nt, unidentified
  source 1..972: mol_type = other RNA; note = synthetic construct
atgaagaataactctctcgagagcgtattcaatagttacttcaaccacaagaagaactttgacgattttcataacatccgcacagaggaagaagtgcgcctgatccctttatctcggaccaaagcagacctctacaagtgctcagacaggctgaaattgattcacaccttcttgtctcgcttcattttcagcgaaatgccggtccgggaggatatcgttttcagttaccgaaaagaggtgaatatatctgaggctgtgaaacctcattgtaattcagagttcatctttaagaccgatattagcaactttttcccatccatctcttccgaggctgtgtctaacaaactttccaaatactatgactacctgagcacaatcgatattgaagatgtgaagaagaacattgaacggatagtttacttatgtacgttcgataataggcttccaatcggctttagctcatccccctccatttcaaacttttgctttttcgactatgacaacattatcgagtcctactgcaaggacaaaaagtatatatacacgaggtatgccgacgacctcataatcagttcccaacacgaaatactcaaaaaggagatcaccaatgatctgataggtatcctgagttccgaccccctgctgaagctgtctatcaaccataagaagacaaaagtcatcaccaaaaagtatgagcgtaaggtgctgggaatcagtattctaaatgatggcaagatgactgttagcaaggccactaaaaccgatattgaagtcaaactacacttgctgagaactgacagagggaaactgatgaattatacagggatggacgagatgtcgtcaattctgagcattgccggtgtattgagccagatcaacaatatcgatcaggattacctctttcacctcaggaaacgatatggcaatgcgattatttcgaagctccttagaggaaaggaactgcttaaatga

SEQ ID NO: 12042 - RNA, 1008 nt, unidentified
  source 1..1008: mol_type = other RNA; note = synthetic construct
atggacgcagatattgttcttccaattggaggttgtaatgacagaaaaaaaacactggaggccctgttcaacagctactttaactttaaaaaggagttctccgaattcaatagtattcagacaatcaatgaggtggagaagatcgccttgctcaagaacaacaagatcatctacaagtgttcagaccggttaaagtccattcaaagctttctgaacaagttcatattcaacgaaatgccaattcgaaaggacatagtcttttcttatcggaaagacgtgaatattgccgatgctgtgcgccctcatagtcactctaacttcatctataagacagacatatcgaactttttcccttccataaaaccccagattatcaagaataggctgctcaaacacagggataaaatcgaatttatagagcgggaagaaatcgaaaagtattgcgatcgaattatcgatatctgcaccattgatgaccacttacccatcggctttccctcttctccgtcaatcagcaatttttgtttctacgagtacgacagtatcatttccgacttctgcattaaaaactcactgatctacactcgctacgcggacgatctgatcataagcagtactgatgaactggacaaagacaatttgtcccaaaccctggaacagattctccattcggatgatcagcttaggctgaaaattaactacaagaagacgaagctcattacaaaaaagtatgagcgtcaccttttgggcatctctattctggagaacggaaaactgaccataagcaagaaaatgaaaagggatatcgagatcagactacatttgctgaaaaccaaccgcgacaagctggtagactataccaattctaatgagatggactccatactctcaatcgcagggactcttagccagatcaataacattgacaaggatttcctttaccagctcagaaagaagtatggcaatgctatcatcagcaagttactaaaagggaaggatctgctctga

SEQ ID NO: 12043 - RNA, 954 nt, unidentified
  source 1..954: mol_type = other RNA; note = synthetic construct
atgaaaataaaggatgcctttgacttctattacaatggcaagtttaacttcgatctgttttccgatttggtcttctctgatcatgtcaaagaagtgatcctgaataagaagctgtttttcagtgcttctgacgatctcaaagtgatacataacttcctttcgaagttcattttcgacagcttaggagtaagggacgatatcgtgttttcctatagaaagggagtgaacgtctttaactgcatagaaccacacaagttctccaacttcatatataagacggacatcgagtcattttttcctacaattaccaaacccgctattgaagaggcaatcaaaaagtccgtgtgcaacattagctacatcgatcacgaggacatcattaataatctagaccgtatcctggaacttacaaccgtgagtgagcgattgcccgttggttttagctcctccccctcaattagcaacttcattatgtacgatttcgactgtgacatatataagtacactaccgatcacggacttgtttacacacggtactctgacgacattctgatcagctctgataaagaaattgacaagaatgagatgaccagaattatctcggacatcctgtctaagaagaaaggcctcaatttcaagatcaataacaagaagacgaagattatcactaagaaatacgaacgcatcatctttgggatttcaatctctcctgttggcactctgtccgtgtccagtaaactgaagaaagagatcgaggtcaaaatctactatctcctgaacaacagggagaaacttagcatgttttcaaacatggacgaaaaaaatgcgatcctaagcttaagtggcagtctgagctatgtattggggatagatccaggctacgtgaccaagctccgggggaaatatggtaatgccattattaccaagctcttgtcaaataaagaggatctgtga

SEQ ID NO: 12044 - RNA, 954 nt, unidentified
  source 1..954: mol_type = other RNA; note = synthetic construct
atgaagctggaagaagtttttaatttctacttcaacggcaaagagagttttgaacaattctatacactgagcctcaatgaccatatcaaggagttcaatttcaacaacaagaaatgctactccatcagcgacgagttgaaaactatccagcttttcctcagtaagtttatcttcgagaatatcgagtttagaaaggacttagtgtacagttataggaaaggtgtgaatgttgtcgattgtatcagccctcacaggttcaacaattatatatacaagacggacatcgagaattttttccccagtatcggctacgatctgattaagaacaaaatcatcgagaaagtcaaggatatctcatttctggatacaaatgacgtgatggttcacttgtctcgtatcttagaactcgtaactattgacaagaaactgccaattggtttttcatcatcccccgcgataagcaatttcgtaatgtacgatatcgactgtaaaatcgattgcttcgctaagaataacgacctaatttatacccgatatgcagatgacattattctttccggaaaaaacaatctggataagaacagcatcaaccaggaaatcaataacattcttaactacaaccaggacaacatctttcatctcaacgacaagaaaaccaagataattaccaagaagttcgaacggaacattctgggcatctcgatatctcctgtggggacactgtccatatctcggcagcttaagaaagagattgaggtgaagatctttttcctgattaacaacaaggataagttcgtcaagttttcagaaatggatgagatgagcgccattttttctctggccggaaaactgtcttatgctttgggcgtggatccagtgtacataaataagttgcgcagaaaatatgggaactccattattaacaagctcataaagaacaagggggacctatga

SEQ ID NO: 12045 - RNA, 948 nt, unidentified
  source 1..948: mol_type = other RNA; note = synthetic construct
atgaacaaaaatcgattcgaggatgtgtttaaggcatatttcaacgggaaattgaactttagcgatatgcttaacctgaatatcgatgagaatatagagatcctctccctggggaatagagaggttatcaagtgttccgaagacctgaaaaagatacactcgttcttcaacttgtttattttcgactacctagagattcaggcagactcagtgtttagctatagaaaaggagtaaatgttgtcgatgccatccgcccccacgcgaagaacaagttcatctttaaaacggatatcaagaggttctttccaagtatttcacatagtctcatccataactgtattttcagccaaattgagaacattccattcctggatttccccacctacctggatcgtgtgtgcgatctggtcacctataacggtaaactccccgtgggttttagtacttcccctaacatatctaatgccatatttaatccgctggacattaaaatcaaggaatactgctcctataacaagcttacatataccaggtatgctgacgatctcatgattagctcaaacaattacctggacaaagaggactacatcaagatcatctctaacataatcaagctggacgacggccatcacttcaccatcaacattgagaagactaagctgatcaaaaagagcaagaatatggacgtgatgggagtcaaaatacaccctgatggcactttgacaattggaaagaagcttaagaatgaaatcgaaaccaagctatatctcttttcgaaaaatcaggatgactttgtgaaattctctaagcaggaaaaagagtcttccaaggctaaattaacagggcagttaaactacatcaataccattgaccctgactacattgttaagttgaagacgaaatacggcaatagcctggtagaactttttttccggaaagccatttga

SEQ ID NO: 12046 - RNA, 948 nt, unidentified
  source 1..948: mol_type = other RNA; note = synthetic construct
atgaataaatcaaagctggacgagatatttaacgcttactttaatggcaaactcgacttttctgaaatgctgactctcaacatcaccaacaacattaataccatatcggtcggttctcggcaggttgttaagtgttcttctaatctgaaaaggatccattcatttctcaacctgttcattttcgatttgttagagatccagactgattgcgtattctcctataggaaaaacgtcaatgtcgttgacgccattcgacctcactccaacaataaatttatcctgaagaccgacataaagaatttcttccctagtatcacccgcatgagcatatacgagtgtatcaacagacagatcgaagcactaccgttcagtgatctgtgcgattatctggacaaaatatgtgacttggtgacctataatggacacctccccatgggcttctccaccagcccacagatctccaacgccgtgtttaatctaatcgacatcgagattaagtccttttgcatcaagaacaatttgacctatacgagatacgctgatgacattctgatatcaagcaacaattaccttgataaggaagaatacatcgataagctgacaaagattcttagtttcgacgatcatcagtgctttacgatcaacacagaaaaaactaagctcattaagaaggggaaaaataccgacatcatgggtgtaaaaattcaaccagacggaacactgacaattagcaagaaactgaagaatgaggtggagactaagttgtatctgttcagcaaaaatcaggatgactttgtgaaattctctaagcaagataagaaccaaagcaaggcgaaactcactggccagcttaactacattaacacaatcgatcccgactatattgtgaagcttaaatcaaagtacgggaacagtttagtggagctgttctttcgtaaagccatttga

SEQ ID NO: 12047 - RNA, 948 nt, unidentified
  source 1..948: mol_type = other RNA; note = synthetic construct
atggataaatactacctggaacacacttttaatgcttactgcgacggcaaaatcgattttaatgacttcctgaacatcgaactcaaaacaaatattgaggagattaaggtggaaaagcgcgaagtggtcaagtgttctgagaaactcaagcgtatacacagtttcttcaaccagtttatctttgacaacttggagattcaggaggattgtgtattctcctaccggaaaaatgttaatgtactggactgcatcgcgcctcattccaagaacaagttcatcttcaagactgatatacactcattcttccattcgattagcaagaaaaccatccataactgcatttttacccagatagataatcaaccactcagtgacattgaaagctatcttgatcggatttgcaatttagtcacctataaagataggctgcctcaggggttttccaccagtcccgtgctaagcaatgctgtctttaacaactttgacatcaagatcaagaagcattgcaatagaaacaacatgatctacagcaggtatgccgatgatctgctgatctctagcaataattatctcgataaggaggagtgtattcacgacatcgacaacattttaaatagttgtttcgagcagaagttcaaaatcaacacactgaagactaaactgatcaagaaaggaaaaaacatggaagtgatgggcgtgcaaatacacccagacggctccttgtcaataggaaagcgactaaagaatgaaattgagacgaagctgtacctgttcctgaaaaatcagaacgactttgtgtcatactcttctttggataaaaaccacgccatagccagacttagcggtcagttgaactatattaacacaatcgaccccaagtatatcgacaagctcaagtataaatacgggaattcccttgttgacctttttttccgcaaagcaatttga

SEQ ID NO: 12048 - RNA, 951 nt, unidentified
  source 1..951: mol_type = other RNA; note = synthetic construct
atgatttcagagaacaagttcgaaagcatttttaacctctatttcgatggcaagctgaatttcagcgatatgctttcattgaacaaagaaaaagagctgaagcatttaacaatcgagaatcgtgaggttataaagtgttccgaaaaactgaagaagattcaccattttctgaacctatttatcttcgataacctgagcattcagtccgacgtggtgttttcttatcgaaagaatgttaacgtggtcgacgcgataataccacacgctcaaaacaagttcatttttaaaacggacctcaacaacttctttaagtcaatcaaacgctctgaaatctacaataacctaataagtcagactgaccagattcctatcattgacatcgtggattacatcgacttaatatgcgacctcgtcacctatcacgacgaactgccccttggattcagtacatcgccgaacattagtaatgcaattttcaaccagtacgacatcaaaatcaaagaatattgcctgtcgaagaagatcgcctacaccaggtacgctgatgatattctgctgtccagcgataactacatcgacaaaaacgagtatatagagctcctcaataatatcctgaccatcgatggcaaacggatcttttctttgaatagcaagaagacaaagttgatcaaaaagtctaagaacatggagataatgggggtaaaaattctgcccgatggaaagattacggtgtccaaaaagatcaagaatcaagtggagactaaactctatctgttcattaagaaccagtcagactttatcaaatacaccaagagcaacaagattagttctattaacaagcttagcggtcagctgaattatatcaatactatcgatcctgagtacatcgagaaacttaaatccaaatacgggaattccttggtcgaactcttctttagaaaagccatttga

SEQ ID NO: 12049 - RNA, 969 nt, unidentified
  source 1..969: mol_type = other RNA; note = synthetic construct
atggcaggtaacaagagcttcgaaaaaattttcgatgcttacttccaccaaaagatatcgtttgaggagttcaacgaaattgagatagaaaaggagattaagcgaatcaacatcggctctaaaattgtgtatggctgctcgtccaagctgaaaaagattcacagtttcctctctgtctttgtattcgacagggtgtcaatacgggaagacgtcgtttttagctacaggaaaaacaataacgtgcttaacgccatctatccacatgctaaaaggcgcgccatttacaagaccgacattgaatccttcttcccgagcatcagaatggagaacgtcaaagagcagctgaaggagcattgtaaggaatccatcttctttgatctcgaagagcatctggactctatcatcaacgtcattagcgtgaatgatcgtatacccatagggtttcctacatccccaattatatctaacttcgctttcatccggtttgataacgagatttcctcttactgcaaaaaacggcgatatatttacacgagatatgccgacgatatcctgatctcaagcgacgattttttagacaaggaagagctcaccaaggatatcaatgagattttcaagaagcttcacagcgactataagctgaatatccctaagaccaaaatcctaacaaaaggaagacccagaatcatttttggggtgagcatttttcccgatggtaaactctctgtgagtcgcaagctgaaaaatgagatcgaggtaaagttatacttgtacctgaaagacaagaaggaattcctgtcctacagtaaagccaatactatggaaggcgcgatcgttaatttgagtgggatcctaaattatgtgaacactgttgacaagacctacttgaataaacttaagtcaaagtacggagcatcagtggtcggactgttttttcgcaaaacaatcgagaacgaatataggaattga

SEQ ID NO: 12050 - RNA, 951 nt, unidentified
  source 1..951: mol_type = other RNA; note = synthetic construct
atgtctgttcaaatcaaggacatcttcgatatctatttcaataactccatggagttcaatgaattgatacacctcaacaaagacgactatctcgagcttaaaacatacaagggtaaggaaatcatagcgtataaaaagggattcaacaagctgaaacttctccaccgatttctgaatgaggctgtctttaataggatagagataatgaacgacgtggtgtttagttataggaaaggggtaaatgtcttgaattgtgtaatgccacataggaattcgaatttcatattcaagacggacattaacaacttctttcctagttttagctccaaattcattgaggtgaaactgatcaacaagttcaacaacttcattatcagtgacattaaccagtacttacccgaaatcgttgacatcgtgacttataacaatactctgccaattggcctgagcacatccccttcattaagcaatatccttttcagcgacattgatttcaagatcaaacttttcagcaacgaaaacgagtattattacacaagatacgccgacgatatcattatttcgtcgaatcgcgacattaataaaaacaccatcttcgatgacttgcagcagattctgacctccgagaatgataacttcattctcaacaagtcaaagaccaagctgctccgtaaggggaatctacggaagattatgggcgtgtgcatcatgcccgatggccatatcaccgtcgataagaagctgaagaataacattgagacgaaactgtactacatgagcaaactaaacaacattcactccaaagattctgaaacaaccgagataaagagatacctgtcaggaatcatcaattacgtttccactatcgataacagctacatcaataaactgaaacgcaaatacggttctaccatagtggaaatgtttatccggaagtctttgattaagtga

SEQ ID NO: 12051 - RNA, 951 nt, unidentified
  source 1..951: mol_type = other RNA; note = synthetic construct
atgtccatcaagattaaggagatcttcgacatctacttcaacaactcaatggactttaacgatttcttcaacctcaataagatggagtatctcgagaagaagatttttagaggccgcgaaattgtggcatataagaaggggtttaataaacttcggcttctgcaccgatttctgaatgaagctatttttaacagggtggatattatggatgatgtggtgttttcttatcggaaaaaagtgaacgtctttgattgtgtctaccctcatagggccaatccgttcattttcaagaccgacattaagaacttctttccaagcttcaatcgtgattttatcgagtctaaactggagtctgttttcaaagagttcataataagcgacatcaatgagtacttgttcaaaatcgtagaactggtgagttacaatgatttcctgcccgtcggctttagtacatctccctccttatctaatatcctgtttagcgacgccgacaaaaagctaaaatcattctcgatctccaatgggtacatctacactaggtacagcgacgacattatcatttcgtccgaaagtgaaattcacaagaaggacattttcacaacagtgcaaggaatcataaattccgaatgcgattcatttgttctgaacttcgacaaaactaagttgttgaaaaagggaggagttcgcaaaataatgggtgtaagcattatgccagacggctatatcagcgtggataaaaccatcaaaaataacatcgagacgaagctacactatatttctaagctcaacaacgtcaatagccaggaacctgagttaatcgagataaaacggtatctttccggcatgatcaactacattagtaccatagatgacggttacatcaacaagctgaagagaaagtatgggtccaccatcgtggaaatgtttctgagaaagtcactcgtcaaatga

SEQ ID NO: 12052 - RNA, 957 nt, unidentified
  source 1..957: mol_type = other RNA; note = synthetic construct
atgaaagatcgtaaacctaacttgaagttcttctttgagtcatacttcaataagaaggtaagctttgacgcctttgaaaacatctctattgagaagaactaccatattcagtgcattaacaagagggaaatatatgtgccatccaatgaactgaaactgatcttatccttcttcagtgactttattttcaagctcctgccaatcgaaggggatgtggcctttgcgtatcgaaaaggaatcaacgttaaagactgtctcctgcctcacgtgaattcgaaattcttctataagaccgacatcatcaattttttcccttctatctcaagctacctcattagggagaacatttacgaggacattctgaaactgtcctacttgaagaaggatgatgtcgacttttatctggacaagattcttagcctcgtcaccatcgatgacaaactacccataggctttccaacaagtccctttatctcaaattatgtgatgcgcaagtacgatcttatgttgaagtacttctgcaatatgaacggatttgtgtataccagatacagtgatgacatcatcatttctagcaatatgaacatctccaaagatttcataaccagaaacatcgatggcatatttaggaaggagaaaagccccttctacttgaataaaagcaagactaagatcttcacgaagaagcacaaagttaaaatactcgggcttactatcaataatggcgagatctctatagaccgggaaattaagaacaacattgagattgggatctatttcttcattaacaatcgggagaagttcatcaattatttcggactgaatgaactttcagccaagaagaaactagctggtaacctctcctatgctatcaacacagaaccggactacctgctgaaattagtgaagaaatacggtagttccacaataaaagagattctgcgcgcatctgtctga

SEQ ID NO: 12053 - RNA, 957 nt, unidentified
  source 1..957: mol_type = other RNA; note = synthetic construct
atgaaggatagaaaacacaatctgaaattcctgtttgagagctacttcaataagaagatctcctttgacatattcgagaacatttccatagaagagtcatatgacaaactgtgcaagaacaaaagagagatttacattcccaactacgagttgaagctggttctttctttcctcagccacttcatttttaagtctcttcccattgaagatgacgtcgccttcgcatataggcggggtattaatgttaaagactgtcttctcccgcacgcgaattccaaatttttttacaagaccgacatcctcaatttttttccttcaatcagtagctctctgattaaggaaaacatctatcaggacattcataagttgtcttacctggaccaagaggatttagctttgtatctcgacaaaatccttagcttagtgaccgtggatgacaaactgcctgtgggctttccaaccagtccatttatctcaaactacatcatgcgtaagtatgatgtgtcgattaagtctttctgcagcaacaacaaatttatctatacaaggtactccgacgacatcataatcagtagcaatactgatatagacaaggactacatcactaataacattgagaaggtcttccaacagggcgaaaatctgttccatctgaacaactcaaaaacgaaggtcttcaccaaaaagaataagatcaaaatgctcggactaatcatcaataataaccagattagcgtggatcggaaggtgaaagatgaaattgaggtagggatccattttttcataaaggatcgcctgaagttcattaactttttcaacgattccgaactcagtgctaaacgaaaattggccggaaatatttcctatgccatcaatatagaacccgattacctgcagaaactggcaaagaaatacgggctgctcacaatcaaggagatcctaaaggtaaacttatga

SEQ ID NO: 12054 - RNA, 957 nt, unidentified
  source 1..957: mol_type = other RNA; note = synthetic construct
atgaaagaccggaaaccgaatctgaaatttctgtttgagagctactttaacaagaaagtgtccttcgatatcttcgaaaatatcagcattgagaagtcgtactataaaatatgcaaggaccagaaggacatttatattcctaatgacgaactcaagttgatcttgtcttttctgagtcactttatctttaagagcctgcccatagagaatgatgtggcctttgcttatagaaaaggcatcaatgtaaaggactgtctactcccccatgttaatagcaactttttctacaagacggatattatcaacttctttcctagcatctctacctcattaatcaaagagaatttgcaccaggacattagtaaactgagttacctggatcaagaaaacctcatgttctatcttgataagattctctcactagtgaccatcgacgacaaactgcctattggttttccaactagcccattcatctccaattatatcatgaggaagtacgacataaacattaagtccttttgcaacaacaacaacttcatatataccagatactccgatgatatcataatttcctctaatgacgacattgataaggactatataacctccaacatcaaaagtatcctgcagcaggaatatagccccttctacttgaacaattcgaagactaagattttcacgaagaagaacaagatcaagattctcggactgacaattaacaatcaagaaatctctgtggatcgtaaaattaaagacgaaattgaggtcggcatctacttcttcacaaaggataggttaaagttcatcgattacttctctgacaacgagctttcagccaaacgaaaacttgctggaaatatatcttacgcaattaacatcgagccagattacctgcagaagctggcgcgcaaatatgggctgtcaacaatcaaggagatccttaaagtcaatctctga

SEQ ID NO: 12055 - RNA, 996 nt, unidentified
  source 1..996: mol_type = other RNA; note = synthetic construct
atggccaacctgaacccccccatctatcgaaataatactcacagttcttctcgaaagttcagtgagctttttgattcctatttctacggaaagtactccttcgacgacttccttagcattgatatatcgaaagagacgaaaaagatccaacttaaggacaacaagataatctatagctgctccggaaagctgaagaatattcacaggttcattaacatcttcatcatcaacaagttgtgtatcaaagaggatattgtgttttcatacagagccgggaaaaacgttgtagacaccattctccctcattctgaaaacaagttttttctgcagaccgatatttacaactttttccctagcattagcatcaatctcatcaaagagactatcctgcggggtatctccaatttagaaatcacagacattgacgattacgtggattacattctgaagctgataaccatagataattcattgcccattggtttctcttcatccccgccaatgagtaattcttgtctgtacgatatcgacaacaagatatcaatttactgcgaacagaagcgtatgaaatatacccggtatgcggacgacctcatcatttcatctatgaacttgttcgacgttaaccatgtcaaaaattcgatcgctaaaatactgaatgagcagaaaaatgcatcctttatcttgaacgaacgcaaaacaaagttttttagcaaaagccagaagatcaaaatgctgggggtcgtaatcctgccaaccggcagagtgacagtcgatattaagatgaaaaagaaggtggaaagcatgatttatttctatctcaacgacaaagacaagctcctggatctaagtggcttaaattacgaggatactctcaagaacattagcggactactgaatcacatcaatacgatagataagaagtacctggacaaacttaggatgaagtatggcaacacagtggtggacatgtttttccataaatccgttaaatga

SEQ ID NO: 12056 - RNA, 936 nt, unidentified
  source 1..936: mol_type = other RNA; note = synthetic construct
atgaagaaaaaggagctgaagttaatattcaacctcatgtaccacggaaaatacgacttcaatgacttgataaactgtaacatcgagaaagagtacatcaagattaagatcaagaagagggtcatctataaagcctcgaataagctaaaaaactaccactctttcctgaacttgataattttcaactaccttgatgtggacaaagacgtcgttttttcctatcgcagaggcgtgaatacagttgacgctgtgcgtccccatgttaattcctgctttttctaccagacggatatcaaaaatttctttcccagcctgaaaaaggatctcattaagaagacaatcatcaactgtaaggattcaatccctgtcatcgacattgaaaaatacatcgatcgaattgttgaccttgtgaccattgacggtgtgttatctaccggctattccacctccccaataattagcaatgcatgcctattcaactttgacaacgaaataaagaggaagctggcgaacaataacgtgatctattctagatatagcgacgatatcatcattagcagtaacgagaacattatcgtggacgatatgaataaaatcatccttctcgccctgaagaataatgtctctcctgacatcgagattaacaagaataagacaaaactgtccaagaaagggtgcaagatcaaaattctgggcatggtaataacttccgatagcgtcattactgtggacaataaatataaacgggaagtggaatacttgctctacctctacatccgcgataaaaaccggtttaagagcatcggaaaaagtataagtcaggtgtcaggtgtactgaattatattcaaaccattgatccagagtacattaagaagctgaaaaagaagtatgggtcaactattgtggatgtatttctgcatcagtcaatgaagtga

SEQ ID NO: 12057 - RNA, 984 nt, unidentified
  source 1..984: mol_type = other RNA; note = synthetic construct
atgcacaaaaaagagctcgaaaacattttcaactcctatttccacaaccaatataacttccaggactttctgaacataatcccgaaacagaacattcactacaagttcaataagtacaagaactacaagttcatctcctacattaaagagaataacagcttcagtaaggacagcatgaaaatgagagaataccacactttcattaagaacatcttctgcaactacatgaaagttcacgctgccgtattttcctatcgaaagcatatcaacatctacgacctcgcgaaaatacacaatgaacaccagaacttctttactacagacattaagtccttcttctactctatttcaacccaaatgattcacgaggtcttgattcagaataaggtcaattttccctttgagctggatgtgaagtactacaaaaacatcgtaaacatcacgaccgtgaataattctttgcccgttggctacgtgaccagtccatcgatttcaaacgccatcttatataagtttgacgagctgatggataattatagccaggagcatagtattagctattcacgctattctgatgacctgatattcagcagtgatgactataatgctattaagtccttgcctgcagtgatcgagtcaacactgaattctctgtactcctctgcctttaaacttaatatcagcaagacacggttttttgataaaaccgaaaaggtcagctttctaggaatcagcatcctccctaatggacatataacggtggagaaatggacaaaggaaaacatatcgcaactgatctatttctacctgaacgataagaacaagtttaccgtgttacttcagaagcggtttaagaataatctttcccgtgcatatgggactctcaattatatcaacgacattgacaagcagtttatcctaaaactgaggaagaaatacggtaacttcatagtggataaattcctccatggcgttaaacattga

SEQ ID NO: 12058 - RNA, 954 nt, unidentified
  source 1..954: mol_type = other RNA; note = synthetic construct
atgttccaggagaaacatagcttggaaatgctgttcaacgcaatgtaccacgggaagtatagctatcaggactttatctcctccaatattgagaactacatccaacacattaacaataagatcgtcaagaccaacaaaacttttcaggtctatcatagtttcctgaacctgttccttttcgactatcttccaattaatgagaacgttgtgttttcttacagaaaaggcgtgaacatttatgatttactcattgttcaccggaactcaaagttcttctttcagacagacttgaagtacttttttccgagcatcacatccgaggatatcaagaagctcattgaaaagaacatcgatatgtttcccgtcgtgaagaaggatatagagactcatatagacagaatcatcagtctgactacaatcaacaattatctggccgtgggatactcgacctctcccaatctgtcaaattccattctattcgacttcgacaattctctgagcgatttttgccagaagctgaatattaagtacactcgatattcagacgacctgatcttttcttccctcgacaaggaaaatctgcaaaaggtagaaatagagattcgcaggcttctcaaaatattatttggcgggcggatccagctcaacaccaaaaaatccaaatacaaccaccagggcaacaaagtgaagatactaggagccattatccttcctaatgggcagatcagtgtggataagaaaatcaagaccaagattgaaaccgctatctacttatatctcaatgatcgcaacaaattcgatgacttcttggagaagaattataggaaaggtgtaaaccagatttcaggaaccctgaattacattaaaacgatcgattacgactacctgaaaaagctgaagaaaaaatacggcagcacagttatcaacatgttcttgaatcaaagcataggttga

SEQ ID NO: 12059 - RNA, 975 nt, unidentified
  source 1..975: mol_type = other RNA; note = synthetic construct
atgatccagcgaactttcaagcaggcattcaatgccgtgtttcacgaaaaggagaattttgaggaatttctggcgcttgatattgagaatgaggtggagaagatttccgtcgaaaacaagattaaaaagcagcaccgcttgttttttcgccaaagcgagaaattgaaaaaatacctgcgattcgttgaccgtgtgatcctgaggaatctggccaaagacaacgacgtcgttcatagtttcaccaaggataagtcaacccttaccgccgtgagcgctcactctaacaatgattacttcttccagaccgacatttcctccttctattcttccataactaaagacgacgtccttcggatattaaagagggacataaatctcatccctatcatcgacttgtcagattatatcgattttctcgtgagcataatgacttacgatggagttctgcccgtaggattttcaacgtctccccagatctcaaacgcttttctgtttgagttcgatggtgaactgaacgaaatttgccgcagacggaacatcatttatacaaggtacgcagacgacatcatcttgagtggcatggatttagaacatctcaaggacatgtcgagtgtgattgacagcttgatcctcaaactcttcagcgggcagataacacttaacaagggtaagactaagctgacctggaaggggaacaaagtaaaaattctaggccttacgatcctaccaaatggcgtcgtgactattgacaaaaagtacaaaaacaccatcgagacactgttacacctgtatacaaccgatatcgaccggtttgaaaaacacctctctgtgacagacggattcaacaagagatctctgttcggcctgctccattatgccaatagtattgatccgcaatacatttccaagctgcaaagaaagtatgggagcctggctgtctacaaactgatggaggattcccagaatgatgattga

SEQ ID NO: 12060 - RNA, 975 nt, unidentified
  source 1..975: mol_type = other RNA; note = synthetic construct
atgaccaaacgaacatttaggcaggcttttaatgcagtcttccatgacaaggaggctttcgaggatttcctgagcatcgatatagggaacgagatagaaagagtggtgatacttaacaaactgaagaagcaacaacgcgtaatcttcaaacagagtgatagacttcgcaagtacttaagattcgtggatcgggtgattctgcggtccttggcccgcaatgatgatgttgttcactcttttacgaaagacaaaagtaccctgaccgccgtgattgcccacgcaaaaaatgacttcttctttcagacggatatttcctccttctattcatccatcactcgaaatgatgtcctcatgcttttgaaaagggatgttgatctggtcccaatctctgatctgtcagactatttggagtttctcgcgtccgtgatgacatacgataacaccctgccgattggtttttcaacatcgcctcagatcagcaacgcctttttatttgagttcgacaggcagctcaacgacatctgccgtgagagagaaattatctatactcggtacgctgacgacattattctgagtagcatgactctcaacgtgttggaagacatgtctcatgtcatcgattctctactgagcgaactatttctgggcaacatcagtctgaacagagacaagacaaaattgattcgcaagggaaataagatcaaaatactcggtctgaccattctgcccaatggggtggtgaccatcgaccgtaagcacaagaacactatagaaaccctgctctacctttacacaactgacatcgagaggtttcatgagcacctgtctattatggacggcttcaatcagaggtcacttttcggcctactccactatgcaaatagcgtagacccccactacatctccaagttacaacggaagtatggagccctggctgtccataagctcatggaagacagccagaacgacgattga

SEQ ID NO: 12061 - RNA, 957 nt, unidentified
  source 1..957: mol_type = other RNA; note = synthetic construct
atgaaaaaacgcacacttgagcaggctttcaatgcagttttccacgagaaagagcagtttcaggatttcctgaaaatcgacctagaactggaagtcgagttgatcaatgtcaaggaccgggtggtcgttagacagagcgataaacttaaaaagtatctgcgatttgtggacagaactattttacgatcattagccaaggatgacgaagtcgtacactctttcattaaagagaagagtactctcactgccgtacaggcccatgtggaatcgaagtactactttctggctgacattaaggaattctatcagtctatcaagagaaaggacgtggtgaacattctagagcggaatcaggccgagatacctatagaggatatcgtcgaatacatcgactacctgtcatacgtgaccacctacaaagatacactgccaatcggtctgtccaccagcccgcaactgagtaacgcgtttctgttcgactttgaccgtgaggtgaaagcgtactgcattgaaaactcactgatatatacgcggtatgcagatgacatcattataagcggcgataacatggatgtgattgcaatgttgtccgataggatccaaggtatgttacaactttatggctctagctgtttcaccctgaaggaaagcaaaacacgcatcacatggaaaggaaacaaggttaagatcctggggcttgttatcctccccaatgggcgcatcaccatcgataagaagtacaagaagattattgaggctctcctctacttctattcttccgataagtctgagtaccagtcactgcttagtaaagtgatgcatggggatgaaaagtccctgtttggactcttgcactatgccaattccgtggaccccttgtatattaacaaattgcagaggaagtacggcgccctcagtctccatgctctgatggagagcgacagggacgacaattga

SEQ ID NO: 12062 - RNA, 987 nt, unidentified
  source 1..987: mol_type = other RNA; note = synthetic construct
atgacccacgaagccgattctaaccaaaccaaaaaaaaaaccctggaacaggctttcaacaccatcttccatgataaggaggatttttccgaattctgtagcttagacgttataagtgaagtagaaccattcaccatttctgacagggaagtgttcaaaacatcagatcggctgaagaggtacctgagatttattgaccgcattatattgcggcacttgtccattgatactgacgtcgttcattctttctcccaagagaaaaacacatacacagcagtcaaagagcatgtcggcaatgactattttttcttgacggacattgagtcttttttcagcaaaatcaagacagaggacgtgaagaagatcctctaccgaaatatcaacaatattcccatctctgacattgagaactacatcgattttctgtcatcagtggtaagctttaataatcagctccctgttggcttctcaacgtccccacggcttagcaactccttcctgtatgattttgacatcgccctaaaaacttattgcagtcgcgaatccctcacttacacccgctatgcggatgatgtgattatcagcggagcttcattcgagaagctagagcggctgaaaacaaccatccaggacttcctgaagattcacgcaagcaatgagctccgattaaacaagagtaagactagaatcactcatcttgggaataaagtgaagatcttaggcctgatgatccttcccaaccgtacaattaccatagatgccaagtacaaaagcaggctcgagcttttgctgcacttttacagtaacaacaaagagaagtatcagtcgtatctggaagagaattttaatggttctgagaagtccgtgtttggaatgctgcactacgtgcagagcatagaccctgattacctggacaagctccagagaaagtatgggatctacgccgtcaggtttttcatggaaaagaagagtaacgacaatagatga

SEQ ID NO: 12063 - RNA, 960 nt, unidentified
  source 1..960: mol_type = other RNA; note = synthetic construct
atgacaaaaagaacatttgaacaggcctttaatgcgatctttcacgactccaaggccttcgtggacttctgcggactggacgtcgccagcgaagtagaaacattcaccgtctctggccgcgagattttcaagacatcggacaaattcaagaagtacctccgctttattgatcgggtgatactgagacatctggcaaaagataagaacgtcgtgcattcctttaccaaagataaaaacacgttcactgcagtcagggctcatacggatagcaattatttctttctcacggacattcggaatttctactctaacatcaagatcaccgacgtgctccgaatcctggagagggataaagaacgaatccccatatccgatatcgactcctacatcaatctgctcgctagcctcatgactttcaacggctcagtgccggtcggatttagcacttcacctcagctgtctaatggttttttgttcgagttcgattgcgccgtgcgggagttctgtgagagcaatgttctgacatatacacggtacgcagacgacatcataatttcaggcaagtcttttgaggaacttagtgatttaaaggagatcatccagaccttcctgaacaagtatgctagtagtactctgctgcttaacgaggaaaaaacccgcattacccacctaggaaataaggttaaaatactgggtttgtccattctgccaaacaggaaggttaccattgatactaagtataagaagaagctcgaactcctgttgcacttctatgtaactgacgagagtaaatacaagagctttctagaagaggagttcaaagggagcgagaaatcactttttgggatgttacactacgtgcagtccattgatcccgactatttagagaagttgcaaaggaaatacggggtgtttgcccttcgtaccctgatggaagaaagatggaacgagtctagatga

SEQ ID NO: 12064 - RNA, 981 nt, unidentified
  source 1..981: mol_type = other RNA; note = synthetic construct
atgaccggcaagagacgttggcaagtagggaagaggaattttgaacaggccttcaatgctgtgtttcatgacaaacaggccttcaacgatttttgcagtctggatgttcgctcggaaatcgaaacctttgttattaactctcgcaccatctacagaacgtcgaaaaagtttaagaaatacctccggttcattgataaggtcattttgagacacctagacaagaatgaacaagtggttcatagctatctcaaagaaaaatcagtcctgaccgccgtgaaagcgcactccagctcaaaatgcttctttctgacggacattaaagatttcttcacaagcgtgaagactcagaacgtgttgcaccttttaacacgcgataagcttcgaattcccatcacagacttcgagcggtatatcgagactattgtgaatctgaccactttcgctggtagtattcctgtcggattcccgaccagcccaagcctgagtaactcatttctgctcgagtttgatgcagtgctcgagaagtattgttgtgaacacggattcatatacacaaggtatagcgacgacatcataatctccggcaaatcttttgagggttttgacaacctggaaaacgatgttcagagcatgctgtataagtctgcatccgaggacttctttctcaatactaagaagacaaggttaacacagatcggaaataaagtcaagatccttggcctagtgataaccctggggggctccgtgactatagactccaagtataagaaaactcttgagtccctgctgcacttctacatcaacgacaaggagaaatataaagatttgctcgagcgaaccctccacggaaaagaacattcactgttcgggttagtccattacgtaaagtctatcgatcaggcttacctggagaagcttcagcggaagtacggcgcatacgccttgagtgccctgatggaggacaggtggtctgataaatga

SEQ ID NO: 12065 - RNA, 972 nt, unidentified
  source 1..972: mol_type = other RNA; note = synthetic construct
atgcgctggcaggtatcaaaacggacatttgagcaggccttcaatgccgtgtttcatgataaagtcgcctttgaagatttctgtacaataaacgtgcaggaggaagtggaagagtttttctatgacgatcgaaaaatcttcaggacatctaagaagctcaagaagtatctcaggtttattgaccgggtgatcttgaggcacctcgctaacgacgacgaggttgtgcattccttcattaagggcaagtcaactttgacagcagtcaaggctcacacaagctcgaagtacttttttatcactgacatcaaggacttcttctccaatgtaaaaaccattgatgttctcagaatccttgagagggataagtacctggtccccatagatgatttcgagaactacattgacactattgttagcatgactactctggggggttccatcccaataggcttcccgacaagcccacaactgtctaacgcttttctgtttgagtttgatcgcaagaccaagtttttctgcgcggacaatagcctgatttatacccgttatgcagatgacattattatcagcggccaagaattcaatgatgtagccggtctaaagagtcagattcagttactgctgagtgaacacgtgagtcctaacctgtccctcaatcaggacaagacccatataacccagatcggaaacaaagtcaaactgctcggactggtgatcatgcctaatggccgagtgacgatcgacgttaaatacaaaaatcggttggagacgttactgcacttctacgtgaacgataaggacaagttcaacgacctgcttaaaaagaccatgaaggggaacgtcaaatctctcttcggacttttgcactatgcaaaatctatcgatcccgaatacctagagaaattacaacgcaaatacggggtgtataccatcagactgctgatggaagacaaactttcagacaatagatga

SEQ ID NO: 12066 - RNA, 954 nt, unidentified
  source 1..954: mol_type = other RNA; note = synthetic construct
atgtcgaagaggacactcgagcaagcgttcaatgctgtgttccatgagaaagaaagttttaacgacttctgtgcaatgaatcatagccaggaagtactgagctttagcgccaacagtagagatttatttcatccttctcccaaactcaagaagtacctgcgtttcatcgataaggtgatcctgagatacctggaaagggacgatgtcgttgtacactcatacattaaagggaagtccgctctgaccgcagttgaagcacacgccgggtcatctcacttctttatgactgacatcaaggccttcttctccaacataactgacgtcgatgtgagggagatcctgacacgcaacgaaggaaatgtgcctattagtgacattaaagagcacatctccctactcgtcgagatgatgacctggcagggatccctaccggtgggctttccaacatccccccagctgtcaaatgcttttttactgcgttttgatcagaagctccaccgatactgcgagggccggggttatacctatacgcgctactcagacgatattgtcatttctgccaaatcgtttgacggatttgagcacctcagcgaaaccatacaactgctgctcaataccgctgtgtcccccttgcttagactttctgacgataaaacacggtatacccataccggcaacaaggtgaagatcctggggttagttgttactcaggggggcaaggtgacgatagacagcaagtacaagagacagcttgagacattgcttcatttctatgtgactgaccgggaacgattcggtcgcgtggtcgatgagactttggccggtaaagagcactctctgttcggcttgctgcactatgcgaggagcatcgacccaagttacctcgaaaagcttcagcggaaatatggagcctacgcactgcgcagcttgatggaggataaatggcatggctga

SEQ ID NO: 12067 - RNA, 1017 nt, unidentified
  source 1..1017: mol_type = other RNA; note = synthetic construct
atgtggttcgtgatcttaacaagacaggactacttctatttctccggaaacctcaaagtcgataatcggacattgcagcaggccttcaatgccgtttttcacaataaggaatctttcagtgagttttgctcactggaacagaggaaacatatcgtcgagtttctatataggggaagaaaggtatacaaaacttccgcccagtataagcactaccttaggtttctcgaaaaggtggtgctgaggcacctcgccaccaatgccaatgtcgttcacagctacatcaaaggcaagagtgctttaacagccgtgaccacccactctgaaaacagcgcattcttcctgacggacatcaagtccttcttccccaatattacagagcttaacgtaaagcacgtcttgaatcgagataaaaatctggtgcccatttcggactttgaacacttcataccttatttggccaaaatcatgacctgggatgacagcattccagcgggctttcccacaagcccgcaactatctaacggctttctttttgactttgacaatgctctttacgatttctgcaaaactaatgaactgacctacactcgctattccgatgacataatcatatcaggaaagtacaaggacaagctgctgtgtctgaaggatactgttcaagatctgctgcataactacgctagcaagaacttcttcattaacaacgagaaaacacgaatcacccatgcagggaacaaggtgaagattctggggctgatcattactcctaagggtcgggtgacgattgatagtaagtacaaacggaccatcgagtccctgctccatttctacaccaatgatcggtcacgctataacgacctgctccagaacgagtttgatgggaaagagcattcactctttggtttgttgcactatgcaaaggcgactgacccagcatatctcgagaaacttcagcgtaaatacggcttactcgctctgcgccaactaatggaggacagatggaacggctctagatga

SEQ ID NO: 12068 - RNA, 1008 nt, unidentified
  source 1..1008: mol_type = other RNA; note = synthetic construct
atgtccattaattccttgaagtcagaaggcgacgaggttagtgttaccgaccggtcgctggagcaggccttcaatgctgtctttcatgatcgcgagagctttaatgatttctgcactttgccgctcgctccagaggtttcagaaattcctctgcatttaaggaaagtgtataggccatccgacaagctgaagacttacctgcggtttatcgacaaggtggtgcttagacatttgaagtataacgcttccgtggtccactcatacataaaaggcagcagtgccttgacagcagttcaggcacacgcgaagaatcaggccttcttcctgtctgacattaaatcctttttccccaatatcggcgatcaggacgtaaggaaagtgttaatgcgtgattctcacagaattcccatccttgatttcgatcagcacatagaacgcgtaacaaagctgatgaccctggacggggtcctgcctgtcggatttcccactagtcctaaacttagcaatgggttcctgcatgagttcgacaacgccctagcagcctactgcgacagcaccggtctgacgtacacgaggtatagcgacgatatcatcatctctggaatggatcgagcgaagctgaccgtgctgcgagagaaagtgcagatgatgctcgaagaacacgcctccaagagtctgaggctcaacgatgaaaagactcgtgtgacccacagagggaacaaagtgaagattttggggttagtcataaccccagatggccaagtcaccatcgacgtgtctcgcaaacacgctctggagggcctcctacatttctacgccacagacactgagaaatacaagaacctcctagagaagacatttaaaggagaagacaaggaaagatctctttttggaatgctgcactatgcaaactcatgtgatagcgagtatctggtgaaactccaaaaaaagtacggtgtactcattctccggacacttatggaggatcggtggagcggtaaccgctga

SEQ ID NO: 12069 - RNA, 963 nt, unidentified
  source 1..963: mol_type = other RNA; note = synthetic construct
atgcacctgaaatccttggagaaggcctttaacaccatgttccataacccgcagcttttcgaagagttcctgtgctccgatttgtccaacgaggttgaagagttttacatagggaaggaaaaaccacgcaaggttatccgagtgagtgacaagtttaagacgttcctgaggttcatagataaagtcatcctgcagcatctcaagatcaatgagggagtcgtgcactcatacatcaaagagaaatctgctatgtccgccgtgcagagccatgtaaacggcaaatattttcttgtgagtgacatcgtgtctttcttcagtaacgtgagctctgaagacgtgaaaaagatattagtggccaacgtgtctaatatacccatcgaggatatcgaagactatattccacgcatcgtcacactggtttgttggaatgattgccttcccgtaggcttcgtgacctcacccaaattgtcaaacgcggccctctttcagtttgattccgcaatggccgattattgtaagaaacagagtctgacctatacccggtattcggacgatctgattgtctctagccaggcaagagaacctctaattgaattacagacccagctccagtcactaatttcccagaatacgaatggtcaactggaagtcaatctggacaagacaaagatctacacaatcgggcagccttttacaatcctggggttggtgattactcagtaccaaactcttactattagcagaaagcataagaaccacctcgaggtagctctccactatttcgtcactgacaaactgaggttcaaggattatctggaggagcactttgctggcaaggagcaaagcttatttggattgctccactacgcaaaaagcgttgaacctcgttacattaataaactccaacggaagtacggtgcctacgctattaccgacctgctggagaataagtggaacgactga

SEQ ID NO: 12070 - RNA, 966 nt, unidentified
  source 1..966: mol_type = other RNA; note = synthetic construct
atgactcagaccagcctgcagaatgcgtttgtgtcctattttcacacaaggtatcagtttgatgactttctgtctatactgactaacgaacattacacagagatcttttactcaaagaacaccttctctccctccaagaaactcaaggatttccagaagttccttaacttgtttctattcgagcttctgccgctgaatcaagatgtcgtttttagctaccgcaaaggcgtgaatgctcaggacgctatctcccctcacaagaactcaaaatacgtactaaatacggacattaagtcgtttttcgcaaacattaacacgagcaaacttaagaagttaatcttggacaacaagaacaatttcctcattttgccctccgatatcgagaaacacatcgacactataatgaacatcgttacctataactcgattctccctgtgggcgctcctacatctccagccatctctaatggttatctctttgacctcgattccgccctgcagtcctactgcttacggaatgagatcatctacacacggtatagtgacgacttcatttttagttctgaaactaaggagagcttgaccaaggtcctgcccattatcaacgatatgttcatacacttaggattcgagacttttaccctgaatgaatcaaaaacccgaattcagcaaagaggttctaagatcgccctcctgggcctgattataacaccacaaggatatgttaccgtagacaaaaatctgaagaaagaagtggagattcttcttcatttctacttgaccgacaaagaaaaattccgtgattacttcctgaagaaattcagcagtaatattgacaaggtgagtgggctcctgagccatatcaatgccgtggatagctactatatcgcaaagctgaaaaagaggtacgggtcatttatagtcaactccttcactcatagagatatccacaacgtgacattctga

SEQ ID NO: 12071 - RNA, 960 nt, unidentified
  source 1..960: mol_type = other RNA; note = synthetic construct
atgaataaaacaagtctcgaaactgcctttaattcctatttccacaataagcattccttccaggattttctgaacataaacatcaacaacgagtacacacagatattctattccaaaaacaccttctccccaagtaagaagctgaagcagttccagcagtttcttaacctgtttatctttgatcatctgaacatcaacaaggatgtggtgttttcttataggaaaggggtgtctacgatcgatgcaataaagccccacaagaataagaaattcatctacactacggacattcaatcgttcttcacacacattgagactgaaaaaatcaagcacattatcctcgagaataagaacaactatatcattatcgaggaggacatagagaagtacatcgacaatattctcagcttagttacctacaagaatgtgttgcctattggagctcctacttctccaaaaatctctaatgcctatttgcttcggcttgacaatctggtccaggagtactgcgaaaaaaacgagatcattttcactaggtacagtgatgatttcatttttagctccgatagcaaagaaaagctgatcaatctggacgataccctcgaagactttctgaagcagagtgaatatctcaatctaaccatcaatcgcaagaaaaccaaactgcaacgtcagggctcaaacattacactgttaggactaacaataaccccccaagggcatatcaccgttaacaagaagattaaaaacgatctggagattcttctccacttttacctgacagacaagtcaaagtttaatgacgtattcgagtctaactatagcagcaaaatagaaaaggtgtcgggcatcattagccatatcaactcaattgacaaaacctacatctccaaattgcgaaaaaagtacggttcatacatcgtcaatagcttcatacacagagacatttcttatgaatga

SEQ ID NO: 12072 - RNA, 960 nt, unidentified
  source 1..960: mol_type = other RNA; note = synthetic construct
atgatcaacaagaaaccctttcaggagatttttaatctgtactttcacggaaagtacagtttcgaagatttcattaacaccgatatcaaacgttgtgtgactccacatcagttcaatcaaaagacaatgttatccgtcaacaaaaaactggcagagtttcacaagtttatcaacgtgttcatcatcaacaaactggcttacaattcattcgtctgcttttcctatattgagaacacaactatcagaaattgcctcgaaccccacaaaaacaacaagtatttcctatccactgatatttctaacttcttcggtagtatccagagcgtggatgtgatgaacactatacaaagcaacattaacgaaggctcactgaatataagcgatatcgagaaatacaaggacagcattatcaaactgataacattcaacgactctctgcctattggattttcaaccagtgggcgcctttcgaattctatcttgtttaagttcgatcaggtggtgcttgactcctgtaatgcacaaaatattacttacagccggtacgccgacgacctgattttctcgagcaacgataagaacataaaacagacacagcttatggttgaaaatgcgttggccgcattattcaacaagaggctgaagatcaatatcgacaaaacgaagatttacagcaaacgggctaagattaagattctgggtatgacgatcaccccgaatgggtctatcaccatcgacaaaaagatcaaaagtgacatagaactcgccatgcatttctatgccaagaatacagagaagttctgctcaatcattgagaataagtttgacggcaatatacagaaagcctttggcaccgttgcttacatcaactccgtcgataaggcctatttgaataagctccgaaagaaatatgggaattataccgtagagtcttttctcaggaaatccgctaagcagtga

SEQ ID NO: 12073 - RNA, 954 nt, unidentified
  source 1..954: mol_type = other RNA; note = synthetic construct
atgcagaaaaagagcttccaggaaaccttcaatttatactttcacgggaaatatagcttcgaagattttatcaacacgcccattaaagacaatatcacccagcatcagttcgatcagcgtacagtgctgtctgccaataaaaaattgaccgagttccataagttcatcaacgtcttcattgtgaacaagctcacatacgacgattctatttgcttttcctacgcaaaaaacactaccatcaggcattgcattgagccccacaaaaacaataagcactttctgtcaaccgacatttcaaacttctttgcatctatccagtccgttgatgttatcaatacgatacagcacaatattgatgaggggaatattggcatcgccgacatcgatcagtacaaggacagcatcataaagttgattacattcgagggagctctgccaattggtttctcaactagtggaagactttctaacgcaattctgttcgagtttgataaggtgatcctaacagagtgtcaaagtaagaacattacctactcccggtatgccgacgatctgatcttcagtagcaacaacaaaaatatcgtgcaggtcaaaccgattgtagaaactgctctctcaaacatatttgatgaacgactcaagatcaatgacaagaaaaccaaaacgtattcgaagaaaagcaagatcaagatcttaggcctgatcataactcctaatggtgacatcactatcgacaagaagattaagagtgacatacaaatagccatgcacttttatgcgaatgataccaacaaatttgactcctttcttcgcaagagatttgacggcaacatccaaaaaatcttcggaattgtgggctacattaatagcgtcaacaaggactttctgaataagctccggaagaagtacgggaactatatagtggattccttcctgaggaaatctgctaaatga

SEQ ID NO: 12074 - RNA, 963 nt, unidentified
  source 1..963: mol_type = other RNA; note = synthetic construct
atgacgaaaactaagatacggcctttccaagagatctttaacctgtactttcacggtaagtactgttttgaggatttcatcgcaaccgacgtgaaaaagcacaccaagaagcatgacatcaacaacaaaatcatcctgtccgctgacaagaaactgaaagaattccaccagttcattaacgttttcatcgttaaccagctggaattcaacgacagtgtgtgcttttcctatgccaagaataccaccacacatacgtgtctggaaccccataaaaataacacttacttccttagcatggacatagtgaattttttcggatctatctgcaataccgatataacacgtgtaattgagcacaacatcaaacagaagaagatcaatatctcggacattgagaaatatacagctagcatcgtcaaattgataacatttgaaggcgtgttaccaataggttttacaacttccggcagaattagtaatgcgattctctttgagttcgataagaagattttggattactgcagtcccaagaatattacctactcacgatacgccgacgatctgatcttttcaggaaacgatacaaatattggccaggtaaaatcaaccgtgaaaaacattctcaccgatctttttgatacaaggctgaacatcaacaatgacaaaacgaaaacctacttcaagaacactagaataaagatcctgggcatggtgatcactccgaatgggaaaatcactattgacaagaagatcaagtccgacattgaaattgccatgtatttctatgtctctgatagcgtcaaatttgaggcaatcctagagaagaaattcaatgggaacatgcacaagatattcgggatcattgcttacattaatagcgtggacaaagattatcttaacaagctcaggaagaagtatggaaattatactgtggagagctttctccgcaagtctgccaaatga

SEQ ID NO: 12075 - RNA, 1659 nt, unidentified
  source 1..1659: mol_type = other RNA; note = synthetic construct
atgaaaaagaagctttataacgtcgtcgggcacctgcccaaaatctggtttgtgtgcggcgcgaaattcgaaggcaaaaactctattcgcaagctcttcataaaatacattcagaagaaccaccaggagatttgtacagctaggaatagaaactctaacagtcttagctttagcccaaaaaagatcattttggccgaggatgtcctggagcagtcaaagaccaaagacaccaagattctggattacgaggagcacatttcagagttttcaaccaatgtgatcttctttctagaatctccttcagtttttatggaaattggacgatttaccaagactataacagaccctctgaaattcctcttctgtgtggatcagaagcacaaaaaaaagaagaatctgatcaacaagctgctatctgaccccaagtacacagttctgcattacaccaccaataatgacatcatcattaactccgatgatttctttaagaaggtgctgaattgcttgaataaaactacgcccactattagctactatgaagacaacattcattccttctatagcttcctaatctcctttttgcaaaaggaagcttctctagagcagatcattaggaaagttgaactcgagcggaagaagacaggattcttctccaatttcctcaataagatcaaattccacttgaagctgctcatcaaaagcggtcttatccttaagcaggactgtttctactttagtgtgatcagaggagatattttgaagggtgtaaaatttcaagccctgaccgagaggcagaaagaactgctgtttgacgttgagatgaactatagctacgaacacatcaaagatttagtgtatgagcccaatagtacccttaaaaactatcaagccttcattaagactcgcgtctttgaccctctggaggaagaacataaagtgatccataagaggtgctttagctacaagaaaaaacatagcatctccaatcttgtggagttacatattggtaacaattacctgctcaatatggacctgaaaaacttcttcaattccataaagagagaggactttatcaaatgcatggtaacactggggctgttcgaggagcgttttcggacaaaaattactgacatatgcttcaagacgaagagtaatgaaataaacggcttacctataggcgcacggacctccccattcatatctaatcttgtgatgcgggaatttgataatctcgtatacaacctctgcgagaagaaagaagtcgtgtatacgcgctactccgatgacttgtcattttcgtgtaagaaaaaaggcgtcctgcaagatatcgagaaggagatctataaagtgataaagaagctgccatacccgcagaacctgaaaattaacgaaaagaagaccaagcacatgtcaaaaaaaggccgtcgaaaaatttgtggattgtatatcacaccagagagccacatctctattgggagaaaaaataagaacaaggtcaagaacatcctcaagaactttaacaagactgaaaagatctaccacaataaggagatgattaaaatcatccaggaaagtttcctcgattcggaggaaaaggggtatctctattacgttaactccgtggagaaggagttcttaaagagtcagatatacctgtga

SEQ ID NO: 12076 - RNA, 921 nt, unidentified
  source 1..921: mol_type = other RNA; note = synthetic construct
atgaaggaaaaggactttaaggtcttttacattccaaagaagaacggttatcgaaagattattacgtataacgacgagaatcgtaaactcagagaatttcatcagcgcgttggagacatcctctacaagaggattcttccctccaaattcgctaaagcatacatcaaaaaacgcagcatcataaagaacgccaaaactcacatgtataatgactcctttctcctgttcgatattaaggacttctttcagtcaatcaatcacaattggttgatagagaagctgtactacgagattaacctcaaccacaagaagaagattagtaaaatcacctgtgctaagattgtcgacagctgcagtgtaagtaaccggggcttagcagtggggctgatcccttctccctttctggccaatatctacttaaaggatttcgacaacatcctgtacgggaacttaaaaaaattgggaatcaagaggatcatctacaccagatacgctgatgacctcgtcatctcctataatgggatagaaccgaaaaatatcgatgatatcaagaagatcgtgtgtgagaatctaaaaaagttcggactgaagctaaatgataaaaagacccgaattatcgacttcaaacagtcaaaccatgttaagatcaccggcataaatattacgaaaactgaggacgatgggcgcaagttgtctgtgggccggaaaagaaaagatgatctttacgtgctggccgtggagctggccaaacggaaacctgatgagaggaagaataacgaaattctcacacttaaaggactgcaaagcttcatactgtcggtggaaggtgtaaagtatgaagagtgctattccaagaacatgattagcgttattaacggcctgggctataacgcgcttaaagacctgatagactctttgtga

SEQ ID NO: 12077 - RNA, 933 nt, unidentified
  source 1..933: mol_type = other RNA; note = synthetic construct
atgcggaaaattaaaggcaagattttctttatccccaaaaagcacggctaccgaaaaatcattacatataaccaatccgacagtgacattgaattgaggaagtttcatgtgaagattgcttccctcctgtacaaaagagttttaccgagtaagtttgccaaagcctacatcaagaataggtccattataaagaacgcgaaaacccatatgtataacgacattttcatcatgttcgacattaaggactttttccagtccattaatcacaatcgccttataaagaaactgtactacgagataaacctgaacaatagaaagaagttgtctatggtgtcctgcagcgatataatcaagagttgctcaataagcaatcgaggacttgcagtcgggctgataccatcaccttttttggccaatatttatctcaaggacttcgacaatatcttgtacggaaatctgaagaagctcaatctgaaaaacatcatgtatactcgctacgctgatgatctcaccatatcatacaaatcggatacgcccctcaagatcgaaaagatcgaaaagattgtttgtgagaacctgaagaagttcggtctgaaactgaactgccggaaaacaaggagcatcaatctgaataaatccaatcatgtgaaggtaactggtatcaacatcatcaaaatgttcgacaactatcggcagctgagcgtcgggcgtaaaagaaaagatgacctctacaacctggccattaagatctcaaagaagaacttcaaagagcacaaagaaaatgagatcaacaaaatcaaggtcaaaggccttcaaagctttatcctatctgtggagggagaaaaatacgagcagtgttattctgagaacatgatgtctgtgatccacgatcttgggtataagagcttaaagcagctaattgataacatttga

SEQ ID NO: 12078 - RNA, 924 nt, unidentified
  source 1..924: mol_type = other RNA; note = synthetic construct
atgattaaagaagcagacctgaaagagttttacatccccaaaaagaacgggtacagaaagatagtcacctataaggacggtgataataaaagaagggaattccatcaacgagtggcccggttgctctataaacgcattctgccgtctaagttcgccaaggcatacatcaagaagcggtcaatcattattaacgccaaatgccacatgtacaatgacatctttctcacttttgatgtgaaagactttttccagtccatcaatcataattggatgattgagaaactgttctacgagatcaatttaaaccacaagaagaaggtcaacaaagtcatttgctcacagatagtgaagagctgttcggtgagtcgtaagggactagctatcggcttgataccatctcctgtgctggctaacatctatctgaagaacttcgataacatactctacggaaatcttagggcgatgggtatgaatcatgtgatttatacccggtacgcagatgatttagtgatctcctacagaggcacagacatcaaaaacatcgacaagataaagaagatcgtttgtgagaacctgaagaagtttggcctcaagatcaatgacaataaatgccgagttattgacctgaataagagcaaccacgttaagattacaggcatcaacattaccaaagagatcgataacaatcgcaaactttctgtggggcgcaaaagaaaagatgacctttataggctggctattgaactagcccagaagtcacccgaggagcggagtgaatatgaaatagggaaaattaggggactgcagagcttcgtactgtccgtagaagggaaagagtacgagaagtgttactccaagaacatgatgacgattgtcaataagctcggctatagtactctgaaagatttgatcgacagcatgtga

SEQ ID NO: 12079 - RNA, 918 nt, unidentified
  source 1..918: mol_type = other RNA; note = synthetic construct
atggacaataatttcaaggttttctacatccccaagaaaaaaggatttagaaagattgtgacgtacggcaaaagtaatattaagctgagggaaacccataagaatatcaatattctgctgtacaggagggtccttgtgagtaaatttgccaaggcttatactaaaaaccgcagcattatcaagaatgccaaaacccacatgtataacgatattttcatcatgttcgacatcaaggattttttccaatctatcaaccataactggctcatcgacaaactctattacgagatcaatcttaaccacaagaaaaaagtgtctaagaagaactgcgaaaagatcgtaaagtcctgttccatatcgaataaagggttagctgttggatttataccttcaccatttctggcgaacatctatatgaaggacttcgacaatattctgtacggcaatctcaagcagctggaattgaaaaatattctctacacacgctatgccgatgatatcgttattagctataagtccaacaagactgaaaagttcctagaaataaagtccctgatagacaaaaacctgtctaagtttgggctcaaaatcaataacgagaagacaaccatcattaacttgaacaaaagcaatcacgtcagaatcacaggcatcaacgtgataaaagacacctttaacaaccgatcaattagcgtaggtcggaaacgtaaggatgatttctacaatttagcactgaagattgcaaaggagaagaaagaggaagtgaatatatatgagcggaagaaaatcattggactataccacttcattgtctcagtggagggcaaaggtttcgagaaatgctacagtgagaagatgaatcatgccattaacaaccttgggtacaaaaactttgaagagttgatcaagaacatctga

SEQ ID NO: 12080 - RNA, 933 nt, unidentified
  source 1..933: mol_type = other RNA; note = synthetic construct
atgaataacgacttgagcacattctatattccaaaggcaaaagggtatcgaaagattacaacctataaggaccgtaatggagatctgataaagtaccacgacaaagtaaacatctctctccagaaacggctcaagcaatccattttcgccaaagcgtatataaagaaacgcagcatcgtgacgaacgccaagacacacatgtacaatgacatctttattagcatggacataaaggatttcttccagtctattactcatgataggctcatcaataccctgtattacgagatcaacaagaatagtgtgggacattttacgcttgagcagtgtcgcgatttagtcaagtcttgcagcacaggacagcgaggtatcgccattgggctcaagccttcacccatcctggcaaacatataccttaaagattttgatggcgtgttgtacggctggctgaagaaactagaccttgacaatgtcatatacactaggtacgccgatgacatgatggtatcctacagatccaattcaaaggataccgtgccgatcaacaaagagattattagtaaagtctccgaactgttgaagctctcgtatctgagactgaatgctagtaagaccagaattatcaacctaaacatctcaaaccacgttcgcattaccggcatcaacattatcaagaatgacgacaactttcggatgctgactgtgggtcggaaacagaaagatgacttatattacaggtctatagggcttttcattaaagaaaccaaggatgacaagtggtatctggaggctaagaaaattcaaggcatgcagtcattcatcttatccgtggagggcgaaaggtacctcaatacttacagcaaaaagatgaacatcgttatcaatgacttggggtttaagaacctgaaagacctgatcgataatctgatctga

SEQ ID NO: 12081 - RNA, 921 nt, unidentified
  source 1..921: mol_type = other RNA; note = synthetic construct
atgtataaagagaagttcaacatcaagtacatcccgaaaaataagggttatcgcaagatagtgacttacaagaattccgactgtgatttgaaaaagttccatatcaagatcagccgaaccatttataataacaccctcccaagcaaatttgccaaagcatacatcagaaaacgtagcattatcactaatgctaaggcccacaagtacaatgacatatacatcttcttcgacattaaggacttcttccaaaacataaatcacaacaagctgattgagaagctgtactttgagatcaacattaagcggaaaaaaaagatctccaaactggattgctatcgcattgttaaatcatgtagtctgtcaaacaagggactcggggtgggacttataccctctcctatcctaagcaatatttacttgaaagagcttgacaacatcctgtacggccgactgaagaagtttggcctacccaatgtgatatacacccggtatgctgacgatatggtcatttccttcaagaaatgcgacaagtataatcttgacgagattgaactcttggttaaaaatctccttacaaggtacggcctgaagatgaacaacaacaagacgaaagtgattaatctggaaaagtctaaccacgtgcggattacaggtatcaatatctctaaagatagccagaacaaaagatatctcaccgtcgggaggaaaagaaagaaccagttatatcatgatgtcatcaagttactgaacatcaagaaagaggatagggacaaaaaagagattaaccgcgtaaaagggatgcagagttttattctctctgtggaaggcatctcatatgaagattcctactcgttgggcatgattaagatcatcgaggaatttggatttacaaatctgaaggaagcgataaatagtctgtga

SEQ ID NO: 12082 - RNA, 921 nt, unidentified
  source 1..921: mol_type = other RNA; note = synthetic construct
atgaagaacaacaactttaagatcatgtacatcccaaaaagcaaaggatacagaaagatcataacctacaaagacaatgatgtggaaatccggaggtatcacatcgatatctccaagttcatttacaataacactctgccttctaagttctcgaaagcatacataaagaaacgatccatcataaccaatgccaaagcccatatgtacaatgacgtctttttatacttcgacataaaggacttcttccaaaatatcaatcacaacaagctgattgacttgctgtaccatgagattaataagggcagcaaaatcaaaacttccaagatagactgcaacaatatcgtgaaatcttgtgctgttagtggcaagggacttggtgttgggctgattcccagccctttgctgtctaatatgtaccttaaagagttcgacaacattctatacggaaaacttaagaagatggacctgccaaatgtaatttatacgaggtatgccgatgatatggtgatatcattcaagtatatcgagtcctacgatatgtcagaggtgaagaacttaatcggtattctgctgcgtagatatggcctcaaactgaacgacaaaaaggtgaagatcattaatctgaacaagagtaaccacgtcaggataacaggcattaacctatgcaaagacgaaaacaacaatcggcgcctgaccgtgggcagaaagcgcaaaaatgagctctactataaagcgattgagacaatttccaagcccgctaaagatcgggaagatattcagattaagaagatcaaaggacttcagtcatttgtcttgtctatcgagggggaaatgtatgaaaatacctatagccagaacatgatcagcattatcaacaactatgggtttaagaatctcaagagtctcatcgataatctctga

SEQ ID NO: 12083 - RNA, 921 nt, unidentified
  source 1..921: mol_type = other RNA; note = synthetic construct
atgaaagatgagctcctgatcaaatacatccccaaaaaaaaaggttaccggaagatagtgtcttataacgtcgcaaaccaaaagttgcggcaggaacataagcacatcaataagtttatctgtgacgagactatcccgagtaagttcgctaaggcctatatcaagaacaggtccatcatattaaacgccaagatgcatatgtacaatgacattttcatctacatggacattaagaagttctttgcctccattaaccacactatgatggtgaacctgctttttaaggaaatcaataagaggaagcccaagatcattattaccaaagatacctgctacaagatagtgaaatcttgcgcaattagctccaaaggccttgcggaaggcgtaatcccaagccctactctatctaacatttacctaaaggagttcgacaatatcctgtatgggtatctgaacaaaatgcacttggagaatatcagatatacccggtacgccgatgacatgatcattagcttcaaggatacagagaattacaacgtggtcgatattgttaacgctgtgacgacacttttaaaacgatacaaactggagctgaacaaagagaaaaccaagattattagcctcaaccgctctaatcatgtgagactgacagggatcattatatcaaaggattccgacaataacaggagcttgacagtgggacgtaaacgaaagaacgaactgtataataaagccatttcactggctaagaagaataaggatatccgcctccagggagagattaataaagtcaagggtatgcagtcatttatcctgtcggtagagggcataaaatatgaggaaatctacagtgacaagatgataagtatagttagagaactcggctatgaaaaacttaaacagctcatcgacaatctgtga

SEQ ID NO: 12084 - RNA, 915 nt, unidentified
  source 1..915: mol_type = other RNA; note = synthetic construct
atgattaaggaggacctcgtcgtcaaatatataccaaagcataacgggtacaggaaaatagtcacttacaaggaaaattcggagttgaagaagtttcatacaaaagccaagaatgtcctcgacaaaaaaatcattccgagcaaattcgccaaagcttacatcaagaagaggagcattatttccaacgcgaacgttcacagatataatgacatattcatcgcgctggatatcaaggattttttcgctaacatcaaacacaagaagctaatcgatttgctacagtttgagctggcacggaacggacggagggtttacaagaaggactgcattaagattgtgaagtcctgctctaatactgatcgcggcctcctggtgggccttaagctgtcacccattctggccaacatctatctgaaagagttcgataatatcctgtacgggaaactcaaaaaaatgaacttacccgatgtgaagtatacccgctacgccgacgatcttgttatcagctttaagaactgtgaggcaaatcttcatgacatcatcagtctgattcagaaactgctgaaaagatatggtctgagaatcaatgaaaagaagacccgcatcataaacttcaatgtaagtaaccacgtacggattaccggcataaatatcgtgaaggacgaaaagaacttccgaacattgtctgtgggtcgacagaggaagaacgagctctactatttagctaaggaaatactggatgggcaattaaacgaccctgtgaaaatcagaaaagtgaaaggactgcagtcatttattctttccgtcgaaggcgtgaattatcaaaaaacgtactcttacgccatgatcaatgagtttacacgtcggggatatattgacctcaaggacttcattgataagttggactacaaatga

SEQ ID NO: 12085 - RNA, 981 nt, unidentified
  source 1..981: mol_type = other RNA; note = synthetic construct
atgtatcgcaaggaacaaataaaacggatcttgttttctcgcaaggtcaacgcaatggatgagaagctgtttcagatcaagtacattcccaaaaaaaacgcattcaggaaaattgtgacgtatcgagaagacaataatatcagagtgatgcacgagaagatcacaagctttatcgttaagaatactctaccttctaagttctcaaaagcttacatcaagaataggagtatagtgaccaacgctaaagcgcatatgtacaacgatatcttcctcatgatggatatccagagattcttctccaacatcaatcacaacaaactgatcaatgtgctctattacgagttgaacaaaaaggaaaacatcatatccaaggtcgattgcactaaaattgtagactactgtagtgtcggaaataagggactgccgattggctttgtgacctccccagtgctttcaaatctgtatctcaaggagttcgataatattctgtacgggaaactcaaaaagtacaacctggaaaacgttatttacacaaggtatgccgacgacttgaccatatcattcaaaaaaaactccagctatgccaatgacattattgtaaatatccagaacacgatagccaaccttctgaagcgttacagtttgaagattaatgagcggaagactaagatcattgaccttaataaaagcaaccatgtccgaatcacaggtatcaatattatcaaggacgacaacaactttaggagactttctgttggtaaaaagcggaagaacgagctatattggtccgccatcaattactttttaaccgacaaagacaaccgcaatgatgctgaactggataaaattaaagggatgcagtcgttcatattaagcgtggagaagaccggctacgaaaatagcttttcaaaggcaatgaagtctaagatcaacgagctgggctataacagcctgaaggaactcattgataaactggagtga

SEQ ID NO: 12086 - RNA, 939 nt, unidentified
  source 1..939: mol_type = other RNA; note = synthetic construct
atgaacgaacaactgaccgtaaaatacatcaaaaccaagaacaaggtccgtaaaattgtgacatataccgaaaatggggagttgaggaagtaccacgaaaatgtggtgaaatacttagagaagtacgcgacaaacagcatttttgccaaggcctatgtccccaaatcaagcattttcaaaaacgccgaggcccacatgtacaacgacatctttatcaaaatggatgtcaagaacttcttcccaaacatcaatcataaatacatggcagagtgtctgttcttcgagctcaataagaatacccagattagtcgaaaagaatgctattctatcgtgaagaagtgttcagtcggcgagaaaggactcccgcttgggctcgttagcagccctgcactagcaaacctttatatgaaagaattcgatggactgttgtatggatctcttaaaactatggacctgaataatcccatctacacaagatatgctgacgatcttgtgatatcgtttaagtctggcactaacgacattgataagattgatgccatcaagcaagaggtaaggcgcctcttgaaaaaagtgcacctgaatttaaacgagaagaagactaagtcctatatactgaataagaccaatcacgttcggatcacgggcgtgtctatcacaaaggatgaaaaaaactacagacacatctccgttgggcgcaaactgaaaaaccagatattctggaatgctattaacatgcatgaccaggaaatcaaggattacgtgcagatcgagcatctaaagggcatatttagttttgctctgtccattgagaagaaggactttgaagcctgctattccaaaaatatgaagcagctgatcaaggagaggggttacgactcactccgggatctgattaaggacctgggtaacgacaataagagtatgattacgaactga

SEQ ID NO: 12087 - RNA, 954 nt, unidentified
  source 1..954: mol_type = other RNA; note = synthetic construct
atgaaagaacagctggtcgtgaaatacattaaaacgaagaacaaagtgcgcaaaatagttacatatactgagaatggggagctgcgtaggtaccatgaggaggtagtgaaatacctggaaaagtacacaaccaattctatctttgcaaaagcttatgtgcccagaagcagtatttacaagaacgcgaaagcccatatgtacaacgatatcttcgtgaaaatggatatcaagaactttttccccaacatcaatcacaaatatctcgccgaatgcctgttctttgagctcaacaagaacacacagatctcacgaaaggaatgttatgacatcgtccgcaagtgctccgtgggagaaaaaggcctcccacttgggttggtgtctagtcctgccctggcaaatctctatatgaaagagtttgatggcttactgtacggtaagctaaaaaagatggagctgaataatccgatttatacgcggtatgccgatgatattgttatcagtttcaagaccggtaaggacgatttcgaaaagatcgacaacatcaaagcagaggtccaatccttgcttaaaaaagtgcatctcactcttaacgagaagaagacaaagtcatacaccttaaacaagtccaaccacgtaagaataactggaatctcgatcaccaaggacgaaaataattaccggcacatctcagtgggcaagaagctaaagaaccagatcttctgggatgctattaacatgtacgaccagaaggttaaagactatactaaaattgagcacctgaaggggattttttcttttgctctgtccattgagaagaaggatattgagaacttctacagcgaaaatatgaagcacctgataaaaattaggggatatgacagccttaaggaattgataaaagacctgggcagcgacgtcgataaaaatgacaataaggccgtcataaccaattga

SEQ ID NO: 12088 - RNA, 957 nt, unidentified
  source 1..957: mol_type = other RNA; note = synthetic construct
atggatgaggagctggttgtgaagtacatcaaaactaagaacaaggtccgaaaaatcgtgacctacaaggaacgcggagaactgcgtaagtaccatgaaaaggttgtagaatacctcgacaagcatgtcattgtctcaaaattcgcgaaggcctatgcacccaagacctccatttataaaaatgcctacgctcacatgtataacgacattttccttaagatggacattaaggatttctttccaagcattaaccataactatctggcagagtgtctctatcacgagataaataagaatacgtccattagcagacgcgaatgctacgatattgtgaagaaatgctccgtagggaaaaagggcctgcctcttggctttgtgacatctccggctctggccaatctatatttgaaagaattcgacggcttactgtatggcaaactcaaaaagatggacatcaagaggcccatctacactcggtacgctgatgatatggtgatcagctttcagtcacaggaggactacttggagaaaatcgagcttataaggagcgagatagacaacctgttaaagagggttcatttgagcatcaaccacaaaaagactaagatcatcaatctggagaagaccaatcacgtcagaattacaggagtgtctattaccaaggataaaaacaactaccggcacctgagtgtcgggagaaaacttaagaaccacattttttggtcagccataaatcagtatgacaaagaggagaaagattataacgaaatcgcacacatcaaggggctgtattctttcgtgctcagtatcgaaaagaatggagtggaaaatggttactccgacaaaatgaagagtctgctcgtggagcggggctacgagacattaaaacaactcctgtcgtctctgggtaatgatgaactaaacaaaaacgagatcgacgatttgggatcccattga

SEQ ID NO: 12089 - RNA, 912 nt, unidentified
  source 1..912: mol_type = other RNA; note = synthetic construct
atggatgagcaactggtcgtgaaatacatcaggacaaaaaaaaaagtgcgtaagatcgtaacctacagagagcataatgacttaaggaaataccatgaagcggtggctaagtatctccagaaaaatacgtttaacagtatctttgccaaggcctatgtgcccaaaagctcaattttttccaatgccaaggcacacatgtacaacgacatcttcatcaagatggacatccgcgactttttccctaacatcaaccatgagtatatggctaagtccctctatcacgagataaataagattgcacagatttccaacaaggaatgccacgatatagtccgaaaatgctctattggggaaaagggcctcccattagggctcgtctctagccccgggctggccaatctgtacctgaaggaatttgatggcctgttctatggccagttgaagaagatgtgccttaaaaacgtgatttacacccgctatgctgatgatctggttgtttcattcaaatactgtgatgactatgagaagtacgcagaaaagatcgtcgctcaggccgagcacctgcttcagagattttgtttgaaactcaatatggagaagctgcagatcgtgaatctaaagaagagcaatcatgttcggattactggtgtgagtataaccagaaactctcaaaattaccggcacattagcgtaggcaagaagctgaaaaacgagatcttttggaaagccattgagctgtacgacaacccggagggacacaacatgatagagagggaacagttgaaaggactgttctcattcgtgctgtcgatcgagaagcgaggagtcgaagaatccttcagtgagggcatgataaatcttctaaagattcggggtttcaactctctcaaagaacttatcaacacattgtga

SEQ ID NO: 12090 - RNA, 924 nt, unidentified
  source 1..924: mol_type = other RNA; note = synthetic construct
atgaataaagagctctttctggaagaaaagtacatcaagaccaagaagaaatatcgcaagatcgtaacgtatgtggacggagaaaacttgctgagagaaaagcacgaacggatcgtctcactcctgaaacaagaatgtagcgattcgatttttgccaaggcatacattgagcactcttctatcgtcaagaatgcgaaagcccatatgtataacgatatattcctgttcttcgacgtgaaagacttctttccgagcataaatcacaactacttaatccagcgtctgtataaggagctaaataacaatggcaatgctagcatcaatagttgttccaaacttgtggagctgtgctccgtgaacgacaaaggtctgccattagggctagtgacatcccctatccttagcaacatttacatgaaggaattcgacaacatcatctatgggaagctgaaaaagctctctctggataacataatttacacacgatatgccgatgatatcgtgatcagctttaaggccgagaaaattgaccccgacataaatgtcaacattaaggagtgcgttataaggtgcttgaagcaggtccaccttaaatccaatgagaataaggaaagagtgtacgatatccgcaaaggtggacatgtgagaattactggcattaacgttattgtcgagaatgacaattaccggaagctcaccgttggaaggaaaaggaaagataggttgtacaacgatgtaatgagttactatatgcgacgcatcaaggaccgggaaaaggctctgtcaattaagggcaacgaatcttttattctctcagtggagggcaaagagtatgagaaatgttacagtgagaacatgaaaaaggttatcaaagagtacgggtatgactccctgcatgatatgatcaaggcaattaagtactga

SEQ ID NO: 12091 - RNA, 930 nt, unidentified
  source 1..930: mol_type = other RNA; note = synthetic construct
atgaacgtgcagcatcccgacatcaaaattcgatacatacggaccaaaaataagacaaggaagctagtgacctatagtagcgatgactgtgaacttcgtgtgcgacataagagaatcaacgacttcattgaggcaaggtttatcccgtccatcttcagcaagggctacgtcaagaatcggagtatttatcacaatgctctggcgcatctctacaatgactacttcatcatgctcgatatcaaggatttcttccctcacatttgccacaaacagcttgccgacaaactcttctacgagatgaatttgctgagtagagagcaaatatccatgaaggagtgtaaaaacgtgatagagctgtgctcagttagctcaaggggcctcccccttggttttattacatctccactgctgtccaatgtgtacatgaaggagtttgacggaatcttcttcggtcaactgaaaaagttgggcctggaaaatcccatctatactcggtatgtcgatgacataaccgtaagctttaagtattctaacagaatcccacctattgaagtggagaatcaggttgttgacttggcccagtctctcctgtctaagtatggactgcaactgaacaaccgtaagaagcgcagttacaacttaaacatttcaaaccacgtcagaatcactgggattaacatcacaaaacagcccgataataaacgcctgcttaccgtaggacgcgccacgaaaaacgaactctactggggcgccatagactgcctaaaaagcagggatcctgaaaagatcgcacacattaagggcatgcagtcctttatcttgtcaattgagaagaatgggtacgagaagtgttatagcaaagctatgattcagcagatccggaacttagggtttttttccctgaaagaattaatcgattcgctggattga

SEQ ID NO: 12092 - RNA, 933 nt, unidentified
  source 1..933: mol_type = other RNA; note = synthetic construct
atgaacgttcagaaccccgatattaagatcaggtacatcaagactaagaacaaaactagacggatcaccacttatgtgtccgacgactgcaatcttagattgagccacacacgaatcaacgtgttcctcaaggaaaactttattccttccgtctttacaaaagcgtacgtttcaggttgttcaatatatcacaatgcacttagtcacctgtacaacgattgttttgtgatgatggatataaaggacttcttcccaagcattagccaccggcagctcgaaaagaagctgtacttcgagattaatgctaaggccccaaatcagatctctatgctagagtgcagggaactgatcaatctgtgctctgtagggaatgtaggactccctctgggctttatcacctccccggtcctgagcaacatttatctgaaagaattcgatggcatcttttacgggaaactgaaaagcctctccttgaagaacattatctacacgcgctatgcagacgatatcgtggtgtctttcaaacccgaggacgtcaaaaatattgatgacgctaagagttccatcattaacatcgccaagcaaatcttgagccgctataatctccatttgaatgagagaaagaccaggttctattcccttgaaatttcaaatcatgtgcgtatcacaggcgtcaacattaccaaaaacgacgacggaaagcgactggtgacagtgggtcggtctttaaaaaataaactgtactgggacaccataaactatatggagtcagataacaaggatgccgagacggttaatcacattaaagggctacagagttttgtcctctcgatagagaaaaatggatacgagaagtgttacagtaagcaaatgatcgaaaacgtgcgcaaacatggcttcaggactctgaaggaccttatagattctttatga

SEQ ID NO: 12093 - RNA, 927 nt, unidentified
  source 1..927: mol_type = other RNA; note = synthetic construct
atgaatatcaacaatcccgacatcgtagtgcggcacattaagacaaagaataaaactcgcaagatcatcacctatcgtagcgaagattgtgagcttaagactaaacacaggaggataaacacatttctgcaggagagatttatcccttcgatttttaccaaaggatacgtaaaaggtcgaagcatttatgataatgctctcccacacatgtacaacgactattttatccttctagacattaaggacttctttcctcacatctgccacaagcagctggctgcgaaaatcttccatgaaatcaatctggtgaaggagaatcagatcaacaagaaagaatgcaattacatcgtcgactgttgctcaattggctctagaggacttcccctagggttcataactagtccaatattgtctaacatgtacctcaaggagtttgactgcatactgtatggctacctcaagaaaatggaattgaacaacgtgatttacacgaggtatgccgacgacattattatctcctttaagaccgattcattcgtcgagttcaaggagattgaaaacgatatagtggatacctctaagttgctgctcagcaaatatggcctgcaaatcaataatcggaaaacacgcgcctacaatctggatgtttctaatcatgtccggatcaccggtatcaacattactaaatccgaagacggctatcgacatcttacggttggaagaaaactgaagaacgagctgttttggaacgcaatagaatgtttcgaaaccaagaaccaggagaatatccagacaattaaggggttacaatcattcgtgctgtccattgagaagcagggatacgagagttgtttcagcgagggcatgttaaaaaaggtgaacgatttggggttcgaaagtctgaaagagctcattgattccctctga

SEQ ID NO: 12094 - RNA, 927 nt, unidentified
  source 1..927: mol_type = other RNA; note = synthetic construct
atgaacagcaccaatcccgacgttcgcattagctacatcaaaaccaagaataagttgaggaaaatcgtgtcatatcgctctaatgactgcgaattgaggacgtatcatcaacaaatcaatgacttcctggaacagcgattcatccctagcattttctctaaggggtatgtgaaaggcaggagcatttacgataacgcccaggcacatatgtacaacgattactttatcatgctggacattaaggacttctttcacaacatttgccacaagcagctgagttctactctattctacgaaatcaatcttgcgcaggccaatcagatatctcagaaagagtgtaatgacatcgtgtctgcttgttccgtctccaaacgtggcatcccgctgggctttattacctctccactcctgtccaacatttacctcaaagaatttgacgggatattctatggaaagctcaagcagatggcattatcaaacataatctacacaaggtacgcagatgacttaacaatctcgtttaagactgattgcacagccaaactgcccgatgtcgagagtctgatcgcctcaacagccgattccatactgaagagatacggactacacctcaacggccataagacccgatcgtattccctgtatgtgagtaatcacgtgagaattactggtattaacgtgatcaaggaccaatcaggttaccggagccttaccatcgggcgctcagtaaaaaaacagctctactgggatgctctccggtgccttgagtccaaggatggagagctgataagacacgtcaagggcattcagagctttatcttaagtgttgagaagcaaggatatgaggactgttattccagcgctatgaaacggagacttagtgatctggggtataaaagcctgaaggacttgattgatgctttgtga

SEQ ID NO: 12095 - RNA, 930 nt, unidentified
  source 1..930: mol_type = other RNA; note = synthetic construct
atgaacgaacagcatcctgatattacgacatattacatacggacaaagaacaagacgaggaagatagtctcttacatatccgacgattgtgagctgcgcaatacccacttgaaaatcaacaatttcctcgagaggagatttatcccgtcaattttcagtaaaggatacatcaagaaccgttccatatatcataacgctcagagtcacatgtataacgactactttatcctgatggatattaaggacttcttccactcaatctgtcacaaacaactggcacagaagatcttttacgagatcaatctcactaaaagcaaccagatcaatctgttggaatgctacaagctcatctccctgtgcagcattgattcacgggggcttccattaggattcataaccagccccatcctgtcgaatatctacctaaaagacttcgataacatcttctatggcaagcttaaggagttaaacctcgacaacatcatttacaccagatatgctgacgacttaaccgtgagctataaaacaaagagcaccgtcaaagatgtgaatatggaggccaaaattgcggaaacagcctctaatattctcaaacgatatggcctgaagctgaataatcgcaagactcgctctattaacctgaatgtctccaatcatgttcggattactggtgtgaatatcaccaagaacaactacaactttaggcacctaacagtggggagaagcataaaaaatcaactgtactgggatgcccttaaatgcatcgactccgacaacgacctgttgaagaataaagtgaaaggcatgcttagctttgtactgtctattgaaaaggccggattcgagacttgttactccgatctgatgatggctaaggtttatagtttgggtttttcaagtctcgcagaactcattatgtctattaagtga

SEQ ID NO: 12096 - RNA, 927 nt, unidentified
  source 1..927: mol_type = other RNA; note = synthetic construct
atgaccgagctgcaccccgatatcatcattcgctatatccgaacgaagaataagacacggaaattggccacctaccggtccgtggattgcgaccttagaaaaaagcacgaacaaatcgaacagtttcttaccgcctggttcgtgcccagcatttttgctaaggggtacgtcaagaatcgaagcattttccataacgcccagtcgcacatgtataacgaccacttcgtaatgctggacattaaggacttctttcctcacatttgtcacaagcaattgagtgagaagctgtattacgagctgaaccgttccgggaaaaatgtcgtcgcaaagtctgaatgcaacgatattgtagacatttgcagtataggatccaggggcctgccactgggatttgtgacatccccaaccctgtcaaacctttaccttaaagagttcgacggtatcttttatggaaagctcaagaagctcggcctcaataatgtgatctatactaggtacgccgatgacctgactatctccttcaagactgtgaccgcacctgaactcagtaaaatcgaggaaagcatagttcagatagctcagcaattgttaaaacgctacggactacagttaaacatgcataagactagatcttacgacctgagagtgtcaaatcatgtgcgcattacgggcgttaacgttatcgtctctgaaggtaaccgcaggagactgtctgctgggaggtcactcaaaaataaactgttttgggatgcgatagaatgtgctgagacacgggatccggtcaagaccgcccatgtgaaaggcatgcagagcttcattttatcagtggagaaagaagggtatgagacatgttttagcaaagcaatgatccagaaggttgagtctctaggcttcagtagcctgaaagagctcatcgattccttgtga

SEQ ID NO: 12097 - RNA, 975 nt, unidentified
  source 1..975: mol_type = other RNA; note = synthetic construct
atgaagaaatccgaagacgtcataatcaagcacattaagaccaagaataagatccgcaagatagcgacatacgtttcagaaggctgcaaactgcgaaaagagcatgaaaatatactgaagtacctgaacaagaacttcattaatagcaaattcgccaaagcttatgtaaaaaaccgtagcatttacagcaatgccaaagtgcatttatataacgactgctttatcatgttggacgttaaggactttttcaattccatcaaccataagaacctgattgagaaattgtactacgagatcaacaaaccaaacaaaaagatctactaccagatcgatgaatcaaacagaaagctgatatcaaagattgagtgcgctaatatcattagtaagtgctcgctgtataataaaggtatccctttgggctttatcactagtcccatcctttccaacatttatatgaaggatttcgacggcatcctctatggtcagctgaagaagttcaaggactacaatatcatatactcccggtatgccgacgatatgacgatttctttcaaggataaccaggataaaaaggagattgagaacgagattatcaatattactgaggatctcctgaaaaggtatgggctcaaactgaacaataagaagacccggagttatgatcttaccatttctaaccacgtcaaaattacaggcataaatattgtgaaggaggaagacaattacagacgcatgaccgtgggaaaaaaggtgaaaaacaagctattttgggatgcactaaagtgttatagggatgggaatcacgactacaaatgtatcgaaggattaaaaggaatgcaatcctttatcctctctatcgagaagaaaggctatgaagaatgttacagcgaaaacatgaagaacatcataaatgagcttgggtttagcagtctgaaagagctcatcgactctctgttctacattgagaaaaattga

SEQ ID NO: 12098 - RNA, 951 nt, unidentified
  source 1..951: mol_type = other RNA; note = synthetic construct
atgtccgaacagaacgtgttctaccaggtgaagtatatcaagaccaaaaataagctgagaaagatcgtcacttacaaagacgaactgccggatataaagttaaagcatgaggaaattgcggccttcataaacaagaacttcattccctctatcttctctaaggcatatgtgaagaatcgcagtatatatcacaatgccattactcacatgtacaacgatgtctttattgctctcgacatcaaaaactacttcaatagtatcgaccacaagctgctcttgagcgctttgtattacgagcttaataaacggaacaagtctacaattagcaagcttgaatgtggcaaaataatctccatctgcagcatctttaagaagggcttacccctgggcttggtgactagtccaattcttaccaatgtgtacatgaaagagttcgataacatactctacgggaaactcaagaaaatgaaactgaaagacgtcatgtacacgagatatgccgacgatctggtcatctcatttaagcgtgacgtgtatctcgattccaatcagattcggaagaatacagacgttatagtacatcaagtgtcctccctgctctccaggtttaaactgaaactgaaccctgccaagaccaaaattacatcattcgagaaaagcaaccatgttaaaatcaccggtgttaacatcatccgagatagttctaaccacagaaaactaagcattggaaggaagattaagaacaatctgttccatgacgcaatcaagtgctttgaggagaagaacaaaaataagtcggatgtgatgaagatcaaagggcttgagtcatttgtattgtctatcgagaaacgcggttatgaggaaatttactcacggaatatgaagaagaagattaaagacctaggatttgacagcctgcacgatctgatcaatagcctgtattacgaatga

SEQ ID NO: 12099 - RNA, 936 nt, unidentified
  source 1..936: mol_type = other RNA; note = synthetic construct
atggatgtgcagaccaattactaccagattaaatacatcaagaccaagaagaagaccagaaagatcgtcacttatacagagaattatccggaaatccgagttcaacatgaaaaaattgctgacttcatcaacaagcagttcatccccagcctgtttagcaaagcctacataaaaaagacaagcatctaccacaatgtgcttccacacatgtacaatgacatattcatcttactcgacatcaaggacttctttaacagtatcaaccacaaaattctgatcgatttgatgtactacgaactcaacaaaaagaagaagaacaccattaacaagctggagtgtgccaaaattatttcacgctgctcaattacaaagaaggggttacccttgggattcattacaagtcctacgctctcgaacatctacatgaaacagtttgataacatcctgtatgggaagttgaagaaactcgagctgactaacgtgatctatactaggtatgcggatgaccttgtgatctcctttaaaagggatgtactatcttcttcaaacatatgcgtggagaaaattatcaatcaagtcaagtcactcctgttgagatacaaactgcagctaaataccagcaagactaaggttattaacttcgaggaaactaatcatgtgaaaatcaccggcgtaaatattattcgggactcctctacaaatcgcaaattatccattggccgtaaaattaagaacgacctgtttcacaaggctatcaagtgttatgagaacgagaatacgaataaatacgatatactgcgggtgaaaggcctggagtcctttatactctctatcgagaagaagggttatgaagaaacctatagcaaaaatatgcgagcaaaggtcaaaagtcttggattcaattccctgcatgaacttataaacaacctgctgtga

SEQ ID NO: 12100 - RNA, 948 nt, unidentified
  source 1..948: mol_type = other RNA; note = synthetic construct
atgaatgaacagaacacttcgtttaggatcaagtatataaagaccaagaagaagctgcgaaagatcgttacttacaagagcgacaatccagaactgagaataagacatgagaaaattgcagcttttctgaactcaaatttcaccccctctaaatttacaaaggcctacgtcaagaataagtccatctatcataatgccaggacacacatgtataatgacattttcatcagtctcgacatcaaggacttttttgggaatattaaccacaagctcttaattaacctgctttactacgaactcaacaagaaagataaagatacgatcaacaagctggagtgtggaaaagttgtctctcattgcagcgtgagtgaaaagggaattcccttggggtttatcaccagcccgattctgagcaacatttacctcaaagagttcgataatatcctgtatgggaaactgaaaaagctaaacctcaaaaatgtgatgtacactaggtatgcggatgacctggttatctcctttaagaactcattcaatggcgacagcaaactcaaatctgacaacgatgaaaacatcatctccatcgtacagaaattgttgtcccggttcaacctgaaattaaacccttcaaagacacgcagagtctctttcgagaaatccaatcatgtgaaaattaccggcgtgaacattattcgggatgtatataatcaacgccgtcttagtgtgggccgaaaactgaagaatgatctgtttcacatggctattaagtgccacgaacaggaaataaaggacatgtatgaggtgatgaagatcaaaggacttgagagcttcataatttcaatcgaaaagaaaggctacgaggagatcttcagtataaatatgaaggacaagatcggtgagttgggtttcgagtctcttcacgatctaataaaaaacatgcggtactga

SEQ ID NO: 12101 - RNA, 942 nt, unidentified
  source 1..942: mol_type = other RNA; note = synthetic construct
atggactaccaggagactaaaaagggctatatcgtgaagtacataaagacgaaaaacaaaatccggaagatcgttacctacggcgataatgctcaagagattaagaaaatccacaccgaaatagcagagttcattaacgagaatttcatgccctctaagttttctaaagcctatattaggcacaaaagcatttaccagaacgctctcgcccatatgtacaacgatatctttatctccctggatataaaggactttttccggaatatcaaccatcagaaactgattaatgcactcttcttggaactgaacaaacattcgaataacaccatcaataagcttgagtgtagtaaaatcgtctctaattgcactgtgtccaaaaaggggttgcctttggggctgattacgtcaccaacattatcaaacgtctatcttaaggagttcgacaatattctgtatggcaagctgaagcgcatgaaagtcgaaaacattatttatacccgttacgccgatgatctggtgatctcctttaaggacatagaaagcaaaacaaagatcatcgatgacatcatcatgctagttaaaaagctgctgagcaaatacaacctccgactaaattcctcaaagaccagaataatttcccttgacaaatctaaccacgtgaagataaccggaatcaacatcatcaaaagcccgagcaattacaggaaactcactgtggggagagaactgaaaaatgacttatttcacacagcggtgaagtattatgaggacggcaatactaacaagtacgagttactgaagatcaaaggattggaaagtttcattctgtcgattgaaaagaacggttatgaggaggtatacagtaagaacatgaagctcaagattaaggatctgggttttaagagcctcaatgaactcattaagggacttacatccaaatga

SEQ ID NO: 12102 - RNA, 951 nt, unidentified
  source 1..951: mol_type = other RNA; note = synthetic construct
atggagaaagacgattggtatgtggagaagtttatcaagcgaaaaaacaagctgcggaaaatcgttacatacaataactccgacattcgcaatcgccataccataattaataacttcctcaacgggaatttgctgttttccaagttcagcaaagcatacattaaaggtaagtcaatctacgacaatgcctacgctcacctgtacaatgactatttcataagcctagatatcgagaagtactttaacaacatcgaccacaatattctgatcgaaacgttgtattatgagttgaacaagacttctgagaagaagatggttatgaataagattgagtgcacaaaactcgtgaatctgtgttccaccagcaaaaaagggctgccactagggttaataacttcccctacactctcaaacatctatttgaaagagttcgacaacatattgtacggcaaactcaagcggctgggcctggaatcgataatctatacaagatacgccgatgatatcaccatcagttttaaatacagcgaggaggaccttaacatcgtccagaataacatctatgacatcgtcagtagccttcttaagcgttacaagctcaagctgaattacagcaagtctaggttcattgatctgggaaaaagtaaccatgtgaggatcactggcatttccattgtgaaagacgagaacaactatagaaaactgtcagtaggccgcaaatcaaaaaaggagcttttttatagagcgatcgattgctatcggacctttttagaagatccctccaatgtggattacctggaagtcctgaagattaagggaatggagtctttcttcctttctattgaaaagaggggttacgaaaacttttattctaagggcatgcaaaaggaactgaaggaactcggattcgataatttaaatgacctgattcgaagtctcccgcacgaatga

SEQ ID NO: 12103 - RNA, 951 nt, unidentified
  source 1..951: mol_type = other RNA; note = synthetic construct
atgaaaatgcaaaacgaatggtacaaggagaagtacattaagaggaaaaataaggtccgaaagatcattacctataacgatgaatctgtacgagaaaagcattcccagatcaacagaatcctcaatgagaagctgatgttctccaagtttagcaaggcatatataaagggcactagcattttctacaacgcgaaaagccacatgtacaatgatattttcatctgcattgacatcaagaagttcttcaacaacatagaccacaaaattctgttgcaaaccttgtactatgagttgaataagacggaagagaatgtcatcaaatatggcagggtggagttaaagaaacttatagaggtttgcagcataagttctaaaggtttgccgttagggctcattacatctcctgcccttgctaacatctacctcaaagaattcgataacatcctgtatggaaagctaaagaagttacagctgaataacgtgatctacacccgctatgctgacgatctcacaatctcatttaagtatatcgaggattacctgtcgatcaaagacgtgattataaacgaagtgtccaaacttctgaaaagatatagactggagatgaatgataagaaggagcgcattataaacctgaataagtcaaaccacgttcgcattactggagtgagtatcgtgaaaaatgtcgacaattatcgtcagattagtgttgggcggaaagtaaaaaaagagcttttttacaaggccatcaacgcctacctaaccttccaggagaatccctcccggatggactttctcgaaatgaaacggatcaaaggcatggagtcttttattctgagcatcgaaaaaaacggttacgaatcctgttactcagtgggcatgatgaggcagctggaagagctcaattttaacaatctgcacgacctgattaatagcctgccaatcaagtga

SEQ ID NO: 12104 - RNA, 957 nt, unidentified
  source 1..957: mol_type = other RNA; note = synthetic construct
atgaatacagattataaagtccgctacataaacacaaacggtaagaagcgaaaaatcgttacctatgctaatgaggctaaaaggaaagagcacatcgagattaagaaatttctcgagaagaagctgatcttttcaaagtttaccaaggcctacataagcaaatcctccatttacaagaatgcaagggcccacatgtacaatgatatctttgtgaagtatgacatcgagaaattcttcaacaacattaaccacaagatcctggtagaaatactgcacgagcaactcaacttaaacagcgaaaagaatgagaattcaatgttggaggtggcagagctcgtctcaagctgcatcgtagacaaaaaaggacttcccttaggaattattactagtccaatattggcgaacatctatcttaagaagttcgacaacatcctatacggcaagctcaaaaagctgggcctggataacattatttatacccggtacgccgatgacctgacgatttctttcaaaaaccctgatgaatgggagattgagagattcaatgatgagctgacttatatagaagaggtgattaccaaacagctcaaaaagttccggctgaagcttaatctgaagaagaagagtatcatcaatctgaaggtgagcaaccatgttcgcgtgactgggatctctattacaaaaatcacagacgacaagcgtagactaagcgtggggaagaaaaagatcaataaactgtacgacgacgccttagaactgtatatcaagacccagaataaagagtacgtcctgactgacgaagatttctaccatatttccaggataaaaggcatggaatcttttattttgtccgttcataagaccggttacaaccacttctttagtggaatgatgcagaaaaagctcgaagaactggggttttcgtctctcggcgaattgatcaaaaatcttaactga

SEQ ID NO: 12105 - RNA, 957 nt, unidentified
  source 1..957: mol_type = other RNA; note = synthetic construct
atgaatattgactataaggtccggtatattgatacgaatggaaaaaagcgtaagatcgtgacctatgccaatgaggaaaaacgcaaagaacacattgagattaaagagttcctcgagagagagctgatcttttctaagtttaccaaagcctacatatctaaaagcagcatctacaagaatgctagagctcacatgtacaatgacattttcatcaagtatgacatcgagaagttcttcaacaacataaaccacaagattctcgtggagatattgcatgagcaattgaatctgaagaatgaacaggatgaaaactctatcctggaagtggcagaattggtttcatcctgcattgtcggcaagaagggtctgcccttaggcctgatcaccagccctatcctagcaaacatctaccttaagaagttcgacaacatactttacgggaaactgaagaagttgggcttagagaatattatatacactaggtatgccgatgatctgaccatctcatttaaaaacccgaacgagtggggagttgcgtcctttaatgaggaactgacttacattgaggaggtgattacgaaacaactcaaaaaatatcggctcaaactgaacctgaagaagaagagtatcatcaatctgaaggtgagtaaccatgttagagtaactggaatctcgatcacaaaagtgaccgacgataagcgacggctctccgtggggaaaaaaaggattaacaagctctacgatgacgccctgcagttatatattaagcagcagaacaaggattacgtacttacagatgaagacttttaccacataaatcgcatcaagggtatggagagtttcattctatcagtccacaaaacaggctataaccattttttctccgggatgatgcagaggaaactggaagaattcggatttgacagcctcggcgagcttatcaaagacctgaattga

SEQ ID NO: 12106 - RNA, 969 nt, unidentified
  source 1..969: mol_type = other RNA; note = synthetic construct
atggaaaaaaagataaacatggccgactatatggttagatacattgtaaccaaaggcaagaggcggagaatagtcacctatggaaatgaagaaaagaggcaggagcacaacgaaattaaactctttcttgaggagaagctgattttcagtaaattcactaaagcctacatcgcctattcatctatatacaagaatgctaaggcacacatgtacaatgacatcttcatcaaatacgatatcgagaagtacttcgatagcataaatcacaaaatccttgtgcgaatcctgcacgaacagctgaatctggggcaggaaaaggaaatatacacaatctttgagacgtcagaactggtgggcaattgcatttttggaaagaaaggcctgcccttgggcctgatcacttcacctgtcctcagcaacatttatctgaaaaccttcgacaacattctctacggcaaactaaagaagatgaagttggagaatgtcatttatacacgttatgcggatgacctcaccatctcctttaagaactcgtccaggaagagcctggaggacttggatcatgtattcagtgaaatcgagtctctcattaatctccagctaaagaactacaagctaaaactgaacgctaacaagaaatccattatcagccttgatgtgagcaaccatgtcagaattacagggatctctattactaagctggtgacagggaagcggcgcttatccgttggaaaaaagaaggtgattaaactgtttgacgatgccctgcaactgtactataaaaagatcgtggacgcagatgagttgagtaatgaggacttgtataatatccagcgcgttaaggggatggagagtttcgtgctgtctatacataaaaccggttacaaccatatgtttagcgagaaaatgcaagacaaattacttaacctcggtttcaagtcccttcacgagctcatcgaatcattatga

SEQ ID NO: 12107 - RNA, 957 nt, unidentified
  source 1..957: mol_type = other RNA; note = synthetic construct
atgaataaagattacaagatcaagtacgtggagatcaatggcaaactaaggaaggtagtgacgtataataatgaagctaaacggttagagcatatcgaaattaagagattcttggagcgcaatcttatcttttccaagttcacaaaagcgtacataccacggagttcaatctacaataatgcaagagctcatatgtacaacgatatcttcatcaagtatgacatcgagaagttcttcaatcacataaatcacaagatcctggtggaaattctgtacgagcaactgaacctaaagagtgagaaggagatatatagcatgttagaggtcagtgagcttattggtcgctgcattctgggcaataaagggctgcccttcggtttgataaccagccctatccttgccaacatttacctgaaggagtttgataacatcttttacgggaaactgaagaagatggaactcaataacataatctacacacgttatgccgacgacctcactatctctttcaaaaatccgaacaactatggccttgttgaatttaacgagaaactgacagtcatcgaaaacgtcatcacgaagttgttgaaaaagtatcgactgcggctcaactccaacaagaagtctattattaacctgaaagtgagcaatcatgtgcgcattactgggatctcaataaccaagatttccaatgacaagagaaggctctctgttggaaagaaaaagatcaacaggttgtttgacgacgccctgcagctgtatctgaaaaagcagcgaaccgattacactcttaccgacgaggatttttacaacattcggagggtaaaaggaatggaaagcttcattctctcagtgcacaaaacaggctattcccactttttttcggaaatgatgctcgaaaaactgaagaaaattggattcaactctctccacgatttaattaaaaccctggactga

SEQ ID NO: 12108 - RNA, 975 nt, unidentified
  source 1..975: mol_type = other RNA; note = synthetic construct
atgaacaaagtcgatgctacgtggtacaagattaagtttattaggagaaagggaaagatcagaaaaataatcacctataccgatcagtcagtgatagagaaacatacacggattaaagagtttctggaggagcgtttaatattcagcaagttcactaaggcctacgtgaagaactcaagtatctttaataacgcaaaggcgcacatgtataatgacattttcatcaaactggacatcaaggacttctttatatcgattaaccacaaaatcctgctcgatctgcttttttcacagcttaatgttaacccagatcaaaccaaagtgtccaagatggagatctctcggcttattagcatttgctctatcgagaagaaaggcctgccgttgggcctaattacaagccctattctgtccaacatctatcttaaggagtttgacaatatcctctatgggaaactgaagaaaatgaacttcaagaacatcatctacactagatatgccgatgacataacaatcagttttaagtctgaggacacaaatgaattcatccaaggcttaaaggtggaaattctgaacctcgtggaagtcttactcaaaaggtacaagcttaaactcaatagggacaaaatctccctcatcaacttgaacatttccaatcatgtccgcatcaccggggttagcgtaactaaggatagtaataactaccgccgcatcagcataggtagaaagaggatcaataaactgtaccatgatgctttgaacctattcattaagatcaaggtgcgaaatatgagcctcgataatcacgactttctgaaaattcgacagattaagggaatggaatccttcatcttttctattgagaaaaacggatacgacaccatttatagtgaaaagatgaagctgcggataaatgaactgggtttcgaatcattgtcccagctgataaaaaacctgcccgagaaaaatttctga

SEQ ID NO: 12109 - RNA, 963 nt, unidentified
  source 1..963: mol_type = other RNA; note = synthetic construct
atgaatgagaagaaaatgtggtacgaggtgaaatacatccggaaaaaggggaaaatcaggaagattatcacctataaggatgagagcatccgaagactccatgttcagattaaggagtatcttgaagaacgcctcatcttttctaagtttaccaaagcctatgtttctaattcctccattttctacaacgcaaaggctcatatgtacaacgatatcttcctgaagatcgacatcaaagacttcttcaactctattaaccacaaaatcctgctggaggtactttatagccagctgaacctggatagcaagcagaaggagacaacaaaaattgaaatcagcaagcttatcgacgtctgcagtctagacaaaagaggaattcccttgggcttggtaacctctccgattctgagtaacatctatctcaaggagttcgataatattctttacgggaaactgaagagactcgggctggagaatctgatatacaccagatacgctgacgatctgactatatctttcaaatccattagcaacatcccagacactctgctcaaagtgattctggaattagtctcaggtttgctaaaacgttacaagctgaagatcaaccctaataaggtgtcgctggtggacttaaatatcagcaatcacgtgcggattactggcgttagcgtgacgaaagatgccaacaattaccggaaaatttcaatcggaaggaaaaggataaacaatttgtatcacgacgccatcaatatgtatattaagtgtcgcacaggcagtctgtcagatgcagactatcttaggatcaagcaaataaagggaatggagtcctttgtctacagtgtggaaaagcacggctatgatcgcgtctactccctcaagatgcatgaacagataaagaatatgggtttcgactcattgtccgagttaattaaaaacctccccgaaaacatacgagcgtga

SEQ ID NO: 12110 - RNA, 960 nt, unidentified
  source 1..960: mol_type = other RNA; note = synthetic construct
atgaactctgactacaaaaagatagtaatcgtgaagaatggaaagaaaaggtttttggtgacctacaataatccagaggttagactgaaacacgaggctatcaaacgtttcttagaggacaatatctactactctatctttaccaaagcatatcgcaaaaagagcagcatttacataaacgcgaaagctcatatgtacaacgatattttcctgaagtacgacatcaagaacttctttgactccatcgatcataaaattctcgtgcaattgttacacatggagctaaacaagttgaacaaaaatagcttcagcctcctggacgtggccacactggttgaggaatgcattattgataagaaagggctgccccttgggctgattacttctcctaccttatccaatatctacctgaaggaattcgataatatcctctatggtaagctgaagaagatggatcttagcaatgtcatctatacccgatatgcagacgatctgactattagtttcaagggtaatctcactagtgaggaattgtcggaattcaatcagcagcttataattgaactccagaaactgctcaagaaatacaagcttacactcaacaagaataagatttccatcatcaacttgaacatctcaaaccatgtcaaagtgacaggcatcaacatcataaaaaagaacgacaactaccgggaactaagtgtaggaaagaaaagagtcgccattctttttgacctggccctgaatatttattccaggatcatgaatgatgactacacactgaacaaggatgattattatgagatatccaaggtgaagggactgaactcctttatcctgtcaattcacaaaaaaggctatgagaatatgctgtctcaggaaatgcggaacaagatttttgagaaaggctattcaagcctaacggacctcataagtaatctgccgaactctaacaattga

SEQ ID NO: 12111 - RNA, 969 nt, unidentified
  source 1..969: mol_type = other RNA; note = synthetic construct
atgaataaaagctggtacaagattaagtacatccgcaaaaagaggaagatccggcgtattgtgacatacagcgacaactccaccgaaataaaaaataagcacattgggatcaaggagtttctggaaaagaatatctacatgagcaaattcaccaaggcatataagaaggacagctcaattttcaagaatgccaaagctcacatgtacaacgatgtgtttattaaactggacatcaaggacttctttcagaacattgatcataaaatcctgctcgagatcctttattttgagctcaacaagagtaagtctttaagcactatcaagtactctaagaaacaactcttatcactcatcgagctgtgctctgtaagcaaaagaggtttaccccttggcctggtgacttcgcctatccttgccaacatctatctgaaagagtttgataacctactctacggaaatctgaaaaagttcggcctgaacaacattatatatacacgatacgccgatgacttgacaatctcattcaaaaaaaccagtcagatcaacatagttaacgagaagaagaacattgaattgctggtcagttcacttctgaaaaaaaacagactgaaactcaacttctccaaatctaagatgatagatttcgaaatctccaatcacgtccgcattacaggtttgaacatagttaaggacacgaacaattttagacggattactgtgggccgaaagaggattaatgacctgtttcatcagagtatgaatcttcatctcaaactgaaggaatattccctaaccgactctgataaactggagattctgcggattaaaggaatggagtctttcatatattccatcgagaagaagggatacgaatatgtgttctccaataacatgaaggagagcatctacaatgaggggttttcgaatctaaccgaactcatcgatgcgttgggggctaggttggaatga

SEQ ID NO: 12112 - RNA, 927 nt, unidentified
  source 1..927: mol_type = other RNA; note = synthetic construct
atggtgaacaattccggctttgccatcttcaaactcaagaagaacaagaagatccgaaaaatcgtggcgtacactagcaacagcgagctgaaaaacatacacaagctgatcaacgaccacctcaaggagagggtcatatactccaaattcacaaaaggttacagagaaggggtgtccatatttgataatgctaaagcacatctgtacaacgacatctttatacaattcgacatcaagaacttcttccctagtattaatcaccacaaactgattaacctgttgtacaaggaggtaaaacataatgggtataacatcagcaagagtcagtcctacgaaatcgtcaaaaaagccagccagggtctaaaaggcctgccacttgggttcatcacctcacccctgctgtcgaacatttatctcaagaaatttgacaccatcttgtaccacaggttgaaaaagcagggcttagacaatgtgatctatacacggtatgccgatgatattaccatatcctttaggtgtattcccgataagactgattacagtgacatccggagcaccatcgagaagatcatttcaaatttgctcaagcggtattctctgaagctgaataataagaagacccgcgtcacaaaccttctcaaatcaggaaatgtgaaggttacgggcgtctatattgttaataagagggacgactatcgacatctgactgtgggacgtaaattcaagaaagagctactttgggatgctattcagacattagataatatcgagagagacgaatctttagtgaagcaaataaagggacgctactctttcgttctctctattgaaaaagagggcattgaaaacatgctgtcaccgtgcatgcgcagaattctcaacgaaaagaacatcagttctattaatgagctgtttagcgtactttga

SEQ ID NO: 12113 - RNA, 927 nt, unidentified
  source 1..927: mol_type = other RNA; note = synthetic construct
atgaggccaaataaagaattcaaggtgtttaagctcaccaagaacaaaaaagttcgcaagatagtcgcatacactactgattcaaatctcagaagggaacacgtgcttatcaataattacctgagagaacgggtgcgctattctaaattcaccaaaggctacagaaagggaatctcaatctttgataacgtgaaagcccatatgtacaacgacattttcatccagtttgacatacaaaggttttttcctagcattaaccaccgaaaactgactaaacttctgtaccaagaggtcaagtataataactataacctgagcaagtcccagagctatgagatagtgaagaaatcatcccagggcctcgagggattacccctgggatttgtgacctctcctctcctgtccaacatttacttgaaacggttcgacaacatactatacgggcatctgaagaaggaggaattagataacgtcatctatacaaggtacgccgatgacattacaatcagctttcgcggcattcccgataagttagattacagtgacatcaagagcagaattgagaagattatcttcgatttgctgaaagagtacggcctgaagctgaataataagaagacgcgtctgaccaatcttctggagtccggaaacgtaaaggtgacaggggtttatatagtgaacaaacagaattcggtccggcggttgacagttggccgccgattcaaaaaaaagttgctatgggacgctatccagagcctcgacaatattgaaagtgacgacttcctcattaaacagatcaagggtaagtatagtttcgtactctccatcgaaaaagaaggtatcgagaacatgctttctccatgcatgaggcgtatccttaaggggaagaatatttcatctattgatgagctgttcagtatcctgtga

SEQ ID NO: 12114 - RNA, 2028 nt, unidentified
  source 1..2028: mol_type = other RNA; note = synthetic construct
atgaaggaagtatatatgctgttcttcaagaataaccaggagaaattcaagccatcatttttcattgccttcctatgtggggttaagtacaaaagcaattctcctgaggataaacgaaatgtgctttatgattacctcaaacagaacagaaagattaaaccagtcattctcgagaaatcatttgacatcgactcctttgacaacattaacaccttaaactacaaggacattggtttgaataacctgcgtgatatcgagatcctgactagcttgtattctcatctgatttttgtcatccacgagtccatgtcaaccgcgagcgagattggcatgtttagctatgatgatcatactgccaaaaaaatatgcgtgatatatcctgacgaattctctatcaacaagaatgtcatcggtgattttttcacttacgcatttttctcagatcgaaacccgattatcaacaacaagtttcctttttatcccagaacgaagactgtgcatcacgcatcaaataacgtggaggcgtacacgtacttcatcaataaccaaataacaaaggacctcgaaaacaagattaatacctacatcgagaacaatagcaaaaggacttacgacctgaaacttcataaaaaattccaacgtttccagagttactacctactgaagaacaagaacaaggacaagatagatatgaacctgacagctgagttctttttttaccacatgcttgcccttctaaacactaatgaggtcaaagagatcttcgaggaaaataatcatgatttccacaagtgtgtgaccaaaattggtaatctctttctagagacattgaaaatgacaatcctctacaatcgcaagaacatcacagcaaacaaaataacgtgccacgtgaataactacccattcaaacaagccttgttttatctgttctatgtgttccacgatattggggtagtagaaatcaaagagaacaagatcgtgaagattgagaataagcagtatgacggctatatttctaaactgcacaagctgctcatctcgtacaaagaggaacgcaccttcgaaaaaatcaatgtgggaaaaaatgcctacaagcagttctacattaaaaagaagacaggcctttatcggaagatcaccacctataatgacaacgaggaaggatataaacttaaagaataccacgacaggataaatgattttctgaacgaaaacatcaccttttcccagttcacgaaggcttatctcaaagacacaagcatagttaagaacgctaggtgtcacctgtacaataacaccttcatccagatagatatcaaagacttcttcccaagtattaatcaccataagctgctcaataggctctactttgaaatcaaccgcggcaataacatgcggtacattatatccaagaaggactgtttagatgtcctgaagacttgctatttttccaagaagggcattcccattggactggtgctgtcccccacactcgccaatatctacatgaaatcctttgacaacgagttatatggcaagctaaagaagctgaatctcaacaatatcatctatacccggtatgcagatgatatggtgattagttgtaaggataagcttgaccaggagaaaattctgaagatcaaggaactggtttctgaacaactgtcgtatttgggtttgaagatcaatgagaagaaattccggaatgtaagcctttatacctctaatcatgttaagatcacagggattaacatttgcaaggtgaaaatgaaggggaacaacaattacagatatctgactgtgggacggtccaaaagggaattgctgtacaaactggcctttgagttattagaactcaacaaggacagttttatctaccagtacaaactcaaaaagcttaaagggtactatgcttacgtgtattctgtcgagaagggaaaggttgacagactgtgccctcccaagtacgtcgataaactgagaaaatacggctacagcagctttagtgacctgatacgcgaattgtga

SEQ ID NO: 12115 - RNA, 1989 nt, unidentified
  source 1..1989: mol_type = other RNA; note = synthetic construct
atggagtataccttactcgagaatattaagatcactaggcctatcctgtttctttgcggtccatactacaacaaaaataacaaatccgatcgccgcctgattctgcaggaaaagatctacgaaatccacaagaataagtttctcccgctggttattgacgactttctgacagagaagaacataaaggacaacactatcgatattcagttgatggaggagatttgtgctgcggtgtctgcgcaaacgtatatttttctcgataccatgagttcagccgcagaactaggcatatttgcaaattctgccttcttcaacaaaatcaaggtgtacattcccaaaaaatctgacatctacaacaaaagcaacgtcgggtattttgtgcgggatgtggtcctgatgaaacacagcgacaaaatagagtgtctggaataccgacctgctgtggaacgcaatgctattgccacagattacatcttagaatactacaagttcgtgaacaaccagctccccaaaaatatagaagacgacatacgaaatgacgaaatattcaacgaaagcgatgagcatttcattgaatacctagatagcaacatgatgcctgacaacccataccagatctgttatcagattcgcaataataagatcgatgtgaatatcagcatcaagatcttgttttacatcaccatctccgtgatcagcatcgaatacaagaatgacattaaggagaagaacttctctgtcttcgatatcaacaaaatcatagagcaagtgaagagtatcattatcaattccctatctgaaaagaccaacaaagatctcaatacgatagatgagatcaatatcaacacagtgagcaagcataaaatcgagaaaattatccagcacatcgtaaaattcgcccatatttattacctgtactcacagtttcactcagtgtatttgatggagaagcccattggtaagattatcagaaagattgaggtcggcaaccatccatacactcttcttcagctgtccgactctcagcttgatcttctccaggacatcaacaacgacaaagataagtactacgaaaagatcgtaatcgagaaaaacaagaagaaaagggagatcatcaagtacattaacaataacgatggggataatgccaaaaagattcatgagtatatcctgaagaagatctattcatactaccggtttaatgacaacagttacgcatatcagaaaggcaaatctataaaggagtgtgtgaataaacacattgaaggcaaatcgttcattaagtacgacatcaagaagtttttcgagtcaattaaagaggagaacctctataagtgcttggtcgacattttcggaattgataaacggtttataggggctctgaaacgtatctttaactcatgcttctatgagaataccttacccctgggattaactctgtcccctgttctgtcggacatgtatctaaagaagtttgatgacaccatttccaggcaacttgaggaaaagggcattacttattcaagatatgcagacgacataatgatttcttccaaagagattatcgacgagaagctgtatcacgaaataaacaagatggttacagatgaactggttaaggtgaacctgatcctcaatgtgaaaaaatccgtcttcgttacattcaatagcaagtgcaacttcatcaggtatgtgggggtcaatattgtccagggtataaatggaaattacctcagtgtcgggaagaaatacatttattccatagccaaggagtatctcaaatacatggacaaggtgaatgtacttaattccgaattgagcagtgagagtgatgaagaactggaagagttgaaaaagaacgtattctatcggagaatggccatcattggaaaggtgagctttttgaagcaaatagagggagacaagggctgcaaaagactgaaaaagcgtctggagaaatatgttgatatcgacctggagaaaatttga

SEQ ID NO: 12116 - RNA, 1989 nt, unidentified
  source 1..1989: mol_type = other RNA; note = synthetic construct
atggagtatactctgctggacaagatcactataacccggcccatactcttcctgtgcggcccctattacgaaaaaagcaacaaatccgaccgtcgagtgatcttacagaatatgctgtacgatacgtataagaataagtatctgcctctcgtaattgatgacttccttaccgaaaaaaacataagggacgacaatatatccattcagattatggaagagatctgtgcggcggtttcgtacaaaacgtacatctttcttgacacaatgtcaagcgccaccgaacttgggatctttgcaaatagcgcttacgtgaatgagatttctgtcttcgtgcccaaagtctctgacatttataatcgcaaaaacgtggggtactttgtgcatgatgtcgttctgaaaaagcacgaggatagagtcaagtgcctggagtacagaccgggacttgaacggaaagcccttgcaactgattacgtcgtggaacactataaattcgtgaatgattcccttccaagcaacctcgctcggcacatcaaagaagaccccatctttggacaagaagacagtcatccaattaacctgcgcgaggacgacgtcgtcattccgcagactccatatcagatctgctgtcagcggaagggcaataacttaaccgtgagtatctccctgagattgctcttttacgttaccgtttccatcattagccatgagtacaaaactttcttacagtcgggagacgaggatttcagtaagttcgacatcgatgatatagttgacaaggtgaaccagtgtatcaagaattttatcagcggcaagacagggaaagatctgtccgcctgtgttatcgccaaactgaacacagtattgcaagaagaagagaggacactggtgtaccatatcgccaaatttgttcacgtttactacctgtattcacagttccatcgattctacttggtagagaaaccactcggtaatgtcgtggacaagattgccgtcgggaaccacccttacaccctctgcggactgaaggaaaaggacattactctccttgaaaagatacaagctgaccaggagaagtactttgagcagataatcgtacgaaaaaacaagaagaagcgggaaattatcaagtatcgcgaggataagaacggagatcaggcccgcgaattacataatcgaatgctacagggtatcctcgagtattatacggctaaccaggcaagttatgcatacagacgaggccgtggcattaaacagtgcgtccaacaacacttggatggggtggatttcatgaagtatgacattaggaagttcttcaattcaatcggcttggaaaaactgacaaagtgttttggggctgctctaaagattgacgagcgcttcttcaaagaattgtatagaatgctcggatcttgcttttatcacggcacactacctctgggcctggtgctgtcccctatcctttctgatatctatatgaacgagtttgacagaagggcagagggttttttttcaagtttgggatttacctacacaaggtacgccgatgatatcctcgtgagcgctaaggaggtgatggaggaagaagcaaaggagaaggccgaggagttcgtcgagagggagctgaaacggctgtcactgtctataaaccgtgagaaggtgagaaaagcgcggctggaaaaacagggggaccaaatccggtacgtaggtctgtatatagtgcgcggcgagaaggagaattttattaccgtgggtaagagctacgcatatgaaaccgcccgcgagtgtttggattacttccacaaagtgagaaggctcttagtggaggaactccccgccgcggagaaagaaaagctagagaaggatactttctttgaaaggcgcatcctactgggcaagctcggtttcatggagcagatggaggggcagaggggaattgaccgggtggaggctagacttaaagcccacggcctgtctattctggaaatttga

SEQ ID NO: 12117 - RNA, 2001 nt, unidentified
  source 1..2001: mol_type = other RNA; note = synthetic construct
atggattatatcctggctgataaactgaagattactcgacctttcgtgtttctctgtggccctaactacgagaggaacaagatcgcagaccggaggaatatcctaagagagaacatccaccgaatttataagatgcagggccaagaagtccttccattgattgtggacccttttcttgccgggaaatacatcgacttcaataagtacagtgtacaactgctggaggaaatctgtgccgctgtcagctgccagacccacattctactggatactatgtccgttgccactgagctcggaattttcgctaacagtacgtatagtaatgagttatgcgtgtatattcccaaaaattctgacgtgttcaatcagggaaatgtggggaccttcgtgcgcgaagtcgtactgaagaatccagccgctaacataagatattttgagtaccgcccgcgaatcatcaggagagcgtattcttccgtgtttaccgcagaacactatgcgttcaacaacgaccgcattcccaaaaatatcaaggaggttttgaaagaagacgccaagggcaacaaactgatttgcgatctgccgattatctatgatgattccaccagtataccctccgaggtaaatcatattgcttacacctacaagaactcaaagctggatatcaacattagcattaagctgctgttctacattgtgacctcaatctttcagcaggagtaccctgaaatcacaaagggcaagatcgacgacttaacacaggcacaattacacaatatatgcacgtatacggaaaatgcaataatcaacagcgtctcttttttcttgggaatcgataggaaaagcctgacagaaacccatataagcaccatcttgaagatcgataacaaggacgccattcagcatatagcaaagttcatcctgatttactacacaaagagccagttcaagtttatggaacttatcacatcctctgagtatacggctataaaaatgaagattggggaacatcccgacgtgatctttaacttaagcaaagaccagatgcaggtggtcaactttgtagttaagaacccagagctctgttacgaatgtgtgaatctgaagttaggcaaaaaggttagggagataattaaatacgccaaatccgaagagggcgataatgccaagaaactgcaccagagcatgaatgagatgttccgtgaggagtataagcacagtatctactcatatgcctatcaccaagggtcctcaattcgtaaatgtgtggattgccatataaattcaaggtcctttgttaagatggacatcaagaactttttcaactgtatctcgaaggacatcctcctgaagaagatcgagaacgaccaaaacattgataagcgctacgagcatttgctaaacgacattatcagctcgatttactataacgaaaagctgcccctgggactcgtcatgtctcctatcatcagtgattactacttgtttgagtttgacggccaagtgggaaaatattgcgagagcaaggctctaatatacactcggtatgcagacgacataatgatttcctcatctagcaccattgaggagcagctctacatggagattatggattttgtgtccaatcttcttaacagacttaacctgaagctgaataaggataagtgcgagtccgtccacttcgataaaaaccagtcattcatccgctacattggtatcaatatcgtgaaaggcgaaaatggagccctcaattacctctctgtcgggaaaaaatacatttacgccttggcaaaagactacctcaaatacgacaatttctgttctgcgcttgaaaatatcacgagcgaagaaaaagagaaaatgcagactaacgttttctatatgagaactgaactgatcggtaaaataagtttcatccggcagatcgagggtgagagagggattgaacggctcaaagtgcggctgtgcaagtattatccagacatagatctgaaagctctctga

SEQ ID NO: 12118 - RNA, 1974 nt, unidentified
  source 1..1974: mol_type = other RNA; note = synthetic construct
atgaaagagtacatgctcctagaccagatatctattgagcgccccatcgtcttcctgtgcggaccttattacaataagaaagacgacggagacaggagaaaaatccttaaacaaaccatctccaatcagtatagcaacagaatccttccgctgattattgatgattttcttacggaggaaaacattgacgacaagactatttctatccaactgatggaggaaatatgtgctgcggtcagtgtgaagacttatatctttctggataccctgagcagcagtgcagaactgggcatctttgccaattctactttcatgaacaagatacaggtctatattcccaagaaaaacgatatctacaacaaatccaacgtaggttacttcgtccgtgagatttcactgaagtctaggcccgatacaatcaaagtgctcgagtaccgtccaggagtgaaacgaaatgctatagcatcggactatattgttgagttttacagctttgtgggaaataaactaccattgaacatccatcaaagcataatcaatgacgaagatctcaaggagagcaagggcaaaaccaacattgaaataatagaaagcgctgatatgccacagtcacattatcagatctgctattccataactaatcaggaattgcaggtcaatacaagcattaagcttatgttttacgtgaccctcgctattgtttcatgcgagtataaagagctgtttgacaacaaagagtcagacttcagtaaaatatctctcgaggaagtggaacagcaggttaaggacgccctgtataatctgatcgaatcgaagaccctcatcaacaaaaacgacttgaaaaagatctcagtgaaaacagtactgaagcaagagcaaaatgacaatctcatccggcacatagtaaagttcttgcacgtgttcaataacaacagcgattacggagtgctgagactctttaagaacccaattaacaagatcatcaagcaggttatcaaagggaaaacagtgtttgacgtaattaaactcacccaggagcagattgagctgctgatgaagattaattccaaccccgatctgtactatgaaacgatcgagattagaaccggcaataaagtgagggaaattgtcaaataccgcaatgataaaaacggggacagtgcccggaagatccacgaagcaattaaccagtctcttaagaacgagtatatgtattcgagtaactcttacgcctacaaaaagggtgagaacatcaaaaaatgcgttatcaaccatcttgatggtatggggtttctaaaatacgatatccgcaagttcttcaattctatctccatcgagttactggccaagaagatgataatcgaattcgatatcgatccgaactacgtctaccagttgaagtccgtgttgatggcgtgctcatataacaatcaaattcctctgggcttcgtgacgagccctattttcagcgatattttcatgaaggacgttgacaacaaaatctgttcagtagccgagaaaaatgactgtatttatactaggtacgctgatgatatcctgatcagttccaagcagatgattggcgacgacatgtataagaatattgatctgaccgtcaaagccacaatgctcgaaaatgggctggtgaccaatgagaagaagaatcagtttatcaacttcgacagctcccactccttcctgaggtacatcggcgtgaatataatccaccaacagacaggaaatatcattacagtggggaagacttatatcaacgatgttgccaaggactatatcgagtacgatcaaaagaagaataactgtcagcagcagttgaatgaagaattattctactcccgcttacggattataggcaagattgcatttattaagcagatagagggcgacgtgggggtggagcgattaaagagacggctttacaagtacgaccctaacattgactttgatgcagtctga

SEQ ID NO: 12119 - RNA, 1992 nt, unidentified
  source 1..1992: mol_type = other RNA; note = synthetic construct
atggggtacattttgcgcgacgaaattattatcaggcgccctatcgtctttctgtgtgggccctattgtcagaaaactaacaaaagtgaccggcgcaacattctgcgcaagtgcttcaaagataattttaaggatggagtgctcccccttattatagatgactttctgaccgaagagaatataaaggatcctcagatcaacattcagctaatggaggagattttcgcaagcatcagccaaaaaacatacatcttcctcgatacgctgtccgccgcttccgagcttggcctttttatgaaccatgcctttctgaataaagtggttgcatatattccgaaggaaagtgacatcctgaacaaaaagaacgttggctacttcgtcaaagatgtcattctcaagatgaacagccgacaggctaagtacatagagtatagacctgcaatcacacgaagcgtaatcgcgaccgactatgccgtcgaacactatggcttcatcgatgacattgtgccagaaaatataaggcgtgacttgctcgacgatatcgctctgaagaccaagaaggtgcacctgatttgcctcgacgaaaaggagactaccccgatggacgattacagaatttgttaccggagaaaagaaaataggatcttccttaacgtatctatctcactggtcttctacattgtcgccagtctgatgtatgagaagtactctgccaaactagtgacgaatcccaacgcctctataaaggactttgatgtcgatgacattcttagaatgaccacagatacgttcgataactacctgctgcgcaaaggactacctactaacgaggacattgaaatcaacaccatcctgaagtgtagctttcgcgacttaatctaccatatcgtgacattttgttacatctaccactgcttttccacatacatgggtctgaggttggttgatagacacatggatactatcctcgagccctacgccgacaagaagatggggaatccactggagatatttgacatatccgtgcaggattatgacttccttattcaatgccagaagaatccagaggagttctactctaaattctacctgttgaagaatggcaagcgcagggaattcattaaatatagcgagacagaaactggaaagaagttacggaaaattcacgaacggatcaacgatgccctcaggaaaaactatgtgagctccgagaaatcatacgcatataaaaagggtagctcaataaagaagtgcgtggagttgcatcagaacaataacgggtttatcaagtatgacatctctagtttcttcaattccatagacatggatatcctgcttgacgcggtgatgaatatcttctccattaactttgcctataagaaagttatgcggaacattatctcgtctttctattacgagggcatgttaccactgggtttagtgatctcacccgtactcagtgacatctatatgctgaagttcgatcagcagataattgaatattgcgagaagaagaactacaaatacacccgttatgcagacgacatcctcatttcaaaagaaaccgagttcgaaacagtggagtacgacgaaattgatgatctggtgattaagtggttgcgacagctcaagctcaagctcaatagcaaaaagaaaaaacggttgttcctgcagaaagacgggcaacacataaaatacataggggtcaatatcgtacattttgccaaggggaataagctttcggtgggaaggcagtacatctatgatgttgtgaaggagtactacaattatagagagcaagctcgtaagctgagagaatatggcatcggagatgagactcatctattttatgaggaacgaaggatctctggaaaaatcgcttttatcaaagccattgaaggcgctgacggttgggagaaagttcggaaaagaattggcgacaaggagggcttatatatcgacgagaaactgaagttttaccacatatcctga

SEQ ID NO: 12120 - RNA, 2007 nt, unidentified
  source 1..2007: mol_type = other RNA; note = synthetic construct
atggggtatgtgctgagagatgaggtgttgatcaagaggccaattatctttttgtgtggcccttactttaaaaagggcaataaaagcgatcgcagatatctgttacgtaaatgcttcagaaagcactacggggacggggtgctcccgcttatcattgacgatttcctgactgaggataatattaaggaccccaacattaacatacagctcctagaggaaatatttgccgctatctcctgcaaaacctacattttcttagacacattgtctgctgctagcgaacttggcctctttatgaatcacgcctttaccaactcggtggtggcgtatgtgcctaaaaaatccgacattctcaataagtccaacataggatatttcgtcaaggatgtgattctcaaaatgaattctgaacaggctaagtatatcgagtacagacccgcaattactcgaaatgtgattagtagcgactatgccgtcgagcactacggatttatcgctgatatcgttccagagaatatcgaaaaggagatcgcctcagatatcatcttcaaagacaagaaggagaagttactgtatacggaggagaacgaacagtatcccgacgacgactttcatatattctacaaaaagcgtgatggcaagatgattttgcatatcagcatcgggatgctatttaacgtggttatgtcccttatgtacgagttaaatcagtcaaagttggtcacgaataaagaagcaaccattgccgattttaacgtggacgtcatacaacggatcaccaaagaagttttcctgaactatctcatcaagaaaggcattccatgtgggaaggagatagaactttacaccaaattgagctattccttcgacagcatcgtttaccacatggtcactttctgttatatataccattgctacagcacatatagggggctccgcttagtagatagacatatggatacagttctggatgcatgtgaggaaatcagcgggaataaccccctgcaagtattcggaataagtgaggaggattacagtcttgtggaatgctgtgccagggaacagcaaaagttctacacttctttcaccattactaaaggcggcaaaaaaagggagctggtcaagtatgtggataccgaaatgggagacgctatgcgcaagatacacgagaaaatggcgtcatccctgcagggaaagtatacatcctctgaactgtctttcgcatataaaaagggtgggagtatcaagaaatgcgtcgagctccacaaaaataacgacgcctacatcaagtacgatatcagtaagtttttcaactctatcgagttcgagaagctgtttgagaagattaagaaggtgttcaacatagattccgcgtacgatgtcataaccaagaagattatcgcctcattttacttccaaaagaaactgcctttgggtctggtgatctcacctctgatgtctgacatttatatgcttgactttgacgagatcattgcagaattctgttccatgcgcaattgcatttatacacggtacgctgatgacatcctgatcagcaaaaaaaccatgtttattgagtcagagtaccaggaaattaatcaaaaggtcgagctgtttctgaacgatctgaagctgaagatcaactctaagaaaactaagagggtgtttctagaaaaagacggtcagcacatcaagtacatcggaatcaacatagtgcattttgacacaggaaacaaactgagtgttggtcggaaatacatttacgacgtggttaatgaatactatcagtacctggaagatcttgagatgctgaaagtaaacgactacgaagacgaacgggaaagactgttctatcaggagcggattatcgccggcaagctagcattcattcagtcgattgagggttccgatggatggcagcgaatccgagcccgcttcggcaagaatgcctatctctgcgagaataaccggctcagcctcaacaatctcagggacaaagtaggctga

SEQ ID NO: 12121 - RNA, 2718 nt, unidentified
  source 1..2718: mol_type = other RNA; note = synthetic construct
atgtccaagaccaaaatcgctgacatttatgccggcttacctgatgcaaaggaagcaatccaatacgaaggcatccgagacttcatggatgccttcgtgattcccccggaatttcccctcgacgaggggctggccagaggtaacaagatgtttattacgggtaataaaggcatgggaaagaccgccgcactgcgatacctgaacgactacttaagtcggatgaacaagtctaccaaaagttcatttatgctctttgaacaggactacaacgacagacgcaaggccgagatgttaaatcaggcgcgctccagtctgtgtctcctgggaatagagcctgatgaaaagatcaatcaggacgacttcagttatatttggcgatggcatatcttcatgaccatcctcaggcagaacggcgagaatatgagggaagccattttcctacaggatgacacatggaaacgcttcaacaagttgctgtttagcgtcatcaagccagactttacaccaaccctgtccggcagtctgagcgttgggctgccctttttcggccccatccagcctgagattacactgaatctacccgagatccgcctcggtaagggcaagggaacttttgaagagataatggaggaggccactgattgtttcaaggagctgatccgctttaactcaccatattatctattcatcgacgaactggacgtctacaggggccaacgggaggagtatttgagagatctcagaatggtgcgggacttaattcgtgaggtcaagtttttgaatcgcctgatgcaaactgctgggtggaacaacactaaactcttctgtaccataaggcctgaagtgattcacgctatagatagagagcttagcggaaatattggtcggcagataacaggctttgactgcccgcttacctggtttcgcaatacccgcgagacatacacgcagccaatcatgcacttactgatgcgaaggattgagctggccgaagagaagaacggggagcggatcggaagcgaggaagaaagatataaaaggtggttccctcaaggtgagacgggcgaggagcctagcgacatttttcggcggataacatggtcaagacctagggacatcgttagatttctgatctgcgcagggaaccggtgcggtggacaaaaagcttttagcgagactgtgttccaggccgtgaaaaaggattacagtttcggatctctggaagaggtgaaaaccgagttgctagccctgtacactgtggaggaggtcgaagctatgtttgactgcttaagagggttgcccgcatgtattaccctcgctgacgtggcacggcggaccgaatctatgaagtgcaagcccgtttccgtttatggccttcagcgtgtgctgggcgacctgtatcgcgtgggggtcataggccagaaaaaaggaaatatccttcggtggcagcacgagggagatgatgggctgttctactctggtgactgggagattgtgattcatccagggctgtgcgatgcactttatatccaggaagtggaaactagcgcgcaggaacaggcccaactcgagacgcagcagcacacctcagggaccaaaagcactaatcaggaactgcaggtcaaggattctgctacaaaacctaaagatcccgtgatgtcatccgaactttcccacgaaatgaaggcccaccaagaagaagcgcgtgaggccccaatttttggtctgtccgaggagcagtatcaattacttctcgatagtcgcaagacaccaagcctctattttcaggcgtttactctcaagacaaacggaaaaacccgtgaactgatcaggtacaaggataatgagtacggagagaagattaggcaggtccatgagactgccgctaacgacctacaaaagcagtaccgccagcatgaggcctcgtacgcatatcgggctgggggatctatcgaaaaatgcgtttccgcacacgtgggcagcacatgcttccttaagttcgacatacatcacttcttcaactctattgacgctgcacttctggcctcagaaatccgagcccagctgcatctgacggcactcagtaaggagagcgtcgaggaatttgtgcagtgcttcttcatagacggcattcttcctctagggcttgttatctcaccactgctcagcgatatctacttgcactctctggacgagaacatggagactttctgtaggcagcagcgatgtatctattcaagatacgccgatgatatcatgatctccggagtagggctccagatggatcagatggaaaccgtcttctctggcaggctctccaatcttttgaaggagaagaaactcgagatcaatcccttgaagacccagaaaatgttcctgaaggagtctggccagtatattagatacgtagggatcaacattgtaagggctgccgaaggaaatgttctgacagtgggcaggtcgtacattcaccagttggcaaaggatttcctcgactttgcgcggagaaaagatgacgcgagaacaaaaaatggggaggctctgtccgaagccgatcagcaatatttgttttaccagggtagaaggttggctggcaaagtacaattcgtgaaacaagtagaaggcgatgctggagtcgaaaaaatactgcgccgaattcaaccgcattggatcgtggaagacgaggccgatctgatgcgtttctgtctgggtaaatga

SEQ ID NO: 12122 - RNA, 2001 nt, unidentified
  source 1..2001: mol_type = other RNA; note = synthetic construct
atgtgtaaaatcatgatcctcgtgttgaaaaagaagatcaagatagaccgtccgataatcttcctttgcgggcctttttacaaagcctcagacaaaaatgatcgtcggaacatactgaaagactttctcttaaccgagtccgacaagaaatgcatccccctgatcattgatgatttcgtaacagaggagaacattaaggacactacgatatccattcaactacttgaggagattttcgcagcgattgcacttaaaacttatgtgttcttggataccatgtccgcagctacggaactaggattgttcaccaataatgccttcattaacaaggtacaagcctacatcccagtggagaacgacattatttacaagaacatcggatactttgtcaaagacgtggttctggacaataaatctggcagagtggcctatatggagtaccatcctcgaatcaaaagggtacccattgctacagattatgtggtcgagcactatgaattcatcaacaatatcctgcctttaaacattcaggagggagttcgcaaggacttacacagctcactctggaacgaaaaagaagttgagatcaatgaatctgcagagctgccctcagatcactacaagatcaattataagtacgatgtggaggataacattttacgggttaacctgagcgtccagtatctattttacatagtcggcggtcttatttattctgaatacagcgatgagcttgtcaaaaatgagactattgactttgatgacagttgcatagaaatcctggaggagaagattaaactgatgctgcggatgttcattcagatgaatatcttctgcggaattaatcagaggacatacgtgcaggtgaacaccgtaataaaggataagatgagcaatatcatccggcatatggtgaaattcatatttctctaccatcagaagtctcgcctgaatgggtatttcctggttaacaaaaaatcgatcttgaaagaggtcatcgtggggaaatccccaatcgatttctttcattttaccgagaacgacattagctacatcaaggacatcaattctaataagggcaaatactacgagtgtctaaatctgaaactcaagggaaagaagagagagctggtgacatactccgagaatgatagggaaggtaaggctaactacgccaaatatatccacaagaaagtggtcagcatcattctggagaactaccagtattctaattcctcgtatgcttacagaaaagggtatagtattaaggattgtgttgcgatgcataagaactccacctttttcctgaagttcgacatttccaagttctttaattcaatcgacctcgacatcctggtgatgacaatcatggaagaattttctatcggcaagagctttaagatgcacgttgaagaaatagtcagtacttgcttcatagataacgaaatgcaactcgggctgatcctctcccccattctgtcagatatctatatgaagaagttcgaccaggtgctcgagaggatgggcaaggaatgtgggttcatatatactagatatgccgatgacatcctgattagcagttcaaacatcatcgccgatcaagacattcagattattaagaacgctatacagtctgaattgaagctgctgaaacttaaagagaacagtaagaagtacaagaagatttacctcaaaagcatcggacaacacatcaagttcttggggttgaatattgtcagaatgatggacgagaataagatcaccgtaggcaaggaatacaaaaactatattgccaaagagtaccttcagtttatcgatatgaaggtgaacgacgaggaagacaaaaaatgtaagttttactggggaaagcgcatcataggttatctgagttttgtgaaaatgatcgagggtgagaaaggcgaaaacgaagtgtatattcgaatactcaagagcacaggcggcaggattgcatttgaacgggagcgcctgcagggcgaatga

SEQ ID NO: 12123 - RNA, 2046 nt, unidentified
  source 1..2046: mol_type = other RNA; note = synthetic construct
atgtatgttattgacgataagatccgaatcgataaaccgattgtgtttctgtgtggcccctattatgatccaaaagacaaatgtgacagacggacgattctgaaaaagtacctgatcgataaggggaactttttaccacttatcatcgacgattttctgatcgacgacaatatcaaggacaagaacattaacattcagctcctagaggagatcttttcaaatatttccgttaagaccctgattttccttgatactttttctacctctgcagaactcggcctgttcgcaaacaatagcttttccaataagataaccgtgtttctgcctcagaagagtgatatcctgggggtagataacatcggattctttgtgagcgacataattcttaaacaagatcccaataggatcaattacttaagttatcgccccaaaatactcagggtgcctgtcgcctctgactacgtgaaagaatttttcggcttcatcaacaatgaagttccgaagaatatcaagaacgaattggacaaaaacttgattagtaagcgggagaattattacatcaatatagagttcgacgacctgaaccttagaaacaactcctcgaacataaacatcgagaaaatatccgtgaatgacaatgggcgtgatatcaccttctacatatcaatacacatgttgttctaccttgtggtcgccatcgtgtataagaattattacgagaagttggacggcgacaagaaactatcgaaaggcaaaaacatttccaacaaaaaggacaacacgaagataaagaacaataagaacttcaccgttaaccaagtgaagaatgtagaaagactggtgcgagagtatattttcaacacctattgcaaccataagggctcctataacaaaaacactaacgtggtcattgaaactaaactggagaggaagttatttgagatcattaagcacatgatgaagttcatttacgtgtatcacgcccatgcgaaatatatgtccaacaacttcattagcgaccccaataatatcattaaagacgtaagcgaggaaaatccagtgaaaatgtttaacatcagcaaagaggacttcggtttgatcaacgatataaagaataaccctgatcgctactatgagaagcggattattataacaaacaagaagaagcgcgagatcgtcaaataccgcaacaatgattttgggatgcagattaggaaactgcacacgaagatagctaacgtcctcgagaaaatctacatttttcacgaatctagctacgcttacagaaaacgaaaatcaattgtggactgcatcaatacccatcggatcaataattacttcctgaagtacgatatcaagagcttcttcaatagcatcaataagaagatcctgctcgctggcgtgtgccatgaacttaagattgatatcaaagcatacggcaaagagattgagagcatctttagtacatgcttttacaacaacaagctccctctggggttgataacttcaccaatcctgtccgatatctatatgaaagtcttcgacgttaaactcacaaattacctgaccgagaagtataacacttgtgtttatacacgctatgccgacgatatcctgatttctaatggtgagatgctagagaaagaaaaggaagatgagatcgacaattacatcatcaatgagctcaaaggtattagtctaaagctgaacgacaagaagatcaggaaagtcaagatttcagaaacaggagatcatttcaaattcctgggtgtcaatatcgttaagggagaggaagacaattacctcacagtgggacgtgaaagaattaacgatgtggccaaactctacttaaagtacaggcacattaaagacacctacttgaatgataagaccaacgataaatggatcttttacacacagaagagaatagtaggacagatcgcttttattaaccaggtagaaggaattattggctataaaaagctggaaaatcggatccttaagtgttctaaggggaatgtcatactcactaacaatattcagtga

SEQ ID NO: 12124 - RNA, 1980 nt, unidentified
  source 1..1980: mol_type = other RNA; note = synthetic construct
atgggtgaaaataaaatggcctacatcttgaaagacgagatcaagattaacaaacccatcatcttcctgtgcgggccatattataacgacctggacaaatccgacagacggaagatcttgcaagattttctgcttgagaactttcccaagaagtgtctgcccttaatcattgatgattttctgactaaggagaatatcggtgacaatgagatatctatccaactgttcatcaagattttcgccgggatctcgttcaagacctatatttttctggataccatgtcctcagccgtcgaactcgggctctttacaaacagtgcctataacaatagcctgtacatcatgttgccttatgagaaggagcggaattgtggcaacattggcgtgtttaccagcaacgtggtattggaggacaatgcagatcggataactgtgaggtattatcatccgaaaattgaacgaattgcattctcgaccgataatgtgggagagttttacaaattcatcaacgattgtctaccagagaagattcggaaggatatcttacaagattacgcggaaaatatcaaccttgagcacgagattcagattgctcataaagaggattatccacagaacgattactgtgtgaattaccagtacaataacactgagaatagcctgattgtgtttataagcgttaagctgctgttctacatcatttgtggcattgtttactctgagtatacagaaaatctgcgcaaaaaggagaaactggatttcgacagctataatatttacacaactgtagcgcatctaaaatcactcatcatggccttccttatgaagcacacttttgtaggaattaactctaagaccaaagtcgacatacagacagttctcacaagaaacattgaggatattgtgaagcacatcatcagtttcatcttcacataccataaaaactccaggcttaagggttactttctcgtcggaaagaacgagatcattaaagaactggaactgcagatttcccctgttgatttttttgacctgacagtgaaggacatcgaaattctcaatctgttcaaaaacaagcctgacgactttttctctacgttcgaaattaagacgggatataagaaacgcaaaatcactacctacaagaacaacatatacggcaatgccatgcgcgagttacatcaaaaaatctgcctcgttcttaacaagcagtatgtgtttgatatccacagttatgcctaccagaagaacaaatcagtgaagaaatgcatagagtgccacaaaaagagtaaaagcttccttaagttcgacatccacaagttctttaattccatcgacaaacgaaaattgagtcagaaactcctgtacgaattcgaactggacgaaatttacgaagagcagttgctgaatgtgctggacatatgctttgacgaggaaaaaatgcccattggactgataacctcacctatcctgtccgacatctatatgaaaaaattcgacgtggaattcagcaacgaattgggtgagaactacatctataccaggtatgctgatgatatacttgtctcatccgccaataatatctctctcgaggaggaaattcgtatcacccgcctcctcgtgtctaagcttaaagttctcgggctgaagatgaacaacaagaagtacatgaagagaaacttaaaggctatcggggactatgtcaaatacttgggaataaacatagtcgtggcaaagaatgggaatatcatcaccgtagggaagacatataaaaactacatagcgaagacttacctcaggtacattgaaattgatgatgagaatcgtgaagagaaattctacttaggcaagaaaattgctggctatctgtcctttgtcaatatgatagagggcgaagacggcctaaagaagatctacaccagaattgagaagagcactaagggagaaatcaaaattgagggcaagatcacggacctatga

SEQ ID NO: 12125 - RNA, 1764 nt, unidentified
  source 1..1764: mol_type = other RNA; note = synthetic construct
atggtgtatgccctgaacgataaaatcaaaattgaacggcctatcgtcttcctgtgcgggccctactacaagagtggtgatgtctctgatagacgaaggatactgaataaagttctacttgacgaatacaagtgtttgccattgatcattgataactttcttaccccagataacattggcgatgacacaatttctattcagctccttgaggaaatcttcgctggaatctcgttcaaaacatacatctttctggatactatgagctcagccgttgaactgggcctgtttacaaacaacgtttacaacaacagcatttcagttttcgtgccgcacctggaagaccgaaattgtggtacaatcggagtattcgtcaatgataatgtactgaccaacaataagaacgtgaagaagatatgctatcatcccaaaatcgaacgggtcgcatttagcacggactatgtgggagagtactacaaatttgtgaacaatcagcttccaacagtgatcaaaaactctatcgaccaagactttgaggagataggcgatcgagagtttaaaatcaaactgaagtgcttcaatgactatcctaaggatgattttgtgatcaactatcgtttcaatgagaaagagaatactctcattgtgttcatctccgtgaagctcttgttctacatcgtgggcgacatcatctatgctgagtactccaacaatttggccagcaaaaagaatcttagaataacctctgaccacataagactggttatggcgcagctcaattctctaattcgcattctattcctcaaaaacagcctcgtagccattaacggaaagactaacatcgtaatacagaccgtgttgaagcggaatatcgatgaagtcgtgaagcatattgtgagtttcatctttacttaccacattaacaggcgtgtcaaagggtactatttaacccaccacggtgacatcctcaaagagctaaacctgaagctctccccccaagacattttcaagtttaacgatatcgacatcgatttaatccgcaagattgacaagagcttttataaggagtttgagataaagagttcgcggaaaaagagaaaaatcgtgacctacaatgatgatgagaatggcaagaaactgagggaattgcataaaaagatggcactcaatctgcaaaagaagtataaattcagtgagtactcctacgcctaccagaaggggaagtcagttgtgaactgcattgagcggcacataaactctgtgcactttcttaaattcgacatccacaagttctttaactcaatcgacattcatagactctccaaacagattagcaatttataccagctggataagttctacgagaagcagctgttagaaatacttaaaacgtgtttcaacgacgagaaaatgcccattggcttgataactagccctatcatatccgacgtatttatgcatgattttgacgtcgaattcgccagtaagctcaataaagattatgtgtataccaggtatgctgacgacatcctgatttcctgttcccatgctatttctcaggatgagctggacaatattatcctcatcctgaagattatgctgaataggaagggattatcattgaacgaaaagaagacagcaaatgtcctgctgaaggacaaaggcgactatataaagtatctggggcttaacatcgttaaatgcgaaaaaagcaatcgcattaccgtcgggaaaaatattaagatgatcctgctgcgcattatctga

SEQ ID NO: 12126 - RNA, 987 nt, unidentified
  source 1..987: mol_type = other RNA; note = synthetic construct
atgttcggctacctcaccctctacttcaaagatatggagcgggccctcagtgttgcaaatggttatttagcggaccccgataagtacacaaaggtacacgttgtgcctatgaacgggaaagtgagaaaactcagagcttatgcagacaataaagagggtaagaggttacgtgaactacatgaggcagtagcgagatttgtgtgggacgcttttcaaagctctaacatgtcgtacgcctacaagaagggcaggagcattgtggattgcgtgagggcccatataaacggaaaggtctttctcaagacggatatccacgcttttttcgacagtacaaagctgagcactttcctgcagatgtttcttcggagcccaaagtttatggcggacaaacccaagctgaccactatactgtcagcctgcttttacgacggaacccttcctcttgggttcgtaagcagtccggctatctcagacttcttcctccacgaggtggaccgacgaatgcagatgttgtccggaattgtttatacccgttatgcagatgatttcctgatctcctccattaatgtcggcgctcagttcgtgctggagaacgccctgaaggtgctgaaaggggaaattcagaaactggggctggaactgaatgaacgcaagacgttctaccgcccattaaaaaacattggagactctatccacttcttgggcttgaacttggtcagaacttcttaccctttcaaccgggtcaccgtttcaaattcatatatcagggagacatctatcgatttggccgccgctctacagaaatccgatcagaaggcctatgaggccgcccggggcaagatttcctttgtgtctatgtgtagtcccgagtcctttgaaaaactcaagaagcttgtcatgatcaaatttcaccttgatctggaggaaatgctggacagcaagacagtgcaagaagctaaactggcaatacatctgaatcgcaaatga

SEQ ID NO: 12127 - RNA, 927 nt, unidentified
  source 1..927: mol_type = other RNA; note = synthetic construct
atgaaaatgccagagaaatgcttctccaccgcgaaggagtaccagtgcaatcctgccgagtttgtccgcgagcatgttgtgaccattaacggaaagaaacggacactgcgagcatacgcctacggatccggtggggaagagttacgtgcccttcacactgccgtggctcagatcatatcctcgggttatatgcctagtaatgcaagcgtggcgtacaagaagggagataacatagtcaaatgtgttagccgccacctctccggctgcgttttctttaagagcgacatcgtcagctttttcgaatcaattaccctcgagaagtttatggaccgcctgaaggactccctactggataaaaactcagacctaaagaagcttctccccgcttgtttctacgagaacatgctgcccttgggattctgttgcagtccaattctgagtgacttttacctcagcgacatagataagaaatatgaaaatgggcaagggtatgtgtatactaggtacgccgacgatttcattgtatcatctcgagtggagtccggcgaggaaatcttggaggaattgagggaaaagttgtgggacgatatggaatctgtcggactggaccttaacgagaaaaaaacgtatatccggagactggaccatgatggggatcacttccatgccctgggcctcaatatcgtgagacgtgagaaagggaagaatatcatcacagtgggcgatgcttatctgagggagacatgcaaacagcttacagccatcgtcggcggcgaaactaataacgaagaagacatttgtgcagtgaggggtaaaatcgaatttattcggatggcttctcaagatagttaccggaagttcgagagactggtgaaggtaaagaccggcagctctttacaggcaatttctgagagactgtcagattga

SEQ ID NO: 12128 - RNA, 960 nt, unidentified
  source 1..960: mol_type = other RNA; note = synthetic construct
atgaaaaagatcgacaagctaatccgtgttgctgaggggtacattgccaatgaagacgcctacatcagacactttgttgtggtgattaacggaaaaagacgtaagttggctacctacgcaaacagcgaaaatgggaacgctctccgggagctgcatacttatatggcctctttcatacgccgactataccaacaatctaatgcttcctttgcatatgccaagggtaagaacatcatagactgcataaaagtacacatccggtcagacgtgttcctcaaaactgacattcatagctatttcaactccattacgttcgaaggcgccgagcgggtcctgaacagacacaagacgtaccagaaaaactccgattctatgggcatacttctcaaagcttgtttttataatggccggttacccctgggattcgtctcatcccctgtgatcagcgatatttttctggtggcgctggatcgcaagtacagcaagagaaaggatattctctacacacgctatgcagacgattttatcatcagcgcaaggggagaaaattcagtcagcgtgctggacgaagtgcgagagactctgtctgatgatcttggcaaacaggggttgttcctgaacaccaagaagacatacatccgcactctgaaacaggccggtgatgccatccatctgctgggtgtgaacctcgtgaaaaccgaaaatgaggagaataggatcaccgtaagtgacaggtatatcagggagacatcgaagggattctccgacttgatgaattttaatggggacattgaagagaagaccgagctttgtaacacagtttgtggacagatatcattcattcagatgtgtagtcaggatagtttgaacaaactccaaaaaatggtcagggtcaagtgcggctatagtgggtctttacaggcgaaagcaatttgcagagcctgcggccttgagaagtga

SEQ ID NO: 12129 - RNA, 996 nt, unidentified
  source 1..996: mol_type = other RNA; note = synthetic construct
atgcggggcaaatattctaaatcttggtctatcgacaccatgtatacagatgcaagaagtaccgtcgagcagtacaacgaagatcctgagaagtatgtacgttcctttaccgtgcggataaacgggaagaagcgcaacattatcacatataccccggatcggaatggagctgcactgagaaatatccactcacgatttgccttcacaatctcccattgctatcagagcatgcctgactccttcgcttacaaaaaggggtctggaattctgacttgcctgtcccagcacctccagtctgacacttttttcaaaacggacatccatgactacttcaactccataaaattcgaaacactcctgagcatgtttcaagaggataaaacgtgtaagaggagaatgaaaaagatcaaggcattactctcactttgtttctacaatgaccacatgcccataggcttcattacttcacccgtgctttcggatctgtatctgcacaaggtggacgaatcgtttctgggaaggtacgacgtcatttacaccagatacgccgacgactttatcatctccggcaagaacaatatgagtagcctagaaaaggccaaaaatgaactagaggaaagcctgagtgagtacggtctttcattgaacgcgaaaaaaacctacttcaggaccctccatcgcccaggcgatgctattcacgtactgggggttaacttagtcaacaacgaccccgatcctaacaggattacagtgagtgaccggtacatccgagagactagcaaagatatttgccgctttcttagcgaatatcaagatcagactaaggaagagaatgagattgccctgtcttccgccatcggcaaaattgagtttatccgcttcgtgagcccatccagctatagtaagctggagaagatggttcgtatcaagcatggggaggccgtggatttgtcaagggctatgctcgagggtttgataaagaagaataattcttga

SEQ ID NO: 12130 - RNA, 2103 nt, unidentified
  source 1..2103: mol_type = other RNA; note = synthetic construct
atggcactgtccttcttcctgttcatgtacattaccaacttcatatgcagtctggattccaggcggcctttggtgttcctgtgcggaccagcttactctcctaatccacaagaccgcagatggatcctatctcattatattcagtccaaatggtccgaaaaagaaaaggataagtatgtccatgccttcccaattgttgtcgatgagttatttaagccggacgaaattaaagagaaaaaactcgatatccggttgaacatactggaggagattgtctcgaagatctcatacaaaacttacatcttccttgacaccatgtctacatcatacgagatgggtcagtttactaactttgcctataacaacgatagtgtgacaatattcgtcgacaagaaatatcgtggccgcaagaacaacgcaatcggggaatatatcaggctgtctattgacaagtcattcgtggagtataccgcgtcttatgataataacggcctgatttactttcctgagaaagacggtaaaggcaaaacacgaatccccaaggagattctgaaggtgctcgaggatgacaatcctgtgaaaaaaggctgtttcctgaataaaatccttttcagcacctatatcaacgatctgaataagccgggctacatagtgtaccatcgatccaaagatcttctgagcttcaacttctgcattcgcaacttgttctattacatatcctcggtatataagttgctgtctaagagcagtcaagccctccttaatgagattcctcaaagccccagagattatcggtttaaagagttcgttaagttcttcaaacaggaacttcttaagactttcgtgtgtgtcaacaatagttctaatatctcctttctcctgactgccgatttcagcatcgaagtcaatgtagagaatctggactgtgatgagttaatctatcacatgctgtacatttcgtacaaactctttaacatcaagagctcatctagtaggtatctaattcccgaagcctcagaccaatcatcattcgattccatttacttcgtggacggactcgaaatgtttggactctttgataatgagacaatgtgtgctctggacaaaaatcgttacctcccacacaagcagtgtatctcctttagaaccctgaagataaagaataagaccaggaatatcctagcgtatcggaacaatttttttggggaaaggttgcgtgggcttcatcagaccatcctggacagctttttaagcaagctacccacgagcaaatccagttacgcttacaagaaggggaaaaacacgctcgtatgtctgaagcagcacgaaggtaactactactttgccaagtttgatattcacaagtactttgagtctatccggctgaaaatgctcgggaacaaaatacagaactacttctacaagaagatcaatgctttgcttagcaacctttctctgtcttatagcaacaagaagaggattaattccaagctcacgtccatcctgaaacccttattctacaaatatcagcttcctatcggattcgtgtcaagtcccaaaattagcgacttttacttgtttgaatgcgatgagcgcatgaacaagcagaaagggataatatacacacgctatgcagacgacatcctcatctccagtaagagtaaaggagaattggatgagggcatacggctcctgaagagcctgctcagggaagaagagctagtgctgaatgagaaaaaaactagatttgccgttttgaaccacgaaaatgactcatttaagtttctgggtatcaacattgtgagaagaaaaggcgacttgttcgactataccattagcaatacctacctcgtgcagacatgcaagatgttctttaaagttttcgaggagtgggagtggaagaaggacattaatgaggttattaaggtgaatggaagaatctcctacattaagaacatcagcaacaattcattcaagcgatttctgcacctgttaaaggtcaagtttaaggacggcacaactatctctgacctgtattggcgcttaatctggatggattgcccactgtatctcgaactgccaaaagacattatcatgagctga

SEQ ID NO: 12131 - RNA, 1833 nt, unidentified
  source 1..1833: mol_type = other RNA; note = synthetic construct
atggaagaaatcctagccaaggtaagcgcgtctaccttcgtctttttggacaccttatctacagctgccgagtatggtatgtttaccaatgcacaggctaataactttacgtatacactgctcccttacgaagaagacataattaatgatgccgtgggatactacgtgaaaaagtcaatcagggaaaatagggatatcagagaaattgtcgatctggttcgctaccacccaaaagtcaacagatacgctaagtcgtccgacgtggttgatgaattttttggatttatcaaggacgagttgcctatttcaattgaagagtctgtgaagaagtccctcctgaggaacaaggagaaatatgagatcgacttctcgattacaaacgagagctcatccgatttctttattaagcttacgagcgacgttctggaacctcagcgttacaatatactgtgctcaactaagctgctgttttatatcatcgagggcttcctgaaggacgaatacggtaataaatccgagatcctcatcaaccagttcaagtataaccttgatgattatgtgagtagtgtaattggcaacgtgaacagcctggtgattaattctttggtgacacacaataccatcactcccctggaggcagtaaatagtaagtttgacattgacgtggatctcagcgagtctatattcgatgtcgttaagcacatgattgagttcctgattctgttccggaacggagggaataaatactccaagaggcggtctttgatttcaaatcccaacgagatttttactcggttcaaatcaaagatctccaaaaacgatagctcgtttacaaatatgatcacaaatgacaagcagctgataaatttcacaaaaatcgccctgcaaaaaccttcctatgagtataacaagttagcctacagcagtttcatagtctcttctccgaaaaagaaaagacggatagtaacttatagcaaaaccgagtacggccagaatgctcgagtgctgcacaagaatatcgtggcattcttaaataaccacgtgctcagtgatagcaattcttacgcatataagacaggcagaagcacttacgattgtgttttgccccatctgaatagtcaatacttctttaaagccgacatatcatcctttttcaacagcatcaactctgacatactcgtcagcaaaatagtgaatcatatcgaggactttaacgttcaacagagcactattcgagacatccttcatactcagattgaaaacatggtcaacaattgttactacctgaacaagctcccaattggatttgtgagctccccaaaactaagtgacatttatctcttcgagttcgacaaggaaataggggaatactgcaaaaaccgcaacaggatctattcccgctacgccgatgacatcatgatttctagcgaaaacgagatcgacatcgagtcaattaaaaagtcagtgatcgattccctttcgaaggtaaagttgacgattaactctaaaaagctcgaaaacaagaagcttctgagcattggggataatgtgaaattcctgggtctgaacattgtgaagaaagagttaggcaacaccatctccgtggggaaatcctatgtctctgaagcgaccatcgagttctgcgatatcgttcttaataaagacatcaaccaacgtgtcaagaaggtcattggcaagcttaagtacataatctaccaggaccccaccaagagtaaacagatcgagcgcatcatcaaaagtaaactcctaagtagctataacttcacctcctccaatgattttatgaccttgtataaacagctgtcagagtga

SEQ ID NO: 12132 - RNA, 2073 nt, unidentified
  source 1..2073: mol_type = other RNA; note = synthetic construct
atgcttgtcccatcatttcctatcagcatcgccctgccagtaagccagtcttcatttatcaaatggctgtttttcgtttgggagaaaatgatgaatcgtaccccagaggaggtgatcaatctaagacccttggtcttcttgtgtgggccgctgtatgacccttccgacaaaaaagaccgacggaaaatacttcgccagtatcttacacggtacaaaactacgttaagttacaacggtaaagactatgtcattgagccttttgccctgatcatcgacaaggtgtttaatacagaggatctggagaataaccagaatattgcactcatcgaagaggtgatagcggcatgtgcttacaagaactatattttcatcgacaccatgagtactgccctggagctcggactgtttgctaactcatattcacagaatagaaccaccgcattactacccaaagactttagaagcttcaagccctccattggatatttcgttcagcagactatcaagaagtcggataatatcgccttatgcatttatggcaataaacgcattaacaagttcatcgacggaggcagacaggtgatcgaaaacctggtcgcctttaaatcgcaccagatcccaagggagatcgagagggatatcaagaaagatttttccaaggggattgaaagctttattctccgcatagagttcacaacaaatattaaagacgcggagaagatactctatcaagtgaacaccgaagggattcggatggttatccccccacgcatactcttttacttggtggaaacctttggctccatcaacaatatcaaaaatgctctgctggattacttcgaatattacgagtgtgagaaagataaggagctagtgatcatgtctattttgattcgaaagggactctgcattctcgagctcgattctcccttcgagtattctataattgacgtgattggtagcatgagctacttcattgagaaactgaaaactcgcgtcgcctttcaccagaactatgaaaggcttcggtacgcccctatcaaacggtggaggagccgcaaaaggtttagtgcttgtgagctgctggggctggacattatcgaaatgcggcaaatgcaatcactgttcgggtataacaagaagaagagtgtgatctctaagaacctgcttatcaacgggaaaaagaggaagatcaaaatgtactcttgcacatctgaaggtttcgctctgaggaatttccatcttcggctgatgaaacagctccagaagcttttcgaactccagccatattcctatgcttacagaaaagatcgctctattctgatgtgtatgaaccagcacatcgacagcaagttctttttgaaaattgatatccgagacttcttcaactcaatctccaagggcaagatgaataagattatcaagtgccatctttgttacgatccgaaacaggcatatgaagacaacgtaatatggagaaagagccgttacttaggagagtacgtgaaggagtggttaggcattaaggagatcactgacatatgctttgtaaatggccgtctggcacttggaatggtgacatcccccatcctgagtaacatatacatggatttcttcgacgccagattccatgataactaccctgaactcgtctacaccagatacagtgacgatattttgatttcaagcggaaaatggttcgattacaagtccattctgaatttcatcgccaaagagctctgctacctggggctggaaatgaatgaacacaaggttgggttttataagctaaaacaggccggcgatcacatcaaatttttgggcctaaacatagtgcatggccctgcggaggaaaactacataacggtaggaaagcaatatatcaaggatgtgtgctccaatatcagtcagtacgaaaagaagattggcttgttcaagaaaagccagataattggtcagatagagtacatcaagtttatttccacccgagactatctgcaactgcaaaagatctacaggattaagaatcacaaggacctcaacgttgaagaattgaaccgggtcggtctgtga

SEQ ID NO: 12133 - RNA, 5223 nt, unidentified
  source 1..5223: mol_type = other RNA; note = synthetic construct
atggccaagttcagttatgagcagtataaaaaggtggtcggaaaagccactgtcaagcccgagatcaacgttgagagcgtcaaagggtatctggataacccaaatcagtatgtgtttccgtttgcgattaatgaaaaaaacgggaaaacacggaccattattacatacaatgagagttcagacgggaaaaacctgcgcaaagttcatgagctccttgcaaaagacttcgaagataattttgccgagaggaaccaatacagttacgcataccataaaggcattagatgttacaatgcgctggaggctcacctgaagagcaactacttcataaaactcgacatccatcatttcttcgagagtataacgctggagaatttcttggatatctatggtgagtacttcaacaaaaactggcgggaaatccttcagtacctgttctactttggctcactttcaattggttttgtaacctcgcccttgttatcggatttctacatgaagaagtttgacaatgccatcgaagaatatctcaaagattacccagagctccacttttcacggtattccgacgacatcatgatctcttccgagtccaaggataatgataccagtctggaagccttgttcatttttatcaaggagcaactcaagcagttaaggctcgaaacaaacgaatccaagaccaaaaagattaaactgaacttagagaagcacaactctttttcattcctgggcctgaatctatcgaagattgatgaggagaacaacaaggtgactatctctaagaggtacattttgttcatcctgtttctgatcgcaaaacagaaacggtataagaataattgcaccccactcgacaacgagatcaagtccagagtcgcatacttggcctataatagcgaaatttcgttcgagcgatttcaaaagaagcacattaacatctacggtgaaccttacaatttcattcctaaggtcttagagaagcgcgaggttggacagaccaccgacaccataaaagattactcagaatataaggacgagtttgagttcaatatccactccaaagccgatggtgcaaacacgagcggctaccagatcaagaatggcatcactctgactaagtatctggggaagaaggaggaagtgattataccagactttgtggacattatcggtgactatgtgttcatgggacacaagatcaaaaaggttatcctcgggaacaacgttaaaatcatcgggaatgacgcttttcgcaactcaaccatcgaggagatagtgatgaacgattccctgcgccatatcggaaatggagccttccagaactgcaagaatatcaaaaaagtcgtgattccttcttacattaagtatgtgtccaacaatacctttgcggagagtgggctggaggagattaccctgccagaaggccttataaaaattaagatgggggccttcgctcagtccaatatacaaaatattaacttccccaccactttggaagccatcgaatacaatgcatttacagaatgcactaaactcagcagggtggatctgagcaaaacaaacatcaccagccttggagtaggggctttcagcaattgcgtgcagctgaaggaggctatcttgcctgaagggttgtctactatcgagaacaacctgttttctaactgctctcttctgaaagagatcaacatacccgcgaaagtgggctacataaataactcagccttctccaattgctattctctatctagcattaaagtctctgacggagtggccttcttgagtcgaaaagataatgcctccatagtcaagaagaaccacgaactcctgtttacactcaaggacaagattgatgaagacatccagattataggacgtggcctcttcgctggagtggctataaagaacatcgtaatccccgagggagtgaagatcataaaagaggatgcctttaaagggtgtctttggcttaagtctattactttaccagaaagtctggaagaaatcggcaataatgcatttgagaagtgtatttcccttgaagagatcgttattccctccaaggtaaaggcactccctaacggcctgtttgctaactgctccaatctcgtgaaggtggttatgggcgaagaagtcacctcgattggcgacaattgtttcgctaatgacaagaagctctcaatcaaacttccgaaagaactaatgctcatcggcgagggtgcctttaaaaactgttacaacattaaggacctctacataccttacaaggtgaaagaaatcaagaaaaacgctttcatcggaatgagtaaacacctgaacagcattaaggtggataacaaaaatcttgtgtactcaagcggagaagacaataatattctcttccttcagaagaagggcagcttgatcttggggaccaaccacagcactatccccggaggcataaagtctatcggcaattacgcatttgcctataattctgaactagaggagatagatctgcccgagacagttaccactatcggagaaagcgctttcaaagggtgtacaaacctgaggaaagtgaacctccactatgtgagtaagattgaaaagcatgccttcgaaaatacacctaacctgaaggacatctttctgccaaacagcctgactcatattgaggaatgcgcttttctgaactctggcctgacgtcgatcacactgcccaactctctcgtcaaattagacaagaaagccttccggggttgccgcaatgtgaaagatattcatattcccgcatcctatactagaagcctcagcgcactgttgaccactggttccgaggagatcaactacatcgaaattgacccagataattccatgtaccgctgtgtagataacaaggtgatcatcattaaggcaataaacaatgaccccgaaaagatcctgttcgtttgcaacggcgtgaaggaaatacctaatgtgcctgtaattatggacatggcttttaagggtgtgaaggggctgaaagagatagtcattcccaacaaagtttgcgtgattggctcaaacgcttttgagagctgcccggatcttgagaaggtcacatttaagtacgacgacgatatcgagattaaggacaatgcatttaagaactgtcctaacctgaaagaagtggtattaccgaaacttctcacaattatctcagccaacctcttttataactgcccgaatctgaagaaggttaagattccagaaggagtgaaagtcatcggtgatcgagctttcagctacacgggcctcgaaaaggtaaccattcgtaaggacctggtaaatattggcaatgacgctttcgcatccacaaacctgaaagacgtgattattgaggaaggggtaaaaaaactcagctatggtctgttcacagagacaaaaatctccaatatcacacttcccaattcactggaggcggttcctgggaatctgttcgctggttgtaaagaactgacatccatcgtgattcccgacaaggttgcttccattggctctagctccttttccaattgtacctcattaaaagaggtgaagctcccagacaatctggagatcattgaggagagcacattctataagtgtgtcaacctggagaatattaatttcccaaccaagctaaaagagattaaaagtttcgctttctaccactgccacaagctgaacgttccagctttcaacgagggtctggagtcaatcttttccaattccttcaattctgtggagacattgaaagatctggcactacctagtaccttgaaatacttcaacaattctgccttcgcctattgtccaattgagagtatcaaggtcagccctggggggatgtatcaatccaataacaatgcccttacttatcacaacaaaaacgcgttcaatgagctaatactcggctgtaaaaatacgacacttgacgactcaataaacttcatcgccccttatgcttttaacaatatcgactctctcctcgaggtggtcttaccgaagaacgttaccaccattagttctaatgcgttttctgattgccacaacataaaacgtatcatcctgaacgacaaattggaatcggtccagagcggagcctttgattccaacttgtgcatcgacgaactgaaaattcctgccaataccaagtactttggctatctgccaaaggaagttaataagatcgccattgataagaacaacattttatacagcgactttggaattggagtgtttgcaactaaggacgggaagattctaatgaccactcccaccagtagcctgcctgtggaaggaatcacaagtatcaatcgggactgctacaacaatcgcaagttcacaaaggtcgagttgccaagtaccctgatctctcttggcggctttaataattgcgagattgatgagctctttatcccagatagcgtgaagaccatatccctgttcgccataaacagcatcatcaaaaagatcacagtgtccgagaacaacccctattatatcgcctctgaagatgggaccatgatcttaacgaggtcaaagaaacaaatcgtgtatctgggcgaaaataccgtcatccccgagggcattacggtcgcgacgacaaatgatttgatcacctcaatccattacccttctactatatcagacagagccttgagcttggaaccgagaggcataaaacagatcgatatcgccaaagatcacccaactgtagccgctaacaataataccctatacaggaagctggatggaggcttaatctatgccgtgaatggagaagagattgcggacgaggtcactaaaatcactaacctcaatctgggaaagttcgacaacgtgattatccccaagaacgtgaatctgatactgcccagggcactaggcgggcttatcattgataacatcgccgcacataaagacaacaagatgttcgatagccgggataactgtaacgctataatacatacctctacgaacacggtactttttatcgcaagaaatgggagagttcctgacgggtgtgttgtcacacccacaactattgaccagagagtgaaagatgtgacaagtattgagattgagaacaattacagtggttatgaaactctgtcatacaacgtcatacagcgactaaataataacccacagaccactactaaaagcagtttctccaccatagcctttgacagcgatgatgatctgcccttctga

SEQ ID NO: 12134 - RNA, 999 nt, unidentified
  source 1..999: mol_type = other RNA; note = synthetic construct
atgatcgaagtagtcgcctactcactgagctttagcccacagtttgtagctgagtgtgctgggagctctccctggtcccgatcattctaccgcagagtgtccatacctaagaaaaataaacccaacgaacgtcgtattatctatctcccatctccagagatcaaacttatgcaacactttcttgttgagcgctacatttctaaactgcctgtccatggctctgccaccgcctataggcggggaagcagtgtcgtcaagaacgctaaggcacacaccggtaattcccatttcctccttatggatatagaaagcttctttgacagtattcagaggggtagagtgaagagaatgttgctaaacaatggggtgtttgtgaacccggcagatgccgagatgctcatctcattgtgtacttacgacggacatttcgtgcagggttgtgtgtccagccccagcgtggccaatgcgtacctctatgagtttgataacaaaatggatatgctggctaggggcctgccaaatggcgtgtatactcggtactcagatgacatagtgctgtccagtagtgagaggattccggggcagatcgcagcagaagttgcggccgctttggctgagttcggattgcggatcaatcacaagaaaacacacttcatctcgaatcgacaacgcatccatataacggggattagattgaaggacaacaagaagctaggcctgaacaccctgttcaagaaggagttaaaaaacgacgtttatcagttctggaagaagtgctccttatccggcgcagatctgaaagacaaaaatagattatacggcaaactggcctatcttaagatggccgacccctcttactacaacacaattatcaccaagtataggttcggatgccgcactctcctcgactttctgcactgcctggtcctggaaaatgatcacctgatgctccctcctgacaaacggtttacagattgctctagtaaccggattgaatga

SEQ ID NO: 12135 - RNA, 960 nt, unidentified
  source 1..960: mol_type = other RNA; note = synthetic construct
atggggatcgtgagggaggatatttctgacacctttaacatggacatgaaacgggtttccatttatgtgaacaaatccaatcagttctacaagaagatagcgatacccaaaagaaagggaggcacaagagaagtctatctgcctagctccgacattaagatgttgcagcactacatttctgagaaatacttcagcaaaatccagctgagctcaaatgccaccgcctatattaaaagcaagtctatcatcgacaacgccaggccccacatcaaaaataagcattttctgtttaccgacatcagcaacttcttcgataacattaaacgaaatctgttcagtgagatactgttgaaagaactgccttttctgtctccctatgatgtcgaggacatattatccatctgcacatacaaaaatcgctttgtgcaaggagcagtgacctcaccaattatttccaacatctacctgaagtcatttgacgagtttctccaaggcgttgtcaagaacatcccgaatggtgtgtacactagatactcagatgatatcacaattagtagtagcgaattcctaaacgagaatatcacgaaaatcatcgctgacgagcttagcaagttaggcctgttcgtaaataataccaagacgtatttctcctctttcgtggatgaaatcgagattactgggctcaaaatctcaggtaaccgtatcagtctctctaacaaaaaaaagcgcgagattaagaacatgatctaccacaagtttaacaaaaagtcgaatagttccgaaactgctgaacagattattgggcatatgttttatctgaggcaaatcgaaccacagtactataatacccttaacttgaagtacaagaagaaaaagaagctcctcattgatcggcttttcctgctaaagaatgaggaaaacatacagaagtgtactgcaacatccaatatacagacatga

SEQ ID NO: 12136 - RNA, 969 nt, unidentified
  source 1..969: mol_type = other RNA; note = synthetic construct
atgatccctgtgagcacggcaattgctcgtggagtgggtgtctccaccgactacgtgctgggtcttccagaacgggtagattccctatatagatcccgcatcatcgccaaagataggagtgggcagggaaaggccagggtgattagtgtgcccgatcccagtctgcagctggttcaggagtggatagccgactttgtgcgagagaacacctctgaacttcccccatatgtggcggcctacgagactgggcgaagcattgttcaaaatgctctgatacatgcaagccacaggcacctgctgactttggatatccaccacttcttcccgagctgcacccgggaaatggtcgtggtgaaagtgttctcaggcatgtctgctcgcgatggagagacaggccagcggcatcagctgggcgcagatgacgtcgacctgcttgcctctctctcttgctacaagggggcactggccgttggctcgccatgtagccctttcattgctaaccgcattatgttacccgtagatggcgaaattatagctgccttgcctgacggctacgcatactctagatatagcgacgacatttcaatctcctccgacagtagaatcaatacaggacttatcacccagatcgtcgagaagatcctgagcgatcacggcttttcactcaaccgatcaaagactcattgtaggggaacggggaatgccagacgggtgacaggcgtatttctcacatccgatggttctctctcaatagggagggaccgcaaaaaggagttgtgccggcaactgtacgcgctgttgaaaaagcaggagggctccccgagtagagttctgggtatgctctttttttgtaaacaagtcgaaccagagtacttcaacaccttagtggccaagtatgctacttatggactagcgaatgactatggaggggtcatccctgctctccaggccttacgccgtaaaatgtga

SEQ ID NO: 12137 - RNA, 942 nt, unidentified
  source 1..942: mol_type = other RNA; note = synthetic construct
atgtctatcgtggaagagatagcctccgatctgggctttagcaagagctatattaaggaaattgccgaaggagctggcggaaggtacaggaaagtcctcctgaacggtcggcgaatcgacgttccttcaagcgatctgaagctcgtgcaagggtggatagcgtgcctgctacaggagtgtatgccctgtgatgcgggctacatcaccgcctacgagcctggtcgctcagtgatcagcaacgccctcctgcacagtgagaatgcccatttaatcactcttgatatcactggcttttttcgctcttgtacaaccgaaatggttaagtccgtgtttagtcagctcagattcgtaagtcatggaagtaacaataagacggctgtaagtaaaaaggacattgagctcctgacacagctttcgtgctacagagggtccttaccaatgggctctccttgttcaccggggatcgccaacagaataatggtgcccgtcgaccaggagattatccgtgttctcccacccgattgctcatatagcaggtattcagacgacatcgccatcagcagctctcagtggctggacatccagggaattgtaggcttgctggaggtcgttctggcagaatatggcttcaatgtcaatcacaagaaagtgcactgctacgggaaaggcgacgcccgaaaaattaccggaatttacattcaccccgatgggacactagggataggcaagtcccggaaagcattactttcccggagcttgtacctgctgcttactagacagaccggatccgcttctgaattgctgggacatttgaacttctgcaaacaagtggaccctgatctgttcgtgaggctcattgctaagtactcctcttatggtgtggcagtcgaatatgggggcgtgatgccagctctggtggagatggcaaatcgcgagggttga

SEQ ID NO: 12138 - RNA, 912 nt, unidentified
  source 1..912: mol_type = other RNA; note = synthetic construct
atgtccataattaagatgattagcagtgacctcagcatgggccagaatgagatactaagtatcgccaacagcgctgactcttcccattatcataagttcatctctggcgggagaaggatagacgcaccagatcagatgctgaagttgttacagttctgggtggcggactttgtgtgcatggagacaccagagctgcctgattacgtaactgcctacgaacagggtcgatctatcaagaataatgcttctatgcacgcccaaaatgcacacgtcattaatctcgatatccaccacttttttcagtcatgcactaaggacatggttaaaaacctgttcgcctcaattgagggatacaatctgacctctgaagatctcaaactgttggtgagtattagcacgtataagggacacttgaccatagggtccccgtgctcaccctttattgcaaaccggatcgctctgcccattgactacgacattaagctgaagctgcctaacgacatggagtattctcgctatagcgatgatatctccatctcctccaataactacatcgactatgaagttatcgtggacatcattggcaacgtcctttcatcccatgggttcgaaattaaccgcaaaaagactcattgtttcggaaaaggtgggcgacggcatgtgaccggcatcttcatcaatccagatggcacattatcgctcgggcacaggagaaaaaaacagcttgaaagcatgctttacaagtatctaatgcgtagtaaaggaaaccctaacgagatcctgggcttcataaacttctgtaattacgtggagcccgattttacaagaaggaccctgctgaaatacagcaagtacggatttgcccggaactacagttcagtcgtagattatctccgccaaatcaaaggttga

SEQ ID NO: 12139 - RNA, 939 nt, unidentified
  source 1..939: mol_type = other RNA; note = synthetic construct
atgacaaagactagcataagcgcgctcatccagagtgacttagggcttgagacgggttatatagagtctcttgccgaacgggcatcagcactttactccaggattaagctgaagggtcgacgaatcgacgctccctctccagaactcaaactggtgcagtgctggtccagtgatttcctacattcagccgacggagacttgccttcctttgtggccgcatatgaaccgtcctgttccgtgatcagaaacgcctctatgcatgctgaccacgcccacattgcgagactcgacatttccgacttcttccattcgtgcaagcacgcaatggtcgagactgtatttcgtggcattcgatttcagccactcccagatggagagtggttaaaactggaggaggcagatgtaacactgttggctaggctgagctgctataaaggcgctctgagcgtgggctccccttgttcccctgctctggccaacaggattatgctccccttcgatagagatatcgaggcaaatatccccagctcatgtcggtactctaggtactctgacgacatggttttcagcagcaattgctggatcgacatcgcggctctggagtcaactgtggatgagatcctatcgacatcagggtttagattgaatcggcgcaaaacccgctgtagcggaaaaggcgatcgccgcagagtcaccggcgttttcgtcacccccgaaggggaactgagtattgggagtaaaaggaagcacgaaattaagcggctgctgtacgattatttgaccaaggggcaaggcgatgccgacgtgatcctgggccttatacaatttgccatccaggttgaacctaagtgggctagtgtcttactggcaaagtacgccaaatatggagaagcccgtcagtacggtgtgataggagctctccggaacgcctctgagtga

SEQ ID NO: 12140 - RNA, 957 nt, unidentified
  source 1..957: mol_type = other RNA; note = synthetic construct
atggaggccctgcctgtgtccattgccgaccggatctgcttcgacctcggaatgactaatcgccagcttttggggctggtcagctccacagccgatagatatcattgtttctctgcaggaggccgaaagatagtcgctccaagacccgacctgaagttggttcaatgctggatttcagactatatcaacaccgaattcgacatagatctgccttacgctacggcgtacaagaaaggttcttcagtgtgtcgcaacgcaggactgcacgccaagtctagccactttctgctgcttgacatttgccatttctttgagagttgcacccagcagatggtcaggaatctgttctcgggggggacctacaggcccacaaatgccgagttccgctcaagactgaccgcggatgatgtggacctactggtagccctctcttgctatcgcggctccttagcgaccggaagcccatgttccccatttattgcaaaccggatcatggcatcattcgaccacgaaattgctgcacgactgggcgagcgttttgtgtatagtaggtacagcgacgatatttgcatctctagtacagaatggatagattctgctgagatcagcacttttgttgggtcccgattgaggcaaaaagggttcgacctcaacagtgataagactcggtgtttcggccgcggccacctcagaaagatcacaggcatctatctggattgcgatggggtcttacggctgggccctcagagaaaagctgaactaaagaggtccttgtatcaggtactcatgagggaatgtgaccgggagtgtgctcttcgtgtgctgggtcatctttcgttttgtaaacaggtggagccggatttttgcaatgccctcttggccaaatacgcctcctacggaaaagcagtgagcagcggtggagtgatgcccgctctcgttgagttagcctacggctga

SEQ ID NO: 12141 - RNA, 909 nt, unidentified
  source 1..909: mol_type = other RNA; note = synthetic construct
atggctgacgacttactgctggatgaggaatatgttaccaagctggtgaacagcagcgccaggtactacctcactcacctcctagagatcaagggtaaaaaaagaaaagtacacaagcctttgccagacatttgtctgctgcagtactgggtcatcgagaatattctgtctcaagctcctacaccagcccgttgtgccactgcctatgagaagggatcctgtatcctggccaacgccgcagtgcacaaggacaatagccatatcatgcaactcgacatcaaacatttcttcgactctatcacctctgatatggtgttcgattactatatcggcctagatgcgagactctctgacgctgatgcccgcgcccttcagcgaatatccacctatcgggggactcttacagttggctcgcccattagcccctttttagcaaatcggattatgatccctgtggacatagagatccaggaatgcctgccatccggaataacgtacacaaggtacagtgatgatatgtgctttagttcaccggaattcattgaacctcagctcattgacgcgattcaggaggttttgtctaggtactccctgcgcttaaacacggcaaaaacccatttttccggtcgcggtgaccgacagaaggtgacaggggtggtgttgattgcaggcggcaagctgtcattgggaagcatgcggaagtctgctctgaagaaaatgctttatgagttcgtccgttacggaaaaggcaatccctccaagatactggggcacatcaacttttgcaaatcaatagatccagaaagcgtcgaaagcatcctcatgaaatattcgaccagggggcccgctgtagagcttctgaaggccgctatcgcaagaagtgaatcagagagaattagtgagggctga

SEQ ID NO: 12142 - RNA, 921 nt, unidentified
  source 1..921: mol_type = other RNA; note = synthetic construct
atgtcagtgctggatctcatggcgtttgacctgttgttagatcgagactatcttgagagcattctacacaataaaagggggcagtatcggaggattagactgcagaacgatagagtcgtttggcagccctctgctaccctcgcattgatgcaatattggctcgtcgactggatctctgagatggacaaaagggagcttccctttgctaccgcctacgaacccggaatgggcattgtcgtgaatgccaagcgccacatcggtgctaaacatgccctggcgatggacatccataagtttttccctagtataggggcacacatgctgggaggctatttcgccagcactattgaggagagcggggcctccgctggaattgaggatagagacataggcctgcttctggacatagcattatttaatggcgggctcgttatgggttccccttgcgccccatacctggccaaccgagtgatggcccccgtagatgaacgtatctggctggaggtagctaacacgagagggctgacatatacccgctactcagacgatctcttcttcagctccccggagtggatcgaaccttcaatcgtgggcgaaatcgcaattctgctacaggagtgcggcctccaggtgaatagttccaagacccgcttcatgtcagaaggcacaggaatcaatattgccggcgtgtatgttgggcaaaagcggatcactctgggccagaagaggaaacgggagttgaaggaacgtttgtaccagttctgtactaacgataaccctaccccagatagtgcacggtctttacttggattcctctcgttttgtaagagcgtcgaaccatcttacgtgggatttatgctgacaaaatacagcacatacggtggtgacataatgctgcgcatcaaagacgcttgctcctga

SEQ ID NO: 12143 - RNA, 966 nt, unidentified
  source 1..966: mol_type = other RNA; note = synthetic construct
atgtcgctcatcgaaaggatctcccgttccctggacattgacgagaacctcataaaaacaatcgcgagaacctctaataagtactatcgcgttttcagcatctccaaaaagtttggtggggtcaggtccatttaccaccctagccctatacttaaagtgtttcagtactggctggtccaaaatctgatttctcacctacccgtcagtgagcatgctaccgcttatggattaggatgttcaattaagcgaaatgctcagctgcacgccgccgccaagcatatagtccggatggacgttaaaaacttctttccaagcatcaggtttcagctgttggctgacagaatcaatgcttttcgggacaccattccaggaggcgccagtcttacggaagaggatctccaactcattaatggaatctgtttcgtgcgagggcgcctggtgatcggctcagtatgcgcacccgccattagcaacgccgtaatgtatccgttcgattgcgaagtgtcacagcaggccagggcactgcacttgacatacagtaggtacgcggatgacatcgtgttctctagcaatgaatggatccatccaagcattgtggaggatatagacgggcgcttagggaaattcggcatgaaactaaatagggagaagacgatcttcatgggcggatcagaccggaagatggttactggtatactgttgaatacaggccgactgtccattggccgggccagaaaagagagtatcaagaagatgctctaccagaagttgagaactggggccggtgataaccggaagatcctgggttatcttaactatctgagagacatcgaacccgatactttcaaccgcatggtggtcaagtacaactctttttttggcagaaacattatgcgtgtgcttacagaggcccctgcagatacccgcaaagcacaggcggaggcagctcctaccaaaaagccctga

SEQ ID NO: 12144 - RNA, 912 nt, unidentified
  source 1..912: mol_type = other RNA; note = synthetic construct
atgggcatcgaaaatcgtattgccaataacctgggacttgacccacagtacatcatcaatatatctaagcggaacgatctgtatcgcaagttctatattaagaaacgaaacgggaaattgagagagattcttcaccccagcaaagagttgaaaatcatccagatctggttagtgaagaacatttttgatgagttcccggtgagcgagtatagttatgcatacagcaagggaaattccataaagaataacgccaaagagcattgctacagtaattatatcttccaggcagatatctctaactttttccctagtattgatcgggctaaactggagacatactttgatgagaacaaattcatagtcgacaaactgggattgaccgacgaagacatagacttcattctggatgtgtgtctctacaaaggtgagtatctggtagtcgggtcatgcgcttcaccctgtatctccaacttaatcatgtacaaattcgacaacgaactgaacaagaaactcctaaaagaaggtaagtacatctataccagatatgcggacgacatcgccatttcatccaaaaattatatctccgtcacaattagggatattgtggaatcggaactcaagaagatgggtttttctatcaataatcagaagacccacttttctaacaagaagagccggagaaggattacaggggtggttctcgacaataattcctgcaaaatgacgattggcaacaaaaagtacaaaggatttcaacgcaagctatataattacctggttaaaggcgagggcgacgaggggtatattaagggctacctgagcttcatcaaggaccttaacatagaacaatacaaacagctcaagaagacttacaagaggtacgataagaagaagaagtttttcactgattga

SEQ ID NO: 12145 - RNA, 924 nt, unidentified
  source 1..924: mol_type = other RNA; note = synthetic construct
atgcgcctaagcgagcgcattgcaaaagggatcggaattgacgaaagctacgtgatcatcattgctagccggaataatctctacgccaagtactacattccaaagaagaatggaaggtacaggttgatattacagccctctaaggagttaaaagtattacaacattggctgctgagaaacatctttgcatatttccctgtctctgaatattcttcggcatattccaagggaaactcagtgagaaaaaacgctgccgtgcataaggaaggtaggtatttgctccacacagacatcactaattttttccccaccatctcaaggaccatgctcaagcaatactttcagtctaacgaaagtctgacccggaaactcgggatggccgacgaggacatcgaacttatcctggatatctgcctgtacagaggcgagaatttggtcgtgggctccgtggcatccccgcagattgcgaacatgctgatgtatgcgttcgatctggaactcaaacagatgctagatgggttcggcagttttcgatacacacgttatgccgatgatatcgttattagcagtatgtcattcattgacgaacaggttctgaaacagaccgagcagcttatgattaaatacggcttcaaaatgaaccatgagaagacttactacatgggtaagaacggcaaacgacaggtgacgggaatcgtacttgacaataaccgcaatgctctgacaattggaaacaagaagtacaagaagtttcagagaatgctttatgactacctggtcaagggtcacggggatctgggctacatcaaagggtatctggcctatatacaagaggtttcccgtcagcaatatgaccagctcgctgagatatataaacggtacgatatagagaatgtgttgtttcacaatgccaacggccggtga

SEQ ID NO: 12146 - RNA, 903 nt, unidentified
  source 1..903: mol_type = other RNA; note = synthetic construct
atgaacctgttggaacagatgaaccgtgacctgggaattgacaaacaatacatccgaaattgtgccaaaaggaacaatctgtacgccaggtactatataaaaaagaagaatggcgggagacgggaaattctgcaaccgagtaaggagctgaaggtcttacagtactggcttatcaacaatttctttaaccagttccctattagcccctacagttccgcctatcagaagggctgttccatccgcaaaaacgctgactgccacaaatatggcaagtatatcctccacacagatattgtgcattttttcgagtccataaccagcaaatctatgaatagctttttcctccgcaacaaagacatcctaggtgatatgcacttaacttttgatgagactagactgatcttgaatctggttctatacaagggcgcatacttggtagtgggctcagttgcttcaccaatgatttccaactgttttatgtacgagttcgatatgaaactgggagagatcattaccaagcggaatatgaaatacaccaggtatgccgacgatatcgtcatctcatctgataactacattgataactctatccttgatgaaatcgacattctcctcaatgagtatggtttcaaacgaaacattgacaagacgtatttcatgtgcaagcgcaaaaagagagaagtgacaggactcgtgatagacaataatgataactcgctgagtatagggcataaaaagtacaatcagcttaagcgggacatctacaattatctgataaagaaacaggggaactgcaatcagatcaagggaaagcttgcacatctgaaaaacgtgaacatcgacaagtatattgcgattaagaagatctactccaagtatgacaaaagccacgaaattttttga

SEQ ID NO: 12147 - RNA, 924 nt, unidentified
  source 1..924: mol_type = other RNA; note = synthetic construct
atgagtctgttacagaggatgtcctctgaactccgtctagatcctgattttattatgtccacggtcaattccaccaaaaagtacaggatctacaaaaagggctccaaattcatctataatagcagtggtgagctgaaaactctgcagtattggttgaattcaaagatcttcagcatactcgagtattctaaatttacagccgcctatcaaaagggctgctcaattaagaaaaacgctagcattcatagcaagagcaactacatcctgcacaccgacatagaaaacttcttcaataatatcaccgagtaccacatcaatattctgcttgaggagattaaccagctcggtaagtctgataaggaactgatcaaaaagatcatcttgtacaaggggcaccttgttattgggagcgtctctgcaccccacatttccaactgcgtcatgtacaaattcgacattgagttatatgacacaatcatcaacaacacaaacatgaaatacacccggtatgctgatgatattacgatctccagtaaagagtacataactcatgacgtgattaaaaaagtggaagcactgctcgttaagtacaagttctcaatcaacaacaacaagacttacttttcgtcaagagcgacccgaagacgcgtaactggaattacaatagacaattccaccaatgagctaagtctgggacacaagaaatacaagttcatcaagaaggagatctacaattttctggtgaaagagcaggggtgtaaagataagatacttggaaatttggccttcataaaggacatcaactctaagaagtatgacgaactcaagtctgtgtatctgaagtatgacaaggaaggcatcgtgtttagtaaagaagagaaagacattgaactgaaagatgaacatgagatttcaagctattga

SEQ ID NO: 12148 - RNA, 939 nt, unidentified
  source 1..939: mol_type = other RNA; note = synthetic construct
atgtcaatgctcgaacgcatttcgaatgatcttaacttgaaagtgagctttatcgagaatgtcctgaaacaccccaagaagcaataccggatatattacataaggaaacgaaatggcggacagcgcaaaatctatcacccaagtcccgtgctaaaaaccttacagtattggctcgtcaacaatgtgttcaatgagtttaacgtgtctatctatgccactggatacattaagggaaagtctattaaggacaatgctgaggcccataaagatagcaactttattctgaacatggacatcgagaactttttcgagtctatcaacaagaaacacgtcaacgagctggtgaatgcaaacggtgaatattcctcactagatatctatcacctgaacaagatctgcttctacggcgactttctccccgtcggctcagtatgcagcccgcatatctccaactgtataatgtacaagttcgacaatgaagtcgttgagaagctgcctaacaattttcggtatacaagatacgctgatgacattactgttagctccagtagctacataaatgataacgtgcaggtgattttagaagaattgctggagaaatacgagttcagggttaatcacaataagaccagatacatgtccaaaaaacagagtcaaatgattacgggcctgaacgttaatgatggcaaggtgacaatcggtactgacatcaagaaacagttgaagaaagacctgtataataacctgaccaaagggaccggggatagcgaagtaattcttgggaagctcaacttcctgaaatctatcgaaccagactacttcaacaagctgatcattaagtactccaagtatgcgaatgtgcttaataaactcaagaacgacgtgaaggagcagaagaatatccctatcgagattaacaagtcaatagaacatacatga

SEQ ID NO: 12149 - RNA, 915 nt, unidentified
  source 1..915: mol_type = other RNA; note = synthetic construct
atgaacattatagacattatggctgatgatttgaagctggacagttcctatatcctgaaaattgccaatcggtctgacttttattacaaggactacacaatcaagaagaaaaatggaggattccgacatatttcacagcctagcccagaattgaaaacacttcaatattggatcgtgaagaacattctatgcaaactccccatttccaatatcgcttctgcctacaataaagggaacagcattaagaaacatgctcagatacatagcggtgcaaaacacattctccacaccgatatcaataattttttcccaagcatccactttagtcacctctccagtatcctattcaagcacaaatacatattcgagaacctgtccattgatatcaatgacagccttccgtacatctccaaaatttgctttaggggggacggtctgtccataggcgccgtctctagccccatcatttctaacatcattatgaactcgttcgatgaaaggctgtacgattattgcaaggcaaataattacctgtgttcacgctacgccgatgatatctatatcagcagcaactcttatatcaacgactcagtggttgtgttcatatcaaacctcttagacgacctggacatgtcgatcaatagtagtaagacccgtttttattctactaagtaccgcatgtctgtaactggcttaataatcacaaacgattcccggattacgataggcagcaagagaagatcagagatagagaagatggtgtacaataaaattgtcaacggaattggcgacaaatattcaattatgggctacctggcgtttctgaaggatatcgagcctaacacctataacaaccttatcatcaagtattccaagtactgtgacggggatgttatcaataaaatcttggaatga

SEQ ID NO: 12150 - RNA, 924 nt, unidentified
  source 1..924: mol_type = other RNA; note = synthetic construct
atgactttgatagaaaagatttctctagacctcaacttagataaactttatctggcccggattatttccagatccggcttttactacaaggactttataatcccaaagaagaatgggggatttcgccgtataagccaacccagcgccgaactcaaaacgctccagtattggatcaccaagaatatcctgtgcaagatccctataagcaaagcagcgtgtgcatacaagaaaggcgactctattaagaaacacgcccttctacattgtaaatcacgacacatcttgcatactgatatcaaggatttcttcgaatctgtagattcatccaagctgataaagattctcgaaaaaaaccacagcgtgtttgaggatattaacctggactacaacagcagtatcgatgacattaggaagatttgcttcaggaagaataaactctgtattggatccgtttcttcgccgatcatctcaaacatcgtgatgtacgatttcgataatgctctgaccggatattgcaaagagaatgggctgatttatagtcgctatgctgacgacatctatgtctcttcagacaagttcattaaccacgacatcttggagtttatttctaacgagttgaataagtgcggcctgagtatcaataggtccaagactagattttattcctccaaatacaagcggagcgtgaccggtatagtgatcaccaacgatagccatatttcagtcggtaccaaacggcgaacgatgatcaagaacatgatttacaacaaactggtgaattccgaaggggacagtaacgagatcttaggctacctgagtttccttaaggacatcgagcccgatacttaccagagatatctgatcaaatactcgaaattctgtacaacagacgttcttacagccctgagcgataaaaatacatga

SEQ ID NO: 12151 - RNA, 918 nt, unidentified
  source 1..918: mol_type = other RNA; note = synthetic construct
atgaatatcctcgagaaaatttcccttgatctcaagctcgatctgacttacatctcccgaatagcggacaggtccagtttttactataggaaatacaccatcgagaagaaaagcggcgggtttcgggagatctatcagccatctgcagagctcaaaacactgcagtactgggtggtgcataacgtgctgtgcgccttgcctatctcagaggaagcttgcgcatataataaaggcaattcgatcaagaagcatgctgaaaaacaccagaagtctaagttcttattccacacagacattagaaacttctttccgtcaattcatatgtcccacctggcccctatcctgagagctaacaagggaatttttgacaagctgggcctggatcttgaacagtctatccagaatattgggaagatatgtttcaagagtgactcactttgtataggaacggtatccagtcccatcatatccaacatcattatgtacgctttcgatgtgcagatggccgagtactgcaaagccaaaaactacatttatacccggtatgccgatgacatatacatcagcagcaacaatttcatccccatcgatatagtttcgtttatcgcctctaacttaagccaaaatggtttcaccataaactctggaaagacaaagttctattctaccaaatatcgccgcaagattactggactgattatcactcacgatgggaaagtcagcgttggtctgcaaaaacgtaacgaaatcaagaaaatggtctatgacaaactgattcacaataagggcgacagtctaaaaattctagggtacttggcgtttctcaatgacgtggatccaaaggcctataatgacatcatcattaagtacagccagtactgttccggcgacattatttcagcattgaacaagagctga

SEQ ID NO: 12152 - RNA, 915 nt, unidentified
  source 1..915: mol_type = other RNA; note = synthetic construct
atgaatataattgctagaatggcacaggacttcaagattgatcattcatatttgagcaagatcgtgtaccggtctgccttctactacaaggactactacattaacaaaagggatgggaagacccggcgcatatctcaggcaagtccccaattgaaagccatgcagtattggatagtggaaaatatcctggccaagattccagtcagtaaaggggcttatgcctataagaaaggtgattcgatcaagcgccatgctgatatacaccgactcagcaagcacattttccacacagacataaaagactttttcttcaacatccacttcgaaatgctgagatgcgcattaagcaatcatagccatatattcgatgaaatcggtatcgattcttctgaggccttttcagacattaagaagatctgttttcgcaatgacgagctttgtatcggaactgtatcatctcccatcatttcaaacatcgtgatgtacaatttcgatgagaagatgatcgactattgtaaccgtaacgggtggatttattccaggtacgctgacgacatttatatttcgtccaactactacatacctaaggaggtcaagaattttgtgtccgccgagctgtccgacaatggatttaagatcaacacgaaaaagaccagctttatttccaacaagtattgccggaaagttacaggcgtcgttctgagcaatgatggcagagtaagtgtgggcacaaaacagcgaaatgcgattaggaaaatggtgtacgacaaaattatccacaaaaagggcagtccagaaactatcctaggatatatcgcgtttctcaaagatatcgaacctcaaacctacaacaacatcatcatcaagtactccaaatattgcgcaggcgatgtgattgacgagattagcaaatga

SEQ ID NO: 12153 - RNA, 912 nt, unidentified
  source 1..912: mol_type = other RNA; note = synthetic construct
atgaaaatggtggacaaaattgccgccgacctgtgtcttgatcctgattacatcgcctcagtcattaagagatcaaggttttactatcgcgattactacatagacaaacgagacggtggccggcgaaaaatttcccagcccagtcccgagctcaaaactcttcagtattgggtggtgaacaatattctgaataagtttcccatcagcaatagtgctcacgcataccagaagggctcctcaataaaaaggcatgcacaattccaccagaacagcaagcatatattccacaccgatatctgcaaattctttcctagcataacttacgaacacttgcagccaattctgctttctaaccctaaactattcgaagacctggagattgatttagactccgttgaaaccattcgggacatctgctttcgggaaaattctttatgtattggcacagtttccagccccatcatctccaatatcatcatgtaccagttcgatgtaatcatgctcggatactgcaagaaaaatcatctgaagtattctcgctatgcggatgacatttatttgtcctcgaactcttatatcgatctggcccatgtttcatttgtgagtgacaccctccgtaagtttgggttcagcataaacgagagtaagacctacttcagctcaccgaaatatagaaggaaagtaacaggactggtcatcggcacggactcttccgtgactattgggagtgaaaagagagcattcatcaagaaactggtctatgacaagctcgtgcacaacaagggggacggtaacagcattctaggatacctcgcttttctgaaggatatcgagccacagacatataacaatatcatcgctaagtactctcaatactgtaaggaggatattatagaggccttgaagaagtga

SEQ ID NO: 12154 - RNA, 963 nt, unidentified
  source 1..963: mol_type = other RNA; note = synthetic construct
atgtctagcctgatcacaagaatttcatcgaatctccagttaaaagacgactacatttcaagcatcattagacgctccaactattactacaaggactactacattcctaaacggaacggaggacgtcggaagatttcccaggcctccccagagctgaagaccttacagtattgggtgaagacaaatatactctcacttctgccaatctctaaggctgcgtttgcctataaccgaggtaacagcattaaaaaacacgcgacatttcataaggaaagctacttcatcttccataccgacataaaggattttttcccgtccatcaccagtgagcacctggtggcagagttggcagctaaccgtggcatcatcgaggctgccaatctgtgggatgatgatattttggatgtagtgagctctatctgtttccggaggaatcatctgtgcattgggaccgtatccagcccaattatctgcaacatagtcatgtacgccttcgacgagcattttacgaactattgcaataggcggaattggaaatattctagatacgcagacgacatctatattagtgctcaagaatatctcccctcaagtctgcagtctgaggtcaatgagaagcttcacgaaattggcttcagttccaacgcctataaatcatggttttgcagtaagaagtgtcgcagagagattacggggctaatactgactgaaactggcaaagttagcgtgggtcttgaaaagcgcctagctatcaaaaaaatggtttacgagaggatcatgcacggcaggggggatcccgataccatccttgggaacttggcctttctgaaggacgtcgaacctaactcctataattctctcctgatcaagtacgccgcctactgtgacggagacgtgatagatgcaatcaagacaggccctaaaccccaccgagtgataactctggatctccccgacatctga

SEQ ID NO: 12155 - RNA, 924 nt, unidentified
  source 1..924: mol_type = other RNA; note = synthetic construct
atgaattccattatagacaggattgctcgggatctgagcctcgaccgcgattatatcgcaagtatcattcggaggtcatccttctattacaaacgtttcactattcccaagcgcaatggagatcctagggtcatctatcaggcctctccggaactgaagtcgctccaatattgggtcagggagaaaatcctgaaatttctgcctgtgagtaacgctgcgtttgcctatcaggccggcaattctatcaaaaaacatgcggatttccataaggaggcccgctttattttccacacggacattaagaactacttcccttccattcacgagaaaatgtttacagatatcctaatcgcccaccaggataagcttcaagcacagggaatgtggttcgatgacatgtgcgacgtgattgcaaaaatttgcttctatcgaggcaggctcagcattggtactgtgagctcccccatgatctccaatatagtagcttatcgatttgacgaactcataattgcctattgtagagagcgcgggtacagatacagtagatatgctgacgacatatacatcagttcaaatcggtacataagccagtctaccaagaagtttgtagaggttagcttatacgagtgcaatttcaagatgaacattagcaagacatggtttcgttcaaaaaaatctcgaagaaaagtgacagggttgatcataaccgatacaggccgcgtgtcagttggattggaaacccggaaaaagatcaagaacatgatctacaataggcttgtgaacggcaacggatctccagaatctattctgggttacctggcctacctgaaggacgtcgaaccacccacctacaacaagtacatcatcaagtattccacttactgtgacggcgatgttatctcggcaatcagacgggggagctga

SEQ ID NO: 12156 - RNA, 930 nt, unidentified
  source 1..930: mol_type = other RNA; note = synthetic construct
atgtctaagagcttggtggaggaaatatccgcgtcgctcaggattagcacggaacgcacccaagagatcattattaacgcggacaaactgtacaagatctactccatacccaagcatagtggggggaatagactgatctatcagccttcctcgcagctcaaagccatccagtactggactttggacaacattatctctttatttcccgtctctgatagggcattcgcttatgtgaaaggacggtcaattgccagcaatgccaaagcacaccgccaatccaaataccttttccataccgatattcacaacttcttccccagtatcacctctagtctcttcgataagcagtgccttaatcgtttctctagcatattggaggaaacaggattttcctttggcgacacaaactcagtcctgcataaaattctgtttcggaaggataagctaactatcggcgccgtttcctctccagcaattagcaatgccgtgatgcacgacttcgaccagtcactgacaaactactgtcttatctcagggtatgtttacactagatatgctgatgacatatacatcagttcaaaaagcctccttcctaaacagatcaaggaggacatctttgccgaaatgcacaagtttggattcagccctaactacaagaaaacatccttttggaatggctcctctcatctgaaagtgactggtgtgaacgtattagctggttcaggccgactgaccatcggcaccagaaacaagaagatgattaaggggatgctgtatgagtatctaatgcacggtaagggcgatccgacgaaaatcctgggatacctggcttacgtcaaagaaattgagccaagcttctataataccctcatcataaagtatagcgagtacaggaatgagcacatcattaagtatctgaaggacagttga

SEQ ID NO: 12157 - RNA, 933 nt, unidentified
  source 1..933: mol_type = other RNA; note = synthetic construct
atgaattttttgaattatctccaggccactggctatcataataacctgctcattgaagtcataaacaatctcgataggtacgtctataagttcaagtttaaaggtaagtggcagatagcaccaaaatgggagctgaagatactgcagaaaatcttgaaagagtacctcaccaagtattacggctcaattatcagcgagaatgctaccgcttacattgtggggaaaaatctgtcttacaatgtgtccaaacatcaaggtaatagctacttcttcgtgacagattttaaaaacttcttcccctctattgagtttgaaaaggtcaagtacatccttaaatccaatcttaacaaggaaacagaggactccatagatctcatcctgaagatcgttttctatgataataagctgcagtatggattccctacttcaccaattatttcgaatcttatcctgatcgactttgacaagaaaattgagcaatatctgctgaactacttcaaagggaacaatattaagtacagtcgctatagcgatgatattacaatctccgcgaaatacaagattaacaagaacgacattctcagcataatcgaaaacctgatcaattcagagtatacgtatctcaagttaaacttgcagaaaaccagattctttgagaaatacagtcactctccctatattactggacttgtgcctctgaaccaacgtatctctatcggcaagaagaagtttaacatcatcaagctaaacacctatctgatcctgaataataaggccatagaaaacgacaacttttttcggaaagaaaatcagctacagtcctatttaaactacttatacctggtagacaagcacaactacatcaaattgaagaactacttcagcaaaaactacatcaatagcgacattttcaacagtttgtttcgaaaatga

SEQ ID NO: 12158 - RNA, 930 nt, unidentified
  source 1..930: mol_type = other RNA; note = synthetic construct
atgtctttcttggagtatctggaagagaaaggatatcctaatactctcctgaggaaaatctttgacaaacacgaagactatgtgtaccattttcggattaaggggaaactgcaaatagctcccaaatgggagttaaagattctgcagaagatcctgaaagattacattactgacaattacgcctcgtatatatctaatttcgcaaccgcttacatcaagaaggaaaacatctcctataatgtgtccaaacactttggacgcaattatttctacgttacagatttcagcaacttttttccctccataaagttaaccaatatcaaggactatctctcaagtatctttaaagatgaggacagttcatcgcttgatatcatctttaacatcggcttttactccgactccttgcagttcgggttccctagcagcccaatcatctctaacatcgtgatgacaaaattcgacaatcttctgttcgaagaactgaagaccaaatttccaaagaacaacatagcctatagtagatactgcgacgacctcacgattagttcaaaatacgaaatctccccgaagattattaacaacattatcaacagcctgctgataaaggagtacacatacctctcaattaacaagaggaaaacacgaagcttcgagaaatactctcagtacccatatataacgggcctgattcccttaaaggataggactaccattggtaagaaacggttcaacattctcaaactaaatatctacctgagcctgaagaataaaaagatcaagaacaccgacttgttcgatactgatattgcgctctccagctatctgtcttacgtctatcttgtagatcctcataattacaaccgtttgaaggagtatttctctaaacgctttaagcccctagagattaagaacctttttaagaagtga

SEQ ID NO: 12159 - RNA, 915 nt, unidentified
  source 1..915: mol_type = other RNA; note = synthetic construct
atggggaacaaatcagacattatagagctcatcagcattaggacaggcatatcttccaaaaaaatagaagagacgatcagtagttcaaagtgtgagtatagcgtggtgcatgcaaaaatcaagaagaagaagcggatcttctacatcccctctccgcagctgaaaattatccagctgcacctgattaaaatagttttggaaggatttgaggtgtccagtcatgctcacgcctacattaagaacaagtccataaaaaccaacgtcaactgccatatcggtaatacttttttcttccaaaccgacatcaaatccttcttcccttccatcaaggccaatcacattaaaaacgtgctgtcgaaggacgactccataagcaaggacgatattggcctaattctgagcgccgtggtgccttttgagtcactggatctgggatcgcccacctcacccattatctctaatatcatcatgctcgagttcgatcagaagattgaaagcttgatccaggagaattataagggcgctatttatacccgttatagtgacgatatcactatctcttctaagcagccaatacttggcattgacaagatcgttgacaaaactcttgaggagttcggctttgaaatcaacaagagcaagacaaaatacacccagctgatcgacaaggtaaaaattactgggatctttttgcacgcggataaaagaatgaccgtcggaacaaattttaagcgcaatctcaaacagcaactctatcttctatccaatggtttagatcctcagatagataacattcagattatggggatgttatcttacatccgagacatcgaaccagaatactacctgtccctcgtccaaaaatacagttcaagcacaaagagcattatcgatattatcaagtctgggatgtga

SEQ ID NO: 12160 - RNA, 1554 nt, unidentified
  source 1..1554: mol_type = other RNA; note = synthetic construct
atgtataggttcaaagaaatccagggcaaagataactttgaacgtctggaactcgttaatgtgatggacatcttctaccttcaacacaaaaaaccatttttcaaggacattgtgaagttcgactttggctatacacttgtgtttaccgacggcgtgaatgattttgtgagtatagatcatccctctcgcctgtgggggaaaaatttcatcccaatcaagaacaatgaggaaatcagttacattcataacgacaaagtcaaaatgtcactcgacatatttaacaacaacgagaacgtgattgacaacttaaatgacctggaagagaaaatagagaactacttgtgctctaattactataacaagatcagttaccgaacagtatacaacaagtttaccataaaggagtttgataacacattcaccgtcttcaagctactgagtgaaaccaagagcattcgcaatacagttaagattcagaacttgatcaagatcgacaaagatctgattaacaagaaagaccttaacttgatcgtggacatcatcaacaacttcactaaccaaaaaacgagcgatgccgagaagaataacagctatctcaagaatatcatcaagctgttacttaagagcttcgaattgaagtactccaacaaaaacaaattcgagacgttctacattccgaaaaccgatggtactaagcgagaaattaatagccctattgaagaaatcagacccattctgaagtcgcagtcaaaaaagctgaatgcaatactcgagtataggattagcaagtataatatcgaggacaacattatagcgtatcgggatgggaaaagcatcaagaacaatgctgattaccacaaagaaaatgacaccatcatcaagtttgacgtatccaagttctttgataattgtcacttcgactattggaaagagaacctgtttttcatcctcaacgataacaaaaatctgatgaaacggtttgagaaggaaatggagggatttctttttcgcaaggataataagggattgtatatggggtcacccctgagtcctgctgcctctaatctcattgtggtgcctgtgatgagatacatcaagaacgtcatatcaaagttcaagtccgatattaaggtttctatatactccgacgatattactttctcttccaaagagataaacgatgagttcaatccatcgagactgaaaaatctcgtcaatcacgccttcgagatctataatctggactttaagatcaaggaagagaaatcactggtaatgaagaatcggaagagaaaagttactggactgagcatcaatcagcataatcaggtcactatctcccagaggcggtatcgtgagctgaggaccattcttcacctcttgtctaacggcatggagtttaaagatattaagggctttgacaatgagattgagttaacaagcctaattaactactacctcgatgtggacatgaccgggaaaatttcccgcctaatcaacaaatacgagaagacattcaatgaactgaagtccttcgaatctggtgaaaaatga

SEQ ID NO: 12161 - RNA, 1506 nt, unidentified
  source 1..1506: mol_type = other RNA; note = synthetic construct
atgtttaagtttaacaaggtaaacaacctgaagatgatcggtgagaacgaaatccataacgaccttatgctggagagaatgatgttcgtgatgaaacccgtcttcagacgcctcgagaagaacaataaggggaaactcgtcatgctgtttagcgatggccgaaagaactacttactgtctacaagcgataagcggtactattcctctcccctcctatcctatgagggagacgagtataaggaactagagtccgcctcctacattgagagtaatatcgatagtctgaaattgctgaaagtgaagatatccgatatattgagcgacaatcaaaatattcgcatcaggaaaaacctgatgtttacagtctacgaagacgtggatgatatcaagctggttcagctgctaacccgaggcgacaagaagattcaatctgcattcaatatagagaacgttatctcgatttcaaaggacaaaatcaaactggacgatttcaaccttattaaggacctcctgaaccactacataattaagggcatcaaagatgtgtatatctctaataccatcaagctcttgatcgaagctcttgaacttaagtattcgggcaagaaggcatttgacacgttttatattcccaaaagtgatggtaccaagagggagattaattcaccaatcgaggagattagaccaattctcaaagaacagtctaaaatcctgaacgctatactcaaattcaggatcgacaaatacaaactggacgaaaatattatcgcctaccgcgaggggaagtccattaaagataacgcaagcctgcataaggaaaataaggtgatcatcaagttcgacatctcaaagttcttcgacaattgccacatcgattattggaaggaaaatctgttcttccacttcaaggaggacgaagatctcatggacaggctcatgaaagagtttgaggggtttctgttcaggaaggacaataaagggctctacatgggttctccgctgagtccttccgctagcaatttaatcatggttcctgtgatgcgctacattagcaatatcctgaagaagttcaaaaccgatataaaggtcagtatttacgccgatgatctgacattcagctccaaagtaatcaacgatgagtttaatgcgaaacggttaaaaaacatggtcaatcacgcctttaaggccaacggactggactttaaattgaaggaggaaaaatcactggttatggtgaacaataaacgaaagatcactggcttgacagtgaaccacagggacgaggttaccatatcacagaaacgttatagacagttgcggactgtaattcatctgttgagcaatggagtggagtttaaaaacattaagggattcaacactgagcttgaactcgtgagcctaattaactattacttagatgtcgacaccactggcaaagtgcggcggcttatatctcgcaatgaacgtgcttttaacgaacttaaaagaaagtccgaagtgaagtga

SEQ ID NO: 12162 - RNA, 1503 nt, unidentified
  source 1..1503: mol_type = other RNA; note = synthetic construct
atgttcaaattcaataacgtggagaggataaatctgatcggaaataggaagatgaattacattgagcttcaggaaagcttatatacactgaagcccaagttcaagaagatcgtcaaaaacgataaaggagatttcgtgcttattttcagtgacgggaggaaagagtacattggcaatacaaatgcaggatcaatgtttaggccaaaaatgatggtggtgaactccatcgacgattataatctgttttccggcgatggccaaccttatcgcgtcgagatatcaagcatgagctcacttaataaacatctccgaaggattatcgatcagaactacacttttaacatcatcaccaagaagtttcgcatttacgaggaggacaagattattaaccttatcaagctcaagtctacaaccgaaaacgataaagacatcttcaaaatcgaggctatcctgaaaatcaagaaagaccttatcagcattgaggaactagaactgatcaaagacatcctgaatgattgtttaacttcccaagggaagtatgaatatattctcaactctctggagctcctgataaaatctatagacttgaagaaccggaacgtaaacactttttacacattctacatccccaagtcggatgggactaagagagaaataaatagccctatcgaggagatccggccgatcttgaaaaagcaggccagcatcttgaacgccatactagacttgagaatagacaaatacaacctcgacgaaaacattattgcttatcgggacggtaaatctatcaaagataatgcggattaccacaaagaaaacaagacgatcataaagttcgacattagcaagttctttgataattgccatttcgactattggaaggagaacctgttcttttcctttaaggacgaggactacgtgatggaacgtttcgaggagtatatgaaggacctgttatttcgagaagacaacaagggcctatatatgggaagttctttgtcaccagccgccagcaacctgattatggtgcccgttatgcgctacattaacaacattctgtctaagttcaagaccgacattaaggtcacggtttacgcagatgatatcaccttttcgtccaacgagattaatgatgagtttaattccaagagactcaaatccatggtgaatcatgcatttaaagttaatggcctgaagttcaaactcaaagaagaaaaaagcctggtaatgaagaatcacaaacgtaagatcaccggtctgtcagtgaatcacaacgatgaacctacaattagtcagaagcgctatcggcagctccggactatcatacacctgctgagtaatggcgtggagtttaaggatatcaaggggttcgagacaccattgcagcttgtgagtctgattaattactacttagacgttgataccaccgagaaagtcaagagactcatggacaataacgaaaagattttcaacgagctgaaaaaagaagctggtgtcaattga

SEQ ID NO: 12163 - RNA, 1530 nt, unidentified
  source 1..1530: mol_type = other RNA; note = synthetic construct
atgcttagcttgatactgattgacaatgttcttatcgacattaacggcgaaattgtatctgagattgacatccggatgaaaaaaaacatcattagcgacaagaaggttcttgccaaactggtgaagtataacatccgcaataaactgattcagtccatcaaagatatcagttatctcgaggaaaacaataagttcgagaataatgaggagttcaatgatatacacctggagaatatcgagaagatcataaagacttacgatctgctgtctaacgatgagatttgcattaacgagggctaccccgacctgcctgttgtgacatatgacaaaaccctcattacggaattcataaacaacatttccatcaagctgagttatcgcaatctaaacatctctcatcgatatatcgaaatgaatgacggatatctctacattatcacgaataccaatgacatctacaataagtacaacatctacaagatcacagacgacaaggaaatgatcaaaatgattaagtacctcctggatatttccattagtcctgatcaacccaataacaaaccactgctcttggagctcttgctgactaggatcctgattcagaataacaatgaaaaactctaccagcactttaaaatcaaccagggcactaaaattagagacatttatgccccacataatgacataaaagatatctcccgtaagtttaacaacatattcaacgggatgctagaaactcagttaagcaataaaggagtcgaaaagcatctgtttgcataccaaaagaaaaaagggatcttagacaatgcgcttgtccacaagaacaacaagtacataatcaaaatggacatcgcaagtttctttgataattgtcgctatgaggatatctcgaaatatttcaagctactggtgctcggtaaggagaacttcaagaagaagaataacaaggatagcgtgatggatacattgttcaaggagattttcatcaatccggaaactggcgggttgtaccaaggtaatcccgcttctggatccctgagcaatcttctgatgagcaatgtcgccaaataccttaagaacgtgttaatcgattcaggcattacattttcaatctatgccgacgatatcaccttctcatctaacgaaaaatccgaatttttcaaccgaaaatacctgaagttcattctaaataaggcttttgaggtgtacaattacagtaatctgtcaattaaggacgagaaaaccataaagatgagcaacaataagagacggatcaccgggattaggattaaccacaatgatcagtgcacacttgatagaaagatgtacaggttactgaaaaccatattcttcaagttgtcaaagaacaagaacaacatcaacaatatctctatgacctttaacgagctgaaaggaaggatatcctactatcggtatattgacaacacgaacaaaatggaaaacctcgtgaatgaatatcagaacaccctcatcaagctgaaattgataaacgagcctaaagtagactga

SEQ ID NO: 12164 - RNA, 1365 nt, unidentified
  source 1..1365: mol_type = other RNA; note = synthetic construct
atgaacgacttgttaatcatttccaaaaaccctttgcggatacttacaaataaaggaatcttttacccgtacgataaagacatcaagattatctctcggtttgataattctgagaaaaagctggttcaactgaacaatattctctttaaggacagctatgacctgctgatcaagatcatgaattactacaagacatccaattctatcgacttcaattactctaagaagtatcttctggagaattccattgaattaagagaatacagcgagttcttttctatgtacagatctttttccagcactccattggtgagtgtgagtaaaggctatatcctgctctaccccaattcgaagattagtaactccaagtatcttatctacaagctaaagagcaaatacgcctcagatattaagctattactcaaacgccgtatgagcctcgaaataattcagctctactgcatcataaaggacctggaggataacaacattgagctgtttaagaagatcaagatagagaaaaacggaaaggagagggaagtgattgatccaaacattaagatcaagaacactctgaaagagatttccaaaatccttgacaaacggctggaccgaaaaatcagcaacttgaaatatcccaacatcatggcctaccgaaagaatgtcagtataaaggacaatgcactcatgcacctgaacaacaagtacataattaaagtcgacatctctaactacttcccctccattgattggaaactgatcaattcaagattcatactcctgctctttcatggggtgacggataaatatatggatacgatcaagaaaggctttgtcgacgagaatgacaaaatgttcctgggcaatcctgtaagcggggttatatcaaacattatcatggtggacatcataaaccatatacagacgatttttcacaagtacgggattatctgttcgtcctattccgacgatattacctttagcaccaatattgacaacaacaagttgttcaacaagaagttcatcatcaaaatctgtaaccaggctttcaagatctataacgacaagttcaagatcaatgacagtaaaaccgtgtacctgaaaggaaatatgcgcaatatcaccggcattaccattaatcataaaaatcagctgaccctttcttcagaaaaatacgatgatatgaggaacaatctctatagttacatgaaaactggttcatgctattatgatgactatgagctgttggggaagatgtcatattatctacacattgatgagacaggtaagttcaggaagctttatgataagtacatcaacatcttcgagagcataaaacgcggcgatgaaaaaattgaagaatga

SEQ ID NO: 12165 - RNA, 990 nt, unidentified
  source 1..990: mol_type = other RNA; note = synthetic construct
atgaatcgcgccaatcagtataacctgcccctcatacaagatgggcaaaagttcttgtcagtagcagacgatcagctgattcgacggttcaaggtgaaggacaaaggaaagctccgcgacgtaaacgatccaattccggaattgaaaaatgtgctccgggcttggaacgcggttattactgaccactacgcaaagaaactgaaagactccgacacttcccaggtggctcatgcttacctcccccataaaagtattcagacaaatgccagagcacatttacacagcccggtcatccagttcgacttcaaaggtttttatgacagctgtaagtttgagtacttcaaaaaggagctccgggaacttgatcccaggctagacgaccaaaacgagcacatcgtgaaaagattgctgatcgatcctcagactgggggcgtcacacaggggctaccagtgtctggcgcactggctggactgagtttaatccctttctgggtggaattagggaagaacctgccagacaacatccgttttacccaatattcagatgacctgaccttttcatatgtcggtcggatgccccctggctttaccatccctagcctcacccagaaaatctatgaggcgctgaagaaaacaggactggacttcaaactgaatcccgataagaccaggaggcagaaagaccagtacagaaaggttacaggcattagaatcaaccaccacaatcagacgactccatcgcgcaatgattacaggttccttcgacatgccctgtatgtccttagcaagtctgataaccttgataaggagttgacgaaatggggatttacatctaaatccgcctttgttggcaaggtgtcttacatgagaagcatagattccaccaacaagataaatcgcctgattatgaagtaccgtatgacctgcaggaagcacgacatttttacaacctggatcgatcagacttacaagcggagtgccttcgcctga

SEQ ID NO: 12166 - RNA, 990 nt, unidentified
  source 1..990: mol_type = other RNA; note = synthetic construct
atgaacaataacaatccatactcattaccccttctacaggatggaagacagctgctgcacctcgccgatgataggctgattcgtaggttcaagataaagaacaaaggaaagctgcgggacgttaatgatccggtcccagagcttaaaactatcctcaaagcctggaatggacccctgacggactactatgtgcgccagctccagttaaacggtgtctctcacgtagcccatgcatatctgcccaatagaagtattcagacaaacgctcaggctcacttgtattcaccaatcattcaattcgacttcaagggcttctacgatagttgcaagtttgactattttcgggaatctctgcgggatttggacccaaccttggatgaccaaaatgagtacgtgatcaagcgtttgctgatcgatcctaatacaggcggcgtgacacagggactccctgtttctggcgctcttgcgggcctttcgctcattccgttttgggtggaattggcaaagtccctgcccgataatatccgcttcacccagtactccgacgacctgaccttttcctacaccgggcagacccctcctggttttacagtccctgccttaactcagaagatttacgaagtgctgaagaagacggatcttagcttcaaactgaacgccgacaaaacaagaactcagaaagagcaatataggaaggtgactgggatccggattaaccatcacaaccagaccactccctccagagacgactatcgattcctaagacatgctctgtatatcctcagcaagagtgacgatctggacaaagagctcgcagagtgggggttcgcaagcaagtctgcctttgtagggaaagtttcctacatgaggtcaattgacagcaccggtaaaatagatcgcctgatcatgaagtacaggactgcgtgtcgcaaacacgacatatttacaacctggatcgatcaagcttacaaacgaagcgccttcgcctga

SEQ ID NO: 12167 - RNA, 1146 nt, unidentified
  source 1..1146: mol_type = other RNA; note = synthetic construct
atgatatatataacggtgaagcaaccacccatgtatcatcagatgacattagaagagtttctattccagaccgaaacaagaccggctgtgatcaacgagaacctcacaaatactaggacctacgagatggagtacgtttcccagcggtttatggataagtttaggttcaacatacccgctctgattcgtaaacttgatgcctttaacgattcaactgccgagttgcgagtgaagcctcggcactctctttaccgcgagtttcacattcccaaaaagtccgggggtcttaggaagatcgacgctcctgagcctgaactgatggacgccctccgtagactgaagaccatctttgaagaggactttcatgtgctgtatcacacctccgcatttgcatatgtaaagcatcgcagcacccttgactcagtaaaacgccatcaggcgaatgagtctaaatggtttgccaaatacgatctaagcaactttttcggaaacaccacactggacttcgttatcaagatgttctcgatgatctttccaatcagcgaggtcgtgaaagatgaacatggcaaagaagcactggtgacagccctggaactggcatttctggatggcgggctcccacaaggtactccgattagtccattgattaccaatgtgatgatgattcccgtcgaccacaaactcgccaattctttcagggatttcaacaggcagcgatatatctacacccgctacgcggatgatttcctcatcagttcccgctatgatttctcattcagagaagtcgagcagcacattgtggacgtgttgaaaagtttcgatgctcctttcacgatcaagtctgaaaagacacgatatgggtctagcagcggctccaattggaatttgggagtgatgctgaacaaggacaaccagataactgtcggctacaagaaaaaacggcagttccaagctatgctcgccagctatgtgatggactcaaagaatggaattttatgggacaagaatgacatccaggttatggagggataccggaattactacagaatggttgagggtgaagccattgacagaatcgtcgaacacgtaggcgagaaatacggggtcaacatcgtgaagatgattaagagtgacctgcggacttga

SEQ ID NO: 12168 - RNA, 1101 nt, unidentified
  source 1..1101: mol_type = other RNA; note = synthetic construct
atgaccctggaagaattcctcttcgaagtcgacactaagcctcaggcaatgataaatccaaacttgaccaacacgagaacctatgaggtggagagaatttcagagaaattcctagagagattcgacgtggccaaattggttacgaaattgtcccagttcaatgcttccactgaagagcttagagcgaaaccgcggcacgacctttaccgaacctttcacatccccaagaaatcaggggggctccgaaagatcgatgcccctgagcccgagctaatggatgcgctgaggagactgaagacgatcttcgaagaagactttaaggccctgtatcatacatccgcctttgcatacgtgaaacaccggtctactgttgatgccgttaagcgccaccaggccaacgagagcaaatggtttggcaaatacgacctgtcagactttttcggatcgacaactattgacttcgccattaaaatgctcggcatggtatttcccttctctgaagtgatcaagagcacagtaggcgaacgcgaattaaggaaagctatcgagcttgcatttttagacggtggactgccacagggcacccctatctctccactgataactaacatcatgatgattcctgtcgattacaaactggccaatggattccgggatttcaatcaccagcgttttgtgtacacacgctatgccgatgattttctggtcagctctaagtatacttttagttttcgtgaggtggagaagttcattgtagatacacttaagagtttcggtgcaccctttacaataaagtcagaaaaaacccgctacgggagttccgctggcagcaattggaatctgggtgtcatgctgaacaaggacaacgaaataaccgtcgggcataaaaagaagcggcagttccaagctatgctcgcaagctatattatggacaaaaagaatggcaaggactgggataaatccgacgtgcagaccatggagggatataggaactactacaggatgatcgagggagatacaattgataagatggtggctcatatcggcgagaagttcggggtggacgttgtgcaattgatcaaggatgacctcagggcttga

SEQ ID NO: 12169 - RNA, 1140 nt, unidentified
  source 1..1140: mol_type = other RNA; note = synthetic construct
atggtctacattaccgtgaaacaacccccgatgtataggcagatgactctggaagagttcttgttcgccactgaagccaagcaagagatcataaatccaaatatgaccaacacccggacttatgaagtggagagggtggggaataagttcctggaaaagttggacgtagccgaactaatcacaaagcttagccagtttaacgcttctacggacgaactcagatcaaagcctagaaaaagcctgtatcgggagtttcacatacccaagaagtctggcggtcttcgcaaaatcgacgcacctgaaccagaattaatggatgccctgcgaagattgaagaccatctttgaggaagatttccatgccctctaccacacctcagccttcgcttacgtgaagaaacgttccaccattgatgctgttaagaggcaccaggcgaatgagagcaaatggtttgggaagtacgacctgagcaattttttcggaagcactacgcttgatttcgtgatgaagatgttctctatgatttaccccttcagtgaagtggtccgctatgacaccggccgcgaggagttaagaaaggcactcgagctgtcttttctcgacggcgggctgccgcaaggaactccaatttcgccactgattacgaacgttatgatgatccccgttgactacaaattagcaaatggtctgcgagaatttaatcatcagcggttcgtatatacccgctacgctgacgactttttggtcagttccaagtacacattctcctttaaagagatcgagaactatatagtcgataccctcaagagtttcgatgcaccttttacaatcaagcctcagaaaacaaggtatggcagctccgccggctccaactggaatctcggtgtaatgctgaacaaagataacgagatcacaattgggcataagaagaagagacagttccaggccatgcttgcttcatacgtgatggataaacagcacgggacagagtgggacaaatcagatattcaaactatggagggatacaggaactactatcgtatggtcgagggagaggcaatagacaaactggttgaacacgtgggcaacaaatttaacgtgaatatcgtgcagctgatcaaagcggatctacggacatga

SEQ ID NO: 12170 - RNA, 1140 nt, unidentified
  source 1..1140: mol_type = other RNA; note = synthetic construct
atgtattacataaccgtaaagcaaccacccagctatcaccagatgaccctggaagagtttctgtttggaggaaacacccagacgagactgatcaacgaaaacttaaccaatacccgcacctatgaagtggagaacatcagtgagagattcctgcagctggttaacgtcgataagctcatagaaaaactcatctggtttaatgaacgcactgactaccttagagagaagcctcgacgggattggtactacgagttccatattccaaagaaatctggtgggctgaggaagatcgacgcccctgaacccgaacttaaagaggctctttccaccctgaagacaatctttgaagtcgacttccaggctttataccacactagtgcttttgcctatattcacaagcgatgcatcatcgacctattgaagagacatcaagctaatgagagcaaatggttcgagaaattggacctgtcaaattttttcggctctacaactatggagtgggtgctgcagatgttcagcatggtcttccctttttctgaagtactgaaagatgagagggggcgggcagagtttgccaaggctattgaactgggcttccttgacggcggcctacctcagggaacgccattgtcgcccattattactaatatcatgatgatccccgtggacttcgaaatagcccggacactcagagagtataaccaccagcggttcgtttacacaaggtatgcagacgattttcagatttcctccaaatacagcttctcattcactgaaatccaaaatgtgattgtcagtatcctgaagaactttaaagcgccgtttacgataaattcaacaaagactaggtacggcagctccgcgggacagaactggaatctcggtttgatgctcaacaaggataacgagatcaccgtcgggcacaaaaagaagcgccagtttcaggccatgctcagctcctacgttatggataggaaaaacggcattgcatgggataaatcagacattcaaacaatggagggttaccgtaattattatcgtatggtggagcgcgagaagatagatggaattgtgaaacatctctctgacaagttcggggtggatatcgtgaaagccatcaaggaggacctggccgcatga

SEQ ID NO: 12171 - RNA, 1179 nt, unidentified
  source 1..1179: mol_type = other RNA; note = synthetic construct
atggtgtatcagaccgtggagcggggcggattcgtatactacatcaccgccaaacagtcacctagataccatcagatgacactggaagaattcttgttcggggagagggagtcctctaagcactactctctcgagttcgaccctactggaacgaagacatacgaggtagagcacatcagtgacaggtttttatcaactgttaacgtggattggctgatatctaagttaagcatgttcaacgagcaaaccaaggatctgaggcagaagcccaggagaagtctgtattccgagttctatattcccaagaagagtggcggcttgagacggattgatgccccagaacctgagctaatgacagctcttagcgtcctgaagacgatttttgaacaggatttccgagccctctaccataccagcgcctttgcatatgttaaaggacgcggaacagttgactgcatgaaaaagcatcagaagaatgattccaggtggtacggaaaatatgacctcagtaactttttcgggtccaccaccccagaatttgtgctgcacatgttttcaatgatctttcctttctcagaagtcttgaaaaatgagagagggcgtgaagagttcaaaaaggcaatagacttggcgtttctgaatgggggcctgccccagggtactccgatatctccactgattactaacgtcatgatgatccccgtggacttcgagctcacacgccgacttcgcaacttcaacgaccaggcatttgtgtatacccggtacgctgatgatttccaggtgtccagcaaatatacctttagcttcaggcaagtagaaaatcttattgctgaagttctcagaggttttggcgccccatttcagataaaatcgtctaaaacacgctatgggtcctcagctggcagtaattggaatctgggcgttatgatcaacaaggacaatgaacttactgtgggatacaaaaagaagaaacagtttcgtgcgatgctaagctcctatatcatggatcaccgcaacggtgtcctgtgggaccggcacgatattcaagtgatggagggtcatcgaagctactacaaaatggtcgagggggaagcaatcgaccggatcgtcgaccacattaatcaaaagttcggcgtgaacgtggtgtctatgatcaagcaggatctcgccatgtga

SEQ ID NO: 12172 - RNA, 1143 nt, unidentified
  source 1..1143: mol_type = other RNA; note = synthetic construct
atgtactatgtgactgttcgacagtctcccatgtataaacagatgtctttggaagatttcctctttaataccactgcttcaaccgctacaatcaatgctaacactgctaatacaaggacgtacgccgtacagtcaattagcgggaagttcttgaagaccgttgacgtggacgtgctggtcaccaagttggcttggtttaatagtattaccaaagagctgcactctaaggatcgccaggacttgtaccattccttctgcatacctaaaaagagcggcggactaagacaaatagatgaaccaaacgaagaacttatgtcggccctccgtatgctgaaggatatcttcgagaacgacttcggagcgctgtatcacacaagcgcctttgcatatgtgcgcgacaggtgtacaattgacgccgtgaaaaaacaccaggataatgagtccaaatggttcggtaaatacgacctttccaacttcttcggtagtactacaaaggagttcgttatgcaccagctagaaatgatctttcctttttgcgaggtactcaaacgagaggacgggaggcgggagctagagactgccatcgacctggccttccttaatggggggctgccccaaggcaccccattaagccccacattaacgaatataatcatgatcccggtggattacaagctgtataacaccctccggaattacaataaccagacatttgtctacaccagatacgcggatgactttatcatttctagccggtatagctttagtttcaaggagatagagaacctgatcaagtcaactcttgaggagtttggcgcaggcttttccattaattcgaaaaagacgaggtatggatcatctgcaggaagcaactggaatctgggggtgatgctgaataaggacaacgaaattaccattggacacaagaagaaaaaacagttccaggcaatggtcgcctcctatattatggattctaagaacggcaaaagttgggatatcaacgatgtgcaaagactggagggcctccggaactactaccattccgtcgagcctgaacgcatcgatgaaatcatcgaacatgcaaacgaaaagttcggtgtgaattttagaaaactgattgccgacaacctcaaggtcgcttga

SEQ ID NO: 12173 - RNA, 1149 nt, unidentified
  source 1..1149: mol_type = other RNA; note = synthetic construct
atgactacttacatcaccgtgaagcaactcccccagtaccgacagatgaccattgaggaactgctgttcggaaccgaaccagctgatacctgtgtcaatgatggaataggcaacacgcgcacttttgtaactgagaactacgccaccgtcgacgaatatatgaaattcatagaccctgcccatctcattgaagtgcttaggaattttaatgacaaggtggactgcctaagacaggttcctcggtctagcctgtatcattccttctcgatccccaagagaactggagggttacgccggattgatgcccccaatgaacagctgatggaagctctgagagagttaaaaaccatcctggagacagagttccacgcactttatcacacatcagcattcgcatatgtcaaggagcgctccaccatcagtgccgtgaagaggcatcagatgaatgaatccaaatggtttgccaagtacgacctcacaaatttttttggctcaattaccctgccattcaccatgcaaattctggctaaaatctttcctttcagcgtgatcctccggagcagagatggtaagatcgaactcgagaaagcattggagctcggctttctgaacggcggattgccacaaggtacaccattatctcccatgctgacaaacctcataatgattcctatcgatcacactctggcgaatgcccttcgagactataacgggcagaggttcgtgtacacgaggtatgccgatgactttcagatctccagtcgcttcacattccagttccgggagattgagtctcttattgtccgggttttgcatgatttcaacgctcccttcagactgaaaccggagaagactagatacgggagcgcaaatggtgccaattggaacttgggcgtcatgttgaacaaggacaatgagatcacagtggggcaccgaaacaagaaaatctttcaggcgatgcttcacaattacatacatgatcgcgctaacggaattttttgggaactgaacgacgtgcaaacgctagaaggctaccgtaactattactcaatggttgagaaagacaccatcaacaagataatcgagcacacagacaggaaatttaacgtgaatgtacggcgtatgattgctgaagatctgaggcgttga

SEQ ID NO: 12174 - RNA, 1167 nt, unidentified
  source 1..1167: mol_type = other RNA; note = synthetic construct
atgtatgagcaaatctcaattgaggaattccttttcaacgataacatcactaacaaagtgatcacccagaattcaagtaatacccacacatacaagctgaagtacataaacgagaaattgcaggatctgtgtagggttgaggatctgatcctagaattggacaagttcaactctgactataagtcactgagaggaattagcagggagaacctgtacaacacgttctttattcctaagcatagcggcggtctaagaagaattgatgccccaaatgcagagttgatgaatgccttacggcgcctgaaggcaattttcgaagaagacttccatgccctgtatcatacctccgctttcgcctatgtaaagaaacgatctaccatcgatgctgtgaagcggcaccagcaaaatggcagcaactggtacggtaaattcgatctgtccaacttttttggcagtacaactatcgagtttgtcatgaatatgctctccatgatatttccctttagcgaggtggtgaagacaaagcatgggaaagacgcgctcgagcacgccctcgaccttgcattcctgaatggcggcttaccccaggggacgccaatatcacctcttatcacaaacgttatgatgattccgatcgactttaaactctcgaatacacttcgttcttttccttgctcccaaccaaacaatttgggcgagactgagaattaccagaggttcatttacactagatatgctgacgatttcctgataagttctaagtacgagttcgacatcaaagagatcgaaaagtttatagtggacacccttagcgaattcgatgccccctttaccctgaactccaagaagtctcggtatggatcccgcgcgggccgtaattggaatctcggaattatggtaaacaaagacaacaatctcactgtcggatacaagaagaagaagcagttccagaatatgctggcaagctatattatggataaacacaacggaaaagagtgggataaaaatgatgtgcaggtcatggaagggtacaggaactattaccgcatgatcgaaggggaagtcattgaccgaatggttgagcacatcgctaaaaaatttggtgaagaaatcatccaccggtgcaatgggagtaacctgaaactcgtgctggaggacttacgctga

SEQ ID NO: 12175 - RNA, 1137 nt, unidentified
  source 1..1137: mol_type = other RNA; note = synthetic construct
atggtctatattaccgttagacagtcaccaatttatcaccaaatgactctcgaggagtacctgtttcagtcttatcagacccccccagtggtaaatgctaacatagccaacactcggacgtatgaagtggagaatgtgagcgagcatttctctagcaagataggggtggaggccctgatcgggaagctggtccgcttcaataacgataccgctgaactgcgtgctaaagagaggagcgagctttacgaaacgttctacattccgaaaaaaagtggcgggcttcgacgtatcgacgcgccaaaggctgagttgatggatgcgctgaggcggcttaagactattttcgaagacgactttcatgcactataccacacagcagcctttgcatacgttaaaaagcgctctaccgtcgatgccgtaaagcggcatcagaagaactctagtaaatggttcgccaagctggatttacacgatttttttggctcgaccacattggactacgccatttccatgttttctatggtgttccctttttccgagatcgtcaaagaacctcagggtgaagccgcgctcagaaccgcaatgagtctggcattcctgaatggaggtcttccccagggtactcccattagtcctttaatcacaaatgtcatgatgatacctgttgacttcaaactctcaaatactctgagaaacttcgaaaagcaatcattcatctacacgcggtacgcagacgacttcatcataagctccaagtatgacttcgatgtgaggagcgtcgaagaactagtggtgtccactctgaacagctttggggctccctttaccatcaatgcttccaagacaaggtatggatccagcgctggcagaaattggaatttgggagtgatgctcaacaaagataatgagattaccgtgggccacaagaagaaaaaacagtttcagtcgatgctgtacaactacatcacagataagaacaacggagttgcctgggagcgcaatgatgtgcaagtgatgtatggcctccactcatattataggatggtggagaaggagacaattgacgccatcgtcgcctacatcaacaagaaaatgaacgtagatgttatccgcatgatgaaagacgacttgcgatga

SEQ ID NO: 12176 - RNA, 1137 nt, unidentified
  source 1..1137: mol_type = other RNA; note = synthetic construct
atggtctatataactgtgatgcagagtccgatctatcatcagatgacgcttgaggaatttttatttcaaaacttccaggcgcctaccatcctgaatacaaacgtgagcaatacccgtacttatgcatatgagacagtttcggagcactttacatcacgcatagacactgatgctttgatttgtaagttggtcagatttaacgaacagaccgaggcccttagagcacaagagagaagcacactctacgagacattccatattccaaaaaaatccggaggtctaaggcgaattgatgcacccaagcctgaactgatgaacgctctacgcaacctgaaaactatctttgaggaagacttccacgcattgtatcacacctctgcctttgcctacgttaaaaaccggtgcaccgttgacgcggtcaaaaggcaccagaagaacaattctaagtggttcggcaaactggacctgcatgatttttttgggtcaaccactctggactacgtaataaaaatgctgtccatggtgttcccattctctgagatagtcaaattcccaaatggtgaggccgaactcagaaaggcccttgacctggctttcctcaatggcggattaccccaagggacaccactgtcccctctgatcaccaatgtaatgatgatccctgtcgactataagctcgctaacgcttttcgggactttgataagcagaggttcatttacaccagatacgccgatgacttcattatctcttccaaggtggatttcgacgtacatcgcgtcgagaagcttgtggtggacaccttacacgaattcggagccccgtttaccattaatgaaagcaagacgcgatacgggagtagtgccggacggaattggaatctcggggtgatgctcaacaaggataacgagattacggtgggccataaaaaaaaacggcaattccagtcaatgctctacaattacatcacagacaagcgcaagggcatcagctggcccagggaggatgtgcagactatgcagggcctgcacagctactataggatggtggaacccgaaaccattgatgcaatcgtgaagcacacaaacgaaaaaatggagactgacgttttgcgtctgatcaaggatgatctgcggtga

SEQ ID NO: 12177 - RNA, 1218 nt, unidentified
  source 1..1218: mol_type = other RNA; note = synthetic construct
atggaaagttcccatcagtgggccctcacgtctatcatctatgtgggatataattcccgactgcgtaagggtggatttaccctagtctacattacagtaaaacagagccccatttatcaccagatgactctagaggaatttttattccagactttccaggggcctgctgtcattaatgagaatatgacaaacactcgaacctatgagttcgagtccgcctctgcacattttaccaagagtattgatgttgacgctctcgcttggacactcgccagatttaatcagtcaacagaagaacttcgggagaaggagcgtatttcactgtacaataccttctacatcccgaagaagtctggaggattgcggaaaatcaatgcccccaaccccgagttgatgaatgccctccgcaggttaaagaccatatttgaagaggatttcaaggccctgtatcacacatcggctttcgcgtacgtgaagaaaagatgcactgttaacgcagtggaacgacatcaacaaaacaacagcaagtggttcgggaagcttgatctccacgacttcttcgggagtactaccctcgattttgttatggacatgttctctatgatctttccattcagcgaggttgtaaaaactgtgaacgggaaaacggaactgagaaaggcattagaacttgctttcttggatggcggcttgccacagggcactcccatttcccctacaataaccaacatcatgatgatccctgtagacttcaaactgtctaatgccctgcgcaactttgacaaccagaggtacgtgtacaccagatacgcagatgattttatcatctcatcacgctacgagttcgacgtccacaaagtggaggagctggtggtctttaccctgcaaaattttcacgcgccttttagcataaacgccagcaagacccggtacggtagcagcgctggcaggaattggaatctgggactgatgctgaacaaagacaacgagatcaccgtgggtcacaagaaaaagcgccagttccaatccatgctgtacaactatattacggataagaagagggggatcgaatggtcccgcgaagacgtgcagacaatgcagggcctgtacagttattataggatggtcgaagagaagccaatcgacgcaatcattaaacatatagatgatcggatgggcgtggacgtgattagaatgattaaaaaagaccttcggtga

SEQ ID NO: 12178 - RNA, 1137 nt, unidentified
  source 1..1137: mol_type = other RNA; note = synthetic construct
atggtctacatcactgtgaagcagtcaccaatgtaccaccagatgactctggaagagttcctcttcaagacattcgagaacgacaagctgatatctaaaaacaccggaaatacccgaacctacgagttcgaacggatttctgacaggtttatgagtagaatcgacgttaacgagctggttggctatcttgcccattttaatgaatcaacggcacaacttcgagaaaaaaataggcaggatctgtattccacattttacatcccgaagaagagcggaggtttaaggaggatcgacgcccccaaacctgaattgatggatgccctccgtcgcctgaaaactatctttgaagagcacttccacgtgctttaccacactgccgctttcgcctacgtgccaggccgatctactattgatgccgtgaagcgccatcagaaaaatgagagcaaatggtttggcaaatacgacttgagtaacttctttgggagcaccaccttagatttcgttatgcagcagtttagtatgatttttcctttctcggagatagttaaatacgagctgggaaaaaacgaactcgagcgggcactcgagctggcgtttcttaatggcggtctaccacaggggacccctatctcccccttgatcaccaatgtaatgatgattcccatcgattataagctcgctaataagttccgggacttcgagagacagtcatacgtgtataccagatatgcagatgactttatcgtgtccagcaagtatggtttcaacgtgcgcactgtcgagcgtgtgatgatcgagacactcgctgagtttaacgccccctttacgatcaacgaagctaagacaagatacggatcttccgctggcaggaattggaatctgggcctgatgctgaacaaggacaacgaaattacagtagggaagagaaataaaagacaattcatgggaatgctacacaactatgtcatggataggaaaaaagggattgcatgggacaagcatgacgtgcaaacgatggacgggtactataattattaccgcatggtcgaaaaggaaacaatagatcggattgtggagtatattaacaaggagacaaatgcgaacgtcttgcagtacatacgcgaagatctgcggtga

SEQ ID NO: 12179 - RNA, 1122 nt, unidentified
  source 1..1122: mol_type = other RNA; note = synthetic construct
atgcagtcacccatgtatcaccagatgacgctggaagagttcctcttcaatacgtatgatgccaagtccccagtgatcaaccaaaacgccgggaacacccgcacctatgaattcgaaagggtttctaatcgatttctgtctcggattgacgtcaacgagcttgtgggccatttagtgcggttcaatgaatccacagaggaactaagaaacgtaaatagacaggacctgtacaccaccttctatattccaaagaaaagtggaggcttacggaggattgacgctcccaaacccgagttgatggatgcgttgaggagactgaagactatattcgaggagaaattccacgccctataccacacttcagccttcgcctacataaaggagcgaagtaccctgaaagcaatccagcgccaccaaaataacgagagcaaatggttcggcaaatttgacctgagcaatttcttcgggagcactactatcgacttcgtcatgcagcagctcagcatgatctttcctttttccgaagttgttaaatacgaacttgggaaaaatgaactcaggactgccctcgagctggcctttcttaacggcggtttaccgcaagggacacccttctctcctcttataaccaatgtgatgatgatccctattgattaccggctcgctaacaagtttcgagattttggtcggcagtcttttgtgtacacaagatatgctgacgactttattgtctcgtccaagtacagctttgacgtcagaatggtcgagagggcgatgatcgatgttttgacagaattcaatgcaccatttacactgaacgaagagaagacccgctatggaagttcagcaggacgcaactggaatctcggaattatgctgaataaagataacgagatgaccgtgggtcatcgtgctaaaaagcagtttaagaacatgctgcattcctacgcactggataggaagaaaggcgtaatgtgggatagacatgatatccaggtgatgaatggctattacaactactaccgtatggtggagaaggatactatcgacaagatcgtggagtatataaacaaggaaacagattgcgacgtgctgcgcgacattcacgaggacttgaagtga

SEQ ID NO: 12180 - RNA, 1167 nt, unidentified
  source 1..1167: mol_type = other RNA; note = synthetic construct
atggtctacattacagtcaagcaagggcaccatgagagacaaatgagcctagaagagctgttttacgaagagtataatcctagacgattttctccacgaaacacaagcgacactcgcacggacatcagatccgcaccgagtgctgagatgatgcggtacgttgacgtaatagggttgatacacaaactcagcgagttcaacacgcagactaaggagctccgcgaatgcaacagacaagaactgtacaacacatggtttattcctaagaagtcgggtgggcgtcgcaggatcgatgcaccgaaaccaaagctgatgcttgctttgaggaacctgaaaagcattctggaagaagacttcggcgccctgtatcacacctctgcctttgcatatatcaaaaatcgttccacattggatgcgataaaaagacatcagcagaatgagtcaagatggttccttaagctggacctccacgattttttcggatctaccacgccagagttcgtgatgaagatgttcagcatgatttttccctttagtgaggtcgtgaagtccgcctacgggaaaacacagctggaaacagccctcggcttagcttttcttaatggtggactgccccagggcacccccatctcacctactatcacaaacatcatgatgattcccatcgaccatcggttgtccaattccctgaggggattcagtaccgaacgggtaaatcctaaaactctggagccttttaaagagcatttgctctatacccggtatgctgacgatttcctcatttctgacgcctacagcttcgattggaagaaggtgcaggagtatatcctaaacgtcttaaaggaattcgacgcgcccttcaccgttaacactaaaaaaaccaggtacgggtcaaattcaggaaggaactggaacttaggagtgatgctgaatgccaataatgagattaccgtgggttacaagcggaaaaaggaatttcagcgactggcatatcagtacataaccgaatctcgcggcggcaacaaatggccacttgaggaggtgcagcacctccaaggcctgtacagttattatcacatggttgagccagagacttttgataggatcgtgaagttcatgaatgaaaagtacaacgccgatatccttactatgatcaagcgcatttga

SEQ ID NO: 12181 - RNA, 1146 nt, unidentified
  source 1..1146: mol_type = other RNA; note = synthetic construct
aaggagcatgacatgccatacatcaccttgcaacaatctccgatttactaccagctctccctcgacgatatactggatggcgccgtggacgtgtcaaaaatggttgtgcctaacgctactaacacaagaactcggtataaggagatcctctcagaaaagttcctcaataaattcgatttcgacgccatgatcagagtgcttgagcaattcaatgagcagcacgagaacctgtttaacgttgagaggaagaccctgtacgagacattttatatcccaaagaggacctgcggattaagagaaatcaacgccccagtgcctgaattaatggacgcgctacgtcagttgaagaccatctttgaagtgaacatgttcgctttataccacacatccgcattcgcctatgtgaagggaaggtctactattgactctatcaaacggcatcagcataatgagagcaaatggtttgggaaatttgactttagcaacttctttggtaacaccaccgaggaattcgtatttagcatgttcagcatgatattccccttttccgaagtagtcaaatcacagcgagaagcaaacgcgttgcgccgggccctgagtttgtgttttctgaatggtggactgcctcagggaacgcctattagtcccattatcacgaatgttatgatgatccccattgatcaccaactttgtaatgagctgagggccatggatgagcactatgtctatacccgatacgctgacgatatccttataagtagcaaggtgaacttcgacatcacaaaggtgcaggagtttattctgtcagtcctgcgcaagttcaatgcacccttttcgctgaagaaggagaagactcgctacggcagctccgcaggccgcaattggaacctaggggttatgctcaataaagacaacgaaatcacaatcgggcaccagaaaaaaaaaactttcaaagccatgtgctgtaattacgtggaggataaacggaagggcataacttgggatcttcatgatgtccaggtattcgctggcctgatatcttattaccgtatggtcgaaagagagtatattgattacgtgattgaacactgcaataccaagttcaatacaaacattgaactgctcattaagcaggacctgtcctga

SEQ ID NO: 12182 - RNA, 1134 nt, unidentified
  source 1..1134: mol_type = other RNA; note = synthetic construct
atgccgtacattacgattcagcaatcacctatctactatcagatgtctttcgacgatattcttgatggcacagtggatttgtcacggatggtggtgcctaatgtaactaacacccgaacacactttagggagttcctgaagccaagcttcctggaaaggttcgattttgatctgatgatcgcagtgctggaaaagtttaacgagcaacacgcaaatttgtttaacgtggagaggaagtcactctacgaaaccttctacattcctaagaaatcgaaagggctgagagagattaatgctcccgtgcccgaactgatggacgcgctacgccagctcaagactatattcgaaacgaatatgtttgccctgtaccacacatccgcattcgcctatgtcaagggccgctgtaccatcgactgtataaaacggcatcagcagaatgaaagtaaatggttcgccaaactggatttctccgatttttttggatctactacagaggagtttgtgatcagcatgttttcccagatattcccattttccgagatcgtaaagagaaaagatggtctagaggctctcaaaaaggccttgagcttatgtttcttaaacggcgggcttccacagggaacccccattagcccaaccatcaccaacatcatgatgatccccatagatcatcagctctgcaacgaactgcgaaagatggacgaacactacgtttatactcggtatgctgacgacattcttgtctctagtaaggttggatttgattgcaacaagctccaggactacatcctcggtgtgctgaaaaaattcaatgcccctttctgtcttaaaaaggagaagaccagatatggcagctctgcgggacgtaattggaacctgggcgtcatgctgaacaaagacaatgagattacaatcggccatcagaagaagaaaacttttaaggctatgtgctgcaattacatatgcgacaagaagaaaggggttgcatgggatttacacgacgtccaagttttcgccgggctgatctcctattaccgcatgattgagaaagactacatcaactatgtgatcgaccaaaacaacaaaaagttcggtgtcaatctcgaagccctgattaaggaggacttgagttga

SEQ ID NO: 12183 - RNA, 1140 nt, unidentified
  source 1..1140: mol_type = other RNA; note = synthetic construct
atgccatacattaccgtgcggcaacccccgccacatcagcagatcacttttgacgacctgttttttagtacatctgttcaggaccacttccagcccgtcagacgggacatgagcggcaccataaccaggtttgtcaaggaacctaagaaagagctactacagaggaccgacatcaattccatgatttcatgcctggagatgttcaaccagaggcatgctgacttgctcgccgcagaaaggcgcagcctgtatcacacgttttttattccaaaacactccgggggtttaagaaagatcgacgaacccaacgaaaatctcatgaatgccttgagggagttatgtagtatctttgttaacaagatgggcgtgctttatcatacaagcgcctttgcctatgtacccgggcgctcaactatagatgcaatcaagcgccaccaggccaacgaatctcgttggtttctgaagacagatttctccaatttcttcggatccaccaccgaggattttctctaccgggctttctctgtgatgttccctttcagtgagattgtcaagactaaaagaggatcggaggccctcaaaaaggctctgtcactgtgcttcctggatggtgggttgccacaaggaacacctataagccctatgcttactaacgccatgatgattcccatcgaccatcgactgttcaacggcttgacaaaacagggcttcgtttatactcgatacgcggacgatattcagatcagttccaagtacagctttgattataaggaaatggtggcacacatcaatggggttgtgaaggatttcggcgctccatttgtgattaaggaccaaaaaacacggtacggatcttcttcaggtcgtaattggaatctcggcctgatgcttaacaaagataacaacataacggtggggtaccaacgcaagaaacaggtaaaagccatgaccaataatttcattgtggatcacctgaaccatattccgtggcccaaggaagacgtgagacacttcgatggaatccttagctactgtaaaatggtcgaaaaagagtatttcgagcacatgatcaaagcttttgaggagaagtacaaagtcaacttcaagatcatgatgaaggcggcactggagcagccttga

SEQ ID NO: 12184 - RNA, 1134 nt, unidentified
  source 1..1134: mol_type = other RNA; note = synthetic construct
atgccttatattaccgttcgccaaaggaccgagtttagacaaattacattcgaggagttgatcttgggaattgcgcctgcgccaaccagaaaacatacatctaagggcggcactatcactcgctacgttcgaaatgtggaccctagcataagggctacagtgaacatgaatgccctgattagcagtcttgagcggttcaacaatctgcaccagaaccttttcgatgctaagagggagagcttgtaccgaacattctacatacctaagaagactggagggctccgccgtattgacgccccaaacgacgaactcatggatgctctccgggaattaaagactattttcaccgatcagttcggtgcactccaccacacgtctgccttcgcatacgtcgaaaatagatccccggtagacgccataaaaagacaccaggtgaacggctctagatggtttctcaagacggacttttccaattttttcgggagcaccaccgaggattttctatacaccatggtgagtatgatcttccctttcagtgaagtcattaagtctcgggtcggcaaggaagagttgaaaaaggcactatccctgtgctttctgaatggcgggctgccccagggaaccccaatcagtccgatgcttaccaatctgatgatgatcccctttgatcacaagttttgcaacgagctgtccaagaaaggatttgtgtatactcggtacgccgacgacatacagatctccaacgaattcgactttaactatcacgaaatcgtccaatacatcagcgatacactgaagtcgcagcatgcccccttcgttattaaaccccagaaaacacggtatggatcatcaagcggtaggaactggaatctgggtgtgatgctgaataaggagggggacatcacagtaggccatgagaagaaaaaagtgttcaaggctatggtgaataactttatcgtggatactctgcgttgtgtgccatggtcaattgaagatgtgcgccatatggatgggttactctcatactataaaatggttgagcccgattactttgaccacatcatcaaatctttcaacgagaagtataaggtcgactatcatacgatggtaagggcagtccttaaaggcaaatga

SEQ ID NO: 12185 - RNA, 1140 nt, unidentified
  source 1..1140: mol_type = other RNA; note = synthetic construct
atgccttacataactctcatgcagtcccccgcttttcaccagatcacttttgacgagatcatctctggggttgttgacatcccgactatgattctgcccaatgaatccaacacccgaacatatttcgccacaagggtgaaccagaagtttctggaaagattcgatttctccgaaatgatttccgatcttgacaagtattgtgaacgccatgccggtctgtatgacaaaaagaggaagagcttgtatactaccttttacctccccaagaaaagcggaggtctgcgtgaaatcaatgccccagtacctgagctaatggacgctcttcgggaattaaagaccctctttgaaaccaagttttttgccctgtaccacaccagcgcttttgcatacgtgcctcacagatgtgcagtggatgcggtgaaaaagcaccagagcaatcaaagccactggttcctcaaaaccgacttctccaatttcttcggatcaaccacccacgattttctgatgaggatgctttcaatgattttcccgttctctgagattatcgccaatgaacacggaaaagcagtattggagaaggcactggacctatgctttctggatggcggcttgccccaaggcacacccatcagtccaatgctcacaaacctgatgatgattcctatcgatcatcgtcttttcaattgtctccgggatttcaaaggccacagttatgtgtacacacgatatgccgatgacatcttaatttctgccagacatcatttcgattacgcagagattgtggactttataaactcgacactgaaggagttttgcgcgccattcaagataaaggacgagaagactcggtatgggagtcgcgccggctcaaattggaacctgggagttatgttgaataaagataacgagatcacgatcggcactaaaaacaaacagcggttcagggctatgctgtgcaactacaccctcgacagaaaaaatgggaaaccatgggaactgcatgatattcaggtcttaaacgggatcatgaactactacaagatgattgagaaggattacattgagggtgtcatcaaggctatgaatgagaaattcaagacggacatagtctctaacatgcgcgaggacctggggcagtga

SEQ ID NO: 12186 - RNA, 1122 nt, unidentified
  source 1..1122: mol_type = other RNA; note = synthetic construct
atgcaatcacccatattccaccagattacatttgacgaaatcattagtgggaacgttaatttggccaacatggtgaaccccaatgagacgaatactagaacctatttcagtaaagtactgaacccaaaattcctcgagcgtttcgatatcgacgccatggtggtaaccttggaggaattctgtaagcaaaatgctaaactctacgaagccaagagatctgacctgtacgacaagttctatatccctaagaaatctggtggtctgcgcgagataaacgctcctcagcccgcgttaatgaatgctctgcgcaatctgaaaacaatctttgagactcagatgttcgcactgtaccatacgtcagcctttgcctatgttccggggaggtccaccattgatgcagttaaacgccatcagaagaatgaaagccactggtttctgaagactgacttctctgatttctttggatccaccacacctaagttcttgatgtccatgctttctaaagtctttcccttttccgagatcgtcaagagccagcgggggtttgacgcattagaaaaggccctggacctctgcttcctgaacggcggattgccacagggtaccccaattagtccgatgcttactaaccttatgatgattcctatcgatcaccgaataaataattgtctgcgggattttaatggcaaccactacgtgtatacccgctatgctgatgatagccttttcagttcaagaaaagggtttgataaggacgagatcatcggctttattaactcaacactcgcagaatttggagccccattcaaaattaaggacgagaagacacggtacggaagccgtgctgggtcgaattggaacctgggagtcatgctcaataaggacaacgaaataactatcggctacaaaaacaaacagagactgagggcgatgatttgcaattacatcctcgataggcaaaacggcaggcggtgggatctacatgatgtgcaggtcctacgaggcctggtgaactactacagcatggtcgagaaagagtatgtggactccgtgatcaagtataacaatgagaagttccacaccgacgtgatgaagagcatgtctgaagacttaaaccagtga

SEQ ID NO: 12187 - RNA, 1146 nt, unidentified
  source 1..1146: mol_type = other RNA; note = synthetic construct
atgtattatatcaccaccatgcagcacagaaaacctaggcaactgtcttgggaggacgttatcatggataagcttgtcatgaatgattatgtgaacgacaaatcaaacagcacagccacaatcactcggaagtatgaaaatatcccggatgaagttatcaagaagataaatgtagagctgatggtccgttggttacataacttcaatgaggagagtaaagaactgtttgagagaaaacgcgagtctctttattcaacctttagaatcccaaaacagtccggcggctttcgccgcattgacgctccctgcgaggaactgcaaaatcaactaaggaagttggtgacatttatttccgatgactgcggagtgctgtaccacaccagtgcctttgcctacattaaaggacgatctatcgtggattgcgtgaggaaacatcagaaaaacgaatccaactggtttctcaagacagacttcagtgggtttttcccaaatactaccttggatttcacgatgaaaatgctgagcatgatcttccctctgagcgagatctgtaagcggaaagacggatactcggaattagaaaaggcaatttctcttgggtttctgaacgggggtttgccccagggcacagtgctatcccccatgctcacaaatatgttcatgattccaatagaccacaagctgttcaatgaacttgccgggcgaaagctggtctacacccggtacgcagatgatattcatattagcggtcaggaacacttcccctttaaagagatagtaactctcattgagaacactctcgctgaatttaatgccccttgggtcatcaagaaagagaagactcattatggcagcaggaaaggcaagaactggaacttgggactcatgctgaacaaggacaacgacattaccatcgggtggaaaaagaagcaatacttcaaggctgcattatgttccttcattctggacacgaagaataaaaagtactgggatctgggcgacgtccagcacctcagaggacagctctcatattacatgatggtggagaaagagtacttcgagaagataatcatccagcagaataagaagtggaacgtgaacgttaaggaaatgtttaaagagtacctgaatggtaccttcgcgtga

SEQ ID NO: 12188 - RNA, 1128 nt, unidentified
  source 1..1128: mol_type = other RNA; note = synthetic construct
atgccttacatcaccgtgatgcagtcaccaagatttcaccagataactctcgatgagatattgtccggcgaggtgcaggtgtccgatatcgcgcctcgctcagttactgggaccgtaacacatttcagtgaaaggctcaacgatcggttaacccggctggcccaagtggatgagctggtcgccgttctcgagactttcattcagaaaaatgagagcctgtatgaacagaagcgctcaaagctgtacaacacattctatattgccaagaggtcaggtggccttcgtaagatcaacgctcccctcgaggaactcatgtctgcccttcgagaacttaaggaaattctggagacgaagttttctgccctgtatcacaccagcgcatttgcatacgttaagtgcaggagcacagtggatgcagtaaaaaaacaccagactaataactccaggtggtttctgaaaacagactttagcgacttcttcggaagtactacgcccgagtttctgatgaagatgctgtcccaaatataccctttttcggaggtcgtgaaattagaaaggggtagagtcgtgctgtctaaagccctggacttgtgtttcctggacgggggcctacctcaaggaacaccaatcagcccaatgcttaccaatttgatgatgatcccgatcgatcatcggatagctaatgaattgcgccgaaacaactttgtttatactcggtacgcagacgacattattatcagccataagttcgactttagtttcaccgagaaatgcgatttcatcaaccaagtgctcgccgagttcgaagccccattcaagatcaaaccctctaaaacaagatatgggtcttccagtggaaacaattggaacctgggtgtcatgctaaataaggacaataagatcaccattgggtatcagaagaagaaaacctttaaagctatgtgttacggatacattacatccaaacagaataatcagccctgggacagacacgatctggaagtgttcaatggcttaattagctattacaagatggtcgagcgcgattacatcgcttatacgattgaccactacaaccagaagtacggcgtgaacatgatggcgatgatccgtgaggacctcagatga

SEQ ID NO: 12189 - RNA, 1149 nt, unidentified
  source 1..1149: mol_type = other RNA; note = synthetic construct
atgccctatgttacaacattcatgactagggctaaaaaacagcttacccttgaagacgtgctctttggggtgaaaaacctaagcccttatatcaatggtgtggatttcgggaccagtacaaggacttatgagtacaagaaattgcctcaggaattgaaagagatggcccgggttccttacttgataggaaaactgaagagcttcaatcggacttaccagccaaaattcgatgcaaacaatatgagagagcattataactcgtttaagatccccaagaaaagcggcggctggaggcagattgacgcacctgatgacgaactgaagcaagcgttgtactcactcaaggccatctttgagaacgactttaaggtactgtaccatacagccgcctttgcatatatcaagggcagaagcaccactgacgccctgaaggtccatcagcgcaataactctaactggtatctgaagacggatctgagtaatttcttcggctccactacattagagtttaccatgcgcatgctgtcagtgatctaccccttttgcgaagtggtaaaatatgaggacggcgaaaaggcactacgtgatgccatctccctgtgtttcctggacgggggtcttccccaaggtacgccaatctctccactgctgaccaatgtcattatgattccaattgatcacgagatatcaagaaggctccgggcttccgagacaaatgatttcgtgtacactcgatacgccgacgacgccaccgtgagttccaagaagggttttctgttcatgggggtgatcgaaatgatgaacgacgttttcaaaaaattcgatgctccgtatacgattaaaaaggaaaagacacactacggatctcgggctggccgaaactggtgccttggactcatgattaacaaggacaacaaaatcaccgtggggcacgagaataagaaagtgtttaaggccatgctcaataattatatagtcgcgagaaaggatggaaaaggatggccccctgaagaggtcatgaccttacgcggcaagctcagctactactctaacgttgagccggagtactttgactatgtgatttcctggtataacaaaaagtaccactgtgatgtcatcaagatgatggcagatgacgtagctgcttga

SEQ ID NO: 12190 - RNA, 1173 nt, unidentified
  source 1..1173: mol_type = other RNA; note = synthetic construct
atgatatatgttaccgtgcgcatcacagaaccctataagcagattgctctggaggacatcatgctggctctgtttcagggagaaaatgtgagggagcgtactcctagatcaccctacaccagaactttcacctacgagagacttcctgaacgaatcctggcaggctttgatgttgagaaaaagatcggccttctccggacgtttaataagaaacatcacaaccttatggagtcagacattcgcgagcattatcacaaattcttcataccgaagaagagtgggggaatgagggaaatcaacgctcctgacgacgagctgatgaactgcttacgcgaactgaagctcctgctagaaagtgagttttatgcttcctcacacgctgcggcatacgcatatgtgaaaaacaggtccagtgtcgacgccgccaaggtccatcaatggaacaaatccaagtggtatcttaagacagatatctctggtttcttcccaaataccacgcctgagtttgtgtggaatgcactgtctatgatatatccattttgcctcattatggaatgtaaaagcggtcgggaagaactcagaaaagccctgtccctgtgctttctggatggcggtctacccatgggcactccgatctcgccaatgttgactaacctgatcatgattccctttgacttcgagttctctaagttcctgagatccttacagaatccagaaaacaatcctgacaaaaaaggccgacggttcgcctacacccgatacgccgatgacatgaatataagctgtggaatcgaattcgacaagagtttcattattcggaaaatcgaaaacctcttccgcctgtttggagctagctatatcattaaggatgagaaaacacactacgggccatcataccacaaaaactgggtgctcggcgtcatgatcaacaaagacaatcagattaccatcggctacaagaagaagaggaacttcgaggccatgttgtttaattacgcaaaggatcgggagagcgggacatactggcccttagagcaactccagtacgcccttgggttgatgagctattaccgtatggtgaacaaggagtctatagatggggtaattatcaggtatagccagaaatttggatttgatattgaggccgcgatgaaaaaggatttgaagaattga

SEQ ID NO: 12191 - RNA, 1131 nt, unidentified
  source 1..1131: mol_type = other RNA; note = synthetic construct
atgccatatgtgaccacgcctttgtcaccggtaactcgccagctcacttttgaagagatcattatgggcgaggtcgacgtctcccggcccgtttattctaacgcgacaaataccaggaccgtctttgttaagtcaatctcgaatgaggtggcgcagaaagctagagtagctagtcttaccaagcagctccaggagttcgcagagaatttcaggggactatacgaagtggaccgtagaagcttatacgacaccttctacattccaaagaaatccgggggtctgcgcaggatcgatgcaccgaacgacgcactcatggcagcactgagagtccttaaaacaattctggagggagccatgcctgccgatcaccataccgcagcctttgcctacgttaaaggccgaagtgccgtggatgccgtgaagagacaccagcgcaatgactctcactggtttctgaagattgacttctccaatttctttggttctacaacgaaggagtttgttgtgaagaccatgatggaaatattccctttctgtctgttgggcgaagacgggcgcactgctttggagacagccttagagctttgctttctggatggagggctgccccaaggcacacccatcagcccacttctcactaacattgtgatgatacctgtagatcatcagataaataagagactggccaaagacgaagggaacagctgggtctacacacggtatgccgatgacatgctgatctcagcccataagtcctttgaccccaagcgcgtgatggatctcatatctgctgctttgcaacatgtggaagctccctacatcttcaaacgggagaaaacccgatacggcagtagggctggctcaaactggaatctgggcgtgatgctcaacaaggacaacgaaatcactatcggtcacaaaaaaaaggagaggttcagggcgatgatccacaattacatgactgatcgtcaaaacgggacggcttgggatcctcatgacattcaggtgctatgtggacacattgcctattatcgatccatcgaaccaagctgggtctgcgatctgctggaaagatatagccagaagttcggacggaacgtggaggacacaatgaaagaggatattcggtga

SEQ ID NO: 12192 - RNA, 1395 nt, unidentified
  source 1..1395: mol_type = other RNA; note = synthetic construct
atgccctacatcactatccctgttagacaaaaggaataccagatctcttttgatgacatactgaatggcatcaatgagtcatttttcgccatgatgatggatgatacgtgcgacacccgaaccgtatatagagatcacacccccccccgattacttgagaagatcaatatcggtgccatggtcgggatgctggaaaagtttaacaatcgccaccgggagtacttcgacgtgcctaaagaaaatctctatgagacgttctatctaatgaaaaagaacaagggattcagtgttgtcgtgagggagattttcaagactcacaacgccaacagtgggatttcttattccgggaaggatgtgtacgcagacgtgtttgcgattttgaagggcctattgactaatcatccctgtgcagaacacaataggatcgagcaagaaacactcgcaaagtgtgtgcaatacctgaccccattaggattcgaggtcaacgaggagaaaattaaaagcttcatcaaggccggatttagaaggatcgatgctcctcgggctgaattcaagtctgtgctgacagatctgaagatcaccttcgagaacaaactgtttgggagctaccataccagtgctttcgcttacgtgaaaggacggagtacaattgacgcacttaaacggcaccagagaaacaactcacgttggtttctgaagctggacttctctaactttttcgggtctactacccatgagtttgtactgcgtcagttatcctccatattcccttattcagagatcgtaaagagcgaacgcggtagggaagcgctctcgaaggccctcagcctgtgttttttgaatggagttctcccgcagggtactccgttttcaccaaccataacaaacattatgatgatcccaatcgaccatgcaattgctaaaatgtgccgtgagcatagtccccatctgtgctatacaaggtatgccgacgatattcttatctcctctgatctttccttcacctgggaggtcgacaaggagggcagcgtgcagaacgaaattttggacatactccggcgcttcaacgtgccattctccctgaatacagaaaaaacacggtatggcagcagcgctggcagaaactggaatctcggccttatgctgaataaagacaatgagattacgatcggccacgaaaaacgcaaagcgtttaaggccgccgtttactcatttttgaacgattatactcaccaccgcgtctgggatgtggaagaggttcaggtgctgggagggcagattgcttactacaggaatgtcgagaaagaaaacattgacgccataatcctggcctacaatcagagatttggcgtggacatgatgcagataattaaggatatcatctccaaccgatga

SEQ ID NO: 12193 - RNA, 1110 nt, unidentified
  source 1..1110: mol_type = other RNA; note = synthetic construct
atgagacagatcacaatcgacgatattctgaacgggatagatgagtctaagcttgcactgcagaaggatactagggacacgactacctggaaagtggatgccatctcccgagagctcatcgagaaaaccgatttttatgctatgcaggtagcactcatggaattcgtcgaaaaatacaaggatttgattgccgttgaggacaaatctacgctgtatcggtcatttaagattcccaagaggtctggaggcttacgccagatcgacgcgcccaatgatgaactgaagaaagcactttacgagctgaagttcatcttcgagaagaagttttacatgtcctatcacacatccgcttttgcctacgtgcacggtcggagtaccatcgactcagtgaaacgacaccagcaaaacaacagcagatggttcttaaagacggacatgcgccatttttttcccagtacaactccagaatttttgatgaaaatgctttgcatgaccttccccttctgcgagttcattaggtatgattttggatgtaaggagttgctcgaaaaagccctgtccctgtgttttctgaatggtggactcccacaggggacacccacaagcccaatgcttactaacgcgctgatgatccctgtcgaccatgcaattaacaagatgtgccatgaatacgctcctcacctgtgctacacccgctatgccgatgacatactgataagctctcagtacaatttcaagtggagcgacgttcagggtagactgatttcgattctcgagacatttggagctcctttcacattgcacccggaaaagactcggtatggcagtagcgctggcaggaattggaacctcggggtgatgttaaacgccgaaaataagatcaccataggccatgaaaagaaaaaagtgttcaaagccatggtgtttcaattcatgaccgacgacgccaaagggaatcactggtccctggacgatgtgcaacatttcctaggcctcattagttattaccgtatggtagagaaggattgtatcaatgagatcctgcagacttactcacaaaagttcaacaaagacgtcgaggcaaccgccaaggctttgctaaaaccttga

SEQ ID NO: 12194 - RNA, 1233 nt, unidentified
  source 1..1233: mol_type = other RNA; note = synthetic construct
atgtatattacctactggaacccacccaagacacgccaaatcacctttgacgagattatcgcaggtgtccagaatgttgaggccttgcattacggcggaagtacgacatccaccatcactgtctgcaggaacgatctgaccccaagactgcaaaaaatcactaacatcccggatatgatagctaaattaacggaattcaaccagaaatacgccggcttagaggcctgtgatctagccgcccattacgaacacttcgaaatccccaaaaagtctgggggttggcggcctatagatgcgcccgacaaggaactgtcagatgcccttgtggagctgcgagaaatgctcaggacatttatgattgctgactatcataccaacgcctttgcatacattcctaaccggagttttatcgacgctgtgagaaagcaccaggcgggccacgtgaaaacaaagaaaaatgaggagactggcgtgcagacaacagtcacctttgagaaccactgggccgtaaagttcgacctccacggcttctttcccagcaccacccccgattttctgctggggatgctgtccattatctatccattcgctctcattatgaaggatgaaaggggccacgaacagctggcaaacgcgcttaagctctgctttttgcacggtggactgccccagggcactccgatcagcccatggcttaccaatgtgatgatgattccatttgaccaccttatcactcggaagctctgctatggttacaaagcaaaagacgggatcgaacgtgaattcacttatacaagatacgctgacgacatgatgttctcatgttatcactccttcgaccctatggagatacagcaaatcgtaattgacggactcaacttcatacatgcccctttcactctgaatgaggcaaagacacattatggaaatcggcactcttcgaaaaactggtgtctggggctaatgtggaataaggataatcagattaccgtcggatggaggaatttaaagatgttccgcagcgccatgaaaaattacatcgacgctaagaagagaggggagacgtgggagctggaggatttgcagaagtttatgggcaaactcaactactatcatatggttgaacctgaagtgattgatgacttggtgcatcgatacaatgagaagttcggagtggatgttatggcaatgctgaaagacgatcttcgcctgaaggacggggaggccgcttga

SEQ ID NO: 12195 - RNA, 1233 nt, unidentified
  source 1..1233: mol_type = other RNA; note = synthetic construct
atgtacatcacctacctcaatccacctaagacaaggcagatcacctttgacgaaatccttgccggcgtccagaatgtggaagcactgcactatggtggtagtaataccagcacgatgactgtttgcaggaacgacctcacatcaaagctacgcgccataactaacgtgccggagatgatcgagaaactcgtagactataatgtgaagtacactgcgctggagtcatctgatatacccagccactactcgcatttcgagatccccaagaagagtggaggttggaggccaatcgacgcccctgatgagactcttagcgacgccctgatcgaactgcgtgagctgctgaagtccttcatgatcgctgattaccataccaatgcatttgcttatattcctaaccgaagcttcattgatgccgtcagaaaacatcaagccggccacaataaaaccgtagtcgatgaagctaccgggatgaagaaggtggtgaattaccagaaccattgggccgtcaagttcgattttcatggatttttcccttccactacacccgacttcttgctgggcatgatgtccgtcatctatcctttcgccctgattatgagagatgctcgcgggcgcgatgaattggctaaagcagtgaacttgtgttttctgaggaacggcctccctcagggcactcccatcagtccatggttaaccaacgtgatgatgatacccttcgatcattgtattacacggaagctctgttatgggtataaggccaaagacggaatagaccgtgagtttaccttcacaagatacgcagacgatattctcatctcttgctatcaccactttgacccgatggagatccaacagatcatcattgacgcattaaacttctttcacgcgccctttacgcttaatgaaacgaaaacccattacggaaaccggcactcctctaaaaattggtgcttggggctgatgtggaataaagataaccagattactgttggatggaggaatctaaagatgttccgatcagctatgacaaactatattaacgctaaacagcacgggcgcacctgggaacttgaggacctgcaaaagtttaatggcaagctgaactactaccacatggttgagccagaggtgattgatgaactcattcggagatacaacgccaagttcggtacagacattatagcgatgttaaaagaagacctgcggccaaaagagggcgttgtggcatga

SEQ ID NO: 12196 - RNA, 1233 nt, unidentified
  source 1..1233: mol_type = other RNA; note = synthetic construct
atgtatattacctattggaacccaccaaaaacacggcagatctccttcgaggagattctcgccggggtcaccgatatatctaatctaagtcgcggaggcgataacacttctaccatgaccatctgtagagacaacctcacaccacgcttggagcagataacgaacattgactccatgatcaatcagctggcagcttttaatcgcaagtacgccgagctggaaagctcaaaccttccaagccattattaccactttgagatccctaagaagacagggggatggaggcccattgatgcacccgacaaagaactttccgacgcgctgagtgaactgcagcgtttactgaagtcgtttatgatagccgactaccacactaatgccttcgcgtatatccctaatcggtcctttattgacgccgtgcgaaagcaccaagcaggccacgtcaaaaccaaaaccgatccagagactggggagaaaaaaaccgtttgttacgagaacaactggtcagtgaaatttgaccttcatggattcttcccgagcactacacccgacttcctaaaggggatgttctcaattatttacccctttgctctcataatgaagtatcctcgcggacaggccgagctcgacaaagctttaaatctgtgctttctgaatggtggattaccgcagggcaccccaattagtccttggctgactaatgtgatgatgatccccttcgatcacctgatcacgaggaagctgtgctacggttataagatgaaggatgatatcgagagagaatttacctacacaaggtacgccgacgatatgatgttctcttgttactgtagctttgatcctatggaaatccaagaaattgtggtaaatgcactcgaattcatccatgctcagtttactttgaacgctgagaaaacgcactatggctctcgtcattcctcaaagaattggtgcctcggcctgatgtggaacaaagacaaccagatcacagtaggttggagaaatctcaaaaacttccggtgcgcacttacaaattacgttgaggccaagagccatggcaggacttgggagctggaagatctgcaaaagttcatgggcaagattaactattactatatggtggaacccgatgttatagaggatttgatccagagatacaacaagcgattcaacgtcgacatcatcgctatgttgaaggacgacctgcggcctaaagaaggggtggtggcctga

SEQ ID NO: 12197 - RNA, 1233 nt, unidentified
  source 1..1233: mol_type = other RNA; note = synthetic construct
atgtatatcacctactggctgccgcagaaaactcgccagatctcattcgacgagatcatggccgggattctgaacgtgaatcagcttaagaacatcggtgacaaaactgctaccgttacggtctgccgaaacgacctgagtgatcgactctttcggataactaacaccccagagatgattgcgcaactctacgctttcaatgaaaagtacgtggctctcgagcagtgcgatcttaagacacactatcgccatttcagcataccgaaaaagtccggaggctggaggccaatcgatgcaccagacaaggagttgtctgacgcccagacggaattgcgcgaactgttgaacggattcatgatcgctagctatcacaccgcagcccacgcgtatattcagaacaggtccatccttacagcagttcggaaacaccaggctggccatatcaagaaaaaatttaaccctgagttgggttactctgaaactatcgtgtacgagaacaattttgcggcttcctttgacttccatgggtttttcccctccacaaatcctgagttcctcctccacatgttcagtcagatatacccctttgcactgatcatgcgctcacagaacggggatgaacaactgcgtaaggctctttctctcgtattcctgaatggtggcttacctcagggcacacccatatctccatggctgaccaatgtgatgatgatccccttcgaccatctgatgagcagaaaactgaccagagggtacactatgaaggatggagtggaacgtgaatttacatacactaggtatgccgatgatatcgatatctcgtgtccattaagctttgaccccctggaaattcagcaaatcattattgacgccctgcacttcataaatgctccttttaccttaaacgagaagaaaacccattatggaaatcggcactcatgtaaaaattggatgcttgggctaatgtggaaccagaataacgagattacagtcggctggcggaatatgaagtattttaaagccgccctcgcaaattacatcgacgccaaaaagcacggaagaagttgggagctggaagatgtgcaaacactaaatggcaagattagctattacaagatggtagagaagaacgtcgtcgattatattattgcaacgtacaacgagaagttcaaagtggacattgaagagatgattagagccgacctgaggcctgttgatggctacgccgcctga

SEQ ID NO: 12198 - RNA, 1236 nt, unidentified
  source 1..1236: mol_type = other RNA; note = synthetic construct
atgtacgtcacttattggaacccccctcgaactagacagatcacgtttgatgagatactgtctggcgtggtcgatgtgaatcagctcaagtacgctggcgatgagacgtcaacccaaaccgtacaacgcgaaggactgaacgacagactagtggcaatcacaaatgtaacatcgatgatcactcagttaacggagtttaatcaaaaatacgccagactggaggcagtgcgggatctttccacatactattatcacttcgagattccgaagaaaacaggcggagtgaggcccattgacgcccctaccaacgaactttccgacgcccttgtggagctgagaactttgctcaaaagcttcatgattgctgattaccacactgccgctcacgcctacatcaatggacggggaaccctaagcgcaataaaaaagcaccaggcaggccaccgttatacagtgaaggaccgcgaaactggcaaggagaagattgtcacctatgagaacaactgggctgttaaattcgactttcatggttttttcccctccagtacacccgaattcatctactccatgttctccaagatttacccattcagcctcattatgaaggaccgaaatgggtacaatcagctgacaaaggctatgcggctgtgttttctgaatggcgggctcccacagggtacccccatcagtccatggatcaccaacgttatgatgataccgtttgattacatgctcaataagaagttaagctacaagtacaccatgaaagatggtatctctcggactttcacttatacaaggtatgccgacgacataaccatttcatgctacttgagtttcgatcctatggaaatgcaggatatcattaaagagacactcgatgcgatcaacgcgcctttcaccctgaacgaagagaaaacgcattatgggaaccgccatagctctgaaaattggatgttggggcttatgtggaatgctaacaatgacatcaccgtagggtggaggaacttcaaggactttaaaaaaatggccagcaactacattgtgtgcaaaaaggaaggcaaaacctgggacctggaagatctgcagcagtttaacggtaggctgaattactatcgtatggttgagaaggagtctgtggacacagttatctcacgctataacaagaagtatagggtcgacatgatggccatgctgaaagcagatttgaaaccaaaggagggagtggtcttttga

SEQ ID NO: 12199 - RNA, 1233 nt, unidentified
  source 1..1233: mol_type = other RNA; note = synthetic construct
atgtacatcacctataaagccgcaccaaagactcgtcagattacaatagatgaaatcttagcaggaatcatagaaagcgagaaacttaaataccgggaggatgtcactagtacagttactgcctgccgtgatgagcttacgcctaggctcagggccatgaccgatattaaccggatgattcgcgagctggaagcgttcaataaaaagtatgagcagctagaatccgagccggatatgtcagtccattacacccactacgaaatcccgaaaaagactgggggtatgcgccccattgatgccccagataagatcctgtctgatgcactcaatgagttgcagactctattgaaatcttttatgctggcagattatcataccgcggctcacgcatatgtgccacatagatcaacactcaccgccgttaagaagcaccaggaaggccacgtaagaacaaagacaaaccccacaaccgggaagaaggaacaagtgatctacgaaaataactggtcagtgaaattcgacttccacggcttcttcccaagtagcaatcctgagttcgtcatggggatgctgtctgtgatttatccttttgccctcataatgcaggaccccttcggcggtcacgaggctctgtctgacgcccttaaaatcgccttcttgcgaaatggcctgcctcaaggatcacccctgtccccctggctgactaatgtgatgatgattccttttgaccacctcctgtccagaaagattcggcatggatttaagatgaaagacggcatcgcccgcgacttcacatataccagatacgctgacgacataactatcagctgttacctgagttttgactatatggagatgcaagacgtgattaagaatatccttgcttacatccacgctccctttacactgaatgaagagaaaacccattacggcaaccgacatagctcgaagaattgggtcctcggtttaatgtggaatcaggataacgagatcacggtgggatggaggaacataaagacctttaagattatgatgtccaactacattaggtgcaagaaggagaacgcaacctggacgatcgaggatgttcaggaattaaacgggttgatctcctactataagatggtcgagaaagacaaaattgaagctctgatcagcaaagcgaacaacaaatatcacgtggatgtaatggccatgattaaggacgacctgcggccaaaagacgccgcttga

SEQ ID NO: 12200 - RNA, 1335 nt, unidentified
  source 1..1335: mol_type = other RNA; note = synthetic construct
atgcttgctcagaagctgattaagacaagccccgaagctcatcagtcaaatgaacgcccaatcggaaatcgtagactggaactcctgcggcagcctacatccctgagcgagcacaagcacaaccctcatattcggtcaacacatatggtatacattacctacaattgtcctgagcggtttagggagatgacattcgaagaactcctgaggggcgacttcaacctcgccaaccttagcactggaggccatggggccactaggaccgtaatatgcaataaggtgccaccccgcattatgagaatcacaaaggtggaacaaatgatcttccagctgcaagcattcaatcagcagtatgagtccctcagattgacgaccccacggtcgagtctgtataaccacttcagtatacctaaagcatcaggaggcctgcgttggattgacgcacctaacccagaccttatgaaagctctgaaggagctgaagaccctcttccagtcatggatgttcgctgaccaccacacctgtgctttcgcctatgtcgaggatcgctccgtgctatctgcggcaaaaagacaccagaaatttaacgcctggtggttcgcgcacttcgatttccacggattttttcccagcactacgccggagttcgttttaagccaattcgagctgatttatccatttaacctgattctggcaagtcctatcggccatgcggagctgtttaaagcgttggatctctgttttctaaatggcgccctccctcagggaaccccgatctctcccttgataaccaacatcatgatgatcccgtttgatcatgccttcgcaaaagccgtcaatcactttgagtctgggaaacataatcctgacgggacccccatcaccgatagactctgctataccaggtacgccgacgacatagaagtgtcttgcaaagtgatctttaactaccacgctgtggagcggctgatcgttcagttactttcccagatgaacgctccatttactctgaatgagactaagacccagtttcattccagggccggccgcaattggatcctaggtgtcatgttgaacaaggataatcagattacagtcggttaccgaaaaaacaaaattttcaaagccacgatcgacacttattttcgagataagcaaaaggggaaaaagtggccagatgaagacttacagagttttcaagggaacatcacatggttcaaggatgtgcaacccgacactactaagtacattatccagaagtacaatgcaaagtacggtcttgatctggaaagctgcataaaggctgacttggcccccccctctgttacagcctga

SEQ ID NO: 12201 - RNA, 1191 nt, unidentified
  source 1..1191: mol_type = other RNA; note = synthetic construct
atggtgtacatcacctacaacacccccgaaacggtaagacagatcacttttgaagaactcatgctgggagtggacatccctctcgattcactgcgcagcggaggtcacggatctacccggaccgtggtttgctctaaggttcccgaaaggattatgaaaatcacttatctggacgccatgatcagccagctgaagatgtttaacacttgctataaggacttgatcgattaccctaataagtgggagctttacgaccatttcgagattccaaaaaagacaggcggcaagatgcgcccaattgatgctccacaccctgagctgaaaaaagcactggcgcaacttaaagatatgatgtccgggtggatgtttgccgaccaccatacctgtgcattcgcatatgtcaacggccgctcgactaaggatgccgtgataaaacatcaaagattcaggagttggtatttctgtcactttgatttccatgggtttttcccttcaactacactacactttgtgttaaaacagatggaggagatctatcccttcaacctcatccttgccgatcctatcgggagacgggagctcagacgtgcactctccctggccttcttgaataatggtctgcctcaagggacgccatttagccccttcattaccaatgtaatgatgattccgttcgaccataagttcgcaaggctgttgaatcagtttcagtcaggcaagtgtaaccccgacggcaccccgataacagatcggatttgctacacccgatatgcggatgatatccatatttcctgcagggtctttttcaattaccgcaaggtggaacgggaactcatcgccatgttacacgagctcggcgccccattcacactgaacactgaaaagacgcactttggaacacgtgctggtcgaaactggatgttgggcctgatgcttaacaaagacggagacataactgtcgggtatcggaatcacaaaattctgaagagcacaattgagacatattttaaagacaggcgaaatgggaagaaatgggatgaggaagacctacagaagtttagaggaaacatctcttactacttaagtgttgagcccgccaccatcgctggcgtgattcagaagtacaatgccaagtacggtgctgacctgctgacctgtatatccaacgacttgaagccaaaagctgcttga

SEQ ID NO: 12202 - RNA, 1155 nt, unidentified
  source 1..1155: mol_type = other RNA; note = synthetic construct
atgccttatatcgtggtcaaagcaccacctcggtataggcaggtgtccgttgacgagtttttgtttgaggatgaagcacgtacttcttacgtggctctgtgcgaaactgaaaccatcacccggttccgagatcacatccccgggaacgtgagagatgcatacaatatcccactcgccatcagagctctccagtcatttaacgaaacacactcagagctatttgagccagaccgaacggcgctctatcatactttctatataccgaaaaggtctggcgggggagtgcggaggattgatcaacccctgcccgagttaatgaatgccctgtatgaactacgccgcatattcgaaagcatgttccacgcagatatgttataccatacgaccgcccatgcatacattcacaaaaggtcaacggttactctggtccgaaagcatcaacagaacgcctccaaatggtttgctcactacgatttccataatttcttcggatccgtcaccccagagttcctgagcaaaatgttttccatgatttacccttttagcgcagtgatgcaaagcgctggcggcaaagctgccctggagaaggccctttccctctgtttccttaatggcggcctcccccaggggacacctatttcacctatgctgaccaatatacttatgattccctttgaccacaagtttagtaaccacctggaggcgtttggagagcgcaattacgtatacactagatacgccgacgacatcagtattagctccagatctccatttgactacaagaaagtagaggccgagatcgctgcctcacttaagacaatggaagcttcgctggaattgaaccggaagaaaaccagttacggtaataatactggatctaactggatgttcggcatgatgctgaactccaagaacaacatcacagtcggttggaaaaatgtgaaggccttccgctctaccctgaatacatacctgtatgagaggagtcaggggagattctggccgcttgaacaggttcgttctctgagcggtaccataagctattataagatgatcgacgagcaatggttgaacagcatcctcgacatttataaccagaagtacaagacaagtgtgcgctattgcttgaaacaggatcagaagcggaagcagtga

SEQ ID NO: 12203 - RNA, 1146 nt, unidentified
  source 1..1146: mol_type = other RNA; note = synthetic construct
atgtgttactacgtatgtcttccaaaaactgaatctaaacccaacatctggtcctggctcgaaggggatattcattcaccccagtggctatggggcacgaaatcagccgctgcaactgtcacaaggagggttgactttattagcgcgagtgtgaaagacaaatacaacgtcaacttcattatcgggaccttagatgctttcaataagaaatggtcctatctgggtcaggagattgagaagcactacagtcacttctacatacccaaaaagaaactggacgagtacggacgcgtcaaatggcgagagatctgcgcaccagacgatgagctgtcagaggccctaaaagatctgaaggaaatctttgaagctgccggcgttagcctgcaccacaccaacgcgtatgcctatgtgcgccataggaccgcctctgatgccgtgtccaagcatcaatacaaccatagtcggtggtggataaccaccgactttcagaacttctttggcaatacaacaaaggactttctcatgagcatgatggctcagatattcccattttctgcagttatagagagagacttcggtaaggagtgtttgtcacgcgcactggatctctgtttcttgaatggtggactgcctcaaggaacacctattagccctatgctgactaacatcatgatgattcccttcgattatatcatgaccaaaaagtgccgagaaaaggattacatctacactaggtatagcgatgatattcaggtgtcgcaccggagaaagtttaacccggacgaggtccttcgttttatccatgagactctcacccagattcacgcccctttcacaatcgagaaagagaagacaaagttcaaatctgggaatcagtttgtccttggcgtgatgtataatcaaaactgtgacatcacggtagggcacaagaataagaaggaatttaaagccaccctgtttaattacatgtgcgacagactcagcggcaaggtgtgggctctgccacagttgcagcagatgatgggaaagtatgcatattactccatgatcgaaaaggaatacttcgagaatgtgatgaaggaatattcccggaaattcaaacaagacgtgatgaagtgcattaaggctgacttaagacggtgctga

SEQ ID NO: 12204 - RNA, 1233 nt, unidentified
  source 1..1233: mol_type = other RNA; note = synthetic construct
atgcagttcacttccctagctaggcccagtttgcaatggaccgcccacatcaaggtgacagagaagaagggattcgttatgtatatcacttacaaggttccaccgcgatatcgccagatgacctttgaggaaatgctttctaatgagacaaacctgagtgaattcaaatactcatcaaacagcatgacacggactatcgttcggaaggtcctcccttctaagttggtagacttcacggatattccccggctaattaaacagtttgaggacttctgcgagaagcataaggccctttatgaagtccctcgtgcgtctctgtacgatacctggagaactccaaaaaaaaagaaaggcccccatggggagactaaatataggaccatttgtaggcctaatagccaagaactccgcgacgcgcataccgaactgcagagaatcctggaggattcgatgatcgcatcctaccacactcgcgcatacgcctatatcaagaacaggcgtaccaaggacgcaatacaggtgcaccaaaaatggaaaagcaaatggttttccgacttcgactttactgatttctttgggagcaccaccctggaattcctgagtcagatgatctttatgagttacccattctgtctcattcctgaggagcatcgggagacagtgagaaaagccttggacttatgctttttaaatggaggccttccacagggtacaaccatatcacccatgcttacaaacctcatgatgattccgtttgatcacatggtatccaatgagttgcacaagcatgatggcgaccgcttcgtctacacgaggtatgctgacgatatcagaatatcctgccgggtgcaatttgacgtgaagcagatggagagctatctgataaagaaactcagacagttcgatgctccttttacaatcaatccagagaaaacaggatatgggtctattaatggcaagaacttttgtctgggttacatgctgaataaagataaccagatcaccattggacacgaaagaaagaagcgatgtaaagccatggtgaataactacatcctggacaggatgtcagggcagccctggtctttacacgaagtgcaagtcctgaatggccagctcaactattggcgctatgataacgaagacggtacgtacgctgtcatgattaacttctacaaacgaaagtacggctgcgacgtggaaaagtggattaaggcagatctgagcgcctga

SEQ ID NO: 12205 - RNA, 1335 nt, unidentified
  source 1..1335: mol_type = other RNA; note = synthetic construct
atggtcatccgggtgctcgccatttatgatctcagccagcccaataaggctttcattccggtgatctccccttcccatagaattcaaaaccctactcagatcacggaaactactcataggaaagagtacatgatgatctacatcacttactcgcagcccgccagatatcatcaactgaccttcgaagagatgatggccggaattaccgtaaatgatattgccgagctccggaccggtacagtaagcggtacacgcacagtgtgcctcaaacgggtcccaaagaagtttcgcgacgcagccaacatcccagagctaagggctcggttgcagatgtttacagatacgtacaacactatgatctccaatccaaatcgccagtcctactactacaagttttttatccccaaaaagtccgggggcctgcgagaaataaatgccccattgcctgacttaagagcagctctagtgcagctgcacactatactgtctggtgcaatgctggccgatcaccacactgccgcttttgcctatgtgaccgggaggtctacacttgatgcagttaaacaacatcagaaatgggaatcaatgtggttcgtcaagtttgacctgcacgacttcttcggaagtacaacactggacttcctcatgtcaaccttctcaaagatctaccctttttgtatcctctgcgaggataaaagcggggaagaccttctgagaaaagctcttagtttatgtatgctgaacgggggcttgcctcagggaacccccatttctccgtttctgacgaatgttatgatgattccattcgaccatagaatgtttaacacaatgcgtaactttcgtttaagcgaaaaccgaaccgatcgttttgtctatacacgctatgcggacgatatgtgcatttcctgtcgcgcggggtttagatacaagaccgtggaagactatattgtgtctaccttgaagtggatgaacgctcccttcgaactaaatcgcgagaagacccactacgggagtcgatgcggtcggaattggatactgggagttatgctgaataagaacaatgaaatcagtgtgggcgagagagagaaaaaatatttcgagagcatgttgacttcttactatatgagccacggcaggggaacgtataggggccacttcgacaaggcactcaccaaaccttggccaatggaggatgtgaggaggcttcacggcctgtattcatactacaagatggtcgagcccgcccggattgcggagatcatcgaagaatataacaagaagttcggcatgaacttcgaggctctgctgaaaatggacgagcagcttatagcatga

SEQ ID NO: 12206 - RNA, 1170 nt, unidentified
  source 1..1170: mol_type = other RNA; note = synthetic construct
atggagaataaaattatgataaccataccgcagccagagaggttccgagctcccactttcgatgactatttgcgcggcctcaactcgttcgatcagctaaaaacttacgatgcaactgggtgtgttacgcggatggtaaatgtggaagctgtccgtgggaaatttgacctttccgccttcaagttagtactgaacaactttctaacagcaacagaaaagctccgtgcggacgacattcatactcattaccatagcttcaaaatccccaaaaagtctggtgggctgaggcagattaacgccccagatgatgaactgaaattcgccctccaaatgctggttaacatactgtcaaacgtgatgcctcgaacgtaccataccaatgcatacgcctacgttacaggcagatgcacctatgatgcagtcgccaaacaccagaggtgggagagcaattggttcggccactttgactttagaaaattctttgacagcacgaccaaggagtttctgatgagtcagatggcgaagcagtatccatttgcactcattaaggaggacgtggagacttggaccaaactgagccaagctctggacttatgctttcttgatggaggacttccccagggcacaccggcctcacctttgctgaccaatatcatgatgattcccttcgactacgaggtgacacaggacatcaaatccatgcctaatagaaagtgtccaaacggaacagatcgctttatctatactcggtacgctgacgatatccacatctcatgccgggtggagttcgacattaaggagcaggaaagatatctcatcaagaagttgcgcgaacagaacgccccttttacaatcaatgctgagaagacccactatggtaataggtctggacagaattggatgctggggtatgtcttgaacgcctctaacgccatcagtattggccaccaaaacaagaaacatattaaggcgatgatacacacctacgcaatggataagcggaaccagatcatgtgggataaggacgatctcatgaccatgctgggcaaaattcaatactggcgcttctccgaaaaggaattagtggattatactctggagaggctttcccaaaaatacggtttcgacgtgctggaagagatcaagaccgacatgggaaatgccgcttga

SEQ ID NO: 12207 - RNA, 1155 nt, unidentified
  source 1..1155: mol_type = other RNA; note = synthetic construct
atgccatacatcacgttgcgggccctaccaaattaccatcaggttagttttgaggagctgttaactaatagcatcgatttgaagcagttcttctacaataagacaccgtcaaacactagaacacactacgtgcagaatgtgaacaagaaactcattacctccattaacttcgacgacatgaaaaaatccctctatcacttcatagatctcaatcaacaattcttcaacggcaccatatctagcctgtccacaatgtacgacacattttatatacccaagtctagcgggggtctgagaaggattgacgctccgaatgatgaactcatgcggaccctcaaggatctcaagagattgtttgaggataagctcctggctatccatcatacatgtgcatacgcctacattcctggccggtgccctctagatgccattaaacgtcatcagtccaacgagagtaagtggtttggaaaattcgatttcaacaacttcttcggaagcaccacccaggagttcctcgagtctcagcttaagcaaatctttccatttagtgaacttctgaacgacgcccaaatttcggggcttttccaccaggtgctatctctgtgctttctgaataattgtcttccccagggaacacctatgtctcccatgctgactaatatcatgatgatcccaattgactttcacatctcaaaatggcttaggagcctggacaagcacacttttgtgtacacccgctatgctgacgacatgcagatttcaagccgatcccctttcaatatcgggaaggttcagaacctgatcctggacgtactgaacagttttcacgcgccctttaggttaaacgatgaaaaaacgcgctacggctccacctcgggctctaattggaacttagggctgatgctgaactcacagaacgagattactatcggctacaagcgaaagaaacagctcaagataatgctgaacaatttcttgtacgactattccaacggtaaattttgggatgcatcagaagtgaggcatctgcagggacagctgcaatattatttgagcatcgaacccgattacataagctatcttgtcgatcgctatagccagattcacaatgtcaaaatctatgacaccttcagtaaaatcttgaagtccaattga

SEQ ID NO: 12208 - RNA, 1167 nt, unidentified
  source 1..1167: mol_type = other RNA; note = synthetic construct
atgctgtttactttctacaaaaaagaagcagagacaaacgtgaatttcacagatctcctagaccaattctataagggtactatgccactttaccatcccgaagagatcaagagctacaagaagacaataaccgtcactctgcccgcgcctataactgatgaagccgccaatgaaaaataccacgtcgacaaaatggtggaggccctgaaagagtttgaggtagcaattgacctgcttaacaatattccgcgaaaagatctctaccgtttctttaccatcccaaaacgatcaggaggactgaggcagatcgctacgccttgtcctgagctgatggccaccctcagagatctcaagaatgttttcgagtacaagataaagtgtctgccccacaatgctgcctttgcctatatcaaggagaggaactgtaagcatgccctggaggtgcaccagagaaacaagagcaggtggtttctgaagctcgacattcacgatttcttcgggagcgtgaccgttcataacatgatgactgagtttggcaaaatttttccactccagacgatcatggaacgggttcctgagctgttcgtgaagatccttgacatctgcaccctgccaaatgagcagggccaatgcgtgctgccgcaaggaacaccaatgtctcccctcctgaccaatctatatatgattgggtttgatcacacaattcagaacaccttacgggactataaccatcagcaatttgtgtacacgcgctacgcagacgaccttttgatcagttcacagtacgacttcgattacaaagaattgactgcatacattgcgagtgtcctgcagctctatcatctgcaattaaatcccgataagacccggtatggatccaacgctggcaggaactggaatctaggcatgatgttaaataaggacaaccagattaccatcgggcaccagcagaaagaacgcttgaaagctatgttgcacaacttccttagagacttcacactgggtaagccttggtccatcatagatactcaggtcttggtcggccaggtatcttattatcgcaacatcgaacctacctacgtgagagaactcatcaagaaatatgatgagaagctgaatacagactttaaacagtgcgtgaaaaagattcttcggcccaagacatga

SEQ ID NO: 12209 - RNA, 1194 nt, unidentified
  source 1..1194: mol_type = other RNA; note = synthetic construct
atgctttacacttacaagataaagtacgttgaggagcgacataatgtcgaaaacctgctggatgtcctctacggcgacgcaccggctcagacagaaaccgtgcggagtaagaccaacaaagtgtacaatgactttagctacgatcgatttaaaacgaccgaaactacccctgagagatttatactgacttcgcctcatgtgaactcagatgagcagacgttaagacaaatctataacctcacagcagaaattgagtctttcctgaataataacccatcccccgcgaccatgtatcacaatttcaaaatccccaaacgcacaggagggttccgtgaaattaatgcacctaacgagacactgatgaagtttatgagagatatccagccctggttcacctacaaactgaacgccctgccacacgactccgcttacgcatacgtatataaaagggattgcaacaaggccattcagaggcatcaggccatcaagagcaattggttcctgaagctggatataaaaaagttctttgacaactgcgatcccgcctttcttcgccaacagttaaaaatgatctacccctttggtattatgcgggatcaggattaccaccgtttcatggacgcgctgattctattgatcacattaaacaatggactgccacaaggcacaccgctcagtccagtgataactaatctgatcatggtgccaatcgatcgcgatatcaacaaaaagctcggcacttatttcaaggacaaacagcagtctttcatgtacactagatatgctgacgacatgctcatttccagcaataaggagatgaacgtccaagaggttgtagggattatcgacaccatcttgcacacttatactaataaactgcagatcaatcctgacaagacccggtatggctctaaagccggatccaactggaaccttgggatcatgtataataaggacaataagctcacagttggttaccgcaggaaaaagaagataaagacaatgttgttccagttttacagctgttacaatgaaggcacccgggacaaagaatatgctcaggccattttgggggagctggcctatcttcacaacattgagcctgagtataccagggaactcgtgaggttcatggacgataagtattcaacggacttttacaccattctacataagacagtgaaagagaactga

SEQ ID NO: 12210 - RNA, 1065 nt, unidentified
  source 1..1065: mol_type = other RNA; note = synthetic construct
atgtattatactcacaataccaagaatcagaacgatagcaagtatcaaagattctcaactaccaaactgaaatccgaagaaatcaccattgagcaatatcgggagttcgaggctattaacaaacagatcttagggctgactaaaaagatcaaagactggttgacaaacaaccagtcggcgatcaagtactcaatcttcaacttacccaaaatgaccggcggctttagaactattaaggctccagaggaaaaactcaaaagctttatgcgcgagatcaaatttgacctggaatctattggcatcgttccacacgattccgcctatgcctacattccaaaccgggactgtctcaaagccattcagtgccatcagagaaataaaagtaactggttcctgaagatggaccttgagaagttctttaataattgtagcgaacaggtcatagccattcaactcaagaagctttacccttttagtttgatgacggagactgattatacttcattcatatctagcctttgcggtctagcatgccacgaaaatgagctgcctcaggggacacccctatcccctatcctgacgaactggctgatgatatccattgacacacagatcaataacgcgctggccgaaaggtctgaggagagcttcatatatacccgttacgcagacgatctgttagtgagcagtaagcagccctttcggcacgaagagatagtggagctcgtcaagggagtattggaacaggaaggtacccccttcacaattaaagatacaaaaacccgatacggatctcggtcaggtaagaactggaatctcggcatcatgtacaataaggaccataacctgacagtgggacataagcgcaaaagacgcattaagaccatgttgtttcagttctatagggggcaacgagacaggggctacgcactggaacttaatggagagctggcttacctcaagaacatcgagccggattaccacgattacctgatcgggtttatgaattccaagtacaggtttaacttcaagaaagccattaacatcgctatcaagcagaattga

SEQ ID NO: 12211 - RNA, 1149 nt, unidentified
  source 1..1149: mol_type = other RNA; note = synthetic construct
atgtacataacctctatcaaaaagaatacgggacctggaaacagtaaagcccagctgaacttgattgattccctgttcggtgagtatcaagaacctgacataattatcgatgccgggaggtttattagaaccagaacaaccagtgcttccacaaatgccttaatggaccttaacaactatgacaataacgtcagatacctgtacaggaaaatctccaacttcctgtatggccacgaaattccctctatgtattatgagttcaagatccccaagaaaagcggaggattgcgcaccatcgatgcacccaacgacgaactgaagaccttcatgtccgagattacccatgaattcgggaataagtttaagctcttgacacacgactcagcatttgcctatgtgaaaaatcgctgtgttgtagatgcggtgaaggaacataataataatggctcacggtggtttcttaagatcgacctacataacttctttgggtcttgcacaaaagactttattgtccaacaactgaagcagatctacccatttgctaagcacgaggctgaaacccccactaaggatctgctcaacgccctcgctgatctggcaacattgaataacggcttaccacagggcacccctctgagcccgatgcttactaactggattatgatcccatacgattatcgaataaaccttctgctcaatactctggttaaacaggagaaacttctgaagcagaggtatatctacactcggtatgcggacgatatcattatttcagcaaaggagaagttcgacaaagacattatcgtgaaggagatcaaaaagctctttgagcacagtcctttagagataaatgagacgaaaactcgatttggtagcaatgccggcagaaattggaatctaggagtgatgctcaacaaagataataacatcacagtgggccacaagcgcaagcggtacataaaagacaacatctactacttcatcaagttcaaagagacttgggacaaggagcagtgtcggtggctgctgggtaacctgtcgtggcttcagaatgtggaaccagaatattgcattgggctcctaaactactacaaaaacaagtacagcttcgatgtactgagggaactccatttggtcctgaaacgttga

SEQ ID NO: 12212 - RNA, 1098 nt, unidentified
  source 1..1098: mol_type = other RNA; note = synthetic construct
atgtatctcaccttctacacgaacgctgccccgaaacagctgacctgggctgatattctgaataacccatacatcaccagacaaacctcagacatcactaagaagaaagtcactaaagagatccctgacgactacgcggaaatcctgtgggctaagcgtagagtgatgtacaatcccaacctgattccgaccgatgtgaccgctattgatacctctgaacattaccgccactttcaaattcccaaaaagagcaatcccacaaaaatgaggcagatcgacgcccctgatgatttcttggggaacatccagacgatgtacaaaaatcagattgagaatgagttgcaggttctttctcacaaagcagcccacgcatatgtcgccaaatgtagcacagtgactgccatgcagacacaccagagaaacgattccaagtggtacttacagatcgatctgaaggacttctttaatagcataacaggagagtggctaaaaactcaactgctccaggtgtttcccttcccactaattgaagagcgggaactggacaaaattatccatgttagtctgctgaacggtacattacctcaaggaagtcatctctctcctctcttgaccaatctggcaatggtaccaatagactacgttcttaccgaaaagctccacaatctgaatgggcaccattacgtgtacacaaggtatgccgacgatatcacaatctcgtgcaaggaaaaatttaacgagcacatgatccttggccttatcaagcacatatttcgcgagttcaacgtcccctttcgagtcaacaatgacaagactaaatttggctccatagcaggtcggaactatcatctggggatcatcgtgaataaggataaccagttgagcgtaggccatgagaagaatcagaagttcagggccatgatttttaacttctgcacgataggcgacgaatgggagttacacgatgtgcagaagatgctcggactgatttcatattataaggccattgaaccagacttcgtcaataaggtgatcaacaagtataacgagaagttcaacattgacattatgtccaaagcgaaagctatgctcacttga

SEQ ID NO: 12213 - RNA, 1185 nt, unidentified
  source 1..1185: mol_type = other RNA; note = synthetic construct
atgcggcatttaaactcaagtgatttgcagagactgcccgtaattaccgtgatggaagaaactaagatgtattataccatccaccgcgaaaaaatcaattatccggaagtgaccctccggaaaatcctattgaataagcccattccagagaagacaaagctcagggagtatacaactgtggagatcccagacacgaccaactttaccctgactgaggacgccattcgatttcgtgactacatcctgaatagctgggaaagcctgtccaaaagcagtatccagctgtactcctcctttaaaattcccaagaaatctggtggcctgcgcgaaatagacgctcctgtccagggacttaagacaattcagtccactttggcctattggttgcaagacgagcttcgaattcttccacacgatgccgcctatgcttatgtcaaggggagaagtcatattgagagcctgaaaaaacaccagaatatgcaggccaagtggtttctgaaaattgacttctcaaacttcttccccgcacataataaggaatacatcctcaatatgctggagcaggtctatcctatcggggcactgatcaaaaatgatagggccgtgatatctaagatgttagacatctgtcttctcaacgataaactgccgcagggaacaccagtctctcctgcactgactaacatctgtatggttcctatcgattacgctattacgaatttatgcgtgactctggggaagaaatacaacaccttctttacatacacacgctatgctgatgacataattatttctgccggaaagtcattcaaatggaccggtgtgatcaaggagatagaaaacatcctgaacaactttaacgccccattcaagatcaacaataaaaagaccaggtacggctcgaatacaggcaggaattggaatgtgggcctgatgctcaacaaagacaaccggatcaccctcgggcacaagaacaacaaaatcctcaatgctaagataaacagattctgctacgaaaacatcgttgagaaaaagacttggacagtgcccgagattcaagagctacagggcaatatagcgtatgcgaaggcagtagatcctgattacacgaattacattttgcacaagtacaccgtcaaatacaagaccaacgttgagcaatgcatgaagaatatgctttactga

SEQ ID NO: 12214 - RNA, 1155 nt, unidentified
  source 1..1155: mol_type = other RNA; note = synthetic construct
atgtacatcagttatatcaacaagaagaacaaccagattgaaacgcgtgacacaagcggaccgacggagaaaaatatacaggagcttgggaaaagactccagtgtttctactacctgtacgaggaggcattaaaaatactccagaatggagacgtctcgagccgctaccggaccgaggacaggctgaagaaaaataagaccaggcgacgcattgacgtcccagatgaagagctcatgaagtaccaaaagaaggtggtggacatttttaacaaccacctggcactggtctttcctcagtccgtgtatggctatgtaaaaggtcggagtcccaaagccatggctgaggttcatcggaatcagtaccaagtaatcaagatggatatcaaagacttctttcccaattgcacacttgatttcattatgaagagcatgtctaccgtctatccattttgcctgctggattcagagctaattgaaaccatcatcaagccctgtatgatcttttatgacggccaataccgactccctcagggagcccctacttctcccatcttgtctaatatagcgatgatcccagtggactatgaacttgaatccggcgccttgaatggcagagggtacaattacacatacacaagattcgctgacgatatcatcatttcacacggcgaatttgatttctcttccagtataagcgctgaggaaagaatcctcagcctaatattcggtattgagtatgaagaacctccaaaatccttggaagagaaatacagcgagattaagaagataacctgcaatgtgatcaacaccattaaggattgcttacacaaccagaacccgaacttcaaaatcaattccgagaaaactaaggttctcaacacagagtgtggaaacgtgtggatgctgggtgtgaccgttgggcaggatgtcaagattgggaatcaaaggaaacagggcctgaaagccactctgtggacatttcttaacgattgtaagaacggaaagccttggtcacagaaggacactcgccatatgttggggattctgggttatgccaaatatatcgagcccaatttcgtgaacgagctgattgcaaaatatgaacagaagaccggcacttcattcaggaaggaagtgaagaaaatcctgtgctga

SEQ ID NO: 12215 - RNA, 1131 nt, unidentified
  source 1..1131: mol_type = other RNA; note = synthetic construct
atgtatataacatacatagaccaggacaagatgcagaaggtgacctgctccactaatattattaccgagcgtaatatcgcatacgcggagagggagaatggatccttgatctcacttgccgaggaggctagggagctgttgaagaagggcgtcaattcaaagtacacgacctactataagaagaagagcaatggccagaaacggcagataaatgtgcctgatgacgagctcaaagcctttatgagaaaggtggtcaaaacctttactgctatgagcgggttcatgtggccggataacatgtacgcttacatcgaagggagaggcatcaaacagcacgctgaactacacaaaaacgctgccgtcatcatccgcatggacatcaaatcgttcttcgacaattgcaccttcaagtttgtaacggagtctatgaaggaggtctaccccttctgtctgatggattggaatttactcgagcccatagtaaaagcatgcatgcttaaggggcgtctggcccagggtgctcctactagtgctattctttctaacattgcgatgattccatttgttacacacgccaataattggaccaaagccaagacaatcaccctgggcctggcaccaaggggaaaatactttaagatgactaagggtacccggaggaaagcaacatctattgtggccaaacgcatcatcttcagcatgtatgccgatgacattatcatctccacaaacataaaggccccttttggtgaaaacgcgtggaaaacaatccggataattcagaaattactcaactggtatacgccactgcaagttaaccccagaaagaccaaatatgtggatattcggagaaaggggggagcctgggtgacaggattgatggttaataaagaacacaacgttactgtcggccgagagaagaaggaaaagctgaaagcaactattttcagctttctggcagattgtaaaaacgggaaaccctgggacgaacatcgcgtgcgccaaatgatgggcactgtgtcctatatccgacatatcgaacctgagttcgtggacatgatcattcagaagtataaccaaaagctcaacattgattaccatgaacagatcaagaacatcatttacagttga

SEQ ID NO: 12216 - RNA, 1161 nt, unidentified
  source 1..1161: mol_type = other RNA; note = synthetic construct
atgcgggaaaacgtggtggaaattaccagaacgcacatcacaggaggagctgcaaatcccgtcagccatatcgagaactggtacgacctggctgccgtattagggctgaaaactgggaccttgtcctatgctctgagagagcgggataaactgcaaaccaaaatccgtttaggggacagaactgtttataagtctgggcgagctctcaaagtgatacagtcgcgcctgacaacactggtagaacctcttttcgacgcacttcccgggaatgagtgcgccttagcctatcgcaccggcgtgtccgccacagatagaatacgtgaaatcccccatgctcggatgctcgtcacatttgatatccgaaagtactacgataatgtcactctaagacacattgaggagtgtctaagaggctgcggcttccgaactcttggagcgcggctggtgggtcgctactgtgtggtaaggcgggagggcaggtgcactttgcagcagggatcaccagtgagccctgcaattagcaatattgtgggtcatttctactttgataccccaattcgcgcgtggctgggctctgagtttccagacgtcagggcgacgtatgtgcgctactgcgataatatcgccttgtttctccacgatggagttccggagggtttcaccgacaagttcaagtccttcgttagagagacatttaggagcggggggttccgaactcacaaatggaattgtatcacagacagtaaccccgtaaaaaatcagaagtttcttggcgtcgtgctgaacgccgaggccagggttgaactggttgtggtggatcggctgagagccatactctttaattggtgtttgtttggcggtcaatgcacggcagacaggtttatgagtgaagagggcatccagctgcgcgacttcatgttcgatggaatgaaagtcgggaagctgaggcagataatgcggggacatattaactacgtcaagaggatcaactccaaacacggcctgtggctcgacaagctcttgggcgctgctctttatctcgatgaaaagggaatgcctgcctgcgcaaacgaggaaatgttccgccgtgtgaagaagtacaaagactgtaacgaatcttatgacgacttcatggccggtattacctcaatcaccggctga

SEQ ID NO: 12217 - RNA, 1149 nt, unidentified
  source 1..1149: mol_type = other RNA; note = synthetic construct
atgcagatcctgcggacttacgttgaagatcagagaaccaattcagtgaggcatatccgcgactggtacggattggctgccgtgttgggcctgaagacaaacatactagcgtatgcgttgaaagaacgcgacaaattgcaaactagaattaaactcggagatcgtactgtgtataaatccggacgggccttaaaagtgattcagtcgagactgaccaccctggtggaacccctgtttgatgcgcttcccggcaatgagtgtgcattggcataccgcaagggcgtcagtgcaactaagtacatccgcgagagcataccccacgcaaggctgctagtaaccttcgacattaagaagtattacgacaacgttacacttaaacacattgaggaatgtctcacaaagtgtgggttccaagtcctcggtgcccgattagtcgggcgctattgtgtggtccgaaaaggcaacagatcaacccttcagcagggctccccggtgagtcctgccatctctaatattgtgggatacttccatttcgatgtacctattcggagctggctgacatccgagtacccagacatcgaagctacctatgtccgatactgcgataacattgcactgtttgtgcacagcgatgtgcctgacgggtttacggagaagttcaaatcctttgttaaacgtgctttaggagatggcggatttaggactcacaaatggaactgtatcacggacagtaacccagtgaagaatcagaagttcctgggcatagtgctaaattcacaggctcggatggagctgtgcatcgttgaccggcttcgcgctatcctctttaattggtgcagattcgggggattcgccgctgccgaaaggttcatggctgaagaaggcatacaactcagggagttctgcatcgacgggatgaagctggccaagtttaggcaggtaatgcgggggcatatcaactacgttaagtctattaacgagaagcacggcctctggctggacaaactgtttgaggctgccacatatctcgacgcaagagatctgtgcgcatgcaataatgccgagctgttcaggtctatcaagaaatataagaacggtaacgagccacttgatgagtttatgagaggtgtcgaagccagcgccggttga

SEQ ID NO: 12218 - RNA, 1293 nt, unidentified
  source 1..1293: mol_type = other RNA; note = synthetic construct
atgaagtgccagaaatatacggaagaagtatttgactctccactcagcctcgtgcacggatgggacgaattgggcgcactgctcaaaatcaaaactaagtacctttcttgggtgggtggcaaggataagaatggtagtctcaggcggaaccacatgcagcacttagtgaaggtcaagggtagagacacttacaagagcgacacaactttagcgcgtatacaaaccgctctgaatattcctttcgatcagattcaggactccttcccccatgagcacctgcttgcttaccgaaagggcgtgaattacaaaaaggagcttcagaaataccttgggcgcaaatacatggtgcactgcgatatcaagggctactttgataacatatcaatgcgcaagatcgtgaagacgttgtgcgctctgggcgccatgtcagaagcaggggctaaactgatcgccagatattgtattgtacgccgaagacaaagcgaccggtgggtccatacactgcagcagggaagcccttgtagcgccctgctatccaatctagtaggctacgcgctgtatgacagggatattctagcgtgggttgcccgcaaacagaaagagtatccacgagcctctctcgaatacgtcagatactgcgacaatctggttctctttgtcgatggagatgcccccctggagctgataaaggagtatcggcaatatgtgcatgtggtgatgagtaggcgcgggtttcagacccacaaatggtctgttaccccaaagaaccacccgttcaggaatcagcgatttctgggagtggtactgaatgttaaagccagagtggacctggagcgtttccagcggattcgggctgccttgttcaatgcatgcagaactagcgttacagaggctgccaacacctatttctcactgtatcccttcagggccgcagagttccctaccgagaacgtgggagaagaccgggccgtgttcgcaatcactcaacatgcaagagatgaacagtttttgagtatcatgaggggtcacgttgcctatatcgattccgtctccaaagaacaagggtccctgctcaaaaagctttttcaagcatgtgtctttctcagggaaaaccctcagggggtcagtcagcgtttggcggagcccgtgttcctggctctgaagacatacaacaggaaggtcgaatcagtcgaggtgtttctcgaaagactttccagtgcttgtagccggacccgcaactcctcggagtctttaacccaggagaacacaggccattgggagtctgtgttgtga

SEQ ID NO: 12219 - RNA, 1155 nt, unidentified
  source 1..1155: mol_type = other RNA; note = synthetic construct
atgaaactgcgcagcaccgaagcatctcagatgatgaagctcatcgacaacttctccgaattaggctcactactccacatcaagaacaaccatatggcatacgcccgtaaattccgagacgatcttcgccggaaaattaaagtgggtaagcgaaccgtctatgcttctaaaagtccactctcggttatccagcgcagacttgggatggtgtttaatattatgatggacgacctgccgtataacgaagtggcaattgcctatcgacctggagtcaatgtggcggaaaaactcgccgtgtgtcaaggctctgctatcatgatcaaaactgacattcgccattactacgataacattagttatgctcacatcgagaaggctcttatggattgcggcatgatcgccagaggtgccagacttatagcctcctactgcactatctggaatggcaggtttagctcactgcaacagggttccgcttgtagccctgctctcgcaaatatcgttggaaaccggtactttgacagacccattgtccggtggttgcgcgatcactgtcccgtggagcacacctactatcgctatagcgataacttggtcttattctgcaaggaagagccaggcaatgacttcataaacgagtacaaggagttcgtcaagaccacagcggctaggggagagttcaggacacacagctggagttcaatcagaaacaatcaccctactagacatcaggaatttctgggcatcgtactgaatgaggtggctaatatttcccgtgtgaaaagggataggatcagggcgattttgtggaacgcggtggtggggaatacagccgaagaggccaagaagtactttgccgacacaggagagctgccccgggggattgctgacgaagaggaggtatatacgaccaagttcatgatggccatgcaggggtatgttgcctacgccaggatgatccaggacaaattcgcaaaccggatagcaaaactgctgattgccgttcgaatcaaggatggctactttaatgaggacgggatgatattcaagtatggtctggataacaagcatattgagtgcgcaaagctgtacaaagacgattccgtaggaatagaagaatttcgtagacggtttctggattgtctaagttcttga

SEQ ID NO: 12220 - RNA, 978 nt, unidentified
  source 1..978: mol_type = other RNA; note = synthetic construct
atgatgctctatgacctgataggtgtgtctaaaaatgactttgacaacttcatcgagaacattaacagcgtcgtgatcaaagagggtactcactggaaacatgtaaacccaagttcccacaactccgtttccataaagttcgacaaatacttcgaagatcagttcaaaaacgtaatctctgcttctagccccaaacaaggagccttttgcggaaagagtatcatccaactcctggccccccacagcagcaaaaagtacgtcttaaccctggatatcaagaatttcttcggtagcattaactttcacaaagtgcaggagtgtaccaaggatcattcgtctcttcagctgtatagcgacatcatccatatattttacttcggaggcgatgatcagctgcgtagaggactgaagggcagcgcagccatagccgaagttgtcgggttgaagattgatcacctcatccgcaaaatcatttattcgaacaaggaatactccaataaggaccttgtgtactctaggtactacgatgacattattatttcaggggactcatttggcgccctaaggagcgtggcaagtgtccttgcaaagagtatctataaggaactgggcctgctcctgaatcctaaaaagacgcgcttgcggatcctacacggatcaaagatattggggttgaggttccatgatagagatattacagttccgcagagtttaaagcataaactgcgagcgattatgtacgaatattcctccgctaattacgatgaatcagactatgagtcagtgcgggacgctaagcgccacgttggccagatcatcggcactctgaggtacatcattaatttcacatctgccaatgtgtccagatacgaggattggctggctgacttttatgaggagcttgaccggctcgaggagattcgaaaagatctcgcgcagtactatgacgacgaaaaggggatttattttgacatgtga

SEQ ID NO: 12221 - RNA, 1074 nt, unidentified
  source 1..1074: mol_type = other RNA; note = synthetic construct
atgctggataagagacggctggccgtcaacacgaaagacttcagcatccttaaaggcatcctgcccggcgttatcgataccctgattcattatccagagggcgcttacaagcggattgaaattccgaaaaagtccgggggcatgagaattatccatgcccctcttggtgaggcaattatgcagatgaacgccgacaatacatcaacgtctctcttaggttggattcaaaagagaatcaatcacgtgctaggcttcatccttttaccctcgtccgtgtgcgccttccgacctggaatagatccatatagttttctgcgaacaactttggacggcatctctaactgtaggtcttcccaagtggggggtatctacaagatcgacatacaggattttttcaatagtgtatcggaggatcaggtgaagatggtctgggaaaagagcctacctaagctcagtggcaacttctactctaaggacatcatcaatatcctgactctgctgtcttgttacgaagggaaactgaatcagggtcctcccagctcacccattatagccaacatagttggatatttgtgcattgactccaatctccgcggactgcagcagaccagaaacattggcagcaacaggactccgaagtcattgtggattaggtacctgcgttacgcagatgatatcatgattctatctttcgacggagcaataccaagcgatatcccagatacaattaacgaaaccatcaaaaacagtggatttcacatcgctaaaaaaaaaaccctcctgttgaatgacagccactcctatcctctgctcggcataagccttttgcgcgacacctccccagtgggttttcagtttcaaattggaacagcccgtgatcgcgacttggcttccgagttactggggtaccagggggaagggattaagtcaatcgcggggaagctcggatttaataagcgcatcagtctgctgggacggtcaggggttgaggtcgagcacttccccggcaggtatagcaaacgggtggctcatgcgctttctatgaaatccgacctcctcctgtgcagccagtga

SEQ ID NO: 12222 - RNA, 969 nt, unidentified
  source 1..969: mol_type = other RNA; note = synthetic construct
atgccctctaaagtcctgcagcatattcccctgaagttgaaccttcacgagataaaatacttaactacccctcttaagactaccgagtccagactcctgaagatcatctcaatcaagtcaaaaatcgtgaaggaaaagaagattcccaaaaagaattcagacgaattccggattttgaattacccggttggcgagtttaaactcattctgaaacggcttcataaattccttatgtctaggtccaagtttccaaaaagcgtttgtggtggaattgtcgacaaaaacctttatgatatggtgaaatcccattgcggccgagaagggatttaccagattgatctcaaagactttttcccaaacataaactccgacagagtatactcttttttcaaaaattcggggagaagtgaacggatctcccaaatcttgacagacctggtgatttacgacaagcgcctgcctcagggttttcccacgtcacctattgtagccaatctaattgcttggaagatggattatgatctccagagtatctgcaataaccacaaactcaactattccaggtggatcgacgatgtgctcatcagcggcaggatcagtgaactgaataaagccatctacaagatcgataagagcatactgaagaatggattctacatcaacaacaagaagaaaaggctgctgaagcgcaagaacagcaaagaaatcgtcagcgtcggcctggatctaaagcgccacaaacctgatgtgccaattaaggtttatgagaagctggagtatatactgcaagtgctgattacagagggtgtggagttcgcacgtgacttctttgaggaggaatttaagttgaaggacatacagaaaagcttaatagggaagatccgattcattgaagagtataataaggcgaaaggcaacttcctctctaacttatacatccagatcaattggggaaaggggatcggatga

SEQ ID NO: 12223 - RNA, 1257 nt, unidentified
  source 1..1257: mol_type = other RNA; note = synthetic construct
atgcaattccttaaaaagctgaaactggcactggatagattgatcctaggacgatctacccccggcagaatgctagagcacgtgttcgacaggaacttgagtattctcgacaaggttctggagagcattctgcttaaggacggcctcgaacattccgaattccgcgggcgtttaactcggtggcggaagagttatatcggcaagtcttgggggttatggacggatttttctgacagcgccaacatttgcgagtttctcggcgatagctcaatagccgagagcgacatcgtgtccattttcgctgatccagatatgcactaccgccgtttctggcttcccagccgcaggtcagataacacaaggtctaaagggcgcgtacgaaagagaaggttaattcacgcgcctgacgatagcctgctgagcatccatagactactgctgcgcgaggtgttggacagttttgatctcgtgatctccgatgcggcacattcatatcggcccaggagaagcccaaggacatgtatgttccctcacaagtcatctggctggatgatctgcatggacttcagaaactttttcggaacaattactgaagacaaagttctgcgcgccctggtcgatagacttggttgcccaagtagcactgctgcctgttatagtcgattgtttactgtgaactgtgaagacaaagggatccgagtgctgcctcagggtgcaccgacctccggttttatttcgaacgtctgcttaattggctttgatcagaggctgagagccatgctttcctccgtcgactctaatatagtgtacacccggtatgctgacgatatagtaatctccggccctggcatgctcagtaaatccgtgaagtcccgagttatcgccctggtgagccaggcagctaatgggaagggatttgtaatcaataattcaaagacccgcgtctatagcggggctagtgtgatgagggccctcggaatcgacatccggggaggtgagctgttcccacggaaatcgatcatcgattacattgagaaacaggtgcggttgataaagacacgttcactgacggaagtctctaacggatggggtggactcgtcgacggccaggacaataccctgaaatacttggatcacctgtgggggctcataatctacgcctcaggaattaatagacggtacgcacaaggggttattgctgagctcgagaatgtggaaacccccctctccggcaggcttggcctgattgactcttga

SEQ ID NO: 12224 - RNA, 1131 nt, unidentified
  source 1..1131: mol_type = other RNA; note = synthetic construct
acgcccctgaggacacctaaacctgaagagccaaataaaggcgttttgccgatttatggcgtggcgcacctgagctggatgctcgacgtgagccctagttcgctatccactctgctgggatccgagagggccgttcgctccgatttacgacgccgtggctctcgccccagagccatttatatccccgactcagagtacctcgcaattctaagaaagattaatcagctggtgttcctcccagccgacgagaggctcgacttagccgccttcggttttaggcctggctgctcacctagtgactgtatggataagcataaacacgggaagtggatgcttaaactggacatccacgaattcttctcaagtatcagcttcttcgacgtgaagcgtacttttatacgggtcggccatagcgagacggtaagtgagacattggctgagatctgtacaataaacgagaatggtagacgagtgttgccgactgggtttccaacctccccatacatctcgaattgggtgctcgcatcatttgacaagagaatgagggcttggtgcgcggaaaacaaaatctattacactcgatatgtcgatgatctgtttttttccggcaccgaagctgcccccaataatataatcggaagcatccaagggctggtggattaccgtctgggtctgcacggactgaccttgaatctgaaaaagacccggttctaccggggagatagcgtctttaaaggcctgggagttgaactccacccctctagggacgagcttgtgggggctggacggtacatgttgccttctagacgcatgcgcgcccatatcgagaaccagaccaggtgcattaagaaatttggcgtcgaaacagcaagcagacactggtgtgagcggagcggtatagatagagggcttggcattccagagtatcggtacgtccagcatcttgcaggtgcactgagctacatcaagaacatcaacaaggcttacggcaatgatctggaaaacgaactccaaattgctttaggggaatccgtttcttcatacctacttgggcatcagagtattttcccaaactctgtgtattcttcatcttatgacgtaccctccgcccgcaagttcggatccaactga

SEQ ID NO: 12225 - RNA, 978 nt, unidentified
  source 1..978: mol_type = other RNA; note = synthetic construct
atgttcaaatttgacggagtgccaccgatcagttatcaagagtaccacatacccaagaagagcaaaggagtaagaattatcgaggaacccaacgctcagctgaaggccgttcagaaacgcatcttaccttacctgtacgattgcacaagagtgggtctgctccctgtgagtcacttggcccacggcttcataccatataggggctgtatgaccgcagtgcccaagcattcccttaatagccccgtactgattggtgcagatgtgcacgactttttctttaatttcccagctgaacccgtggagaataacctgtggttcgccatggactcaagcagagtcgattatatcatgacctgtgcactctggaaaggaaattatcctaaggagcatttcccccagggatcgcctatctctccatacctaactaacattggcatggtagacgtggaccgaatgatcgctgctttttgcaagaaaaacggactcttctttacacggtacgccgacgatatgctgttcagtataattgacggggccgaggattctccgcaggtccgaaagatgatgcgtgaggatgaacctttttcctcactatttcacggggtggaagtcattcttcaagaccatttggggcttgagttatctgcaaaaaaatctcatgtgatgtggcgccattccacttgtaagacgcaggcgctgggcatcacatttcggcaagataataaggggtacaatgctaacaaacggaaacgtcgcaacaccagagcccagctctacaacctgttccggaaggtccaagcgcaggggggccacttccaggatgaagactggcaggagtggaggagcgtgaatggttcaatgaattattgcaacctcgttaggagcctgtccaagttccctgaggttgcaggcattgacccagtctttcagttgtcctactataacgaaatcgaaaggtgggccaacgctgccgtttga

SEQ ID NO: 12226 - RNA, 1590 nt, unidentified
  source 1..1590: mol_type = other RNA; note = synthetic construct
atgacggacaatttcgactacaaaaacccacataacataaccacagggagattgctgtactctgacgagctccccttcttcgacatgatatccttttgtatgttcctgggaactacccctacacagctccagcggatcttgggcaatatcgattctatgtatagtcgcttctatatcgataaggacacaggtcgagtgacaagcaagcatgcaggattaaggctgcgggaaataaacgcacctttggagccccttaaaacctggcagcttcgtctactggatgtgctcaatctgttccctaagcatgaggccaatacggcttttatggaggggtgctcggttatcaatgcagcaaagactgcgaccaaaggagatgttctcgtgcatgtcgacataaaagatttctttccaagccacactgccctctacataaaacgtaaactgtccgccctggtatttaaaacatttcggatgtacctccccgaggaagtcctggtggcgattactaagttaatctgttacagaatgcagctacctcaagggtccccatgctcacctatggcaaccatcgtactaaattacgatttagacacacgaatcgacgctgtggccaagaagtacaacctggagtttaagaggtatgccgatgatatgtggttcacaggcgttcagtcggacgacgtgatccaggagtttttgtacgagttacaggatgcaattcaccccttctctctcaactacaagaagactaacattatgaggactagagcctaccccaagttcaacggagtcagaattaagttcaccaaatcttacgtgccaagtacgcaagctgctaaaataatcaatatggtagttgccgctctcggcttcaccaagcacaaagctaacatctcaaagaaccaggtcctgattgagggctatcccactccccagcttgctttggacgatgtgcgcagtctgatggatagcgtagccgcaaccatcatggccaaatatccgaacttggtctttacttgcaaaccgaactggtactatatccaatccaccaagaaatgccttgggctgaatatcgtcggcgaaaatgtggtctatccacgcaaaaggtataacgacctgagactcgaggccatgcttatggggagacagcgagcgctgttcgccctatacttcgctattgtggccaagcacaaagcaaacccacggctgctgccccctattaagaccgccccttttgtgtttgcctcaaaaggttccgtgggacacgagaattttcggaatctgctgaccaacccgtttaataggagggtttttatgggaaaggttgcttatctgcgcagcattaacccagaaaaggcagataagatcatggctattgaaaaggcgagctatcaaaagtgtattgacgggtatttgctgtggtaccctacagtgaacgtggattattacccagacgtgcagtggctcagcagtcttcgcgacatccccaatagcgaagcctgcgtcgacattttcatcggttcctcaatctccaatgaggaactttcttctattctcggcgaagccggcattggctgttgggctctgtga

SEQ ID NO: 12227 - RNA, 1704 nt, unidentified
  source 1..1704: mol_type = other RNA; note = synthetic construct
atgattgagctgatgaaaaattacagcttcaaaaccacccttaagaatctcgtaaagggcttcgtcgctgccgaaacagctgctccgaagcttttcacgaaaagtttagacgactggccattctttgatatcgcaaccttgtgtgcttatctagggatcacgccactggagttgcaggccttatgcaattgccaacctacactcctctatcaccgcttttacattgataaggcaactaacaggattgtgccattcaacaaaaccgcgaacctgcgaatgatagaagctcctcggcctgagctgaaagagtatctaatgaaactgattcccttcttcgaaaagttccccattcacaagtgtaactatgcttttatacgcggcaaaaagatcaaagatgctgtggagtctgtgaaagagggcgaggttctcatccacaccgacctaaaagacttttttacagaacatactccgctgtatattaagagcaagttggagatgctgatgctccagaacgtacccgagatgtatgaccctgagttttgtaaggtgctgactaggctgataacagtgtacacacatctcccccagggatccccctgttcccccatcctgaccgccattgtgaattatgatatggattccaccatccagtctcttgccgacgaatacaatttgacctatatgcggtacgccgacgatatctgcttttccggagctatagccaacgatgacattcgcgtgtttctggacaaacttgtcgacgccgtccaccccttccgactaaaccggaagaaggttgcaataatgcgggatgcagcatatccggtgttttctgggttaaaactctacatcgaaaacgaccgccaatacattccaagtagcctcttagggaagctcattaaactgctgaggcatgaattcgaaccaatggagttcacctccgtccacactgtggccactcagggaaagatccatttcaaactgggcaaaatcgttgagacaccagtggggagtctgaaggagaagtgcgatcgtttcagctgccacctgaatagcaagtactcagccagcggttttaagttcaagctgaagcctacatacttttacatcaaaagtctgaagcaagttctcgggatgcacattacagatggaaagatttgttaccctcggaaaatgtacaatcaacttagactggaggcaatgttggtgggtcgtcagatggccttccagttcacgcagaaatatatcgccaagaatactatagaccccatcacctcaaaacagcatgtgtatcttgacttgcagaattttgtcgacaacatctctgacaaagatgacccaatgtactccaggttttttactgtgagatacactaacgtccctgtcggtaacgctcgaaatgccctgtataccatctcatccagatcttataaattggtgtcttacgcagagattttaggaatcacacccacgtatcttagaggcaagaagagaacctcgaagggctacaggaacatgctggataagcctgtgtcactcaaggttttctatggcaaagtgaattgggtaaacactgtcgatccagaaaaggccaccaagctcaaggagatcgtcaagaagtacaagcttaaaacactggcggcgctggtgaaagcatttcaggaaagcgcgagtcgcgaatacgtaaaattctcagccgtttga

SEQ ID NO: 12228 - RNA, 1458 nt, unidentified
  source 1..1458: mol_type = other RNA; note = synthetic construct
atggacatcaacagattccccaagctggtccgggagtattataatacgttaaccggacgtcatactccattagagtccatctgtggcaatcgggttctcaccctctctgaactaccttttatcgactacaactcattttcaagctacatgggagttactccagagatccttaccagtatcactgacgtgacagcaaaagcttgctactcacgcttctacatcgacaaaaacaccaagaagattgtcccctacagcttcggcattaaactgagggagataaatgccccaaccgaagcacttaaggaattacagctgaaactcatggaattcttcaaccagtttcctaaacacccatgcaattacgcttttatgcaggggaagaacatagtggacgctgccaaaactgtcgccaatgatggcgtactggttcacgtggacctcaaagatttttttcctgctcacaccagcctctacgttcagaagggcctggagcatctgattgccaagaatttcaacactaaccttcctttggacgtcctgagccgcattgtgaagctggtgtgcttggatggggtgttgccccaaggcgcccctacttctccgatactgaccatcatcctgaattacgatttcgattgtcgggtggcagagttggctgaaaagttcggtttcacttatacaaggtacgccgacgacctttgtttttcaggtaataagagcgatgcggagtgccaggattttatcagcgaactgtccgaagtggtccacccgttcaggatgaactacaaaaaggtgggcataatgagggacaaggcatatcctattgtgacagggtttagaatcaagacaaaggtcacctatttgccaagtacacagtctgcgaagatcatcgggattatcacaaactatctccaaatgcccgacctgaggggaacgatatcggccaaagtaattgagtttaccttttctaaggacacaaaaatacccctcgatgagctgcccgaaaccctgacacggatcactgaccttgtacataccaaatacccaaacctggaattcattgtcaagcctatgtacaagtatgtgcagtccgtgaagacggtgttgggtctacacatctccaattctgaagttaagtatccccgcagcaaatacaacgatctgagagtggaggcaatgctgattggaaagcaactcgggattcgagaggttatgtataatattcatccggccagaattgctttagtgaagaaatatgccgcgcataacaagttctttaaatccagtttccgaaacctcatggtaaagccactatccaaaagagtcttcaatggcaaacttgccttcctgagtatcgtggatcccgataagacactcaaactgaaaaccattatggataaacaccgtcagaagacggtcgaggacatgatcgacatcttcaaacgcgagggattttga

SEQ ID NO: 12229 - RNA, 1185 nt, unidentified
  source 1..1185: mol_type = other RNA; note = synthetic construct
atgaaaaagtacactgtcaacacatccatgctgagcctgctggagggatgttctttctttgttaagggcaagggggccgagccccttccatactctcatgcagaagaaggcaagctggggaacaaatttttctataagatcagcgggtccgagtcaaaacaaattaataccattcacgaactcctgatatcctcattatttgagcggctccctgttaatcaatctgcaacagcttatctgaaaggcaagtcttacctagactttctcgagcctcaccggaacaattattacttcctgaggactgatctcaagaacttcttccattttattgacaaagagatggttgtcgaggctctgaggcatcacgtgagcgaagaacctgtcactacagaatacagtcagtcttccttggagctcgtctcacgcttagtgacccttaccctgccaaaaaatagtaagaatttggagttcgctggtcagtccatcctgccaatcggatttaaaactagtcccgtggtgagcaatgtggtgtttcgaaagttcgacattttgattgaaaagttctgcgcccagcatgacatcttgtacacccggtacgcggacgacatgcttttctcagcctcggatataaggacttccaaatacaaggagaaggacatttttagtgtgctgagaaaccccaaggtgaaggagaaaaagcctttcctgcactctagaagattccttgaacagatctcattcattgtaaatctcggcgggtttaagatcaacaataagaagacgcatatgagcaaaggttactttaccataaacggatacaccatcagcggcactaactacccgtatacatccggcaccattcgtgtatcgaacaaaaaaacgaaaatcatctgcaaactcttgcacgagtgtaagattaatgtcgatgatggagatatccttaagactgtttttaactatcgcgagacaaaagcacggctaccctataagagctccaagaaatttatgaatacgtatcacgccacccagctgaataacaagttaatgggttaccgctcatatctaattagcctgctgaagttcaacgaaacatataggtgcatggacagtacattcataaacaaatgtacctctctcgtgtgcgaactggatagcatcatcaatagacgaatcaacaaacagtga

SEQ ID NO: 12230 - RNA, 1179 nt, unidentified
  source 1..1179: mol_type = other RNA; note = synthetic construct
atgaagaaatacacaattaatgcctccatcctcagtacccttgagggatgtagcttcttttttaaagggaaaggagcagaacccttacccttctctcacgttaaggaggggaagctgggtaataagttcatctataaagtgagcggatccgaagctaggcagatcaatctgattcacgaaagtctgatcagcacattgtttgagaaacttcctgtgaaccagtctgccactgcctacctgaaaggcaagtcttatttagactttctcgagcctcaccgcaacaaccactattttctaagggtcgatctacgcaacttctttcatttcatagacaaagagatggtcctcgaggccctgcaccatcatgtttcggaagataagattacagatgaatgcaaccaaagctctctggagcttgtcagccgcttggtgactctgaaactgcccaacgaatccgcgaactccgatttcaccggcaagagtattctcccaattgggtttaagacctcaccagttgtgtctaatgtagtgttcaggaaattcgacatcctcatcgaaaaattctgcgctcaacacgatatcctctatacgagatatgcagatgatatgctcttttcagctagtgacattagaacatcccagtacaaagagcgagacttaatctttgatctggttaaccctagggtgaagaaaaagaagccatttctacatagccaccggttcatcgagcagatttctttcattgtgaacctgggcgggtttaagctgaatgccaagaaaaccaagatgggtgagggcaacttcactataaatggttacaccatttcaggcactaactattcatacaagagtggggccatacgggtatccaataagaaaacaaagatcatctccaagctgctccatgaatgtaatacgaaagacgacgacggatcgattttgaacgcggtgtttaattaccgggtcgctaagatcaaactgccgtacaaaccttccatgaaattcctgaaggtgtactatacttctcagcttaacaataagctgatcggatataagagctacctgatttcattgctgaagttcaatgagcactaccgatgcatggaccccgcattcataaccaaatgtgaaaagttggtcagcggccttaatgagatgatcatacgtagaatgaagtga

SEQ ID NO: 12231 - RNA, 936 nt, unidentified
  source 1..936: mol_type = other RNA; note = synthetic construct
atgaaaagctacaccatcaattctactgtcattgcgacattggagacttgttccttttactctaaaggcaaaggcgtggaatcatttccatattctcaggtgaaagagtgtaagttgaacaacaagttcatttacaagctgtccggagcagataccagacaaattaatgagatacacgacatcctgatcaagactctgtttgacaaattgcccatcaataatgctgccacagcctacctaaagaacaagtcctacttagattttttggaaccacatcgaaactccaactatttccttcggattgacctgaagaacttctttcacttcataaacaagaagatcgtaaaggaggtgctcttccaccatgtgtcatcagatcctattagcgagaaaaccacacagtctagcctcgatcttatcacaaatctgctgacgatcacactcccaaataacgttaagaatctggaatttagtggaaagagtattctcccaatcggattcaaaacctcacctgccgtttctaacatcatcttccggaagttcgatatccttatagagaagttttgcagtcgccatgacgtcctctatactcgttatgctgacgacatgttatttagcagcagtgacactaggaccgagcagtatattgagaaaagcctgttcgatatccttctgccccccccgaacaccaaacccttcctgcactcttccaagttcacagaacagatcgccttcatactgaatctcgggggttttaaaatcaacaccaagaaaacgtccatagcaaaggggaattttaccgtgaatggctacaccatttccgggagcaactatccttacaaatcaggtacgattaggatttcgaataagaaaaccaagacaatcagcaaactaattcacgaatgcaaaaagactagtcctatgagaacttactga

SEQ ID NO: 12232 - RNA, 1170 nt, unidentified
  source 1..1170: mol_type = other RNA; note = synthetic construct
atgaaaaactatacagtatccagctcaattctgagcctggtgaaagagtgtatgttctttaacgaaggttctggcgtgaaatcccttccactttcatgcgtgcacgaaaccaaggtcaagaataagttcatctacagcatcacaggaagtgaaggagataaaataaaccacattcatgaggcattgaacagatctctgttttcaagaataccggtgaatcagagcgccacggcttatgtcaagaataagacctacctgaactttcttgagccccaccgtaaccactatcactatctgcgcgtagacttgaagaatttcttccacttcattagcgacaagattgttagggagagtctcaaggagcatgtgtctactagcaacatcagtgaaacttgtagtcaatctcatttggacctggttacaagcctggttacttacacactcccaaagtccgcgaaaaataccgatttcgtggggcgctcaatcctccccatcgggtttaagacatccccactcattagcaatattgtgttccggaaattggacatcctgatcgaaaagttttgctcagaacataatatcacctataccaggtatgctgatgatatgctcttctcctcttccacaatgcgtgatggcaaataccgagagaagactccttttgacggagtcctggggatcaaggacaaaaaaccctttgtacattcccaaagattcatagaacagctcagtttcatcataaatatcgacgggtacaaaatcaatcgccggaagacgatcaaaaaaagcggctacattagcatcaacggctactttattgaaggcagtaattacccttacattattggtgagctaagagtctctaataaaaaaaccaaagtggtcagcaagttaatctatgagtgctcaaccgataaatccgaccgggagattttaaaagccgtttttaacgtggatgtggagaaacttaagttcaggtttaaccctaaggattccttcaaggatgagtactcaaagtcccagataaacaataagttaatcggatacaggagttatctgatttcgctgataaagtttaacgactgtactcagtctatgaataaggacttcataaacaagtgctcgaagctaatttctgacatcgagctgatcattaaccggcgaatgtga

SEQ ID NO: 12233 - RNA, 1176 nt, unidentified
  source 1..1176: mol_type = other RNA; note = synthetic construct
atgaaatcatataccgtgaattcctctgtattaagcgttctggaagagtgtacactgttcgataaggggagcggactgaaaccgctacctccgacccagtttaaagagacaaagatcggtaacaagtttatctacataccctcaggctccgagaggaaaacaatcaactatattcacgagagcctgaataagaacctttttagcagaatccctattaatcaaagcgccacggcctattccaaagggaaaagctaccttaacttcttggaacctcaccggaacaactactattttcttcggcttgatctgaagaactttttccatttcatcaatggcgataccatcaaaaatgcgatttctgaacatgtgtctagcagtgcaatcatggacgggtgtatccagagtaatttggactttattgtgaaagctctgactattactctccctaaagagagcaagaacaaagagttttctgaaaaaaccatcctgccaattggctttaaatcaagccccatcgtaagtaatattgttttccggaagctcgacattattatcgaaaagttctgctccgaaaacaacataacctatacaagatatgctgatgacatgctgttttcctcatccactaccagggatgagaattaccgcgaacgcactttagtggcctccctctttgagaagaaagacaaggtcccatttctccacagtgataagttcatcgagaaaatcagcttcatagtcaatatagacggcttcaaaatcaatagaaggaagacagtgaagtcaaagaaatatctgtcactgaacggttacatcatatctggatcggattacccctacctctcaggatctattagggtcagtaacaagaagaccaagattatttccaagatgatccatgagtgcaacaagtccaatgatgatatcctgatttataagtccatctttgggtctgacccatctaaaatcaaattccagtacaagccaaaagagagtttcttgataaagtactgtcgctctcaggtgctgaacaagctcgttggatatcgaagctacctaattagtatcctgaagttcaatacggactacttatgcatcgacagaggcttcataaaaaagtgcgaacacctgatacgtgagttggaacccctcattgagtcgcgaattgacaagtga

SEQ ID NO: 12234 - RNA, 1176 nt, unidentified
  source 1..1176: mol_type = other RNA; note = synthetic construct
atgaaaaactatacagtcaacagcagtgtactgtctgtgcttaaggaatgcaccttctttgatgagggctccggattgaagtctctaccatctactcattttaaggagactaaggtaggcaaaaaattcgtttatgttcccagcggatccgaaaggaatcacattaacgccatacatgaaagcctgaataagagcctgttctccaggattcccattaatcaggctgcgactgcctacagcaagaacaagagctacttgaactttctcgagccccacagaaattcatactatttcttaagactggacctgaagaacttctttcacttcatcaatcgaacggtggtgagaaatagtatcagcgagcacgtctccagtagcgaagtgatcgagggttgttcacagtctaacctggatttcattgtgaatattctcaccattacgctgccggacacatccaaaaatgaagaattctcaggaaaaaccatcttacctatagggtttaagtcgagtcctgtcgtgtcaaacatagtgtttcgcaaacttgacattctcattgagagattctgtgcaaaaaacaatgttacatacacccggtacgccgacgatatgttgttctcttcaagcaccgtgcgcgacgataaatacagggagaagtcagtctttgacgacctcttcaagaaaaaggaaaaggtcccattcctccatagtgataaattcattgaggagatctccttcatagttaacatcgacggttttaaattgaaccggaaaaagaccgtcaaatccaaaaagcacctatctctgaatggctatttaatctcggggtcagattatccttacctgagcgggtctattaggatctccaacaagaagactaaaataatctccaagatgatccatgagtgcaacaaggatcaagatgatatctctctctataagtcggtgtttggggtgaatccctccaagatcaattttcggtacaaaccaaacgaggcttttctgatcaagtattgccgaagtcaggtgcttaacaaactggtaggctatcggagctaccttatcagtatcctgaagtttaacgagaattacagctgcattgacggcaagttcatcaataaatgtgagtctctcacccgttgtctggaaacaattatagaatcccgcatggacaagtga

SEQ ID NO: 12235 - RNA, 1182 nt, unidentified
  source 1..1182: mol_type = other RNA; note = synthetic construct
atgaaaaactacactgccaactctttcactctttcattacttaagcaatgcacctttttcaacgaggaatctggactgatctctttgcccagttctcatgttattgagacacgggtgggcaataaatacatatacaagctagttgggtcagaatcagagctgatcaataaactccacgaaaatcttaacgagacgttattctgtagaatcccagtgaatcaggctgcgactgcttacacaaagaataagagttatctggactttttggaacctcaccgtaataatttttactttttgcgggtggatctgaaaaatttcttccacttcatcaaccgcgagattattaaagattcactcaaggatcacgtgtctagcaaaccaatcatctctggctgcagacaaagcaatcttgactttatagtcaacgtccttacgataaagctgcccgaaaccagtaaaaacacagacttcattggaaagtcaatcctgcctatcggcttcaagagctccccagtagtcagtaacatcatttttaggaagctcgacatactcatcgagcgcttctgttttgagcataatatcatttacaccaggtatgccgatgacatgctgtttagctccagcgatctgcggaatgataagtatcaggaaaagtccgtgttcgatgacttgtttaagaagaaggagaagaacaatttcctgcattcggaccgatttctcgaacagatttcattcattgtgaacatcgacggattcagaattaacagcaaaaaaacagtgaggtccaaaaagcacttaggtctgaatgggtatctgatttccggttccaattacccctatatagatgggaaaatccgcatcagcaacaagaagaccaagaagatatctaaactaatctacgagtgcaataccgacaaaagtgacctcgatatcttcaaggtggttttttccattgatccgtttcggattaaatttcgaaggaaacctaaggtcgaatttttgaacaactattgttgtgcacagatcaacaacaaaattatcggctaccgttcgtatctgatttccctgctcaagtataatgacaaatacagctgcctggaagacgatttcattttcaaggtaaaaggcctgataaaagagagcgagaaaattatcaacaacagaatgaagaaggagatctga

SEQ ID NO: 12236 - RNA, 1176 nt, unidentified
  source 1..1176: mol_type = other RNA; note = synthetic construct
atgaaaaagtactcactgtctagcgtggttctggatcttctgaaggaatactcctactataaagaggataaaggagtcttgcctctctcatcctcccatgtcagagaattcaaaattgggaagaagttcgcttattccaccgctccggcaataaatcgtatccactcacacctatcaaaggtaatattttcccagtacgttagcaaaatacctgtgaaccagagtgccaaagcttaccttgcaggcacctcctattatgattttatagaaccccatcgcaacaattatttttttctccggctggacctgaagaacttttttcattcaatctccaaggacgtaattcagaagaacttccttgagtactttagtgacgagaagatttcggagacttgtgagcagacacacgctcaggccatctgcaatttgatcatgtataagctggacgtgaataacagcaacgtggcgtttaaaggtaaatatatcctacccatgggtttcccacttagtcccagcatttcaaatgtggtcttcagaaaaaccgatttgctgatcgaaaaattctgcaacgaaaaagggattacgtatactcgctacgccgacgacatgctgttcagcagtaggggaacaatcgtcccaccacccatattccggctgatcggaaagaataaggacaaagttaaagcctatgagtctccttttttgcacagcaaacgattctacgatgaaattagctacctcgtgggcctggacggatacaggatcaacaagattaaggtgatcaaggcagtaaacacaattagcctcaatggttatacgatagccggcactaattactctgatctgaagggcgacattaggctatctaacgccaagaccaagatcatttataagctgctccacgaattaaaggtccaaaaatccgatgacgttctcgtgtttaaaaagtgtttctcgtctgagatgcctgtgcccaaatataaaaagaacgtgggcaaattcatcctgaatttctgcaccaatcaaatcaataacaagttagtcgggtacaagagttacatcatcagcattttgaaatacgatacagagaaggattgtctgagtgtggagtctaagtctaagtaccttaacctgctcgggaaattagacgtggttattaagaagagaatgaaatga

SEQ ID NO: 12237 - RNA, 1173 nt, unidentified
  source 1..1173: mol_type = other RNA; note = synthetic construct
atgaaaaaatattctctgagtcccgtgatcctagatctgctcaaggaataccctaattatgaagaggataaaggtgtgattccactgacatctagccatgtcagagaatttaagatcggaaagaagttcgcatatagcaccaatacagccattaataaaacgcactcccacttgagcaaagtcatattctcccagtatatttcgaagatccctgtcaaccagtccgcaactgcttaccttgaaggcaaaagttactatgacttcatcgaaccacataggcataactactttttcctcaggctggatttgaaatctttctttcactccatcaggagcaacattgtgtcagagaatttcctggagtattttagcgacaaaaagatttcagagaactgcgagcaaacgcattcagaagcgattttcaaccttatcatgtacaagattgacaacaagagtaagaataacacctttaaaggcgagctgattcttcctatggggtttcctctgtctccctcaatctccaatattatctttcggaagacagatctcttgatagaaaaactgtgcgatgagaatagtatcacttataccagatatgctgatgacatgttattttccagccgcgggcagatcattcccccgagtattttcccactaatcgacaagaacaaaaaaaaggagacaacttacaagaacccgtttgtgcactctaagagattcttcgacgaaataagctacctggtgaaactggatgggttcaagatcaacaagaaaaagacaaagaagtcagtacacaccatctcattaaatggatataccattaccggctccaattttcccgacataaagggagagatacgaattagtaacctgaagaccaagataatctctaagttaattcacgagctcaacaacaaaactgatgacgttatcgccttcaataagtgtttcaaaaaggaaaatcccatcccaaaatacaagaaaggtagcgaaaacttcattagcgagttttgcaagaaccagatcaataacaaattggtgggctacaattcctacataatctctatcatcaagtacgacaaggagaaaaattgtctttctcgggactcccgcgagaaatacgccaatctcgttaaggatctgaacaagctcatttcgaaacgtctgaaatga

SEQ ID NO: 12238 - RNA, 1173 nt, unidentified
  source 1..1173: mol_type = other RNA; note = synthetic construct
atgaagaagtattccctctccccgattatcattgatctcctaaaggagtatgcttattataaggaggataaaggcgttttacctttgtcgagctcacacgtgcgtgaatttaagattgggaagaaatttgcctactctacctcaagcgcaatcaatagcgtgcattcccaagtgagcaagctgatatttaaccagtacattagcaagataccagttaaccaaagcgccaccgcatatttgtccggcaaatcctactatgacttcatcgagccacatagaaacaattacttttttctgcgcctggacctgaagaacttcttccactctatctcaaaggatataatcgagcggaactttctggaatactttagcaatgatcccatttctgataagtgtgagcagactcacgctcaggcaatctataacttaatcatgtacaagctggacagtaaatccgacaatagcacattcaaaggctgtgagattttacctatgggatttcccttgtctccctcaatttctaatctcgtattccggaagatagacctgctgatcgaaaagttttgcgacgagaagggaatagtatacactagatatgcggatgacatgctattctcttccaggggaaaaatcgtgcctccaccaatcttcgctttcttcggtaaagacaccaaaaagaggaaatcctacgatccgccctttctgcacagtaaagccttctatgaagagattagttatctccttcagctcgacgggtacaaaataaacaagaacaaggtgaagaagagcgtccatacgattagtatcaatggatacacaatcactgggagtaattatagtgacatcaagggtgacatccgaatttcaaacatcaagaccaaaacaatcacaaaacttatccacgaactgaaagtcaacaaagacgatatcctggtttttaagaagtgcttcaaaaaggagtttcccacgcctaaatacaaaaagggcgccaatgatttcattagcgacttctgtacaaaccagattaataacaagctggtcgggtacaagtcctacattatcagtattgtgaaattcgatggcgataaagactgcctttctaccgcctcaaggtctaaatacaccaaattgcttgaacagctggataattcgataactaagcgcctcaagtga

SEQ ID NO: 12239 - RNA, 1182 nt, unidentified
  source 1..1182: mol_type = other RNA; note = synthetic construct
atgaagaaaattctgctccatcccagcgtggtggagctgctgaagaattttagcaactacacagatagcaaaggcattctgccactcttaagttctcacgtcaaagagttcaaaataggaaaaaggttcgtctatactctcagtgagaagatatctccttcctacaaacatatcataagagccattcacacgcaaaatctggcgaaaattcctgttaatcagtccgcaacagcttatcttaagggcaaatcctactttgattttatagaaccacaccgtaacaactacttcttcattaagcttgacttgaagaatttcttccattccatatctgaagacgtgatcaaatccaatttcctcgaatatttctctgacgagataatctttcccaattcaacccagacccacgctgaggccatttacaatctcatcaagattgacctgtctgaaaaatcatcgaacaagaggttcatcaaaaaatccattttgccagttggttttccgctgagcccaatcattagcaatatcgtgtttcgaaagattgatcttctaatagagaagttctgtgacgagaaaaacattgtatatacacggtatgccgatgatatgctgttttcctccaaggggaaaatagaatataatcccttctcaaccaagaacaacaagtacttaaatccgtacctgcactcaaaaaatttctacgacgagatctctttcatcctgagtatcaacaactacaagatcaacaagaacaagattaagaagtcggtgcataccatgagtctcagcgggtataccattacaggctccaactatagcgacattaaagggttcattagtatcagcaacaagaaaactaagatcatcagcaagcttatccatgagcttaaaatcgaaaatactgatgaagaccgcgatagagatagagatatcctgaagaaatgcttttctatgatacctcctaaacccaagtatcgcaaaaagaccgacgaatttatcaaaaagttctgcgagaacatgattaacaataaattgctgggataccggtcatttctaattagtatcctgaagtacgacaagaatcacgactgtatcaacattgagaacaatgagaagtacaacaagttgctgaacgaaatcaatatcatcatcaggaagcggctctcattaaatgatttttga

SEQ ID NO: 12240 - RNA, 1197 nt, unidentified
  source 1..1197: mol_type = other RNA; note = synthetic construct
atggaagagatagaaatgaaaaagatcacgctatcaaagacagtgtttgatatcctcgacgattactcattttttgataaggccaaaggcctaactccactgtcctttgaaaacgtcaatgagtttaagattgggaaaaagttcacttacacccccgaaagcaacctgaaacctttacaccaaaaattgagcaggttcatcttgaacaattacctgtctcatatcccacttaatcagagcagtgtggcgtatcagacgaaaaaatcatacttcgatttcatcgagccccatcgcaataattactttttcatccggattgatctgaagaacttcttccatagtatttcccctgccatcattaaatctaatttcctgaaccacttcagtgatgacccaatctctgagtcctgcccccaatctcacgctaagctcgtttacaacctgataacattaaagctcgacgagaactctaaaaataagaccttcatgaacgaggaaatcttgccaatggggtttcctctttctcccgtggtgtcaaatataattttccggaagatcgacatactcattgagaagttctgcgacattcaccacattaaatatacccgatacgctgatgacatgcttttttccagcaagggatcacttcttccgaaacctatcttcgagccgatcgtaatgggtctgaaagccgtgacaaaatcgtacaagccccactttattcacagcgaaaggttcttggaagagatctccatattactgaacctggatggttttaagctgaacagaaagaagaccactaaagcagtcaacaccctaagcctcaacggatatactatcagtgggtcgaattttcctgacatcaatggcaccataaggatcagcaataagaagacaaaactgatttcccagctgattcatgagttgaattcagaagaacccaagacagacgttgagattttcaagctgtgctttcgccatgagtttcctaaaccaaagtataagaagaatgcaggacagtttatcgaaaccttctgtataaaccagattaacaacaagctcatcggctatgtctcttacctgaaaagcatcatttattatcacgacgaccataattgtctgtccaatgagagcatcaacaagtacagtaagattataaacgagctcagtacgatcatttccaaaagagtgaaatga

SEQ ID NO: 12241 - RNA, 1152 nt, unidentified
  source 1..1152: mol_type = other RNA; note = synthetic construct
atgaaaaagtattcacttacaccagccatgttggaggtgtgtaaagaatataacttcttctcagatgtgtctggatttatgcctctgacttccgagaatatcaaggaaatcaagattggtaagaagttcgcctatagtcaccaggataataataaacccacccatcagaagcttagcaagatcatcttcgagaattttctctcaaacattccgttgaaccaatctgctattgcatacgtgaaaaagaaatcctacttcgactttattgagcctcacaggaataactatttcttcttgagaatagacctcaaagacttttttcattccatttccgaggatctactgaaacgcaccctgtccgattacttttcatctgagagtctgagcgaaacaattaaacagtccaacatcgatgctatctttacctttctgacagtcaacttaaaatctgacagctctaacgtgaaattcctggacaaaaaaatactgcccataggctttcctctcagccctaatctggccaatatagtttttaggaagacagatcttctcctagagaaattgtgcgatatgcatggggtaacatacactcgatacgcggatgatatgttgtttagctcccgtggaattatggagaagaacctgctcttcagaaagaataacaactacaaaaagccctacattcacagcgacaatttcttatcggagatcaaatatctggtgagtattgacggatttttcatcaaccacaacaagactatcaaatctgtcaacactctcagtctgaatgggtacaccataagcggtacgaattttccagatatagaaggcaagataaggcttagtaacaaaaagaccaagattatcgagaaggtgattcacgaaattaatattaaccccgacgacaaagtcactttcgaaaagtgttttaagaaggagttcccaaagcccaaatatgagaaaaatcgcgacaacttcatcaacaacctctgcaccatcaaaatcaatcagaagctgcttggctatcggtcctacttaatctcgatcatcaagttcaataacaagttcaattgcatctctgaaagctcagaagacaaatacaacacgctgctgagcaagatcgaaaatgttattaagaagcggatcaagtga

SEQ ID NO: 12242 - RNA, 933 nt, unidentified
  source 1..933: mol_type = other RNA; note = synthetic construct
atgtctgccgtagcctatatcgagggcaagtcctacctcaatttcatcgaacctcacagaaataacttcttttttctgcggctcgacataaagaatttctttccaagtatcacagaggctctcgtcaaagagtgcttccgtgattatttcagcgaagagcccataaatgatgtgattaaacagagccatctggatgccttcgtgaacttcgtaacgttgaatatcactaactcttctgtgaatgacacctttaaaaattccagtattctgcctatggggtttccactgtctcccataattagcaacattatcttcaggaagatcgacattataatcgagcggctgtgcgttcagtcctacattacctatacacgctatgctgatgatttgctgtttagcagccgcggaaaggttgacatgtcactggcgtcgttcatgaaaatcaactcaacctacaccgcttttattcacacagagcgattctgtgactccattagaaaaatcctagcagtcgatggatacaagatcaacaagacaaagactattcaagccaaaagcattgtgtctcttaatggttataccatcattggttcaaactattccgacgttagaggggaaatccgggtgtccaataagaagactaagaaaatcgagaagcttttacatgagcttaagaagaagatttccgaccaggctgtctatctgaaatgttatagtaaccagatcccggtgcccaaatacagttcaaagaaagaagtgtttctcaacgccttctacaagaaccagatagacaacaaactgtctggctacagggcatacttaataagcatgatcaaatttgacggcgaatacgattgctttgatagccacgcactccagaagtacaaaaatttgatcagtcaactagacctggccctgtcaaagaggaaatga

SEQ ID NO: 12243 - RNA, 1182 nt, unidentified
  source 1..1182: mol_type = other RNA; note = synthetic construct
atgaacaagaataaattcaacaacgacttcctgaaaagaatcgtcgtggactacaagaattacaatgagagccacaaagttcccagtatagaacccgatatggtcgtggagttcaaattgggtaagaaatatgtgtacaagcttaacgaagcgcactctgattacgaagggatttccaagtgccaaaacaagctgatcactgagtttttgtccaatataccaatctccacagttgccaaagcctatgtttctggcaagtcctatctggactttctcgagccacaccggaataattattatttcgtacgaatggacctgaaaaacttctttcattcaatctcttccgaactgatccggaactcttttgacttatacttcgaaaatgagttcactaacgaggacaaaaagcagaccctcatggacgcatttattaatatcgctacctacaaactcgatcaggagtcaaaaaacgtggccttctctgggaagaggattctgcctatgggctttaagagctccccgatcatttcaaacattatctttcgcaagatcgatattctgatagaggatttctgttcgaaccataatatcacctatacacgatacgctgatgatctgctattttcctcaaaaacgaatagtgacccttacggtagtgtatttttgaagcggtttaattccaagccaaggaccggatttatccactctaacagatttttggatgaaatctcatacctagtgcgcatagacgggttcaaaatcaacgctagtaagaccataaaagccatcaatactctgagtctcaacggatataccatcgaaggctccaactattctgatctgcagggaacaattcgcattagcaataagaagacacagataatcagtaagcttattttcgaggtcaagaaaggcagctctaatttcaacgtgatgaagaagattttcgatttcaaagtgtcgaataagtacttcaactatatcccccccaaagaagaacatattgaaaggtactgtagggaccaaattataaataaagtcagcggctatcgtagctaccttatcagcatcttaaaatatgagtcagagtacaaatgcatcgacgaaaagagcattaacaagtacaacaagctcattaaggagctggagtggattcttactaagcctgagtttgcaagctga

SEQ ID NO: 12244 - RNA, 1104 nt, unidentified
  source 1..1104: mol_type = other RNA; note = synthetic construct
atggacaaaatcgataaagataccttctttagcgaattgctcgttggagactatagtacgctaataaatcagggcgtaccccagacagatttcggtgacgtcacagagattcagtctggaaagaagtttttctacaaactgaaagaggactcagatctgaacaagtgtctcaaagtcctgaccactaggtttttgaacaagatcccgattaataatagcgccaaagcattcagatcaaatcagtcttacctgaactttattgagcctcacagaaaaaactaccattttattcgcatcgacatcaagaatttctttcactccatctcagaagatattctgaaggattgcttttcctcgtattttgagaaacaaatcgtgaataccaagtcccgatccctgcttgtggacagcttcattaatttagtgaccttacggctcagtgagaactccaaaaatgaggtgttctctaacaagatcatacttcccatcggctacaaaacgagtcctatcattagcaacataatcttccgtaagttcgacattctgattcagtctttgtgtagcatgcataatatcgagtatacacggtacgctgacgaccttctttttagctctcccaaacactccaacacaattcactctactttcttctacaacgagatctcgtttatcctgagtctggggaggttcaaaatcaaccagaagaaactcttgagcgctaaaaagattctcagcattaagggttacactattgatggcaccgaagatgaaaaacggttggggactatccgaatttccaacaagaagatcaagatcatagagaagttactctatgaattcgacaaagggtcatccaatatcaagatcctaaggaaggtcttcaaaataaacgtggaaaagaagaagttcaagtataagccaaaaccagagtttatagataagtacgcgaaggatcaggttcataacaaaaccctgggatatagaagttacctgatctcactcataaagtttaatcaagactacaagtgcatcgatgacaaatctattctgaagtatctgaagctggtgaaacgccttgaaaagctggccctagaaattaaatga

SEQ ID NO: 12245 - RNA, 1233 nt, unidentified
  source 1..1233: mol_type = other RNA; note = synthetic construct
atgaagattatcgagaaaaaggactttgtgaatcaggtgctgcaaggatatgatgggtattcaaatgagatgggagtgaagaccttgactcccaacgagattgttgagtttaagatcggctcaaagttcggctacaggtgtagcaacaacgatcttgccaagtccctggaaaacacccaactgcgcgctctctcccgggtcgtgaatacattggaaatcagcaaatgtgcgacagcttttgtcacgggatctagctatctggattttctcgaaccccatcgttattcataccatttcattcggttggacattaaagacttctttcactctatctcctcctctgtcatctcagaatcttttagtaagcacttcaaggacactaatatcactagcggcgagactaaacagacactgctcaagtctttcctaaaccttgttacatatacgatcccacctgattccacgaataagaaattcgcaggcaaaactattcttcctatagggttccggacttcccccgccattagcaatatagtgttccgcaggctggattgcttaatagaggacttctgctaccgaaataatgtaacttacaccagatacgccgatgacatgctgttttcgagcaagataaatacaaagttcaagtccatcttgcagaagaaagatgtcctcccacctattccgattacccataaagagcacaaaaccagattagctaaaatcaaaagagaggaggcactgaaacacgggtgttttctgcacagcgacaagtttacaaacgagatctctagtattatccggataatcaacctgaaactgaacatcaaaaagacaatcaagtccaatcagactattagtctaaatggctacaccatcgatggtgtagatagctatctgtctgctggtacaattcgagtgtcaaataagaagcttaacgtgataagcaagatcattcacagtctcaacaaaaacatgtctgccattgaaatcatggaaaggtacttcaagatgaacaaagcccatgaatgctttaagtaccctcccaaatatgactactacaacaccttttgcattcagaagcttttcaataagatcaccgggtatcgctcgtacctggtttcattgatcaaatatgacgaggagtataactgtattaccccaagtagtttaaagaagtacaaatccctcatagcagaactcgacaaaaccttcaccaaaatcaagctgtga

SEQ ID NO: 12246 - RNA, 1143 nt, unidentified
  source 1..1143: mol_type = other RNA; note = synthetic construct
atggtcagcgaaaagaaaatagggaataaattcgcgtactccctcaaagtgaacggtgatgaaggccagaatatactggctatacacaacaaactgaatcagctgttcctgaataatatcgagattaatcgttgtgccaaagcattcataaagggaagatcctacttagattttatcgagcctcatagagagaactttcatttcataaggctggatatcaagaagtttttccactccattggaatcgatcttctgaccgaggcctttgaaaattacttcaagaaggactacctcatcaataatgagaacaaacagtctctgttgaacgcctttattaagctcgtaacctatacaatccccgacgactcacctaacatcgaattacgaggggtgaccgttttgccaattggcttcaaactgagtcccgtgatatctaacattgttttccggaagttcgaccttctgattgaagactactgttatcacaacaacataacatacagcagatacgccgatgacatgatcttttctatgaagatctctaacaagttcaagaactttaagaggatcaaattcccatccctcctgatcaatgccgaagacgatagggagaggaaactggaaattctcagctttattcacagcgacaaatttatcgatgacatctccgatattctcagtattggacagcacaaatttcacttgaaccccaaaaagacaatccggagtcatcatactattagtctgaatggctatgtcattgagggttgcgaagaccatttctcgacaggctccatccggctgagtaataagaagactcactttatctccaaggtgattcacgctatcacgaagaaaaagctgtctccggagagcattttcaagactatcttgaaggagtcaatcgataagtctaatattccatacacccctgctacccctgcattcaaaaaacagtattatcgctcacagcttatcaacaaacttgctgggtatcgaagctatattatctcatttctcgtgtacgattcaaagcaccattgcattgaggacaagtacattcgcaaatatttagagatgatcaacgcaatcgaaaagagcataaacaaactagagaaacaacgcctacaacagcccaagtga

SEQ ID NO: 12247 - RNA, 1119 nt, unidentified
  source 1..1119: mol_type = other RNA; note = synthetic construct
atgaaatacaagaaactcacagtgaaatccttcgtgagtatgctgtctgatgaagcctccgatcagttggaattacttaaacagcccattgaaccctacaaatttagcgatgtcaaacagagaaagctggggaagaagacaatattcaaactcacgcctgcaaagtctcagtaccttgaccggctgaataacaaactgttctctcatatccgcattaacaattccgccatcgcctatgtcgaaaaaaaatcatacctggacatgtttgagccacacagaaagaacatcaattttctgcgcctcgacattaagtccttctttcatagcattaatcgtaaaaccttggaggagactcttagcccttatgtgacagacgaaaactttttcgaggtcgggtctgtgaaacagagtctaatagatgccctcttaaatctcgtttctctgagggtatccgtggagtataatgacgagtcactgcacaataaagacattttgccgatcggcttcaaatcctcacccgtgattagcaacattgttttccggaaatttgatatcatcatccaagagttgtgcgctaagaatgacattatttatacccggtatgcagacgatatgctgttcagttcaccagtccattccaagtatatccacagcgataaattcttaaacgagatcagttacatcctgtcattcggcggatttcgactgaatcagagcaagaccatcaaggacaagcgtatgatttctataaacggttatgtggtagaggctggagagaatggagattcggggacgatccgcataagcgaaaagaagactaggaagatctacaagcttatctatatgatggagaataacatccctccaaagactattatgaaccgcatatttaaggttagggatcgggacatcgtgtaccgatacaagaaaggtaaggcgaagtttaaagaaaccttctacaaaacacagaccttgaatagactgactggctatagagcgtacataattagcctactgaaatacaacaacaagtacaactgcattaaggaaaggcaggtcaacgagtaccaaaagatgattatcaagctcgaaaagcaaatctataggctgaacctctga

SEQ ID NO: 12248 - RNA, 1146 nt, unidentified
  source 1..1146: mol_type = other RNA; note = synthetic construct
atgtgtcgcggccgctctagagatataatgaagtacaagaagctcacaactaaagcttttataagcatcctgagcgacgagacaagcgatcaacttgaactcctgaagaagccaattgaaccgcacggcattagtgatgtgaaacagggaaaattgggaactaagtccattttcaaacttactcccgccaaatcccagtatctgggtcgactcaataataagttcttctgccacattcaggtcaataattcagcagtcgcttatgttgaaaagaaatcctacctggacatgtttgagcctcatcgaaagaataccaatttccttcgtatcgacataaagagcttttttcatagcatcaacagggagatactagctgaagccctgtcgccttacgtaacaaatgaaatctttttcgagtctgggaaagtcaagcagtccttgctcgatgcgctgcttaacttagtatctctgagggtgagtacggagtataatgaccaaagcctgcacaataaagacattttgccaattggcttcaaaagcagtcccgtgatctccaacatcgtgtttcggagattcgatatcattatccaagagctgtgtgccaggtcagacataatatacaccagatatgcagacgatatgctgttttctagtcccgaacacagcaagtacctacataccaacaaatttctgtctgagatttcatacacactgtcattgtccgggttcaagttgaaccaggcaaagacgatcaaggacaagaacatgatttctgttaatgggtatgtgattgagtcaggcgagaatgggaacagtggatctatccggatttccgagaagaaaactaagaagatatacaagctcatctacatgatggaaaacaacattccacctcggaccatcattaacaggatttttaaaatccgcgatagagatatcatctattcctacgacaaaggaaaacgtaagttcaaggacaaattctacaagacccagacactcaacaaattaactggttatcgggcctacatcatttcgttactgatttacaacgagaaataccactgcatcaaagaagagtatatcaacgagtataagacccttatcggcaaactcgaagtgcagatctataagctggttaagtga

SEQ ID NO: 12249 - RNA, 1131 nt, unidentified
  source 1..1131: mol_type = other RNA; note = synthetic construct
atgaaatataagaaactgacgaccaaaactttcattagtatcctgtccgacgaagccaacgaccagctggaactattaaagaatcccatcaaaccctacaaatttagtgatgtcaagcagggcaagttgggaaacaagtccatctttaagttgccaccggctaagtcccagtaccttgaccgcctaaatgtgagttttttctcccatatccaaataaacaactcagcagttgcatatgtgggcaagaagtcttatctggacatgtttgagcctcacagaaaaaatactaactttctgcgtgtggatatcaagtcattcttccacagcattaataggaagactttgaaaaaagccctgagcccttacgtaagcgatgagaactttttcgaaaaggataaggttaaacagagcctgttagatgccctgttgaatctggtgtcattgcggataagcaaagagtataatgagaaatcccttcataacaaagacatactccccatagggtttaagagttccccagtgatttcgaacatcgtgttccggcggcttgatattctcattcaagaattctgtgctaagaatgacatctcatacaccaggtatgcggatgacatgctgttttccagcccaacccactctaaatacattcacaccaataagttcctgactgaaatctcttatatcctctctttatcagggttcaaaatcaaccagtctaagacaataaaggacaagaatatgatcagtgtcaacggctatgtcattgagagcggaaagaatggcaacagcggttcgatccgcatttctgagaaaaagacgaaaaagatctacaaactgctgtacatgatggagaataatattcctcaccgaaccataatgaatcgaatttttaacctgagggatcgcgacatcatttacaatcatgagaaaggtaagggcaagttcaaggataagttctacaaaacacaaacactcaacagactcaccggatatagagcctacatcatctccctcctcaagtacaacgaaaaataccattgcattaaggacgagcacattgaagaatacaaggacattatcaaagggcttgagaaccagatatataagatcacatatcagcccacaaaatga

SEQ ID NO: 12250 - RNA, 1116 nt, unidentified
  source 1..1116: mol_type = other RNA; note = synthetic construct
atgaaatacaagaagctgactaccaaagcttttctatcctttctctccgacgaccctaatgacagattggaactccttaagacaccaattgcaccgtataatttctctgatgtgaagcagggtaagttggggaataagtctatcttcaagctgagtcccgccaaaagccactatctcgaaaggttaaatcggaacttcttgtccaagatcaagattaacaatgccgctattgcatacgttgagcaaaagagttatttggatatgttcgagcctcatcgggagaacactaactttctgaggctggacattaaatccttctttcacagcatatctagggagactctggctaaaacctttgaaagttatattagcgacgaagtgttctttgaagtgggcaagacacggcagtctctgctcgatgccttccttaacatcatttgtctgaaagtcaccacggatttcaatgatctgtccctgcatgacaaagagatccttcctattggttttaaaagctcaccagtcatatccaatatcgtgtttaggagattcgacatcatgattcaagaattttgcgctcgacatgatataaactatactagatacgcggacgacatgctgttttcttcacccaataagtctcagtatctccacaccaaaaagtttttcagcgaaattagctacatcctatcattaggagggttcaatattaatcaggcaaagacgatcaaagataagaacatgatctcaatcaacggatacgttatcgagaattatagtgatggcgtgcccggaagcatcagagtatccgagaaaaagacaaagaagatatacaagctcctgtacatgatagaaaacaacgtcagctacaagatcataatgaatcgtatcttcaacgtgcgtgatcgagatatcgtatataactatgagaagggcaagcgcaaattcaaagacaagtactataagacccagacactgaaccgcttagccgggtaccgcgcctatatgatctcgattctgaaatacaacgacagatacaattgcctgccaaaaagtaaatcagacgagtacttcaagattatcaaccggcttgagaaacagatcctcattattaaatga

SEQ ID NO: 12251 - RNA, 1143 nt, unidentified
  source 1..1143: mol_type = other RNA; note = synthetic construct
atgtgtcggggtagaaatcggtacatcatgaaatatcggaagcttacaacaaagaccttcctgagcattctctcagatgagattatagaccagttggaattatccaggaaccctattcaaccctatacagtgaaagatgtcaagcatgggaaaatcgggactaagtctatatttaagttggcacctgctaagagtcaatacttagagcgtctgaaccagaagttcttcagcaatatagaggttaacaattccgccgtagcttatgtgggaaaaaaatcctaccttgacatgtttgagcctcatcgaaataatgcgaattttcttcgcctggacattaaaagcttcttccactccatcaacagggaggcactgaaaaaaaccttttctgcctacatatcagatgaagtgttttgcgaagatggcaaaagcaagcagcccctgatcgatgcttttttgaacctcatcagcctgaatgtgacaaaagactacaatgacccccagctcgttaacaaaagcattttgccgatcggctttaaatcaagtccagtcatctctaacattatcttcagaagatttgacatcctgatccaggagctatgtagtcgctcaggaatctcttacacgcgctatgccgatgacatgctgttctcttcaccaagtgaacatacatacctccacaccaacaagttcttcaacgagatttcctatattctgtccctgggcgagttcaaaattaacacttccaagaccataaaggacaagaacatgatttcgatcaatgggtatgtcatcgaaagtaaaggcgatggacgtaacggcaccattagaatttcggagaagaaaaccaagaagatttacaagctaatctacatgatggaaaagggagtcccacacaaggtcataatgaatagggtgtttcgcgtgcaggacagggatatcgtgtacaactttaagaaagggaaggaggagttcaagaagaaattttacaaaacccagactcgaaatcggcttacgggttacagggcatacatcatcagcattctcaagttcaatgacaagtatcagtgcatagaagccaagtatgtgagcgaatatcaaactattgtagagtctctggaaaagcagatctataaagttatctga

SEQ ID NO: 12252 - RNA, 1119 nt, unidentified
  source 1..1119: mol_type = other RNA; note = synthetic construct
atgaaaaatcgcaagttgacaaccaatacattcttgtccatactctgtgacgatcctttagagataaacgagctactgaaaaagcccattccggcctataccaagcaggacatatctgagacaaaggtgggcactaaaaccatatttaagcttactccagccaaggcccattaccaaaaaagactcaacgatcggtttttctccaggatacctctgaaccagtcaagtgtggcttacactaaacggaagagctacctggacatgttcgaaccccatcggaaatcatataggtttcttcgtctggatatcaaatccttcttccattcaatctcccgcgacctactgaaggacaccttgagctctcacgtgtctgaggacctgtttttcagcagcaattatgccaaacagactcttattgacgcccttttgaatattttaacgattaacctcggtgatacctacaaagataaagatctcacgaatagagacatcctcccaattggatttcccagctcacctgtcgtatcaaatatagttttccgtaagttcgactttctgatccagaagctgtgctccgaaaataacattatctataccaggtatgcagatgatatgctcttcagtagcacagcagatagtaagttcatccactctgaacacttcatccgagaggtgtcttacattctgagtttgggcgggtttaagctgaacggtgacaagaccattaaggagaaaaacatgatctcgatcaacgggtatgtcatcgaaagtaacggaaaggataaaaactccggacacattcgcctcagcaataaaaaaactgctatgatctgcaagctgatcgataagctggacaagaatgtggcacacaaggatattttaaagaagatcacagggttgaaggagaaccatattaaagtgtcctttgacaagggcaggaatgagtttctggctcagtactacaaatctcaaattatcaacctactggcgggctatagagcctaccttatcagcatcatcaagttcaataaactctacggctgtgttgaagacaagtatctggacaaataccagaacatcattgacgatattcagaaacacctgtttcggctggtctga

SEQ ID NO: 12253 - RNA, 1089 nt, unidentified
  source 1..1089: mol_type = other RNA; note = synthetic construct
atgataaagaggaagaaattgaccaccaacacctttctatccttgctgtctgatgaccacaaggatcgatttgagctgtcaactcagccgatcggcgacatcacatccaaaaacgttattgagttcaagatcggaagtaagacctgtttcaaattcaaaaatgccggtgtgctggaacagtaccaagaacgtataaatcggttgtttctgtcagagatcgaggtaagtcatagcgcctttgcttatgtaaaaaacaagtcctacctggagatgtttgaatctcataggaacggatactattttctcagagtggatatcaagagcttcttccacaatatttccagacagctcatagccgatagcctgtccggctacatcagcgacgaagactttatcaagaacaaacagaagctcatggatgcattcataaatattatcacccttaacgtgacgaaagaacaatcttctttcgtgggtagacagatcctgccaattggattcaagacttcacctgcagtttctaatataatcttccggcgatttgacaatttaatccagtccctgtgctccaaaaataacatagtttacaccaggtatgctgatgatatgttgtttagcagtcccctaggctttaagttccttcacactgagcgctttatgaacgaactgagctacatcctttcgctgggcggcttttctattaacaacaagaaaacgctcaaggacaaacatatgattaccctcaatgggtatgtgattgagtcgagcttaactagtgggaagatcgcatcaattcgcatttcaaacaaaaagacagacatcatttccaaactcattaataagctggagtataacgtcgacagcaagttaatcatgcggaaacttttcggactgacaaatgaaaaagtcaaaccccaattctctagtaagaagaacaagttcattgaccagtactatgagtcacagctgctgaacgcgattgctgggtatcgcgcctaccttatcagcatcgtgaaattcaatctcaagtacaattgcgtcgagcaaaaatacattttgaagtatcaggggatgatcgataagacatga

SEQ ID NO: 12254 - RNA, 1122 nt, unidentified
  source 1..1122: mol_type = other RNA; note = synthetic construct
atgaagcgcaagaaaatcacagtgcgagctttcctgtcaatactgagtgatgatccgcatgatagggcggaattaagcctgcagcccatcaagtctattgaagcagatcgtgtaactgagtgtaagataggcagcaagactgttttcaaactcaaagatgctaagcttcttgagcagtaccaagaccgggtgaatcagagattcctttccaatattgaggtgtcaaacagcgctatagcctatgttaagaataagtcttacctagacctgtttgaaccacacatctacggttaccactttctgcgggtggacatcaaatcttacttccatagtatcagtagggagctcattaaaacctcctttagcacttacatcaatgatgaggatttcatcaaaggccaacagaaactcattgacgccttcacgaacatcctcaccttaaatgtcggggataaacccaagaataacgcactggcaggtaaagaaattctcccaattggctttaaaacctctcctgccgtgtctaacatcatttttcgcagatttgacaatctgattcagtcgttgtgtagtaagaaccatattacatatacccgctatgccgacgacatgctgttttcatcacccctcaagttcaaatttatccacactagaaagttcatggatgagctcagctatatcctaagcctgggcgggttcctgatcaacgacaagaaaaccgtgaaagaaaagcatatgatttccttgaacggctatgtaatagaatcaaatggggtcacaggacagcctgccaagatcagaatctccaaccgaaaaaccaatataatcgccaagctaatcaacaagttggaccacaatgttgactgcaagctgattatgtccaagctgttcaatttatccgagaaaagtatcaaggtcaaatacaaaaagggaagggatgactttatagaccagtattaccggacacagctgattaacgtgatatctggatatcgggcttacctgattagcatcattaagttcaactgcaaatacaactgcattgataagaatcacttgagcaagtatcaactcatgatcaacaaacttgagaagcacttgcttaggctgtccaactggtga

SEQ ID NO: 12255 - RNA, 1122 nt, unidentified
  source 1..1122: mol_type = other RNA; note = synthetic construct
atgaaaaacaaacggattctgattgataaggtgttctatgaacgatttctcagtgtcgattcttttaaggagaacctgatcagccaaattcctatccccaagatcacaaataaagaagtcaggttgatttcttcaggggctaaaacgttttatgctattaacaacacctcaccccactcgcatgtacaataccggctgaatagatatttcttctcccacattcctattaactctgccgccaaagcctttgtgaaaggtgggtcctatctcaaatatctggagccccacatttatggatcaagtttttgtaggctggacatcagcagcttcttcaataatatcagtttcaacgacgtggagatgtgcctgtctccctacataaaagacgaataccttatcggaaatgaacagaagttgctgagcgcaatactgaatagtatcgggtatgaaatccctattcacaagaagcataccttgattgtcccaatgggatttaagacatccccaatcataagcaacattgtttttcgcaagatggacctgcttatacagaacttttgcgcgaagaaaggcataatctactctcgttacgctgatgacatgttattctccaatccaaaggagtctaagttacttatcagcgattacttcttcgatgagatatcaagtctgctgtccattatgggcttcaagatcaatgaatcaaagtacatagcaagagagaaagagatttctatcaatggctatgtgatcgaaaacaaaggcggttacggggctgttggtactatccggctctcgaagtcaaaactcaagactatactcaaggtgatccacggcctaaatgaaaacatgccgcataaatccatctgcaacaagtacattgacatcagactcagcgagtccgacttcaagtacgaaaacaaaaaggccgagtttgagaaaaagtattacagggaccagttaatcaactatctgtccggatatcgcgcatacatcctaagcctcattaaattcaacattgagtaccgctgtgtgaataatcactttttgagccagatctccgccatgcttgatgatattcagaagcatatcatcaaggagaaaaataagcgactgcggtga

SEQ ID NO: 12256 - RNA, 1134 nt, unidentified
  source 1..1134: mol_type = other RNA; note = synthetic construct
atgaaaaaacaggccatccttattgacaagtcgttctatgagaaatttctgtctgtggaaagcttcaaggaaaatatcactttgcagacggcaattcccaagattacaagtaaagaagttcgcttgatttcatcgggtgccaagacattctatgccatcaacaaggcatccccacatagccatgtgcagcatcgcatcaatcaatattttctgtcccacatccctctgaactcttcagccaaggcttttattaaaggcggcagctacctcaaatatttagaaccccacatctatggatcctccttttgtcgtctagatatatcatccttcttcaacaacatctcattctatgatgtcgaggaatgtctttctccctatatcaaagacgagtacctcatcgggagtgagcaaaagctcatagacgcgatcttaaactctatcggatacaactcacccatacagaataaaatcatcgtgccaatgggctttaagactagcccgattataagcaatattgtcttccgaaagatggacatattgatacaaaacttctgcgcaaagaaaggaattctttactctcggtacgctgacgatatgctgtttagcaatcctaaggaatccaaaatccttctgtccgattactttttcgatgagatcgcctctctgttgagtattatgggcttcaagataaacgagtccaagtatatatccagaaaaaacgagatcagcattaatgggtacgtgattgagaataaggggggatatggtaaaattgggagcattagactgagcaaatctaaaatcaacaccatcctgaaggtaattcacgccctgaagcaggacattccaaataagattatctgcaacaagtacatccagattaggctgaaagaaaccgatttcaaatacgaaaacaagaagctggagtttgagcagaaatattatcgggatcagctgattaattacctcagcggctacagggcttacctcatctcactcatgaagttcaatctgatctttaactgcatcaatcacgactttctaacccaagctaatatgatcctgagtgacatccagttatacctccacaaaattaagaacaagagaagtcctaggcatataaataacatttga

SEQ ID NO: 12257 - RNA, 1125 nt, unidentified
  source 1..1125: mol_type = other RNA; note = synthetic construct
atgaaaaccaaaaagatgattctggtcgacaaggtgttctatgagaaaatcctctcagtggagtccttcaaagaaaacattatcacacaatcagcaatccctaagatctccaataaagaagtacgccttatcagctccggatccaaaatcttctacgcgattaataacactagtccacatagccatgtccagctgcgattgaataggttttttctctctcacataccactgaatagtgcagccaaagcctttgtacgaggagggtcttatcttaagtacctggaacctcacatttatggaagtagctactgtaggctggacatcagtagcttcttcaacaacatctctttcgatgatgttaaacagtcgttatctccctatatcaaggatgaatacctgataggcacagagcagaagttgattgacgccatcttgaattcagtcggctatgagagccccatccggaaagataagggaatgattattcctatgggctttcgcacgagccccgctatctcaaacatcgtgtttagaaaaatggacctactcatccaggatttctgtgcaaagaagggggtgatttattctcggtatgctgatgatatgctgttttctaatccaagagagagcaaactgttaatgagcgactactttatcgacgaaatcagctccctgctgagcatcatggggttcaacatcaaccaatcaaagtacattagtcgcgagaaggagatttccattaacgggtacgttatagaaaacaaaggcggtaatggttctatagggaccattcggctctccaaatcaaagctgaatactgtgctgaaagtcacccatgctttggcccagaacattccgtacaagaatatctgcaacaagtacattaaggtgagactgaaggagaagaacatcaaatacgaaagtaagaaggacgaatttgagaagaaatactatcgtgaccaattaatcaactacctcggtggctataggtcctaccttatttctctcgtgaaattccactcggagtataagtgcgttaattccgacttcattattcagataaacggcatccttaatgatatacagaaccacatacagaagataaagaataatcggaggctatga

SEQ ID NO: 12258 - RNA, 1113 nt, unidentified
  source 1..1113: mol_type = other RNA; note = synthetic construct
atgaagcgaaatactttcgtgatagacaaggaatactacgaaaaatacctgtcagctgaaagcttcaaggagaactttatctcaattacacctatccccaagataacgaagaaagaggttaggctgattaaatccggctttaaaaccttctacagcctgcagagcaccagtccccacagtcatatccaaaatcggcttaacaactacttctttagcaaaattccgttaaactccgcggccaaggcctatgtgaaaggcgaaagctacctgtcttatctggagccacatatctatggaagctctttttgcagattggatattaagtccttcttcaacaacatctctttcactgatgtgaaaaaatcactttctccctatgtaaaggacgaattcctgattggaaaggaacagacagttcttgaagctattcttaacagcgtgggctatgatgacgagaagtatgacagaacactgatcccaatgggctttaagacttctcctgtcatttcgaacatcattttccgaaaaatggacatcctgattcaggacttttgtatcaagaaagggctaatctacagcagatatgccgatgacatgctgttctccaatttaagggatgggaatctgctactctccaattactttttcgatgagatttcaagtctgatctccatcatgggatttaagctgaatgagagcaagtatatcgcaaagaagcggatgatctcggtgaatggctatgtgctggagaataagggagggaggggtgtagtcggcaacattcgcctctcttctgagaaattgtccaccataaataaagtcatccacgccctcaattcaaaaattccgtacaagaccatatgtaaaaggtacctcgatattaagttgaaggacggtgattacaaatatgagtccaaacgggaagattttgaacgcaaatactaccgggaccaattaatcaattttatgaacgggtacagagcatacctcatcagtataataaagttcaactccgactataactgcatgtcaataaagtttatcgagagtgtgaacttgaccctcaatgagattcaggttcgcatccgtgagatcattaaaaagcgtatttga

SEQ ID NO: 12259 - RNA, 1116 nt, unidentified
  source 1..1116: mol_type = other RNA; note = synthetic construct
atgaagaataacaacattctgatcgacaaagccttctatcaaaaattccttacttccgaaagctttaaagaaaacctgatctctggtatccctatcccagtgatctctaacaaagaagtaacctgcttttttagtggctacaaaaagattcatgtgattcgcgatacatcaccgcatagccacgtgcaatatcgactaaacaaatactttttcccccacatccccctcaatagcgccgcaaaagctttcgtcaaaggcggatcttatcttaaatttctggagcctcacataaatgggtcctccttttgcaggttggatatatgttctttcttcaattccatctcctttgagtatgtcgaggagtctctgtccccttacatcaaagacgagttcatcattgataataagcagaagctggtggaggctgtgttaaatagtataggctttaaagacgagaagattaacaaggaggaaatgatcattccaatgggattcagaacttcacccgccatcagtaacattatcttccgtaagatggatatacttatccagtcattctgcagcaagaaaaacattattttcagtaggtacgccgatgacatgctgttttctaccccaaaggagagcaaaattctgagctccgattactttttcaacgagattgcatcgttgctcagcataatgaatttcaagatcaacgacaagaagtacatcagtagagaaaaggaaatctccctgaatggctacgtcattgagaacaaaggtgggtatggagcttcagggtcgattagactatccaataagaagatgatggttatcacgaaagttatgtacgcgttgaataacaacattcccgcaaaaacaatatgtctgaagtaccttgacattaagctcaaagagaagaacatcaagttcgaaaacaagaaaagcgaatttgaaaagcggttttatcgggaccagttgttaaattacctcgggggataccgctcttatctgatatcaatcctcaagttcaatagctcatatggctgtataagggacaatttcacccatcacatcatctttattctgaatgatatccagctccacatggtgaagattaagaagaaaatctga

SEQ ID NO: 12260 - RNA, 1134 nt, unidentified
  source 1..1134: mol_type = other RNA; note = synthetic construct
atgaaggaaaagatttctaagatcgacaagaacttctatatcgacatcttcataaagtccagttttcaaaaggagttcgaaacaggagatatcatcccgctgattgccaacaaagaagtctcgatcattaacgacaagaacaaaactttctactccttggctcactccagccctcattactctatccaaactaagatcgagaagttcctgttaaagaacattccactgaatgcatcttcatttgcctacaggaaggatctgtcctacctgcattatctggaaccacacattcagaatgtgaaatattgtcatctggacatagtgtccttctttaattccatcgatattaacctagtccgggataccttttctgtttatttttctgacgagtttctggttaaagacaaacagagcttacttgacgcatttattgccagcgtgacctttagcaccaaagtgggggatgtagagaaaactataatccccatggggtttaaaagctctcccagtatctccaacatcattttccgcaagatggatattcttattcagaaattctgcgacaagaataacatcacatatagtcgatacgcggatgatctgctcttcagcacgaaaaaagaaaataacattctgtcgtccaactttttcattaatgagataggctccatcttatcaatcaattcattcaagctcaacaagagtaaatacttgtacaaggaagagacaattagtctcgggggatacgtaatcgaaaacacactgaatgacggttcaaaaggtaatattaggctgagcagctcaaaacttaatatcctgcataaggccctccacgaaatcaacaagggctcatcagctaagcacatttgcaataaggtgttcaacctaaagataaaggagttcacctacaagaaaaataagaccgcctttgagaaaaagttctattcttctcagttggtcaataaactcttgggctatagatcctatcttctcagtttcgtgaaattccagaataagtacaaatgcatcaaccccgtttttctcgagaaatgttttcgtctgataaacgagatcgagaacataattaacaagaatagccacgcacagggaatgaatgctcctatgagcaactga

SEQ ID NO: 12261 - RNA, 1101 nt, unidentified
  source 1..1101: mol_type = other RNA; note = synthetic construct
atgaaagagaaaatctctaagatcgacaagaatttctacaccgacatatttatcaagacatccttccaaaatgagtttgaagcaggtggggttattcctcctatcgccaaaaaccaggtgagcaccatctcaaataagaataagacattctactccctggcccattccagtccccactatagcatccagactcggattgaaaagttccttctgaaaaacatcccactcagtgcatctagttttgctttccgtaaagaaaggtcatatctccactatctggaacctcacacgcaaaacgtgaaatactgtcatttagatatcgtctcattctttcactccatcgatgtgaacatcgtacgagacacctttagtgtctacttttctgatgagtttctggtgaaagaaaagcagtccctcctggatgctttcatggcctctgttactctgactgcggagctggacggcgtggaaaaaacatttattcccatggggttcaagtctagtccgtcgataagcaatattatcttccgcaaaatcgacattttgattcagaagttctgcgataaaaacaagataacctacaccagatatgccgacgatctgctattttccacaaaaaaggagaacaatatcctatcgtctacgttcttcattaatgagatttccagcatactctcaatcaacaagtttaagctgaataagagcaagtacctttataaagaaggtactatctccttaggcggatatgttatcgaaaacatactgaaggacaacagtagcgggaacattagactgagctcttcaaaactcaaccccctttacaaagctttgtacgagattaaaaagggctcctcatccaagcatatatgtatcaaggtcttcaatttgaagctgaaacggttcatttacaagaagaacaaggagaaattcgaggacaaattttacagctctcagctgaaaaataagctgttaggatatcgcagctatctcctcagttttgtaattttccacaagaagtacaagtgcataaacccaatttttttggagaagtgcgtgtttcttatttcagagatcgagagcatcatgaataggaaattctga

SEQ ID NO: 12262 - RNA, 1113 nt, unidentified
  source 1..1113: mol_type = other RNA; note = synthetic construct
atgaaacacaagatcacaaagatttccagtgacttctacaagaatttttacctgcgtgaaaccttctcagatgatgtcattatgcattgcggggttcccaatatcacaagcaacgactacaagtcgatatcattcaataacaggatgtttttcagcatcaagaataactcccctcataaaaagattcaggaacggttgatcaaaaattttcttcagaagattcccctgagttcacctgctatcgcatacagaaagaaactctcctatctgcactttctggagccacatgtacatggcgaaagcttttgtcgcatcgatctatgcaacttcttccacaatattaactacgactttgccaaagaatgttttcagtcatactttgaggacgagttcctcctggataagaaaatcaaggtgattgatgccttcctgaattccttatctatcgagatggaaatctccagtgggaaaaaaaagatcttccccatgggctttgccacttccccgtttattagcaacatcatattcaggaagttggacattcttataaagaacttctgcgataagaagagcattatctatactcggtatgccgacgatatgttgttttctggatcagggacggataaactgctgggtagtgagcacttcgataaagagatcgcttctattatatccatcgccggtctatccctcaacatgaacaagaaaatttacaagaggggaattatctcgctgaatgggtatgtgatcgaaaataacaacggcggaggcgaaagaggatctttacggataagcaatggcaaaacctatcttattagaaaagcgctcaagaaatacaagaatggtgacagtaaagagattatctgtaagaaggtgttcttggttaagaaaccatctatcaagtacaagaagaacatcgacctgttcgtcaataagttttacgactcacaatttagcaacaagctcgctggctatcgcagctactttatatctctcatcaaattcaacgacaagtatcgatgcttcaaagatgacgagatcgcaaaatatagcgcaattatagaggagataagttctgtgctgcttaaatcccagcacaaaattaaatga

SEQ ID NO: 12263 - RNA, 1098 nt, unidentified
  source 1..1098: mol_type = other RNA; note = synthetic construct
atgaaacataagatcaacaagatcaacaacgatttctacaagaacttttaccttcgcgaaaccttttcagacgatattataatgactcatggagtgcctgaaatatccaatgacgactataagtccattagtctcaaaaataggctctgcttcacaatccggaaatcttcccctcataaaaagatccaggagcgcttaatcaaaaactttttggtcaaggttccccttagttccccagcaattgcttatcgcaaaaaactgaactacctgaactttctggagccacacatccacggagagaatttttgccggatagatttgtgtaacttcttccacaacattaactacaactttgccagagagtgttttaagagttatttcgaggacgaatacttggtgaataagaagattaaggtgattgacgcatttctaaattcactcagcatcgaaatcgtggtgaataacaagaagaagaagatctttccgatggggtttgctaccagccccttcatatctaatatcatcttccggaaactggacatactgattaaatctctgtgcgacaaaagaagcattatctatactcgatacgccgacgatatgctgttctcgtcaagtgggaaagataagttgcttggcagcgaacactttgataacgagatcagcacaattgtaaatacagccggcctgtcgctaaacaagcacaagaaaattttcaagaaggggatcataagcctgaatggatacgtcattgaaaataagaatggcggaggcgagcgaggttctattcgtatttccaatggtaagatgtatctgatcaggaaagccctcgacaaatttaaaaagggctacagcaaagagcacatttgcaagaaggttttttctgtaaagtcacccaccgttaagtataataacaatgcagatcagttcgtcacggatttctacaatagtcaattcagcaacaaactcgctgggtacagatcttatttaatctcactggtgaagttcaacgataaattcaggtgtttccatgagaatgaaatcaccaaatattccgtgatcatagacgagatctccaacgcgctccttaaaccttga

SEQ ID NO: 12264 - RNA, 1098 nt, unidentified
  source 1..1098: mol_type = other RNA; note = synthetic construct
atgaagcataagattacgaagatcaactcggacttttataaaaacttctacttgcgggagacattcactgatgatatcattatgactcacggtgtccccaacataaccaatagcgaataccaaaacataagcttcaacaatcgtgtcttcttttcaatcaaacagagttcaccgcacaagaaaatccaggagcgcattatacggaatttcttacagaaagtccctttatcctcacctgcgatcgcctacaggaaaaaactttcatacctgcattttctggagccacacatctatggcgagaatttttgcagaatcgacttgtgtaactttttccacaacatcaactatgactacgcacgggaatgcttcaagtcttacttcgaggatgaatatcttgtcaataagaagatcaaggtggtagatgcctttcttaacagcctgagtgttgaagtggagctcaacgataagaagaaaagaattttcccaatggggttttcgaccagtcctttcatctccaatatcgtttttcgaaagctagatgtgctgattaagaacctgtgtgacaagaggagtatcatgtacaccagatacgccgatgacatgctctttagctctagtggcaaagacaatctcctggggagcgagcattttgacaaagagatcagctctattgtgaatatcgccggcctaaacctgaacgtgcacaaaaagatattcaagagggggatagtgagcttgaatggatacgtgatagaaaataaggacggaggcggtgagagaggatccttgcgcatttccaatggaaagacatatcttattcgcaaagcactcgacaaatacaagaaaggctatagcaagaagcatatttgccaaaaggttctgtccgtcaaacccccctctgtgaaatataagtccaatgctgatcagttcgtaatggaattttataactcccagttccataataagctggctggttatcgatcttacctgatttccctcgttaaattcaacgaaaagttcgggtgttttcacgagaaggagattacaaaatacagcgctatcatcgacgaaatttcatctgtgctcctgaaatcttga

SEQ ID NO: 12265 - RNA, 1098 nt, unidentified
  source 1..1098: mol_type = other RNA; note = synthetic construct
atgaaacactccatcactaaaatcaattccgacttctacaagaacttttacctgagggaaacatttggggacgatattattatcacccgcggcgtcccaaatatcacaaatgacgactaccagaagattagttccaacaatcgaactttcttttccatcaagaattcttcacctcataagaagatccaggagcgcctgattaggaatttcttgcaaaaggtgcccttgagtagcccggccatcgcctatcgaaaaaaactcagctatcttcactttctagagccccatatttacggagaaaacttttgtcggatcgatctctgtaatttcttccacaacatcaactacaacttcacgagagattgttttaaatcgtacttcgaagacgagtatcttgtgaacaacaagattaagttgatcgatgcttttctcaactccctgagcattgagatagactttaacgacaagaaaaagaggatatttcctatggggtttcctaccagtccattcatcagcaatatcatcttccggaaactcgatattgttattaagaacctgtgcgataagcgtggaattacctacacaaggtatgctgatgatatgctgttctcttcttcaggcaaggataaactgctggggtcagagtacttcgacaatgaaatctccagtatcgtgaacatggcaggcttaagcctcaatactcacaagaagatcttcaaaaaaggcattgtctccctgaatggttatgttatcgagaacaaagacggtgggggcgaaagaggtaatcttagaataagcaactggaaaacctacctgataagaaaggcactggacaaatataagaagggatactctaaagagcatatatgcaagaaagtgttttccgtgaagaaaccctctgtacggtataagaaaaacgccgccgcgttcgtgcagagtttctactcatcgcagtttagcaataaacttgccggatatcgcagctatctgattagcttgattaagttcaatgacaagttcgagtgcttttcaaacgaagagatcgcaaagtactctgctataattgaggaaatatccgaagtcttactaaagtcttga

SEQ ID NO: 12266 - RNA, 1098 nt, unidentified
  source 1..1098: mol_type = other RNA; note = synthetic construct
atgcgacaccagataaccaagatcaactcagacttctataaaaacttctacctccgggagacattttctgatgacataattatgaccgacggcgtgccaaacataaataaagacgactaccagcacatccttttcaaaaaccggatattcttttccatcaagattaatagtccccatcgcaagatccaggaacggctggtgcgcaatttcctccaaaaagttcctctgtctagtcctgccatagcatatagaaagaagctgtcctacctgcattttctcgagccccatatttatggggagaaattttgtcgtatcgatttgtgcaaattcttccacaatatcaactacgatttcgctaaagagtgttttaagtcctactttgaagatgagtatcttgttgacaagaagattaaagtcgtggatgcctttctgaattctgtgagcatcgaaatagatctcaacgggaagaagaaaaaaatattcccgatgggcttttccacttctccattcatttcaaacattatcttcaggaagctggacattctgatcaagactttctgcgataaaaggggcattatctacacccgctatgcagatgacatgctgtttagctcactggggaaagacaagttacttggaagcgagtattttgataaagaaatctcgtacatcgtcaatatggccggactgtctttgaatacgcacaaaaagatcttcaagaacagcatcatcagtctgaacggctatgtgattgaaaataaggacggttcaggcgaaaggggacgactgagactaagcaatcggaagacatatttgatcagaaaagcgttagacaagtataagaaaggtgaatccaaagagaacatctgtaagaaagtattcctcattaggacacccagcatcaagtacaaatccaatgcttctctatttgtctccaattactttaagagccagttcaataacaagctgagtgggtacagatcatacttgatcagccttatcaagttcaacgataagtttaactgctttgaggatgacgagattattaagtactcgaacattattgaggacatttcgaaagtgttactcaagccttga

SEQ ID NO: 12267 - RNA, 1098 nt, unidentified
  source 1..1098: mol_type = other RNA; note = synthetic construct
atgaagcataagatcacgaagataaatagcgacttctacaagaacttctatctaagagagactttcagtgacgagatcgtcagcagtagaggtgtgcccaatatcactaatgacgactaccagagcatatcactgaacaaccgggtctttttttcaatcaagaaaaactctcctcacaaaaagattcaggatcggctcattaagaacttccttctgaaagttcccttaaatagttctgcaattgcctaccgcaaaaaattgtcatatctccatttcttggagccacacatctacggagaaaacttctgtaggatcgatttatgcaactttttccacaacatcaactacgattttacaagggagtgtttcaaatcgtattttgaagacgaatacctgatctccaagaagattaagctgatagatgcgttcctcaatagcctcagcatagaggtggagttgaacaataagaaaaagaggatctttccgatgggctttagcaccagccccttcataagtaatataatctttaggcggctcgacattcttatcaaaacattttgcgacaaacgttctatttcatatacacgttacgctgatgatatgttgtttagctcttctgggaaagataaaatccttggctccgaatatttcgacaaggaaatttcttccattgtctcgattgctggcctgagtctgaatacccgaaaaaagatcttcaagaagtccatcatttccctgaatggatatgtgattgagaataaaaacggggggggagaaagaggcaatctacgcatcagtaatcggaaaacctacctgatccgcaaagccctggacaaatataagaaggggtactctaaggaatatatttgcaagaaggtgtttagcgtgaagccacctgtaattaagtacagaaataatgccaccctgttcaaaaaggagttttataactcccagttttccaacaagtttgcaggttaccgatcctacctgatctctctgattaaattcaacaacaagttcggctgtttccaggataaagagatcactaagtattcagtgctgatcgaggaaatatcacaagttcttctcaaatcctga

SEQ ID NO: 12268 - RNA, 1131 nt, unidentified
  source 1..1131: mol_type = other RNA; note = synthetic construct
atgttcaagaagctcaatagtaaggacttgcttaatattctcagcagcgactcccaaagcagactggtggttctgacacagtcatggccaatgttaaatgtggatgatgtgaagaccctgaagttcaacaacaaaaccttcttctctttagtttcccgagtggaacgggatggatacttgaaaaagctgaacttgagtttcctttccaagattaaaatcaacagcgcttctgtcgcatacaaaaacggaaaatcatacctggacttcttctctcctcatgtggagaattataatttcctgaggctcgacctaaagagctttttccactcaatctcctatgaaatcattaaggaaaccttcgagagttatttcctagacgaatattttgtcgacaatggaaaggagaagggaaaagagaaaatcatagacgtctttctgaacctggtaatgctgaatgtaccctccagttatggcgattcctttatctcgggtagacggatcctgccgatgggcttctctacatcccccctgattagcaatattgtgttcaggcgatttgacatcgtgatacacgagttttgcgaaaagcacaatattaagtactcaagatacgccgatgatatgttgttcagctcaaacatttcagacaagactctgtttagtaaccggtttcatgaagagattaaatacatcctgaaccgcggcgggtttaaactcaataacgctaaaacgattcagtcaaagggggttctaagcgtcaatggttacgtgatagacagctatttagagcgtaagggcctgagactcagttccagcaaactcaagaacattaacaaaatcatccacgcgttgaagaaagggtggagctatgagattatacttaagaagtatgccaagaaagactttgataagactaactactacaacaagggtatctctaagtataggagtgaatacgagaaatctcagatactcaatctgcttgtcggctaccggtcctacctcatttcttttcatgaattcgatcgcaaagacaggtccatcgataatgattttctggttgtgtctgggaaaatcatcaaatcgatagagaaagccatcaacaagatctataaggatcgcaaactttga

SEQ ID NO: 12269 - RNA, 1125 nt, unidentified
  source 1..1125: mol_type = other RNA; note = synthetic construct
atgaaaagactgagtcgccctgagtttatcaacctgatagataatgacactttcattgagttcacagcagggaaaatttttaacattccatcctctggagttgtcgagtttcagctgtccaataagtttttctacaagttgcgaactgatattaagctctggtccttcttacgcgtaatccattctaaccttaacaagaacttcttgaagaagattagccttaatagttctgctatcgcttttagatcaggactgagctatattaactttttttccccacacatagagaattacttctttctgagactggacatcaaatccttctttcactcgattagtaagaatctgatcaacaacgtgttcagctcatatttcagggacgaatttatcgataagaattcccagattagcctcttagaatatttcatctttctgacaacgctatacatcgatgaaacttacaagaacaaccagtttaagtaccagtatatcctacccatggggttctctaccagcccgctcataagcaatatagtctttaggagtatcgacatccaaataagcaatatctgcctggagtatggtgtcacctacacacgatacgcagacgatatgttgttttctatgcctaaaaatgcgaatccccatatccaaaccgatgtgttctacgtgtctataaaatccatcttatccaaatacggcttcttcattaacaaacacaaagtgatttcgaagaagaacactatcagtatcaatggctatacacttcagaatacgccaaatatgtgtgaattccgggtgtcaaataagaagatcaagatcatccagaagattatctatgagtacaacaagaacaccgaaatatcagccattctgaagaagtgcttcaagtataacatcatcaaacggtttaccacccctgagaaagtgcccaataatctggttgaaaagtataacaagcaccagcttattaacaaaatcgccggctacagggccttcctgctctcattcatactctttaatcatcggtctaaactgatgagcattgagacaagcaacaaatatctcaacctgattaacgaattggagaaaattatgcgtaacatttacctcactttggactga

SEQ ID NO: 12270 - RNA, 1098 nt, unidentified
  source 1..1098: mol_type = other RNA; note = synthetic construct
atgaagaagcttgataagaagctgtttttcgacatcctcaatatcgaagagcaggttcttaatcccttcgtcgaagaccaggtgtcatcgtttaaaattggccgcaaattcgtatacgccctgggagataggtctagggaaaaattgtaccagcaggaattaaatcaacggtttttgtacaagatcccactgaacaacgcagctaaggccttccggaagcatacgtcctattttgacttcctcgaacctcatagatataactacaatttcctgcgtctggatattaaaagctttttcccctccattactaagcccagtattgttgagacattttcacattacatcgaggacgaactggtggtggacgacaccggcgaaaaactactactgaattgctttgtggatttagtcaccttcactatcccgtcccactctgcaaatcgaaagttcgccggagagagcgtcttgccaatggggtttgtgacaagccctgcgatctctaacattatctaccgcaagcttgacataatcattcagaagcattgcagcattcacggcatagaatattcgcggtatgctgacgacatgttgtttagctcactcgcctcttctagttacatacactcaagatccttcctggatttcatcagccagctcctgctcaagcacggatttgagctgaacaagcgaaagagtatctacaaaaagcacgtgctgagcctgaacggttatgttatagagggggccaggagtgattttccttctggcgatatcagactttcccacaagaaactgaagcttctcgacaagctgatttatgagctgggtaacgggaaaagcaatagtgaggtcctcaaatcagtgttcagcttagagattgataaagtgaatttccccataccaaataccgaacaagagtttaaagacgcatactgtaaggatcagctgctcaacaagattggcggatacaggagctacttgatcgctttcatcaaattccttatgctgaacaacatttcctccagtgtatccatggaacgctattcagagctattgatcaaactcgagaaagagtattccaagctgcataaatcttga

SEQ ID NO: 12271 - RNA, 1107 nt, unidentified
  source 1..1107: mol_type = other RNA; note = synthetic construct
atgcacattatcgacaaaaagttcttcaaaaccgcgattgcttcgaaagatttgttcgagaatgacattttccctccaattccgtcaaagtacgtgttcgagaagaagctgaaaaagagatacgtgtactcactcaaaaaagactcagccatcttcaatgcacagcagaacattattgacctgttcctccgaaagatcgatgttaataattgtgctgtgggatttcgaaaggacaagagttacttgaactttcttgagccccatagcggcaactactattttctgcggttagatatcagaaacttcttccacagcattgatgaaaagctgctgaaagattgctttagcccctattttaaggatgaatttatcgatgctgagaacaaacagaagttgatctccagttttctgaatcttgtgacattccacgtgggtaaaagttacggaaatatagactttgtagggaagaagatcgttcccgtgggctttcctagctccccatttataagcaacatttacttccggaacattgacgtgatacttcagaaactgtgcgccctacatgatatcacatatactagatacgcagatgacctgctcttctcttccagccgtgataataagttcgttcactccgactcatttgagaaagaggtaaaggtcatcttgtcctctcggaaactcaaggtcaatgaaaaaaaaatcgtgaaagccaagcacaggatttctctaaacggttatgtgatccaatctactgcactcgtcaataataaaaacgacaacaatgtctctggaatctttatctccaacaagaaaacgagcatcctgaaaaaggtcctgcatgaattcgaatcgaaacctgttaactataccaagataatggagcgcatctttaaggagaagattcgccaggaggactttttctaccccattaccttagacttcaaaaagaagtactacaagacacaagctaggaataagatctgcggctttagggcctatctcataagtttcatcaagttcaacgccatttatgggtgtattccagaatgtcgcatacaggcctataaaaagcttatctgccagatagatacctttctggtgtga

SEQ ID NO: 12272 - RNA, 1107 nt, unidentified
  source 1..1107: mol_type = other RNA; note = synthetic construct
atgcacatcattgacaagaatctgttcaaaaccgagattgccccaaaggaccttttggaggacgatgtgattcctagcataccatactcatccgttctggaaaagaagatcaagaaacgctacatctactccttgaagaacaagtctcccgcactactcgcacagaggaacctgattgaggtacttttgagacgaattgacctcaatgactctgctgtcggctttcggaagggcgcctgttatttaaacttcctcgagcctcattctaataattatcatttcctgcgctttgacattaaaaacttcttccactctatcgatgagaagttattaagagattgctttagcagttacctgaaagacgagtgcattgatcccgggaacaagcaaaaacttatcagttcctttctgaacctgattctgtttcacgttggcagctcctttgggaatgatgatgataaaggaaagaggatcctgcctgtcggtttcccagcctcaccctttgtgtccaatattttcctgaggaaaatcgacatcataattcagcggacctgtgcgctgcacaatgtgacatatacacggtacgctgatgacatgctgtttagcagtagtcgtgctgataaatacattcattccgactcattcgaaaacgaaatcaaagtgatactgtctagccacaagctaaagattaacgaaaagaaaatcgtgaaggcaaaacaccgaatttcactgaatggctatgtaatccagtcctcgtcactcaccaacagaaaaaatgtcaatgacatatctggtgtcttcataagcaacaagaagataatcaagctcaagaagatcatccatgaatttaacaagaagcctgtggattacactaaaatcatggaagggatcttccgcgagaaaatcaaaccaagcaatttcacctttcccattactggaacatttaaacagaagttctacaaaacgcaagttcggaataaactctgtggatatagagcctatctcattagtttcgtgaacttcaaccttaggtatgactgcattccggacggcaagatcgagttgtactccaagcttatcaacgagatcgatgtgataatcaaatga

SEQ ID NO: 12273 - RNA, 1107 nt, unidentified
  source 1..1107: mol_type = other RNA; note = synthetic construct
atgcatataattgaccggaaccacctgaaaatcagcatccttccaaaggatatttttgtagatggaatcgtgaatcccatcccttcttctgccgtcacagagaagaatgtgaaagggagatgtgtgtacatcctggaaaagaacagtgactacgccattgcacaacgcaatttagtcgagcagttcctgtcaaaaatcgaggttaataattcggctaaaggcttcaggaagaatctgtcttacctaaattttttggagccccatgcctcgaactactacttcctcaggctcgacgtgaaaaatttcttccatagcatagatgagcggttgctgaagaagtgtttcttcatctacttcaaggatgaattcattgacagcaacaacaaacagaaacttcttgacgcttttatgaatctcatcaccttttatgtcccttctagttccaaaaacataaactgcaaggaaaagcggatcattccagtgggcttttcctcaagcccgctgatatcaaacattttttttcgctctatcgacattcttcttcagaagctgtgcattgcgtttaatataacctacactagatacgccgatgatctcctcttctccgcagttagaggttgtgaatacattcacagcgattctttcgagaaagaagtgcgtatcattttaggcactatgtccctgaagattaacaacaacaaaatcatccgcgccaagcaccgaatttccttaaatggttatgttattcaggcacgaagtttgagcaaaaaaaaaagcgctaacgattacaatggggtattcatatccaataagaagacagagacaataggaaaagtgctgtatgagctgagtctcaactcagtggactacaagaagatcatggaaaaaatcatcgggaacaagatcaagatctccgattttaactatcccctgacctacggcttcattatcaagtattataagacgcaaaccaggaattatttgtcaggatacagaagttatctcatcagctttctgaagttcaatgagatatataggtgcgtccctgacattaaaatcaacgtctataaagacctactggacaagattgacaagtttctggtgtga

SEQ ID NO: 12274 - RNA, 1125 nt, unidentified
  source 1..1125: mol_type = other RNA; note = synthetic construct
atgcttaataagatcgacaagaactacttcgttaacaatatcctgaacagaaagattgacatcatcaaagacggcgaaattaaaagcattacctcagataacgtgattgaatttacagtgaaagacaaactgctctactctctggggaatggaaatttatactctttcccccaaaaacggatcaatgatttcctattcaagttcataccattcaacaatgctagcaccgctttcaagaaggacttctgctattttgatttctttaagcctcacattggaaacagtctttttcttcggttagatatcaagagctttttccatagcattaacattgataagctcaaagacgtgttgaataagtacgtcgaggacgactttattgacgagaaaaaaaaccagaagatcattgattccgttattaacatcatctccttggacattactttgaactccaagaacaagtactacattaacaagaagatcatccctatcggattttcaagtagtccattgatatcagatctgtactttaggagaatcgatattctcatacagaaaatctgcctaaagaactccattacttacacaaggtacgccgacgatctcctgtttagcgcagcccatgaaaataattacgtccgcaaaaattggataggttttacagaggagatacgcaaactcctgtattacttcaacttcaatctcaacgataagaagactatccagaaaaaggggctgctttctctgaatgggtatgtgatcgagactagactctcaacaggtaacaataagctcattttttccgagctgcgattttccaatgagaaactctctaaactgatcagggcaatttatcacctggaagtattaggcaccagtcccaccgtgataatgatcagcatattcaaagagaagatcaaagacttgaagttcaaatatcacatcacgccggcgttcgccgcccgacattatcggtatagcctgctgaataaactaaggggctatcgttcttttatcatctcgatactgaagtacaacatcaagcacaatattcttaacaagaagaccaaggagaaatataaactgctgaccgaaaaacttgaacgcgaaattttgaagctgtga

SEQ ID NO: 12275 - RNA, 1119 nt, unidentified
  source 1..1119: mol_type = other RNA; note = synthetic construct
atgttgaaaaaaatagatcgcaactacttcaacgacatcatacttaacggtaaaaaagacatcatctccgatggtgaggtaaaaactatcccctctgactcaattaaggagttcagtgtgaaaaacaagttcttctatcagctgtccgataagagcatctacaaaaagccccagcagatcattgcagagttcctgagtaaacacgctacatcaaacaatagctcaattgcgtttaaggcaggcctgtgttattttgattttctgaagccacacctcaataattcgagattcctcagactagacattaaatctttcttccacagcattgacatagaaatgctgaaaaaaaccctgtcacattacatagaagacgattacatagacgacatgaagaaacagaagattatagatgccctgatcaatattgtgacaatcgagaattcagaagacctgaatatcaagattaagaaaggctccaagtttttaccaatcgggtttaccagctctcctctccttagcgatgtcttttttcgcaagattgacataatcattcagaaattgtgcgttaaacactctatccagtacaccaggtatgccgatgacttgctattttctgtgtcgcataaaaacactttcatcaataagaactgggaagggtttaccaatgaaatcgagaagattgtgaattacttcagactgaacattaaccggaaaaagacaacgatccgaaagggcttaattagccttaacggctacactattgagacaaagatgcttaacggagccatcttgaacagtgaggtccggctgtccaatgataaactctctaagctcacaaggactatatatcatctggatacgctgggaagcagccctaagaagatcattaacattgtgttcaaggaaaagatcgagaatatcgagttcaagtataaagctacccaatcctttattgaacgtcactacaaatttgtgctcatgaataagctgtgcggataccggtccttcatcatcagtattctcaaatataactccgggaagaagatcctgaatgagaagtccaagcaaaaatatgagaacatagttagtaccctggaaaggcttatcttagtcttgtga

SEQ ID NO: 12276 - RNA, 1158 nt, unidentified
  source 1..1158: mol_type = other RNA; note = synthetic construct
atgatcaagcttaatagagagttctttacttccgacattatcgtgctgaagaattccgagtctggactctctgagttcataaactcaaacactatcccttgggacaatgtaaccgagatcaaactcaaaggcaagtactattatagtttcagcaaacggatagtccataatattgactacgtgaaatctcaacggaacatctatgactactttagcaacgtaatccccttaaataacaactcctttgcgtataagaaggaaacctgttatctggattacttaaggccacatataggcaactactttttcctcaaaatcgatattgcaagcttctttcactctattaaggaatcatacgtgcgcaagctattctacaactatatcaatgacgaattcctcgacaatgataaaaaatgtagcttgatcgatgctcttattaaacttacctccatcgatattcctagcgagtcgaagaatatatcctatgttaacaaacgggtctttccaattgggttttccagttctcccattatctcagaaatttatttccgtccgattgacgtgttgctcatgaaactgtgcagtgatttcgaactgacttatacacgatacgctgatgacatattaattagcggtggcatcaataataagtacatagccaacaattgggactttatctacaatcggattttcgaaatcttctcatactataagctgaagatcaacacgagaaagacgataaataagaagaaatgcctgagcatcaacggatatgtgctggaatcaatgtactatgataacaggctcttgttttctgagctacgcatttccaacttcaagcttaagaagatcaataaagccttgttctacctggaggagaacacatacatcaagaacgaaaccattaagtatgtcatggagaaagtgtttaacagtaaattcaagaaggacaagttcaagtacaccattacacagagctttatcgatcgacactatgttttttcgctgacaaataagatgagggggtttagagcctatctgctcagtttcataatctacgatcgcaaatacatgatcctgcagaaagagactaaagacaaatacctgaagatcattggtagaatcgagcttattattgacaggctgctgaagaaatga

SEQ ID NO: 12277 - RNA, 1149 nt, unidentified
  source 1..1149: mol_type = other RNA; note = synthetic construct
atgaataagattactaagaagatcctgatcgaaaaaatcttgttactaagcaaggatgagattgatgagttttaccaagctgaaattcctgattcgaatgttgtcgagaagaagcacaaaaacaaattcatgtacagcctgagttatagctcaacctttcgcaaaatccagtctaatattaacagtgctctgaatccccttctcgacctgaacaattctgctatagcgtacagaaccggtttgagttatttcgatttcctcgaaccccatgccaaaaattatcactttctcaggatggacattagcctgttttttcactcactgaacatagacgacgtgaaggaagccatttcacagtacatcgacgatgatatcattaacacaaagcacaaccagaagttgatcgacgtcataatcaagtgcatctcttataagattcccaagaagttcaaaaacaccaaccttcacgataaaaccattctgcctatgggattcagcacctctcctatcatttctaacataacctttcgcaagatcgacatcctgatccagaaactgtgtgccaaattagatatcacatacacgcggtatgcagatgacatgctattttctacgccgcgggacaagaagataatccattccgaatttttcctcaaagagatcaaaattctcgtatccctgctgggcttaaagatcaacgcaaagaagactatcgtgaaatcacatacaattagccttaatggctacatcatacagaatcagatccgactaactggattcgcagggctgttctcaccaatatcgccagccgagattagactgagcaataagaaaacagccattatcgataagctgttgcaccatattctggttaaaaaatccgattccgatgtgatactgaataagctttttaaagaggacgtgagggacctgatgcatcacggtaacaaagagaaatacgtcaaggaatatagtttggaccaaatcctcaacaaacttacaggctatcgttctttcctcctttccattatttcccacaataagaagttcaatagcacttccgtggggactatcaaaaagtacagttccaagatcaccaagattgagaaatgcataaacatcctcgacaaaaagaagatttacacatga

SEQ ID NO: 12278 - RNA, 1149 nt, unidentified
  source 1..1149: mol_type = other RNA; note = synthetic construct
atgaacaagattaccaaaaagatcctgatcgagaagattttacttctgtcgaaagatgagattgacgaattttatcaggcagaaattcctgacagcaatgtcgtggagaagaaacacaagaataagttcatgtactccctctcgtactcttccacatttcgtaagatacagtccaacataaattcagcgctgaatcctctgctcgaccttaacaatagcgccattgcatacagaacaggactgagctattttgattttctcgaaccccatgccaaaaattatcacttcttacggatggatatcagtctgtttttccacagcctgaatattgacgacgtgaaggaagccatttcacagtatatcgatgacgatataatcaacacgaaacacaaccagaagctaatcgacgtgattatcaagtgtatctcttacaaaatcccaaagaagttcaaaaacactaacttgcacgacaaaaccattcttccaatgggcttctctactagtccgatcataagcaacataaccttccgaaagattgatattcttatccagaaactctgcgctaaactagatatcacctacacaaggtacgcagatgacatgctgtttagcacaccccgcgataagaagattatccattccgaattcttcctgaaagagataaagatccttgtctctttgctgggtctgaagattaacgccaaaaaaaccattgtgaagtctcacacaatatccctgaacggctatatcatccagaatcaaattcggttaactggttttgctgggctgttttctcccatcagtcctgctgaaatcagattgtccaataagaaaactgccattattgataagctcttgcatcacatactagttaagaaatcagacagtgatgtaattctgaataagctcttcaaagaggatgtgcgcgacctcatgcatcacggcaataaggagaaatatgtcaaagagtactccctggaccaaatcttgaataagctgacaggatataggtcatttctgctctcaatcatttcccataacaagaagttcaactctaccagtgttgggactatcaagaaatacagcagcaaaatcaccaaaatcgagaaatgcattaacataatcgacaagaagaagatctacacgtga

SEQ ID NO: 12279 - RNA, 1149 nt, unidentified
  source 1..1149: mol_type = other RNA; note = synthetic construct
atgaacaagatcaccaagaagattttgatagaaaagatcctggtcctgaacaaggatgagattgacgaatatttccaagcagagattcttgattctgacgtcattgagaaaaagcacaagaacaagtttatgtactctctgagctatggtaataaatttcgcaagatccagagcaatatcaatagtgaactcaatcagatactggaactgaacaactccgctatcgcctataggaccggacttagctatttcgactttttggagcctcattcaaaaaactaccatttcttgcgaatggacatttcctccttcttccactctcttaatccagaggatgtaaagagttctctgtcccaatacattgataacgacgttgtaaacgaaaaacacaaccaaaatctgattgatgtgattctcaagtgtattacttacaagatccccacaaaatgtcagaataaaaaaatccacgaggccatcatcctccccatgggcttctccacaagcccgctaatttcaaacatcgtgtttaggaagattgatatcctcattcagaaactgtgcacaaagcttgacgttacttatactcggtatgccgacgatatgctgttcagtacccccagagataagaagattattcacacagacttcttcctgaaagagataagtatcttagtgtctctacttggcttgaaactgaatacaagaaagacgatcatcaaaagtcatactatcagcctcaatgggtacatcatacagaatcaggtgagactcattggttttgcgggactcttttcgccaatatctcctgcagaaataaggctgtcgaataaaaaaaccgctgtgatagacaccctccttcatcagatcctggttaagaagaatagcaataaccagatcctgaaacacttgtttaaagaggatgtccgcaaactgatgcgtcatggcaataaggaaaaatatgtggaggaatacagccaggatcaaattttaaataagctgaccgggtaccggtcatttctgctctccattatctcccacaacaacaagttcaactcaacttcattagacaccatcaacaagtacaagagcaaaattacgaaaatcgagaagtgcataaacatcctagacaagaagaaaatctacacatga

SEQ ID NO: 12280 - RNA, 1149 nt, unidentified
  source 1..1149: mol_type = other RNA; note = synthetic construct
atgaagaaaatcactaagaagatcttgctggagaaaatcctcctgctaaataaggacgagtttgacacgtttattcaagtggaaatccctgattcagaggtgatcgagaaaaagcataagaacaagttcatgtactcactgtcatacgcttccaaattccgtaaaattcagtcaaacatcaacagcattcttaacagtaccattcagctgaacaacgcggcaacagcctatagggccgggcttagttatttcgatttccttgaaccccatgtgggtaactaccattttactaggctggatatttctagcttcttccatagtcttaaggtagaggatattaagacagctttggagcagtacgttgaaaatgacactctcaacgaagaacacaatcagaaactgatagatgtcatcttaaagtgcgttacctacaaagtgacgaaagaaagtaacaataaccgcattcacgacaaggtgattatacctatgggattttctacctcccccgtgatttccaatctggtctttcgaaaaatagacatcatcattcagaagctctgtaccaagttagatatcacctatacaagatatgctgatgacatgctctttagcgccgctaagaacaaaaaggcaatccatagcgactacttcataaaagagatcaagatactggtatctctgctcggcctgaaactgaatgaacggaagacaatcaaaaagagccacacaatatccctgaatggctacatcatccagaatcaagtgaagttgtctgggttcaaaggactttttagtccaatatccccagcagagattaggctctccaacaaaaagactgtgattattgacaaactcctacaccacattatggttaagaagaacaatcacaatgacatcctgaagaagttgtttaaagaggacgtccgccatattatgcggtattcaaataaggccccgtatatcgataaatatgccaaggaccagatcatgaacaagttaaccggctacagatctttcctgctgagcatcatctctcacaacaaaaagtgcagcagctcctcgaatgagacaattgaaaagtacaaagccaaagtcgtcaaaatcgagaaatgtatcaagactttggataccaataagatacacacctga

SEQ ID NO: 12281 - RNA, 1146 nt, unidentified
  source 1..1146: mol_type = other RNA; note = synthetic construct
atgaaaaagattacgaagaagattctgttggaacagatcctcgacgtcaaaaaagaagatatcgatgcattcctccagaataatatcaacgatagtgacgtgtctgagaagaagattaagtccaaatacacttacaccattaacgacaataagctcaaaaagatccaatcaaacatcaatgagttcctgacccaaattatagatcttaacaatgccgccatcgcgtaccgaaaaggcttgtcttattttgacttcatagagccccatgccaaaaattaccactttattaggatggacatcagtagctttttccacagcctggatgttaaagacattcaggaagccctgtaccaatatgtggacaatgatgtggtgaacgatacacacaatcagaaactgatcgatgtaataatgaactgcataacctatacgattccaatcactgctaacaacgaaaagtaccataatattaccgttcttcccatggggttttccacctcaccactcattagcaatctgatcttcagaaaaatcgacatactgattcagaagttatgtaccaaactgggagtcatttatactcggtatgcagacgacatgctgttctctgctccttttgacaaaaaaatcgtgcacagtgagtttttcatcaaggagataaagatactgatctcccttatcaaattgaagctgaacaagaacaagaccattattaagtcacatacgatttccttgaacggctacatcattcagaacaagatcaaggttaatggaataagaggtctattcatcgagcctacaccgagtgaaattcgcttaagcaacaagaagacaatcatcatcgataagttattgcactacatcgaggtcaaaaaaagcaagaataacatcatcctcaagaaactgtttaacgaagatgtacgggaccttatggtgttctctaacaagaagaagtatatcgatgactattctcttgatcagatactaaacaaactgactgggtatcgttcatttctgctcagcattatcaagtacaatgagaaaacgaacatcacctccaatacgactattcagaagtaccagaataagataaagaggattgagaagtgcattaattcgctcgacaaaaacaataagtacacatga

SEQ ID NO: 12282 - RNA, 1173 nt, unidentified
  source 1..1173: mol_type = other RNA; note = synthetic construct
atgtataagatcaataagaagtacttcctgacttacctgcagcccataattgaaaaggggatagtcacaaccatcaaaaaagagaaggtgaaagagtataagttggggaaacactatttttacgagattaccgacgagaaaatcaggtatattcacgagtggctaaataagtcttttcagaagaacatagaccttaacaattcaagcatcgcctatcgaaagggatacagctatcttaatttattcgagccacaccgccataattattactttctcagactggacatcaagagttttttccattctatccaaatgtctgacatcatcgctgtctttgaaccttatttcgataatgaacacatcgatgagaaaaagaagcaaaaactcattgatggctttattaaccttgtgactttcaaaatccctgtgtcctttaagaacaaagaattcaagtctagccggattctgcccataggttttataacttcccctgtcatctctaacatcattttccgtaaaattgacctcctgattcagaaattctgctccgaaaagaacataatttacacacgctattctgatgacatgctgttctcaagttccaacaattcaaaatacttgcatagtgaggatttctacaaggaaattagcattttcctgaacatcatgaactttaagctcaatcagaacaaaaccctatacgccacgcatacactgtcattgaacggctataccttgcaatattccaatcagccgaatagcaagaatgaacagttaatcaatgagttcagactgagtaacaagaagcttctgatcattaagaagatgatatacctcatcaacaagcaggaaaaatccccaaaattcatcctgaacaagctctttaacttcggaatcaataaactcagcactaaatatcccatagagagcaagaatgtgaaggaaaaatattactacgaccagctgctgaataaacttaccggctacaggtcctacgttttatcgattgtggtatttgataagaagcacgattgttgccaggacaaaacgattgataaatacaccgatatcgttgaagacctgaacaagattatcaaacggtacatcaagaaaatcgagacaatttcaaagaagatcgaggacgagattaaagagagtgagagcgcaaaatga

SEQ ID NO: 12283 - RNA, 1077 nt, unidentified
  source 1..1077: mol_type = other RNA; note = synthetic construct
atggggaaaatcagtaaagacggatttaagaagttcttacagaccacgactcaaaccaacattaacgagttcaaaatcgggaagagttatttttatgagctgaaagacaacgacaatctcttggcatttcacagagtcctcaatcgggagttccagaaagtaattcccctgaacaatgctgcagtggcctttaggaaaaacaaaagttaccttgacttgttcgaaccccaccgtaagaattactactttctgcggctggacattaaagccttctttcattcgatacagatcgacgacataaagaagaccttttcaacatacttcgaggatgagtatatcgataacgataagacccagacactcattgatgcgtttatcaatctggtcacttataaagtgcccgataacagctccaataaagacttcagaggtaaacagatcctacctatgggcttcgtgactagccctgtgattagcaatatcatatttcgcaagatcgacattcagatacaaaagttttgtagcaagcgggatattacctataccaggtacgccgatgatatgctgttctccagcgacaagaattccaattatgttcactcagatggcttcatcaatgagatatccatctttgttgcccagctcaaattcaagctgaaccatcataaaactctaaaagcaacacacacattgtcactgaatgggtacacaatccagtattctaacatcaagaaggatattctgggagctagggacgaggaagttatttctgaatttcgcctctccaacaagaagatcaacataatcaagaagatgatccacctgattgaagtggaacatcaaacgccgcagtatgtcttgaagaaacttttcaactatcgacttccaaatgatgtgccagctgagaagaaagaagaatactacaagcaccaaattaccaataaactgactggctacagatcttacatcttatctttcatcacattcgacaagaaataccattgcatgcagaaaaacaccgtagagaagtacatcaagcttattaagctgattaaccagaacccttatctccagtga

SEQ ID NO: 12284 - RNA, 1110 nt, unidentified
  source 1..1110: mol_type = other RNA; note = synthetic construct
atgaaaaagattattcacaagtccttcttcaagaactacatcatcgagggtgaggtgcctagtactaaaatcccctccgtaaatgagttccaactgggaaagaatttcttttacgaggtggtcaacaataagaaactgctatccttgcataaacagctgaatgatgtgctgctcaataagatagaccttaataatgccgcagtcgcctttcgtaaagactacagctatctgcacttatttgagcctcatcgaaccaactattatttcttgaggctcgatataagatcgttcttccattctatcagggttgatgacattaaggaaatcttcaaggcttacatttcagaggacgaatacattgacgacaagaagaaacaatctattctggaagggtttattaacctggtcacatacactatccccgccgactcaaaaaacgataagtttaaggagaagcaagttttaccaatgggctttactaccagtccagtgataagcaacattattttccggaaactcgatattcagatccagaagttttgcagcaagaacaacattatatacaccagatatgcggatgatatgctctttagtagctccctggctagctcttttgtgcacagcgaatccttcataaaagaaatccggatcacaattagccagatgaagttccagctaaatgaaaacaaaacaatcaggacgaaacacaccatatctcttaatggctacactatccagtacagttacttcgagaactttcttaagttgcataagcaggagtacaaaattaatgaggtgcgcctgtcaaacaaaaagaccaacatcataaaggagatgatctacttgatcgaagttaaaaagatgtcatcccagaaaatcctgtggaagttatttcactacaaactccgcttcaaatttgtgattacagaaagtgacgtccgaaaaaagtattatgatgatcagctcctgaataaagtatctgggtatcggtcctatctgcttagcatcattaagttcaacaagaagtactcatgtacaagagacaccacgatcaagaaatattctgagctgatcaataacctcgacaaaatcatcgactataagtattga

SEQ ID NO: 12285 - RNA, 1377 nt, unidentified
  source 1..1377: mol_type = other RNA; note = synthetic construct
atgaacaaattaatcactatcgactacttcaagcgtataattctgaagaataaggtgccgaatatcagcaaagataacattcgcgaattcactgtaggaaagaattacttttacgagctgacagacaagcagcaactgttggtccaattccaaatcttcaataagctgagcaacaacatcgagctgaataatgccgctatcgcatttagaaaagacctctcctatctgcatctatttgaacctcacagaaagaactacaactttatccggcttgatattcgaagcttttttcactctattcagatcgacgatatccgcgaggtacttaaggtgtatattcccaaagatgagtacatcgataagaaagaaaagcagtccgtcctggatgcgttcattaacctagttacgtataaaattccctctacaagcaagaatgagaagtttaaagggaagcgcgtgctacctatgggctttcaaacatccccaataatcagcaacattgtttttaggcaacttgacattctgattcagaagctgtgtagttcacacgaaatagtctatacccgttacgccgatgacatgttattcagctcctccaagaataggacctatgtgcataccgatgactttattaaggagatcaggatcatcctgtcgaccatggacttcaaacttaacgagcacaaaacgctgaaagccaggcacaccttgtcactcaatggatatacgattcagtactcagacatatctactatgaagagcaagaagaagattatcatacacaatgagagtgagctccatgaattacgactgagtcacaaaaaaaccgacatcgtgaagaaaattatccacatgatagtgacagaaaagaaagagccagaggtgatcttgaaaaaactcttccagtacaagataaacctcaagttcatcccttccgaaaccctcaaaaataaatacagccatgaacagcttttgaacaaaattctcgggtatagaagttacttgattagtatcatccagttcaacaaactgtactattgcactcaggacaaaaccatcgataagtatatcaagatcatcaatgacctggagaagatcgctacacagtatcggatgaagatagagaagctggaacggaagattgataaagaaaagaaacggatcaagtcaatactgatgcagcccattgacaaactgcagttcactatttgggagaaagatgcactctctgaagtgggatacaccactctcaactccttgaagggcgtcacagagaaacatctgtacggtaatataaagggcatcggtgaagtgaaggccaagaacattgtttctattgtcaacaaagagctttcaaagacgaaatctagaatttga

SEQ ID NO: 12286 - RNA, 1071 nt, unidentified
  source 1..1071: mol_type = other RNA; note = synthetic construct
atgaagatcaacaaaaagcagctttttcagcaaatcaaactgctgctgaattccaataataggattaataacctggaggtagaagagtttaagattggcaaaaacttcttctacaagatcgacaacatcgagattattaagtttcacgactggctgaataattacctgctggacaaaatcgaaatcaataattcctcgaaagcctttatcaccgacaaatcttaccttgatttcttcgaaccacacattaaaaactacaacttcatccgattagacatcaaaagcttcttccactccataaacattaaagacattgcaaacgctgcgaaagcctactttgataaagacacaatagagctggataagaaatatcccctgctcagcttcttcctgttttttacaacgtacaagattcctgatatctccgagaacaaaaagttcattaacaaacgtgtgcttcccatgggctttaagacgtctccaaaaatatctaacatcgtgtttcgcagcttagacatccaaatacagaagctttgcattaaaaacgggataacctatacaagatacgtggatgacatgctgttttctagcaagaaggatctaacatatatccacactgatagtttcatagagcaaatcagcttcattttgaatcagatgaacttccagttgaattcaaagaaaaccatcaaggctaaacataccatcagtctgaatggttatactattgactctagcaaaaaggagtttaggataagtaacaagaagctcctcaagattaagaagctaatctacatgaagaacatccagaagaaatccgccaaggatatcttgaagaagttgtttcctaaggatttccggaaatataaacttcgctattgcagctcacagttggaaaataagattaagggatatcggtcatacctgctgagtttcattgttttcgacaacaagtataagtgtctctccgaaaataccaagaattcatacatcgacctcataaacaagttagaaaaactcatcctcctggacactaaagtctacaatgacgagattgatgaggatttttga

SEQ ID NO: 12287 - RNA, 954 nt, unidentified
  source 1..954: mol_type = other RNA; note = synthetic construct
atgctgagtcagattgaaattaacaactccgcctttgcttttgtacctaaaaggagctatctcgattttttcactatccatatcggcaattacaactttgttaggctggatatcaaaaacttctttcactctattgacctgaagaaattggaaaaaatgctgagcgtgtactttgagaatgaatttatcgacaccgacaaggaccagctgatcataaagagtttcatgaatctggtcacctacaagattccactggccagcaaaaatacaaccgagaaaggcaacaccattctgcctattggattccctacctctcccataatcagtaatatctatatgcgcgacttcgacataaagattcaggagttctgtgcaagacacaacatccagtattcacgttacgctgatgatatgcttttctcttccaaaaaagactcggacttcgttttctcagaaacatttatgaaggaagtggcaatcttgctatcattgaaagggctccatttaaatacgaagaaaacgatcaagcggaaacacaccatttctctgaatggatacacactctctaatagcaaccccactattaaggaaacttccccacattttgagttccgaatctccaacaagaagattagcaccctcaagaaattcatattcttgacaaagaacgtcaacatcagttccagagagatcatggaaaaggtgttcagcttcaacatcaaaaagcaaaagtttcggtatccccccaaaaagaagtttatcgagtcttactgcaagacattactggtgaataagataattggttaccgctcctacattattgccatactcaaacactcagagaagcaccaagcgtgcaacgattcgactatcgagaaatataaactccttctttccgagcttgacttttatctagataagaatccgccagaggatttcagcaagactctgtga

SEQ ID NO: 12288 - RNA, 1143 nt, unidentified
  source 1..1143: mol_type = other RNA; note = synthetic construct
atgctgaagatccatgccggtcaattcaaacagctactgaccggacagagtattttcaaaaatgggaccattcccaccatagaagacaaatttatacgggagattcaactcaaagggaagtttttttacgcaatccagaatagtccagagctgtcttcaactcaggccaacctgataaacgagctgtttatccagattgagatcaacaattcagcctatgcttttgtcagcaaaaaaagttacctcgactttttcaccaatcacatcggaaattacaacttcgtgaggtttgatatcaagaattttttccactccatcgacgtaatcaaattagagaaaatgctttccgcatatttcgaaaacgactacatcgataacgagaagcaacagcctacgatcaagagcttgatgaatctcatcacatataaggtgcctttgtcctcaaagaatattgcgaaacgcggcaacacaatcctgcccataggattcacgacaagcccgattatctcaaacatatacatgagggacttcgatatcaagattcaagaacactgtatccggcataatatcaattacagcagatatgctgacgacatgctgttttccagcgataagtcttcggagtatatattctctgattcctttatgaaggaggtcagtattcttcttggcttgaaaggcctacagctgaatgctaagaagactgtgaaacggaaacacactatcagcctgaatgggtacacaatttctaacaaccatattagccagattcttgagaagcctgcctttgaattccgattatctaacaagaagttgtgcatcctgaaaaagtttattcacttgagcaagaaggatggcgtgacttccaggctcattatggaaaagctcttctctttcaacattaagcgccagaaattccgttacagacccaaaaaggaattcatagagtcctattgcaataccctcctgaccaataaaatcacaggttacagaagctacctgatttccatcatcaagcatgcccttaaatataacatcagttcagattgttcgctggagaactataacaagattctgaaggaactggaactctacttagacaaaaacccagttccagatcactcaaaatctgacaagatatga

SEQ ID NO: 12289 - RNA, 1143 nt, unidentified
  source 1..1143: mol_type = other RNA; note = synthetic construct
atgctacgaatcgacgcaaccacactcaagaaaatgatcatatccgagaatctgctgatcgagggcattattcctcccatcgagagcaagtttgtgactgagtttagggtgaaaaacaaattctactacagtgtccagaataatccagaattactgctggcgcaaaacaagattatcagtgacattctaagcaaagtggagttgaataactccgctttcgcatttatcaagaataagagttacctggacttcttcgaaccacacatgggaaattataacttcgtccgcattgacattcagaatttcttccattctatccataccccccagctgaaggaaatattgtcccactatttcaaagacgaatttatcgaccccaataagaaacagaaaatcatctcttccttcatgaacctgatcaccctcaatataccactgagttctaaaaaccagaactcaaagaacaacaacatccttccaattgggtttactacaagtcccattatttctaacatctacatgagagacttcgatataaaaatgcaggacttttgtatccgtcacaatattacgtattctaggtatgccgatgatatgcttttttcctcaactgaacaaagctcatttgtgttatcggatgctttcatgaaagaagtgagcatacttctcaacctcaagaaattgaagatcaacacatccaaaaccatcaagaaaaagcatacaatcagcttaaacggttacacaattagcagctccctgattgttgatggcaaagtcatttctccggccgagtttagaatttcgaataagaaaactgccatcatccggaaattcattctcttgtcaaagaaggaaaagatcacgtcacgctacattatggaaaagctgttccactttgataagaataaggttcactttctcttccctcctaaagacaagtttatagagtcttactgcaacactctgctggtaaacaagattaaggggtatcggtcctacataattagcctcatcaagaacgccaagaaatataacaataccaatgagaacaccatcaagaagtatcaggagataatacttgagttgaatatctacctggataaaaatcctctgaaaaatttcagcgagaacaagaaaacctga

SEQ ID NO: 12290 - RNA, 1101 nt, unidentified
  source 1..1101: mol_type = other RNA; note = synthetic construct
atgattaagaacaagatttccgatgatttcttcaaaaaggctattctcaaggggaacgaaggcctgctgaacgacttttcgcccagcgtgcgagagtttaaggtgggctgcgacaacttttttgagatttcacgggacagtgagcataagaggattaatgacaggataactaagttcgtgcttgataagagcccaataaattcttcagcgtgtggatttgtgcagggcaaatcttactacgattttttacggcctcatatccaaggatactatttcctcagacttgacatcaagaaatttttccacagcattcctagtcacgaagtgaagagtctcctcgctcagcactttaacaacgaaaaaaacgggaagaagtattctgccttggatatagcctacatgagcatcacccacagggtatccgataactatatcgataaagacttcaggggcaaagagatactgccaatcggtttcagtagttcaccggtgatcagcaatattattttcagacgggtcgacatcctgattcagaagctctgtgaagataagggaatcatatactcacgctatgcagatgacatgttattttcctgcgacaattctaagtatttgcactccgaacaatttgagaaagacatttccatcttcgtcagcacgctttcgctgaaactaaagaagagaaaacgccgagccacagagaataccatctccctgaatggttatgtcgtgcagaaccgcaagcgcaagaaggggtttctccatgtctacaaagagaaacctgtggggaatatccgtttgtccgacaaaaaactgaagccactgaaaaagctaagcgccttgttaaagaaacagaaagaccccatctacattatggagaacatcttttacctgaatcccaaaaatttcatcagacgttatggcggaaacttcgcattctattcaaaatacgctgatgatcagctgcagaataagctgaaggggtaccggtcttatcttgtctctctgatcaaatacaatgacaagtacggctgtgttaacattgactgcatgaagaaagtaaaaggtctggttgaggttttcgaaagcaacataaagtga

SEQ ID NO: 12291 - RNA, 1101 nt, unidentified
  source 1..1101: mol_type = other RNA; note = synthetic construct
atgattaagaacaagatttccgatgacttctttaggaaagcgattcttaaggggaatgaagatctgcttaataatttcagtcccgcagttcgagagttccagataggatgtgataatctcttcgaaatcactcgggagacagagcataagcagataaatgaccgcatcaccaaatttgtgctggagaagacccctatcaattcatccgcttgcgggttcgtacaggggaaaagctattatgattttctaaggccccacatttctggctactacttcctgaggttggacatcaagaaattctttcactctatcccatcctatgaggtgaaggccctgctcagccaattctttaataacgaaaagaacgggaacaaatacagcgcactggatatcgcctacatgagcgtcattcacaaagtgagcgatacgcatattgataaggactttaggtccaaggagatactgcctatgggctttagtagtagccctgtgatatcaaacattatctttcggaaggtggatattctgattcagaagctgtgtgaggataaaggcattgtctacagccgctatgccgacgacatgttgttctcctgcgacaactccaattacctgcactgtgaccaattcgaaagagacatctccatcttcatttctaccctctctctcagattaaagaagcgcaaacgtagggctactgaaaacacaatcagcctgaatggctacgtggttcagaacaaaaaaagagaaaagggctttcttcatgtctacaaggagaaaccagtcggttcgatacggctgtctgacaaaaagttgaaaccgcttaagaaattagcttctttactgcagaagcagaaaagtcccgttgttatcatggaatcattgttcagtctcgagcggagaaagtttatcaatcgctacggaaacaattggaacttttattgcaagtatgcagacgaacaactccagaacaaactgaagggatatcgttcatacttggtgtcactcatcaaatacaacgataagtatggatgtgtaaacgtcgagtgcatggagaaactgcgagccctagtgggtgtgttcgagcttaatatcaagtga

SEQ ID NO: 12292 - RNA, 930 nt, unidentified
  source 1..930: mol_type = other RNA; note = synthetic construct
atgatgaagaacaacatatctgacgactttttcaaaaaggccatccttaaaggtaatgaagacctgttgaatgactttagccccgccgttagggagtttaaggttggctgtgataacttcttcgagattagtaaagattctgaacacaagagaatcaatgaccgcattactaaatttgtgctggcaaagatcccgattaattcttcagcgtgtggcttcgtgcagggaaaaagctactatgacttcttacgtccccacattcagggatactattttctccggctcgacatcaaaaatttctttcactcaatctccgcacacaaggtgaaaaatctgttggcccagcatttcaataatgaaaagggcgggaacaaatacagcgcactggatatcgcttacatggctgtcacccacaaggtatcggatacttatttggataaagactttcgcggtaaagaagtcctcccaattggatttagcagtagccctgtgatatcaaacattatcttcaggaaggttgatatcctaattcagaaactctgcgaggacaaggggatcatctatagccgctatgctgatgatatgttcttctccagtggaaatagtaaatacctccatagcgaacaattcgagaaggatatttccattttcgtatccacattatcactgaagctgaagaagtctaaacggaaggccacggagaacacaatatccctgaacgggtatgtggtgcaaaaccggaaaagaaagaaggacttttttcatgtgtacaaagagaagccagtcggcaacatccgactttctgacaaaaaactgaaacccctgaagaagaacttccgaatcgcccagaagaccaagatttccaatatatacaacggcgagaggcttccttttaaaccaaagaaggtctgccctaagatcagagagtga

SEQ ID NO: 12293 - RNA, 1107 nt, unidentified
  source 1..1107: mol_type = other RNA; note = synthetic construct
atgataaagaataagaagaagatcagcgacgattttttcaaaaaggcaatcctcaatggcaataaagcccttctttctgactttagcccttctgtatcagaatttaaagttggaggcgatcggtttttcgagatctctcgcggatccgaacacaaatccatcaataacaggatcaccaaaatcgtgctcgacaaaattcccatcaattcctccgcttgcggatttgttcagtgtaagagttactacgactttcttcgcccgcacgtgcatgggtactactttctgagattggatattaaggagttcttccattcgataccatcgattgaggtgaagaaactattaagccagtacttcaacaacgagaagaacggcgccaagtacagtgccttagacattgcgtatatgtccgtcactcatagggttagcgatacatatattgaggaagacttcagggggaaggatatcctcccaattggctttagcagctctccagtcatctcaaatataatattccggagaatcgacatccttatccagaagatgtgtgaggaaaaaggcatcgtgtatactcgatacgcagacgacatgctgttcagttgcgaaagtagtaagtacctccacagtgaacagttcgagagagacatttcaattttcgtctccacgttgagcctgaaactgaatcgcaagaagcgtaaagctgctgagaacacaatttcactgaacgggtatgtggtccagaataccaaaatcaacaaagggttttttcacgagtatattgaaaagcccgtgggaaacataaggctgtccgataagaagctgaaacccttgaagaaactgtccgtgttgctcaaaaaagaaaaggatcctatctacatcatggataaagttttcaacctgaaccctagcaagttcattcgaaagtacggtaagaattacgagttctattctaagtatgcagacgatcagctacaaaataaaataaagggttaccggtcatatctgctgtctctcatgagctataacgataaatatggttgtgtcaatgccaaatgcatgcaaaaagtaaagggcctggtggaggtgtttgagtctaacattaagtga

SEQ ID NO: 12294 - RNA, 1122 nt, unidentified
  source 1..1122: mol_type = other RNA; note = synthetic construct
atgtaccaagtggaagcgtctatgatcaacactaaaatcagcgatgagttcttcaagaaggcaattcttaagggccagagcgagatattcaatgaattttcaccttccgttcgggaatctaaggtgggccccgactcctttttcgagatcgcccagaactccctccataaggacatcaatgacaggattacaaaattcgtgctcaataagaacccaatcaattccagtgcgtgtggctttgtcgccggtaagtcatattatgactttctgcgccctcatattaccggttacttctttctcaggctggatatcaagaagttttttcacagcattcccgttagcgaagtaagggaacttttgtcgcaacacttcaatgataccaaaaatggagccaagtactctgccctggatatagcatacatgtccgtcacacacaaggtcagtaatgaccacgtggatcaggatctcaaggctagggagattcttccaattgggttctcatcttctcccattatctccaacataatatttcgccgagttgacatactgatccagaagctgtgcgaagagaagggaatcacatacacacggtatgcagatgacatgttgttttcaagctacaagtcccgttacctgcacagtgaacaattcgaacgcgacatttcaatcttcatcagtacgttgagcttgaaactcaagaaaagaaagagaaaagaggcagagaataccatttctctcaatggctatgtcatccagaacaaaaagattgagaagagcctgtttaacgttctgaaagagaaaccggtagggaagatcagactgagcaacaagaaacttaaaactctgaaaaagctggctgctttactacgaaaaaagcagagtcctacctacatcatggagaaccagttcaaattgaatcccaacaaattcaaagctaagtttgggaagaacctgaatttctataacaaatttgccgacgaccagctacagaacaaaatcaagggatatcggtcgtacctggtggccttattaaaatataacgaactccatggctgcgtgaatattgattgtgtgaaaactgtcgagaaactgattaaggtgttcgagcttaacgtgaagtga

SEQ ID NO: 12295 - RNA, 1101 nt, unidentified
  source 1..1101: mol_type = other RNA; note = synthetic construct
atgaataagaaggtgagcgatgaattctttaacaacgcaattctcaaagggaacgtggcgctcttggatgatttttccacctcagtcatcgaaagaaagagcggcgctgatatatttttcgaaatcctgaaggatagcgaccataaaattgttaacgatcggattacgagatttgtgctatctaaaatccccgtgaattcaagtgcctgtggattcgtaccaggcaaaagttattacgatttcttgcgccctcatatctcagggtactattttctgcggctggacattaagaaatttttccactccatatccgtccttgaggtgaaaaatctgctctcccaatacttctctgacgacaaaaagggagcaaagtatagcgccttagacattgcatacatgtctatcacacacaaagtgaacaataatttcgatgacgatgacattaagaagaaggaaatcctgcccataggttttagcagttctccagtagtgagcaacataattttcaggagaatcgacatcctcatccagaaattatgcgaagataaagggatagtctattccagatacgctgacgacatgctgtttagtagttcaaaatctcgataccttcatagcgagcagtttgagagggatattagcatcttcgtttccaccctgtctttaaagttgaagaagcggaaacgcaaggccgttgagaacactatctccctaaacggctacgtgatccaaaatacaaagctgaagaagaatctcttcttcaatgtctataagcaggatcctatcggctcaattcgtctttcagacaagaaactgaaacacttgaaaaagctgtctgctcttctccgcaagaatagggactccgtgtacatcatggagtccatctttcagctgaactataacaagttcaaacggacttatggtgagaacataaacttctacatccagtacagtgacgaccagctgcagaacaagattaaaggatatcgaagctacctggtatcgctgattaaatacaatgagaagtatggctgtgttgccaataactgcattgtgaaggtgaaggagctcgtcagggtctttgaatcgaatattaaatga

SEQ ID NO: 12296 - RNA, 1104 nt, unidentified
  source 1..1104: mol_type = other RNA; note = synthetic construct
atgaacaacaagattatcaagaacgacttctttgagcaggcagtgctgaaagggaaaacgcagctcctaaataagttcacaccgagcgctgtggagaggacagtgggaaatgatatctttttcgagatccccaaagatagcgatcactttttgatcaatagacgaattgagcagctgattttatcaagcatccccgtcaactcttcttgctgtggcttcgttaagggtaaaagctacctggactttcttaagccacacataaaaggatactatttccttagactggatatcaaagacttctttcactccattcagctatccgacattaaggccttgctcggggactattttgaagatgacaagaagtctttcaagtattcccctctggacattgccctcatgtctttgactcatagcgtgagttccacacatcctgctaaagatatgaggggcaagaccatcctgccaatcggattcccctcgtcacctgtgatcagtaacattctttttcgtaaggtggatataaccatccagaagttttgcgaagacaagaaaatcacatattcaaggtacgcggatgatctgctgttttctagcactagttcccgcttcttacacagcgagcagttcgagaaggaaattagtatcttcataagcatgctgaccttacggttgaaacggaagaagcggatcgcaggtgaaaataccatttcgctgaatggctatacgatccagaacaagaaaaaatccaatgtcagtttcctgcgggactaccaacaagaccccattggctctattagactgtcaaacaagaaactcaaaactctcaagaagttggcagccagccttatcaagaagcattccgctgtatctataatggaaaacctcttcgggctgtcatttcagaagtttaaacgcaatcactttccagataaaaacttctaccgaaagtacgcccgcgaccaactacagaataaactcaaaggctataggagttaccttatatcctgggtcattttcgacgataaacattcctgtgttgcttcagattttctgctcaccgccagatgcctgatagacatttacgagaagaacatcgagtga

SEQ ID NO: 12297 - RNA, 1104 nt, unidentified
  source 1..1104: mol_type = other RNA; note = synthetic construct
atgaataaaaacaaagtgagtgatgacttcttcaagaatgcaatcctcaaaggtaacctcggactgtttgacaagtttgatctgtccgtgattgaacgtaatatcgggaataacgcatttttcgaaatatccaaagactcggagcagtacaagattaacgaacgaatcacaaagtttgtcctgtctcgacagcccattaattcagccgcgtacgggtttattaagggcaagagttactacgattttctcaaaccgcacataaccggttactactttttacggctggatattaagaatttcttccactctattccagtgagggaggttaatagtttgctggagggattgtttaactcctcaaaggaaggcaaactctattctgccctggacctggccaaaatgacgcttctgcatactgtgtctaaagacttcagcgacagcagcctgagaggggattatgttttaccaataggcttcccctccagtcctgctatatccaatattattttccggagggttgacatcctaatccaaaagtattgcgatgacaagaatatcatctattccagatacgccgatgacctgttattttctagcgcgaactccaatttcattcattcagagcagtttgagaaggagatctctatattcatctcgaccttggctttgaccctcaagaagagcaaaaggaaggcttgtgagaatactatctcacttaatgggtatgtaatccaaaacacccgccctaagaaaacactttttagtaacatcttccgggaaaactctaccggagcaattcgcctatcaaacaagaagctacagacattgaaaaaggtactgcggtcactcttcaagggcaaaagtgccatttacatcatggagacattttttggactgaactacagcaagttcaaaaacaagttcaattccgactatcgcttctataacaaatatgctacggaccagctgcagaataaacttaggggctacagaagctacctggtcagccttatcaaatataacgaaagctacgattgcgtggatcagaactgtctcaaaactgtgaagtccctggccaaggatctcgagaaatatatcgtctga

SEQ ID NO: 12298 - RNA, 1104 nt, unidentified
  source 1..1104: mol_type = other RNA; note = synthetic construct
atgaacaaaaaccgggtatctgatgacttctttaagaatgccattctcaaggggaatactgacttgttcgatagttttgacgtgtcagtaatagaaaagaagataggcaacgactgctttttcgaaatcccccgagattctgagcagaacaaaatcaacgagaggatcactaaatttatcctgtcaaggcaacctgtcaactccgcggcttgtggctttataaaaggaaagtcgtactttgacttcctcaaaccccataccaccgggtattacttcctgaggctggacattaagaatttcttccactccattcctgttcgtgaggtgaataatctgctcgagtcccttttttcaagctcaaagaatggcaagagctattctgctctggatctcgcaaagtcaacagtccttcacacagtgtctaaagattttcccgatctatccctcagaggtgaatatatcctgccaattggttttccctcctcaccagccattagtaacatcattttccgcaaggtggacatcctcgtgcagaagtactgtgatgacaagaatataatctactccagatatgctgacgatttgttattcagtagcattaacagcaactttatccatagcgaacagtttgagaaggagataagtatctttatctctactctgtccctgaatctgaaaaagagtaaacgcaaggcctgcaaaaataccattagcctgaatgggtatgttattcagaacaccaaaccaaagaagatcatctttagcatgttctattctgacaaccctgtcggaacgattcggctgagcaataaaaagcttcagatcctcaagaaagtcgtggcagccctattcaaaaagaagtctgccatctacattatggagaacattttcgacctgtctccgtccaagttcaaaaaaagcttcaactcatcctactatttctacaacaaatacgcagaagatcagcttcaaaacaaattaagaggatatcggagttacatcgtgtcgctgattaagtacaatgaaaagcacgagtgtgttgataaaaattgcttgatcacagtgaagagcttagccaaagctctggaagagttcatattgtga

SEQ ID NO: 12299 - RNA, 1095 nt, unidentified
  source 1..1095: mol_type = other RNA; note = synthetic construct
atgatcaacaacaagattcacgacgatttttttaagaacgcaattctgaagggcgacacatccctctatgacgactttagccaaagcgttattgaaaaacaggtggggccagatgtcttttttgaaatcaagaaagactctgatcactacaggatcaacgaacgcataactaaaatcgtcttgtctcaggtacctattaattcttctgcttgcggctttgtgcctaacaagagttattatgacttcctcaaaccccatatcaaaggttattactttctccgactcgatattaagaacttcttccattctatcccgaagaagtacgtggaggagcttttcaaacagtatttcagcgataagaagaatgagcagaaatattcatcccttgagttagctctcatggccgtgctgtacaaaaccaacatctttgatgacgaaaaggacaaaatagtgttgcccatagggtttcccagctcaccagtaatctccaacattctattccgtaagatagacattttgatccagaagttttgtgaggagaagaatatcatctattcaaggtatgccgatgacatgttattctcttccagcaaaagtaattacctgcacagtgaatatttcgagcgggaaattagtttctttctgtccacactggccctgaaacttaaaagacgcaaaaggaaagcgacggagaatacaatttccctgaatggatacgtgatacagaatgagaagccaaagaagcgctttctattcaatgtttacaaggaagagagagttggcaccattcggttgtcaaacaagaagatcaagattatcaagaagctgagcgcccatctcatcaaagggtcgtcccccgtggtcatcatggaaaatctgttcaacttaaacccttacaagttcaagaaaaagtacaactcgaacattcaattctacaacaaatacagccgggatcagctgcaaaacaaaataaagggataccgatcatatctcgtgagcctgattagattcaacgaaaaacacggttgtatcgataaaaagtgccttgagactgcaatcaaactggtcagtatcctggaggacaatattacctga

SEQ ID NO: 12300 - RNA, 1104 nt, unidentified
  source 1..1104: mol_type = other RNA; note = synthetic construct
atgaaaaacaagatactgtcagacgactttttcaaaaacgccatcttaaaaggcaattcagctctcttcaatgaattcacccccagtgtcactgagagagaggttggtccagatgttttcttcgagatagaaaagaactccgagcacaggaagatcaatgaacgtatcaccaaattcatcctgagtcagattcccataaactcatcagcttgcggttttgtacaaggaaagtcctactttgatttcctgaatccccatattaaagggtatttttttctgaggctcgacatcaagaaattttttcactctatacctgcaagcgaggtcaagagcctctttaaggtgtacttttccaatacgaagaaagaggaaaagtattcggcccttgacatcgctttgatggcagtgctgcacaagactagcaagtctctgtccgactcagagctaagagacaaggaaattttacctataggatttagctcaagcccggttatttccaatataattttccgaaaggtggatatccttatccaaaagtattgtgaggacaaaaacatcgaatacagtcgctatgctgatgatctcctcttcagcagtgcgaaaagcaactttatccatggggaacagtttgagcgggaaatttctatttttatctccacactgtccctgagactgaaaaaaagtaagcggaccgcaagtgagaatacaatcagcctgaatgggtacgtcatccagaacaccaaacagaagaagcttttcaacatgttcttctacaaagatgccccaattggcactattcgggtgtctaataagaagaccaagatcatcaagaagatgacagccttgctgcgccagggcaaatctcctatctacatcatggagaatgtattcaatctcaaccgaaaatctttcaagcccaaatataccaacaattacacgttctacaaccgctatgccacagaccagttgcagaacaaaatcaaaggatataggtcctacttggtgtcgattattaagttcaacgaaaagtacaagtccattgatgagaagtttctaaagagcgccaaaaaactggtgaaagagcttgaagactctattccatga

SEQ ID NO: 12301 - RNA, 1098 nt, unidentified
  source 1..1098: mol_type = other RNA; note = synthetic construct
atgaagaagatcaataacgagttcttcaaaggggccattcttaaaaataatgaggctctctttgacgaatttaaaccttcgatctcagagtttaggattgggggagataacttctttaagattagccctaatacacctcaccacgacatctctgaaagaattaccaaaatcgtcttctcccaggtggaaattaattcatctgcctgcggcttcgttcagggtaaatcatacttcgattttctgaaaccgcatatccacggctattacttcctgcgactcgacataaagaaattcttccactcaatcaagatcagcgatgtttctgcactgctggaagactgcttttccaatgagaagggaaagttcaaatacagtccctacgacattgccttaatgtccgtgacccataaagtttccagcaatttcagcgatataaagctgagggaaaaagacattttacccattggactgccatctagtccagtcatctcaaacattatttttaggagagtggacattctgattcaaaagtactgcgaaaacaagaaaatcacttactccagatatgcagacgatctgctattttctagcctcaacagtaactttatccattcggagaattttgagcgggagatttccttttttctaagctgtctgagtttgcgcctcaaccacaaaaaacgtaaggcgtgcgagaatacaatctcactgaacggttacgtgataaaaaattctaagcccaagaagttggacttcttcaatatccacaaagaagatcccgtaggcaagataagtctgagcaacaaaaagcttaagatcatcaagaagatcatccatcaccttaagaaggggagctctgccattacgatcatggaggagctcttttatctgaacttcaataagaaccggtccaaattttataactactatggcttctaccagaaatacgctgaggatcaactgcagaataaactcaagggctatcgaagctatttattgtccttggtaatattccatcagaaaaacaagtgtgtggatgaactctgtcttcgcactgtcaaaaagatgatcaaggacataaacaagaagatagtgtga

SEQ ID NO: 12302 - RNA, 1098 nt, unidentified
  source 1..1098: mol_type = other RNA; note = synthetic construct
atgaagaaaatcagtaatgagtttttccagagtgctatactgaagggaaactccgccattctggacgacttctcgcctagcgtcgtggagcagaatgtggccaacaatacattcttcactatccggtcagatacagctcacaaaagcatcaatgagagaattacgaagatcgtatttagcaaaatcccaataaacacatcagcttgtgggtttgtttcaggcaaatcttattatgacttcctatccccgcacgtgtactcttactattatctccgcctggacataaaacaattctttcacagtatcccaatctctgaggtcaagaaactgttggaagataactttaccaaggataaagggacttttaaatactccccctatgaaattgcattcatggcccttacccatagggtgagcaagaacagctctaataaggagttgatcaataaggacctgctgcccattggattttcttcgtctcctgtgatatccaatattctctttcgcaagatcgatattctcattcaaaagtactgcgagaacaagaagattaaatatactcggtacgcagacgatttactgttcagtacccttaattcaaagtttgtacactctgagcagtttgaaaaagagatcagtatcttggtcagcaccctggggttaaaattgaacaacaagaagagaaaagcctgcgaaaatactattagcctgaatggctacgtgattcagaatacaaagcctaaagaaatgaccttcttctccgttcgaaaagatgacccagtcggtacgatacgtctctccaacaagaagctcaagatcattaagaaactcatcgcagcgatcggcaaaaatattccctccgtgaccataatggaagatctgtttggcatgaactttgacaagttcaggggcaagcatttcaacaacctcatgttcttcaacaaatatgtggaggatcagctgcagaataaactaaaaggatacaggtcataccttattagcctgattcagtacgacaagcgggttggtcatgttgacgtcgattgtcttgaatccgtgatcgagctgatcaacaagatcaacaagtacatcaagtga

SEQ ID NO: 12303 - RNA, 1104 nt, unidentified
  source 1..1104: mol_type = other RNA; note = synthetic construct
atgaacgagatgaacaaggacttttttattaacgccatccttaacaaggatgaaaccttgctgaatactttcaaaccatcagtggtcgagcaccaagttggcgatgattttttctttgagatccaagatcgtactcctcataagaatatcaacaaacggattaccaacattatcctgtctcaaattcctctgaactcctccgcatgcgggttcatcagaagtaaaagttactacgacttcttacagccgcacgtgaccggctactactttctaagactcgacatcaagaattttttccacacgatagattcagatctcattgacgatctgctgctttcactgttttctgacgagaagaaagggtcggacacattgtccccttttgatattgcctcattagtcgttacacataaggttagcgaaagttgcagctgtgagctaataaatggaaaaaggattctccccattggctttcctagctctccagtaatatcgaacatcatattccgcaaaatcgacttgatcatacagaagttctgtgatgacaagcggataaaatatactcggtatgcagatgacttactgttctccagccccgacaataagttcattcactctgaacagttcgaaaaagagatttctatcttcgtcgcgatccttaacctgaagctcaacaagaagaaaaagatcgcttgtgaaaatacgatcagtctgaatggatacgtaattcagaatgagaaaggtaagaaaactcgacatctccatgtgtataaggaagagccaattggaaccatcagacttagcattaagaaaacaaagatcatccagaagatggtgtatctgctggacaaaaaaattgctcccgtgacaattgtgagcaagctcttcaagatcaattaccatacccacaaatttaagtacaggcgcaacctggaatttttcaagaaatatgccgacgatcagctccagaataagttgaaaggttataggtcttatctgttgtccatcatcaactataacaagattaagccctgcgtctccaccgagcacatcgataaatacctgtaccttgtggacaagataaatagctacatcaaagagtga

SEQ ID NO: 12304 - RNA, 1101 nt, unidentified
  source 1..1101: mol_type = other RNA; note = synthetic construct
atgaaactaattacgaatgaggtgttctccaagacaattcttaaaggcaagagcgagctttttgatacatttacccccctgtcgactgaacgacagatcgggaaggaggtgtgctgtatcataccagacagtactgaccataaggtaattaacaacagtctgacgaagattgttttttcacggatacctctgaataattccgcatacgggtttgtcccgaatagatcatatctggactttctcaccccacacgtcaaaaactattatttcctgaggttggacatcaaaaagttcttctactcaatcgacattagccttatcaagaaactcgtgcaatctctctttagtcaggataaggaaggcaaaaaacactcaccttacgatgttgtgatggaggctattacccacaaaacatccagcgactttcccattgctgaaatacgcaataggcaagtactgcccatcggatatccctcttccccagtgatctctaacatcctcttccgtcctattgatatcttgattcagaagtactgtgagggcaagaagataacctatactcgctacgccgatgacatgctgttttctggaaataccaaacggattttgcacggggagaatttcgaaacagaaatcagcatactccttgcgacaatcggtctaaagataaacaataagaagactatcgcctgcgaaaacactatctctttgaacggctatgtcattcaaaatatcaaacctaccgttaacgagttcctgtctcagtattacgaaaccagtatcggtcatattcatatcagcaacaaaaagactcagttaatctgtaaagtgatccatagtctgcggaagaaagaaagcccagagaatatcatggccacacactttggaaaaacctacaacaagcacaaattcaagtacaccaaggattactccttctacataaagtatgccgacatgcagctgcagaataaattaaagggctatagatccttcctcatttccctgatcaagcacaacaaaaagaacaactgcattagcgataaaaacattgagaagtactcaaatctggcaagggagatcgagagacatattaagaattga

SEQ ID NO: 12305 - RNA, 1098 nt, unidentified
  source 1..1098: mol_type = other RNA; note = synthetic construct
atgaagctgataaataacgagattttcatccgtacgatactgaagggcaacaccgatctttttaatacattcgttccaacttctgcagaatgccagatcggtaaagaattctgttgcgtcattagtgattctacaaaccataaggccatcaatcacgccctcactaagataatcttctctagaatcccccttaattcctctgcgtgtggctttgtgaagaataaatcctacttagacttcctgacaccccatatcaaaaattactatttcctgcgcctcgatataaagaagtttttttacagcatcgacgtatccttggttgaaaacttggctaaatcgctgttttcacaggacaaagagggaaacaaatttagcccatataacatcgtgatggatgcaattacccataaggcctcagccagttttcccattactgagctgaggaacaagcaagtgctgccaatagggtacccctcatcccctgtcataagcaatatcatcttccgccctatcgatattctgatccagaaatactgtgagggcaaaaacatcatttatacaaggtatgctgacgatatgctcttcagtgctaacacaaaacgggtgttacacgaccggagcttccagaccgaaattgctattctgctgtccactatcaacctaaagatcaataagactaagaccattgcctgcgaaaataccatttccctcaatggttatgtgattcagaatgaacggcctattttcagaaagagccctcaccaaaactacgagcaaccaaccggacacattagaatcagcaacaaaaaaacggagatcattcataagatcttgcactcgttgcgagagaaggagtccccgagcaccatcatgaaaaagcactttgggaagtcatacgacaaccacaaatttatctacaagaaggactatgccttcttcatcaagtatatagagacacagctccagaataaacttaagggataccgatcttttcttataagtctaatccagcacgataagaagaacttttgcattgcagacgaacatattgagaaatactctaaactgaccaaagaaatcgagaggtatattatttga

SEQ ID NO: 12306 - RNA, 1050 nt, unidentified
  source 1..1050: mol_type = other RNA; note = synthetic construct
atgtttgatgactccatctttaatcgcatcatactccaaaatcacctttcacttaggaaggattttcaccccaaagtgatcgggatcaagatcaacaagaatctgtacttctctattaacagcgatatccatagggacatcaataagcgcattgtgaactatattttgtcagacatccctgtgaatagttcggcatgtgcgtacataaaaggaaagtcctacttagatttcctcagtccccactgcaaaaattgctactttcttcgtctggatattaaaaacttcttccatagcttcccagagcgaattctcgatgaattcctgttgtcactctttaataacgaaaagcccaagggttctgatgaattatcctcttacgagcttgctagactggtgctgctctataaatgtgacgatgagtatagtgacgattccatcaaggggcgaagtattctgcctattggctttccatcctcaccgataatctctaatatactgttccggaaaatcgacattttgattgagaagtattgctatacacgcggcatcacttataccagatatgccgacgacatgctgttctcctccaaaagctccgggtttttgctaaaatccgagtttgaacgtgaaatgagcttccttataagcctcctgggatttcgcctgaataacaacaagaccataagaagttcaaacgagctgtctctaaacggctacgtcatctacaactacatggaaaataatcggtctggcatccggctgagcaataaaaagctgtcaattattcggaaggtcatctactacaagaaaaacaagatgagcaacgacttcataatgagaaggttattcaacatccacatcaacaacttcaagttcaagtatggaaaacacgagagttttttcgaaaaatactgcgaggaccagattcagcataaaattaggggctttaggtctttcctcctgagcttttcgaactatagcaaggagaattacggtgtttgtgaggagtatatcgaactggtaaatgaattggagaagtacattatctga

SEQ ID NO: 12307 - RNA, 1095 nt, unidentified
  source 1..1095: mol_type = other RNA; note = synthetic construct
atgaagaagatcagtcgtgatgatttcgttaaagacattctgggcctcagcgtctccacctctttggatagccctacactttctgtaaagtaccacaagatcaaatcacaagatacatacagcatcgtggaacagacccttcattattatgcaaataaagccatcaacgacaacatcctgtcaaaaatatccgtgaactccagtgcgaagggattcgtcaaaggcaagagttatctcgacttcctgagcgagcacaaggacggttactactttctcagactggatattaagaagttctttccaagcatctcacagacggatatcaggaacgttctaagtcagtatctttcgtacaagattaacaagaaagacaagatttcgactctggactacgcaatgaatgtgattactcaccgcgttgaccctaaatctgctccgtttctgcctgtcgggttctccagtagccccaccctcagcaatatcattttcaggaagatcgatattctgatagaaaagttatgcttggacaaaaatgtcaagtacacacgatacgccgatgacctactgttttcatcttcaaataatcccgagatcctggatgacaagtttataaacgagatttccaagctggtcagcattctgtccctaaaattgaacgtgaagaaaacaaaacggaaaaaagggctgatatctctcaatggatatgtaatctgcaacaaaagccccgaccagccatggttatttagcaaaaagaagaggtacttcactggaaatctttgggtgtcaaacaaaaagaccaagaacttctctaagttgatctatttgatggaaaagggctattcctctgattacatcgccaataaagtgctgaaaattactcccaacaataaccatgtgttttatggtgtgaatgtggatttctataccaagtactgtaacgaccaagtgctcaataaagctagagggtatcggtcttttctgttatcccttataatctacgacaccaagaataaatgtgttgaggagaactacatcaacaaatattccaagctcgtaaatcgcctggatctcgtgattgacaagtacacgagttga

SEQ ID NO: 12308 - RNA, 1128 nt, unidentified
  source 1..1128: mol_type = other RNA; note = synthetic construct
atgtcaatgtgttctatgtgtcatacagtgaacttttgcttctgtataaaagacaaagcctattacatgagcaaatacattgagcggaagatcggccctagccttaccagtaaactgttgagtaacatcgatcggaacgtagtgagcgagcttaaagtagggaaagattatacctattccatgctgactgattcacacctagaagtcattaataaggaactggtggagaacctgttttcccacattcccttgaataattcatgtgtaggcttcgtgaagaagaaaagttatcttgatctgctggaaccccataggtactcgaaaaagtttacccgattggatatttcaagcttttttcactccatcagtatctctgacgttaaagctagcctgaccccatacgtgaatccgctgtttctggacaaagagaagaaaatctccaccctggagaagattattgagtgtatcacatatgacgtccctctgacctcctccaatacaattttccgcggaaagaaaatcctccccatggggttcagctccagcccagtgatttcgaacgttgtgttcagaaagattgacatacagatccagaagtactgcatcgaaaacaagatcatatatacgcggtatgccgacgacatgctcttctcctctaacaaagaactagtttctcaagtggaattcatcaacaagatccagtctctcgtgtctcagttgtcattacgcataaatgaacgcaaaactatcactacaagcggacatatcagcctgaatggttacgtcattgatggttcttccggcactattaggctctctaacaagaagctgtctcgaatcaataagatcacccaccagctcctggttagaagtaaaagtccttccagcgtcgctaagaaattatatgggtactcaattagccagtataacttcaagtactcatactccaaggagtttttcgagcagttctgcaaagaccaacttcacaataagatagcgggaaatcgtgcatacctcatcagcgtgttaaagtttaatgacaggtacgagtgcatatgcccagattacctgaagaagagtaaggtcatgcttgataggctcaacgagattttggacaactggagatga

SEQ ID NO: 12309 - RNA, 1062 nt, unidentified
  source 1..1062: mol_type = other RNA; note = synthetic construct
atgtccaaatacaacgagagaaaaataggtccttccctgatctcaaaactgctggcagacgtggaccataacgtgatatcagaagctaaggtgggcaaggatttcacatacagtatgctcacaaattcggacctggaggtcctgaataaagagcttgtgagcgactttttcagcaagattccactttctaactcctgtgttggatttgtcaagaataagtcttacctggatctcttagagccccacaggttttcaaatcatttcaccagacttgatatctcctcgttcttccatagcatcagtattgacgatgtgaaatctagcctgtctccttacgttaaaccggaattccttgatgaggacaagtctataagcagtattgagaaggtgatcgactgcatcacttatagcgtgcctaccacatcagaaaatgtcaaaagcaggggtaagaaaattctgccaatggggttttcaagcagtcccgtagtctccaacattgtgtttcgccggatcgatatccagatccagaagtactgcattgagaataacatcatctataccagatacgccgatgatatgttgttttccagtaccaatgaactggtgataaaggttgagttcgtgaataagattaagagtttggtcgctcagctgtcactcaagattaacgaaatgaaaactatcaccacttctgggcacgtgtcattaaacgggtatgtaattgacggcgttaatggaacaattcggctatccaacaataagctcagcaggataaacaagattacgcaccaactgctggtacgtcgcaaaccacccgagtatgtcgccaagaaattgtatggctactccatcagcaaattcaaatttcgctacggattttctaaggatttctttgaccagtactgcaaggaccaactccacaacaagattgcgggcaaccgatcttacttgatctccctaatcaagtataatgaacgacaccagtgtatgtgtcccatctatttctccaagagtaaactcatgttagaccggctcaacaacatactggataattggaaatga

SEQ ID NO: 12310 - RNA, 1062 nt, unidentified
  source 1..1062: mol_type = other RNA; note = synthetic construct
atgagcaaatattccgacattaaaatctcccctagtcttaactctaaactgttggcaaacgtggacaggaatgtagtgtctgagattaaagtgggaaaggactatacgtattctattatggccggctcgaatctagatgtgctgaacagggaattagcatccgatttcttttctaagatcccgctcaacaacagctgtgtcggatttgttaagaataagtcatacctggatcttctcgagccacatcggttcagtacaaaatttaccagactggacattagttccttcttccattcaatcagcatagaggacgttaagctttcaattgaaccttacgtgaagcccaagttcctggataatgacaaaaccttgctgagcatagacaagatcatcgagtacattacttacgatgtccctcagaaatctaagaatgtcaagttcagaggcaaaacaatattacccatggggttttcctcctcacccattatcagtaatatagtgtttcgcaagatcgatatccagatacacaaatactgcaacgacaataacatcatctataccagatatgctgatgacatgttgttctcatcaaataatgagattgtggggcaacgtatttttatcaacaagattcggagcctggtgtctcagatcagtctaaagatcaacgagcggaaaacaattactactagcgatcacatctctctcaatggatatgttatcgatggtgcttccggcacaatacgcctcagtaacaagaagctcaacaaaatcaacaagattacccaccagctgctggtccgagacaggagcccagccgtggttgcgaagaagctgtatgggtattccatatccaagtacgactttaaattcggttactcgcaggaatttttcgaacaatactgcaaagaccagctccacaataaaatcgccggcaataggagctacttgattagcgtcctgaaattcaacgagcagcatgattgcatctgtccagaatacgtagtgaaatctaagattatgctggaccgattaaacaagatccttgataattggcgctga

SEQ ID NO: 12311 - RNA, 1071 nt, unidentified
  source 1..1071: mol_type = other RNA; note = synthetic construct
atgaataaaaccaaagtgatcacgttacagtcggaacacaaagtgcttctttgtgaggatgccaatccggatgacatttcaagtatattctatttggggaagctggcgttcaagattaaagccaactgctttagagagcaaatcgctatttacattagcaactctatccaggatgtgatcccaataaattctgcagcaactggctttatcaagagaaagagctacctggacttcctcagtcctcaccggcgctcaagtttctttataaggcttgacgtcaaggatttcttccactccatcaaagaagaggatatcaagaaaagtctgtcgaactatattgttccgtcccatattatgattgaggacaagaagactccaacaatcgaccagcttataaagtacatcatgcatgagatccctgatgactttcctgacaagaacctgaaaggaaagaagatactccctattgggttcccatcatctccctctatctccaacctggtatttcgtaagattgacattttgatcagcaagtattgccagcatgaaaacattatgtatactcgatatgctgatgatctcttattctcttccaaaaagaagctgccccccgagctcgagaataagatttcagagtatctgagcatcctctctctaaaacaaaacaacaaaaagaccctgtgtacaaaaagccacatatccatcaatggctatgtgatcgacggagaaacaaattccattaggctcagtaatcataagttgcagcgcattaacaaactgacccacgccatcattaatcggaaagatagccccaaagaaataatgaaggtcatgtacggtaagactttctcccagtatccctttaattacccaaaaggcaagaggaacttttacatcaagtactgtattgaccagatcaataacaaactgaaaggttacagaagctacttgctgtccatcattaaatacaacaagagcgagattatcatcacctcaacctataaggaaaagctaatgacagttataacgcggatagaaaagtgcatcgacatctacaataaactgaaatga

SEQ ID NO: 12312 - RNA, 1143 nt, unidentified
  source 1..1143: mol_type = other RNA; note = synthetic construct
atgctcactgctagtaaacttccctctcatataaccagggtcagctgcggcctgcaagtgacatgcgaaagcttgttctgtatcggctcagacatgaaaaccaacaaaatcaagctgccagcaagtttgggggcttttctgaatgaaaactctgacaccgcagtgaaagagcggaagattaaaggtaactatttttacagcgtggatgattccgtgctggataagcaccagacgctggctaagattctgtccgaggcaatcccaaagaatagtgccagcaagggcttctccgccgattgctcatatctcgatttcctgaaaccccacacccctagccgctttttcctgcgcatggatatctcgtcttttttccactctatccccgtagaacagatcgccaataagctgaaaccttactttgacaacaatgcggacaacgaatctcacgccgtgtccgtcgactccattctcaaaaaagtgacatataaggtgccagaaaccagctctaacaagaaaattctaggagagacgattttaccgatgggatttccatgcagtcctactctgagcaatcttttttttagacccctcgacatcgtcattcagtcatactgtcttgaacacgatgttatctacactagatatgccgatgacatgttgtttagcagcaaatataatcagaccatcggctcaggggacgtggagactttcattaaacgtctcatgaataagaactccctcttgatcaatacaaaaaagacactgtacaccgaagggcatatatcactaaacgggtacgttatcgactctaatggtggctgtatacggttatccaattcgaagctgctgacaattaacaagttaaccaagatgctcattgttcagaaggtcagcctgcggcatgttgcggagtccctgttcgggatgaacataagaaaccttccttatgagaacgccaacactaatgctttcttcgaaaagaaatgtaggaagatcgtcctagacaaagtgcgaggtttccgctctcatattatcggagtgaagaagcacggaatcgcaacaagttcaatatccgccgagagtgtaaagaagtacgagaagattatcgagaggttggagaaaattatacttcaacatggctga

SEQ ID NO: 12313 - RNA, 1056 nt, unidentified
  source 1..1056: mol_type = other RNA; note = synthetic construct
atgaaaattacaaagattgccctgtccgatgaccttagagcattcctgacaaatgatgacgtgcaactggtacgcgaaatgaagatcaaaaaggatttcttctaccacctggaaagcgaggaaacggctaggtaccacaagaagattgagatcctcataagtaagtacattcctgtgagccgatcaagctatggatttgtcaaaggtaagtcatactttgacttcttatctccgcatttggatagcaaatacttttcccgtctagacataaaaaagttcttccactccataagcgcggacgatttgtcaaaaaagttgaaaccctacttcgttgataaacttgataaagactccaatgttcgacttatcgatttaattctcaagaagctgacttatgaagtgccagcaaacagtaagaaccagtactttatcggtaaaaagattctgcctatagggtttccatgcagccccattatttctaatctggtactgaggcccattgacattcagatcgaaaaaatctgtaaggaacataacgtcatctataccaggtatgctgacgacatgctcttctctagtaaatacatgctttcactgtttaacggggagattaaaaactccgtgaatcgcattatctcacacattgggctaaccctgaacgaatccaagaccgttattaccagcggccatatatccttaaacggatatgtgatcgatggcactaccaatactctgcgcgtgtctaatgagaagacaatgaagctgaagaagactatccggctgatcatccttaaaaaagagcggtttagtgctatcgcctgtaaatactacggattgaatatcaagaacctcagataccacaatgccaatacagacaaatatttcgagacgtattgcaagaacatagtcctgaataagctcagtggctatagagcctatttcatctcgattctcaagtttgattctgagcataatgtgttggatgagaagagcataatcaaatataacctcatcatctctgacctggacaagatcctaaacgagtaccggaactga

SEQ ID NO: 12314 - RNA, 1035 nt, unidentified
  source 1..1035: mol_type = other RNA; note = synthetic construct
atgaaactatcacagaaagaggtattaaacgcactcaaggtgcaaagcatcgatgacatcaagaagatatccaacgaattttcctttaaggacggcttctatattcccgagtcgatggaatataagatcctgtctaagaacctgtcagtgatctttagcaagcttcctctgtcttctgctgccaaggcctacaggaaaaagcactcatactatgatttctttaggccccatctcgaaggagagcactttcttcggttggatataaaagccttcttcaacagcattactagtgagcatctcgaggggtttctcatatctcacctgaaaggaaagaatgcgtatgagataaaaatgctcgcaagagctatcagttttttccttaccgtgaaagttgacaaaaagcaaatcctgccaatcgggttcccagccagcccttccattgcaaacttgatttttcgtcccctggacatcacaatagaaaagctgtgtcataacaagaagattatctactccagatactccgatgaccttctgttctccagcgctagcgggagtgtcattcactccagctggttcgagagtcagatctcttacattatttccaaattggacatgcgcctgaatacctcaaagcgaatcgctacgagcaaagaaatatcgctgaatggatatgttctctatggtgaggaaaataacaagaaaatccggttcagcaatcagagactgagaattctgaaaaagctcatccactacaagaaagtccgcaatcttccggaccgagtgattgccaagaaactcttccaggacgaagtgaggatcttggatagttcactgaggttcaacaagaagtctgaattcctagatacattttgccgcgaccaggtgattaataaattgcggggctaccgttcatacttaatctctctgctgaaatacgacaatctatatagttgtgtcgatcgggagtacaagatttacatctgcgatttaattggcgagctgaactctatcatcttttcctatgatcgcggttga

SEQ ID NO: 12315 - RNA, 1029 nt, unidentified
  source 1..1029: mol_type = other RNA; note = synthetic construct
atgaaactttctcagaaagagattttcaaggctctagaagtgaagagtatagaggatattaagaagatcagttctgactttgccttcaagaatgggttttacattccacgctcccccgaatataaaacatcaagtgaaaacctgaacgttctgtttagcaaattgcctctgagctcagtcgcaaaggcataccgaaaaaaacacagctactttgatttcttccgtccccatctcgacggggaacatttcctgcgtctggatgtgaaggcatttttcaactcgataaagcgggagcaaatcgagatttttctgatttctcatttgcggggcaaaaatgcctatgaagtgaaagtcctcgcgaaggcaatcagtttctttcttactgtggaggttgacaagcagagggtactacctatcgggtttccagccagtcccgccatcgcgaacctagtgtttcgaccgctggacattgctattgagaagttatgtcacgagaaaaagatcatctattccaggtatagcgacgattttctgttctccagcgctagcaatagcatcatacactctaactggttcgagtctcaaatctcctacataattagcaagttggatatgcggttgaataatggcaagagaattaccacctcaggcgctatctcccttaacggatacgtgatctcaggtgaggaaaataacaagaagttaagcttctctaacctcagactgaaaacgctgaaaaaattaatccacttcaagaagatccgcaagctttctgacaaaatgatagccaaaaagctgttccaggacaatctgaagaacctcaatttgaaatactccgatgaaaagtcattcatcgataaattttgccgcgatcaggtcattaacaaactgagaggttacaggtcctatctgatatcacttctcaattacgacaacctctattcctgtgtagattccgcccatcggagacacatttgcatcctgatcgaggacctcaattcgattattctcagttatgacaggggatga

SEQ ID NO: 12316 - RNA, 1035 nt, unidentified
  source 1..1035: mol_type = other RNA; note = synthetic construct
atgaaactctcacagaaagaaatcttcaaggccttgcaagtcgagagcatcgacgacattaagaacatatcaagcgatttcagcttcaaggggggattttacattcctaacgacctcaaatacaagaccagttcccagaacctctcgaaattattcagcaagttgcctttgagctcagcagccaaagcctaccggaaaaaccattcatatttcgacttctttaggccacatctcggcgggaagtactttctgagattagacattaaggccttctttaactctattaagcgagaacagattgaggatttcctaatctctcacctgaaaggtaaaaatgcgtatgagatcaagtttctcgccaaaaggatcagtttttttctgactgtggaggctgataaagatcagattctacctattggtttccccgcttcaccagctatcgcaaatcttgtgtttcggcccctggatatcgctattgagaagctgtgtcaggagaagaaaatcatttactctcgatactcagatgacctcatgttcagttcggagaacagttccacgattcattccaactggtttgaatcccagatctcctatataatctctaagcttgacatgcggctaaataccaggaagcgtattgcaaccacagataccatatccctgaatggctatgtgatttctggcgaatctcccaataaaaagatcagcttcagcaaccagcgcctcagaatactgaagaaactgatccactacaagaaagttagaaagttgccggacaaggtcatagccaagaagctgtttcaggacaatctgaaatcccttgattcctccctcaagttcgcgaagaaagagagttttcttgatacattttgccgggatcaagtgatcaataaattacgcggattcaggtcttatctgatatcactgctgaattacgacgacctgtatagctgcgtacaaagcgaacaccgcgaacacatcagtagcttgacagaagagcttaacactatcatcctgtcttatgacagagggtga

SEQ ID NO: 12317 - RNA, 1026 nt, unidentified
  source 1..1026: mol_type = other RNA; note = synthetic construct
atgaagaagatttcagtggcagagattttgacaagcctgggagtaaaaagcatagctgaaattgaccagatcccaaaggatcacagactcgttagtagctatcatgtggccggatcctctgcatacctggcagcctcaaaaagtatcgggcagctgatttcaagattaccgctaaatagcagctcggtggcctacaggaaagggctgtcttattttgatttctttcggccccatcttaaggggaaatacttccttcgtctggacatcaagtctttctttcacagcataacaatcgactccattatcagaacatttgattcccacatcaagggtagtaaacgacgggagaagagtgaactgaccaggaaactcactgactttttgaccattgaattcgagggcaaaaagattctccctatcggctttccagcttcaccccaggtggcgaatctcgttttcaggcccctggatatccaaatcgagaaactgtgtctcgaaaagggtgtctcctatacacgctacgccgacgaccttctgttctcctcccagtctgaaaaggtcatccattctacgtggtttgagtccaccattagcagtattatttcacagcaggagttgaagctaaacaacagtaagaagataaagactaagggcaaaatcagcctgaacggatacttaatctctggctcagactacaagaaaatcagcttctcgaataaaaggcttactgtagttcggaagctactctatttcaagaacaagaaaaactacgatgacctgagcatcatgcggcgcctctttcctaccgatcttaaaaatctgcatcttgtgcaccctaacaaaaatgaatttctgaaagtgttcgctcaatctcaaatactgcagaagttgaagggattccgctcatatttgctgtccatagtgaattacggcgaaaaatataattgcattgagcagtctcaccgaatcgtcctgctcgagctcatatccaatctgaacgatgtcattttaaagtatgagaactga

SEQ ID NO: 12318 - RNA, 1029 nt, unidentified
  source 1..1029: mol_type = other RNA; note = synthetic construct
atgagtaagatcagtatactggaagtgctgagctctctgaatgtggagtccattcaggatatcgacaaaatccccaagaacagtaaacttaagagcggctatcatattccagataatggtgcctatagcgaggccagtagcgctttgggtgagttgctgtcaaagctcccgctgaataactcatcagtggcgtacaggaagggatactcctactttgacttctttcgccctcacatcaaaagcaattacttcttgagactagacatcaaaagttttttccactccatcagcaaatccgtgattgagcaaactatagagtctcatttgcggagctcaaaagaactggataaatccctcctagcaaggaaggtcagcgaattcctcacgattaaatatgacaaagtcgacattttgcccattgggtttcccgcatcaccaagggtggccaatctcatattccggcctctggatattcagatcgagaaaatctgtcttgagtctggcattatttattctagatactccgacgatctgcttttttcctctatcaacgacaaaaccattaagagtaattggttcgaaagtcagatctcgtatgtaatctcccaactcaacatgaagcttaacaacaaaaagaccataaagaccaagaatcagatctcgctgaatgggtatgttatctcaggctccgaaaataacaagtacatgtccttcagcaacgaacgtctcaaactgatccggaaactcatttacttaaagaaggtgaagaagatctctgacttctcaataatgcgcaagctgttttttaccgaaatcagcaacctcaaactgatctatcataacaaggctgagtttacacaggtatacgccaaatctcaagtcgagaataagcttaagggcttccgatcttacctactgagcctggttaattatggagatagatacgattgcgttcagttagagcacaagaagatgctgattaacttaattgaagagctgaacctgcttatattccagtacaataactga

SEQ ID NO: 12319 - RNA, 1071 nt, unidentified
  source 1..1071: mol_type = other RNA; note = synthetic construct
atgaaaaccattaccaaaaagtacttcatggagaacattctaaactctaacccccctggggatatccctgacaattcaattcaggaagttaggattggcaaagactttgcatattcgattgacaagaaattcgagtcctacagtatcaataaacgcctgacaagtctggtatttaacaaagtcccactgaatgattccgctgtggccttcaggcaagggatgagctactatgactttatgtttccccacaagaataattacaagttcctccgattggatgtcaaaagctatttccattcactgagaatacgggcaataaggaactgccttaaacattacttcatgggatctaggctgaccaataatacgacgatggtggaccaggcgctgaaatattgtacatacactatccccaccgatagcaaaaacgtgaagttctccgaaaaagttgttttacctataggtttcccatcctctccggtaatctcaaatatcatttttcgtcagctggacatagagattcagaaaatctgctacaaacacgagatcatatatacacgctacgccgatgatatgttgtttagcgctaagaagagcaatatttacatccacaacgccctttttgaggaggaaatctctagattactccagcggctatccctcaaactcaacaataagaagactctgaagaagaatcatacactgagccttaatgggaatgtcatagcctttggcaaagctggaggttcgttaagattgtccaacaagaaagtgaagttgattaacaaggtgacttatctggccctggtgaaggaagagagtgccgtgttcatcatgaataaactcttcaacgtgaacattaacaactacaactttcagttccagcaggacgaaattttcttcaagaaggtctgtatggaccaactttttaacaaagcagtcggctatcgctcatacctgctcagcatcatccaatttgacaagaagaacaattgcctggagactagataccgaaagaagtatagtaagatcattacccggctcgataagctgatcgatatctattcttga

SEQ ID NO: 12320 - RNA, 1029 nt, unidentified
  source 1..1029: mol_type = other RNA; note = synthetic construct
atgaggatcaatagtaagttatacgatgatctggagaactacttcagcatgtctgtgaacgagttaacaattacgacctctttggaggcaaaagatcgggttgagatcttttctatcgaaaagaagaacaaggagaaaagagagatacacagtgtcgatacaaaaaccacgatgtggaaagtgcaaaatttcctgaacaataagtacttctaccagaataacttccctgagtatgtgtttggattcttgaaagggaagtcatactttggctttctccagtaccatgtctccaagaaaaacaccaataattttctgaagctcgacatcaagaatttttttggctccatcgacactgaggtgttgattgaagacattgtgaacgacttcgaagaggacacctataagaaggaagagctgaagatgctgttcaaagtggtcctgacatataaagatcaactcccacagggattccagacctcgccctatctgagcaactattatttcctgagggcagatctccggatcaagaagtactgcgacaagctcgattttaaatattcacgctatgccgatgacattattatctccaccctctcaaaaggggaaaaactgttcagtaagggcactgtttccatgatagaccggatcatagcggattttgacctgaagcttaataggagtaaaactcgagtggccaagcgtgaactggtcctgaatggtttcgtgatatcttccgaagtgaggctgagtcagagcaagctgaaagaacttcgcagagttttgttcatcatagagcacaaccagtgtaaaaattcagaccagcttttagacctaatcaattccgacaaaaagattaacagcaagaacaaaaagcgatactacagcactgaatatttgctaaagtacctctctggtattcgcgcctttcttatctcctcactaaagaacattagcacaaaaagcgattggtacaagacagcttctaaactgatcgtaagagtcgaggctgtaattcttaaaatgtactga

SEQ ID NO: 12321 - RNA, 1005 nt, unidentified
  source 1..1005: mol_type = other RNA; note = synthetic construct
atgtataacttaagtgaccacatcgaacacgtttacaaaaagaacattagcgagctgattgaccagttagaactcgataagaagaacaatgtcgaggaattcaatataaacaagaacaacgggacgaaaagaaatatcaccatggttgtgggggattgcatcttgggccgactgcagtctttcctgtcagataattacttcaataaggttgagttccctatcaattccttcggatttagggagaactgctcttactttgatttcctcgatatccattgttcgagcgaggaaaaagacttccttaaattggaccttaaagacttcttctctagtattgacgctaagctcgtgtgcgaaaacctggccaaagattttgaacgcaatgtgaagaagcgggtgaaactggaggagttatttttcacagtgattaccttcaagggtaagataccacagggttttaagacaagcccctttatatcaaactactttttcgtgagggcagatctgcgttttcaaaaatactgtgacaagctcaactaccagtattcacggtatgcagacgacattatcatctctagcaatacaggcaaagacttttttgtagggaacactatcgccatcgctaaaaaaatcttggctgatttcaacctgaaactaaactccagcaagactaaatatgcgaagaatgagctcgtcctaaacggatatgtcattagtaatgagactagactgtctcagtccaagctgcgagaaattagaagggtactgtttattatggagtcatccgtgaatctggatgtcgcaaccgaccgcttgaatagtaagaagtacttcagctctaagattagcaaccggatcttcgatctcgagtatctgtttaattacctgtccggctatagatcctttcttatatcaagcatccagaagaaggagacaggaaaatggaaagacaccgcctccaagctcatcaaaaggattgaagcccagcttctgcgccaagaatga

SEQ ID NO: 12322 - RNA, 1029 nt, unidentified
  source 1..1029: mol_type = other RNA; note = synthetic construct
atgttaagtatccatgagcatatcaaggataggttagaaattagcattgaggacttggtaaaggttatcaagtccgagaaacttaataacgtgtgcacctataatcttagcaagaaaggcaaggagagacaggtggtcgaggtcgataaggacactacactttactatgttcagaccatattgctcaagtttttttcctctatcaaccattttcccgagtacgtatttggcttccagaaacacaaatcctattacaaattcctggacatgcatactactggtaacgacgaaacgtatttcctcaaactggatatccagaattttttcaccagccttgacgctgaaaaactgcttaccaatctggtggcacaatttgagcaggtgacagccaaccagcctatagtcaaagagttactctatgccgcactcacatataataataagatcccgcaagggttcaagacttctccattcctgtccaattactacttttttatagccgatttgcgaatcaagaagtactgcgataaacttaacatcaagtactcaaggtatgcggatgacatgatcttttcatcccactttaagaaaaacatctactctaaccgtaccattaaagctttcgaaatcattctgttcgatttcaatctcaagctgaataagagcaagacgaagctgtctaagaaagaactgtgtctgaatggatacgtggtgtcgaacgaagtgaaactgagtatgaacaaattgaaggagttgaagagaatactattcattatcgagcaaaacaagcaaaaacagaccaaggacctgctgatttcaataaacaatcacacttatctccacagtagcaggaagaagaacacacgctactttagtgaagagtacctgaaaaattacctgtctgggtatcggtcattcctgctcagcttcattaaggaaaacacacaccagaaaaaatggcgggaaatctccaaaaagattattctccgcatcgagaaagccctactgattctctatgacctacagtga

SEQ ID NO: 12323 - RNA, 990 nt, unidentified
  source 1..990: mol_type = other RNA; note = synthetic construct
atggacattttttctaagaagcagtttgaacacctgttgaatattgatattgagaatgacacacagaagatcattgaagagaagaacaacatcaagaacatcgagatcgtggtgaacaacaagactaggaatattctgcgtctacccacatcaagtcttatacgcagcactcagaagaagatccagcataccatattgtccgacgaatattatccggattgcgtgtgtggatacgtgaagaaaaagagctactttgactttctgaaacctcattgtgataaaaagtacttcctgaggatcgacatcaaagatttcttcgacagtatttccagcgagaaactcactattctcttggccgagaaaatcaggatcaacgacccaaaagagcgaaaggagatcatggacttcctactcaatatcctgttcgttaacaaaaagttacctcaaggcttctctacgtcgcccgctctttctaatctgttttttaagcgggccgacctgcgcattgagaaatactgtatgacacagaagattacctatacccggtatgtcgatgatttgctgttttcctctaatcaaaacaatctgatcgggaccaaaatactgacgacaattaagtacatctgcaaggattttggcctggagatcaactacaaaaagataaagcgcggtatcgataccttctctttaaatgggttcgtcattgataactcagaaattagactttcccggaaaaagttggcgtacctcaaagaagtattattcttcctggaccacaattgccacaaagacaaccttgacatactaatttccaaagaattcggatccaagttttactatactgagaacattctcagctttctgtcaggctatcgagcattcctgatcagcagcctgagtagtaatccatcaacatggaatgataagtgcagacttctgatcaacagaatagaaaaactcaccatcatactcagcaaaaagatcctctga

SEQ ID NO: 12324 - RNA, 1005 nt, unidentified
  source 1..1005: mol_type = other RNA; note = synthetic construct
atgcaaatttttatctacaaggaggagtacttctatgataaaattttgtcgagcagcaaggcattaatcgaagaaaccattaaggacaaagacaaattctacagggagaagaaaatccctaaaaaaaacggtgacaggacactgttctgtcttaagaaagactgccccctatctaaagttcagcagaacattcggatgaacttcttgaacaaaattagtattcccgactatgtgtacggatttgtaccgaatcactcctataaagatttcttactgccccatactaataagaagtactacatccgactcgacatcaagaatttcttcgattctatcaactcggaaatactctctgagatcttttcctactactttcaagtgaaagacgtggtaaatgatgttctgctgcgacagttcatcgaactcgtgacactgaatgatagagtgcctcagggggccattaccagcccaattatttccaatatcatatttcgccagctggatctcaggatacggaaatattgcgcgaagtttaacatcacctatacaagatatgccgacgacttgctgttttcctcagataacccatatctgcacaaggacttcttcatcaagaagataaagtatatcgtcagtacgaaaggctttcaattaaataaggggaaggttagatacgacaaagatttcatcagcctgaacggctttgtcgtggaaaaaaatatccgtctgtcccggaaaaagttgaagaacatttcaaacactctgtttatccttgaacgctacaagaataagttcaacctgaacattgtcctcgccgagatcaataagatgcagttgaagaaggagatcagctcaattagtgagcttatcaattaccttgctggataccggagctttctcatacagctactggataaagagaatcttgagaatttcgaaaacgagaaattcctcaagtatattaaccgcatacagaccgctattatatttctggattctcagtga

SEQ ID NO: 12325 - RNA, 1005 nt, unidentified
  source 1..1005: mol_type = other RNA; note = synthetic construct
atgcagatttttttataccgcgaggatttcttctacaacaaagttctctcaagcagtaaaaaagcggtggacgagataatcaaaaacaaggacaagttctatcaggagaagatcatccccaagaaaaatgggtatagaactctgtcatgcctgaagaaagatagctctctcagcaaaattcagcagagtattcgctccaattttcttaacaagatttccattccagactatgtgtatggattcgtccctaaacatagttacaaagacttcctcagtccacacaccaaaagaaaatactacattcggctggacatagaaaacttcttccaatcaattgatcctgatacactaaaagaagtcttcgcatactattttcagatcaaccacgtgaccaacgaagaattgctcaaacagtttatcgagctggtgacactggataacaaggttccgcagggggccataacaagccccattgtatccaatatcgtcttccggcagctggacctgaggataaggaattactgtaagaagttcaacatcacctacactaggtatgctgatgacctgttatttagctctgacaatccttacatccataaggatttcttcatcaagaagatcaagtacatcatttctacgaagggctttaaactgaataagaacaagattcggtacgataaggaatttatttcgttgaacggatttgtagtggaaaataatatccgcctttcccggaagaaactgaaaaatttgtctagcagcctgtttatacttgaccgatataagaacaagttcaaccttaatgaggtgctgatggagatcaacaagatccccttcaaaaaagagattaattccatcggctccctcataaattatctgtctggctatcgtgcctttctcatccaattgctgaacagagagaatctagaaggtgacgagaataagaagtttttaaggtacattgagcgaattcagaacgctatcatctttctcgattcacaatga

SEQ ID NO: 12326 - RNA, 1002 nt, unidentified
  source 1..1002: mol_type = other RNA; note = synthetic construct
atgcagattttcttgtataaggaggacttcttctacaagaaaattcttctggactctaaggagtccatccaggagattattaaggacaagaacaacttctaccgaaagaaaaagatcccaaaaaagaagggctaccgtactctgtgttgcttagaaagggacagctctttgtacaaagtgcagcagtccatacggaaaaactttttgaacaagataagcatcccagattacgtttatggctttgtgcccaagagctcttacaaagattttctcgtccctcatacaggtaagaaatattacctaagactcgacatccagaactttttccagagcatagataccaaagtgctgaaggaagtattcctttattactttcgactgaaggacaataacgaggaaactctgaataattttgtcgagctcgtgacactggaagataaggtgccccaaggggccgtgacatcacctgttatcagtaacgtcatttttaggaaactcgatctgcggatttataactactgcaagaagtttaacgtgacctacacaaggtatgcagatgacctgctgttttcctcagataatatctacattcaccaagagttcttcatcaaaaagatcaagtacattgtctcgacgatgggttttgaaatcaataaatccaaatcccgctacgacaaagacttcattagtttaaacggattcgttatcgatgaggacatacgcctgagcaggaaaaagatgaagaatctctcttctatcttgttcgtcgtagagaagcatcggaatagatttaatttaggagatgtgctgactgaaattcagtcacttatccacaacaaacaaattgattccaaacatagtctgatccactatctagctggctatagagccttcctcatccagttcatatcaaaagaacagaagaccgacctcgggaataaaaagatttttcgctatatcgagcggatcgagaataccatacttttcctgtatagcctgtga

SEQ ID NO: 12327 - RNA, 1005 nt, unidentified
  source 1..1005: mol_type = other RNA; note = synthetic construct
atgcagatatacatttacaaggaggacttcttttacaacaaaatcctctcaacctctaaaacacaggttgaggagattctcaacgacaagaatagatattacacaaaacgcaagatcccgaaaaaaaatggatttcgaaccattaactgcctagaaaaaaatagtgcgttatccaagattcagcagtctatcagactcaattttctgaacaaagtctcaatccccaattacgtgtatgggtttgtgtccgggcagtcttatagcgactacctgaaacctcatgttaggcagaaatacttccttcggttggatatcaagaattttttcgagaacatcacgtcacagaccatcgagagcgtgttttcttattacttcaggctgaacacaaatactaacaatgacgaggagttgcaattttttattgacttagtcaccctgaacggtaaactgccacaaggcgctataaccagtcccacaatttctaacatagtattccgtcagcttgacattagaattaacaagtactgcaagaagttcaacatcaactacagcaggtatgctgatgatctcctgtttagttccgataacgatttcctccacaaggaattcttcataaagaagatcaagtacatcctgtcctccagaggctttgagattaataagcacaagatacgctatgagcaggattcaatctccctgaatggatttgtgatagaagaaaatatccgcttaagtcgatcgaaactgaaaggcctgagcaaagtgctattcattattgacaagcataagaacaacctggatactactaaagtgattagcgaaatcaatgacggtgggttcaacaaagaaatcaagaataagtacagcctgcttaattatctcgcaggataccgggccttcttgttgcaattccttgatcgcgagaacctggaagactataacaacaagaagatcaataggtatgtcatccggatccagaatgccattgaactgctctatcaatga

SEQ ID NO: 12328 - RNA, 1002 nt, unidentified
  source 1..1002: mol_type = other RNA; note = synthetic construct
atgcagatatacatctacagggaagactttttctacaacaaaatccttgccaccagtaaatcattggtagaggagattctgaaggataagagcaagtactatacaaaacgtaagattccgaagaagaatgggtttcggaccattaattgtctagagaaaaacagtgccctctctaagatccagcagagcataaggataaatttcctgaacactatttccattccaaattacgtgtacggttttgtttctggccagagctatagtgattatctgaaacctcatgtgcgccgcaaatattacctgagactggacatcaagaatttcttcgagaacataactaacgacaccctggaatcagtgttctcctattacttccgcctcaacgataacaagaataatgaggaattgctcctgttaattgatctgatcacgctggacggcaaactgccccaaggtgctattacatcccctactatctccaatattgttttccgtcagttagatatcagaatcaacaagtactgcaagaagtttaacatcaattactcccgatatgctgacgatctcttgtttagcaccgataataagtttcttcacaacgacttcttcatcaagaaaataaagtacatcctgtctacccgggggtttgagcttaataaacacaagattcggtatgaccaagactcaatatcgctgaatggcttcgtgattgaggacaacattaggatctctcggtctaaactcaaaggacttagtagcacactatttatcattgacaaacatcgctccaatttcgacatcacaaaactactgtctgatattaacaactcaggattgaatcgagagatcaagaacaagtatagcctcctcaattatctggcagggtatagagcgtttcttttacagtttctcgatagggaaaaccccgaagagtactataacaagaaagtctcgaattacgtcatccggatccagaacagcatcgaattgctgagaggatga

SEQ ID NO: 12329 - RNA, 1017 nt, unidentified
  source 1..1017: mol_type = other RNA; note = synthetic construct
atgttagggtacatctataccgaggactttttctacaaaaagctgctctcctctgagaaaaagatcgtcaaaaacactctgctcattaaagagagtttctataaagagcgagatctgtctaaaaaaggcggaactagaaccctgtcatgtatcgagaagaatagctccctgtataacttacagaacaatcttaggagcaatttcctgaataacattcccattcctgacaatgtgaaaggatttgttcccggtcactcctatcgggacttcgtgattcctcatctaaacaacaagtattatctgcggcttgacatcaaaaacttctttgacaacatcactttcgagacggtcaaagaagtatttggcgaatactttaagttggacaacgcatccaataacaataaattgctggaaacctttgccgaaattatcacacttagagggtccttgcctcaaggcgctgtgacaagcccaacagtgtccaatatcattttcaggaggatagatatccgcatcgcccgctactgcaagaagtttaacatcaattacacccgctacgccgatgatctactgttctcgtcaaatcagtctaatctccataaagggttcttcatcaaaaagattgcattcatactccgggatctgaatttgaagataaacagcagcaaaatcaagaagaccaagaactacattagtttaaacggctttgtcgtagataaggatatttctctctctagaaagcgtaagagtgacctcaccaaaatactgttcattatcgacaagaacaaggcggtgtgcagtacagatgccctcctgtttattctgaataccgagagctacattcacaagtcatactttttcaaagacaagtggtcacttgttaactatctaagcggatatcgagctttgctgatcgattggcttccaatcaataaggagacgatgaattacgaaaagtcgaaaaagctcataactaggatcgaaaaggtgatagactttctgctgggtgagaactga

SEQ ID NO: 12330 - RNA, 996 nt, unidentified
  source 1..996: mol_type = other RNA; note = synthetic construct
atgatcattatcttcatctacaaggaagactttttctacgattacgtgttacgaaatagcctagaagaaatcaacaaacagatcattgacaaacagaactactattacactgtgaagattccgaaaaagggcggcattagagtgttgaactgcattaagcagaaaacccctttatttgagttgcaaaatctgctgaaggttaacttcttggacaaaatacctatagccgaaaatgtttttgggtttgtgaaggagcaatcttataaggattttctggtgccccatacctgggagaattccagggagagatattatttacgggtggatatcaaagacttctttggttccataacaaatgataccatactggaggtttttgactattacttcaagacaaacgagaaaagttcaaaggagatgaatgaattgcttatgcagatcattagtctcaatggttgcctcccacagggggctgttacgagcccagtagtgtccaatgtcgtgtttagacagctggacattaggattcaaaaatactgtgagaagttcgatgtgacttattctcgttacgcagatgacctactttttagttcagaaaaactgaaactgcacgataagttcttcataaagaagatcaactccattctcatgtcctcaaacttcaaagtcaatgacaagaagatcattaagaccgaatcggaaatttctctgaacggatttgtcgtcggaaaaaacgtccgcatctctcgatcaaagaaaagggatctgaaccggatcctgttcatctatgaggacaagaaacccaagaatatcaaagactttcttgatctgctcaacagcaacaagttcaaaaatcgcgtgaaagtaaataacaagtacttcaacgacaagaacaacctcctcaactacctgaatggctaccggagcttcctgatcaattggcttaataataacagcagcagtatcgagtataaaaagcagaagaaggtatattga

SEQ ID NO: 12331 - RNA, 1068 nt, unidentified
  source 1..1068: mol_type = other RNA; note = synthetic construct
atgcgaaaatactctttcaacttcgaggtgatcatcatctacatctacaaggaggactttttttatgaatacgtgcttcggaatcccttagaagaggtttctaaacagataaagaacaagcaagactgctattataccgtcaaaatcccaaaaaaaggtggagtaagggtgctcaattgtatcaaacaggacacatccttatttgaactgcagacctcactgaaagtgaatttcttggataagatccctatagctgaaaatgtgtatggttttgtgaaggagcagagttataaagagtttttgtttccgcacgtttgggataatggcaaaaaacggtactacttaagggtggacattaaagactttttcggaagcataacttccgagacactgatcaagacgttcaagtattactttaagacttcggataaggtgagtaaagaactaaacgaactcctgatgcaaattatttctctcaatggggtgctacctcagggcgcagtgacaagccccgtcgtcagcaatatagttttcaggcagctcgatattcgtatcaagaagtactgcgacaaattcgatattatttacagcagatacgccgacgatcttctgttttcttccagcagcatgcgcctgcatgacaagttctttatcaagaagataaaccacatgctgaagagtctcaatttcaacatcaacactaagaagatcaagaaaaccgagtcagagatttccctgaacggcttcgtcgtcgggaaaaatgtacggatttcaaggtcaaaaaagcgggatcttaaccgagtactgtttatttacaaagatcagaagccaaagaacatcaatgatttcctgaacctgttgaacaacaacaagttcaaatcccgcattaagaacaacaacaacaagtacttcgaagacaagatcaatctccttaattatctgaacggatatagaagtttcctgattgggtggttgcataataataccctgtctgttgactatgagcaccagaaacaatatatcgagagattggaggaatttattctcaatgtgaatcgcatgaactga

SEQ ID NO: 12332 - RNA, 1068 nt, unidentified
  source 1..1068: mol_type = other RNA; note = synthetic construct
atgcggaaatattcctttaaggtcgaagtggtcataatctttatctacaaagaggacttcttctacaattacgtgctgcggaataactccctagaggagattaataaccagatcaaaaacaagcaagactcttattacactgtgaagattccgaaaaaaggtggaattcgagagctgaattgcatcagacagcatacacccttgattgagttacagaggtctataaaagagaattttctggacaagatcccaattgccgaaaatgtgtatggctttgtgaaaggccagtcgtataaggattttctgactcctcatatttgggagaacggaaagaaaaggtactacttgcgcgtagacatcaagaactttttcgactcaatttcagaagatacactcattaagaccttttcctactatttcaaggccaccgtcaaggctagtaataccatgaacaagatattgatgcagatcatcagcctcaatgggaatctgccccagggagcagtcacttcgcctgttgtgagcaacatcgtatttcggaaactggatatcagaattcagaagtactgtgataagttcaactttacatacacccgctatgcggatgatcttctatttagtagcacatccacccggctccacgacgattttttccttaagaagatcaagtacatcctcaaaagctcagatttcaaggtgaataacaagaagatcaagaaaaccgagaatgaaataagtttgaacggcttcgttgttggggaaaacgtcagaatttcccgttcaaaaaaaagggacctcaatcgagtgctgttcatatatgagacgtataaaccaaaacgcatggaggacttcctcgtgcttctgaattccagcaagttttctagccgcgtggagttcaacgacaagtacttcaacaacaaaatcaacctgctgaactacctcaatgggtatagatccttcttaattagttggctgcacaactctacttctagcaaaggtaacaacaagcaagttgaatatatcgaacgtttagagaatctgattctggaacttaataggatgtcttga

SEQ ID NO: 12333 - RNA, 1038 nt, unidentified
  source 1..1038: mol_type = other RNA; note = synthetic construct
atgatcatcatattcatctacaaagaggacttcttttacgattacattctccaggactcccttgaggagattaagaaggtaatcgaaaataaggagaacaactactacatcatcaagatcccgaaaaaagatggactgcggaagcttaattgcatcaagaaagagacgaaactttatcagtatcagaccctgattaagaataagtttctgaaccgaatcccaattgcagaaaacgtatacgggtttgtcaaaggccaatcctataaagactttttagtgccccatacctgggaaaacaacaagaaacgtttctatctcaggatagatattaaggacttcttcggtagcataaatacagacaccctccgccaggtgttcaggtactatttcaaaacagacgaaaatgcctcaaatgagatgattgacctgctattggatatagtgtcactagacggctttctgccacaaggcgctgtgaccagtcccgtgattagcaatatcgtgtttagacagttagatctgagaattcagaagtactgtaataagctgaactttacctatacaaggtatgccgatgatctgctcttctcaagtattaacaagcgaatctatgatcccttcttcattaagatgatatcaactatcctcaagagcagaaacttcaagatcaaccactctaaagttaagacatccgacgaagagataagccttaacggatttgtcgttggtaaaaatatccggctgtcccgctctaaaaaacgggatctgaataggatcttattcatattccaagaccagaagcctaaaaacattactgactttcttagcctgttgaattcgaagaagtttaaatcccggattaatgtcaataacgagtacttcagcaataaaactaacttgctcaattacctcagtgggtacagatcttttctgatttcctggctgcctgaaaacaaaagttctcctgatttcaagagctctaagatctatatcaagcgcattgaagagttgatcctgaacatcaacaatatgaactga

SEQ ID NO: 12334 - RNA, 972 nt, unidentified
  source 1..972: mol_type = other RNA; note = synthetic construct
atgaaggagaaaataaaggacaaacagcaaaactactacctaaaagacatacccaaaaaagggggacgccgctatttaaactgtattgaaaaagagacaccgttatatgtgtatcagacctccctcaaaaacaagttcctgaacaatataccgatttcagagaacgcctacggctttgttaaggggcggtcatattacgactttttggtgccccacacacgtggtaataatgagaatggaagatactttctcagaatcgatatcaaggatttcttcgattcaatcaccaccgatatcttagaagagacgtttaagtactacttcaaaacagacgaaaagtcaagtaatgaaatggtggggctgataatagacattattagcctgaatgacgttctacctcagggcgcagtgacttcccccgttgtgagtaatattgtctttaggcagctggacattcgaattcagaaatattgcaacaaactgaaggtggtctatacccgatacgctgatgatctcctgtttagtagcgtaaataaccggacacatgaacctttcttcatcaaaatgatcagcaatatcctgaagacattgaacttcaacatcaacttctctaagatcaagaagtccgaggaagaaatctccttgaacggatttgtagtcggtcaaaatattcgtatttcccggaaaaagaagagagatatcaacagggtgattttcatctataaggacaagaaaccgaaaacgactagcgagtttctgaccctccttaatagccagattttcaccactaggactcgcaaaaacaatgaatacttctcttctgagatcagcctgcttaattacctcagtggctatcggtcctttttgatttcgcttctcccaagatctaagcagtctatctactacaagaacatgaagaggtatatcaacaatcttgaggagctgatcctgaacattataaatctggagtga

SEQ ID NO: 12335 - RNA, 1038 nt, unidentified
  source 1..1038: mol_type = other RNA; note = synthetic construct
atgaggatcgatagcttgaacaagttcgagaagaaagttttgcgcggctcaatcaccgagtataatgaaagtctgacagacgattccattaaccaggcataccacactaaaatcattaagaagaacgacaactctgaaagaaccttgcagtgcatcgatagcaatcacgacatttataagattcagaagaagctcaagaacaatttcttcgactttattcctctgagtaatcatgcgtatggctacgtcaaagggaagagctactatgactacctgacccctcacattaagaaaaagttttatctgcgactggacatcaaggactttttcaatagcattaaggagaaaaagctgcgggaagtgatcgagtacgacatcgataacatcaaaataaacgaagacacgactcttgtggattttctgatcaaaacggtaacttttaacgggagcctcccacaaggtgccgtaacatctcccgttctgtccaatatggtgtttcgagttctggacattcgcatatctaggtactgtcggaagttcggtatagaatatagtagatacgtcgatgatcttctcttttcatccaatgacctgctaattcataagaaagtgttcacaaacggaatcaccaaaatcttaaaatcccaaggcttctatctaaaccacaataagttacggaaaagtaaggatgagatttcactgaatggcttcgtggtgggaagcgaaatccgtctctcgcgcaagaaaaccgccctcctgtctgctctgatattttgctaccagaacactcagaagaagacattcgataacctttcaacagagttcaaaaaacacttcgggattgacaacgagaaaataattaatgccgacagactccataattacttggctggctataggtcctttctgctcgggctcttaccatttgattctgtcggagtgcttcccgataatatgaccaaaatcaaccagaagtacctaatcaagatcaacgagatagaaaagcttttgaaactgaccagcaaagagatgaattga

SEQ ID NO: 12336 - RNA, 1023 nt, unidentified
  source 1..1023: mol_type = other RNA; note = synthetic construct
atgagaatagaatccctgtccaaattcgaaaaaaaagtgctgagggactctgtcagccactacgtagatcttcttacagaagagcagctcctgactgcgtactataccaagatcatcaagaagaaagacaaatctgatagggtaattcactgcatagataacgagcatctcatttacaagatccagaaacagctgaagaacaactttcttgatttcatccctctgagtaactgtgcatatgggtacgtgaaaggtaaatcgtattacgactatttgaagccccatgtgaaacatggatattacatgaagctcgatattaaggacttcttccacagtattaaggaaaaggagctgcgtgaggttctgaagtattacgtcgatgacgtgagcatcaatgagtctctgaccatactggattttataactaaggtggtgaccgttaatgaattcttaccccaaggtgccgtaacgagtcccgtcttgagcaatatttactttcgcttcctagatatccgcatatcacggtattgtcgcaaattcggcattaattacacccggtatgtcgacgaccttctgttttcaagcgacaatctgttcattcacaagagggttttcatcaacggcattacaaaaatcctgaaatcacagggatttcagctcaaccctaaaaaagtgagaaaaacgaagtccgagatcagccttaacgggtttgttgtgggcgaaaacatccgactcagtagaaaaaagactgctatcatttctagcctcatatattactaccaatgctctccaaataagaccctagaggaattgctaaccgaggtggagaagaatctcgagattaagatcaagatctccaacctccacaattttctggctgggtaccggtcatttttgttaggactgctgccgttcgattccgtcggcgtgttgccagaagtgattacaaggacagacaagaagattctgtataaaatcaacgagatcgagaagatcttagacctgactgccgccaatatttga

SEQ ID NO: 12337 - RNA, 1029 nt, unidentified
  source 1..1029: mol_type = other RNA; note = synthetic construct
atgcacatcgaggacctgaacacttttgaaactaaaattctacgggaaagcaccaaaacatgtgtcgagattctgaaagtggagaagatatccaaagcctactacacaaaaaccatttcaaagaagaacgggatgaaacgaactctccattgcatcaacaacgaacatatcctctataagttacagggaaacctgaagcggaacttttttgattacatccctctgtccagccatgcttatggatatgtgaagggcaaaagttactacaattacttggaaccacacgtgggcaatgatatcttcctaaaactcgatatcaaggacttctttggcagcattaaggaaaacaaacttcgcgaggttctgggctactatgtcgacgacattaacgttagcgataactttaccctcattgatttcatcgtgaaagttgtgacagtagatggtaagcttccccagggagccgtgacgagtcctgtcctctcaaatatactgtttcggcacttggatatccgtatttccaggtactgcaagaagtttggaatcacctataccaggtacgttgacgacattctgctctcgagtgcatctttctatcttcacaaaaaagtcttcgtgaacggcataaaaaagatcttgaaaagctacgacctgtatctcaacacaaacaagatcataaagactaagaacgagatctcactgaatggtttcgtaattgggaaggaaatcagattatctaggaagaaaacagctttcatttctgccatcatctattgttatcaacagaccaacaagaaaaacgtggacaacttcattaaagagatcaaggagcacttcaaacttacggactcaaccgagattaatctgctttggctgcataattatctggcggggtaccgctccttcctgctcggtctactgccctttgattctgtgggggtcttaccagaacacttgagcaagtccaacagaaagcttttgtacaagataaatgagatcgagaagatactggacctgctcattctgtga

SEQ ID NO: 12338 - RNA, 1020 nt, unidentified
  source 1..1020: mol_type = other RNA; note = synthetic construct
atgaagatattctccctggattattttgaaaaccgggtgcttaaggaaaagattgaaacgctcattatcgaccctgtcgaaaaagattcctgttacacccagatcgcagttaagaagcgggcggggggaataagaacccttagttgcatccatctatactcaagagtatatcactctcaaaagcgcttgaaagagaattactttgacaaaattcccacttcagacttctgctacggctataagaaagggttgtcctacaaagatttcctggcccctcatgtcgactctaaatacttcttaaggatcgatctgaaggacttctttggaagcatcacatgcaatctgttaagcgaggtcctgaccagttatatatcttgtcttccggttaataacacaacactgctggatctaatcattgacatcgtgacccttgatgggaagctcccacagggtgctatcacatcccctaccctttccaatattgccttccggcaactggatatccgcatatataaatactgtgagaagtaccaggtgatctattctaggtacgctgatgatctcctgttcagcagcaacaacatggttatccacaagctcttttttctgaaaaggatcagtaacatcttgaactcaaaagggttttcgattaatcgggacaagatagtgaaagcaactgagcagatcagcttgaatggctttattgtaggatccgagctgaggattagcagaaaaaaacgtagactgctctcggtgatcctctattgttttgacaagtacaaaccacgaacctataacattctgctgaatcacgtgaacgctgagctgggtgccaagcccattaagactactgaatacctcaataacttcctatcaggctatcgcagcttccttattggctggctcccatatgactctttgggctgcttaccctctgaagcctttctcagtgagttcgacaagaagaatctgcgactgatcaaccagattgagtacatattgaagaaattcaacccctga

SEQ ID NO: 12339 - RNA, 1047 nt, unidentified
  source 1..1047: mol_type = other RNA; note = synthetic construct
atgaaaatctacaaagtagactacttcgaaaggcaaattatgaacaatgaatacagcaccgaagacctacttgacgtgttcctaaaaaaagaggagcattacaacctttacgtcataccgaaaaagaagaatagaggaacacggaagctgtattgtctgtcgaaaaacaaggagttatacaggtgccagcaattgctgaaggttaatttctttgataggattcctgtctcagactattgctatggctacagaactggaaaatgctacaaaaactacctagaaccacatattggaaagaagtactttctgcggctggatatcaaggacttttttgactgtatcggcaaggatatcatcagagacttcctgcttacttatgtatccgaggatatcgagaataccattctggggaaagaaattagctttgggctgttggatcttatcactgaacttgtgaccattaatggccacctgccacagggcgctatcacaagtcctgtgataagtaatctgatctttcgctcactggacattaggatctatagatattgctgtcggtacgggattacatattctcgatatgccgatgacctgctcttctcatccgagaactctgtcttgcacaaaaacttctttaccaacaagatacagcacattttaaagtctggccagtataatttcgatataaactaccgtaaggtcaaaaagtgtaggggagaaatctccctgaacggtttcgttgttggtgagaacgtccggctctcccgcacaaagatcaaaaagatgaacacgatcatacatgtgttcaaaaaggaaaaggatctggacaagtataacatactcatcgagttgaaaaagaactacaatctcgtgttcgagaacgtggtggacttaaataattttttgagcgggtatcgatctttcctcattggtatcctcccctttaatagcctgggcgagctccccaataatattaaccgctacgataccaagaacctccgcattattagtgagatcgaggggatcctggaaaaggtgaataaatga

SEQ ID NO: 12340 - RNA, 978 nt, unidentified
  source 1..978: mol_type = other RNA; note = synthetic construct
atgaagaaaaacgccgagattagcaagatcacaaaccggaagatacagtgttattttcgggtcagcattcccaagaaaggaggcgagaggattatctattgcataaacccttcgtgtaaccttcggactctccagcagaacctgcaaaggaactttctgaatcgtattccgatccccaataacgtatttgggtttaagaagggatacagctataaagacttcctggaaccccatgttaacaaaaattactacctgagagtggacatcaaggatttcttcaattccatcagtaaggaacttatttacgatgtactcaccaattacttgaaaatggatgaagctgacaataaagaggtgctcgatactgtctttgatatcgtgagcctccacggaaagataccacagggcgcgattacatcaccatctattgcaaacgtgatattccgtcagattgacatgcgcatcaaaaagtactgcaaggtttttaacgtcgagtatacgaggtatgcagacgacatgctgttcagttcagacaatgagtatttgcttaagccttacttcataaagaagattgccaaaatcctgttctccaaagggtttcggatcaattctagcaaaatcaagaagtccaataacgggcagattgtgctaaacggcttcgtgatcagtgactccctgtctatctccagaaagcgattatcagatatccaaagagtgctcttcctgtaccaaaaagggggcgctcctgtttcaattagtatctttctagatcgcatcaattctgaacagtatttataccgcaaaaagatgaacggtaaatactttcccacccgaggttccctgattgattacctctctggctatagggccttcttgatccagtggctgccagaggacaaaaatagcaatgtctatgagaagctgaccacccttataaacagaattcagtacttgctgatcaatattgaggaaatctga

SEQ ID NO: 12341 - RNA, 1017 nt, unidentified
  source 1..1017: mol_type = other RNA; note = synthetic construct
atgtttatctataacgaggatttcttctacggcaagattctgaattgcagaaaggatgccttagaagatatactgtctaataagtccgacgaataccaggaaaggattatttcaaaaaagggtggaaagaggtatttgtcttgcctgagtgatacatctagcatcgctacccttcaaagaggattatccaataaatttctcgatcacattcccgtaccagactatgtgtacggttttattaagggcaagtcttacaaagactatcttgtgcctcataaaaatcgggagttttaccttagagtggacatcaaggactttttcagctccataaataaagacctcgtaaaagaagtgctggactactatattagaacagataatgacaccctgaacaagaatttgattgacatcatctacgatatcgtctctctcaatgatagcataccgcagggcgcgatcacttcacccagcatttctaatatcgtttttcgatccctagatatccgaatcaataaatactgtaggcgcttcgggataacctacacgcgctatgcagatgacttgctgttctccagtaacaacagttttctccataacaagtactttctgaagaaaatcagccacatcctgcagagtaagcgcttcaacattaactccaacaaggttatcaaaagcaacaagattatctcgctaaatgggttcgttgtcggcgagaaaatctggctcagtcggaagaggctgcacgatattaacaaagtgctgtatctctacaagacaaatactttctcaaacatcaactccctgttgtatgtccttaattcaagcgactacatttatcggaagaccaacaataactcattcactagcaaaatggagatcgtgaattatctggccggataccgttcgttcttactgcagtggtatgagtttcaaaatggggacaacaagaacttcaagttgctcaacaaaatagacgaaatcgagcggatactgattgagattgagcagcttaaatga

SEQ ID NO: 12342 - RNA, 1140 nt, unidentified
  source 1..1140: mol_type = other RNA; note = synthetic construct
atgaaatggattatcattatggccattcggaccatttacgacgaggagtttttctataagaatattttgcgcgaagagaaagagaacgtcatagagatcattaacaagaaaaaggagtactactacaacaagaccatcaacaaaaagaatggagtgcgcaatcttaaatgtataattgaggatagccccttatatttcctgcagaaaaatctcgtgaattactttctcaacaacattcccctgccgctgtatgtgtacggttttagaaaaggggtcagctataaaaagtatctggaagtgcacctgagagaagaggttgacaacaactatctcgaatccaatagtagaaaagatgtgtcaaaagactgtctacaacctcatctgaggaattacatcggaaagaagacctgctacatccgtattgacatcaaatcgttcttcgattcaatcaatctggacctcatcaagaagattttcagcaactactttactcctaaagattcctttcttaaggatgagctgcttgaaattttcagtcaaatcgttaccttggataacctactgcctcagggggcagtcacgagtccaacaataagcaatatcattttcatccgagaagatatcaggatttataactactgcaacaagctgaatatcaaatactccagatatgccgacgatatgttattttcctctaagcacaataaggtattcaaaacgtacttcatcaacatgatcacaaagatcctggatgagaatggcttcaagatcaactattctaaaaccaagaaggggttagacgagatatctctcaatggattcgtaataagtaactgcatcagcctctcacgaggcaggaagcatgacatctcaaagatcctgtatatctttgacacccttaaacccttctctacttctacttatttgaacatgttgaacgacaaggacaacaacttcaagtatataaagtacaaggctgactgttacttttcctcccggggcaaactgattaattacctctgcggttatcggagctttctgataaattggttgccacgggagaatgaggaactgacatacaataaggttaaaaggctaatcgatcgcattcaggaagtgattcttaaaatacaggaatga

SEQ ID NO: 12343 - RNA, 1035 nt, unidentified
  source 1..1035: mol_type = other RNA; note = synthetic construct
atgattgtcatctacatatacaagaaacacttcttcatcaacaaggtgctgggcacaaagaccaaaaatatctatgacctggtggaggaaaaagataaacactacttcaacaagacgatccaaaagaaaaatggggttcgagagctgaagtgtctgaaagagggagactttaagcatatccagcaaaacctcaagaagaattttctagacgaactgcccattccagattacgtttacgggttcgtaaaatactcctcatataaggactttctgctgccacatattggaaaaatgtattatgtgcggttggacattaaagacttttttccgagcgtgaagaaagatcttctgtttcaggcctttaagtcctattttaagctcgatggctcagacaacgatgacgtactgaatttgtttgtggatattgtgactcttaacgaggaactgcctcagggcgcagtcacaagccccgtcatctccaatatagtcttcagaagcttggacatcagaataaagtactactgcgataaacttggtattacctatacccgctacgctgatgatttgctattttcttccactaacgagcagctgcatagccggtatttcatcaaaaaggtttcgaagattctgggcgataaaaagttcaagctcaacaccgacaaaattcttaagtacacagacgagatctctctgaacggatttgtggtgggtgagaaggtacgtctcagtcgcaagcgaaagagtgatattgctcaggtgataagactgtgcaggaatgttaagaaacctgtcgactttgatacgctgctcagtcaacttaatcagttggatctccggtatcgcaaaaagactgtgagcgacaatggcgaggaggtgtacttctcatccaaagaaaccctagcgaattatttactcgggttcaggtctttcttcatagactggttaaacactaacttaatctctgacaaaagggaaatcaaattcttcatcgaccagattgaaacattcatcgataagcactacgccatctga

SEQ ID NO: 12344 - RNA, 2307 nt, unidentified
  source 1..2307: mol_type = other RNA; note = synthetic construct
atggtctttatcaaaatctacagtaaggacttcttctacaagtacattatcgaagacaaagaacaggatgaattggccgaaatcatcagcaataagatgtactcttatctcaggtttgagtacgagaaaaaaaatggataccgcttcatctacagtatgaaaaaggacactgggttatatgaagtacagaccaaactgaaggataactttctgaatgagattccaatcgccgaccatgtgtatgggtttgtctctggctattcctataaggactttcttgttaggcactgctacgaggataagaacaaaaccacctatttcttaaggctagatatacaggactttttcgaatccatcaagactaagatgattaaagagacactcgagtattacatcaagataaaagacgaggataaccctactgtgctcgatctgattaacgatctcgtcaccataaacgactttctcccgcagggagccattacatcccctgttctaagcaacatagtattccggcagttggacattaggttccaaaaatactgcaggaagatcaatatcaagtacagccgatacgcggacgacctcttatttagtagcaaggagagttatctgcacaagcgcaattttacgaataagattcggcatatcctgaaagacaaaggcttcaaactaaacttcaccaagacaatcaaatctcagaatgagatcagcctgaacggcttcgtggtcggcaataatatccggttgagcaggaagagaaaccatgacatatccatgatcctgtatctgtacgataaccaaagcgtggacgagttcataaacatccttaataaggagaacttcatctaccgtaataagaagtacgacatgaagacaaatgacgaaaagtactttatcaaccaggacgatctcattaattacctcgcaggctatcgttctttcttgattgattggatcccaataaaggatggcaaacacaaagagaagcacattaaactcatcaagaatcttgaagtgctacttgaagacctgagcgatattaacaatgaatacaactacaagggggataaaatgtcccagaaagaaaatatcccactgtcagtgccgaacctctcgaaagatattttgcccaatatagaagagactattgagtcgggttgggtttccacagggggaaagttcattgatcaatttgaggaaaagctggctgactacgtaggtgtggaccaagccgttagttgccagtctggaactgctggactgcacctggccatgcgggtattgggcattgggccaggtgatgaggtgattgccccgaccgtgacattcatcgcagcagtaaaccccattagatatatgggcgcggaacccgtgtttatcgattgtgattctgacgatggacctgctgggccctcagcagagcctactaacgcgtttaccaacgaggggtcagtcaacatggacttagataaactggaagagttcctcgaaaatgagtgtgaattgaccgatgggagggtgatcaacaaatcaagtggacgcgagattaaggcaattaacattgttcatgtcttcggcaatcctgtgaacatggagcgcctgatcgacattgctcgagagtatggtttgaaagtgatcgaagacgccactgaggctctggggtcttactacaccgaaggacggtacgccggaagatattgtggcaccatcggtgatatcggcgtctactcattcaatgccaacaagataatcactacgggtggaggcggcatgattgtggcaagagagtccgatctcctggaggaagccaaatttctctctacgcaggctaagtccgatagactgtattatagacacgacgaggtcggatataactataggatgaccaatatacaggccgcttttggcactgatcagatcgatagactggaaggctttattgccacaaagattgaaaactatcgacgatacaaagaggctattgcggagatagacggcctggagcttatggcatttaatgaagggtgtcgcccaaaccattggttctacagcgtgcttgtggaccctgacctgtatggtatcgaccgcgacgagctgctgcaggagttaaatgcagtggggatccagacacgtcccctttgggggcttatccaccagcagaagccatatctggactgccaggcttaccggattgaacaagccccctattaccaacaaaacctaataaatctgccctgctcctcaaatcttacagccgagcaggttaagaccgtcgttcggtatctgagagagttcaaaagctga

SEQ ID NO: 12345 - RNA, 1002 nt, unidentified
  source 1..1002: mol_type = other RNA; note = synthetic construct
atggaaggcatcgataaagaaaatctcctggagataattgccaacaaggaaaaccattatggcaagaatgaaatcagtaaatccaacggtaaacgtataatctactctatcgacaacaactctcagttatataagatgcagaagcatctcgtgaacaattttttgtcccaaatacccatcgcagatcatgtgtacgggttcgttaaggattatagctacaaggattttctcttgagacacattcacgataagaacaataagacgtactattaccttcgactggatattaaagacttcttcggtagtatcaactcaaatctcatcgaggagactcttgactattacattaaagtgaacgaagcggagaacggaaactctattattgagattatcaacgggattgtgacacttgaaaatttcctcccacagggcgctgtcacctcaccggtagttagcaacattgtgtttcggcagttggacatcagactgcagcgctactgcaggaaactcgacatcaaatactcacgctatgctgatgatctgctattcagttccaccaattcgaatctgcataagaacaactttttcaagaaggtttcctacatattgaaggacaaggactttcggctgaactattctaaaacaataaaggacgagaacgaaatctccctaaatggctttgtagtcggcaataatatccgactgagtagaaagaggaagaaagacatttctaaggtcctgttcctgtacaacaataaacctgacaatcaatcattcgtgagctacttaaatgaacacgaattcctgtatcgcgataagattggaagctcctactttctgaataaagacgaccttattaactacctggccgggtatcggagctttctgatcgattggatccccgtgaaagagggaaggcacaaagagaaacacataaatctcattgagaacatcgaggacttactggagaatatcagcgatgtcaataatgagtataactga

SEQ ID NO: 12346 - RNA, 1020 nt, unidentified
  source 1..1020: mol_type = other RNA; note = synthetic construct
atgtacattaagatctataacctgaactacttcttgaagaaaatcttggagatatcggaagaaaagttaaagaagaccctgacgaataaaaagaacgcctattccaagtataagattcccaaaaagaacgggtataggaaaatacatagccttaaaagcggcgatttaagtcacttgcaaagcaacttgaaaaagaacttcctcgataacattcctatcgcagacaatgtgtatggttttgtcgaggggtacggttacaaagatttcctaatcccacacacatacaaaaaatactacctgagattggacataaagaatttcttcgagtccattaagaccaataagcttgaaatcatcttcgattactacataacagccagcaacgacgaggagaaagacaaaattcttgactacctgattagcatcattagtctcaatgactatctgccacagggcgccattacttccccggcaacttccaatatcttttttcgagagctcgatatacggattcagaaatactgcaaaaagctgggatttgactactccaggtatgccgatgatatcctcatctcctctaataatgataaactgcccaaggattttgtcatcaaagcggtgaataaaatcgtttctgacagaaagctgaagctaaactacaagaagataatccgtgaaaagaacgaaatttcactgaatggatttgttgtgggcaaaggcatcagactgtcacggaataggcgctatgacatctcaaagatcaactttctcttcaagagtaacaaatctgtgagccagtacaagttcgtagaactgctcaataatgctaatggcgggtttaaatatcggtacaagaataacaacgggaaattcttctctgatatagacgacctgattaactatctggctggatatcgctcatttctgattaactggatccctgatgaggacaacaagtactataacaagcacatcaacttactgaatgacattgaggagattcttctctggcttaattga

SEQ ID NO: 12347 - RNA, 972 nt, unidentified
  source 1..972: mol_type = other RNA; note = synthetic construct
atgagcaaaacgctagagaaaaaagaaaacttctacgaggtgattgaaatccccaaaaagaatgggatacgtgtgattcactgtattagcaagaattcaccgctgtactatctgcaggaccaactgaggaagaattttctggaaaaaataccctgctccacaagcgcctgtggcttcattaaaggatcttcatacaaggatttcctgattccacatcagaatatggaatactatctccgcatcgatatcaaggacttctttaactccatcaagaaagacaagattaaggaagtattgcgacagtatctgaagctaaataacgagaaaagcaacgagatcctcaattacatcagcgagttggttactatagacagttacgtcccccagggggcggttaccagtcctcagttgagtaatatcattttccggaagttagatgtccgcctgcaaaagtactgccagaatctcaacatcaactataccagatatgccgatgacctcctctttagctctaaattcggtaaagtgcatctcccattttttctaaacacgatccggaaaattctgctgtccgagaattttctgatcaacaagtccaagataatcaagactcgcaaggaaatttccttatccggattcacagtgggcagaaatattaggctctctagatcaaggaagggtgatcttaccaaagtcctgtttctcttcaaccaaggcggaaagcctaaatctatcaatcagttgttagagcgactgaacagtgaaacatatcgttaccgcatggtgagggaggagagaaacaataactatatctacttcacctccaaggaatcgattcttaactaccttgcagggtatcgggctcttctgatcgattggggcaaccacaataaatacaaatcacttaaggacgagagcaagctgatactgcggatcgagaagattataaaagacatctctcagttgtcttga

SEQ ID NO: 12348 - RNA, 1032 nt, unidentified
  source 1..1032: mol_type = other RNA; note = synthetic construct
atgaaccacattaagatctatgatgagtccttcttctatagggctattctcgagatcgagcatgaaagtatgatttcaaaggtcgtggagaacaaaatcaacagctacaaagagatcacaatcagcaagcacagcgggagtcggacaattcactgcatcaataataacgaccagctgtatgggattcaacgcaatctggtggacaatctgtttagcaaggtggcgctccccgataacatctgtggctttgtcaagaagcggtcatatagagactttctggttcctcatctctggaacaacaatgagaaaagatactatcttaggctcgacatatctgacttctttggaagcataaactccgccaagattcatgatgccctagacggcctcattgatctcgatgaggaaaaaaaggtgaagatgttgaagctgatctctgagatctgcactctgaatgatattctaccacaaggtgccgttacatcaccagcaatttcaaacatagtgttcaagcggttagatgtccgtattcgaaactactgtcgaaagttaaacgtcacctacaccaggtacgcagatgatcttttgttctctaccacgaaagaaaaaactttagggggatatttcgtgaaaaagatcgtaggcatcctgaaatcctctggcttcatcttgaatcgcaagaaagttaaacgtggaaagttcgaaatcagcctgaatggattcattgtgggcgaaaatataagaatttcccgcaaaaagaagcgcgacattgctgcctttttttttctgtacatcagaggtgggaaacccaaaaacatagtggaaatcttggagaggctgaatgattatgactttagatttaggcagaagctgttcacttcgaaaaatgacatcatcaattaccttgctggttaccggtccttcatcattgactggctccctcaggaaacagagagtaacgtacacaaggacctgaagaaaatcattgacaagatacaggaaacccttgaagagatagaggagctggaatga

SEQ ID NO: 12349 - RNA, 1032 nt, unidentified
  source 1..1032: mol_type = other RNA; note = synthetic construct
atgaccaagatcaaaattttcgacgagaacttcttctaccgcagcgttctcgggatagaggatgaacacatattcaataacctcgtgattacgaagttcactagttataaagagatcgctgtgcctaaaaatggcggaattagaaccatccagtgcattgacaaggaaaatcagttgtacaagatccaaagaaatcttgtcgataacttcctgagcaagatacatctgcccgacaacatttgcggatttgtgaaacgtaagtcctatcgagattttctgataccacatgcatgggaaaacaacaacaaaaggttttacttaaggcttgacatctctgatttcttcggttctattaacagtgccaaaatccacaattccctgaacgatctaattgacattgaggaggacaagaaaaacaagatcctgaacatgatttctgagatctgtactctcaatgacgtcttgccacagggcgctgtgacaagccccgtactcagtaatatagtttttaaacggctcgacatccggattagaaactattgtcgcaaactcgatgtcatatacactcgatacgcagacgatctccttttttcgaccacgaaagaaaggtctttgggcggatttttcgtaaagaagatcatcgggattcttaagacaagcgggtttatactgaatcggaaaaaggtgaagagaggaatctcagaaatctcactgaatgggttcattgttggtcagaatgtgagaatttccaggaagaagaagtcagatatcaccgcctttttctatttgtttatctatggtggccgcccgaaaacaatcaaagatctgatcgagcggctgaacagctataaatttcagtatcgtaggtcactgttcgtctccaaaaatgacatgattaattacctggcgggctaccgctcctttctgattgattggttacctgaggacaccgagacaaaggtgtacaaggagttagtgaagatcatcaataagatccaaaacactctggaagaaattgaagccctagagtga

SEQ ID NO: 12350 - RNA, 1044 nt, unidentified
  source 1..1044: mol_type = other RNA; note = synthetic construct
atgtttgtaggcgacataatccttatctacaagaagaacttctactaccagacagttttaggcgtggatgattccagcatggtcaaggaggtcatagagaataaggaaaagcactacaaaccaatcgtgatttacaacagagggaaaaaacgggagattaattgcattgaggaaaaacgcgaactgtacaatttccagtcaaacctggccaagaactttctgaataaactccccctccccgacaatgtatgcggatttgttaagaataggtcttatcgcgactttctggtaccacatattaactcacacaattctgatcgtttctatcttcggctcgatattaaggatttcttcaatagcatctctgaatcacacctgagagaagtcctacaggaatatgttaccattatcgacaaggaggataatgaggaggtgattctgagtatggtgaatttagttacactgaacgggtccctaccgcaaggcggagtgacttcccccgtgttgagcaacttggtgttcagaagtattgacatcagaattcgcaattactgtcgaaaactcgacgtcacgtacacccgttatgcagacgacatgttattctcatgtgacaaagaaaaagtcatcaacggcttcttcattaagatgatcatctccatcttgaaaagcaagaagtttgtgctgaataggaggaaagtcaagaagggtgctagccagatctcccttaacggcttcgtggtgagccataacataaggattagtcgaaaaaaacgacaggatatcaatcggtttatatttctgtgggaaaagggtggaactcctaaaaccatagatgaactcatcctccggctgaactcttttgatttttcttatcggatcaaggactttaacagtaaatacagcgtgctgaactatcttgccgggtacagatccatgctgattaattggctgcctaacgagttcgatgacgagtggtatcaacagtcggagcgcctcattaggaagataaacatgatcatcatgaagatcgagcagttggagtga

SEQ ID NO: 12351 - RNA, 990 nt, unidentified
  source 1..990: mol_type = other RNA; note = synthetic construct
atgctcgggatcgagaaagatgagaactttaagatcataatcgagaagaaagccaacaactacaaaaatctcctgatctcgcgcaaaggcaagcaacgagagataaaatgtatcaataaggagagccagttgtataggattcaagctaatctcgtacagaactttcttaacgagattccccttcctgacaatgtctgtggatttgtcaagaagaggagttacagagacttcctggtgccccacatcaataattcccctactgaccggtattacttgcggctggatatcaaggatttctttgacagtataaccgaagagaaaatcgagaagagcttacaggaatacgtgacgatcaatgacggagcagagaataaggaggtgctgaaggacattattgacatcgttaccctgaatggttgcttaccccagggcggcgtgacaagcccagttatctcaaacattatttttcggaggctggatataagaattagaaagtactgctccaaactcaacattacatactctagatatgcggatgacatgctgttttcctcccagcataatcgcctgtttgatggctttttcgtgaaaatgattgccaagatcctaaaggatagtaacttcgttctcaacaggaagaaaattaaaaagggggtgtcattcatcagcttgaacgggttcgtcgtaggaaagaatattcgaatctcacgtaaaaaacggcaggatatcaaccgcttcatattcttattcgaaaaaggcgggaacccaaaagatgtgaacgaacttctgagcagactgaataaggagaagttctattaccgtagcaggaactttgaatccaaatctagtgtgatcgactatctggccggttatcgctctatgctgatatcttggattccggaagactccgatgaagcttggaaagaaaatgtcaaaaacttgctagacaagatccagaagattattatgaagatcgagtacctcaagtga

SEQ ID NO: 12352 - RNA, 1050 nt, unidentified
  source 1..1050: mol_type = other RNA; note = synthetic construct
atggccttttatatctatcataccgagcagttctttcagaatattatcagggacagcagtgccaatatccaagcgtccctcgaagagaaagaaggcagttatgagaaattctccatctcaaaaaacagtgggactcgaaccatatatagcattaagtctgagagcaaattgaagaaataccaaaagaatctgctgagcaacttcttcgaatacataaacataagcgatcagtcttatgggtttgttaaagaacggagttacaaagactacctgcagccgcacatcaataataacctctataaggatcgatactacctgcggttagacattaaggagttttttgagagcatcaagagggagacaattaaggaggaactatcgttctactttcgccttaaggatagcaagcagacagaggaaatccttaaattggtcactgacatagttaccctgaacgactcaattccacagggggcagtgacttctcccacgctgtccaatattatttttagagagctcgatgtgaagattaacgcatattgcaatcagcttggtgtggtgtatacaagatatgctgacgatatgctgttcagctcgtttcgggaacatgataagtttgcccaacccctgatcaaagtcatttacaagatcctcaagacaaaaggattcaagctgaactacaagaagaccatcaagggaaagaaccagatctccctgaatggattcatcgtaggtgataacattagattatctcggaaacgcaagaaagatatcaacaacatcattttccactactacaaatccggcaagaatatagaacaattcctgaactctttgtcagaggtggacctaatctaccgtcacaaaaacatcaattcactcggctctctggtaaactacttgaatggctatcgcgcttttctcattgactggatacctgtgaatgtgtccaatgacaaaatcagtaaacattccaagaacatagacaccattgaacagattgtcgagaggctggagaacttcaagaattcaatcaggaaacttaagtga

SEQ ID NO: 12353 - RNA, 1056 nt, unidentified
  source 1..1056: mol_type = other RNA; note = synthetic construct
atgcggtatctgctgtttctgtttgcatgggaggatagcatgtacacgattgagtctttttgcaacgcaatttgggaaacaagttattccaaggtcagtcagggagtaaccaaagaggagtatggcgaatttgagattcccaaaaaagggggttccagagttattaactatctggggagggacacttccatgtggaatctccagcataagctcctgaagaacttcctggagaaacaggatctgccggtgtgtgtcaaaggatttcgccagggagaaagctatcatagcttcttggccgagcacataggatcaaaattcttccttcggatcgatatctccagcttcttcccatccataaccgagaagcaaatcaaaaacgagcttagccgcttgctagcttgtaactcaaacgaagaaaaggaaaaactgcttaagctgatctgtgacatcacaacattaaacgactgcctgccacagggcgcctgtaccagtcctgctatttccaatctcgtgatggctcgtatcgaccaacgtattaccaaatactgccaggtgtttgatatacgatatactcgctatgcggacgacctgctgttcagctctgagggcttcaatttcaagtcgaagaattggttccttaagaagatcaagtacattctctcatcacagaacctcaaattgaactacagtaagatcaagtacggtgagaatgaacttgtgctaaatggctacattataagcaataaggggatctgcctgtctagatctcggctgagcgacatcagacacgttgtctccttcgccaaaaagaacaggaatctgatcgaggagttcggcagtgagcgctttttgcaggaaattaacaaactccctctcaggcacagggatttaactgaatatcccttcaataccgtgtttcaatttattcagtacatgtgcgggtacagagcctttttaatatctctagtggatcggtcttacgaagaaacctcatttcagaagcaactgcagcatttgatccgaaagctcgagacacagatcacgcactacacttga

SEQ ID NO: 12354 - RNA, 1017 nt, unidentified
  source 1..1017: mol_type = other RNA; note = synthetic construct
atgtttacgatcgagtccttttgcaatgccatttgggaaacttcttacgcaaaagtgtcacttaatatactcaaggatgattactccgaatttgaaattcccaaaaaagacgggaagaggaagataagttacctggacaaagacagtggcttgtggtctttacagcacaagctgctaatcaatttcctgaataagcaagacctgcccgtgtgcgtgaaagggtttaagaagggcgaaaattatagatcattcctggcggagcatattggtgccaaattttttttgcggatcgacatttcttcgttcttcccaagtatcaccgagaaacagatcaagtcagagttagcacgcctgatcatctgtaactcagacgaggataaagaaaaattgctcggacttctgtgtgatatcaccacactcaacggaagcctacctcagggagcctgcactagccctgctatttccaacctggtcatggcccgcatcgaccagagaattactaagtattgccaggtgttcgacgtgcgatatacacgatacgcagatgatatgctttttagctcccacgtctttgacttcgacaagaagaagtggttcctgaagaagataaaatacattctgtcctcccaggacttgaagctcaactactctaagatcaaattcagccaagaccagctcgtgcttaatggctacgtgatttctggcgatggtatcagactgagtcggaataggttatcagatatcaggcacgttgtttctttcgctagcaagaactatatgcttattcagaacagtgagtcccagaaattcctccaggaggtaaataagctacccctgcagtatcggaacctggtcgattatccatttaaaaccgtcttccagtttgttcagtacatgtgtgggtatagggccttcttgataagcctggtcgatcagaactacgctgagacaagctttcaaaaacaggtacaacgtctgatccgcaagctcgaaatacaaattgtgcattgtacctga

SEQ ID NO: 12355 - RNA, 1173 nt, unidentified
  source 1..1173: mol_type = other RNA; note = synthetic construct
atggctatgcctgccgccggtgtgagaagggaccatagctccatgtgctgcgtcaaacacgcacttcgggacctgctcggaaagtatttgtacactgccctctgtttttttctgctcgagaaaaacgccatgttcacgacggaatctttttgtaatttggtttggggcacaagctatctgaaggttctgcgcaagatctcgaaagaggactataatgaattcgagatcccgaagaaaggcggaacacgcaccatcaattacgtggatcgacagtcatccctgtggaagttacagcgggagcttcttaacaagtacttagtgaaacaggatctaccaatttgcgtgaagggttttaagaagggggaaaattacaagtcttttcttagcgaacacatcggagctgagttcttcctgagaatagacattgcaaatttctttcccagtatcaagattagctctgtcaaacgtgagctggctctgataattaggtgtgacaatgatgcagaggaggagaaactcctggatctaataggagagattgtaaccctggacgggcgcttaccacaaggcgcgagtacctcccctgtgatttctaacctggtgatggctaggattgatcagagaatcaccaaatactgccaagtttttaacgtccaatacaccaggtatgccgatgacctcctcttttcgtcaaacactttcgactttgaaaacaaaaagtggttccttaagaagatcaaatacatcctgaagtctcaggaactctctctgaactatagtaagattcgatacggccacaaggaaatcatcctgaatggctacgtaatctccaataatgaaattcgactcagtagaaaccgcctctttgatatccgccagatagtgaagttcactaaagagaacgtgcctttaattagatcaatcgggcttgatgagttcctgagcaaagccaacaagcttccattgaaacatcggaatctaaaagaatatcccttcaagagcatatttcagttctcccagtacctgtgcgggtatcgtgcgtatttgatttccatggtcgacacaaactgtctgcaaacatcattccagaaagaattgcagaggctgattcggaagatcgaggcccagatactgctgctcgagcaggcattgcccatccggaatagcaactga

SEQ ID NO: 12356 - RNA, 990 nt, unidentified
  source 1..990: mol_type = other RNA; note = synthetic construct
atgatttggaactactcgtacagtaccgtgcagagtaagatcgctcagaagaagtacaaaacaatttcgatcccaaaacgaaatggcttcagggagctgtcctttctcgaccccaaaactgatttgcatatgctgcaatccggactggtcaacttcttgaaaaagatagaactgcctgtttgtgcaaagggctttgtcaaaggtgaatcctatctgagctacttagaacatcacatcggctcaatccacttcttgagactggacatcaaagattttttcccgagcatcactcggaagctaatcgagcgcgagatctcatgctttatgtctttcgattccgaggaagagaagaaaaagattgtgaaactcgtaagtgatctcgtgacataccacaattgccttccccagggagcggtgtcttctcctgtgatcagcaacatcgtgatgattcggatagatcagagaattctgaaatactgtcaggttcttgggattaagtacacgcgctacgccgacgatctgctgttcagttccgaggagtttgacttcaatgacaaaaaatggtttctcaggaagattaagcatattgtaagcgacgggaactttaagataaactacggcaagcttaagagcagcacccgcgagatatctcttaatggatatgtcatctctcaggaaggtttgcgattgagccggcagagacttaacgacatcaagaaagtggtcagttttgcttcatctaaccgtcaaatgctgcagtctgatcccaattcatatgtccaggccctgaatcagctcaatctagaacacagagggctgtcagtttatccattcaaaagcgtgtatcagttctatcagttcctctgcggctataggtcctatctgatctccttcctcaagtacgacatagagtcccaatttaggaaaaagctgtgtaagctattagacaagctggaaaagatcattaaacaaattgccagcgtgttatga

SEQ ID NO: 12357 - RNA, 1005 nt, unidentified
  source 1..1005: mol_type = other RNA; note = synthetic construct
atgactatcgagtcattctgtaaggttgcatggaatctctcctataaccaggtgagatcctccattacaaagaaggactacatccagtttgacatacctaaaaaaaacggcgtaaggacaattactctgttacccgagggctcttcattatacgtgttgcagaggaactttaacaagtactacttgaataagcagggactacccatttgtgtcaaaggctttgtccgcggcgagtcgtatatttcttacctcgaatctcatataggtgccaagtatttcgtaagaatggacataaaggactttttcccctccattaccagcgaaattatcaaagacacatttagtcacttgctgtccttcgatactgatgaagaaaaagaaaagatcctagagctcatctccgagatttgcacatatgagggtgtccttccacaaggggtgccgacctcacctgttatctctaacattgtgatgacaagaatcgaccagcgcattactaaatactgccaaatcctggggatcacctatactagatacgcggacgatatgctcttcagttccaatatgttcgatttcaaaaccaagaaatggttcatcaagaagatcaaattcatcctggctagcatgcactttaagataaactacagcaaactcaagttcagcgaaaatgaaatatcactgaacgggtatgttgtgtcagacaccggaatacggctgagtcggagcaggctgatggatatcaagaaggccattaccttttctaaaaacaatcatacgctgctgaaaaccgatcctaccgggtttcttcgacttgtgaatgagacgtctttggagtacaggaacctgaaggtgtacccatttaatagtgtcttccagttcactcagtttctgatcggctatcgaagctatcttatcagctttctgcgctatgacattgatagtacattccgtaagaaagctgagaagctcatccggaatattgagggagaactggagttttactga

SEQ ID NO: 12358 - RNA, 1017 nt, unidentified
  source 1..1017: mol_type = other RNA; note = synthetic construct
atgttcgatctggaacagttctgtcagaacatatttggcaaaggattcgacgaaatcaaggagaagattaacaaagaggattatagttccttcgtgatccccaaaaagagggggatgagacagattattgcattaccaaagaactctgagttacgccgtatgcaaaagctcctccttgataagttctttgctaactactcattacctataccagccaaagggttcgcgaagcatgagagttataaaaactatctcatgccccacatgggagccaattatttcctccgcatcgatatctccaatttcttcaacagcattaagtttgaacacgtggaagagctgctgaaggatttgttcgtgtttatggataaagacgagaagagcaaggttatagaccttatttgggacatcgttagttataatgactccattcctcagggtggagtgacatcgccgattatctctaatttgatctttcgcaagctggatcagaggatactcaaatactgccagttgttcgacatcgaatacacccggtatgccgacgacctcctgtttagttcctacgagttcaattttatggacaaaaagtggttcctgaagaagattaaatacatccttggctccagaaagttccgaatcaactaccgtaagattaaatacggttacaaagagatcagcctgaatggctttattgtatcaaacagagacattcggctgtcaagatcaaggctatttgatataaggcatatcgtgagctacatacggaacaatgaagacgccaaaaggaaagacaaatgtctgctggggattaataaccttcgatttaagcactacgatatcgaaaaataccctttcaagagctactatcgcgtcattcagtttctatgcggctatagatcttttatcatctcttggatcgatgattgcatccccaacatcgcaaatcaaaagaagctgcggaaactggtcaatgaaattgagaaggctattaacatcttgagcgagtatatatga

SEQ ID NO: 12359 - RNA, 1032 nt, unidentified
  source 1..1032: mol_type = other RNA; note = synthetic construct
atgaatgcaaaggagattttttgcctcaaaattataggagacagcaattttgagatccttacagtgctgtccaataagaaaaacgagtacgaaaagatcgagatacccaaaaaaaaaggttaccggaagatatattgcctcaagagcaattctaaaatcaagcgctaccagcaaaatctgatcaacaacttcttcagtcattatccgattcctgtggtggccaaagggttcgtagaaggcgagaattacttttcctatatgaaggagcacgttggcagcaattacttcttgcgaattgatatcaaagacttcttcgaatcgatcaaatacgagcactttgaaaacttcatgtacgaaatggaaacctttaaggacaagaacaatgaaggcattatcaaaatcatctggaacataatcagctataacgattacttagtgcagggtgccgttagctcaccaatgatttctaacctgattttcagaagaaccgatcagaggatattgaaatattgtcaggaactgggcattaaatacactaggtatgctgacgacctgctgttttcatcctctaactttgagttcaaaaagaagaagtggtttctgaagaagattaattacatcctcagacagaacaaattccaaatgaactgtagtaagctaaagtgttgtgactatcaaattagcctcaacgggtttgtgatttcttacgataatatccggcttagtaggaagaagtaccacgacatctcacaggtcgtatggtatgtcaacaagtccgacatctatgaaaagaattttttcgacgagctgcataaactagggttctacaataacaaacttcgcacgattaatacctattattccttgctccagtacctgtgcggataccggagctttttaattggatcctacaaagagtgcgagatgggcgatgatacaaagcgtaagatagagtatatcatcaagaagatcgatatgtccattataaaggtcatctcgaacaaatatcccacatactgggtgactaaatga

SEQ ID NO: 12360 - RNA, 1047 nt, unidentified
  source 1..1047: mol_type = other RNA; note = synthetic construct
atgcgcatttacaaagaggagtacttttacaactcaattctgcagtgtaacaagcaaaaagtgctcaatggtctggaagccaaatctgaggcgtactttaagtatgaaattcccaaagctaacaacaagaagagaactattagtgctttagataaggattccctaatctacgagctccagtcaaacttatacaagaactttttcagcttccagccgattcccgtttgcgtaaaaggatttgttaagggcaattcctacttagactttttgaacgcccatatctacgacaattactctacttatttcgtcaggctcgacattcgagatttcttcgatagcatttcgaaagaaacaatgatctcaaccctgcaagagtttataaacatcgaggatgtgatcaatgtgatttatgacatttgcaccctagaagacaaactaccacagggagcagtcacatcacctctgcttagcaatcttgtgctgaggcgcattgaccagcgtgtcacactctattgtcagagtctgggggtggcctatacccggtatgcagatgacctgttgttcagtagtaacgaaatcgattttagccaacaaaagtggttcgtcaagaagataaaatacatactgggttccatagacctgaagatcaattacaacaagatcaaatacgggaaggacctcatcagtatcaatggatatgtggtgaactctaacgttaacctgagccggaagaaactgtataatttgactagcgtgctctactttttcaacaagaacaaaggcaagtacaaaaaagtatacaaggtggacaataagatcttcatgaatacaaactggcttcacgatctgaatacgtatttgaaaaacagcaccagcaccaatctggagtttgtctcagtgcataaactgcagaatttcctgattggctatagagcctatcttatatcctgcatctcttactcttccgagaacaaggttaatcagtattcttccaaaatcaagcacattgaatccatcatcaataagttgcttgagctcaatcagtga

SEQ ID NO: 12361 - RNA, 1044 nt, unidentified
  source 1..1044: mol_type = other RNA; note = synthetic construct
atgaagatctacaaggaagagtacttttacaattcgatcttgaagcatagcaaggaaactgtcctcaagggcctcggagcgaaatcagaagcatatttcaaattcgacatgccaaaagccaataatgagaaaaggaccatttccgctcttgataaagacaatttaatccacgagctgcagagtaacctcaacaacaatttttttagccttcagcccttgccgatttgcgttaaagggttcgtgaaaggcaacagctacctggattacctgaacgcacacatctacgataattcctcaacatattttgtgcggctggatattaaggactttttcgactcaatctctaaagaagtgcttatctcaaccctcagggaattcgtgggcatcgaagacgtcattaacgtcatatatgacatatgcaccctggaggagaaactgccccagggtgccgtcacatcccctctgttgtccaatctcgttcttaggagaattgaccagcgtattacattgtattgccagagtttaggggtaacgtatactagatatgctgatgatctgctattctccagcaatgagatagatttccgcctgaagaagtggtttgtgaagaaaatcaagtacattctctgttctatcgacctgaagataaactacaagaaagtcaagtatggcaagggattgatttctataaatggttacgtggtagataacaatgtgaatttatctcggaagaaactgtacaatcttacctccgttctatacttcttcaataagaacaaggggaaatacaagaagatctataaggtggacaacaacatctttctgaaccgcacgtggctggaggatctcaataccttcttgactaacagcacatccagtaaactcatctttggctcaatccagaaactgcagaactttctaattggatatcgagcctatctgatttcttgtatagggtatagtagcgagaagaaaattgaccaatactcttcgaaaatcaaccatatcgagagcattcttaataagctcctgcaactgaactga

SEQ ID NO: 12362 - RNA, 1041 nt, unidentified
  source 1..1041: mol_type = other RNA; note = synthetic construct
atgtttattttcgacgagaactacttctacaacatcgtcattaaatgcgacaggaaccagctgctgaatatcatcaaggaaaagaatctgcaatacgagagtttcgagattcccaaaaatgatgggatgagggtcattagtgcaatcaaaaaaaacagccaattggtcagattacaaaagaacctcaacagcaatcttttttctaagattcctctgccggtatgtgtgcgtgggtttgtatcaggcgagtcatataactcctatttagtggagcacatcggtaaaaaattctttcttcgggccgacataagcgccttctttgattccattaaaaaggataccatcatcagcatgcttaatgaatttatctccgtgataaacgtgatcgaacaaattagtgaagtggttactttggacgacaaactgccccagggagcgattacctccccatccgtgagcaatttgatatttagaaggatcgatcagagaataactaagtattgtcaggaactgaatgtcacgtacacccggtatgccgatgacatgctcttctctagcgataaactgaatttcaatgagtcaaccttcttttatgccatgattaagaagatcctcaaggagaatggttttgcttgcaacaataagaagaagaagattgagatcgatgagattagcttgggcggcttcgttatttcgaatgacgtgcatctctctcgcaaaaagcttgagaacatcaacaagctaatctacttttttcgaaaggacaagacattcgaaaaacagaaatacctggtcgactcactagtgttccaggataagcattggctgaatgaagttaacaacctgaaactgaaagaaaacatctccttcaaatgtttctcttctaataaccagctcatagattatctgtgcggataccgcgctttcattatttcgatagtgcaggcaaacgacaacaatacagaaaatatcaagcagctccggaaaaagatcaacaacatagagatgatcatcgaggctatcattaagcacagtacatga

SEQ ID NO: 12363 - RNA, 1095 nt, unidentified
  source 1..1095: mol_type = other RNA; note = synthetic construct
atgattagcgtaaatcgctacctgaagctgtacagtaagaagtacttcctcactaggattcttgaatgtagtgaggaggagctcgctcaggctaaaggagagaaagggatagtgtgtattgaagaccggataccaaaaaaaggaggctttcgttctatcgtgtcagtgaagcccggatcatccctagcgaagcttcaaaagaagctgtacaagaattacctgtcccagatccctgtgtcaacggccgccaagggcttcgtaaagggttgttcttacgtcaatttcctggaggagcatgtgggacattcttattttctcagagttgatatccgagactttttcgacagcatcacaaaggagaaactggccgaatgcttagaacccttcgctgaaaaagagattgccgacgaaatcatggagttgtgtacttggaatgggaaagtcccacagggcttttccaccagtcctgccttgtctaatctcgttttcagacgcatcgatcagagggtcaggaaatactgtagaagctaccacaaggagatggatcgtcgaattttttatacacgctacgcggatgatatgctgttcagctctgctggtacacttgagttcgacttttgcaagaacaaaaatttcaagcggatgatagcacacattttacatcagaacggcttttcctgcaacgaaagcaagaccatctatgccaaaggagagataagcctctctggctatgtggtgtcaaacgacgtgcacttgagccggcaaaagttatgcaacatcaacgaagtgatttatcagttcgaccagagaaaatcctatgggtcgattagttactcccttgacaaggctacagtcaatattaagaacatcatgtgcaacctgaataagaggaaaatgaagaaagcagatggcactgttatccaatttgacagtctaagcgatctggtgtattacgccgcaggctgccggtcctacctgatgcagatcgcctcaaccgaacacggggacaccgggtatgataaacagattgcaaaaaagatccgcaaactggagatgatcctggattatctctcggaggaattgggtgaagtctga

SEQ ID NO: 12364 - RNA, 1008 nt, unidentified
  source 1..1008: mol_type = other RNA; note = synthetic construct
atggtgttgtacagttacgagtacttccttgacaagatcctcgagtccacacaagaggaggtggagaaggccaaacgtgaaaagatattcgtctgttctgagatgaaactgccaaagcagtccggcttccgcaacatagtcagcgtggaaaaagacagcattatgaaaaaactgcagaagaacctgcagaaaaattttctagacaagttgccggtctgtccctcggctaaaggtttcgtaaaagggaattcctatatggattttctggaagaacatatcgggcacgaatactttctgcggatggacattcacaacttcttcgactctatcgccgaaggtcttttggatgaaaatctcaagaacttcgtgagagacgaggaagagatgtcacctgatttagaagagttagagtccggcgcgaagggcagtagaattcgagaagacatcatcgaattatgcacttggcaaggacgtgtacctcaggggtttctaaccagcccaagcatcagtaacctcgtgttccggagactcgatcagcggattagaaagtactgcagggcttatcaaaaagagcagaagagggaaattttctatacacggtacgcagatgatttgctgttcagtagccaagggttcgactttaagaggaataagaactttaagcgcatgatatgtcatatcctcgaggattacggattttcttgcaatgagaacaagacgatctatcagaacggtcagatttcactcactggatatgtgatcagaaaagatgttcacctttccaggaagaaactgcgaaacataaatgaggttctgtaccagtttcgcgagattatcgagtgcgacgagcgagtgcgctctgaaaaaattaaagccaatctgcagatgatcctgcagaatctgaatcagaagaagatgaaaaagagcaacggagatcccatctactttgccgacggcaaccggcttattcattatgttgcaggctataggtcatttttcaccctgtga

SEQ ID NO: 12365 - RNA, 1098 nt, unidentified
  source 1..1098: mol_type = other RNA; note = synthetic construct
atgaagaagatctatggctgggactactactgtgagaggatactgcggaaatcacagctgtttattgagaatagtcttgccgaaaaggaaaactcctacatagttttcgacatccgagatagaggaaaggagcggaccatttgccaggtggataagacaagcgggctgtaccaactccaaaacaatcttaatcgcaacctgctggccaaaattccattgtcaaaagccgccgccggatttgtgcgcggtttatcctatcaagactacctgaggagccattgcgggaagaagtttcacatgcgattagacatccaccatttcttcgatcacgtcactgaagagcaagtgatcaaaagtctcgaggaatttgttcaggacgaaaaaatccgcgagaacataggcgaaatcactacctttaacgggaaactcccacagggcgctgtgacatcccccgcagtatcgaatattgtgtttagacgcattgatcagagaatcttaaaatattgccagtccgtccggaaagtccgggaaggaaagaaattctatcaggaggatctgatctacacgcgctatgcagatgatatgatgttctctagcgactacctcgacttccgtcgggacttgtttgtatacaggatgatcaagcacattttgaaggaaaacggatttagcctgaacgtcaagaagacatatatggctgagggggagattagcctctctggcttcgtcgtgggcggtgaggaaaatggctgctctgtgcgtcctagtaggaaacgtctgagagagatcaatagaatactcgcgtatttcgatgcgcgaagggagctggacgggtgtccttacgaggctgacattaaaaaactaagagatccgagggtgattgataatgttaacctgatgtttcccgacgggtcagtggccagattcagcaacaagaagtccctaattaattacctttgtggctatagggctttcctgatcaccttcctcaagggtgaaaacggccagggatcttcacagcgcgcacttcagggaaagatccggaatttggaaaagctgatagaccagtgtcagcgatggtggtttcatatcgagtga

SEQ ID NO: 12366 - RNA, 1098 nt, unidentified
  source 1..1098: mol_type = other RNA; note = synthetic construct
atgaagaagatctatgggtgggattattactgtgagaaaatcctgtggaagaatgatgctttcattgcatcttccttggcggagaaagaggagtcatactcaacatttaccatcggcgatcggggtaaatctcgagttatacagcaggtggatcagactagcggactgtatcagctgcagaataaccttaacaagaacctgctttccaggattccactgtctaaggcagctgctgggttcgtgaaagggaagagttaccaagactacctgcggccccactgtggaaagcgtttccacctgcgcttggatatcagacacttctttgaccatgtgaccgaggagcaggtagttgagtcgttgaaggacttcgtgcaggatgaaagaatccggatcaatattgggcagatcactaccctcaatggctgtctaccccaaggcgcaatcacatcaccagccatgagcaatattgtcttccgccagattgatcaaaggatcctcaagtattgccaggccgtcaggaaagtgaaggagggaaagcaggtgctatatgaagacattgtttacactcgctacgccgacgacatgatgttttcctccgaatatttagacttccgaaaagagctgagcttttataagatgatcaagcacattctcatggataaggggttccgattgaatcatgacaaaacgtacatgacagaaggcgagataagcatgtctggatttgtcgtcggaggtgaagcgcacggctgcatggtgaggttaagtagaaaacggatgagagagatcaacagaattcttaactacttcgacaagagagctaaaatagacggcagcccttatgaagtagacgaagaaaaggtgaaagactttcgggttgtcgataaagtgaacgctctcttccctattggtaaaatcgcccgcttcagtaacaagaaggcccttatgaattacctctgcgggtaccgggcatttctgatcacctttctgaaaggagagaacggccaagccctgcatcagcgtgccttagagcgcaaaataaagaatctggaacagctcattgatcaatgccagtccaggtggtttggcatgacatga

SEQ ID NO: 12367 - RNA, 1119 nt, unidentified
  source 1..1119: mol_type = other RNA; note = synthetic construct
atgaagcggctctatggctttgagtactacgctaagaacattttgaagattgatctgctgaatcaagatgaaaagaccaagttcttcaacaaactggaaacaaatatctctgagagctatgtgaaattccagattccaaagaaagatgggatgagagacatatgcgccatcgataaatcttccattctgtataccatccagaagaatctgaacaagaatttcctgtcgaagatccctctatcaagcgtggcaattggttttgtgaagggaaaatcctacaatgattttttggcgcatcacattgggaaaaaatactatatgcgtatggacatcaaggatttttttggcttcatcagtgagaaacatatcaaagagagtctcaaggagttcgttcaggagtccgagattattgaatccatcgtaaatatctgcatgagggagggtgaactcccccagggagccgtgacaagtccgacgataagcaatattattttcaggaggatagaccaacgcattataaaatactgtcagagcatacagaacattaggattgctaagaagaactacaacgaagacattatctatacccggtatgccgacgacatgctgttttctagtaatatcctggactttaaggagaacaagtactttaagaagatgatcaagaacatcctatcgaacaatgaattcaaagtcaactacaacaagatgtactactcatctgattcaatctctctgtcaggattcgttattgaaaaagatgtccaccttagccgcaaaaaaatgaaaaacatcaactccatcctctatttctttgataagcgcatcgaatacgataagacgaagtacaacataaacattgacaagatcgaagacactcagttgattaaacagctgaatgacctcaacttaaacacacttaatggccggaaaataaattttgagaacatcgcacagttcatcaattatttatgtgggtatcgaagctttcttatatccttcttgaaaatggacatcagaaaaaccgatagcattaaccttattgagaagaaggtgaaaaagatcgaggaactgatcaacaaaatcaacgagataaatgacttcagaactcaaaattga

SEQ ID NO: 12368 - RNA, 1125 nt, unidentified
  source 1..1125: mol_type = other RNA; note = synthetic construct
atgaagatttatacagaggagtttctgcgggatggaatcctcgagatacaggagcaaccttttgagaagcttctggtcgagaagaataagtggtataagtgcttcgaaatcagtaaaaaggacggcaaaagagagatatgcgcgctgtcagacgaagagagcgggcagaaagtcaagcgcttgcagaaaaatttgcttcatcgcttcctgagaaagatcccaattgccgtgtgtgcaaaaggcttcgtaaaggaggagtcatatcagtcttttcttgagccacacatagggtctaaatactttatgcggttagacattcggaactttttttcgagcttttcagaagatttgatctggaagggactgcatgagttcgtggagaatgccgaagccttggatatgatttgtgagctgtgtacatgggagaataccctgccccagggtgctgtgacaagtcccgcactctccaatatcctgttccgcagggccgaccagcgcatcctgaaatactgtcagaccatcaccgaacgatgctctaagaaccgatacagacctgaggctgccggcaacgagaacactctatattatactcgctacgcagatgacatgttgtttagtagcgacttcttcgatttctccaaggaagagtactttatgaaaatgatctcccggattctgaaagactatggatttgagctgaacagggacaagacggtgattagcgaggatcaaatcgttctgaatgggtacgtggtaggtaacgccgtttggctgtctagaaggaaaatgcgtgatttaaaacgtatcctctacttcttcaggaacaaaaatcacgagctataccgtatcgataagcttaaggtgaaaaagacaatcgaaagcctcaaggaattaaattgcttcatggagaagaacaactcagaaagaaataatttcgcgaacagtctagaacttattaattatctggctgggtgtcgcagctggctgatagctattctgcaaatgaggaccgaagacaacaggactagacgaaacctcggcaaaaccaaagtcagaattgagatgctcctctccgaactctcccggtgcgaagaagaaaagcagcggtgggcagaaaggggctga

SEQ ID NO: 12369 - RNA, 1203 nt, unidentified
  source 1..1203: mol_type = other RNA; note = synthetic construct
atgtatcgggtaaggttcttccactcactgagtagcccaggaatcaccccaattcggaagttttcggagagtgcttgcagcttccccaagaacattatgaagatctacacactggaatttctctttaagattctcgagttgcagcctgaggaattcagccagattctacttaagaaagaaacggcctacaatacatttgagatccccaagaaaaacggtcgcagattaatccacggtttggacgcaaaagacgggaagcctcttaaaaaactccagcagaatctctaccgtaaagtgctgtgtaaacagcccactgctatccccgccaagggctttctcaaaggagagtcttacttaagcttcctggaacctcatgcgggaaaccaattttttctcaggctggacatccacgacttcttcggatccttttctgagaagatgatcagagacaacctgaatagcttcatcgaggataaagaagccctagaattagtctttgagctgtgtacagtgagcaaaaaactgccacaaggggctgtgaccagtccagccctctccaacatcatgttcgcccggcttgaccagcgtattctgaaatattgccaggcactggaacagaataagcgggagcagttgcatagggaaaaagagtcatggtgcaatgcttcaatatcttacaccagatacgcagatgacatgctcttttctagcgatttcttcgatttccgagagaacttagcattcctgcacatgatatctcgaatcctgggcgagtatggcttccatcttaaccgccaaaagactatgatggccgaaaaggagttgtccatgaatggctatgttgtcggcgaaaacatccggctttccaaaaagaagacatcggagctgcgcagaattttgtattgtctgaaggatcaggaagccgagacttatcagctgaatcaggagctgatggatgatcctcagaagatcctgaaaaagattaaacagttctcctccgaaactcagaaggggagtcgaaccttttccgatattcacaagctgatatggtaccttggtggctgtcgctcttggattatatcagttctccaaacggaagccaagtttgggaaagaggaaaagaacatggtgaagctaattagaaggatcgagtgcgtgttggacgcgctgcaagctatgaccgaggacccgaatcgcaggtga

SEQ ID NO: 12370 - RNA, 1095 nt, unidentified
  source 1..1095: mol_type = other RNA; note = synthetic construct
atgcagatttataactacaagtttctgctggagaaaattctgaagacttccgatgagaagctgcatgccgtgctcgagggaattgaatatgcctacgaagagacagagatccccaagaagaatggcatcagagtgattcacatgttgcgtaagacgcctgaggggaggaatcttaccaattttcaaagaaacctggttcggagattcttacaaaaaattccgattgctatccccgcgaaggggttcgtcaccggagagtcttatcagaattttctgatgcctcatgctggtaatcactacttcctgcgaatcgatattaaagacttctttgacagcttttctgaaaaactgatgaaatcaaacctgaaggagtttattcaagacagggaggcactggagactgtgtttgaactctgtacactcaatgctaagcttccccagggtgctgtgacctcgccaatcttgagcaacattttcttccggcgaatagaccagaggatactaaaatattgccagagtatcgaggagaggtatcgtaaagaaaatacccgttcagaaaaacagggcatcaggcgcatcagctacacaagatacgccgacgatatgctattctcatctgatttctttgactttggcgagcatatctatttcctgaggatgctttccaaaatcctaaaggagaacggctttgaaataaaccgctccaagactatgatgtgtaagggggaaatcgggttgaacggttacgtggtaggagatggccttaggctcagccgccgcaagctccagtctgttaaagaaacgctctatttcttccggaaacaagaccaggagctgtacgaagtcgatatgcggaaagcagaggacttgaaggaaagtctcaagaagcttaatgaaatgcgcagagagaacaacaaagaagcacgcgaattccgatcccggcaggactttatacactacctggccggctgcagagcctggatgatcagcgtcttacagacagagcagttactgaagaaggatagtaaacggctcgagaaaaccatacagagactggaagagctgttgaaggccgtggaaaaggaggagggatga

SEQ ID NO: 12371 - RNA, 1083 nt, unidentified
  source 1..1083: mol_type = other RNA; note = synthetic construct
atgtttatcaacgaatacgactacttcattaacggcgtattgaaaacatcggagactacactgaagaatgtgcagaaggatatcaaagcaaactacaccactcataagatccctaagaaaaatggggaacggatcatacacgccattaagaaggactctgatctctataacttgcagaaaaacctctgtctgcacttcctggacacaatccccctgccaaaacccgtcatagggttcgttaaggatgagaattatgtccgcttcttgagtcagcatattggaaaacgatatttcctgaggctcgatatcaatagcttttttgacaccgtcaataggaagatgctgcagaagaccttcaaggagttttttccaggctctgacaacacttcactatccacctttatcgatctgtgcaccattgatggcaagctgccacagggagccgtgactagccctgtgatttctaatattgtgtttcgccggatcgaccaacgtatactaaagtattgtcagaacttcgacgatgtatacatcagtaaacgaagcaataaagagtctatcacctacactagatatgcagacgatttactgttcagcagcgacattatagacttctccaagaatgctttctttatgggcatgatcatatccattcttaaggacaacggattcacagtgaataaaaccaagacaaggtgtagcacaaatgagatttccttctcaggctttgtgcttggtcgcgatgttcatttaagtcggaagaaactgcatgagctcaacaaggttatctacttcttcaataaggccgacgaacactcatacaaaaagtacagacttaacaaagctgtgttcacgagtggtgattggctggcgaagattaattctcttgaactggaaggaccctttgggcagaaaaaatcatttaagaccccggaggaactgcttaactatttatgcggttttaggtcctttctcctactgattttgagagagaaccccaacgggtcccctcacatggaacaactggataaaaaaatccacaagctcgaggagatcattgacctcatcttgtgccacacgtga

SEQ ID NO: 12372 - RNA, 1119 nt, unidentified
  source 1..1119: mol_type = other RNA; note = synthetic construct
atgctgatagatgtatatgccgccttcgcactaaggacaaggctgattttcagtgagggcacatatagcattttgacaatatattccgggggtaacaacattaatatctacgaagagtcctacttttacaagaaaatcctaggatacgaatccatctctctccccttatcgctaactaataaactggatgcgtacaattcttttgagctgagtattaacaacaaggtgagaaacataaacgcaataaattccaagagtgatctgttcgcttttcagaagaacctgttgaataacttcctgatttatatcccattgccaaattgcgtgtgtggcttcgtaaaaggaaaaaactacctcgatttcctgaaagagcacctcaaaaaggacttttatttacggcttgacatcaaagactttttccctagcttgaaaagcgaaaatatcaaagacgtgctggatgagtacattatcatcagcgacattaacgaaaagacccatgtgctggacaccatcattgacattgttactttgaatggctctctcccccagggggctgtcacgtctccacaggtgtccaatgtcgtgtttagacgccttgatatccgaatccgaaactactgccggaagttcaatatttcctatacaaggtacgccgatgacatgctcttttcgtcaaacgattcacgtctccacaaagacttctttgtcaaaatgatcagcaagattctgaaggataattgtctggagctgaatagatcaaagattaaaaagaccaaggagcaaatagtgctgaacggatatgtcgtgtcaaaccgcatttctttatccaggaataagttgaagaaggtcaacactctcatctacgcctatgagaaccttgacggtaaaaaaaagaagccgaagaacttcaatgagtatcttaatcggattactacgctcgaagacttctttccttctcttcctagcaatatcgaggggagacgtaacgttatcgttaattacctcgctggctaccggagttatctgcttagctttgataaagatacctaccgcgacatctgcgtgacctatcccaacaagataaaaaagatcgaattcatcctgaaggaactgatgtga

SEQ ID NO: 12373 - RNA, 1029 nt, unidentified
  source 1..1029: mol_type = other RNA; note = synthetic construct
atgaatatatatgaggaatcgttcttctacaagaaaatactggaatatggactgacccccccgacagatattacttccaacaaggcagacgcctataacacatttgagctgattatcaatggtaagaagagagagataaacgccatttccccaaaatctgacctatataacatccagaagtccctgttggataattttctgacgcacatacctcttccaaattgtgtgtgcgggttcattaaaggcaagagttatctggattttctcgaggcccacttaaaaaaggaatattacctgcggatcgacatcaaaaatttcttccccagtctgaaggctgaaagggttaaagaaaccttgagcgaatacattaagatctcaaactacaccaagaagcaggaagtactcgataatatcgtggacattgtgaccttgaacggatctctcccacagggagcagtaacaagccctcagttatcgaacattcttttcaggagattagatatccgcatccgcaactattgtaggaaattcaacgttgactttactcgatatgccgatgacatgctgtttagttctaatgacgaccggctgcacaaagacttcttcgtcaagatgatctccaaaattctgaaggacaaccaactcgtcattaaccgtaaaaaactgaggagagggcaaaagaagatcgtgcttaatggctacgttattagcaatcatatctccctgagccgaaacaagttgaagaaagtcaattctatcctgtactccttcgagaacatcaaagggaaaaaactagagcctaagaatttcctcgagttttattcacgcctgtccagcaatagaagcatatttcccgattcaagccttacaatcgagaagaaatacgacattctctttaactacctagcgggctaccggtcttaccttctgagcttttctaaggagaagcataaggatacttgcgtggattacagtggtaaaatcaagaaactcgagtacgtgctctcaaagttgaataagtgggcttga

SEQ ID NO: 12374 - RNA, 963 nt, unidentified
  source 1..963: mol_type = other RNA; note = synthetic construct
atgttagccatcatagataaaaatctggcgtacaaatcattcgaaatgacaaccaacggtaaggtacgcaatatcgatgctattgactctaaatcttccctgtacaagttacagaggaactttcttgataggttcctgatcgatatccctctgcccgactgtgtctgcggctttgtgaagggtaaatgctacctcgacttcctgattccccactgcggcaagaagtattacttgcgtctcgacattaaggattttttcaactccctgaaggttgacaaaatacggtcagtcctgggagagtatatccaggtgagcgatctaaacaaaaagaatctgatcctcgacgacataggggtgatggtcaccttgaatgatagccttcctcagggggctataactagtccacagattagcaatattctattccgcaggattgacattcggatcaggaattattgtcgcaagtttgatgtcgaatatacacgatacgctgatgatctgctcttcagctctaacaaatccaaactccatgacaagttcttcacaaagatgatcttcaagatcataaaggacttcgacttggtagtgaaccgaaaaaaaatcaagaagtcagaagagagactcgttctgaatggatacgtgattgacaaaaacattagtttgagtcgggccaaactgaaaaacattaatacccttctctactgcgtggagtataattccggcactaaagcatatccacgcacaatcatcgagttttttgacagactgaaaaacgttaagacctgtctgcggcttacttctgacatcaagaagaacaagagcattgtgatcaactattttgccggatacagagcctttctgattaatttttcgaaggtggggtataaggattactgtaaagattacaccacgaaaatcgacagaatagagaaggcattagagatcatccaagaaattaagtga

SEQ ID NO: 12375 - RNA, 1329 nt, unidentified
  source 1..1329: mol_type = other RNA; note = synthetic construct
atgaagatctacagtgaggatttcttctataaggggctgttgggatttgatagcagaaccgtgatgaagaattccctcatcgctacaaactcttatcagagctttgagctggaggtgaatggtaaaaaacgcaagattgatgccataaagcctaacaccaagctctattacattcagaaaagactcctgaagaattttctggtgaatattccacttcccaattgtgtatgcggatttgtggaagggaaaaactatctggactttctcaaacctcactgcaacaaaaaatactacactcggctagacattaagagtttcttcaactcgattaagtctgagaatattaacggtatcctcgaagaatacatacaaattaacgacgaggaaaagaaacagcagatattgaatgacttctgcgagattgtgacgctcaacggcagcttaccacagggggccgttacatcaccacagttatcgaatatattcttccgtcgaattgatattaggatccgcaattactgtcggaaatttaatgtggaatacacccgctacgctgatgatatgctgtttagttccaacgaggagacgatgcataaagacttttttatcaagcggattagcaaaatcctgaaggactacaagctgaagctcaacaacaagaagattatccaatctgaaaactctatcgttttgaacggctatgtcgtctccaataagatatcactgtcaaggaaaaagctaaagaagatcaacacattcatcaacgccttcaacaatagtgacggcaaaaagaagaagtttatcggaactgaagactacacatatcggcttactaaatccaagaatctgtcctttactatgaccgatgacctttatatcaacaagctgaagatcatcaactaccttgccgggttccgctcatatttaatgaccttcagcaagcccaataatgaagactactgtgaggattatttcgacaagattaacaacatcgagaaaatgctggagaaactaacaaaggaaggtctgccttataacgacaaaaagagcaacattgcaattatcatcgaccacgttaagttcggccgtgtcaatggattcaacatagaggtgaggaaaatcaataaatcttcccacagcaatagaatgctgtacaaacatctcaaaatgaatctcaacgataggacccttttcgtaaaattttatccctttccgttgaaactggatgagttgataaatgacatcgataagaaagcactgaagaacagaatcctgcagaataatatcaacgagatacgatacgcgttgaagattaatgaaaaaggctga

SEQ ID NO: 12376 - RNA, 984 nt, unidentified
  source 1..984: mol_type = other RNA; note = synthetic construct
atggacattctggatgaggttccaaccatcgaggatatcaacgagtactatgacacgttcaatattcaggtgaacaagaaacagagaacgatcaatgccgtgaagcaaggcagcctgctcaggaaactgcaggaaaaactcttggtcaatttcctggagaacatccctctatcggattgtgtatgtgggttcgttaagggcaagaattatttagactttctgatcccgcactgcgagaagaagtactttctccgcattgacatcaaggatttttttaacagtctgaaggtcaatttggtgcgcgacaccctgtcagagtacatagacattaagattcctgatgaaaaggaaaacgttattgacgagattatcactatcactacacttaatggatctctcccccaaggtgctgtcactagcccacagttaagtaacattttgatgcggaggatcgacatcaggatccgaaaatactgcgaaaagtttaaggtcgagtattctcgttacgccgatgacatgctgttctccagcgaaacatccgagatccataaaagcttcttcatagggaaacttaaggagatcctgaaagatatcaacctgcgcatcaattcaaaaaaggtgataaagaccaacgagaaaattattctcaacgggtacgtggtatccaacaacatctctctgaccagaaaaaagcttaagaaattgaacacactgctatacactttcgagtacaacggctcaatcaaaaaatatccccagacctttacagaatatattagaaggctccagagcgtgaatcccattctgatcgacttatcaaaaggtgacgattggtccaaagtgcagattataaattacctggcaggatatcgggctttcttgctgagcttcaatgcgctctctataaaggattatacctgcgacttttccaatcgaattaagagaacagaaaagatgcttgaacggcttagtgatataaagtga

SEQ ID NO: 12377 - RNA, 921 nt, unidentified
  source 1..921: mol_type = other RNA; note = synthetic construct
atggtgaacaagaaagtacgtaagattaacgcaattaagacgaattcagtgttacataacctacaaaagaagatcagcaacaactttctggataatattccgctcgccgattgtgtctgtggatttgtcaagggtaaaaactatctcgatttccttctgcctcactgcggcagcaagttttatcttaaggtggatataaaggacttcttcaattcgctcaaagaatctttagtacgggacacattaagtgaatacgttgacatcaagaatcgagaagagaaagacagggtccttaaagaactgatctacatcacgacattgaacggcagcgtgcccctgggggctataacctctccacagttgtccaatctgttgctgcgcagaatcgatctccggatcaaaaagtactgcgagaagttcaatgtgatctacaccagatatgcagatgacatgctgttctctagcaacaatcaggaggttgcgaaacccttctttctcggtcgattgaaagacatcctgatagacttcgagctcaaaatcaactccaagaagaccatcatcgccgagaacaagattatccttaatggctatgtgatttcttccagggtcactcttaccagaaacaaaatgaaaaagctgaacacactactgtacaccttcgagtacaagtcaggggttaagagatatccacggacatttaatgagtttctgcagcggctgaaaactgtgaatgaggaactctttgatttgtcaaagtccatacctgaaactcgcattcagatcattaactacctggctggatatagggcctttctgctcagcttcaataagtccagtattaaagactacacttgcgacttcagtaaaaaaataaagcgcaccgagaaaatgctagacattctgtcagatattaggtattga

SEQ ID NO: 12378 - RNA, 984 nt, unidentified
  source 1..984: mol_type = other RNA; note = synthetic construct
atgaatatttatagcggcaagagctttttcaaggaggtgttcgaaatgaaatacgaagatgtaaagaaggtgactgacagcaatatagaggaaaactacaacatcgtgaaaatcccgaaaacaaaggggcacagagaaatatattgtatcgacgactcttccgagctgtacattctccagaagaacatattgatgaatttcctcgatgacatacctatctcagagaatgcttttggcttcgtgaagggtcgatcctacattgatttcttatatacccacgtgtacaagaactacaaaaacatctactacttgaagctagacctgaaagactttttcagttccatcaaatcattccacatcgaacgtactctcgaaaagcatgtccatacaaatagcagcaaaatttccaaagagatcatcgacaacatcgttaaactcactaccgtcgataataaactgccccaaggagcagtcacgagcccaagtctgtctaatatcgtgtttcggttcaccgacattaggatcgcacgctattgtgagaaatttggaattaggtactctcgatatgctgatgatatgattttctcaagtgacagaaaggtcatccatgcccccttcttcataaagaccattaagaagatcctgaatgaatccaacttttatgttaacaaccgcaagactaagttttcaattgggagcttgaatctgaatgggtttaggattaccgataagattaacctgacacgcaaaaaacgggcgaaactgaacacatgcctgtacatttgcaacaatacgaaaaaaaagcacgtacttaccaagcttaatctttctggcttcaacttttcggacttcgaggatctggccaattatctcaatggtacccggtcctttttaatcatgatagccagatctagtaacaacaatatcgttatcaacgagctaatcaaggagattgaggtgaatattaacaagtttctgcagtga

SEQ ID NO: 12379 - RNA, 1014 nt, unidentified
  source 1..1014: mol_type = other RNA; note = synthetic construct
atgattatctactctaaggagtttttcgataacaacatcttgaagatcagcaacgaaattgactacattaatgctatccagacaaaagagtcttcctatacccataaaagcattctgaaaaagaaccgattgaggaatatagaggttatagatagagacagtctcttggccaagatgcagattaatcttaaggacaacttcctgaacattatcccaatccctcatttcgtgtacggttttgtaaaggggaaaagctataaggattaccttatccctcacataaacaatatgtcgaagaacaagtactacattcgactcgacattgggaatttttttgacagtgtaactgtcgagttaataaaaaatgccctatccgagtatctttctctcaatgatctgcaggaaaaagaccaaatcatactgaatatagccgatttggtcacactggacggtaaacttccccaaggcgctattacctctccagtgatttcaaatatcgtgttcagaagactggacttgcggataaagaagtactgcgaccagttaaacattacttacacccgctatgcagatgacatgcttttctctagttacgacaacatcctgctgaaaaataatctcatcaatctcgtgagggcggtcctcaacgactatggattcgaactgaactttgataagacgattcgcactaaaaactttatctcactgaatggattcgtggttagcgataatttatccctgtcacgcaagaaactaatcgaaatcaaacggatcctgttcatcctggagaagaataagaagaacaagaacagtctgaaaatcctcgaagaaattaactccttcggcaaatacaagaagcgtaataaatttaccagcgaagaggcattgcacgattatctggccggctatcggagcttcctaatttccctgctccccgataacgatgacctgtggaaggagaaatgtatttcaacaatcaacaggatcgagaaggctatcagcgtgtccttttga

SEQ ID NO: 12380 - RNA, 1044 nt, unidentified
  source 1..1044: mol_type = other RNA; note = synthetic construct
atgcaaatctttgataagggctttttctacgaaaagctgatagctaagagtaatctgcacgatttaaacaatgttcgcgacgtgtactatcggaagttcaatatcgtgataaacaacaagaagaggagtatcgctacagtccttgagggtacggctttatataaattgcagttccggctcaagaataattatctggataaactaccccttcccgactgcgtcataggctaccgcaaaggcaaatcttatcgagactttctggttcctcacgtgaagttagataaaaatgaccgcttttttgtgcgtcttgacatcaaaagttttttcgactccatcaacgaagatgtcattaaagaagcgctccaagactatgtcaaaatagccggagaggaagacaggaatcgagtgatatccgacattatcgacatctgcaccctcgaggggaagctgccacagggagcactgactagccctgccttgtcaaacatctgttttaagagacttgacctacgcatccggtcatactgtcggaaattaggctatacctatactaggtacgttgatgatctgctgttcagctcaaccgacctgagcttgatccagccgaaatttatccagatgatcaagttgattctctccgattacgggatgaaactgaaccatagaaaaatcatccagacaaagaacttgatttctctgaatggattcgtcattagtgacgagattaggatctccaaaagcaaaatgaatcatctgctaagccttctgttctgcattgaacagaacctcaagtcccgaaacctcgcagagctgctggaaaaactgaaccagattcgtcagcatgacggcaagagggatttcttgacagtggatgatgtaatggagttcctctctggtagccgggcctacctcattgcctggaattcatctgactcttcggcatggaaggtaaagtgtaccaagttcattcttagaattgagagacagctcgtgtccctggataagaagcacgggcaagagctgagagaggtgaacttttactga

SEQ ID NO: 12381 - RNA, 969 nt, unidentified
  source 1..969: mol_type = other RNA; note = synthetic construct
atggattcctttaagatcctcaacaaagagacttggcttcaaaccttaaatatttccgaggaagagctaatgaaagtcgcagagctgaagagcctgttttataagaaataccggaaggagaagccaagtggctacaggactatctatatcatcaacaaagacagcgtactgtactcacttcagtctaagatacagaaaaagatcttccgcaatatattcctcccggaatgtgtgtacggatttcgggagaactgctcctatattgattttttgacacctcacatcagtagcaagaataagttttatctgcgacttgacatcaaggacttctttgaatcaatttcagtcgagtacatcaaggatttcttccagtactatatcgacgacaaaatatctaacgaagagaagacgttcatagttaactcaattatcgatgtcacaaccctgaatggaaaatttattcagggggccgtgactagtcccagtatcagcaatttcgcatttagagaaattgacataaggattctcagctattgccgcaaactgaatgtgcggtatacaagatacgccgatgatatgctattcagctccgaaaacaactaccttaactccaagcatttcattattgccatccaggctatcatcaatgacctcggctataccctgaaccacgcgaagaccctgaagtataaaaatgagatttccctgaatggctacgtgattggggctgacattcgtttgtctcgcaggaaactccataaaatcaacgaactgatctttcagctctcgaagtctgatttctacggttttgagaataacatcgagaaataccacatcaagaaccagttggccggttaccgatctttcttgatacaagtgaatcggcacgttgtggacctgccctatagaagacatttagaagagaggattctgaccatagaaaaactgatcattaagcacttcacatga

SEQ ID NO: 12382 - RNA, 903 nt, unidentified
  source 1..903: mol_type = other RNA; note = synthetic construct
tgtctgagccagaagacagactgctacagggtgtacagcaaacaaaaaaaagatggcactaggaccatccatgccatcaaatcagactccggtttgtacgtgctgcagcacagaatgcagcagaagtttttgaacaacatctatcttcccgacactgtttacggctttcgggaacactgctcttacatcgactttctaatcccacatatttccgaggaaaaagacagatgtttcttgcgtctggatatcaaggatttcttcggcagcattcgcatcgacgatctcaaggaagcactaaaatattatgtcagcgatgagatcgagaacgctgaccaagaaaaaatcctcgacaaaatgatcgagatcgtgacggtcgatcagaaagtcgtacagggggctgtgacctctcctatgctgtctaatttagtgttccgacagcttgacattagaattgagcgatactgcagccggtttaatctcaagtatacacgatacgctgatgatatgctctttagtggtcggacatcatacattcactcacggaagttcatggccgccattgctgccattatagagtccaagggattttcacttaattactctaagaccctgagggcagagcaggagattagcctcaacgggttcgtgatcggctccgagctgcgggtaagtagaaaaaagctgcataagctcaacgaaataatgcaccgtttaaatagtcgcgaatttgataagttctccagtgactatgagctttatcacgttaggaatcaactggcaggatataggtctttcctgctgcaggttttgcataccgatgagtcggaagcccgcaaatataagattcaaatcaagatagaccgcattgaagcgctgatgagaaagtactgtaagatagactga

SEQ ID NO: 12383 - RNA, 978 nt, unidentified
  source 1..978: mol_type = other RNA; note = synthetic construct
atgaagtcttggcagattcataattacgatagcctgatctcagacattctggagactagcccagaggccctggaagaggctttcaaaaatgtagacaagtactacgagagattaaatctgttgaagtccgacaaaaagtcctataggactatttatcgtcttaaggaaagccccgtgagcatcatgcagaaaaatctgcttaatcgattctttagcaacatttacttcccttctaacgtttttgggtttagaaagggttgttcttactttgactatctgaactaccaccagatgatcggcgatgggacatattatctgcgcctcgatatcaacagtttcttcgataacattacgatcgagaactttgaggactctatcacatattacatttcagacgattgcagtgatgaagagaaacagaaaataatcaagacgctcctcaagattacaacctataaaaaccacttcgtacagggctccataactgctccagttatatccaatatagtcttccgagaactcgacataaggatcgaaaaatactgcttcaccatgggcattaaatattctagatatgccgacgatttgctgttttccagccccagcagttttcttcactcagacaggtttatccggatgatcatcaacatcctgaatgataaaggattctccattaaccatcaaaagacactcaaacaggtgggacaattggtcattaatggctacgtggtcgacagtgcagttcatctgtcacgcaataaactccggaccatcaataagattttacacaccatcgagaaaaagaaatcgaaggtgctactgacttcttggggcgcccctaactatagggtgttgaattacctgtccggatacagatcgtaccttatcaacgtgatgaagtactgtgacgaggaaaagaagaacaagttagggaagaccctagcgcgcatcgaagatataattaaccggtactattga

SEQ ID NO: 12384 - RNA, 990 nt, unidentified
  source 1..990: mol_type = other RNA; note = synthetic construct
atgaacaacataaccatcaaggataagactgcctttctcgacctgatcatggagaatccagaagatcaggataagtttgatcgagagaaagccactacgtaccgcctgttcaaaataaaaaagcacaatggcgaccgccatatttatgctatcaagcccacttccattatctgtaaataccagcagaatctttacaagaactttctgaccaaactgttgtttccggagtgcgtatgtggtttccgcaaggacaggagttatttcgacttcctggtccctcatatcagcaaacagaacaagcggtactacctgcggcttgacattagtgatttcttcgaatctattcagctgtccgatgtgaaggattgctttcagcactatcttaatgacgatatggatgaggaggtcaaggatgatatttgcaactacttcataaagatcgtgtcatacaagggtaaaatcgttcaaggggctgtgaccagcccagctatcagtaatttagttttcagatccctggacattaggatcacaaaatattgccaaccctttggaatcacatataccagatacgccgacgacttgctgtttagctgtaaccacaagaaaatcttttcatacagcttccagaagtgtattcaggcaatcttgtcggacaaagggtttaccttgaacattgacaagaccctgaagtttaaggacgagatcagcctgaatggctatgtgattggagagagcattagactatctcggaagaaggtcactaggcttaacaaaatcctctttgagctctctcagtctaacttcgatgaactaaaatccgaacgcgagagatatattttaataaatacgctcgccggctaccgagcgttcttcatcaattcaatgcggtatatgatagaccctgtgcagacaaaaaaaatggaaaggaagattcagcaaacagaaaaggcaattgacaaaatccgtgcactccccatccagcaaatatga

SEQ ID NO: 12385 - RNA, 975 nt, unidentified
  source 1..975: mol_type = other RNA; note = synthetic construct
atgattgggtttagaattacctccaagtctcaattctttgatgaaatcgtagaaatctctgaggaaaaaatggccctcgctctcaataataaaaaaagcgcctatcactgctacaaaaaagccaagaaggagggttttagaatcatctatgccatcaagaagaacaatcttatctacgaattgcagaataagctgaagaactccttcttcatgaacctgttatttcccgagtgtgtttgcggcttcagaaagaggaaatcgtattatgactttctgattccgcacatctcttcaaacgagcctcgctattaccttcgactggatatttccgactttttcggctccatcgacgtcgacgatatagaggaatcattgaactactacattgatgacagcatatcctcagaggaaaagcagctgattatcaacaacattattggcattaccacaatcgatgacaaaatcatccaaggagctctcacaagccccatacttagtaacttggtgttcaggtctttggacattcggatcgaaaagtactgcaaaatgctgaatatcacgtatactcggtatgcggacgatatgttattctccagcgattctagttatatccataactacaggttccagaatatgattaagacgatcatcagtgagaaagggtttaatctgaacactaaaaagaccctgaagtacaagaatgaaatttctctgaatggatacgtcgtgggaaattcaattcgtctaagccggaaaaagctgagccagcttaacaacataatctatgagatgggcaagaaacagttcaaagggtttaagtccaacaaagagaagtacacaattaagaacaagctggcaggctatcgagcattcctcatccagagtattccatacattaatcgcaacaatctagtgcagataagcaaaaagataaccaagatcgagaatctcataactaaatactgtgctgactga

SEQ ID NO: 12386 - RNA, 981 nt, unidentified
  source 1..981: mol_type = other RNA; note = synthetic construct
atgaatagttttcgaattgagacgaaagaggagttcttcaagatcttagattgtgacgaggacacctttacttcagccattaaggacaaagaaaaggcgtacttcaaatataagcttcagaagaagatcggtagcagatacatatacgggctagtaaaagataacctgatctacacactgcagaaaaagatcaatcgcgaaatcttcaagaatatcttgtttcctgactgtgtttacgggttctgcaaacgcagatcttatttcgactttcttgtctcacatatctctaacaaccaacgtaaacactatctccggctcgacatcagtgatttctttgactcaattgagattgatgacatctatcagtgcctgtcctattatatcagcaatgacatatctggtgacgaccgagattacatcctgcaacttatagtggatattacaacgttgaacaaccatgctattcaaggcgcaatcactagccccgccatttcgaacatcatttttagatcgctggacatccggatagaaaaatactgtgagaaaatcggcgtccactacactcggtatgccgatgatatgctctttagctccgagagtagttacatacattcctacaagtttaccaacgctattcaggccatcataagcgataaagggttctacctgaatcgcaaaaaaaccctcaaatgcgagaacgaaatcagcctcaatggatacgtggtgggaacaaacatcaggttatcccggaagaagtacaagtccatcaacaagatcatttatactttgacaaccagctctttcaccggcttcaagaacaattaccaccagtacattacaaggaataaactagcaggatataggtcttttctgattcagtattccaggtatatccaagatgaaaatcagaacaagaagattcagaagaagattgaaaccatacagaatctgattctgaagtattgcgtgtcttcaatttga

SEQ ID NO: 12387 - RNA, 1050 nt, unidentified
  source 1..1050: mol_type = other RNA; note = synthetic construct
atggacagttttaagatagccaataaggaggaattcattgagcttattgatgtgtctgaagacgaactgaaggaaatcctgaaaaataagcagaacagctaccacaaatgctttgtgaataagaaaaagcgggattccattagaattatctttgctctggaccagaagtctaacctctttaaaatccagcgagcattgcagagaaagttcttctgtaacttttatttcccaagcaatgtctacggcttcatcaagcaacggaattacattgattatctggagcctcattgctctaggaacggaacacgcaattttctgagactggacatcaaagacttcttcggtacaattgacatcaaccacatcaaggaatgtctgaagtattacattgcggatacctgtgatgaaaacgagaagaagtacataatcgattcgatcgcagagattgtcacgtacgagaacaaattgattcaaggcgcaattacatcacccgtaatcagtaacctcgtttttaggaaactagatataaggattgagcgcttctgtgaaaaaaacaatgtaatctacacccgctatgccgacgacatgcttttcagcgggattgactttgacgtgcataaacggacttttatcaatatgatcgccaccattatcaaagattatggattctccctgaactataagaagactattaagatgcacgaagagttgtctataaatggttatgtgcttgggcgtgatataaagatcagccgaaagaaatatgagtcagtgaattgcctcctctactacatcaattccaagattaacaagatcccgatcagtcggagctttaagtaccagttaatcaacatactcgctgggtataggtccctgttcatacaagtgttaagatacgttcatgacagccacaacaaagaggtcatccagaaaaaaatagccgaaatcgagaaaggcattaacaagatttcacagttcaaggagaacaatattggagctaataaagactacgaagataaaatcctggaggagatctgctccaaaaagtga

SEQ ID NO: 12388 - RNA, 1095 nt, unidentified
  source 1..1095: mol_type = other RNA; note = synthetic construct
atgctgcatagggcctccaagcagggagatgacacgttaaaagtttggagagtcgataactacaatgactacttcagcaacatcgttaaagtgcccgaaaaggaattcaagagcaaaatcgcggataatgaaaagaagctcttttactctgagtacattaacaaaaccaagaagaatggtctgcgaaaaatttattgtgtcacagagaactctgacctgtataagatccagaagaacattaagaacaacttccttgataacatcatgctgagtgactcgtcttatggctttagaaaaggccgaagctattacgactttttagcatcccacaagagcttctacagtggaaagtattttctgcgccttgacattagagattttttcggatccattgagtactctttgatagaggacgtggtcagttattacttcgtggtcggggaaaatcttacctcgtcacaaaaaaaggagctgctgcaaaacacactgagttccatgacctatgaaaataaggttcctcagggggccatcactagccctacactgtccaatattgtatttcgtcagctcgacttacgcatcgaaaaattctgccagaatgtggatgctatttatacccggtacgccgatgatttgctgttcagttcatacaacaggaacctacactctgccaagttcatcaacttcatcagatccattctgatatccaagggcttccacataaaccattcaaagactattcggactaagaatctcatcagcctcaatggttttgtgatctctgagaatgatatccacttgtctcgtaaaaaacttgcatcactgagccggatcctgttttgcctcgaaacaccaaagtggataaattccaaagccagcttcgtgaatctgaacatgaaactcaaaaccgagggcgacaaacatctgtttgaggggaagtacgcattgctaaatttcttggctggctttagggcttttatcataccaattgtgaggtcaatggacgacagcaagctccggaagaagcagcagaaatatattgtacgcatcgagaagaccattgaaaaaatcgagaaacttccgcccaagaaatga

SEQ ID NO: 12389 - RNA, 1050 nt, unidentified
  source 1..1050: mol_type = other RNA; note = synthetic construct
atgaaagtatggaaaattgagaactacgacgactatttcaactttattgtgaaagtctctgaggataacattaatgaactactgtcacaggatgagaaaaagaaatactacagtggctatattgagataaagaagaagatcgggaaaagaaagatctattgcgttgataaagacagtaaactgttcaagctgcagaagaacattaaaagcaacttcctcgacaatattatgttgtccgacgcctgctatgggttccgcaaagggtactcttattacgattttctctctcctcacaaagacttttacagtaagaagtacttcctccgaattgatatcaaggagttcttcaactgcattgactattcaataatcgaggatgtgattaagcattactttgtggtgggagataacttaaccaagtctcagaagaaaaaactgatccagtatactctgaaggcagtgacctacagaaaaaaggttattcaaggtgctatcacctcacccgtccttagcaatataatattcagacagctggatcttcggattgaaaagtactgtaagtacatagacgttatctacacaaggtacgccgatgatctgttgttctcctcctataatcgttttctgcactcgagggcctttattaatatcatctccaggatcctcaacagcaagggttttgacatcaattatagcaagatcatccgggcgcggaattcagacaaaaatagtgtcagcatcaatggctacgtcataaatgacgaaatccacttaagccgcacaaaacttaagtctctgaacagggtactgttttatctggagaacacaaagtggaaaaactgtaaaaatgacttcgagtccttgaacaaaaaaatgaaggctgaaaacgatatccataattttagcggaaagtatgagcttgtgaacttcctcactggctatcgagcatttatcatatccatcgtgaagggaacggacgatattattctgaagcaaaagtaccagaagtacattgaacgcatcgaactattggtgaagaaactcgtctga

SEQ ID NO: 12390 - RNA, 1041 nt, unidentified
  source 1..1041: mol_type = other RNA; note = synthetic construct
atgaaaagatggaggatcgataattaccgcgatttcttcaacaaaatcttaaaagtcgaggaggacgagcttatagcactcctcgaaaacaaaaacaatgtgtacagctcctataagattaagaagaagaaaggccaccggactatctactatctcaaagataacctcgaccttgcgaaaatccaaggcaatctcatcaaaaacttcctgtccaatattatgttgtccgaaagttgttatgggtttcgctgcaatctgaattacatagactttttggaaaggcacacaaccctgtccaatgatagatattttctgcggttggacataagcaacttcttcgaatcaatctctatggaactactgattgatgtgctgagttattacatagaagacagcgaatatgtgacttcagacgagagcaacaagatcgtctattacatcaaggagattgtgacatttgacgacaagctggtgcagggaattgctacctctcccatcattagcaatatcgtatttaggcagttggacattcgtattgagaaatattgccggaagctcggagttgaatattctcgatacgctgacgatttactattttcgtcggagattaaaagcaaaatccacggtgacttttttattggcaaaatagccaagattctgagtagcaaatccttcaaccttaaccataagaaaacgataaaggccgataaggagctttgtatcaacggttacgtcgtgggaaaaaatatccgcatctctcgtaagaaaatgcagaccatttctcgagtactttttttcctgaacagtgttaacatcaagaagaatttgaacttcctggatgagctaaaccataagctcaagaatgagatgaaggataataggatttacttcctcaataagatccagttaatcaactacctgtcagggaatagagcctacctgatatctattctgagatattccgacgagtacttcgggaaacggatcattaagaagatcaacaatatcgagaagctgattctggagctggatgaatcatga

SEQ ID NO: 12391 - RNA, 1044 nt, unidentified
  source 1..1044: mol_type = other RNA; note = synthetic construct
atgaagattgctaagataaataacagggagcaactgtacaaaggcgtcctcgaatacgaaaaacgtattatcgacaccgctttaacagattctgccaaaaaacagtactatggcaagcgcataaatattccaaaaaagggcgggagccgaggcatctactgcgtagattcgaatacattcctctacgaagtccaaaagtccttcgcaaagaacttccttaataatattcccaacagcgatgcagcacacggcttcgtgaagggcaagaactactactccttcctcaacgcgcacgtctatccatattcaagaatcagtttcctccgtcttgacataaaggacttctttgaaagcattacgtcagaaatggttagaaactctctggactattatgtcagtaatgacgatccccgaatgcatgatgaggtgcttaatattatgactgacatcgtatgttacgaagggcgcttgatccaggggtccccgacaagtcctgccatctctaacattgtttttcggcctgttgacatcagaatcgagcgctattgcatgtctcagggagtggtgtacagccggtacgcagatgacctgctgttttccagcattagcggaacccagttatccgagagatttatatctggtattaaggccatcctgaaggataatcattttaggttgaacctgcagaaaactattcggtctgtggattacatctctctgaaagggtttgtgatagagggtcaaattaggttgtcaaggaagaagaccaagtcaatcagacaggtgctgtatttcctagagaaaaatcgctatgagaataccaatgcctggatgtcgtccttcaaggaggagatggagggcctgggtaacgactccgccatggacatcaacaactcatatagtctgaaaaactacctcgccggaatgcgggcttttatcatcagctccatcaaagagagtggagatatctattacaaaaagcgggctgcgggaattatcagcaggatcgaaaaacagatagacgagattgaaaacaaggggtga

SEQ ID NO: 12392 - RNA, 1056 nt, unidentified
  source 1..1056: mol_type = other RNA; note = synthetic construct
atgggagataacaatgggatgaacgggtggaacatacaggataaggaagacttctacaatcgcatcggtgtgaaaactgacctggagctcaaatcctatgtctcttttttagccaagaacaagtactacaaacaatcagtagagatacccaagaagaatggtaccaggctgatctacaatattgataagactagcgaactctaccgtatccataacaacctaaagaaacagtatctcgacaggatatacattagcgacgctgcctacggctttgtgaaaaagcgctcctattatgactatctggtaccccacctgaacaagtacaagaatcgccattacatgagaattgacatctcttccttctttgattcaatcaaatccgagcacattgagaatgcgttcggcttcatacttaaagaatgtaaggacagggactatatcatcgagagattaaaagagatcttcctgtacaacggaactttggcacaaggaacaccaatcgcacctgctgtttctaacattgtgtttagagagcttgacattcgtatagagaaatattgcaacaaacggaaagtcgtgtatacacgatatgccgatgatctgctgtttagttcggatgacaatacggtgatgcgcaaggatttctaccgggggataagaaagatcttgggctctcggggcttcaacatcaacgaagataagaccatcaatatgtccgatagcattgttatgaatggaatcgtggtcgggaaaagtattcacctgtcaagaaagaagcttaaaccaattcgaaccatgctcttcgccttgaagctggttgagaaggaaaaagacattgaaaagtgtctcaaatgcatcaacaacacatttcagaaggctaaaattgataagaccttcaatagcgcaatcgacgtgcggttttacctgtgtggctataggagttacctaattcagatccttaagtattgcgaagacatcaatattgagaacaggttgaagaagatcataaatagcattgaaagctacctgaatggtcctaaaaaatcatttctctga

SEQ ID NO: 12393 - RNA, 1008 nt, unidentified
  source 1..1008: mol_type = other RNA; note = synthetic construct
atgtggggaaaaaagacattcttcgaacctaacccattcttcaagcgccggctccagtggctgtatcgacagctcttaccattgtacgagccgcccgcatgcgcctttgcctatatcaaaggccgcaattacgctcaatacagagcagtgcaccagaagaatcattatatctacgccatcgacctcaaatcctttttcaacagcattacaacaccacaggtgaacaacgcccttcaatccttctgttcccctgccgtggccggttatctagcagacgcgctcactgccgagggtgttctccccattgggtttcctactagtccactgatatctaacatagtcttcaagaacctggatgagaaaattgtggagtttgcaaataaagaagggctgagctattcaaggtacgctgacgatatcctgattagctctaacaagaaaatcacaacccagaatctgaatgcctttgtatacctaatcgagaagaatggcttcaagatcaacttcaagaaattcaagaaggtggataagaacaccaatctgtctacgctgagcttgaaagagcgtagattccttaatttgcttctgcaccagtggcagaaaaaaggctacatggacaccaatctctggtttctggcagctcataggaagagttatgccaaaccgcaagatgctttgagtaacttccttcgggcgaagatttttccctttaaggatgacttccctaagctgtgggctcagtttgagagaatctctaagcagtatccctaccagactcaaaaccaaatggaggaaaatagcatacctgccactgagaaaacgcagattatgaaagaacagcccaagtcaccaacccagtacgctcaggcacccgaaccagttgttgtcagtgctactacaaacgcgaccaaactgaccttttccgcctcgcggcaggaattagaacagtaccgaaggacccctgtctccggatcaattgacaattttttcaagaaccactgccaatga

SEQ ID NO: 12394 - RNA, 1509 nt, unidentified
  source 1..1509: mol_type = other RNA; note = synthetic construct
atgaagaagctgaacagctataaagtcaagaaactcattgacagatacatgacttcttctgaagagctcgggtcgatgttattgcgagcatccaatctgagcagacacatactcaacaccattgatatgaacaataccgacaaagcaacccataaattcctgtcaaattacaaggaggagatagacgatatccaggagcacaattcgtatagcctcagcaagtttagtagctctaaactcggactgagtaataggggtatcctaagtacttccatgtctctggctggaagttattcaaaatgggacgctcggcattgggtcagttatcgcgaggatgacaataggaagacacagttgtataaagaaggatcagagatcctctccccatctccatccgggatcgagtttgactttaacaacgatgtgttcatgggcgaggtaatcggtaacattaatcaattgatgggagtgattgggaagatgtccaattccgtgatctttcgacatcgattcgtggatggccggcgcatctccatgataaatcccaagctggaaaaaagcctgcgcgatattatagaggcggaatttaagggctatgctaagaacttctataagatgtacaacagctttcacctgaatattggctcaaatagggagcacgtgaccgggttcattaagggtaaaagctacattgatcatgctagggcgcacttaggctgcagaagcgccgtctcaatcgatatctcaaagttctacgataacatctcactgctcaacatcatcaacaacaacctcttctacaattcccttttgtcttttttcaagcaggagacggggctgccattcgaagcatcttcttttaaggaaggatatcactatgatctcctgtccaagctttttggacttatgaatgttcaattcgtgggcttgatgacttttctaacacataacggactgcttcccaccggtgcccattactcccctaacattagcaacctgatattatctaacgtcgatctgcacatggtggacgagatcaagaacatcaatagtaacctaaagtacacaagatacgccgacgatatctgtattagttccgacaaagacaaggatgagaatggggaatactacttgaatatggacttcattaagcggctggaaactattattaacgatcacggctttcacctgaattacgacaaaacaatgattatgggcgccagcgaccgtaaaaaaattgccgggataattcttgaccatacggcaaatcctcccagactcagcatcggcagtaggaaaaaactggagctgcaggagcggttcaatggtaaagactggaaggaacttaccacatctgacataggaaccatcaactgggtgaagaccatcaatgtgaaccagtataacttcgtatgctcggggatcacaggcgaacgcttaatgcctatcccgcggggctgtgaacgtgatcccatcacttcactggtcgttgacgccgttcctttttga

SEQ ID NO: 12395 - RNA, 1296 nt, unidentified
  source 1..1296: mol_type = other RNA; note = synthetic construct
atgaaacgtctggccttgaaaaggacccgatataaaaagctgaggaagcagctctgtataagccggctgccaaagaataacaatgatctttccgcggtgtcttttctggctctctacatcgattttctcaagttatacagatcaaccctgatactgtgctgtagtatcgtgtattctgacagcattgcgattgagatctccaagaaaaaaaagaacaaggacttcttcaaccaacatgatatcgctctgtttgactctctgtatctttccataatcagcgactacgatctctacaagaaagacctgaacgaaaaaaacagagctgtggtggttgcacggatagatcgcaatagtaaattattgatgccggtcttcaattccctgtttgagctatttggaagcgtttcaaatacgtttatctttcgaaacgtggtgattaacaatcggcagctgtccataatctcggatagcattgatgccggtttgacctaccacattaagaagaacaataaagccatctcactctttttctccaggtattatagcatcttcgttaaccattactcactaaatgacaatgtgtatgggttcattaagaacaaaagttgcgttgataacgccaactaccatcttgacaactcacccgccagcctcattaacatagacatcaacaagttcttcaacaattgcactgtggtcaagtgcttgaagaataatgttttcaccgacactatcgacctgtttgacgcctcagtcgatacaaaaatcgccttcagcttcggtattatttctcttctgggatactgtacacacaatagtgtcttccctactggcgcatcgtttacacctgtattgagtaacatcatgctaattccagtggacgtcgctatcaaatcttacctgtccgaaacctttgggaacaacgtgtgtaatattagatatagtcgctatgtcgacgacatatctataagctctgatcgcgcgaaaatcaataaatcttacgtgctgacaatcgatacaattaagtgcattgagagtatcctcaacaattacgggttctatgtaaagtattccaagaccagcatcgcaggccccggcgataaaaaatccgtcaacaatattatcctcgacaataataaccacaagttatccattggaacggacaagaagcttaagtacaagactattttctcaaagctgtttgctgatgaagagcacgactatgtggtagcaaatctgccctacatcaaggatatcaacaaagaccagtacgattacatcactgagcagaaatga

SEQ ID NO: 12396 - RNA, 978 nt, unidentified
  source 1..978: mol_type = other RNA; note = synthetic construct
atggattacaacaccgtgattactctcctcggccatgataacgaaagctggcaaaatctgattgcaaatggtatccgctattctgtctttcagctcccaaaggccaataagaagctgcgtctgatagaggcaccgcagggcgagctcaaacgcacacagaaatatcttaacaacatcctgtacgccgagtaccaccctcagagccccgactgtgtccatggatttattcgaatgaaagctgctccacggaacatcttgtctaacgcaaggactcacctggggaagaagtacctaatcaacattgacctgaaggacttctatcaccagataaccactgagagaaccacagacctgctttggaagcggtttcccaatcttctgcccaacgaagtggacgaattgaacaaaatcgtggtaaaggacgatagactcccaatgggggcccctacatcaagtgttttatcaaatatggcgtttcaagaatgcgatatggcacttatgacgtattgcgaccagcataagattgtgtatacaagatatgtcgacgatctgtccttcagctcgaataaacagatcaacagcgccatcttagaaggcatctacaccataattaagctgaatgggttcagtgagaatcctaaaaaggtaaaacactatggcgagtctgatgttaagatcatcaccggaatcgcgatgcagggactccactggcatgtgtccgacgacatgaagtcaaggttggaaaagaatatgtccgagtaccggaagctacgaaaactgattaacaatctcaaattcctgggcgtggaagctaaggccaaaacgaaactgaaaactttgaaaagggctattgccggtcaattagagtttgtgaaacagatagaggggatcgattccgatttctaccgctctatgaagaagatatggaagcaaagcgatgccgataccgtcaacgttgacctgagtgtgtacatttga

SEQ ID NO: 12397 - RNA, 993 nt, unidentified
  source 1..993: mol_type = other RNA; note = synthetic construct
atgcatgccctgtttaaaaatgaacctgatcagctggcccagagcttgaattggcccgacgactaccaagatgtgatcaagaagcagaattaccatcagttctcaatgccgaagaaggatggcactctgagagcaattacagctccaggtaacaaactcaaatttctgcagaaaaccctttcccacgccttccagctgacctatctgaacaagatccccgattgtgtgcacggatatgtgccaggcgacatccatccagaagttgggacccgacacattctcagcaatgcccaggttcactttggagctaaatacttgctgaacttagatattgacgacttctttccgaacctcgatagtcttcggatactggatgctctgcgctactggtatcccgaaatgccccaagctactcaagagctgttggtggggatctgctgctacaacaatcaacttcctatgggggccccatcttcacctgtcttgtctaacatgtgtgtgcaccagatggatctcgccttacttacactatgtgctcagcaccaggtcacctattccaggtacgtggatgatatgtccttctcaagctccagtgataatctgctggccctggagcccgctttgatagaagcactccagtctttcggctttactatcaaccaggcaaaacgtatgcatttcggacccgagggccctaagattgtcaccggccttatcatggacgagacagacataacggtaaatgacacattcctcgacaatctaaacgagtgcattaaggaatattcgcagctcagatggctctctaggcagctggagatggacaagaagtggctacaatccaaagttcggttcgcagcgcagagcattgagggacagctggcattcttaagtcaaatccagggtgccgatgacgcggtataccaaaagtatcataggaagtttgacaaagcccagagcatgcgccctccaaactacgacttttatttttga

SEQ ID NO: 12398 - RNA, 1017 nt, unidentified
  source 1..1017: mol_type = other RNA; note = synthetic construct
atgaatatcctgaacttacagaacgcgtctaatagagtgcagttttgtaaagtcctggctatttccgaggacgccctgaaaagcgctctggcaaatcacaagtactataccttcaaagttaccaaaaagaacgggaagctgaggaaaatcgaagatcccaacgatgagagacagtatgtgcagcaacgtctgagctttgagctctacccactgtacaagacggttctgccaccttatgtacatgggtatatccccacagctatttcccaaaacggctcaaggtctatcttatctaatgcagaggcccacctaaattgcaacttcatggtgaacctcgatctcctcgatttcttccatcagatcaccataagtaaaattcgaggatgtctgagcaaagtctacaagatacgaagtctcaacataattgacctaattgtcaagatagcatgttacgaggggcggcttcctatgggttccccatgctcaccggtgttgtccaacatgatagtcattgacttagatggagccctgtttgactattgccaggcccagaatatcacttacacacgttatgtggacgatctcagcttctctagcaagcttgaaatcaccggcgtccagatcgagactctgaagaagatcattctcaatgagggtttcctgctgaatgaggaaaaatttcgcatctttcaccagaacgaccccaagaaagttacaggactggttgtgcatcaaggcaaacttgatgtgtcagatgactaccttaattccctctcgagaaacatcaaaaagttgaagcggattaagcggacataccagcacatgagaatgcttcatcctgagttgaagactaatctccagtcacggtaccgcctgatcaagagtagtgtagcgggccaactatccttcgtgcaaaggattttgcagcccgaagacgaaaggtgccttgccttggccgaagagttcgatgacgctcgcacctctagcgaagtggtggacctgcacctgtatttttga

SEQ ID NO: 12399 - RNA, 1692 nt, unidentified
  source 1..1692: mol_type = other RNA; note = synthetic construct
atgtattctaagaaagtgaagacgcctagtgatttcctccttctaagcaatgagcttgaaaatatccgagactttagcggactggccgtcctgctcggcgttaaccaggactatttgctaatgaatatcctcccgtcttacacttgtttcgagatcaaaaagaagagcaccttgagaaaagtctactaccccgagtactatgtgagtgaaatccagcgcacattaaacttgtacctgactgcttcttacctcacaaactattatctgccaacgcaactccctgtgcactcatatatcccgagaattaccctcacagaacaatcagattccgatatctgtcgtaataataaatccaacgccgaagtccacttcgggtccgaacgcattctcaagctggacttagccaacttcttcccatctatcaaatccatccacgtgagggacggtcttcggcgactgctgcccagactccctcagtattgtattgagtggctggtccatctgactacatttgagggttttctgccagctggcgcacctacttctccaaccatttccaacattattctctacgacttcgacaaattcgctaatagcataaacggaatcaagtatagtaggtatggagacgacctgaccttttcagccattgatgggcgcataaatctgaagcaggtagagcgagacgtgaagattgagctggaaaagtggcagtttcagatccaggaggccaaaacctttttccttaggaagggccagcggctgcgcatcacaggagttgtcctgaatgagaagctcaatattagtagggagtaccttaagtggttacgcgctgtagtatactcctgtgagagcataggtattgagaaagcagcaacgaaatatggcgacaggtactttgagaaaatgttgaactccacaaggaagaagtaccgctatatcggggtctatgtggataaaggtctgatcaaaaaatgcataaccaacaaagagctcgtctccttccttaaagccagtctgctgggccatataagctacgtttcctccgttcgtgggaaggatgatgtgtacgttcagaacctgagaaatcggtttatcaattgcctgagggaagaaggcttggaaaagaaggagatcgaatttgaagcgaagtcatttaaggagaacgagaatctggtgtatattactaacgccacctcacaatcggtagtgtactatgcctatgtgttcctgaagtctgctaagttaagtgatgatgacattaatcgacttcggaagcacttctcttataaagacagtagcaatatcgacttcaagaaaattaaggagaacttcatcaaccagtcaatttacttcctagagctgtacaattacatgttttaccgggaccggtttaagttgttctacgaatcactatcggatgatgaatggaatcagctttttaaccgtgaccagaatttcgcgaataagagaacttatcccagatggatataccaccttgattttaactgctctaacatcagaaacaactataacgaggaaggcgtgttccatcccaatagcggagtgttttttgaagaggagaaagcaaaccaagtgtacaacgcatacttgttggaaaaaaacttcctcgatcagttagggatgcggacctgcctgatctgccaaagcaatataagcgagttcacatga

SEQ ID NO: 12400 - RNA, 981 nt, unidentified
  source 1..981: mol_type = other RNA; note = synthetic construct
atgaaaaacaagagcgccttttatcacttcgcaaagtctttcaatttggagcaggaggacctgtacctggtttactccgcacccacctatcatacctttgagatccccaagaggaatggcgatctgcgaacgatctatgcaccagccccaaacctaaaaaaaatacaacgcaagatcgcagagaagctttcaaagtactactcggagagcttacctgctagcgtaatggggtttgtgaagacagccgcctggaaaaaaaaacgggacattgtgagtaatgccagaaagcacattaaatccaagcacctgataaatatcgacatcgagaattttttcccttccataaaaaccgaccatgtggctcgtgtcctgaacgaaatcatcaagctcgataacgaaggtgttcagatcatacggcaggtgttaatgaaagatgattccctgccgcctggctctccagctagtcctatcctctcaaacctcgtctttaagcccattgacctcgccattgaacacttctgtaagggacagaagattatttacaccagatacgtggatgatcttaccttttcctcaaagaaggaaatcacaaaaactcagatttgcactattgcggacattctgacaaaatacaatttcagggtgaatgaggacaagactgtcatctataaaaagaacgacatcaaagagatcactggaatcgctatagtagacaagaagttgaccctatgcgaaagcacaattgaggagatcaagaacaacattttgtactacaaggaatggaaacagcagatcctgcaacaatatggtcccaacgagtctgttaggaagaagattagtcatatgcagcggagcattaaaggccagctgaatttcgccaaacgcatagatggggagaaaggagaaaagtataacgaactcaaagagctttacgaacactctctggatgaaaaagagttcgcgttcaaggtgtatatctga

SEQ ID NO: 12401 - RNA, 1200 nt, unidentified
  source 1..1200: mol_type = other RNA; note = synthetic construct
atgactaatgcccctgacagtgccccccttactaccccttcagggaaaaagccaccaggactgtccgttacactgaccgtcgaaagacaccggctcctgcatgtgattcttgaccccgcagcctggaggatgtttcgggaggccctacaaacccgcggtgcttggagcagacgtggacgaattctaaaggcgacgttggtcgccgaggattttcgcgggtggtcaccgaggccttacttgccacctgactcgcctgactggagtgaaaccgtcatggaactgcaccccccaaccgaaccggctgcattcgagaggctgatcgcaactgcgatggagcacttccgaatcctcgagcaggaagacgctgctgcctttgatcgcagtctgagaaacacatgggagaaggttaggcgggccgcgatggcagctcatgctcttgcaccatctcagctgccccgcccctttccggtgtatgcagctcggctggcggccatccccaagaagaggccaggagagtttcgggttatagccgtccctgatagggcacaactggctgccgggcgatccttgctgccctatctgcactctcgactggatcccgccctgcctatccacggcttcgtacccgggcgcaacccagtgactaatgcacagccccatcgcggcttcggatggtccctaactatggacctggccgatttcttcgatcatgtaacagccgacaaactcgtggacgccggattgccacgtagcatcgctcgcttgattacagatagagatggcgtggcccgacaaggctacgcgacaagccctgccgcaagcaatctcgcttttcagacagtagaccaccggatacttgctcttcttgccgcagaatgtcctggcgccgtgtatacccggtacgccgatgacctgacgatttccgccaatgacagagaggctttaatccgcgtgcagcggaacctcgaagccttaattgccagcgcaggcttcaaagtgtctgcgcgcaaaacccacgttctcgcggctagggcagggagaagggtggtcacgggtgtggccgtgggtgaaactgatctcagagctacccgttctgccaggagacggctgagggctgctgagcatgcagataacaggatgcaggccagaggcttaagagagtggtcactcctgaaagcaccacgtgacaagctcccgtga

SEQ ID NO: 12402 - RNA, 1146 nt, unidentified
  source 1..1146: mol_type = other RNA; note = synthetic construct
atgaatgactatatcacccttgaccttaaggggcgtagtgagaatggacggtctaggcaagtccatctgacaggagagggcctaagagaattcggagaaaaacttgaaaagaatggtttgcagaccgaagcgcccttaattgttagggcactttttctgcggggtgaagccggaaacttggactcccgcccctgtttcaacggtaatggctgggacggcaatatgctggaaattcacctggcaccgggtatcggcagcaaagtggccgaggcaggggtcgaggcttatctcgacgtgacattcgaccggaaggccgatgggctgttcgataggaaatggagagccgaaatggccaaggtgcggggaaactttccagggtttccaggggggggagtagccccttttccagcattcgatgcccccttggtacggatccccaaacgccgacctggcgctttccgcctgatagccacacccactgcagaccagaaaagagcggcaagatggctgctgcccaccctggataagtggattgattaccggctccctatccacgggtttgtgcacggccgcaaccctgttacaaacgcgaaagttcatataggatttcgattcagcctgggctttgacctcgaggacttctttgatcacgtcaccgtaaagaagttggtggccgccgggctgcctcgttcattagctgtggccgtgaccgatggggcaggtattgcccgtcagggatacccaaccagcccaactgcggccaatattgcttttcaggaggtggacagagctctcctccgaactgtggcccagctggaccagggagttgcttactctcggtacgccgatgacctgacgttttccgcagattcctggagcgtgttgcgcaggttaaggggcctggtcgaggagctcgttccacgatatggcttccggatctcacacaggaagacgactagttggtccgctttcgccggtagacgtatgatcacaggcgtcgctgtgggcaaggatggagtgtgcgcaccccgcgaaatccgcaggaggctcagagctgctcgccatcaaggccgagcacctcaggcctctggcctagctgagtggaacagagtccgggagccgcatgtcttcaggagatcggattga

SEQ ID NO: 12403 - RNA, 942 nt, unidentified
  source 1..942: mol_type = other RNA; note = synthetic construct
atggcagccaggtttgcacgagggccgcaaggcttacagagcgatccatcccacctgaaaacaacagggtcccatactagtaaccgcgcggctatttgtggactggtcgacgtgttcatagttgaattcggaatgcaagtgctgcgcatcccgaagggtaacggaaaggtgagagtggtttacgctccttctgaagaggagaaggcagaactgaggtccctgctccccgctcttgtgaaaattgctaagcgacgatgcaatctcgaagtcgtacatggctttatgccaggtcgctcgcctctgactaacgccctccctcacgtgggatatcagtacactgttaatatggacctacaggatttctttgacaccgtcctcatcacacatgtcatgcacctcatcccaccccagattttggccaaggtgatgcggtatggcgcagcccgtcagggtttacccaccagtcctcttgtggcaaatattgccgctgcccagttggactgggatctgataaccgccttgcccgaggatgtcgtttacacacggtatgccgatgacttatcattttctttcgatgaccagaaactgaccaaggagctacctttgctggtaaaaaagatggtggaggaccacggcttcgctgtcaacacggctaagactaaagtgcaatgggcaggggcggggcgcagaatcatcacagggatcgcggtagaccacagccgggtttttgcaacgagagaagtgcggaggaagcttagggcggcccatcaccagaataacaagggctctaaagccggactcaccgagtggtgccggctgaaactccccgctctttacctggccgagcagaccagacgtggcaagaaaagcaaatcacaccatagggccgaggaaccagtggtcgaaaagagcaataaggagaggcgctccctgagactgtga

SEQ ID NO: 12404 - RNA, 1293 nt, unidentified
  source 1..1293: mol_type = other RNA; note = synthetic construct
atgaaaattttgaagatcccaaagaagaacggcaagtatcgaactatttacgcccccgatgcagaggaaaagagggcactcaggggcatcgtgggaatactgaatcaaaaatgccagcatgtttgcgacccagccgctgtgcacggctttatgcccctgaaatcaccagtcaccaatgcattggctcatgtcgggagaaagtacacagttagcttcgacctcgaagatttctttgatacagtgaccccagaaaaagccagtaagtgtctgaccaaagagcagaaagagttggtcttcgttgatggagccgccaggcagggactgcctacatctccagccgtcgccaatctagcagctaccgacatggatcgcgccattcttaagtggatcgaaaagtcaggaaagtccgtggtgtatacccggtacgccgatgatctggctttttccttcgatgaccccgagcttattcctgtgatacagaaaaaggtgcctgagattattaggcgctccgggtttcgggtgaatacagacaaaaccactgttcaggccgcggtcgctggtcggagaataatctgcggtgtcgcggtcgatgatgaaggggttcaccccacccgggaagtaaagagacggctgagggctgctaaacaccagggaaacgagttggaagccgctggattagaggagtggtgtaaacttaaggtaccgtctggcaagcgacaaaaggcaagggagactacggaggggctcgacgagttaagaaagcattggaagctaaggaagatcgacatggcaaaagcagtgagccgtaaggtgatccccgaaaaggacctgggggacaattgttacattacgaacgacccagcctattttatgggaatgtctacttttaccactggctggaaaagctgcatgcggatggacggcggggagtaccgcaaaggtgtgatggcttggctcgcactgccgggtactagcgtagctgttttcctttcggatcgcacaatgaacatcgcgggcgttgagcgccgtaggatgagagccagatgtctggtccacaagctggagaacgggcagctggtgtatgaccgactctacggtaaccccgacgatacacccgtgctggtaaaaaaattagaagaggccggcatccggcctatacgcgagttcgcagggaagggcatttacgtggaaggagacgtccctgcgagtatggccatgccttattgcgacaacctctgggaagaaaaaatcaatatcaagtccggcaaacgagtggtgagattctatgtgtga

SEQ ID NO: 12405 - RNA, 1296 nt, unidentified
  source 1..1296: mol_type = other RNA; note = synthetic construct
atgaagattgtgcagatccccaagagaaatggagagtacagaaccatttacgtccccgataagaaggaaaaacagaaattcaagaacctattgggcgagttaaatagaaaggccaagaatattctgtcaaatgcagttcatggattcgtccccggaaggagtccggtgacaaacgccctggctcatgttggttacgagtacactatatcgttcgacttagaggacttcttcgatactgtgacacctgaaaaagttagcaagtatctcacaaaggaggagaaggaaactgtcttcgtggatggcgcagcacgccaagggttgccgacttcccccgtggttgccaacttggctgctgcggacatggataaagctattctgaagtggatcaaaaagacccagaaaaatatcgtgtacacacggtatgccgatgacctgaccctctcatttaatgagccagagctcattccagtgatcaaagataagatccctgagatcgtcaaacgaaatggcttcaagatcaacgagaaaaaaaccagggtccaggccgctattgccggcagaaggataatttgcggaatcgcggtggacaaaaacgggatttacccaaccagggaagtcaaaaggagactccgagccgccctgcaccaaggaaaaatacggcaggcaaagggtctggaagagtggatgaagctgaaacttccaaactcagagaagaaggaagagaagataaaacggattgaggaagcgaaggtcctcatcgaactgtggggtattaagaaaatagatgtagagaaggcactccgggagaaagctatccctgaaatggacctcggggataattgctatatcaccaacgaccccgcatatattttcggcatgagctattttactacagggtggcgcagctgtatggctcctgacggcgggtatggaaaaggtgtggtgacctggatgatgcttagcggcacatccgtggccgtgtttctgtctgaccgtaagaaggctacggggtccgtcgagcgcagggtaatgcgagcacgctgtctggtacaccgcctgcgtaccggcgaactggtatacgaccgtttgtacggcaaccctcaagatatcgagtttctgaagaaaaagcttgaagagcacggaatcaaaagtgccagagaaatgcccaaagacagtaaactatacgtggttgggaacgtgtctcggtctttgcctcagccatattacgatacgcttcggaaggaaaaggtggttctgaaggaatcccagaaaaaggcctatcgcttttttatctga

SEQ ID NO: 12406 - RNA, 918 nt, unidentified
  source 1..918: mol_type = other RNA; note = synthetic construct
atgagacggatattaatcccgaagagccaccggacctggagaaccatctatgttccaggacctgcagagaaagcacgactgcgtgggcttgtgcccgtgctccataggctcgagaggtccgccgcagaacgtcacggaactattcatgttgcccacggctttgtaccccacagatcacccgtcacatgcgccctggcacatctcaactgcgcctggacgctaacagcagacttggccgattggttcgaccacattcacgagtcacagattgctcatggaatcgaactggggggcggagatcctaacgttgctgcgcagctctgtgtggacggggcacctcaacaaggactgcccacatccccgatcgcagccaatctggctgctattcccatggatcggtggatcctggatcggctccctcctgatgccgtgtatacaagatacgcggacgacctgcagctgagcttgcgcaccgctccacacgacccacaggccatcgtaggtatactcgaagaggccgcctctcacatgggctggcagatcgcgcctcataagactcgcatttacgatgcgcgaaggggtcacaggataatcgtgggtattgctgtcggctctcggtcgatcgctatacctcggaccaccaggcgccgattaagagcagccaggcatcagcgaccccaacatccgcatacacagggcctggaagaatggtgtagactgttgcttccacgcgctttgaggcctcgccgtcgactacgctttgagcaagctaccgacactccaccagccgggctttcctccctgagtacgccctcttcaagaattagtcacgccggcactatcgagaggagccagcagcacaaaccagggcttcgccgggtgttcagattcagcgtccggaatcagagcagtccctga

SEQ ID NO: 12407 - RNA, 972 nt, unidentified
  source 1..972: mol_type = other RNA; note = synthetic construct
atgaataatgactactccaacactcagggcggtagtgtcaatgataaccagtggaaggaagacctggatggcatatggtcgataaccctgacaccaaagttgagtaacatttacaacgtactagcctatggggaatggctttccgatcccaataaaatagaagccctgagcgtcaaaaaaattcacgtagacactggtggcaagaaacggttgatctactcacctaacatggattctaagggattctatcaggccatcttacctaagttaaatgagacgttcgagaagatggaggagcgagctgtggcgtatggattcgttcccaagagatcctgcgtcgaccaggccctccaacacgtgaactatgcatacaccatttctcttgatatcaaggacttctttgaccatgtgaagattaaacatgtgaagggtctgatcgacgaggaacttatcccttatctgtttatcgatggggccgctcggcaaggattgccaacatcaccgatggtttctaacatcgcatttaacgccattgaccttgaaataatcacctttctggaagaaagaatgggctttaccactagcaaacccaaagctgagcgagacatgttcttctgggacctcgacctggatttcgaccaagaacagaaacggtattatgcatacacaagatacgcggatgatctctctgtcagcttggatcagtacgaggacattgcacgcgttattaacggagtgcagcgcattctcctcaggcacgggttcgagctgaatgcccgtaagacgaagatcctagactccaataatggcaggagggtgatttgtggagtgggggtcgatgaggagacagtgtacccaactcgcaagaccctgaagaaactgagagctgccaaacaccagaagaacctgtcaagcatgtttggccatagggcttggatctacagtatcgataaaaagaaacccgtgcggtga

SEQ ID NO: 12408 - RNA, 951 nt, unidentified
  source 1..951: mol_type = other RNA; note = synthetic construct
atgaacaatgattattctaataacgaaggctcttcagtaaatgaaaatcagtgggaggacaacagcaacggggtctggtctattacgctgaccccaaaactgagcaaaatatacgccgatgtggtctggggggagtggctatcagagcctgggatgatcgaagtgctcaatgtcagaaaaatacatgtggatacagggggtaaaaagagacaggtctattcccctgatatgaatagcaaggttttctatcaagcattgctaccaaacctgaatgaaaccttcgaaaagatggaggagcgcgccgtagcttttggctttgtccctaagcgttcctgcgtggaccaagccctccagcaccgcaactacgcctacacaatatcccttgacatcaaagactttttcgatcacgtgaaaccaaagcatgtgaaaggtttgattgacgaagagctgatcccctatctgttcattgatggagccgctcgacagggcttacctacaagccccatggtttcgaatatagccttcaacgctatcgaccgggagattattgcatttctggaggacaagatcaccctgatcgcggacaagccgaagtatggaggctcatcttggggaggcgaggagaagaaacgctactacacttacacccggtatgctgacgatcttagcgtgagtctggactcctatgatgacattgcgcgggttatcaacggagtacagcgtattctcctccggcatgggttcgatttgaacgccaggaaaaccaagatcttagatgcaaaaaacggcaggcgagtcatctgtggcgtgggtgttgatgtggaaacagtgtaccccactagaaaaactctcaagaagctgagggccgcaaggcaccagaagaatcttagttccgtgtttggacaccgcgcttggatttacagtatcgacaagaaaaagcccgtgagatga

SEQ ID NO: 12409 - RNA, 951 nt, unidentified
  source 1..951: mol_type = other RNA; note = synthetic construct
atgaacaacgtttactctaattatgagggctgtggcgtgaacaacaatcagtggaaggaagaccaaaacggcgtatacagcatcactctggcacccaagctgtccgagatttacgctgatgccgtgaaggatgagtggtttttcgaaccttcaaaatctgacaccttatcagtcaagaagatcaatgtggacaccggagggaaaatccgaaagatctactcacccgatatgcagagcaaggtcttttatcaggctcttctgccaagtctgaatgaggcctttgataagatcgaagagcgcaccgtgagctttggattcgttcccaagagaggttgcgttgatcaggcattgctgcacctgaactacgcttataccatctctctcgatatcaaggactttttcgaacatgtgaagataaagcatgtgaaagggttgattgacgaagagctcatcccatatctgtttattgacggcgcagcccggcaaggactacccacatcccctatggtcagtaatattgccttcaatgccatcgatagacagattgtgacattcttggaggacaaaattggacgggtggcctcgcgccctaaagacgaattcttcttcgaccttgaagatgatctcaagtgctactgctcctacacacgctacgcagatgacctgtctataagtctaagcctttatgaggatgtcgcgcgagtaataaacggggtgcagcggattctcttaaggcacggctttgagctcaacgctaggaaaactaaaatactggacgccaaaaatggtcaccgggttatttgtggtgtgggggtggacgaggaaacggtatatccgacacgtaagactctgaaaaaactgagagcggctaggcatcagaagaatctttcctccatcttcggccacagggcctggatttatagcatcgacaaaaagaaaccagtcagatga

SEQ ID NO: 12410 - RNA, 915 nt, unidentified
  source 1..915: mol_type = other RNA; note = synthetic construct
atgaatgacaaccagtggaaggaggaaattaatggtgtgtggtcgattaccctcaccccaaagctaagtaaaatttacgcagatgctgtatggggcgaatggctcagcggagacggcaaaagcgaggccctgacaatcaaaaaaatctgcgtggacactggaggcaaaaagcggcagatttacagtcccgatactcatagcaagctgttttaccaagctttgcttccgaacctcaacgagacgttcgaaaagatggaagagagagctgttgcctttgggtttgtccccaagcgctcctgtgtggaccaggcccttcagcacatgaactatgcatacaccataagcctggatatcaaagatttcttcgaccacgtgaaacccaagcacgtgaaagggttaatcgatgaggagctgattccttacttgttcattgacggggctgcgaggcaaggtctgccaacctcccccatggtttctaacatcgcctttaatactattgatcgggagattgtgaagtatatcgaaggaaaaatcggcctgtccaacacaataaagcagacggacgacttctttatttggggcgatgaaaatgattggaagtatgcatacaccagatatgccgacgatctatccatatctctgaacgacttcaatgagatccctcaggttataaatggtgtgcaacgcatcctcctgcggcatggattcgagttgaacgcaaggaagacaaaaatccttgacgcgaagaatgggcgaagggtaatctgcggggtcggcgtcgatgtcgaaaccgtgtatcctactcgtaagacattaaagaaactgcgcgccgccaggcatcagaagaatctctcttcagtctttggacacagagcttggatatactcaatcgacaagaagaaaccagtgcgatga

SEQ ID NO: 12411 - RNA, 1935 nt, unidentified
  source 1..1935: mol_type = other RNA; note = synthetic construct
atgcatgagttaaggatcaacaaggggaatggaaagtttcgcagcgtggtagcggttgggaaagaggagcggtatttttaccgcgaactgctcgagaaccaactggaacaaaccctaactggccatcttaaggaaaatggcctgttcaatgtagtccacggccggaagtattctaatactgtggcaaacgccatcccccaccagcgatatcagtacaccctctctgtggatctgaagagctgcttcgatagcatgaccagagacgtagcagccaagaacggttttcctgatctgccggaggactgctttgttgctatttctacttcctctgagcccgttgctgcccaaggcctgccaacgagcactgtcatctgcaacctactgctggtgaaaaccgacataaagatcctgcacctcctccataaaaccttcaagggagaattcgcctacacccgctatatcgatgacctgacaatctcgtttaactcctttaacgaaaagaaatacaccaccttgcttagtaatttagtgtatctggtgtcgcagagtgggtttgaagttaatatgtccaaagtggaactccagcgtgccttggacggcaggagacgcgtctgcggtttggccgttgacgagggcggagtttacctgcctcggaaactgaagcggacaatacgtgccctcgagcacaaggagtctatgaacttatttccatcaaaacagactcgaacacttaggggcctgttagcatacggcgaactgaaactacccaataagctcggggcccagcaggaggatacggaatctcttatcaagtcaatagtagtgtctggcgagtggggaaaaaaatggctctgctatcttattgaacttagtagcaagcaatccaaaaatcccggacaagagatcttttgtttccgagttccacacaccttggacgatggttccataaggcagctggtggaggcttacaccatccaggagagttccattgagaatgacagaaagacactggacataaatcaggtgtcatccactgaacagcccgatatcagaacactgtccagctacgacattatcgcaacacaccatgaagtcgaggtgctggggtgtaccgatgcacagagcagcaagctgaaacaggcctatttcgagaagcgagtgaacttcacaagtcaggatcggaaaattctcgggttcctcgaaaggcgtgaacccattcctagaagtttacgcgaagtgattacaattccaccaaacacaaaaaagttggacgccctcgtgtgcgcaattactggactgttcgattcagaaacgatcttgaacatttgtaagcgcgagatctggctgtctggagcccttgagaacgtgctgaacgacgaagacaggctcttgttcctgagccaacacccctatgcttacagatacatgctccactttgtcaatgaacgcgatctggtcaaagtgcttgagtcaaacttctactcagctaagcatatctttcctcacattaaaaccgcacagatgaagcgagcgctaggtaatactcgggagctttataggaaactggtgtctactaactcatacggggctatgtacctggtgccacctgaatggttcaaaaaggagaggttcatttccttatgttctgagtactttaacctcacgagcgtgatgctctatgaggtctactcgaggtccgtcgcgttctattacctacgggaaagactttatgatagtaactttgagtgcgcgtccctggacgacgtcatccgccagtgtaaggctcataccttccgggtggtcgagagcgaattccctgccgctaaaaatttggatcagaatgagatctgtaccgtagagttgagagtgaataagctggttacagagatacagagcagatggccgtggaagtttgtcattaagaatatgggctga

SEQ ID NO: 12412 - RNA, 1164 nt, unidentified
  source 1..1164: mol_type = other RNA; note = synthetic construct
atgaaggacagaattgagaaaattatcacgatctccaagaataatgggaaattcaggaaggttttcgtgcccacaccatcttacgccgaacagcttaataagaatctgaagtacctgaacgagatcctattggaaagagacaaatgcaaagtcaatcacgcttttctcaccgggaggaattcagtgaccaacgcaatgcaacacattggctaccggtattgtctccagctggatattgaggattttttcgactctattacctctgaaagcgttaagggccttattaacgatgaagtcataaacttggtgtttatagacggatttctgaagcagggtctgcctacatctcccatgatatcaaacatagcatttataccggttgatcaggctatactgaatttcgtaaagaatctcgatgaaaacatcgtctacactaggtatgctgacgatttaactttctccttcaacgacattagatgcaaaggtgtgatccacaagcggatcattaagatattggacgaatttggcttcaagattaacaacaagaagacaaagttccagaaagcagtcaacgggaatttcatcatcacaggcattagtgtgaatgagaaaggtgtcttttccacgcgtaaaactaaaaaaaaactccgagccctagagcatcagtaccaaaagaacatcaagttcatcatcaacatcatcgaagacattagcttcatggaaaaagatatccttaagttagtgaacgtgctgaaactgctgaatacctactataagaacaaggacaacatactgaattggaacctcaagtttttggacggattcctcaatgaggcctgcaatatctttgtgagcttttcagggaatatctatatctccgacgttaaagagatcggacgatatcacaagtacctgaaatataacagtgagtacaaccatatcatcaacaatcataccgatttcaagtggattaaataccggaaatacaagattaagctggaggacattatcaaaaaatgcgacgagtgtcgctataattttcactcggtaattggctttcgcggatgggccagctgtgcgcttcctaagaaggagaaaaaagatgccaaggtgaatcagtccagcagtaacattttcttcgatgatgataacatccccttttga

SEQ ID NO: 12413 - RNA, 1164 nt, unidentified
  source 1..1164: mol_type = other RNA; note = synthetic construct
atggagaatagaattgctaaggttatcaccatcagtaagcacaatggcaaattcagaaaagttttcgtacccaaatcttcttataccgagcagttgaacaagaaaaggaaatacctcaacaagatactgctggagagggatgaatgcaaggttaatcacgcctttttagcagagcgcaattcagtcaccaatgccatgcaacatatcggttaccggtactgtttgcagctggatattgaagacttctttgattccatcactagtgaaagtgtcaaagacatcatagacgacaaagtgtgcgaccttgtgtttattgacgggattctgagacagggactacccacaagcccgatcgtaagcaacattgcttttataccagtggaccaggctatcctgaagtttgtcaaaaaactggatgagaatatcgtgtatacccgctatgcagatgacctcactttcagcttcaatgacatcaagtttaaagatgtgatctacaagcgggtgattaaaatactcgatgctttcgggttcaagatcaacaacaagaagacaaaattccagaagtcagtcaacggcaatatcattattacgggagtggccgttaacggcaagggagtcttcccaactaggaaaacaaaaaaaaaactgagggcgattgaacaccaatatcaggccaacataaagtttctcatcaagatcatcgaagaaattagtgtgcgagagaatgatgagtccaaactggtgaacattttcaagcttctgaatacctactataagaacaaggacgacattttgtcgtgggattgggaaaaacttaacttcctcttaaatgacatcgaagcaatctttaagatcttctctagcgatatctacatatccgatacaaaggagctgacgaaataccagatgcactacatccataactcaatctattactcaaacgattccgagtgttttaaccggaacaattatactgacttcaagtggcttaagtaccgtaaatacaagataaagagcgaggacattattaacaagtgtaatgagtgccgctataactttcattctctgattggctttcgaggttgggccaactgccccctacctaagaagcgggagaaagggaataagaatagctccaacttcgacaatgatattccttattga

SEQ ID NO: 12414 - RNA, 951 nt, unidentified
  source 1..951: mol_type = other RNA; note = synthetic construct
atggatgacttcaccgagtatcatttcgagggaagctcgtggatcactccctggtattttccatgttggaattctgaatgggagtgggagtacgatgacaagatctatagaactatccatgagtggaacgccgcgggcagaatcatcaagaagggggagaaaaagaaatgctacctaccctgcagaaagcgcctcgtcttcacaattgatcagaccgccaggttcgacctgttttacatctctaagaagaacggaaaattccgacgaatttttagcttgtaccgtaagcagaaagatcagttgcggaagcttatcccatacctcgagaaaatattactgaagcacgatgacgacaaggttaactatgcatttataagaaaccgcaactgtgtggagcacgctatccagcacattggctataagtatacagtgtccatggatctggaaagtttctttgaatcagttaaccgcgaacacgtgtccaaatacctgaccacgaatgtcatggaccagtgttttatctcaggggcaccgcagcaaggactgcctaccagccccctaatcgccaacctggcctttctcgattgcgataaggctattctcaattcccttgaaaagtacaacattagctctgtgtacacgcggtatgccgacgacctggtagtgtccttcgacgacaaaaaagatatagggaaaatcatcttcctgatcacaaatattgtcaataaggctggcttcaaagtgaataagtccaagaccaaaatacagtctattaaaaacgggaggatcatcataactggcgtagctattgacaataagggtgttaggcctaccaggaaaacattgaaaaagattcgggccgcaaaacactcaggcaatgataagagtttaagcggtcttattgaatggtcaaaatgcagtctgcctaagactcatccacaaaagatttga

SEQ ID NO: 12415 - RNA, 957 nt, unidentified
  source 1..957: mol_type = other RNA; note = synthetic construct
atggagatagaggaatacaagatcagtaaaatacctaagggaaaaaactcattcaggctcctgtatatcccaacacccaccctgaaaaaaaagcttcagtcacacctatcttatctgcagtacaagaatctcgagcttgacgaacatagaacgtgccacgcattcttaaagggaagaaattgtgtcactaacgctctccagcacgtcggctacaactattgcgttagcatggacatcaaagacttctttgacagcgtgcggccacatcacgtagagaacaaggtgtctcgggaggttatccaggattgttttatagacggtgcacccaggcaagggctgcctacttcgccattgctctccaatctggccctgttggatgccgacgctaaaatcatagaattcttgaatcagttccgtgtagtgcatcgatatactcgctacgccgacgatatttccataagttttgatgatgagcgcgcgactggaaggatcatcttcattgtgaacagtgtgctcgagtcctacggtttcagcgttaaccagaagaagaccaagattcaatccaaagagaacggcagaattattattacagggattgccatcgacaaaaatggcctgtttcctacaaggaaaaccaagcgaaagatccgtgccgcctatcatcaaaagaatatttcaagcgtccgcggactggaagaatgggctaagtgtaaactccccaataacacacctaagaacccgaaacggtttattagaatcgtgggcaaaacgctggtgtcttgcatgcactgtaatcagagcaacctgatctgggcagagcagtaccccggccgcacatttcttgtcaattctgaatccgggagtcggcacaagtgcaaattcttgaacgctatccttagccaaagggatctaatgacccagctgaagaagtgggggaccagaacctcatttttatga

SEQ ID NO: 12416 - RNA, 1464 nt, unidentified
  source 1..1464: mol_type = other RNA; note = synthetic construct
atgcagacagagtttactatcaagaagatccctaagggtaaatcatttaggaccctctatatccccagctccgcttacaaaaagcatctgaaaagcaaactgccactgctactcgaacgctatatcctctttgaaggagacaacggattttgtcattccttcctccccggccggaattgtgtaaccaacgctatcccgcacattggcttcgcttataacatatccctggacatccaggactttttcgacgccattacgcctgaccatgttaccagcaaaatatcccgagagctcatccaggattgttttatagacggcgcacctcggcagggacttccaacctctccgctgatagcgaacattgccatgatcgacatagataatgagatcgtggcctcaatctctaagttgacctccgaattcgtgtacactcgatacgccgatgatatttgcgtttccttcaaccagaaacagtatttataccaggccaagtacctgataaccaatttactgaacaggcacggcttccgcgtgaacaataagaagaccacatttcagtcacttaagaatggaagactgatcatcaccggtattgcagtcgataaagccggagtgcacccaactagaaagacaagacgtaagatgagggccgcagagcaccagggtagcgagagctcttatcgcgggctgcatgagtgggctctgtgcaaacttcccggtcaagggatttcccactcacaggaactgcaccagatttctcctaagagtatctcttgtcagttctgcggggaacaagatttagtgtggctacgaattggcaagagcaagttaagactgtattccaaaaccacgaagatgatccacgattgcggccaacataagcggctggatgtgtttgagcatctgactgcactgggcttcacaaaattcgagacatctcggaaaccctggtttacagggttctacatcttgcagcaggaatcgctgttgctcctatttaggaaacgtggcattgatatctacaggattgatttcctcgaatactttcacgactgtaccagtcctgcggaagtcattgaggacgtgaacagcactctggtagaccatgaaatgtatgaaaccactacagagaacaatgggagtgatgaactgtacttggaggatcacgtccgggaggagctcctccaagacaatcagatcgatgagttccaaagaggatttacgcctagtgaactctgcagagacattttccgccccgagtctaaatatcttagtttgatggagagggttaattacaagaagtttcccctgaaagtccacaagttcatcctgtcattgactactccaattaacttccgcgaagagttctactcggcctataataacgctataagccagcaagcaaaaaatgggacactagattttgacgaccttgaccttatcgactgggacattccattctga

SEQ ID NO: 12417 - RNA, 3054 nt, unidentified
  source 1..3054: mol_type = other RNA; note = synthetic construct
atgtggctccagtcctctgaggctagagagatcttcgacacagacttgacaaagacaataggcatcgacgcagccgaaatagagaaatttagaagagaactcgccgccgtaccttctgccaccttggtaaagttctggtttggcgcacagaggacttcggaacccacaacactggagaaacacctgcgggagaagctcagaaccagggccgcgctgttcagctgggtgcatggacctggaactagcatagcacgcgacttgctttacgtgaaactgccctcctctgaaaagaggcgtctagtcaacctgctgctggcctcgcttaggtctaggatgccatggatcgagtctagattaattcacgcaatggcctttcgcccagctgagttgaacagagttgctgagaaaacggtggggaaaacgaagggtttccagcagtggggacctctgtatagaggcgtgaaaatcggcaaaagaaggggctataggcagctgtggattcccaacacccccctcaaggctacccagggggctctactccgactgattgcccctggactggccagagtactgcaaccttttgtctttggtgccagctcaggacggagagggccaactttcgagaatgcagcagcccatctgggaaaagcctacgtggccaccttcgatctccgcgatttctttccgtcaaccagagtgggcgacgtcatacgcgggatccaatgggccgcagaccatggccatctgctcgtcgacgaaacacgcgtgccaagttatctcgaagagaacccccaggtccgttcacttaggtggacagacgacgcaatggttttggtggcacggttggccacctatcgggccagactaccacaaggatccccactgtccccacttctggctaatgtggcattcgctcgcttcgacgagagaatcctggatgccctcgggagggagtttggcaagagggagttcgcgtacacccgctactttgatgatttaaccatctctttgtccggtgctgccgccagggacttgggactcaagcagacctccaccgtccgggaccggattgagcagaagttgcaagaggttctggaggggagcagttttgccctgaatgcatcaaagagccgttgtacagcgcttactgtggaacggcggcccgctgctgggaaaaccatcgctaacagcctgggccaccatgtcaccggggtgatccttcggcgagagagcgtcgagttgacacgcgatctcaaacgagaactgcgaactacgatccaccgactgaagcaccgcgacttcgttgaagatgcacgggtgtggcatcaatccaaaaactttctgcccccagctttcaaaagccttagtaagggccatcgatgggagggtaataccataatttcacgcaggtgtagcgccgagcgcttaagcgtcctgatgttacgccactttcaccccgagttaagagtgcgggcgatcctgagggagtggtatccttggcaggagcgcttcattgggggggagcaagttcgtcgcggcaaacaggcttggcccctgattgagtggctcctcgctgctctctgggagggtacagtgactgcgaggagacacggcgacaatacaatccgattctcccaggggggagttgccgtttgcgatgtcgaagcagagtccgcattacagttcttcctgctggccaaggagagtgcgatcgccgtgacggaatattggcatcacctgcagggacttaagggttatctaggcgcctgccctatcagacctgagtttagcgatattattgagtggcgtgataggctggtggaggctatgagtgctctggagatcaggggttacgaaatagaggccaccgaaccgatcgtggaaaacacttcagacggggacccagaacccctaacggtgtcagatcgagtcaaggagcgcagtgataggtttattgtggtgtaccgggagtttgcgcggcggatgtccatcgccggtgatacattcttaggcacttgcgaagacgctgctagggttgtagccactaacagtgcagacttcgatcgctggatttccgccattcgaggcctcttcgtcactcgcttgcctcgcctacccgcagtcgtggagcacagggattctttcgacagaaggagactctttgatgccgttagagtgtgggacgacggcacgaagaggttggttgcagacgactaccagttcgtggccgacctgcgcgtggctctgaagattgatcgtctggattctgaagacacctaccagtttgctcgtgcccaattgagactatttgactggcttctggcctcattcgagcgatcgacagaaacacggcggtgtggcatcggcgaggttagcgcactggatcgaggatgcgacttacctgtgaacctgtggtccggcaccctgaaagaaaggctggctgaagcgtttgaggagctcgtgtccgcccacgaggtacttcggtcatctgacggcgaaacaaagcttttcattcagcggtcaggagaggagctccaccgagaacgggaaactatccggtgcactgaacagtggaacaatgaccgtgcatgggaacacctttgtcaggttgcacgggtcttgttcataactacccaagaaagtgtggaaccgtctctgtggagagatccagtggaggatgatcaacctgtgagcgcgcagaatgaactgagacgcaaaaagacatggaagggggtgtgcgatcgggtagatagtgaattgcgtcatagggcgagactcctggccaaactcagaaaccgagatgcccataaggctaatgacgataggcgagccgaatggtgtagcattcaggctgacgtagcccgcatcctgggacggagctgggaatccacctctggacggaaacacccccagtttcacgctaaggatgacttagagctatttgggcatgaggtcactgtagtgaagcttgaactcattcgttctcttaccgcactctttaatcgcgcagctgaactgcaggtctggaggccggaacacggtatggatagatga

SEQ ID NO: 12418 - RNA, 2529 nt, unidentified
  source 1..2529: mol_type = other RNA; note = synthetic construct
atgacatcgcgcctgattcatgcgctggcatttcgaccctcttatttcactaggcatccaagctcacgctggggggctctctatcaccgacgggagatttctagaggaactaacaagcctagggtcctctatatcccgaataaacctctcagatccatccagagggcacttctgttcctgtttcttaaccgcgccagtcacgagctgggccaatccgtttttggggcaaggcccggacagagatgccctctgatcaataatgccaaacggcacctggggcagatgtatatcgtatcttttgacctggctgactttttcccctctatcacgttgggccacattgtttcagccctggctcacatcaggaccccgctaggccattgcgctcttcaggacaacgaggctaacctggatcggcctcgccgtgacttcccatggacacatgacgccgccgttttagtagctcgcctgtgcacttaccgagggagactgccacagggggcctctactagccccctgttggccaacatcgctttctccaggtttgatgacttgattgctgagagactgggcaccggactcgtttactcgcggtatttcgatgacattacgattagtgtgagcaagtctgctgccagaaggctccaccttaataacgcaaaagccttggccgattacgcccagacgtgtatagagacggagctaattcctgccggctttagactcaatgcaaagaaaactaggttcggaacagccgctgccggattcactgtcacgggccttaggataaacaagaataccatcgatataccaagaaaaacccgcagacaaatccgagctttactgcacactatctccacctctgggttactagcggccgctcggaaaacatggggcgccgaattggaagcccggataaggtgggactcagcccgtcaaagtcaccatagcgcaggaaggcggctccctcaggagaaactgtgtgctctgatgctgaaacggctcctgcctgacctggtgatcagggtctttgatcgcgacgaaaccgaagccccccggacaacagagatcaccggacgccaggcaaccagggtgttggaaaagctcctgacttatgcatggacacacagagtgagctttcgcgtacatgatgactacgtggctgtgaaggcagcaggtgaaagggagatagcacgattattctccaaagtctcgatcgaatttttcggactggccccaaacgagctgattcggtgcactgagctgtttcacaagcttgccggctggagcgcatttctggaggacgcagaaaaccatggagaggcgcgtagagtggccgacttgggtagggaactcagacgagttctcgccggtgtgcaagccgggacccgaagtgaaaccactgcctacgagactggcgcacttagagtggacccggcaggtttacccctgaccgctgaacaggagaatcgccagctggcgagggaggtgtttgaattgattcgccagttcatgctcttcgtgtcccccggcccaatttcacatgacttacctgagcttgagaggaatttcaaagctgtggctaattctgaagagacattctctcgttggcttgaaaccaccatgcgcttgtatcagatccgtgcagaggtcgttccacccgaatccgcgcgtagggaattccgcggccacgatattcacgaaacaatccggctactgagtgatcgactcgcagggagacgggcaccaacctacgagatcgagcgggacttctacaagaaggtgagtaaagatgatgtacctgatagcccgcgcgcctaccttagacatcaatttagagtacttggaagacttaagtccgcctttgattgctccttagctctacgaaaccagcgagggcccaccgcctggattcagactcttaacgagaatacctggagcaggagtattgcggctcggctgcatacagccgtccaggtgctgagggagagactcgtggaaatggcgagccaaccaggcgtgatgcgggtgtttcagaatgctgttctcgccgacctcaacgccggcatgagcgaactgatgacgacagtttccagtacaacatcagaactgcgctggaagtccctgttcgccaccggctctgtgctgtcaaagctaatattggaacaggtggaggcttcccgattggagactgaaactacagagaagcgttcacacaccgaaatcgctatcgctagcctgaccgcaggtaccggcgaaagccacgcggatctgctaaggctgatacacctgttgcggtgtcgcgatgcccatcctgcgactgatgagcaaatgaacgactggatcaagctccagcgtctgtgtggttcacggttaagacgggtcacaaccaacatcagaatgcccgacaacgccggagccatgttcgggaatgggcacctcgagctcacagagttggaggcaaatgacctgaagctctctattattgagggtgtcgatcgcttcttgcggcaggtcagcgtcgtgtga

SEQ ID NO: 12419 - RNA, 921 nt, unidentified
  source 1..921: mol_type = other RNA; note = synthetic construct
atggcattccgcgaagatcgatttcagcgtctctttgccccagcccacggcgaactttaccgtcgcaagagagtgccaaaaggtaagtgctgctataggaccctgttcgtaccatgtgcccctctggcaagagcacaacggctgctgctgagccgttgtctgaaccagatgctgggtcactctcatccgggagtctacgggggccgacctcagacaagtgtctatggcaatgcccagcggcatcttggtcaaaagtttgttgtgactttggaccttagagacttcttcccctcagttacagtcaaccacgtcgtcgccaccttactgcgcttaccccccgtgtcactcgtgaggcacgtatggctagatcagcctacccaaggggggagagcaagggtgccacaaatgcatcggtacgcttggacgcagagggccgcagttcttgtggctcgactgacaacatttcgcggaaggttgcctcagggagcccccacttctcccgcaattagcaatctcgtgttcgcccgctatgacgacagaatcgctaccgctctgccgggatttgtgtataccaggtacgtggatgaccttaccttaagcgtgtccgagactgccgcgcgcgatttgggcattcggacggctaaacaggcccaggccgtggtcgtagagagagtagagcgcgcgctccgtcgaagtgggttcatgctccaccccgacaaaactagagtgactgctatcgaacgggagcatcgcatcacagggctacgggtgggcgctgacagggttgatgtgccaagaagagttaagcggaaagctgcctccttggcgcgggatctccggaagctgggattggttgacacagcgaggaggcgaattggcgcagagatacacgctgccacccaggcaaggccttgggtctga

SEQ ID NO: 12420 - RNA, 2868 nt, unidentified
  source 1..2868: mol_type = other RNA; note = synthetic construct
atgtctgaccacattgtagagaagatcaaggcccttgacgctcaatttgtacagcttgagaagctcccccaccacgtgatatattcagagttcaccactcctcaacagttactgctcgaccggaaaatccagtatcgtgagggagcttatcagctgctggactggtaccccccaattagggaagccagggagttgctaaagcacctgcccccttttgaaatgttgaaactggtgggaggaaagccctgtagctcactgtcactgttcactttcattaagcgccatctggccaggaagggaacaaaaagtatcttccggtggtccgatcggaaaaggtttgtttactgggtttataggaacaagctcctgtccagtgtgcttccctacgtgaggccggcctctgaaagtaaacacttggtactaaggtaccttctcaagccccttaaaaagcagcaagggtactactcctccaaagtggtgcacgcttgggccttccgtccagattttttcaaagccaaggtagattatgagccattgtacataacacgcaagattgcaaagtctcagcgcgggtatcggaccttagacattccttttgccggactggctaagcttcagcgagccatcttgaaaatgctgctgaacccagcctgtcagcgcgtgttgaccgacagcgtgtttggttttacacccggaaatgatcggactatttttagcgcggccgaggcacacctgggtgcaaaattccttgttggctttgatatcgccgacttctttcatacggttaaattcaacgacattacttcaactctcatgaaactgccccctgatattctgagagcatccaactcagctatctcaaaaaacaagtcccctctaaaatgggagtgggacctggtgctccttctggccaagctgatggcgtacaagggacgccttccacaaggcgctccgaccagcccagccttagccaacctcgtcttccatgaatacgacgtcctgattcggcagcagttgtgtgatagcttcgagtacacgagatatgcagatgacctgacgtttagcatttctgctaccaaggctaaaagactcgggatccggtctgaactcgatgcaaggcagtacctggagaagcgcttaattcagctgttcgaatcctccagcttcacactgaatagcaaaaaaagtagagccgttaacttacgccagggcggtcgagtgttggggctgtatctcaataacgaaggtgtgggagttccacgcagcacccgccgagatcttagaacaaccttgcacaagatgcggaatcacggccttctgtgcaccgccaggaaccatcctgcgttacccgattgttccgaattcgtccatcgagatacaaaacgaggcgtgcgtcatttcttcaagtctgggagagtgagcatggaacggctgtgcagcctcactgcccacagaatctgtagaaatctcactatttcagacctacgcaatgaggggtctaccagggagctaatcggcaatcgcctgcgggacaccctggaaagagtcatttcaaatgcctggctagggaaattggtgctcgcgaaacaggactccaaaagcttacttgtgtcgtttaacagtggggatcctgcgctcctgctgagagcagaaacgggaatagactttctgctgctgggccggattgactgcgtcaaatgcgccttactgcaccagagcctctccggctacctgtcttttctggagggggctcctaacagggctacgttcgcagccatccatgacctagccaaacagctgggtgacgtactcggcagcctggacataggccaattccagcccgcagcaagtcgtcaggctggcactaccgacggagagaggccatcacttacaatcgacgaagatgtgacaagaaaagcccgagcttttctcgctaaactgggagtctctgactttgaacaccctgattggagtgtgctatgcagggccgtatattctcgggagcaacttgattcctggttaactgctacagataagctcatcaaggagaaaagagtgtttgcggagggttcccgccgaaaccccgtcaaatttatcgacattagagctggcaagatattcggcaggcgcaccggaacctatgatgaggaaaatcaataccttgtgaggagattgtccgaggacggtctgagtcgtcccgacctggccttgcagctccaggaggagctcatcgaagatctgatagagtatgccgagcaagctggcgaacagggggaaaccgcatacccagagcagtcggtccggctagaacgcgtgtgcgccgatcttaagaagttgcggaaccagctgactacaacaaacgaaagtatgctcctcttcgcaagaaggtgctcaccggaaaatgacaccaacatcaggaagagattagaaaagcttgagcagccaatctcaggcgattcgtctggggcggtgtggtacagtctgtttgagttcggcttctgttttgttcagagtttccaggaaagcttggagcacgatgatgaaggtaagccggtcgcaaccagccgtgcctggaaggacatcaagcggtataatgtcctgtctctgctgcgaaatcgccatgcacatgggtgggttaagactgcagctaacctggccaatctcgatgagatccaacggaccatcgccaagcgtctgggcaagatctggaagcctaagaaaaatcaagtgggggacacactcgagtcccttatcacattggagttgacctcttttgaggctaatgagttcactctggatatactgaaccagctccgagacagcctcattgcagtcagacaagaactgcagacacccccttccccatga

SEQ ID NO: 12421 - RNA, 945 nt, unidentified
  source 1..945: mol_type = other RNA; note = synthetic construct
atggaaaggactgaaataaccccctggttctactacgacatctataagacagaaaaacgtaccatacataagccttcacatgctttgaaaaaagtccagcgatttattatgcggaagtttctcaaaccccactttaaacaaatgacaaccaacgaagcagcttccgtgcactgcgggaagaaatggattatgaagctggatatcaaagactttttcaactctatcacggagaaacagatcaaagacgtgatcaagaaatatgtgtcctatgacaactacgactcctctattacatacgagcacacttgggaagtgtttagcgaggaacagattttcagcgtatgtaccctgaagggaaaactcccaacgggggcctcaactagtccctatatagcaaacctggttctgagggatttcgatatcgagatcgagaatttctgtctgcggtatggtgtgagatatacacggtacatggatgacctgtttttctctactaatcgcgagcagtactttctcagccttgtggaactggaagttctcagactgtttaaggagcttggtttcgagattaatgtcccgaagatcaagtacatctcgagtaataagtgccaacagattttaggcctaggcgtaaacaataagaaaccagtgctgactaaagataccaagagggagtatcgcgcctatttttataacttactcgcgcctatacagtttaacaataccgaggagtacaagaagcacgagaaagaattgttcggacatctagcctacatcatgagcgtcgataaaaagttctactacaaaatggttgcctacatcttcaacattatcaagcgcttgaatatttggcgtaagccttgccttaagaatctgattaagaagattggcaacaactttgagacagaaatcgagatgttcagattctgttcctatctgaagtga

SEQ ID NO: 12422 - RNA, 1248 nt, unidentified
  source 1..1248: mol_type = other RNA; note = synthetic construct
atgccccctgcagaacccacaccttccctaggacaagctatgcgccgcttgcggttagctgccggactgagccaacgtgaacttgccggtcgactcgctgtagatcccacttacttatctcatctcgaatctgaccggcgagatccaagtgtcaggttcgtgaaaaggtttgcggcgctggtggacgtgccagtcacctcactcctggtggttgccatgtgggatgagatggcccccagcgagcaggacatgttccagcccgtcgtgagctcgctgatgcacctgacagaggcggtggtgaggatgcccgcttcatctcctggcccacttcggcgtctgagtgtgcagaagctcgtggctgtgtgtcggctctctgaacagcagtttgcgagactgttggaaagccgagaaaaggaatatcacgaggtatcctgggagaaagagcctggtaaaaccaggactctgcacattcccagcgagaggcttaaggccgttcagcgcctgatactgcgctacatgatcgaccgagttcctccgcatccctgcagtgcctgcgtgaaaggaagaggcaatcattgggcctaccggagacatgctcgtcatccatcaatgctgaggctggacattagtgatttctttccatcagtgggcgaggacgccgttagagaagcattcatacgccttggcgcaagggaaccggtggcagacgctcttgtccgtctcgtaaccttacccgagcgcttaccacagggggcacctacgtccgtggctgtagccgatatggttctctttcctctagacgttaggcttgccggaatggccgagaagcacggcttcacctactctcggtatgtggatgatattacactgtccggtgggaataggctcgctagattcgagcagactgtccggagaatcgttacagacctcgggtgggaactgaacgagaaagggggcttggtgggttcagatcaaagacactccctgctggggggaatcgtaaacgcaaagccgaatgtggcctctgagtattatggcagggtccggagctacttgagactggtcgcaaaggggcgcgagcaacctgacgaagacgattttagaaagctgcgctccaaagtggaatggatcgtcagcgtcaacccagagcggaaagccgccctgcacgccttggtcgatgaggcactaaccacgttgaagcagcaggaggcttccatccgcagacgagaaaagattgtgccacagtga

SEQ ID NO: 12423 - RNA, 963 nt, unidentified
  source 1..963: mol_type = other RNA; note = synthetic construct
atgttttcactggatgagcttctgagtatattcaacgacgtcgaagaggtggaaatgtccccaagcttcgcattcgtttatagtcagctggtcgagaagggcaccagcgccttttggctgggggtgaggaaacacgccctgcgagactggtatgagcagtatcacaacgtgctgagcgaagacgtgaaagtggaatacacccccgtaaggatcccaaagagatccggtgggttccggactctctacatcccttcagatcaactgaaagagcggcagcgtgcttggttaaagcttacgtatattcttgttcccaaggttactcatgcctacgcattcgaaaagcggaggagtctgcgggatgcgcttgagaagcacgtcggcaattatttgtttctgagactggacattaaggacgcatacccatctataaggaagaaggttttggactcagtgctcgttaaacatgacgttccactttccgtaagacagatgctaatccgcgattgttactttaagggactacctcaaggcgctcctacaagcggccgcctgtttaatattgtgttgtcccagaccgatttagtgattgccgaggtcattgctagactccatggcgtgtatacaaggtatgcggacgatatcttggtgtctttccccaaagacgccaaaatctccattagcaaaaccagtcaggtaattaaccgctacttgaacaaaatcagcctggagctgcacccctctaaactccgcgtcggtcgtggtaaactccgagtgttaggatgcgtcgtccactcggataaggtgacaatctcacgaaaagtgagacggctgtaccgcgccatgctccataataacaaaacaggaaagatctctctgtccaagcacaagatcaatggaataaaggggtggctcaatatggtgtacaggagcgaaactgtacctgctatcgggccgatatcttga

SEQ ID NO: 12424 - RNA, 1410 nt, unidentified
  source 1..1410: mol_type = other RNA; note = synthetic construct
atgatcttcataaaacttctgctgctcccgttctacctgatttttggtgtgctgcgaaacatcctgtctgaaggagggcacccgttcgacggcgcatacaacgacatggtcgctcgccaaaatgaggagcatcgaaaaaacctcaaagagcgaagcgacaaaatcaaaaaggccatcaacgagattgaaaagaaatccaaggaagaaccactgtggaagctctcaaaactgacgaaaatttcgatcgaggagctaaaacataccaccggaacatataggaaagtgaacgtcaagaagaaaacaggtgggtatagagaattacaaatccccaatgaccagttgaagcaagtacagaagaagctggctaagttcataaatagccagtttaagaacgatatctctcccttttgccacagctacaggaataaccgcggcattataagcaattccttaccccatcttaactgtaaagtgctggttaagctggacgtcaaagactactttcagaatatcaccttcgagcaggtgatgcgggaacttgacctgggctttgagagcatccagttccacccacagagtaacttcattcggcacaatgtgagcgagcctgacagcagaatttccagttaccttgcttccgaggaagcgcaggagattttgaagaaactagtctattctgaacagggactcccacaaggtgctccaacttcccccgtaattagtaatcttgtcctgagtgattttgataaggaagtgtatgcacttgtgacctccttgaatggcgcatacactcgctactcagatgacatcaccataagctttaaagaggattcgtctcagaagatagcccaggtgatcaagtttgttgaagccaaactggccgagaatggctttaagctgaacaaaaagaagggcaagattaacgttctcagacctcatcaagctcagcggatctgtggggtgactatcaactctggaaagcctaccatttcccgtaaacagcggcgtctgattagggcagcagagcacaatgccaagcaaggaaaacctacaacattcaccgaggaccaaatcaaaggacatgaatctttccagaagtatattaaggaacacggggagttgctagccgggaatgagcgcatacaatatctgaagactaaggtcatcagtgctagagggtgcaaagtggataagaacttcgtcatcctcaagggcagccagttcgatatctcaaaatttgatgaggccaaagaagaatttcagacattgttcaaccagctcaaacaggagggcgtaattgttctcaagcagaatgtggccaggttcaagcggaaccaccagttcaaatccaagactctcgcgacgtctctgttacacttgaggaatgtgagatcatcaaagtgggtttga

SEQ ID NO: 12425 - RNA, 999 nt, unidentified
  source 1..999: mol_type = other RNA; note = synthetic construct
atggaattcgccgtggattcaatttcatacgagcttggaactgtgttggcactcttggtggtcctggtgggcctcgttctgctcactaagagcttagcccgggattacgtctccaagtatggaggcggagctcgaaagcatgctcagcgaaagaattcacgtaccctactggataccatagatgtaagggaggacgttttttttggcgtcgcaacagactacgcccttgtcaaaatccctaaacggactggaggaagtagacagttacagatccccaatgccgagctcaagcgcctgcagaggaagctgctggtgtatctgacagctaaactggggcatagagtgaaccggtccgtgcactcttataagaaatacaggagcattaagaccaacgcaaccgtgcatttgggcgctgcagtggttatcaagctggacattgtcaatttcttccccaaggtgacgctgaaacagtgccgccaggttctcaaacttctgaatctgactaagcccgttgaggatcgtctcgtcgcgctgttaacaacgccaggcggcctacctcaaggggctcctacctccccgcttctgtccaatctggtgttgcgggctctagacaagagtgtttggtactattgctggtctaggggtcacagatacagccgttacgcagacgacataacaataagccttccaattgatgaccgccaggccgtgcacagagctatcagctttgtaaaccacgccctcaaacgggccgggttcaaactgaaccggcgacgcggcaagttccacattctcaggcgccatcaagcccaaagaatttgtggtgtaaccatcaattccggtaaaacaactatctcgagacagaagcgaagagaacttagggcaatccggtataggctggagaacaacatggaagcctcaattagcgaaatccagttggaagggtatgaggcctacgtccgcatggtgtctggggtaagtgtgaaagcgttttcttga

SEQ ID NO: 12426 - RNA, 1098 nt, unidentified
  source 1..1098: mol_type = other RNA; note = synthetic construct
atgctgccacaccagattagacctgaacacttagccgaagctatgggcctaagtgtcaacatgctgtggtcctttgcccgcaatatggatgcttgcttcaaaccacgaaggatgcaatgggacgggaagaaacatagacctatcgatcccctgtataaacccccgaaacggctgctcaaaaagctgcacaggtttcttcagaaccaccacctgtgtcatcccgcagcccatggcggagtaaggagacggtccacattcacatcggcccagatccatgttggttcacggaacgtgtggacgagggatgttacagattgctatccatcaatttcacaggccgcaatgtttagccaactgcgaaagctgaagttccagcatgacacagcacttgtgctcagcatgttgttcacctatcgcgacggagttccccaggggagccctattagcggggatgcactgaacatctttttctggcctctggaccagctcttggccagtatggccggttccctcaagctccgctatggtcgtaatgctgacgactttgtgtggtccggttcgaatcgcgagaatggagacaaacttgcggcgagattggaatctgagatagaactactgggactgaagatcaatgagaagaagaagagggcaaacgggctacagactagcagtgacgagcggttggtccacgggatatccgtttctaaaccaagcggcactgctattagcagactgcagtcaaagaaagctctggcccttggcgagaagtacgtggcggcttgtcgatccgtcactgccgatagtttagaagccgtcgctgtgaaacgggcccaactcgccggatggatgtactactgccgacaagcacacataggcccggcgcggaccatcagacagctcttggaggctggcgataggcatgtgctcaagaagcttagggccattggactgtcttctcagaaaaacaagtggtggatcatcgactaccgccccagacgcaataagccttctagaaatgagccaaaacgtttagctaacgcatggcgtaccaggctggcccggatgtctcacaaaaacgtagtggcaaccggcctgtga

SEQ ID NO: 12427 - RNA, 1080 nt, unidentified
  source 1..1080: mol_type = other RNA; note = synthetic construct
atgaagcctagcgaaatcagggtggaacaccttgccgaagcgatgggcctctcaattaatgctttttggttcttcgctaggaacattgataatgcatataagcccagacgtatgagatgggacggaaaaaagcaccgccccattgacccgctgaagcccatggctaaaaaggtgctgagaagacttcaccgcttcttgcagcggaacagactatgtcatcctgccgcgcatggcggaatcaaagggagatcctgctttacttctgcgcgggtgcacttgggcgcaaggaacgtatggacacgcgacgctaaagattgctacccaagcatcgctcccgaagccatgcagaaggagctgcaggctctctcctttagaaatgatactagtaaagccctggtacttctcttcacttatcgaggcgccgtgccacagggttctcctatctccggggatgccctgaatatttttttctggcgattggatcagctgttggcaagcatggccgggtcactgaaattaggctactccaggtcagctgatgacttcgttttcagtggggacgaccgggacgcaggagatcagataaccgcatgcctagagaacgaactgcttaaccggggcatgaagatcaatcgtaaaaagaaggaggagtcgggacaccaaacagccagcgatgagcgtttagttcatagtatcgccgtcagtcgcaggaggggtacaggagtttgtaggctgcatgcccgcgaagcactcgagctgtgccgcatctttgtggctgcctctcggtccgtgagcgccaattcaattcaatctgtcgcatccaagcgagccacgatacagggctggctgaactattgtcggcaggcagactttggacctgctaagaccgtccgacagcagctggaggcgggtgatcgccacgtgctcaggaagctgcagtctatggacctctcggccaagggcaacaagtggtggtacgtcaatagcacccaagggcgagacgagccacggagattatctgcaacctggcgggctaaacaagctaaaaaaagcgcggacctcgccggttccaacgcctga

SEQ ID NO: 12428 - RNA, 1047 nt, unidentified
  source 1..1047: mol_type = other RNA; note = synthetic construct
atgaaccccaagtccattacgcccgcagagatcgccgccgcaatgaaaatgaccgagcggcagctctggactttcacccggaattttgaaaagctttttaaacccacccgagaaattatgatcgggtctaaaaagcgcgccattgacgccccaagggatagtgcgaaaaagaagctaaagctgttgcataaatggttctttgagaaaaaactgttccacccatctgcccatggcggtgtacgtcaccgatcatgttttacatcagctcagcagcacctgggaaagaagtttgtctggacacgggatgcatccgattgctatccatccattactccagagatgttcttttatgaactcaagagaatcggcttccgccaagacacagcgacgctgttgacccgcttgtgtaccgtgcgagggtctataccgcaaggttctcctgtgtccaatgatgcaattaatctatacttctggcggatagaccagttcctgaaaagcctgtcaggcgcaaacgacctgtcctacagccgtgttgctgatgactttgtgttgagtggctataagaagtacttaggggataatattctcctcaggctcgaaggcatgctgcagcagtttggaatccaaatcaacgacaagaaaagaaggaaaagcggattccagaacagatctaacccgcaattagtccattctatccgggtcgacttacgccgcgggactaaaatttcgcaggagcatagaacaaagatcatagatctggccaacagctatgaggctgcctgcaagcgtgttcagcccagtagcctggaacctatcgctcataaaagacagcaactcattggataccttcactacagcaggcaggccgacctgagccctatcaagcaccttaagagtaagatacagaatggcgacagaagagtgtccaggatccttaaaaacctccacatttcagctttcaaaggtaagtggtggctggtgtcatccaaacgcaatgagcctaggcggctgaagagtatctggatgaagaggctggaggctaattga

SEQ ID NO: 12429 - RNA, 1155 nt, unidentified
  source 1..1155: mol_type = other RNA; note = synthetic construct
atgctctctaagaactggctgaagtggaaacacggctctatgaggtactcacctgccgtgaagacccgcttgtcgccacccgacctcactgttaagcgtctggcggctgtggcgcaagtagacccgtccgaacttatgaggtatgccggaaatactgcagtgatgtatcggagcgctaggaaacagtgggatggcaaaaagcaccgggtaattagaccgatgaacaaaaagttcaagaagatgtccaaacggttgcacaaattttttcagcggcagccttggtggcatggcgcagctcatgggagtatttgccatagaagttgttttactagtgccgccagacatgtaggccagagacacgtgttcaccagagatgttgaaaactgtttccccagtatcaccactgacgctctgtaccgccagcttctgctgctccgattcaagccagacgtcgctgacctgctcgccaagctgatgacctgcgatggtaccatcccccagggatgccctacaagcacggacgcggtcaatttgttctttgccggcctggatcaacgccttgcttcgactgccgccgctatgggagcacagtactcccgtgtggtggatgatgtcgtcgtgagcgcaaaagataaagacgccggccagattgttataaatcgggttgagcatgagtttgaacgattaggtttgaagacaaacctcaagaaaaaacaaaccgacgggtaccggggcccacatcagaaacgccacgtccacgggcttgatatctcttcaaagagaggggttcagatcagccgacagtgtaaggaaaaggcactagccgtggcccagtcttatctggactcatgtaagtcagctacccccttaagcctggagtccattgccgcgaagcgcgagagggctatgggttatatgcaacacctaagacaaggaaccgggtccacattccgccagctcgaccagaaagtcaaggcaggagatcgagcagtgcaagccaaactgcggcgcgtgggggtgacatgcaggaaaaacagatggtggatcattaggggtcctcaggacaggataacaaaggcagcccggaatatcgtgcgtgaggtcgctaggcagtggcacgccacaaaatacagcacgccctcttccagcccatga

SEQ ID NO: 12430 - RNA, 1059 nt, unidentified
  source 1..1059: mol_type = other RNA; note = synthetic construct
atgaaaccgtcagacattaccccagcgatgattgccgaggcttgcaaagtcgatgaaggccgtctgtggcgtattgccgaacggacagagtctcagtaccattccccccgacctaagctgatcaaaggaaggcaccgagagatagacccacctaaccatgactttaagaaggtgcttcgacgcttacaccggtacctgcagagatcactcacctttccgaggtgtgtgcatggggggctacggggtagaagctgtgtgaccgctgcggggaatcacgtgggtcggaagtacatcgtcacacgcgacgtgaaggattgttacccatcaatccctacggaggccctcaggcgtagactcatcgacgagggcttcagaagtgataccgctctgctgttatctcggctaatgacaaatcggggggtgatacctcacggggcaccagtgagtggcgatgccttgaatctgttccttgccgattctgaccgtcgactcgatcactgcgtgagacgccgcggaggctcttatactcggagcgctgatgacatggtggtcagtgttggtgccagggagtccgttacgccccttgccagagtgatcgaagacgaaattgaagggcacggcctgagagtgagcgaacacaagaggaggcagaagggagttcaacattcaaacactcgagggggacctcgcgtgcataatctcctggttaacaataggagaggcgtaggcgcagtacccgagcatcgcgcaaaaggactgagactggctgagtcttatgtatgcggcgcacggagcgttcgacccgagacattagagggactggcaagtcgcagggcggaactcgtcggcatgattaactatttccgtcaattgcgcttttccccagcaaggcacttggcccgcttgctgaggcagggtgacagacttgtccggagccggctctccactgtcggagtgtccctgaccgccaaatggtgggttaatagccgcaagcggaacagacccagggaaatcggcgatagatggaggctgaaatcggacaactcccccgctgcctga

SEQ ID NO: 12431 - RNA, 1023 nt, unidentified
  source 1..1023: mol_type = other RNA; note = synthetic construct
atggcgtcgctggatggcatggctagcaacatggcatcttggtacaagcccgcgcgaaaagtattgattaagggtaagctgcgagaaatagacccgcctacacctgttctgcgctataggctcaggaagctccacaggtttatcgccgctaactttagaccacaccgtggcgtgcatgggggtgcaaaagggcgctcttgtttctcaagtgctcgcgtgcataaaggaagacggtatatcataaaacgggacgtgaaagactgctatcccagtattaagactgcagccctcctcgatcgacttgtggcttacggattctgcgaggagacagccagaatcttgtccctgctgatgactctgaacgggaggcttccacacgggagtcccgtgtccgctgatgcacttaacctctttttgttcgaagcagacgaagtgattgtagccaagtgtactgttctggggggcaagtactcccgtacctacgatgatatggtcgtttccaccaatagtggagcagctagccgagagctaggcgaggtcttagagtctcagatcgccgcccacggcttggaggtcaatagcaggaagcgggctaaagaggggttccagccacctcataagcggcagctggtacataatatcgacgtgcggtctgctggaggtgtgagaattgtccgcgagcatgaacaaaaagccctagccgtggccacacgctatgtccgggcagctcgctgtgtgtctcccgaatcccttgagcctgttgcgctgttaaggagccaagccgccggctacatgcactactgcggtcaggccgactttggcccagctaagcagttaagacgtctgctgaagcagggagataggcacgtccggaaacgcctgacgaatgaatgcgtgacccgatgtagaaagtggtggatcatcagcctgcggagaaacaaagcaaagcaaattgcccagaggtggagggccctccaggacgaagagtcaagatcctcagcgccgagcacctcaatagcctga

SEQ ID NO: 12432 - RNA, 1107 nt, unidentified
  source 1..1107: mol_type = other RNA; note = synthetic construct
atgaaggagaagtaccgcatgcagtgcaagcacaaggacgtgaaaaaaccactgaaagggatgacagtggaatggctggccgaggaatgcggcacgacaggagatttcctttggatcttagcaaaggactcaaccttcatgtacaaaccccctagaaagcagctgaagaggtccggtaatggatatagagagattgacccccctaagcaccaatacaagagaatcctgcggaaaataaccaaggttttgtctagcaacatgagacaccatcctgccgctcatggaggcgtgccttaccgctcttcctttacatccgctaagccacactgtggcgccaagtttatcgtcacccgcgatatccgagaatgctatccgagcattagcagtcagaatctcttccgctcttttcgactgcttggggctagcttgtcattcgccaaatttctctctgctattatgaccgttcacaaccatattccgcaggggggccccccttcgagtttagcattgaatctctatttcagacggatggacgatcatttctaccggcgggcacagtctcaagggggcaactaccggagatttgccgatgactttgtgatcagtaataacagcaggaaaaaagctgtagctttggagtcagagctggaccatagtatctcccaccgtgggctagaggtgaacgaaaagaagcgtgagaaaaaaggattcttgtccggcgatcagctgaaagagattcactcccttgtagttaactgtaggaggggcctcaaaccaaaacgcgaacacatcgccaagggtctgcagcttgcggagcattatgcgagatgttgtacttgtgcaaaacctgccgacctgcccagcctggcaaagctgcgacaacgggccactggaatgatgtattactttcgtcaggccgacttctcacccgctcgccatatacgaaatatgctggaacacgcggataagaaagtcctgaggatgttacagtcgaggggtctgcagccccataagaataagtggtggctcgtgcacgccactcggaacgaaccacagaggctcctatgcctctgggagccatctgcccaagtctgcagcgtggcatga

SEQ ID NO: 12433 - RNA, 1101 nt, unidentified
  source 1..1101: mol_type = other RNA; note = synthetic construct
atgaacagcgaaaccgcctcaagaaccgccgatgccggaacgctgctgagaggaatcacagtggaggccatcgcgcaagcgtgcgaaacttcccctgacgagctgtggcgactcgccagaaattctaaactcttgttcaagctaccgcggcagcaacggaaaaaggggggtggctttcgggtgatatatcctcctaccaaaacccacaagccactgctcaaacggatggcccgctttctgagccggcagatccccgtccatagtgctgcacacggtggagtcaagggacggtcaagcttcactagtgctgctaaacacctgggggcaactgttcttgtggtacgcgacattgaggagtgctatccgtcaatcggcccccaggccttggctaacgctctaaaacgtctcggtgccagcccatcgctggccaagtttctcagttccattatgactgtggatgggcagataccccagggtggacccttatcctccctcgcactgaatctattcttctataggcaggatgagcatttgcataggaaggcccgtcgcgtgagaggcgcttacacaaggctcgccgacgacctggtagcctctgtcggcgatacagagacgggggctgctatggggcgagaattcgactcggctatttctagccgacaccttcgcgtgaacgcgtctaaacgggcaaagaaaggccttttagggggcgacaagttgaaggaaatccacagcctgattgtgaattccagaaggggccttagaccaaaggatgaacatgtgcagaaagccctgaggtttcttcagaactactgtaggcgatgccgctctgcaacacctgcggatctcgaaagcttagcctacctgcgacgggttgtctgtggatggatgtactatatgcgccaagctgccagaagtcccgcaagacatatgaggaagcaaatccacttggcagacgccagggtgacccagatgctgaagaagcacgctattcaggcgaaaaaaaataagtggtgggtcctgtcatccaagcgcaatgagccacgtagactggcagcacagtgggtttggcgcgaggttaacgctgcaagggccggctga

SEQ ID NO: 12434 - RNA, 981 nt, unidentified
  source 1..981: mol_type = other RNA; note = synthetic construct
atgagtgagcacacctttctcgactgggtggccaggggggatgaacggtttctaccaactaggattgatagcagctctgggaagtttcgggaactggacgtccccaagccgtctgatatgcgtatattccgcatgttgaataaaagcctgggattcgaccggttgtttcacagggtagcacacggcggtgtgaaaaggaggagtagcgtgacctctgccaaaagccatatcaaggccccattcgtgtgggtgatcgatgtaaccaattgtttcccctccgtgaagttcgaccgctttgcttcagaactgggccatttgggagtgactccagctatgcagaagattatcgccgagactctcttttgcagaggccagattccccaagggtgtcctacaagcaacctggccctcaatcttttcttcatggctctggattaccagatggccgagtactgctggaaacgcctgatctcattcacacgcatggcagatgacatcgttgtaggagctaaggaaagaagtcgcggcgagcacgctgtggataaattggttgcagggctggcaaaactggacctaacagtcaacgagaagaagagagcaaaagtgggtttccagcctaacacgggccaacagctcgtccactcactcgagatctcttctggatcacttttattatgcgatgaacatcggaaccgtgcccggcaagtcgctgagaaaaccgttggcgcgtgccgatcggttcagcctcagtccctcgaaagagccgccgattatcgacgacagcttaatggttggtttcactattcgtcccaaagtcaggacctgttaacgtccgacctggccaaagcgatacgcgtgtccgacaacgctgtcaagtctaggctgcagagagctcagctggactgtaagcggtggagatggtgggagattaagaccgccacagagcttgcggcacgttggggatcccatattagcgtgtga

SEQ ID NO: 12435 - RNA, 1218 nt, unidentified
  source 1..1218: mol_type = other RNA; note = synthetic construct
atgggggatctcatccacactaggcggtgggatcttccagatatcgacgagctgctgcgggaacgaggtctgccagaattgtccgacgggggaaatagggtcccaattagcagcttgcctatccagcgaatagccgtgcggagaaggcctagaaggccatccgaaggaaacgagctggacgtcctgatgcgcatttgcacggctctcggctgtaacgccgattggaccacagtggttcaggtggccagggcctctcattgggagaggcaccgacgttacaagaaaagtggcgctattcggtggctcgatgtacctgaggaacgtctgaagacggccctgggtgagattcacagactactgctgagcagcatgccgcgggatggaacaagcacagccttccatgcaggcgcatcccctgcactgcacgctagggttcacagcggagccgtggcagcagcagcagcagacattagaaacttctttggcagtgtgcgtccgcggcacctcttgccttggttcggcttgactgactaccctaaggcaagcctactgcccggctggtcggagcttgggagaaaggccgtgtgccagttgctcttcagatatagagatgggaaaccagcgtacctggcgcaaggtgccccatctagtcccctcgctgccaatctggctgggctttggcttgaccgggctatcgtgtctgctgcggctcgccagtttgctcccgggaaatttgcctattctcgctatgccgatgatctggtgctgtccgctgtagactgcgaggaacccacccgctttgccgaagaggccgcccaaatcctcgcgagatcagttgccggccagggctggaccatccagtcatctaagagtcggcagtggacaactgccgactccgtcgccttacacgtctgtggattgcgcgttcccactaggcccggcgagcctttaaccctgggtagagaaacctggcgccgcgccaggtcagctcttcatcgacttcgacaccggtccgattttggactgcatgctgcaggctccccagccgtggcacatggtctactcgcttatagctactctgcgaccggagacttacgttggctggcttacacatccgcaagactcgcgtacttagccaggcgcttgggagggcccatattctctgaaagtctgctggctgggtggtcagacgagtcgtcactcgccgacgtcccctga

SEQ ID NO: 12436 - RNA, 1065 nt, unidentified
  source 1..1065: mol_type = other RNA; note = synthetic construct
atgccatttagcatcaagaagcgtgagaaaaccaagctacgggacaggtttcctgtactatggcaagttctcggagacttgctcgcaaacgaaacctgttactgcgcctcagactacaacagcttcacatttaaggcgcgcagatccagaaaaagtcggacgatagatgccccttgccctcacctgaaggctctccagcggcaggcattgaacatcctgctggcgccagtggttgtacatgaagctgccatggctttcgcacctggcaagagcatcgcgatgaacgccaggtgccatctgggggcgacacacctctattctacggatattcgatctttctttacttcagtgagtcgtgtccatgtgaaggaaatgctggccacccgagtgaagtatttatcagtggaggcaagagaggagattctggaccttgtcacctggaatgaacgcctgcctcaaggcgcaccaacctcgccacacatcgccaacctggtcatgttcagcttcgatgagctgtgtacagatatggccacacgcgtgggcgctacatatacccggtacgccgacgacatttccatttccagtactagcgccgacgttcttctgcagatgcagaaagtggtgaatatgggcctcggagcactcgggatggagccacaccccgagaaaacacgacaccttggtcctaatcagacgaagttagtcaccgggctggacatcggtggatctcacattaggcccactcgggccttccgcaaaaagactaccgctctggtgaggatgtctgtaaagtatccagctgagatggaaaaacatcaggaggtgatctttgggtacttagccttttggtacgatgtcgaccctggagatccccagttggcaaatcttttgtggcagatgggtcaacctagggaagcctccagagctaaggctacccgccagaaacagataggcatgatgtccaaaccatcaccgactacaccgccgcccaaagaacagcaagccgtgcccctgaatgctgagagaaaacccagcaagccccccgttactaagcccgatgtctga

SEQ ID NO: 12437 - RNA, 945 nt, unidentified
  source 1..945: mol_type = other RNA; note = synthetic construct
atggaggacgttttctatgatcgcgcaaactcataccacagttttacaataaaggccagacgctctgccaagatcaggacgattgacgcacctaacccccccctgaaattgttacagagagctaccttggacaagcttctcgcacccgttgtggctcacgatgccagtatggcattcgcacctgggaagtctatcgcaatgaacgcccgaaggcatctcggggcttcctatctgttttctactgacattcggtcgttctttccgagcgtcacgagccaacacgtgagggaaatgctggaggccaggttccagcacttctctcccgaggctcgtgaggaggtccaagatctggtgacctttaatggccggttgccacaaggagcgccaacctccccgcatatcgggaatcttgtcatgttcagctttgatgagatctgctgtgccaaagctgccgaaatgggagctgtgtacacccgctatgcagatgatattagcgtgtcctccaattcaagtgaacctcctcagcggatgcaggaagttatcaccggttatctctccgcgatgggcatggagctccatcctgacaagacacgacagctgggcccaaagcagactcggattgtaactggcctggacattggccgatctaggctgaggcccacaaaggcctatcgtaaaaaggccgccgccctcgtaagaatgagcagtaaataccccacaaaaatggcgcggcagcattacaagatactaggttaccttgcctactggaacgacatcgatccttcagacccacagttagcagccctgctggatcagatgaaaagaccgtcatgggcggctaaagtgcgcgctagcgctgctcgccaaaagccaagaggacaggccatgttccacagatttcccgaggaactgctaaaagacctggggccaggattgcggaagtga

SEQ ID NO: 12438 - RNA, 1056 nt, unidentified
  source 1..1056: mol_type = other RNA; note = synthetic construct
atgatttttgggagcgacgaccgcaaggttaatattctggaggaatatcctacactgtgtcaagtgctggaggtcagccaggaggaagggaactgtgattgtgaggtgagttacaatagctttatcatcaagtcccggcgctccaaaaagtaccgtacaattgacgccccatgcccccatcttaagtccattcaaagagccctgctggaccgccttctagcaagtgtcccgccacacgacgcagctgccgcttttgtgagaggaaagtctattgcgatgaacgcccagcgacatcacggggcaagccacttgtttactacagacattagatcgttcttcccctctgtgaaggattctcacgtgcgagaaatgttgagaatccacttcccacatttcagtcaggttttctgcgaagagataatatccctggtcaccaacggcggacaactgccacagggagccccatcttcccctcacatagcgaatttggtcatgtcaaaatttgatgagcggtgccaggaggctagcgataacttaaaaaccgtatacactcggtacgccgacgatatctcaatctcctcaaatgatgctgcgagtctcagacgcatggaacgggttgtgcggatcggcctggacgctctggatatggaaatacacagtgaaaaaaccaggcacttaggtccccagcagactaagctggtgacaggcctcgacatcggtggctcaaggatcaggcctacgagggcctttcgtcgaaaaacctccgctttggtgaggatgagcgtgaaatatccggggaagatgaacaggcatcgcgatactatccgtggctatctagccttctggtacgatattgaccctatcgatccccaacttccttctctccttaatcagatggccctccatcgatgggaggtacggctgcgggcagcacaggagacaaatcagaggctcttacccattcagcccaaccctctgcagggcagaacccaaacgaatggatataccaaggtccgcagcaacatcgtttctctgttcaaaaagctcagagactga

SEQ ID NO: 12439 - RNA, 972 nt, unidentified
  source 1..972: mol_type = other RNA; note = synthetic construct
atgtcgagcgagcagtcagtactttcttctgtactgggcctagacagtacagccatcaagcctgtcatgggatggtatgggccaatgttttaccacagcttcgacgttaagccaaagagacgcggccgaaaggcacgccagatcctcgcacccattgatgaactgaaaacaatccagagagctattctggagaaattactgtctcacgtctcaccgcatcccgccgctactgcattctttgcgggacggtcaattgttagtaacgcacgacagcatcacgggtgccggtacctgtataagaccgacatcagcgacttttttccctccgtgacgaccggcatggtcagggttgtcctcgagcggcacttcccgcacttgtcccaaagtgcaatcgacgaaatcattagattaactacccatgaggggacccttcctcagggtgcccccacttcacctcatctcgccaaccttgctttgtacgatttcgatgactctttgtccagactatgtaatgaaataggtgccaggtatactaggtatgccgacgatgtgacggtgagcgctcaggatgaatatgccctgagcatagccgccggagcgattcgtagcggctttgcggaactgggcctcgcacagcacccagctaaaacacggtgtttcggacccaattgcaggaaaatcgtgacagggctggacgtgtccggggaggtgattagacctccacggtctttccgcaaaaaggctgctgccctggtgcggatgagcgagacatacccaaagaggatggagaggcattcgccccgagtgatgggctacctggcccactggcaaggtaccactcctgatgatcctgaactttacaacctgaaacatagaatgcgccagttgcaacgccgtgaggctatagcggaccacaccgtcaatgcagtgtcctcctgggccatcgaggatgacctcaagattagtttttga

SEQ ID NO: 12440 - RNA, 1362 nt, unidentified
  source 1..1362: mol_type = other RNA; note = synthetic construct
atgactgcacaaacccccgagaggctggtttttgagggacgggagcatccaatgttttcagagccactctccgatttcttgcgcagtgggagcgggcgccctgaattccagatgcagtctacggcatgctggagaggctatatcggcacatgggaagttatcggaaggagactttatctggttaagctggaaggccggctgaagtctggggaaaaggccaatctagctgcagtattccccagtagcgaagagcgtgtattcgcgcggtggttctctggaatcattcagctgccgcagggcgacgagatcgagtacctgcatatcggcttcgcttccatctatgagagagacttgcttcttagatttgaggacggagagcttgtcgaccgcagattgcgagtgaacggtgagacggggagtgatgctcccggtgactgtgcactactcccgaggcgcgaagatgcaaagctggctgccggccccggacatcagttgtgggagcagatagagcgggccgctgaagagctctccacacaaccaaaaacttttgccgccctggccctccgcgagttttactatacggaggggagtgtccggatagcacggaaaatcagagccctggcgtgtccctccgaacagctcaagaaactgcagaggtcaattctgactagcattctggacgtggccgctcctcacaaacaggctacagctttcttccgagggtgctcgattatacagaatgccaggcaacaccacaacaagcactacatgtttaaaaccgacatccgaagcttcttcggttcaattaccaccgaggatataaccacaactttacgtagatttatccccaatctctctcagaagaatctagaagcattgaccaaggtgctctcatgtgatggtaccttacctcagggcgcccctacctccccacatgttagcaatcttcacatgagggattttgacgaactggtgtcctcgcaagcgaaaaagcacaaatgctcctacactagatacgccgacgatattgccgtcagcagcgataacaagttcgctgtgcaccagatgtctgaaatcgtcggagatgcactgggcaacgcccggtttacccagaacacccggaagacacacctccttggaaaattcgataggaaaatcgtgactggcttagacgtgagtggggaccatattcgcccaacaaagaagttccgaaaaacaactaaggcgatggtcagagtgtttatcgtgcatgacaggaaagcaatgctgcctaacatacagtcccgactcgctttttggcgtagcattaggcctgacgatccagaaatgctgcaactgcgcaagtctattgcctcagcctga

SEQ ID NO: 12441 - RNA, 915 nt, unidentified
  source 1..915: mol_type = other RNA; note = synthetic construct
atgcttaccgaggccccccgtcaccacctatggaaggaaatcgaacgcgctgcagaggagctctccacacaccatcccatcattaaacttaatgccttcaatggctactccgggagggagtttttctacaccgagggctctataagggtcgctcgaaagcggagagctctcgcctgtccttccgaacagttaaaagaactgcagcggatcatcctgacgtctattctcgatgtggccgctcctcataaacaggccactgccttctttcggggttgctcaattgtccagaacgctcgccagcatcaccgtaaggattatatgttcaagaccgacatcaagtcctttttcgaccatatcaagtcagcggatatcatgagagctgtgcagagatttattccgaatttgtcacaagccaatcttgatgcactaaccaaagtcctgtcttgtgacggtgctctccctcaaggcgcaccaactagcccacacgtttcgaacctgcacatgcgagattttgacgagttaattagcgccgaggcccgcaagagagggtgcagttacacacggtatgccgacgacatagcaatcagtagtgacgataagttcgctgtgcaccagatgagtgaagttgtgggggaggcgctggagaaagcaggattcacacagaacaagcgcaaaacacatctcttgggcaaattcgatcgaaaaatagtaactggactggacgttagcggagtgtatataaggcccaccaagaagtttcggaaaactaccaaagcgatgacgcgcgtatttattgtgtacggcagaaaggcaatgctgcctagcatcgaaagcaggttggccttctggagatccatccggccagatgaccccgaactgtttcaactgaggaagtctattgacaacgagaggtga

SEQ ID NO: 12442 - RNA, 1485 nt, unidentified
  source 1..1485: mol_type = other RNA; note = synthetic construct
atgggcaagtctaagaacaacgaattttccagacggcagctgctgattgcctttgcttccacatcaatcattggcataatgccaagtatcacctcagcctctagccacatctacgagaaagagaatgcattaatttggcttatcggtacactgcagcccattagtttgaatgagcttgagaacacctccttttttccagaccgctcttggctgattgagactattaataacttcgaggagcagctactaattaacaagcataagcggatctccgagttttatttctctttgacccacgagggtcacgaaaagctgccttggatccacgctcatagtaaagatatcaccagactcagcattctccgttcaagcatcttcaggtccaagaataaggtcaaattcgatcgctggatagcatctgctggtgtatcccccccgaaacggacgaacgttccagtgagcctgggagctcacaacttcgcccgcattgaagacgagatggtgagttccgacagacttttttccgacaaaaaccagctgattagctttaatagtgcacaggacctggccgatagtatcccccagaatctgtcccagagcgaggtccctttgtacaagttcgcaattgacctaggcattagcgtggaattttttcaaaagttcttcgaacaccgttatgaaatgtacaagttcaagaagacacgcaaacagaacggaacgctgagggaaattgaaatccctcttgagaatcttaagactctccagagcgtaatggcatggaagctctcatttcagctgaagcctcacaagaccgtgcatagttttatacggggacgatcgagcattactaacgctaaggaacacatacgaggcgactttatcggcaaatctgacatcaggaatttcttcccaaacatttcatctagcaagatctatacatctctgatctcctcaggatacaacagattcgaagccaaattcatagccctcttctgtacaatacaaaagaacaagcgctccaaattgccgcatgggtcccccacctctcctatcctctcaaactttgtcctctacgatgccgatgaaaccatctatcagtactgcaaagccagggatatcacatatacccgatatgcggatgatttcactttcagcggcaaaaattactcaaaaatccaacaggcgatcaaataccagatttctgccttggagaatcatgactttcaacctaatcattcgaaggttaaaatcagcaatgccagggactttcccagggtgacagggattaacatcagcggggatatattccccccacggaatctgaaaaagagggctagagctgtttttcacctgatagagacggggaatagttcgccaaaagtgagaagccaagcagccggatacctggggtatttatctcagttcacctcattcactagaactgcgacttacaagaaatggcagaccatcttagagcgccggtga

SEQ ID NO: 12443 - RNA, 1005 nt, unidentified
  source 1..1005: mol_type = other RNA; note = synthetic construct
ggctactacacgttcaccatcccaaaagggtcaggtggcaccagattaatcactgcgcccgatgatgagctgaaagcaaaacagaggaagctgttgaagaagatgcagaaaaagcactggatctcaagaaaggcacatgggttccgcaagcgacataactgccttaccaatgctcaggtccacgccggcaagaaatatattctgaacatcgacgtaaagaacttttttcccagcataacttctatcgcgtatcggaactacgctactcgggaaaggaatctgatggagacaaagtataaagatgaggaccgcggctttcccaatttgttcttctacgcagctacacctgtgtttcactccggatctctgcctcagggagccccaacgtctcctttcattagtaacatatacatgcgtcgcttcgacacacagatcgaaaagctcctcaggcagtatatctccgacgacatcctatacactcgatacgtggatgatctcacatttagttctaatagcagagccgttgaaagagtgatccctattgtccgcgggaaactgaaatccctgcgccttgagattaacgatgataagaccaagtttatgtccccctcgcaaaggcaagagataacaggaattaacgtaaacagtgggaggccgacaatcgggaaggcctatagacggaaagtgagagcgattgtccaccgcgctgaacagggttgggtgattacttcagcacaaaaggaacgattattgggcatgattagccacatcgctctctgtcatccgagtgaggccgcaaagtatcgtgacgccctgcttccagttagcatatccccaaatagcgcccgtatgttcagcggtgtgaatcgggttaagctgcccgtcaaaaagaccaggtcaaaaaagaaacagtctaattccaatgccggagtcaccggagctaaccggaccgtgaaacggaaaattgccatagacaaaaagggcgaggtgcatgacatcgactga

SEQ ID NO: 12444 - RNA, 1071 nt, unidentified
  source 1..1071: mol_type = other RNA; note = synthetic construct
atgctcatggggccacaacagatgcaacccgtggctgcagcggccgcatggaatgttcctcgcatagaatccccagacgccttagccgactggctccgactcactcctggagagctgagatggttcgcagatctcaaccacctgaatgatcgcagcagaattcaaaagctgtcccattaccactatcagatatccacaaagccagctggtgggtggcggttgatcgagtcaccaaagcctcgcctgaaacacatccaacagcaagtgctgcaccatattctggaacgcattcctccacaccgtgccgtacatggtttcctgaagggccgctcgatccagacatttgccgctccgcatgtcggcaggcgtgttgtcttgagaatggacctacaggatttctttcctacgttccgaggcgctcgtattcgcgcgttcttcagaaccctgggataccccgaaaccgtggccgaccttctgggtggactctgcactaatgccgtgagccacaatgcgtggcctacgcggatgcatcacgaagactctgcccacaggtctagggtccaggccttctacagcagggtacatctgccccagggggcaccaacaagtccccttctggccaacttatgtgcgtatcgtatggactgcaggttggccggacttgcagagtcagctggcgctcggtataccagatacgcagacgatcttgctttttccggcgagaaggattttgaacgggggatagagaggtttagtacccacgtggctgcaatcctccttgaagaggggttccaggtgcactttagaaaaacaagagtcatgcggcagggcgtgaggcagcatttgaccggcatcgtggtgaaccgacgactaaacgttatgcggcccgattttgacaggctgaaagccattttaactaactgtgttcggctgggacccgagagccagaatcgagagggtcacgccaacttccgctctcacctggagggacggattggctttatggagatgatccatccccagaaaggggctcggctcagaaggatctatcgcgaaatcagatggccgtga

SEQ ID NO: 12445 - RNA, 1329 nt, unidentified
  source 1..1329: mol_type = other RNA; note = synthetic construct
atgcagaagctcttcctagtgaaggttattgccggtgcatttctgtctggcgaacccacgattccagaaattgtcgccaggttgtctagaactctcgggaagagatgggactggatccatcctctggcccagaggtatataaagacaatcgcaggtcgaacccgcccacgacggagagatgtagtgaagtttctgctgcaggactctggcttcaagaaggcctggtccaatcatgcgcaccagctctccattaagcagtggttaaccgagccccaacgaatgcagccggtcagtgccgctgaaaattggggaattccagtgatagagagcatcggcgccctggcacagtggctggaactgactcccagcgaactcctttggttctccgatctacgcgggctaggctgccgctcagatgagcgtcgcttgaggcactatcactaccgcatcctggataaacaatatggtaacatcaggctgatcgaattgcctaaaccccgcttaaaacaactgcagctccagatcttagcgcagatactggagaggattcctccccacccatcggtgcacggatttgtgaagcggagatcaatcaaaactttcgttgccccgcacgtgggcaggcctatagtccttagaatggacttgcgggagttcttcccaagttttcgtgccgccagaatccagacactgttcagaaccatcgggtatcctgagccagttgccgacctgcttggagggatctgcaccaatgctgtgagccgcgacgtatggaaaaaaccttcccccgacgtgcatccttgtcggtggagcgaggcgcggattctgtactcaaagcctcacttgccgcaaggagctcccacctctcccgctctggcaaacctatgtggatacagaatggattgcagactggctgggctcgcaaagagtgtgggcgctcaatacacacggtacgctgacgatcttgccttctccggcgataaagcactcgaaatgcgcattgagaggtttgcgacacatgtggcagccatattaatcgaggagggctttatggtccactaccggaagacccgggtaatgcgtcaaggagtccgccagcatcttgttggactcgtgatcaaccaccatgtgaacacgattaggcccgactttgaccggttgaaagctacactgactaactgtgttcgtctggggccagaatcacagaatagaaatgcccacccacatctcaggcttcatctggaggggaggctgggcttcgtcgagatgattaaccctagcaaaggtaagcgactccgagctatttttaaccagatcaattggcagtga

SEQ ID NO: 12446 - RNA, 1329 nt, unidentified
  source 1..1329: mol_type = other RNA; note = synthetic construct
atgccgttcagcagcctactgcgaactgttgcggcctccttcgtagcaggggaaacgacaaccgaggaaatcatcgccagactttcctctacattgggacggaggtggaggtggttgggccctcttgcccagcgctacgtgaagttcgtctcagcgagaacacgccccagacactccgaagtagtccagtttctgcgccacgatgcgggctttcgaagggcttggagccggcacaagaacgagatctctatcgagcagtggttaagtggtcccgctcaaatgcagcctgtgaccgcagctgcaggttgggacctgccagcaattgagtcaataggggaactcgccgcctggtttggactgaccgtcagtgagcttctctggttcgcagatctgaagggcctcgggtataggcagaagtctgagaaactccatcactaccattacaggatactccctaagcctagcggtgagattcgcctgatcgaggcccctaaaccccgactgcgcgaattgcagagacacatactgtccgggatcctgtccagaattcccccacatcccgctggtcatgggtttattaagggccgttcgattaaaacattcgtgctgccccacgtgggccagcacgtgatcctcaggatggacctgcgtcacttttttcctagttttcgagctgcgaggatccaaaccattttcagaaccacaggttatcccgagccagttgctgacctcctgggagggatctgtgccaattgcaccccaagagacgtctggaataagtacggcagtgagtccgattacgactgccggtggcaagcccgagtgctgtattgtagaccccaccttccgcagggagcgccaactagtcctgcccttgccaacttatgcacgtatcgggccgactgccggttaagcggcttggcacgcagcgcaggtgctcgtttcactcggtctgccgatgacctcgctttctctggcggggccgattttggaagacatgtggagcggttttcaacacacgttgcagctatattgctcgaggagggcttcgacgtgcactacaggaagactcgtgtgatgcgccaaggcgttcgccagcatcttgccggagtcgtgctgaatcagcacgtcaacgtaatgagggctgattttgatcggctgaaagctactctgaccaattgtgtgcgactaggaccaaaatcacagaacagggaatctcattcaagcttcagatcccatctggaaggacgcatggccttcgtggaaatgattaacccagccaaagggaagcggctacgggcaattttcgaccagatccattgggaatga

SEQ ID NO: 12447 - RNA, 1356 nt, unidentified
  source 1..1356: mol_type = other RNA; note = synthetic construct
atgaggaatcactcgctccttacatctctcgccaggtcatttctggccggggaacctgacaccgatcaggtctttacaagagcaagtcgcttacttggaagacgttggcgctggctgcggcctttggctaggaggtatgttatggcatttgcggacaaggctaggcctagacagagagacgttgtccgctttctcctgcacgatcccgatttcaagcacgcccgtgaaaagtatttcaaagagcttagcgtgcgacagtggctgatcggcccacaacagatgcttcccgtggccgccgcagaaacatggggagttcccgctattggcagcattggggccctggccgattggttgcagttgaccccgggcgagctgcagtggttcgctgatcttaaagccctaggatataaacgaaaggactgcccacagctccagcactaccactataaggtgttttcaaagcgctccgggagcatcaggttcattgagagtcccaagcctaggctaaaggagctccagcgtcaaatactggctcgcatactggaccgcacgccagcgcatcctgcagtccatggcttctgtcggggacgatccattaagaccttcgcagcatctcacactggccggagggttgtgttacgtatggacctgcaggacttcttccccagcattactggagctcgcgtgcaggccctgtttagaactgctggctaccccgaaagtgtagcagatctcctggggggaatctgtaccaatgtagtcccacgggatgtctggaaagagccagcccacgagatcgatctgcgacagctctgggaggcaagagtgctgttctcccgacctcatttgcctcaaggtgcaccgacctcccccgctttggccaacttatgcacataccgcatcgattgccgacttgccggtttggccaaaagcgccaatgcggagtacaccagatacgccgacgacctggcattcagcggcggtcacgaatttgaaagatctgtagaacggttctcaactcaggtggctgccatcctatccgaggaggggtttgcgatcaaccatcgcaagacccggatcatgcggcagggcgtcagacaacatctcgctggcctggtgatcaaccagagggtgaacgttacacggtctggatttgactgtttaaaagcgactctcacgaattgcgtgcggctggggccagaatctcaaaatagggagaaccatccaagtttccaggctcacctggagggtcgcatcgggtttgtggaaatgataaaccccgctaaagccattaggctgcggaggatatttgagagaattcaatggacaggcatggaatcacagagagagcggtga

SEQ ID NO: 12448 - RNA, 1329 nt, unidentified
  source 1..1329: mol_type = other RNA; note = synthetic construct
atgtctaggtcatccctcctgagagtcctggccaccagtattcttgcaggagagcctacggtggaccacatcgtagtgcgcgtgtctaggacactcggtaggacctggagatggctcccacctttgtcccaacgatacgtcaaggccttcgccggaaggactcgtccacggagacgcgacgtcgtccagtttttaagacatgaccctgggttcctgtgtgcctggtccaaacactttcacgagctctgggttgagcagtggcttaccgaacagcagagaatgcagcctgtggctgccgctgaaacttgggctgtccccgtaattgagagtcctggcgcactagccgattggttgggcctgcggacagtggagctgcagtggttcgctgatctgaaagggctcgggtataagtcctcccgacctaagcttagacattatcattaccggatcttggccaagcagtctggtaacatccggttaatcgaggcaccaaagccccgtctgaaagaattacagcgccaaatcctggcccagatcctagaacggattccaccccatcccgcagtccacggttttgtgaaaggcaggagcataaagacctttgttgcaccgcatgtaggacagagggtggtgctgcgaatggatttgcgtgatttctttccgagcttttctgctgcgagaatacaagcaatcttcaggacgctcgggtatccagagtcagtggctgacctgctgggcggcatttgtactaacgccacaccccgcgatgtttggtcacggcctgcgtttgacattgacctgagtcaggtccaggaagctcgcgccctgtactctcgcccccatctaccacaaggagctcccacctcgccagcactggccaatctgtgcgcttacagagtcgattgtagactgagcggcctcgccaaaagcgtgggggtggagtacacacggtatgccgatgacttagcattcagcggcaacgaagccttcgaacgttgcgtggaccgatttagcacccacgtggcagctatccttttggaggaggggtttgcggtgcactttcggaaaaccagagtgatgaggcagggagttcgccaacaccttgcgggcctggttgtcaatcagcacatgaatgttatgcgacctgacttcgatctgcttaaggccacattgactaactgcataaggctgggccccgaaagtcagaatcgggacgcccacccccgcttccgatcacatctcgaggggcgcgtgggtttcgtggagatgattaacccggtacggggacggagactcaggactattttcgaacagatccaatggaggtga

SEQ ID NO: 12449 - RNA, 1338 nt, unidentified
  source 1..1338: mol_type = other RNA; note = synthetic construct
atgagtaagagctctctgcagcgcgcacttgcgaacagcttcctggctggtgaaccatatctggagcagctcgtatcaagggcatctcgcaccctggggcgagattggaggtggctgcgatcactcgcacacaggtacctgaagaggtttgcaggtcagacccgccccaggcatagggatgttgtgcggtttcttaacgacgattcgggctttagacgtgcttggcttcagaaccacagcgagttgactgtggcccattgggtgaccgagccccctaggatgcaaccggtcgcagcagccgagtcctggaagattcccagcataagctcagctggcgacttagctgcctggttagggctctccattggcgaattgcagtggttcgaggatgttcgccgactggtgtacaaggagggctccagtaaactccgacactatcactatcgtgtagttgccaagcaattcggagccgttagactgatcgaagcgcccaaaccaaggctcaagacactccagcggcagatcctgtcccagattctggagcaaatccctgcccatccggccgcccatgggttcattaaaggacggtccattaaaacatttgtgagcccccacgtcggacggagggtgatccttcgcatggacttgcaggacttcttcccatcgtttgcagctgcacgcatccaagccctcttcagaacctttgggtaccctgaatctgtggctaatttgctcgccgggatctgcaccacaactacgccccagtctgtgtgggagggtacagggttcgatgtgagtctgaaacagctgcaggaggcgcgcatcctatattctaatgcccaccttccacaaggtgcccccacttcccctgctctcgccaatctgtgcacctatagagtggactgtcgtttacggggtctggcttctgcagcgggagcagcatacactagatacgccgatgacttggcctttagcggcgacacccagttcgaacagggcattgaacggtttagtaatcacgccgctgctattatcctagaggagggcttcgctgtccacttcagaaagacgcggatcatgcgtcgaggggtccggcaacatttggcgggaatcgtcacaaaccaccatataaacattatgcggccagatttcgacaggctgaaggctatcttaactaactgtgtgagactaggacctcagtcacagaatagagacgcccactcccattttcggctgcatcttgaaggaagagtaggctttgtcgaaatgattaatccagccaaaggctaccgcctgagacgcatactggatcagatacagtggcctaccgagacatga

SEQ ID NO: 12450 - RNA, 1335 nt, unidentified
  source 1..1335: mol_type = other RNA; note = synthetic construct
atgggcggcccaggcttctatgcggccttagcgaatagcatggtggccggcgaggctaccgaagatgccatcgccgctcgcctagcccaaaccctcggacatcggtggagatggatcaggccactcgctcggaggtatgtggcccgctttggtggggcaatgcgacctagacgccgcaccatcgcacagttcctgataacagatgagggattgtcccgcgcgctgaggcttcaccggaaagatattcgtatcgctaactgggttgctcccgctggcgacatgcagcctcatagagcagcaaagaactggcccgtacctgccattgaaaccgttggcgcccttgctgaatggcttcaggttacacccagtgagttggagtggtttgccgacctcaaaaggatgattagcagaagagaggacggattcgagggacccctgagccattatcactataggatcctggccaaaccagggggggacgtccgtcttattgaagcaccgaaggaaagactgaaaaagatgcagaggcagatcctggccgacgtgcttgaaaaaatccccgtgcaccccgccgtacatgggtttcgaagaggacgatcaattaagacatttgcagcgccgcatgtcgggcaacgcgtcgtaatccgaatggacctgcgcgatttttttccttctatctctgctccccgggtgcaggcattattccggactgcaggttaccctgagagagtggccgacctcttagggggcatatgctcaaatgccaccccaaggactctgtggacgaagaagggcagtggtattgatccactaaggatggctgaggccaggcagcactacgcttggccgcatctgcctcagggtgcaccttcgtctccagccctggcaaatatttgcgcctacagggtggactgtcggctgacatgcttggccgaagcctccggagctgtctacactcggtacgccgacgatctggctttctccggcggcatggatttcgagagatgtgcagagaggttcgctattcgcgcagcggctatactcctggaggaaggttttgcggtgcatcacaggaagacgcgaatcatgcggcagggcgttcgccaatacttggccgggattgtggtcaatgagcacgtgaacgtgatcagacgtgactatgatgccctcaaggctactctgaccaactgtgtgagacacgggtgggagtcccaaaaccgggaaggacacgttaacttccgcgaacacttggccggtcgggtcagcttcgtcgaaatggtgaatgctaagcggggagccaaactcagagcactgtttgagcgtatacgatggtga

SEQ ID NO: 12451 - RNA, 1206 nt, unidentified
  source 1..1206: mol_type = other RNA; note = synthetic construct
atgacattgggtagaccatggcgctggctaagaccactgggccagaggtacctggccaggttctcgcaaggcactaggcctcgaacggccggagttgtcgacttccttctgcaggatccaggatttcgtcgggcagcccaacggcatgcacgtagcctggacgtggcgaattggctctgtgagcctcgccagatgcaacctgtggggaaggctgccggctgggatattcccactattgaaaccgtgactgatcttgcttcatggctggaaattcccttagacgcccttaattcagccgctgtcccatttgccacaagccatcactatcactatcgcctcctgtccaagcagagcgggatgctgaggctgattgaggcccccaagccacgacttaaggctttgcagagaaggatcgcagcgggcatactggactgcatccccctgcatccggccgtacacggctttcgccatgggcactctatcaagacatttgctgccccgcatgcgggacaacgggtagtgttgcggatggacttaagagactttttccctactataacacgggcacgtgttcaggcctttttccgcactgcagggtatcctgaagcagtggccgatatgttgggaattctctgtactaactcaacccctggaagtatctggaaaccggccgatcccaaactagtccctgagatgcgcgcacttcacaggaccccccatttgcctcaaggcgcacccacctctccagcgttagcaaacctgtgtgcatatagattcgattgcagactctctggcctagctctcgcctccggggctttctacacaaggtacgctgacgacctggccttttccggtgacacggatttcgagaggtccgtggaccggttcaccacacacgccgctgctatcctcatggatgagggcttcagcgtccaccacagaaaaacccgcgtcatgaggcggggagttcggcaacatctggcgggactcgtgaccaatgatatcccaaacatctaccgaggtgattacgaccgactgaaagccattctgaccaattgccttcgacacggccctgccagtcagaacagaaatgggcatcccgatttcagagcccacctcgacggtcgcatcagttttgtggaaatgattaacccctctaaggctcggaaactgcgtgcactgtttcaccagataaactgggcttga

SEQ ID NO: 12452 - RNA, 1329 nt, unidentified
  source 1..1329: mol_type = other RNA; note = synthetic construct
atggccaacccctcattgcccaatctcctggctcgtagtttcttggcaggcgaaccctcactagaccaaattgtttcccgatgcacccaggtgctggggcgcagatggctttggctgaggccgctggctcagagatatctggaaactaccacgagtaaaactcgtcccaggcaacgcgaggtcgccgacttcatcttacgcgatcccgtgttcagcaggatatggagcgagagggcacatacactggcgattgaacaatggctgccagctccatcccgaatggcacctgtgccagccgctagagcttgggatatccctctcatagattcccctgcggccctggctgactttctctggcttgactacgccgagctggactggttcgcagatcttaagaagttaacctacaaaaccgcccacccacggctgaggcactactactatagagtcctcaccaagcagagtggcggcgtccggttaattgaagccccgaagcggcgtctcaagcgactgcagcgcgagatcctggccggaatcctcgagaagataccccctcaccccgccgttcacggattttttaaaggaaggagcatcagaacatttgtcgctcctcatgttggccggcgggtcgtgttgagaatggatctccgggattttttcgtgagcttcggcgcagcgaggatccaggcctttttccggactctcgggtatccagagagcgtagcggacctgctcggcggaatttgtacaaacgcggtgcctaggcacgtgtggcatgatgcagggagtgacatcgatccagcagaattcgaacgcgttcgctccctatactctcgccctcatctgccacagggagcccccacttctcccgctctggcaaatctgtgcgcctatagactggactgccgcctggccggtcttgctaaatcggccggggtaacgtacacgcggtatgccgatgacctggctttttctggcgggtcagagttcgaaaaacacgtggagaggttttccacacacgtggccgcaattgcattggaggagggtttttctgtgcatcaccggaagaccaggatcatgagaagaggtgtccgccagcaccttgccggcgttgtcactaatgagaggattaacatactacgtgccgactttgatcggctcaaggcaaccttaacaaattgtgtgaggcatgggccggcttcacagaaccgaactgcccatccaagcttccgagctcaccttgacggtcgcgtagctttcgtggaaacaattaaccctgaaagaggaaaacggttgcgaaccttgttcgagcagatcgactggagatga

SEQ ID NO: 12453 - RNA, 1308 nt, unidentified
  source 1..1308: mol_type = other RNA; note = synthetic construct
atggccaacccagccctggttgcacaccttgcgcgctgttttgcgtccggagagacaaccgccgacagaattgctgaaagggcagcggaagtgttggggcggacctggttctggttactgcctcttgcccgacgctaccttaaagagcataagggttccactcggccgaaacagcacgatgtcattcgatttctactggatgacggggagtttaggagaagagcaaacaagctgagcgtggcccggtggttaatggccccacagaggatgcaaccagtacctgctgctgctacctggtccctgccagaactcgtgacggccggagacttggctgcatggttgggcgtaagtcctggggaactcgactggttcgccgaccgaaagggcctcaacgcacgaaccaagagagctcccctggaccactatcactacagaattctcgcaaaaccccggggaggcttaaggctgatcgaggccccaaagccgagactgaaagagatgcagcgaaggatcttgactgaaatacttaatcgtattcccgcacaccccgccgcccatggtttttgtccaggacggagtatacggacattcgctgaaccccacgtgggacgcagcatcgtactcaggatggacctgcaggacttctttcccagccttccggctgctaggatacaggctgtgttccgcacccttggctatcccgagtccgtcgctgacttgctggccggtgcctgcactcatcgcacactttcgtctgtgtggagggcagcagagcctagcatctctggggccgaactgttcctggctcgccaactgcatcagtcacctcacctccctcagggagctcctacctcacccgccttggcgaatctgtgcgcctatcatgctgattgtcggctaacaggtctggcaagacacttcggcgcggtgtatacgcgatacgccgatgatctggccttcagtttcgatgagccaggtgacgttagccggtttacctcttacgccgccgcaatcctgctcgaggagggctttgctgtcaataatagaaagactcgtattatgactcgggggagacagcaacggttggcaggactcgtgacaaacgctcgcttaaacattccacgctctgatttcgatcagctcaaagccacactcaccaactgcgttcgtttcgggcctgcggagcaaaatagagccggcgtggccgattttagggcacacctgctggggaggattggctttgtcgaatcaatccatcccggcaagggcaggcgcctgcgtatcctatttgacaatatctgctggtga

SEQ ID NO: 12454 - RNA, 1308 nt, unidentified
  source 1..1308: mol_type = other RNA; note = synthetic construct
atggcaaacccagctctgttaagcattctggcccggtgcttcgcgtcaggagaacctacagcggatggtatcgctgcccgaactgcccaggctctcggtaggccatggttctggcttctgcccttagcgcgcagatatctgaaggcccacggcgctttgacacgtcctaagagacaagaagtcattaggttcttgctcgacgacaccgggtttcgccaccgagcacacaagctgagtgtagccaagtggctgacagagccacagagaatgcagcctgtgcaggcagccgctgaatggaatctgcccgagttggtgactgagggggatctggcttcttggttgtccgtccgcccagaggagctggattggttcgctgacccgaaagggctcaatgccaggacatcgcgcccacctttagagcactaccattaccgagtgctggccaaacggcggggaggcattcggttgatcgaagcccccaagccccggcttaaagaaatgcagagacagatcctcggcgagatcctcgatcttgtccccgcacatcccgccgcccatggattttgccctggtcgcagcatccgcaccttcgctgaaccacacgtggggcggccagtagtgctgaggatggatctgcaggacttcttccccagccttccggcagccaggatccaagcagtgtttaggactctgggctaccccgagctagtggccgaccttcttgccggtgtgtgtactaacagaacccactccagtgtattgcgtacaccccggccagctatacctcaggttgaactcatcgaggctcggcgcttgtatcactggcctcatctaccgcagggggctcctaccagtccggcattagctaatctgtgtgcctacagagccgattgtaggctgaccggactcgccaggaattttggcgcaatctatacaagatacgctgacgacctggcctttagcttcggacagccatcagatgtcagacgtttttctacgtatgcagctgccattctgctcgaggaaggctttgcagtgaaccaccgaaagaccaggattatgacgcgcggtatgcaacaacgtctcgcaggcctggttactaatgaccatctgaacatacctcggtctgattttgataccctgaaagctattctaacgaactgcgtgagacttggccccgcgacccagaatagagcgggggttcctgactttagggcccatctcaacgggcgcgttggattcgtcgagtccatacacactggaaaaggctcccgactgcgggcaatcttcgacaacatttcatggtga

SEQ ID NO: 12455 - RNA, 1323 nt, unidentified
  source 1..1323: mol_type = other RNA; note = synthetic construct
atggatcgcaggacactcgcgactgccctggctagggcactgtgtgctggcgaagctgatgcagccagcgccgctgagcggttagagcagaccctcggacgtaaatggagatttgtggcacccctggctcgaaggtatgcagcggcctttgaggccgttgtgcgtccacgcctggcagatgtggagcggttcctcagtcgggacggcggtttttgcagagctgctcgaaggcatggaccacagctcgccgtggctcagtggattcaggaacctgcaccagcaatgaggcctgccgccgctgctagagaatggggtctacctgctgttgcgactccgggggacttagccgcgatgttggggctggaggctgccgatctggactggttcgcagatctgagaggctggggtgcagggggagttgacgccaaactggagcactaccgctatcgtgtggttcctaagcggtccggccgcctcaggctcatagaagctcccaaacagaggctcaaacaggtgcagcggcgactgttggctgaaatccttagaagcgtaccccctcatccagctgtccacgggtttgtggcggggaggtccgtagccacattcgcagagccacacaccgctaagcgcatggtactgaagatggatctgcgggacttttttccaagtgtgagggcggcccgtatcgaagcctttttcaggacggcgggctatccagaacctgtcgcccgagctctgactgggctagtgactaatgctgcacccaggagagtcttcgctaaagagggggagttgggtttagtgcacggcgcgcgaagcctatactgtagaccccatcttccgcaaggagcccccacctctcctgccttggcaaatatttgcttcagacgcgccgaccaacgccttgaggcacttgcccggtcagctggtgccgactatacccgctacgccgatgatctcgctttctcaggcggcgacgatttcgcccgacacgccagaagattttctttgcacgtcgcagcaatcgcaacagaggaaggcttcgccgtcgagcaccggaagacacggttggctcctgagtcgggcaggcaacggttagcgggagtcgtggtgaaccatagacccagcctgccgcgagccgaaattgagacgctggaagccatcctgaccaactgcgcccgcgactctccagaaacacagaaccgcgacggacacccccgttttcgggagcatctggcaggacgcatagcctacctcgccatgcttaatccctccaaggccgccaagctgagagccatcttcgaccggattgcatggacctga

SEQ ID NO: 12456 - RNA, 1326 nt, unidentified
  source 1..1326: mol_type = other RNA; note = synthetic construct
atgcagcggagcctggtgataaaaaagttggccgaagtctttctggcctctgggataaacagtcctttcttgacttcacggtgcgcagtcgtgcttggccggaattggagatggctgaggcccctggccgatcgatatgtggtgaccttcagcaatcgtataaggcccagctacagagaagtcttaagtttcctcgaaaccgatactggcctcaaagaggcatttacacgcaactccggacagtttgaaatcaagcagtggatagaggaaaccccccacatgaggccagttccagctgcccaagcttggcccgtaccccctattgagacaacgggggcattggctgagtggctgtggctggacgcaggccacctggagtggtacgccgacttgaaagcctttgccgagacatccatctcagaaaaacttagccattattcttaccatgtcctgcgcaagagaaccggaagcgttcggttgatcgaagccccgaagcgccagatcaaaaagcttcagactcagattctcgagtggatcctaaatccagtgcctccccatcctgctgttcacggctttattgcgaagagatccattaccactttcgttgctccacacacaggccagcgggtggtgctgaagatggatctgcgaaatttcttcccgagtctgagggcggcgagaattcaggcattttttagaacggcagggtatccagacgaggtggcccagctcctcacaggagtgtgtaccaacatcacaccaaggaggttttggcgcgctcccgaactgaacctgaccttgcaggagattcaagacatgcgggatctctacggaaggccgcaccttcctcagggtgctcctacctcacctgctcttgcaaacttatgcgcatggcgcctggactgcagactgcaagcgttagcggcctctgcaggggcccaatacactcggtacgcagatgacctagttttctccggggacgagcatttcgaccgttctgtcagtcgttttagcgcccacatcggtgccgtggtgctagaggaaggcttcgctattcatcacgctaagacgcgaatcatgcggcaaggacaacagcagcgcgtcgctggccttgtagtcaaccagcacgccaatgtggccagacctgattatgacaggctcaaggccattctgacaaattgtatccgccatggacccgagtcccagaaccagaatgctcatacttcattccgacagcatctggagggtcacatctcgtttgtgcacatggtaaacccagccaaagccctcaggctccgagccctgttcgatcagatcgcatggtga

SEQ ID NO: 12457 - RNA, 1134 nt, unidentified
  source 1..1134: mol_type = other RNA; note = synthetic construct
cgcgataggggacttctgcgggcctatgaaaattacggtcaccgaatcaacgtaatcacctccttcccagaggtacaggaaatgtgtcccgtcccagctgcgaggacatggggagttccaccaattagaactgagggcgagctggccacatggctggggatagagctgaatgagctttattggtttagtgatgtggcaggcttcggcgccagacttggtgcacctccgaagactcgccactacagttactggattctcactaaacgctccggaaacatcagactgatcgaggctcctaaatctagattgaaggccctgcatcgaaagatcctctctgaaattctggagcgtgtgcccatccacgacgcagctcatggctttgttaaagcaagaagcatcaccacattcgcagctccacacattggacggcgagtggttctaaagatggacctgcaggattttttcccctcctttcatgcagcacgaattcagactctgttccgcaccataggataccctgagcgagtcgcagacttgttttccggcttgtgctgtgccagcacgccgagagaactttggaagcagatgcctatcgaggtgaatccacagcaatggagggaatcacgggacctctacttcaggacacacctaccccaaggtgcgcctacgtcaccggctctggccaacatctgttgctaccggctcgattgcagattagcctctctggcgaattcggccggcgctgcttataccagatatgctgatgaccttgccttctcaggggtgggtcagtttgtgcgcggcatagagcggttcgctaaccacgtggccgctgtcctgctcgacgaagggtttagcgtcaactttaggaagacccggattatgcgtcatggcgtcaggcagcggttaaccggactcgtaatcaatcagcaccctaacgtgccccgtgatgagttcgatcgcctgaaagccattttgacaaattgcgttaggctcgggcccgacactcaaaacagggaggggttgagccattggcggcagcacctggaaggacgcatcgggttcgtggaaatggtgaaccccaagaggggcgccaaattacgcagaatatttgacgtgattgcctggaattga

SEQ ID NO: 12458 - RNA, 1332 nt, unidentified
  source 1..1332: mol_type = other RNA; note = synthetic construct
atgcgccccaacgtctgcctctttgaggcactcgccagcgccttcgtagccggtgatcccaccgtggacgggatcgtcgcacgcagtgctcgcatgctgggacgtgattggcgttggctccggccactggcccaaaggtatgttgaaaccttcgcaggtcgtgtaagacctcgccgaagcgacgcggttgacttccttcggggtgataagcgattcagacggatctgccagagaatcccatcccatattggcattgcacattggctgactcagtcccagcgcatgctgccaatggctgccgccaagggatggagggtgccttccattgaatctgtcagtgccctcgcagattggctagggactgatgaaaattacgttgaatggttcgcagacttaaaagcattaagctgtaagtccgaccacaacaagctgagacattatcactaccgtgttctgctgaaagatagtggcgacgtgaggctgattgaggcccccaagcaaagcctgaaaaggttgcaacagcggatactaacggggatactgaatggcataccagcccaccccgctacacacggattcgtaactggcaggtccatcaaaacctttgctgctccccacgcaggcaaacggattgtgctccgaatcgacctgcgcaacttctttccctcgttccgggccgcccgcattgaagcatttttcaggactatggggtacccggaaaccgtggctgccatgttggctggaatctgtactaatgcgacccctcgggatatatggcataacgtgaagccgggaggcggacccgtgcagttttgggagacacgcagcctgtatgcgcgccctcacttacctcaaggggcccctaccagtccagcaatcgctaatctgtgttgctacaggctggactgtagacttgcaggtcttgctaggtctgcgggggctgtctacacaagatatgccgatgacttggccttttcaggctcaaagtcatttgagaaatctgtggagagattcagcattcacgtcgccgccatcgctttggaggagggtttttcagtgaatcaccataagacacgaatcatgaggcagggagtgagacagagactcgctggcgttgtcgtgaaccagcatccaaacgtgcttcgacatacgtttgaccggttgaaagccacactaaccaattgcgttcggtacgggccgagctctcagaatcgggagaggcacatcaacttcagagcgcacctcgaagggcgcatctcctttgtggagatgctcaatcgaaacaagggctctagacttcggaagctgttcggccagattaggtgggagtga

SEQ ID NO: 12459 - RNA, 1338 nt, unidentified
  source 1..1338: mol_type = other RNA; note = synthetic construct
atgaccggacgcatcgctgccgcaatgaacgccgcgttcttagccgcactcgctcggtccctcatggcaggtgaacaaacagtggaagctgcacgagcgagagccatgaggactctcggacgcaggtggaggtgggcaggtccattcgccgcaagatacattgcagcctttcgtcatggaccgcggccacggttgaaggacgtcatcgcattcataagggccgatgaggggtttgatctggccgctttgacctatggctctaagctgagtattgctcactggctggcggccccacagaggatgcttccatatggccccgccgctgattgggatctgccctcaatccatactgagggcgatctggcccgttggcttgcgctgcacgcaacggagttggactggcttgccgatcgcaaaaatctctgtagaaagcaagcgaaccccaagctgcgccattaccgatacgtgatcgagcctaaacgcagagggggaatcaggctcatcgagagccctaaaaggctccttaaggaactgcagcgacggatcctggctgaaatactagacagaatcccccctcacccagccgctcacgggtttgtgaaaggccggagcatagtaaccttcgcaacgccccacaccaaccagcctctggtcatgagactggacctggagaatttctttcctagctttccagcagcgagagtgcaagccctgtacaggacactaggatatccagacgccgttgcagacgtgctgaccggcctgtgcaccacttcaactttacatgacattgtcagagcccagacattcgaggaccgccgtttgtatgagcagcggcaccttcctcagggtgctcctacaagtcccgcccttgccaatgctatggcttaccggttggattgccggctgtcgggacttgccagaactgcgggggctgtgtacaccagatatgctgacgatctcgccttctctggcggtgatgaatttcggcggaacgcacaccgattccagcaccatgctgctgccatcgccctggaggagggcttcgctgtgaatttccggaagacgagaattatgcgtcagggggtaaggcaatcattggccggcttggtcgtgaatggcgggttatccattcgtcgcagggacctggaaaccctggaagctatactcacaaactgtttaagacacggacccacatcccagaaccgagccaaccatggcgactttcgcgcccatctcgaagggcgcatttcctacgttgagatggttcacccggagaaaggtcgccgactcaggagcctatttgacaggattgattcttgggcaaatactctgtga

SEQ ID NO: 12460 - RNA, 1299 nt, unidentified
  source 1..1299: mol_type = other RNA; note = synthetic construct
atgaaaatttcttttcctgctgccgttgtcagtgcggttgctcggtcactcatggccggagagccgacagtggaaggagcacatgtgagaatgatgcgcacactgggccgcccttatagatggctgctgccattggccggccgatatgtgagagccttcgctggaagaacccgtcctcgattgcgggaagtcgtgcagtttcttctgaacgacaggggatttaggagggtgcgccagagacagctcgccgtagaacactggctcaccgagcctcagcgaatgcttccctgtggtcctgccgcagagtggggcttacccgtggtcgaatgcgaggctgaccttgcaggatggctgggcctgcacctgtctgagctcgagtggttctccgaccgcaagggtctgtgtcgtaaacacggaagcgagaaattgcaacactaccactacagaatggaagagaagcgatccggcggcataagactggttgagtgcccaaaaagggaactgaaggaactgcaaaggtggattttggggagtcttctcgatcggatcccggcacatgccgccgcacatggtttcgtgaaagggcggagcatcgtctctttcgcggcaccacatgccggcaaggcagtgctcctacgtatggacatggagaatttttttccctccttccccgcagctagggttgcggcactgtttcggactctggggtatcccgaggtcgtggcggaacatttgatggggctgtgcacgaacgctgtgcctcgtggtgtatggggaacccgggtcgaaggcagaatgctctactcccgcagacatcttccacagggtgcccccacatcgccagccttggcaaatgccatggcctatcggctcgattgccgcctaactggcttagcccgcaccgcaggcgccgtatacacaaggtacgctgacgacttagccttcagcggcggggaagaattccggcgagtggttgatcgattcgggatacacgtggcagctgttgccctcgaagaagggtttgctgttaaccacaggaagacgcgggtgatgggtcagggaatgcggcaggctctagctggggtggtcgtcaatcagggcgtgtcaattaggcgcgatgagctggagaaactggaggccatcctgactaattgtgtcagaaccgggcttgctgcccaaaacagggagggggtagcggattttcgggcccacttagagggaaggatcggattcgtggagatggtgcacagagagaagggccgcagactgcgcgctattttcgagaagatcaggggctga

SEQ ID NO: 12461 - RNA, 1035 nt, unidentified
  source 1..1035: mol_type = other RNA; note = synthetic construct
ctggtggccgaatggctccctgaagcacctaggatgaggcccgtggcagcagccgaagagtggaaattgcctgcgattgaaaccgttggggatttagcagattggctctccctttacccagccgaactggagtggttcgcggacctgaagcatctgaacaaccggcgacccaagctgcagcactaccactatagagtccttgtcaagaggtcgggaggcgtgagattgatcgaaacaccgaaagccacccttaaggcccttcaaagaagggtgctcagcggcattctcgatcatgtacccgtgcacccggatgtccatgggtttgtccgaggccgtagcatcgtgacatacgctcagccccacgtgaggcaggatgtcctgctgcggttagacctggagaatttctttcccgcctttcctgctgcacggatccaggccctcttcagaacgctggggtatccagagactgtttctgatagactggggggactgtgcagcaatagcgctcctgctgacgcctgtggtgcactctacgcacggccccatttgccacaaggcgcacctactagtcctagtctggccaatctgatggcgtaccgccttgactgtcggctctcagctttggctcggacagcgggtggtcggtatacaaggtatgccgacgacctcgccttctcaggtggggtaccctttcgccgtggagtggaccgcttcgcttcccacgccgctgctatcgccctagaggagggcttcggggtgaaccaccataaaaccagaataatgcgcccatccacccgacaacagcttgccggaattgttgttaaccaccacgtgatcatctctcgtagggagctggagctgttagaggcaatactaactaactctgtgcgcagaggcccagcctcacagaatcgagacggaacgccagactttcgcggatgcctacagggccaggtatccttcgtcgaaatggtgaatagggctaagggccagccgttgcgcaccctgtttgaggccattgattgggaaagatga

SEQ ID NO: 12462 - RNA, 1359 nt, unidentified
  source 1..1359: mol_type = other RNA; note = synthetic construct
atgagccgagcggccatcctgtctgtcctggcacgctcactgcttgccggcgaacctgcgtatcccgcagctaggagtcgggcagaacgaacactaggacgccggtggcgctggttgggacctttggctagacgattcgctggccgatttggagatgcagtgaggcccaggcaccgcgatgtcgtcagattcctcgctcgggacgcgggcttttcagaggccctgcatgcttatgggggccggattcggattgctgagtggttggctgaacctcagagaatgctgcctgttgaagctgcactggcctgggatctccctgtgatcgagactgctggtgccctcgcggagtggctaggtgtgaccgtggacgaattagactggtttgccgaccggaaagacctgtgtgggagggcgaacgcctctgagcagctccgtcattatcgtctccgactgctggcaaaacgcacaggaggagcccggttgaccgaggctccgaaacctaggctgaaggccgtccagagacgcatcctggaaggcatactcgatagggtgccgccccatcctgccgctcatggttttgtgcaggggcgttccatcgtaaccttcgcagagccccacgccagaaggcggatgcttctcaggctcgacctggcggacttttttcctgccagtcccgccgccagagtggaagcactcttcaggacattagggtaccccgaggccgcagccggactattagctggcctttgcaccacagccactcccagggccttctggagagactgcccagcctggttgggagccgaagagtggtccgctgcccgaacgctgtacgctagaccacaccttccgcagggggctcccacatctccagccttggcaaacgccatggcctacagacttgattgtcgtctggcagggctagcaagaagcgcgggagcggtctatactcgctacgcagatgacctggccttctccggcgatctggagttcgcaagaggcgtacacaggttcgccgcacacgctgccgcagtagccttggaggaggggttcgccgttaaccaccggaagaccagaattcgcggtcagggtgcccggcaaagactggctgggctggtggtgaatgaccgccccaatctgccacgcagagacttagagaggctcgaggctatactggtgaactgcgctcggcggggtccacaagggcagaatagggcaggcgaagctgattttcgtgcccatcttgaaggccgtgtgggctacgttgaaatggttaatccagcaaagggagagcgacttcggaggatcctggagactattgcttggccagaacgccaaggccgcacgctcgatagctga

SEQ ID NO: 12463 - RNA, 1005 nt, unidentified
  source 1..1005: mol_type = other RNA; note = synthetic construct
atgcctgaggcctggggcctccctaagattgctagtgctgaggccttggctgaatggcttgggctcgatccgcctgacctggcctggttcgccgacttgcgaggtatgacgagacaggccccaacagaggccctacggcactaccgttatcacgtgatcgttaaacgacatggcaatctgaggctgatcgaagcccccaagccgcgactgaaagcgatccaacggcagattctgacagagatgttggaccgggttcccccacacgaagcggcacatggatttgtgcacggtcgttcaatagccagctttgccgctccccatactggacagtccgctgtcctccgcctggacttggaccacttctttcctagattacagcgggcgcgcgtacgcgctttcttcgaaaccctcggctataggaagcctgtggctaccctgcttggggggctttgtaccaatagagcccccaggttccttccatggcccgacttcgcaacaatgcaggttcatactgccccccacctcccacaaggtgctccttcatctccaagtatcgccaacagctgtgcttacagagcagattgccggttagcagggttggcagctgctgcaggagtcaggtacacccgctatgccgatgaccttgccttttccgggggtgacgagttttctcgcggagcactgacatttgcaacgcacgtggcattcattctgggagaggaggggttcgccgtgaatcatagaaagacccgtctcatgagacaaggggtgcagcagtacctgaccggactggtcgttaaccagcacctgaacgtggatcgggaggattttgatcgacttaaggccactctcacaaattgcgtccgcagaggcctggcgagcgaaaacagggagggcttaactgactttagggcgcatctggaaggcagggtaggcttcgtggagtggatcaacccacggcgcggcgaaagattgaggggcctaatactgcagattaaagattga

SEQ ID NO: 12464 - RNA, 990 nt, unidentified
  source 1..990: mol_type = other RNA; note = synthetic construct
atgcacgcaaggttcgccttaagccatccgctgccaccactgcccacagaggtggctctcgccgattggctctgtctcagtccatcagagcttgactggttcgcaaatcgcagaaatctggcgacctctgccgccagaagccactaccgataccatctgcttaccaaaccctccgggggagtccgtctcctggaagctcccaagtttcggttgaagtgcctccagaaacgcattcagactggcattctggaccttttgcctccgcatcctgccgtgcacggctttgtgaaggggcgatcggtgaagtccttcgctattggtcacgttggacagcccggcgtgttgcgcatcgatctcgagaactttttcgcttccgtgcgctctgctagaatcaccggattgttccggacgcttggctatccccctccagttgccaagctgctatcagaactctgcacgaattctgtaccaaagacagtcctggccgaccatcccgagaggtttctgtacttcaatagacacctaccccaaggagccccaaccagccccttgctggccaacctgtgtgcatatagagccgactgcaggttagcagccctcgcaaaagccgatgggagtttatataccaggtacgctgacgacatcgcattctcaggtttcgtcaacaacgaccttgctgcccaagctagtgcgatactggcagaggaaggctttacagtaaatcaccacaagactcgccttatgtccgagggagttcgacagcatctggcgggcctcgtcgtgaacgccaaaccatctacacctagagatgagtacgatcggctgaaggcaactctgactaactgtgcccggtatggtctagatagccagaaccgtgacaagcaccctaattttcggcagcatctggaaggtcgggtggcttgggtcgaatacatccaccctgagaggggggcgaaactgaggaccatattggctaaactggaaccttga

SEQ ID NO: 12465 - RNA, 1299 nt, unidentified
  source 1..1299: mol_type = other RNA; note = synthetic construct
atggcacgcatccttaacggagctcccttcgacgtccccggtatgatcgcctcagcagacgagatgctaggacgacggttccgctgggtgcgcttactcgccaaacggtacgccagcgctatggcaggcaaaacacggccccgccttcggactacccgtcaattcctcatccaggatggcgctgtatccgaagcgtggaggaaacacaagattagagttgagcagtgggtcacccacggaccaagaatgcaacccgctccggctgcctcagaatgggacctcccacggattgaaacatcgggcgatctggccgactggttttggattgaacccggggagctggagtggttcgccgatctcaagcgtctgggcaataagttgggtgttgctaagttgcagcactaccgatacttgatactcaagaagcccaatggcagactgagactgatcgaaatgcctaagaggaggcttaaaagcttccagagacagatccttgagttcatattggaccgaatccccgtccatccggctgcgcatgggtttgtgaaaggcagatcaatccatacattcgttgcaccacatattggacaggaggtagtgctgcgaatagatatcgccgatttcttcccagccattagtcaggaacggattcaggccctgtttcgcacgatgggatatcctgaagcagtatccgacctgctcggggggatatgcacaaacgccgtgccatacgaggtttggggacagaccccggagggtgtcgatgctcgggtaagatatgaagccaggaatctgtatagatgggcccaccttcctcaaggcgcgcctacttcccctagcctggccaacctgtgtgcctatcggttagactgtcggctggccggattagccaatgccgcaggcgtgcggtactctcgttatgcagacgatctagctttttctggaggcggggcattcgttaagaatgtgagacgctttgcggtcagtgtcggctctattctgcaagaagaaggttttgctgcaaaccacaggaaaactagggtgatgaggagaggagtgcagcagagactaaccgggctggtggtgaacgagaggcctaatgtgtcccgcgaggaatacgatcgtctcaaagcgatcctgaccaattgcgcacgacatggggctggtagccagaaccgggaaggccacgccttttttcgcagtcacttggaggggcgagtcggctttgtggaggctgtgaacccagagagggggcaccgcctcaggaagattctggagaggatcgactgggaggagtga

SEQ ID NO: 12466 - RNA, 1365 nt, unidentified
  source 1..1365: mol_type = other RNA; note = synthetic construct
atgcctctcgccctggaaattgaaatctgcgccgccttggcacaagccttcacgaacgcggcgtccttacccgacatggtggctagcgcagatcatcttctgggtagcaggtggaggtgggtaagactgctagtgaagagattcgctgctgccaatcctagcgccacacgacccagataccgcgacgcatatcagtttctcgccaaagacggagctgtccggagggcactgtatcggcatcccggcgaaatccatcttgcccacacaattccctctcccccaagaatgcggcctgtcccagcagcccaaccctggaatctgcctacccttgaaactctaggggaccttgctcagtggttttggctgtcacctgagcagctagattggtttgctggcctcaaccgattctcaaagaacggatccgaggagctgcaacactatcgctaccgtctcgagccaaaatcacatggaggcttaagacttatagagattccaaagccccggctgaggaaattacagcgccagatcctccactatattttggacttgatcccggcccaccctgcggcacatggatttgtgaaaggtaggggcatcctgtcctttgctcaaccgcacgcagccaagcccattgttttacgactggatctccaggacttctttccatctatctacggccccagagtgcagactttgttcaggacatttggctaccccgagaatgtcgccgatagcctggggggtatttgtacgaacatagttccgtctcacatttggaacactaccccagagggcacaaccttggacgctaaggtggccgctaaggcgctctaccggtcgagtcaccttcctcagggtgcacccaccagcccagcactcgctaacctctgcgcataccgcttggattgtcggctgaccgggttggctaaggccgcaggagcagtttatacaaggtacgccgacgatctggccttcagtggggatgcgtcctttgcacggggggtagaccgtttcgccacccatgtggctgccatcgccgctgaggaaggcttctccgtgaatcatcgaaaaactcgcatcatgagactgggggtgcgacaacacctagccgggcttaccgtcaacgaaaaacctaacatacgtagggacacattcgacgagctgaaggctatactgactaattgcctccgccacggacctgctacccagaatcgggaaaatcatcctgatttccgcgcccacctggagggcagggtgagttttgtcgcgagcatccacccagccaagggactgaaactgcagtctctgctgagacagatccagtgggccgatactcctagacccgccgctccaagtccgccatga

SEQ ID NO: 12467 - RNA, 1377 nt, unidentified
  source 1..1377: mol_type = other RNA; note = synthetic construct
atgaaacctcatgattttgccacagtgttggccatagcacttctggccggtgatcagagcgatgacgccgcagttgcacgcctgaggttggtggcaagagggaggcaacgggacctgctcagactcgttggctattaccgggccctagcgcctaatggtgttgcccccaggagaagggaggtggcaaggcagctgcgcgcactcttcgacgcccagagagaacgaggagcagctccctgggttcgggctaggacgcaagtggatgtgcccctgccctcgccagtaatgaggccgagtgcaatgcgcacatctgctgtgcgtgctgctccagcccatgcatgggaccctgccccaagagacaggcctgacatcgccaccgtaggagcgctggccagctggttagaactgcctgtcgaggaactgctttggttcgctgactgtagagacttgaaccgccgccattccgctccgagtcttcgtcattatcatgtgtccactcgtccaaaaaggcacggaggggtccgcgtgattgaagccccacaaacccgcctgaaggccatccagagaaaaattctatcagagatactcgaaaccatccccctctattatagcgcagcccacggtttcgtgaagggccgttctgtgcgatccttcgccgctgagcacgtcgggaagcctctcctgctccggattgatttagctgatttcttccccactgtgtcaggggccagagtccaagccctgttccggacactgggctacccagaggctgtggcggaccttcttggcgggctgtgcactgcgacaacctctagacacgtctttggcgcggttcgggcacaggtcgacagaaggatgctgcagcacgccatggagttgtacaccaggccccacttacctcagggggctcccacaagtccggcactcgcaaatgcctgtgcttttcgactggatgcccggctcactggtcttgccgattgggctggagccgtgtacagccgatacgccgacgatctggcgtttagcggcggagacgaatttgccagacgaattgaccgcttttgcgctgaagtgggcgcgattgccagggatgagggctggagggtgcaggaccacaagacccgaatcatgcggagaggagcacgccagcagttggctggcgtcgtcgtgaacgagcgcctgtccacccctcgggttgcctacgagcagttgaaagccacgctgactaattgcgtgcggtttggcccagcatcccagaaccgcgcggctgtagtcgatttcagagctcatctactgggacgtatggcttgggtagcttctctccacgcagcccgagggcggaagttacacgccatcttcgatcggatctcatggtga

SEQ ID NO: 12468 - RNA, 1344 nt, unidentified
  source 1..1344: mol_type = other RNA; note = synthetic construct
atgccccaccaatcactgacgatcgcgttggccagggctttgactggcggctcgcaggacgagccttccattgcactgaggttagcagtaacccttggccgaccacctgctcgctggatagcgcgattcgcccatcggtatgtccgtgcattttctggtaatactcgaccccgtgagatcgaggtcgcccagtttatcgttgccgataggtcttggagtgcccgcttagcgccaacccccactcgacctagacagctagtggcgcgctggcctcttgaaacaccggggatggttccagttccagccgcagcagactggcccgtaaaacgtatcgagtcagtaggggatctggccgaatggctgggaattgacagcagcatgctcgactggttcgtggatgctaaaaacatcgctcacaagcagcctcatacaaagctgcaccactatcattacagggtgctccagaaacggtctggcggcatcagaatcatagaggcccctcaggagcgattgaagatcattcaacggaaaatcctcaaggatattctcgaacaggtgccacagtattactccgccgcccatgggttcgtcaagggtcgctcagtgcggacatttgccgcaccccacgtgcaacaacaggctattctccgaatagacctgcaggacttctttccaaccatcggccgggccagagttcaggctctgtttcggaccctgggctatccagagactgtcgccgatgcacttggcgccctctgcacgaatacaaccccccgcaggttcttcgccatgaccccgagaactgccggagacgtggcgcttcaggtgaaggctagacacctgtacggaaggccgcatgtccctcagggagcacccactagtccactgattgctaacctttgcgcttatcgcctagattgtagactaaccggactggccgattgggcaggggccgtttacacaagatacgcagatgacgttgctatttctgggtccgggaatttcgcccgcaacgtagaacgctacgctgcggaagtgtccggcattgctctcagagagggctggagcgtgcaacatcacaagacaaggataatgcggcgcggtgtgcgtcagcatttagccggaatcgtggtcaacgagaggctcaatgtcagtaggacggacaccgatcggttgaaagcaattctgaccaactgtgtgagacatggtcctacaagccagaaccgggaacaccaccccgactttcagagccacctgcgggggagagtgggatgggtgacctttgtcaatcccctgaaaggacaaaggctggctactttgttcgagcagatcaattgggaatga

SEQ ID NO: 12469 - RNA, 1191 nt, unidentified
  source 1..1191: mol_type = other RNA; note = synthetic construct
atgcacaccctcgcacgagcgtttctcgccggggaactgaatgcccagtcagcagcagctcgagcagcagcgctgttcgctactcccccccgttggttgcccgcactagcagctagattcgtcgcggccttcgcaggaaaaacgcgaccgagatttctgcacgcagtcgcctttctccaagcccagcctccacgcgcggccaaactgattaattggctcacagagcctgctgtcatgcagccagttgaagccgccaagggttgggctctgccttccctcacttcaactggggagctcgctacgtggctggggctgagtatacctgagttggaatggcttgccgacttaaggggtacagcgcgccccggtcactaccattaccagcctgtggctaagcagagcggagccgctcgtttactcgaagcgcccaagcctcgcttgaaggccgctcaacgacagatcctgcgccagatccttgatctcgtgccaggccacgccgccgttcatggatttcggagacatcggtctattcggacattcgccgccccccacgctgctagaccagtagtcctgcgcatggacctgagggattttttccccagcatctccaggacacgggtcgatgctgtgtttagaactctagggtaccctggccccgttgctgcccttctagctggactgtgtaccactgctgccccgactggcggtccattatataggcaaccccatcttccgcagggcgctcctaccagtccagcccttgccaacatttgctttcacagatctgattgccggttggcgggtttggcagctgctaccggcttacagtatacccgctacgcagacgatttggcattcagcggcgagttcatcagcgagaacctgcaggcaagaataggcgcaatcgtgcttgaggagggcttcacgctgcagtatcgaaaaacacgcctgatgagacaatcggtgaggcaacacctggccgggctcacagtgaatgccgggtgtaacgtacggcgggttgacttcgaccgcctgaaggccacactgcacaggtgcgtgcagctaggaccacgtgacgaaaccagggatgccctgaccggccatgtggcctttgtggaatccgtgaacgcagccaggggaaggaaactccgggccctgctggagagaattcagtggacctctcatggatga

SEQ ID NO: 12470 - RNA, 1347 nt, unidentified
  source 1..1347: mol_type = other RNA; note = synthetic construct
atggagcggcccttgcagcctctgtctcactcctcaaacgagttcctcagcctcgctcacgcacttctgtcagccgagcaggccgtggaaccacacctacagatcttgcgtactgcatttcgggcagaacctccccccggaaggcttagacccctggctgtacgaaccgtgggatgggcaagcactaggcccagaccgagaatcagacgattcatagaacagctacgggctgagcctcgccttgtgcgcctcatagaacgccacgggctccgacagctgccattggtgagtgtaccgctccgtatgctccctatccctggtactgcgcctgtggtgttggagacagccgggtccttggctgcatggttggaggtcgaagccggacaactgctgtggttcgccgacctgcgggattggaacaggaaagcggggggtgaccgcctgaagcactatacctgccgggtgctcgctaagccatatggcgctattcgcttactggaagttccaggacccagactcaagagcatgcagcggagaattctgcgtgagattctcgcccctgttccaccccatccagccgcacatgggtttaggcgagggcgcagtatcgtctcttttgctgctccccacgcaggccgagaggtcgttctgaggatggacctgcgtgacttcttcccctccataagcgggccgagggttcaggcgctgttcaggactctggggtaccccgaacctgttgccgacctccttggcggcctttgtacagcgaccacaccgaggggtgtgtggcgcaatactggatgcgagctgtcggcagcagacctccaggatgcgcggatcttttacgccaggccacatttaccacagggcgcccctacatctcctgctattgcaaatctatgcgccctgcggttagatcggagaatcggcggcttagctgaaaaagccggtgtgacatataccaggtacgccgacgatcttgctttctccggagatgcactctttgctagaggagccgagaggtttgccttgcgcgtcgccgcaattgccgccgaagaaggcttcgccgtccatccccgcaagacgcgactgatgagacggggggtccggcaacatttggccggtctgaccgtgaatgctcagccccaactgccacgccgcgagctagagagactggaagctattctgacgaactgtgtgcggcacggcccagagggacaaaatagagatgggcacgccgactttaggaggcatctggagggcaaagtggctttcgcaaccatggtaaaccctgcccgtgccggccaccttcgagagttactggagagaatcgcgtggggcgattga

SEQ ID NO: 12471 - RNA, 1797 nt, unidentified
  source 1..1797: mol_type = other RNA; note = synthetic construct
atgggatatcacgagcccaccccggcaatttcagtgccggcaagacccagggtacctcacgtcagtcgcgtgggtgacatggggtaccatgaacccacacctgcgataagtgtgcctgctcgaccccgcgagcctcatatctcaaggctgctcgaaacatgggatactaccaacctgaccagaccaagcgccctctctcacgagaggcggtgtgatctcgctctggcttcgcggcctcttgcagcacaacggccagctgctattctcttaatgcgtcgatccgccccctcttggcagggcaaaaaaccgagtggattggccctcacgtctctgggcctccctcaaggtaacgtagccattagggcactagtcgccggcgcctccctgagatctcatgccgaccagttgccaccaggtcagaccaggtggtcgacccctttagcccctcggctgtccaagagtgtgctgatacgtgcattagctactgctttcctgcacggggaacccactacagaggagctgatccaacgagcagcccacactctggggcgcaactggaggtggcttcggccagttgcccgacggttcgtggagagattcgcagggaaagttcggcccacaagacgcagcgtgctcgccttcctacgtgaagatgagaacgtcaataggacatggcacagccgtaggcatcagctcaccgtggcgagctgggtggtggaacctgatggcccagccgcaatgcagcctatggcagcggcagcagattggcctataccagccatcgccacagtcggagacttggctcgatggctgggcctgaccatgggcgatctcgagtggttctccgacccacggcggcttacggctaagacacgcactcccactttacagcattatcattatagggtctttccaaagagcagcggaggctttcgcctgatcgaagctcccaaatttcggctcaagaaagtacagcggcagattcttcacgagatcttggacagggtgccgacacatgcagctgtgcacggctttgtgcctggtcggtccattaaaactttcgcctcactacacgccggtaagcaggtagtgctaaggatcgacctgcgagaattctttccatccattggacgtccccgcgtgcaggctctgtttcgaaccatgggatatccagactctgtggcggggttactgagtgggctttgcacgaacgcgactcctcgacgcgtctggagagaaggcaccgctcaacccagccggagcgttgacccagcagcctcattcgaagccgcccagttctacgctagaccccatttgccccaaggagcccctgcgagcccagcattggcaaatctttgtgcctttaggctggactcccgtctgcagggactcgctaatgctgccggcgccacctacgctagatacgccgacgatctggccttttctggggacgcagccttcgctcgctcagcagagcgcttcgctgccagagttgccgccatcgcggaggaagaggggtggacagtcaatcataggaagacgaggatcatgagacagggcgtcaggcagcaccttgttgggctggttaccaatacccacgctaacgtgcgccgcgccgactttgatcggcttaaggctattctgactaattgcggactgcacgatcccgcgacacagaatagagaaaaccaccccgccttcagggcccatttggagggcagagtgtcctttgtcgagtctatcaacccgggcaagggtagaagactccgcgcgctgtttgatagaatagtttggtga

SEQ ID NO: 12472 - RNA, 1452 nt, unidentified
  source 1..1452: mol_type = other RNA; note = synthetic construct
atgagggcgtatgccagctacctgactccagaccagacccgttggtggggaagcgctgctgctcctactatgctcccctcgaggacccaagtgactccccctgttgagtgcacccgcaataacttggcccgagcactggctagtgcaatggccgccgggccagtcgaaacagatgctctcatggaacgcgcctcacgactgctgggtgatcaggagcagcataaacggctgagctggctgcgcccccttacgagaagggtggaggctgaatttggggcaggtccacgacctagagctgctgccctggctgagtacttgttgtgtgacgagggatttgaacgggcctttcagaaacacgcgccttggccggtaggccttgtatctgctgcccccgctatggcccctatacctgacgccgcagattggagagtagcccctctgaccaccgttggccaagctgccagctggctcgggttaagtgtgggtgagcttcggtggttcgccgactgcagggcctgggaaagaagacgtccagccggccccctccgacactatcagtatcggggactaactaaacgattcggccagacccggttaatcgaggcgcccaagccaaggctgaaggccctccagagacaagtcctggaacgtgtgttagacagggtgccgccccatgatgccgctcatgggttccggagaggaaggtccgtggggaccttcgcagctcctcacgcaggacagagggtcgtattgaagattgatcttcaggacttctttccgtccatcgcaggggccagggttgctgcactgtttcggtccgttggctatcccgagccagtcgccgacgtgcttacaggattgtgtacaaactccgcaccacccgatgtctgggcagagggtcccacgtcaagagcagccgcccagcaaagacgcctgtactccgctcctcatctgccgcaaggggctcccacaagccctgcactagccaatctcatcgcctaccgccttgattgtcgactggcggccctcgcaaaatctgcaggtggcgtgtacactcggtacgcggacgacctggctttcagcggcggtcaggaattcctgcgcagtgtgcaccggtttcggacacacgcgtgtgccaccgccatggagcagggattctcagtcaaccaccataagacacgtgtcatgccctcttcccagcagcagcgcattgctgggctcgtggtgaatgagaggccagccgtttctagagtggagcgcggcagactgaaggccattctgagtaattgcatcaggcacggacctgaatcacagaaccgtgacggccacgcagattttagggcgtgccttcaaggccgcgttgcatgggtggaaatggcatgcccaccacagggcgcgaagctacgctctctcctggatttggtggactggactgccacgcggaaaagatga

SEQ ID NO: 12473 - RNA, 1323 nt, unidentified
  source 1..1323: mol_type = other RNA; note = synthetic construct
atggaaactgatattcaatcagtggctagagctctcgctgcagctttcgcagcagggccactgaccgctgacagattggtgggatgcggcgagaggacactgggtcgaaggtacagatggctgaggcctctggcctggagagttgaggccgaattcgcatacgggcctagacctcgggcagaccacatcgccgatttcctgctgctggacgagcggttccgagtgtacgcggcaaggcacgatgcagccgctgtctccagagtccatgacccagtggagttctgcccattcccggcagcacaagcttggcccgttgctcgactccgcacacctggacaacttgcgggctggttagacacaccacctcagcagctggcctggcttgctgacgtccgtggatgggaaaggcggaggaggagagggcccctacgccattatcattaccgggccctggctaagagattcggagccactagactcatcgaagcacctaaaccacggttgaaggccgtccagcgtcggctcctggctgagatcctgcaccatgttcctccccacgatgcagcccatgggtttcggcccggacgaagcattcggaccttcgccgcaccacactcaggccagcgtgtggtactcaaattagatctggaggacttttttccaagcacccccgctgcccaggtgaatgccctatttcgcagcctggggtatcccgaagccgtagccgatctgttgaccggtctatgcacaaacacggcgcccgcagccgtgttttctcccgacagtgcgcgtgattggagggccgctttacagcgcgcccggtatgcacagccccatcttccccaaggcgctccaacaagtccggctttggcaaacctgtgcgcttaccgcctcgattgtcgacttgccggattggcagcagccgccggaggtgtatatacccggtatgccgacgatctcgccttttcgggcggcgctgagtttgcgcgctctgttcaccgatttaggactcatgccgctgccatagcgctcgaagagggctacagagtcaaccaccacaaaacgcgcgtgatgccgaccgctcagcaacagaggatcgctggcctggtggtgaatgcccagcctgccgtttccagggctgagagagacaggctcaaggccgtgttgaccaactgtgtccgccacgggcctgcatcccagaatcacactgggcacactgacttccgcgcccatctgggcggtcggattgccttcgtggaaatggcctgtgccagacaggcggcgaagcttcgccgtgtctttgaacagatagagtggggctga

SEQ ID NO: 12474 - RNA, 1338 nt, unidentified
  source 1..1338: mol_type = other RNA; note = synthetic construct
atgaggccaggccacagcaccgcggtagccttagcaaccgcattcgtggccggcccgttagaagtggaccccctcgtggaccgaggagcacacgtgcttgggggtcgaccccgttggttacgtcctctcgcccgtagagtagcagcgagattcggggaccagacacgaccaagggtcactgctgtggcccgcttcctactggccgacagggcattgttacgggccgccctcacctgccaaatacagcctggcgctggtctggggcttactccagagatggcaccactaggccctgctgctcggtggagaacaccatcactgtgtaacaccagagagttggcggggtggctcggacttcccgttggagaactggagtggttcgctgatctgaggagcctggagtctcgccagagagaagggcccctgcggcattaccactaccgccctctcacgaaacgattcggccagactcggctgattgaggcacccaaacctaggctgaaagctatccagcgggtcatcctcgcagagctgctggaccacgtcccaccccatccttctgcccatggcttttgtcggggcgggtccgtgcgaacctttgctgcaccgcatgccggaaggcccgttgtgcttaagattgacctggaggacttttttccctcaatcgccgcagccagagttagggccttgctccgcgccataggatatcccgaacgcgtagctgatcttctggcagggctgtgcactaatgctgtgccgcctgatgtctggaaggaagccggagctcctgccacaggacatgctgaccgacagctgcggcggtatgcccaaccacatctaccccagggtgcacctacatcccctgcccttgcgaacttgtgcgcgtaccggctcgattgtaggttggctgggttggcagaagctgcggggggtgtttatactaggtatgccgatgacctggctttcagcggaggcgacgcttttgccaggtgcgtgggcaggtttcaaacacacgtctgtgcaaccgccatggaagagggatttgcagttaaccattacaagacgagagtgatgcgtaggggccaacgccagcagattgccggtctggtagtcaaccacagaccaggcgtcgcccgggatcagagagatcggctgagagctaccctgacaaattgtgtgcgccacggtccagccagtcaaaatcgcgaagcccacgctgatttccgggcccacctaaatggccgcgtggccttcgtggagatggttagtccggagcaggggcagcgcctcagaagacttttcgaagagatccgttgggaggcgggctgcggagtgtga

SEQ ID NO: 12475 - RNA, 1323 nt, unidentified
  source 1..1323: mol_type = other RNA; note = synthetic construct
atgccaacccccagaataacggcagacgctctggcggccgcatttttggccggggagatcgaaaaagaccagttgatagcccgtgcgtctaggatgctgggaagacgccctcgttggctagcccctcttgccaagcgcgtagccactgcatacggcaccagaacgaagccaaggcgcgcagctctggcgacctttctcttaggagatcccggctttcgcgccgctcttgctaagggcccactcagaatcgtggattggactaccgatgaaccggccatgaggcccacaactccagcggctgcgtgggttttgcctctgattggcaatatttcagaactcgccgcatggctgggcgtcagtctacatgagctggcatggttcgctgacatgcgctcatgggaggcaaaacggtcctctggggccctacgacactaccactatagaatcgagagtaaaaggttcgggcaggttaggttaatcgaggctcctaagtcccggcttaagacaatacagcggcggatcctggcagagctgctggaacccattcccttgcacgaagccacccacgggtttcgacggggtagatctattaaaagctttgcagtcccccatgtgggtcaggcagccgtgctcaaaatcgacctccaagacttcttcccttcaattgccgctgcccgggtgcaggctctgtttaggactgtgggatatcccgagccagtggcggatgctcttgctggcctgtgctgtaacgccacaccggcagatgtctggaacaggtccgaagccgacggagatgccgctcaacggcgacaaacccgttggctttatgagaagccacatcttccccagggagcacctacgagccctgccattgccaatctgtgcgcctaccgcctcgattgcaggctctcagcattggctgcttccgctagggccgcttacaccagatatgccgacgacctcgcctttagtgggggagccgacttcgcgagaagcgctggtagattcgagactcaggtgtgtgcaactgtaatggaggaaggatgggctgttcgccatcggaagacaaggttaatgcgacagggcgttcgtcagtcgctggcaggcatcaatgtcaataagcgactgaacctctgtcggcgcgacgtcgatcaactgaaggccacactgacaaactgcgtgaggatgggggccaccagccagaaccatgctgaccacgcagatttccgcagccacctggaaggtcgggtgtcttttgtggaattcatcaatccagagcgaggcgccaaactgagaagattgttcgagcggattgagtggtga

SEQ ID NO: 12476 - RNA, 1323 nt, unidentified
  source 1..1323: mol_type = other RNA; note = synthetic construct
atggccagcgagacaattgtcaggctattggcggcagcttgcctggccggcaaccttgaagttgacgaagtggtggatcggtgggggagggctatgggcaaaaggtggcgttggctgcgtcctcttgctaggcgcgtcctcgccgaatttgccggtgacgcacgggcaagagagtctgcagtagcgcggttcatagcctctgaccgagggtttagaagagccgcgttgacccacgatctgcgtgtcgcagaggtccttcatgcctctgggcctggaatgtcccccgtgagggctgctgaagtgtggcagctgcccccattacgaaccgcaggcgagctcgctcagtggctcggaatcgatacacgacagctggactggtttgctgaccgcaggagctttggcagtaagcggcatcagggccctctcaggcactatcattaccggacggtagcaaaaagattcggtcaagtgcgcctgattgaatcccccaagccgaggctgaagcagatccagcgtcgcatactcgccggaatcctcgatctgattccgacacaccccgccgttcacgggtttaggcggggaaggtcgattatgacatttgctcagcctcatgttggtcaacgaatcgtggtgcgcatcgatcttcaggacttctttcccactgttggcagggcctgggtgcaggcattgttccgcactgtaggctaccccgaagtggtcgccgatgtgctggcaggcgtctgtacccacgctacccctgcagatgcttgggaaagtgtggattccgagcacttcggccgccagcctgacagaatccaccggttgtactcaaggcctcatctaccgcaaggggccccaacgtccccagctcttgccaacctgtgcgcctatcgcctggactgtagactggccggtttagccagaagcgcgggagcgtcctacaccagatatgcagacgacctcgcctttagtgggcaagcagacttcgtgagagtggccccccgattctgtctgcacgttggagccactgctatggaggaaggattctctgtccaccatcgcaagacaagacggatgaggcagggggtgcggcagcatttagctggactcgtcgttaatgagcgcctgaacgtacgacgcaaggatttcgatctcttgaaagccaccttgactaactgcattagatcaggcccacagtcacagaaccggggtaatcaaagcaatttccgggcccacctagctgggcggcttagctttgtggagctggtgaatccagagaaaggccgtcgactgagagagctgttcgacagaatcccatggtga

SEQ ID NO: 12477 - RNA, 1323 nt, unidentified
  source 1..1323: mol_type = other RNA; note = synthetic construct
atgtctgacataactgtggcacaggccttgacaacggcgtttctgacaggagagcccgatttagatcagatcgtggataggtggagtgtgacactcggaaggcggtggagatggctccggcctttagccgtgagactcctggccaatttagacgaagccgatcaaagacgcgaagtagcagtcgcctggtttctcttccttgacagaggcttccagagggcctgcgactcccacgatctggatgtggctcagtggattcacatcacacgtcccccgatgaggcccatagcagcagcaagagactggcaggtgccgtcaatatgtacccccggcgaactcgctgattggctggacgtcgagccaaatcggctggagtggtacgccgacctacgtagcctggagtcgtattggcctcaaaataaactgcgccactatcattatcgcctgcttgagaaacgtttcgggcaggttcgcgtcatcgagtctccaaagccgcggttgaagcaaattcaaaggcaaatcctaaccggtattctggatcacattcccccccatcctgccgcgcatggattcaggcgcggctgttcaattagctcctttgcccggccacacgtgggcaaacggatcgttgtgagaattgacctgcaagatttttttccttccatcagccacctgcgaatcagggccctctttttgtccctgggctacccacagcaggttgctaaacgccttgcaggtctgtgcacaaatgtcgtgcctctcgacacttggctgggggattgtgggaacagatcaacgttcggacccagcggtgtccagagactgtattccacccctcatctgccacagggcgccccaacctctccagctcttgcaaacctctgtgcttttcggctggactgtcggcttgccgccttggctaactctgcaggggctacctacactcgctacgctgacgacctagctttcagtggtgaacgggacttcgaacgagttgctcataggttccacctccacgtgtgcgcagctgtaatggaggagggcttccgcgtccaccatcacaagaccagacggatgaggcgaggagttcgtcagcacctggcgggcttagtagtgaatgagagattgaacgtctgcaggcaggacttcgatcgactgaaggctatcctgactaactgcatcagacacggccctcagagtcagaaccggatggcgcatcccgattttcgcgggcatctcgccgggcgaataggattttttgaaagcgtgaatgccgcgaaggcaaggcgcttgcgagcccttttcgaccagattgcctggtga

SEQ ID NO: 12478 - RNA, 1323 nt, unidentified
  source 1..1323: mol_type = other RNA; note = synthetic construct
atggactcttatgccaccatagccgacgctctcgcaactgcctttttggccggcgacatcgagacagacgagttggttgatcgaggctcacttctgttcaacagaaggtggaggtggattcgtccactcgcacggcgggtcgttgagacttttgcggccggcgtaagaccccgacagactagcgtcgtagaatttattctggcagatcggggtttctttcgcgcttgccagaagcacgaccttcgcctcgctaataggctggtggcgccaccaatgatgcgacctgtgattgcggctgccagttggcgtgtggccagtattagaactccacgcgaactggcagattggctgggggtgagcttcggggagctgtcctggtttgctgacctccgaggtctggaacacaagcggaaccatggacggctacgccactatcactaccgccctttggctaagcggttcggccaggttagactgattgagagtccgaaacctagactcaggcagatccagaggcgtgtgctgaccgacatcttagaccacatccctcttcatgacgccgtgcacggatttaggaggggacgctcgattaaaacgttcgcagccccccacgtgggacgtagagttgtactcaagatagacctgcaggattttttccccagcatcagcgcagccaggatccaggccatcttcagaacaatagggtaccccgaagaggtagcagaccttctggccggtctgtgtatgaattccgctccgaccgacgaatgggaccacgagttttcaggatcttcagggagacaggtcaggcagttccgctggctgtactcccaaccccatctgccacagggcgctcccacaagccctgcattggctaatctctctgcctaccacttggattgccggttaaccggactatcccggtctgccgccgcgacttatacccgctatgctgatgatctcgcatttagtggggcgcgggattttgagagagtggccatgagattccacaaccatgtgtgcgccaccgtcatggaggaacgatttacggttcatcatcggaaaaccagaatcatgcggcagggcgtgcgtcaaaggcttgctggactggtcgtcaacgaaagagtcaacgtgccacgggtggatttcgatcgactgaaagcaacactgacaaattgtatccgccaaggccctcagtcccaaaacaggcagggccatcttgactacaggggccacctccaaggtcgcatatcattcgtggagatggtgaatcccagcaaggggcatcgactacgcgctttattcgatcagattgattggtga

SEQ ID NO: 12479 - RNA, 1335 nt, unidentified
  source 1..1335: mol_type = other RNA; note = synthetic construct
atgaatttttgcaacgtaactgctagagctctctcagcagcctttttggccggcgactttgatgtcgacggtcttgtggtacgtggatcaagagtcctgggaaagagacggcgctggttgaggcccttggcacgacgagcagtggagacgttcgccggacgaccaagaccacgcagggtcacccttgcggagttcattcttggtgatcctggctttctgcaggcatctcgacgacacggtctacggccagctacactgcctactgcaccctctatcatgtgccccgtgggcgccgctgaatcttggcaaattcccagcatccgcagtgctggagaattggccgattggctcggggtcaccattggcgagctcgagtggttcgccgataggagatccctggaatataagtggaatcatgggaggctgaggcattatcactaccggcctttgacaaaaaggtccgggcaggttcggatggtggaggcaccaaaaccaagactgaaggccatccagagacgtatcctggctggaattcttgaccacatccctctgcatgatgctgctcatggtttcaggcgcggacggagcataaacacctttgcatctcctcacgccgggaagagggtggtgctcaagatcgaccttcacgatttctttccctccatcaggctagcccgcattcaggcgctgtttcggactattggctacccggaagaggtagctgacctgcttgcaggcctgtgtaccaatgccacaccgcccgacgtttgggaagccgacacgatcagactggccgggggccaattgcaggaggcgtgttggctgtactcccagccacatctccctcagggtgctcccacaagccctgccttagccaatttatgcgcataccggctagattgtcgcttacatgggctggcacagagtgcgcacgctgtgtataccaggtatgccgacgatctcgcgtttagcggcgacagagacttcgagcgggcagctaaaagattccacctgcacgtgtgcgccactgttatggaggagggattcagtgttcaccatcgtaaaacccgcataatgcgtcagggggtgaggcaacggctcactggactggtcgttaacgaacgcctgaacgtgagccgcagacagttcgactgcctcaaggccacactgaccaactgtatccgcttcggcccacagtcccaaaatcgttcaggccacggcgaataccgggcccatctcgatggtcggatatcgtttgtggagacaatcaaccccgccagggggcaccgcttaagagaactgttcgatcgaattgaatggcctgagcgggactga

SEQ ID NO: 12480 - RNA, 1323 nt, unidentified
  source 1..1323: mol_type = other RNA; note = synthetic construct
atgagcactcgtaatcataccgccaacgctcttgctcgcatcttcttagcggggaaatttgagtcagacgagatggtagagagggcctcacacctacttgcgaagaggtggagatggctcaggccgttggcccgacgagtagtagccgcttacgatggcaaacccctgccgcgatccatcgctctgaccaagtttattttgtccgacctgggcttctcccgggcgcttgaaaaacatgaagtgcacgttgtgcacccacttataaacgtcccaacaatgaacccaattgctgtggccaacacttggcgactcccctccatctgcaccatcaaagaattggccgatctactgtctataactgtgtctgaactgaactggttcgcagatcttaagctgttcgagtataagcgcaataggggcgctctgcggcattaccgttataggccagtcacaaaacgctttggaagaatacgcctgattgaggctcctaagccccggctgaaggtgatccagactctcattttatcaaccatcctgaataatgtgcctccccacaccgccgcccacggatttagaagggggcggagcatcaagacctttgcagagcctcacacggacaagatggccgtgctcaagattgacttaagcgattttttccccagcatcagtattgctcgcgtgcaaagtctcttccgcgccctgggctatccagagttggtcgctgacacactggcaggcttgtgtagcaacgcaacccctctggatgtatgggacagtcccaaagttgactctccggccaaaaacatcaggcaggtcagatggctctacgctaatcctcatctacctcagggagcaccaacgtcgcctacactggcgaatttatgtgcataccggcttgattgtaggctgagcgccctcgccgaatctgtcggtgcagtctacactagatacgccgacgatctcgcattttccggggatgactcttttgcacgtgtggccaagcggttccaaattcatgtgtgcgcaactgcgatggaggaggggtttagagttcatcacagaaagacacgtatcatgcgaaggggtgtgcggcagaggattgctggactggtggttaacaaacatctgaacttggccagaaatgatatagatcgcctgaaagctattctgaccaactgcatccggttcggtgcccacacacagaatcgcagtgagcaagacgacttcagagcacacctctatgggcgggtggccttcgtcgaatccatcaatccccgcaagggctcaaagctcagacagctactggaacaggttgaatggtga

SEQ ID NO: 12481 - RNA, 1380 nt, unidentified
  source 1..1380: mol_type = other RNA; note = synthetic construct
atgtctctgcgggccagactggaaagtctcggctattcagcagcttgtctcattgcgatgtcgtcacccaagcgaattgctgaacctttggccgcagcctttctggccgggccattagaagtcgaggggatggttgcccggggtagccagttacttggcaagcgctggaggtggctttctcccctcgccaagagaatgcaccgctactttggggggacaactcggccacgtcaggctagattaataaatgtcatgctctgtgatgaggggttctatcgcgcgtgcactaagtacgagctgcagctcgtcgaccttcaggcatgccaacccgccatggcaccctctttggccgccttgagctggaacgtaccggcgttgtgcacaaccaaacagctcgccgattggctgggactggccgtgtctgagctggaatggttcgcagatatgaggaggtgggagacaaaacccgcctctatgcagactcaacactatcgctacagagtgctgtccaaaagaaatggccggctgcggcttattgaagcgcccaaaagcaggctcaatatgctgcagcgacagatcctgacacacctccttgaccgattccccgtccattccgcagtgcacggatttcggcagggaaggtcaatcagaacgttcgccgttcctcatatccaccgtccggtggtgctgaaactggatctgagggatttttttccaaccatacggattgcacaattatccgcactgttcaggacggcaggttatcctgagcgggtggccgatctactggccggtatctgcactaacactacgcctaccgaggtttgggacgacgaaggcctggctgcttccccaagcgagattaggcgaatgagaatgctctacgagcagccccatttacctcagggggctccaaccagcccaaccttggctaatttgtgtgcctacagactggactgtagactggctggccttgccgaagcgagtgggggtgtatacactcgctatgccgacgatctagcctttagtggcgacgagaggttcgccaggacagcagaaagattcgctatccacgttatggctaccgtcatggaagagggattcgaggtccatccgcgcaaaacccggctaatgaggcctggcgtatgccaacgcctaacaggcctcgtggtgaaccagcatctgaatatcgctcgtagcgaccgggatcggttgaaggctatactgaccaactgtgtgcgacacggccctgcaacccagaaccacgagggacatcgagactttagatgccaccttcgtggacgcgtggcttttgtggaatccatcaacccaacatggggcaagaagctccgcggactgttcgaccaaattgtttggtga

SEQ ID NO: 12482 - RNA, 1314 nt, unidentified
  source 1..1314: mol_type = other RNA; note = synthetic construct
atgtgttcatacgtgtctatcgcacggaatttggcagcctccttcgtggctggccagtttgagtcagatgccatagtcgaaagaggtgcgcaacttctcggaagacgttggagatggctcaggccactcgccatccgcgtgatcgagaagttttccaaaggccctaggccctcccacgcttctgtcgtccagttcattctgagggatcacggtttcatccgggcctacgagaagcataatctgcaactcatcgacttgattggtgaagccaccgagatgagtcctattaagaaagcacaaccttggacagttcctataatcaataatattgccgagctggcagattggcttgggataacaatgggccacctggagtggttcgccgacctgaattctctagaatacaaatgcaaccgcgggcgacttagacattaccactatagaccgttggccaagcggttcggctcggttcgccttatcgaggcgccaaaagcgcggctgaaagagatccagagaaaaattctgagcgggctgttggaccagattcccgctcatgaggctgctcacggattccaacgcaaacgaagcgtgaagacttttgccgcttgccacgtgggcaagtcagtggtgttgagaatggatctgcatgactttttcccctccatcactttaagccgcgtacgggccgtttttcgtagtacggggtatcatgaaagtgtgtctgatctgctggccgggttatgtactaactgcgcccctctcgatgtctgggaaaatctggtaccttcaggccccggccgacagtcgatcatgttatacagccagccccaccttccacagggagcaccaaccagcccagctctagccaaccttatcgcttatcggttggattgtcgactgtctgccctagcacactccgcaggagcagtttatacccgatacgccgacgactgtgctttctctgggggtcccgagttctttaggatagtgaagaggtttgcttgccacgtaggcgccgtcgtgatggatgaggggttttccgtgaacttcagaaaaacccggattatgagagaaggagtgcggcagaagctcgcgggactcgttgtcaatgaaaagacaaactttccacgtgcagactatgaccgcctgaaagccaccctcgtcaacagcattaagcatggcccggaaagtcagaacaggacacagcacagggactttagggctcatctgctcggtcgcatcagcttcattgagatgctgaaccccaatcgcggccggaagctgaggcagctgttccagggaatagcatggtga

SEQ ID NO: 12483 - RNA, 1134 nt, unidentified
  source 1..1134: mol_type = other RNA; note = synthetic construct
atggcaaggtttattctcagcgatagaggctttctgcgggcttatgagcgccacaatttgcaactggttgaactcctcacaactgcaccagtcatgcttcccctgcctactgctgaagggtgggaggtaccacagttacctgaagtgaacgaccttgctgattggcttggagtcagtttggccaccttacactggcttgcggacacaaggtgtctcgagtccaagtggaatagggggaagctgcggaattattactaccgccccctagctaaaaagcagggaactatacggctcatagaggtcccaaaaccgagactaaagggatgtcaaagacaaatcctgacaggtatcctcgatcatatccctccccatgacgctgcacacggcttttgccggggccgttctatcaaaagcttcgctgacaagcacgtcggtaagcaggtggtgctgcgactggatctgcaggactttttcccatctgttcacggaggccgcgtgcaggccgttttcagaagcctggggttccccgcatcagttgccgacttgctggccggcatttgcacgaactcgacccctcgcgatatctgggaatcattgcaatttccgcagcctcagctgcgactgacccaatggcagtacgataacgtccaccttccacagggtgccccaacatcccccgcactggcaaacctgtgcgcctaccgcctcgactgtagactgagcgctttggcgaggaccgtgggagccgattacacacggtatgccgacgacctggcgttctcaggcggacaggacttctctagagccgtacggaggtttcatgtgcatgcatccgcaattgccatggacgaggggtttcatgtgcatttccgaaaaaccaggattatgagacggagtgccaggcagcgtttggccggtcttgtggtaaaccagcacgctaatattagcagggctgagtatgatcgcctcaaagccactctgcacaattgcgtgcgctctggccccagtgatcagaaccgaaccggccatacggatttccgggcttacttaaatgggcgaatctccttcatagaaatggtgaaccctgcgcgtggggcccacctaaggagactctttgacagaatcccctggtga

SEQ ID NO: 12484 - RNA, 1365 nt, unidentified
  source 1..1365: mol_type = other RNA; note = synthetic construct
atgacccatgctaggccagatagcctgggggtcctcgaccgtttcccgatgactcattctgaccagaccatcgcaagattccttgccgcagcctttgttgcggggccccttgtcgccgacgaaatggctactcggggggcaaggatgctgggacgtaggtggcggtggttgactaggctcgctctgagggtaagcgaagagtttcagcatggccctcgccctagaagagctacagttgaagaattcttgttgggtgactcagtttttcacaaggcctgtgagcgccacgaattggagattgccaattactccattaccgcacaaatgtgccctgtggatgctgcaagaaactggcccgttcccccactttgtaccttcgcggatactgccgactggctgaacgtgcggtccagggagctggagtggttcgcagacttgaggggccttgctgctcgcgcctctcatcagaagcttcggcactaccactaccggacactgtccaagcgcttcggtcaggtccggctgatagaggctccgaagttacgattaaaagagatccagagacagatcctgcgggaaatactggatgccatccctgcgcataatgcagcccacggcttttgtgctggccgctctatcaagaccttcgcagcaggccacgtggctacgtcggtcgtactcaggatggatctgcgagatttctttccaagcattagtcgagcgcaagtcgaggccgtgttcagatccgtagggtatgctgagagcgtggcgaatgttctggccggcctctgcacaaattgcgcccccgatgatatctgggacggagtggaggtccctgtgcagcagctgcgaagtgtgatagcccgctatgccagaccacacctaccacaaggagctcctacaagtcccgcactcgcaaacctctgcgcctatcgcatcgactgtcggctagccggcctagcagaatcagccggggccacttatacgagatacgctgacgaccttgcgtttagcggaggtgacgaatttcggcgttcagccaaaagatttagccagcacgcatcagccatcgtgatggatgagggtttcgacgtgaaccaccgcaagacaaggattatgcagagtggagctagacaacggctcgccggcatcgtggtgaacgcccataccaatgtgccgaggaaagattacgaccgactgaaagctattctcgttaactgcctgaggtctgggccccagtcccagaatcgtgatcaacacgccgattttagggctcatctgaacggccgcgtcgcctacgtggagctgattaatccacccagaggaaaaaagttacgcgaactgttccggcgaattgactggtga

SEQ ID NO: 12485 - RNA, 1323 nt, unidentified
  source 1..1323: mol_type = other RNA; note = synthetic construct
atgaatgaggcggcaatcgccaaagcgttagctaccgctttcttggcagacactatgactattaccgctatggaagctcggggcagccatgttcttggccaatcttgtgattggattagaccactagccgcccggatcatggctgcctttcccggaggtgtgaggccacgtcgtcagagggttgtggagatcatacggcagtcacgtgctttcctgctcgcctgcgaagagcatgactttcatgcactgaatcccacgttgctcccaaccaaaatgcaccccgcacagtcgatccggacctggaatgtgccttccataacgagcactgatgccctggcaagatggctggggatttccccagcacagctcgattggttctcaggccgcttccgcaggtcagcatctgtgcgtattgggagtctgggccattatagataccggcttttacagaagtcatccgggcaagtgaggctgattgaaattcccaagtggagactcgccgaactgcagcgccaaattttgacacgaattctgaaccacatccctcctcacgccgctgcccatggctttcgccagcagcactccatccacaccttcgtcgcccctcataccggccaggcaatggtcgctcgaattgacctccaagactttttcccctctatcacacttccgagggtggcggccgtgtttagaacggtcggttaccctgaggctgtagcagacgcattagccgggctgtgctgtcaccaagtcccggaccacgtttggcactcggaagcggggaatctgggtactagcagccgcaaccagctcagactgctgtatcgacagccacacttgccacagggcacacccacctctccagcgatcgccaacctgtgtgcttaccgcctggattgccgacttaccggtctagcccagagtgcccgcgccacttacacacggtatgcagacgatctcgctttctctggagatgacgaatttaggcggagcgccaaatccttcgtactgcacgcctgcgcgtgcgtaatggaggagggatttacagtgcacttcagaaaaacccggataatgcctgccgctgcccgacagagactagctgggctcgtggttaacggcaagactaacgtccccagagaggacttcgataggctgaaggctatactgacaaattgtatcaggtccggacccgatagccagaaccgcgaacagcatgtcaattttcaagcagtgcttagcggaagaatcagtttcgtggagcatatcaaccctagtaggggaaggaagttgcggacactttttgagcagatcgtgtgggcctga

SEQ ID NO: 12486 - RNA, 1380 nt, unidentified
  source 1..1380: mol_type = other RNA; note = synthetic construct
atgcagtccaacagggtgttgattcgcaccatcgctattaccttacttagaggagactggcaagttgaagcgatggctatcaggaccgccaagctgctgggcaagcgctaccggtggatatctccactgatcaagagactagaccagcagttcggcagtagcagaaggcctaagcagagcgagctgattgactttcttcggctcgaccgcggcttgtgcagagccttggaaaaacacgaaccagagatctttgactggcttcaagaggccgacgtgatgcagcctattccaagtgccgaagcatggcagatccccagtattaccacagaaggggagctggctgagtttctgggggccgcaacgtcggacttaatctggctcgctgacgaaaagtcactgcactccaaaaatactaaaaagtactcagggcactaccatcatcacctggtaaacaaaaaaaactctgttctccacttctgtaaccctcatgatctggatgctatcgccaatcggctcagaatccctagcgagagcatcaggctgatcgaggctcccaagcgccggttaaaaagcatacagcggaacgtgctaaacgggatactggatagggtcccccctcacaggtcgtgctgcggttttaggcagggggagtccattgttgattattcacgccctcacgtgggcaaatcaatcgtgcttaagatggaccttagaaatttttacccgacaattacgctgaaccgcattatctctatctacacatctttgggttttccggagactgtctccaggttacttgcacatctgtcaactaccgtaaccccccccgaaatatggcgtaatcataagggtgcatcccagctgcgatatctggagtccctgtatacttgccggcacctaccacaaggagccccatcctccccagcgctcgcaaatctggtggcattcagattggattgtcgactcgaaggcctggccaaacatgtgggggccgattatacacggtacgccgacgacctcgcttttagtggaggagatgaattccgtaggattgccaagcgcttcagcacttctgtgagtgccatagtaatggaggagggcttcggagttaatttcagaaagacaagaattatgcccgcggcttctcgtcaacgactggtcggcctggtggtcaatcatgggttgaacgtgcagaggcaggaatacgatcggctcaaggctatcctgaccaattgtatccgacacggtcccgaatctcagaaccgggataaccacccgagctttcgacgttatctcgagggaaaaatcgccttcgtcagcatgattaacatagagaagggcaataaattgctcggccttttccgcgcaattagctggtga

SEQ ID NO: 12487 - RNA, 1131 nt, unidentified
  source 1..1131: mol_type = other RNA; note = synthetic construct
atggcgaaccagtccggacctcaggacagagatcgcgtaaaaccacgtgtcgtttcatggaggccccggggcacagaaatgcgtccagtaagtgccgcttctcagtggcatgtccctgaaatcaggacaccgagagagctggcagcgtggttaaatgtgagctttaagcagctggactggctggctgatattagatcactcgaatatactccgggcagaggacggtcccgccattactgttatagagtgttgtctaagcggtttggcgccgtgcggttgatcgaggctcccaaatcccgcctaaaagccatacagcgacagataagcagtgagatcctgtcacagatccccgtgcatgagtcggtgcacgggttccggaggggtaagagcattaacacttttgccgcccctcatgttgggcgagcatgcgtcaccaaaattgacttggaagacttcttcccaactgtcacgcgaagttgggtgagagggatctttcaaagcgcaggctaccctgacgccgtctctgttcttctagctggactgtgcaccaattctgcacctcacgacgtgtggcaggacatgcgggagcaactgccaaggcaacgactgcgctacatcgaagccctgtacgccacaccacatctccctcagggtgcccctagcagccccacactcgctaatctcgcggctttccgcttagattgtaggctgtccgggctcgcccgaaaaatggagctcacttatacccggtatgccgacgaccttgccttttcaagtgatagccccgcgactcgggatattcacagacgcctgccctatatctacgctattgtgatggaggaaggtttcagaattcacttcaggaagacgagggtaatgccctccgcaggacgtcagtttttgaccggccttgtggttaacgatcggcttaatatcaccaggacagactacgatgttctgaaggcaatcttaaccaactgcgtcaggcacgggccagatggacagaacagggatcgccgcaacgacttccgtgctcacctctccggccggatagcatttgtggaatctgtgcaccccgagcgcggcaataagctgagacagctgttcgagagaattcaatggccaacctga

SEQ ID NO: 12488 - RNA, 1332 nt, unidentified
  source 1..1332: mol_type = other RNA; note = synthetic construct
atgcataccatccagttctatgctatcaacttagcgggcgtatttgtagacggcccatttgatgtggacgccctggtcgagcgaggcagccaaattctctccaaacgcggacgctggctgcggcctcttgccaaaagattagccaagacatttggagacaggattagaccacgtaaatccgatgttgtgtcctttctcctagctgatcaggggttccgaaatgcttaccagaatgggagatttaaatttagcagcctgctgcgcccagcaccagaaatggtcgctcctgccgttacaaccacctggcaagcccccctcaatctgaggactcctcaggatctctcacactggctggatcttaaacccggggagctcgcatggttctctgatcggaggcagctggaagcaaagcaaaacaagcccaaacttcaacactaccggtacagactgctgcccaaacggccaggagagttccgcctcatcgaagcacctaagccccgattgaagaccatccagagaaggattctgaaggatatactgaaccacctccccccacatgacgcgtcacatggtttccgttgtggaagatctatctcctcttttgcacgtccgcatattggccgggaggtggtgttgaaaatggatttgcaggactttttcccttctatcagggccgcccaggtgcaggcaattttcagaagtctgggatatccagattgtgtggccgaccttctcactggattgtgcacaaacagtgcgcctactgagatatggaacgcattagaccacgctcctcctgccaagatccagtacaagatccggcgatatgccagaccccacctaccccaaggtgctccgacgagccctgtccttgctaacctctgcgcctttcggatggacagtcgacttgctgggctggccaggaagatgaacgcctctttcacccgctatgctgatgacctagccttcagcggcgactgtgaattcgctagaatatgcaggcggttctcagtacatgtggcggctattgcaatggaggaaggttacacggtgcactaccgcaaaactaagataatgcgaaaaggcgtgcggcagcggattgcaggcatcgttgtcaataagaggccaaatatcctgaggaaggactatgacagactgaaggccattctgtcaaattgcgttcgcacaggtcccgcctcccagaatcgcgaagggcatgacgacttccagagccacttggcaggcagggtgtcgtttgtggagatgatccacccggatcgcgggcgtaagttgagggccattctggagcagatcgattggaccgtcagttga

SEQ ID NO: 12489 - RNA, 1329 nt, unidentified
  source 1..1329: mol_type = other RNA; note = synthetic construct
atgcatagtgtgacacatagcgcaaatatattggccaccgcctttgccgctggtaggtttgatcctgaggagctagtgcagagggggagccaagtagtggcatcacggggccgatggttgaggccactggctgtgagacttgcggaggcgttcgccggaaaaattcacccacgaaagagcaccatcgttgcatttttggtggccgatgccggattttgtcgcgcctatcacaatgaccgtgtgcagatcgcgaacctcttaggccccattcccgaaatgatccctactgccacagcggctaactggcaaggttgtcttgccctgcccacgcctcacgatgtaagtagatggctaaatcttgctcctggggagctggactggttcgctgacagaaggcgaatggcccacgcccagtctaaccccaagctgcagcactaccgctaccggttactgcagaagcgcccgggcgagtaccgtctgattgaggcccctaaacccaggttgaaagcaatccagcggcgcattctcagtgacattctcaaccacgtgcctccccatgaagccgcccatggatttagacgtgggcggtctatcacctccttcgctgctccacacgtgggcaaacaggtagttcttaagatggatctccaggacttcttcccgtctacccgggcagcacagatccaatccatattccgttttcttggatatccagacacggttgccgacctgctcaccggcctgtgcacaacttcggcaccccaggatatttggcccactgctgcgccaaggcctgctcaaccaacccagagacagatgaggcgctacgcggagcctcatctgccgcaaggagctcctacatcacccgtcttggccaacctctgcgcctataggatggacctccgattctctggtctggcatccactgtgaacgcttcctacaccagatacgctgacgatatggccttttccgggaatcaagatttcgccagagtctgccagcgctttagtactcaggcagccgcaatagcaatcgacgagggctataccgtccattttcgaaagacaagaatcatgaaacagggcgcctgtcagagggtggctggaatggtcatcaacagaagactgaatatctcacgcaaggactatgatcggctgaaagcagtgctgacaaattgcgctcgacacgggccagatagccagaaccatgatgcccacaatgacttccggtcacacctggaagggcgcgtcagcttcgttgaacagattaatccagaaaggggccgccggctgcgggctttactagaacggatagattggagcaagtga

SEQ ID NO: 12490 - RNA, 1398 nt, unidentified
  source 1..1398: mol_type = other RNA; note = synthetic construct
atgattccccatgccgagagggactcactagtcatcccaccatcaaccttcttcttaatgcgtacgtccaagaagaccctggcagcagcacttgcgacggcctttgtggctgggagcttcgaagtagacgatttggtggaacggggctacggagtgattgggaaaaagcccagatggatgcaaccgctggcagagcgcctacatgccgcattcccatgggatatgaggccccgaagggcttctgtggagaggttcctgctgtttgattacggcttccatcgggcctacagacgctccaaactgactgtggcatctaggatcggttcaagtcccgtaatgaatcagggcgttgtcgccagtgggtggaaagcaatccgccccctgacaactccagctgagctggccgactggctggatgtgcctctgagacagctcgactggtttgctggggtgggcccttataaacgggtccccacggagatgaagcttcagcactacagataccgggtgttaaaaaaggttgacggcaacgtaaggctcttggaggctcctaaggcgcgtcttaaaaggatgcagcaaaagattctcacagaaattctgaaccatgtgcctccgcacgctacttgtcacgggttcagacggggcaggtctatcaccacattcgcaaagcctcaccaaggccaggccgtggtcgtcaaactggacctgcgtgactttttcccctccattagagccgctcagatacacgccctttttttgtatttaggctatcctgagcccgtcgcccacctcctgacaggactgtgcacaacctcggccccagaaaccgtctggcgagaaatcggagcgagccctagaaacaatctcacccaggaacaaattagacgctatgctcgcccgcatttaccccaaggagcgcctacaagcccagcgctcgcaaatctgtgcgcttaccgactcgactatcgactgtccggacttgccttggctgccggtgcgacctatactcggtacgccgatgacctcgctttctctggagatgctgtgtttcggcgagcagcacagaggtttgtggtgcacgctaccgcaatcgtactagaggaaggttaccaggttcatcaccgaaagactcgcgttatgaggcagtccgtgcgccagaaaatcgccggattggtggtgaatcaacaggccaacgttcctagaaaggactttgataggcttaaggccactctgaccaattgtgtccgtcatggcccagagagccagaatcgggccgatcacgccaactttcggttgcacctccgcggtcgcattgcttttgttgaatcaatcaaccagaaacggggggagcagctgagaagtatattcgcccagataacatggccacagagcgcctga

SEQ ID NO: 12491 - RNA, 1314 nt, unidentified
  source 1..1314: mol_type = other RNA; note = synthetic construct
atgcactccaggaagctgctcgctgccactctggcgtccgccttcgtaggtggacccgtggagacagatgcgctggtggagcatgtgagagtattgctgctggacaaacggaagcaaaggtggctgaagcctcttgttaaaaggtttgtgcaggcttcaagtgtggggccaaggcccaggcaacctcaggtggaggcattcctgctggctgactacgggttcctgaaagcatatcacaagaatcacattcgcttatcaggggcgttggccccctcacccgtaatgagctccacaatagaaagcattacgtccagcgatcgcatctctcttattactcctgccgagttagctagatggctcgacctgccaattagagagctcgactggttcgcagaccgccgtggttgggaggctaaacatgcaaacgcaaagctgcagcactatagatacctgacctttgccaagccctcaggcgagactagactcgtcgaagcccctaaaagcagactaaagggcatccagcggcgtattaatactgacatcttgaatcatgtacggcctcacgaagcggctcatggctttagagctggacactctgtgcgtagtttcgccgaaccacacgtcgggaaacgagtggtgctgaagctagacttacggaatttttttccctctataagggccgcccaaattcatgccatctttagaagcatcggatatcccgatgcagtcgccagtttgctcaccggcctttgcacaaacaccaccccaagcgaaatatgggaggaaagacttcctcttgccctcgacttccctatgtatgaacgcccccatctgcctcagggcgctccaacatctccggccttggctaacctggcagcctatcgactggatgcccgactcggagggttggctaaaagtgctggcgccaactacaccaggtacgccgatgatctggccttttccggtaatacgccattcgaacgggtcgtccgacgctttgctgatcacgtcgcagcgaccgttatggaggaaggtttcttcgtgcatcaccggaagactcgaatcatgccgcaaggggttcgccagaggatagcaggagtcatcgtgaacgagcatctcaatgtggacagacggacatacgaccggctaaaggcagtgctcaccaattgtatccggcttggcccggattcgcagaacgtggatgcacacgagcactaccgccatcacctggagggacaggttagctgggttgaatccatcaacccacagcgtggccagaggctgcgcgagttatctaacaggattatgtggtga

SEQ ID NO: 12492 - RNA, 1341 nt, unidentified
  source 1..1341: mol_type = other RNA; note = synthetic construct
atgctgaatgaccctgagtcccccactaaacgctggcaaatgctcgccgatatactccttcactgtcggtggaccagcgccgatcatctcgccttggggatgggcgcgatcaaaagacagcctaacgctgtgaggaatatgatcgccgcgattcaccaggccttcccatgggtgccatcgagaactcagctcgtgaccttcctggccagtcgatcagaccttttaaaggggttgcgctggaagagactgccagacatccaatgtcagcggaggctgtaccctacaacgatgcagccgactaggtttgcacagcagacatgggaaccaccacccctgcccaccctgggatctgtggctgacgatcttctgcgcctccccgcaagcctggttgaatggttgagtaatcctcgggtacagcactatgtcgtcagtgttatcgccaagcgaggttctgcagggtccgcaggtaccggtgcagcgactggaaggattcttgaacagccaaaaaggttgctgaaggccgcccagcgggacattctgcgcgagattttaagggacgtcccagcacaccccgctgctcatggctttgtcccgcaccggtctgtggttacatttgctaaacctcataccggacgcccagtagtggtgcgcatggacctggcaaacttctttacaagcatccctgctgccagggtgaacgccgtgttcaggagcctgggatatcctctgcccgttgcccatcagttaacaaatctatgcactacggcctgcaaattggacgctgtcgagggcttagccgactattccgccgcggagcgagttcgcttggagaacctctacggtcggcctcatcttccccaaggcgcacccacttctccagccctagccaacctggtggcctatagactcgatgcacgtctctcaggcctcgcaagaagagtggggtgtgagtacacacggtacgctgatgacctgctgttctcaggggataggcgcctactgcgacaggctcagtcccttgtcgtgcaagtaagcgcgatagcactggatgagggattccaggtccagcaccgtaagacccgaattatgacacaggccgtgctccaagcagctgctggcgtggtactgaaccagcacactaatatcgatcggagggattacgacaacctgaaggctaccttgaccaactgcgttcggcacggccctgctacgcaaaatcatctgcaacatccgaattaccgtgaacatctacttggcagaatcggatgggtgcaccacctcaaccccaccagagggtccaagctgatgcgtatttttgaaagaatacagtggcccaattga

SEQ ID NO: 12493 - RNA, 1335 nt, unidentified
  source 1..1335: mol_type = other RNA; note = synthetic construct
atgcagacaccccacaccgtagctgaaacactcgccgaagcattcctgcaaggcgagttcgccaccgaatccttggttcagaggggtgcacaggctctacagggcactccaccaagatggctaagaagattggcctctagggcggtgcaaacatacggtctggggccacgaccagcgttacctgccctctcaagattcatcgcacacgatgccgctttccagtcggctatgcgtggaaggaggcccgtcgtagccagagcatggctctgtgtccccgaaatgtttcctatcgcagctgcgagatcttgggaggtacccccgctgtgtactctgggcagcctggctgaatggcttgacgttcctgtcggacgccttgatgcactgagtgatgtgaaatcacttgagcgcctgcaccctcgggaaagcctgagaaactaccgctacagggtgctttccaaaggcggcgggcgtgtgcggttaattgaagcccctaagcctctccttcgggccatccagcgacaaattctcgccgagattctgcgggctgcccctgttcacgacagtgcacacggtttttgccatgggcggtcaaccaagacattcgcgacccctcatgtggatcagagtgtggtcatctcactcgacctcaaggagttttttccctccatcagcgccgcacgtgtggacgcactgttccggtccctcggatacccagcacgagttgccgccgctcttaccgccctgtgcgtcaactgtaccccgagctgggtatggaaaaagctgtctggggatgccctgactaggagacgaattgaattggagcggctctatggctttgcccatctgccacaaggggcccccacttctccagctctggccaatctgtgtgcttacaggctggactgccggctagccggcttagcagccgtttgcggcggaaactatacccggtacgctgacgacctcgcctttagcggtggagagagattgcgccgttctgcggccaggtttcaggtccacgcctccgcaattgtgatggaggaggggttcaaagtcaatcatcgcaaaactaggatcatgagccaaggcgcttgccagaagttggctggagtggtggtgaatcgcacaacgtctctaccgagacgagacgtggatcagttgaaggctatcctgacgaattgtgtgcgctttggccccacaagtcagaacagggagggacatgctgattatcgagggcacttacgggggcgcgtggcgtatgttcagttcctgcaccccggacgcggtgctaagctgagagccatattcgagcagatagactggaacgcatcctga

SEQ ID NO: 12494 - RNA, 1392 nt, unidentified
  source 1..1392: mol_type = other RNA; note = synthetic construct
atgccagatgatcttgcagcagcacggcgccttgccttggcctttctcaccgcagagtggaacccacagtctatggcagaacacggcaggcgcgtattagggcttaagggcagccctaaatggatcctccggctggcggagcaggtctgtaggcagtatccagcagcccctcctcccacgcagctagagctgtctcgcctcctggccacttcaggcagactgcgccaggccattagacggagggaacagtccaaccagccactggacagcgggacactgctgctcccacctatgcccatgcgccctgtggtgggcttaccagcgggatgggaactaccgaacttaactagtgccggccagttggccgcttggctcgatataacccctgacgaactagactggttcgctgacgtgagaaggctgcaacgagataggccaccgggacccgccagacactaccagtacagatggatcccaaaggcgggaggacgccaacggctcctggaatcccccaaaccgagattgaaacaggtccagcgaagcctgctgcatggcctgcttgatcgaatccccccgcatcctgctgcatgcgcttttagaaggggccactcccttgcttccttcctcgcccctcatgccggacgcaggattctgctgcacgttgacctgcgccatttttttcccagtatctcatcagcgcgggtacacgctttgttccggaccgtggggtatccagaggccatggctaggtctttgacaggtctatgcacaacttctacgccaaggcaggagttagaccgccctcaggatcgtgaggccgaagctgccttgcacagactgtatggttcgccccacctgcctcaaggtgcacccacaagccccgcactcgccaacttgtgtgcccgtcgtctcgacgtgcgcctgaatggactcgcccgcagaactggcgccgactacaccagatatgctgatgacctgctgttctccggggggcacgagttggagagaatgcttagtcggtttcgagtttgggtgtgtgcgatcgcaatagatgaaggcttcaccattaggcataggaaaactcgggagcttccccggagtggcaggcaacaagtggcaggagtcgtcctcaacgaaaagctgaatcagccccgggccgaatacgaccgtcttcgagctaccctgcataattgcatccgtcacggggccgcctctcagaatcgaaatgggcacccacggtttcgggagcatctgggaggtaggattgcttgggttaatatgttaaacccaaaccgaggggctagactcaagcagctgttccagcagattgactggcctgaggagtcaacaggtagcccccccgcagatagccaaccggctaagcctgattga

SEQ ID NO: 12495 - RNA, 1386 nt, unidentified
  source 1..1386: mol_type = other RNA; note = synthetic construct
atgacagatgtcagggccgttgccaggggcttggccacagtattcctgtcaggggaatggactagagccgggatcacccaacgggtgcagacggctttagagcagcgggtgaagtcccgcgccgtcgatcttctagtgggacgcattcttcgggcttgcggagaacagccccctccaccaaccttgcataaacttactaagttgattctatccgaccccgtgtttcacaagtacattgctgaggaggacggctatccgagaaggctaaacctggcccacctgccaccccctgttatggctcccgcacctgctataccgtcagactggcagctccctaccattctgactcctggggcactggctgactggctggggttaagttcccccgagctcgagtggttcgccgattgccacggacgggaaagacaacgtgcccgggaggcccttcgccactacagatatcgatggatccccaaaagaaccggcggccgcaggcttctcgaaatccccaagcagcggctgaaagacctgcagagaaccattctgcagtggatcctaggccgtatcgaaccccacgcagccgcacatgcctttcgtcgaggccggagcatagcctcgttcgcccaaccccatagcgccaagagagttgtgctgcgaatagacttgcgtcatttctttccatccgtgcagccctctcgcatcaagtcactcttccggactgtaggctatcctgaagcggtggcgaggctgttatgtggtttgtgtactaacagtgtgcctgacgacattttaggcgtggcagaacagcagtttgccacaaatgagaggcagcccgtcgagagactgtacgctgcagcacacctcccacagggagctccaacttctccggcccttgctaatctggccgccaggcgacttgatgggagactcagcggcttagcgacagctgtcggtggggattacacccgctacgctgatgatctggtcttttctggaggcagggctctggagaggtgtctgccacgatttcggacattgctcctcgcaattgtgctggacgagggattcagcataaggcaccgcaagaccgcagttatgccggccggtgggcgacaacaagtagcaggtatcgtcgtcaacgaacatccaaacttgaaccggaaagagttcgatagactcaaagccatcctgtataattgcgcacaccacggacctagaagtcagctgacaggctgcctccctcagccaaatgagccccctaccgaggcgacgctggaacagctgcgctctcatctcacgggtaaagtggcgttcgtgcgcatgatcaatccagctaagggggaacggctgagcaagctcctgagggagatcgactgggttggatga

SEQ ID NO: 12496 - RNA, 1347 nt, unidentified
  source 1..1347: mol_type = other RNA; note = synthetic construct
atggatgatagttttcggcagttcactgctaacttggctgagacactcgcccgcggtacctggtctttagacgagctactcaagagggccgatcagtccttaacagagacaagtagccgtgcatggataataagactgaccgaacgaaccatggtggcctttcccggacgccagagccctcaacactgtctgctgatgcagttcctggcacatgacagaggactgagacgagtttggaacaattgcgaacgcgacgagcgcccattccccgaaatcgacttgaccaaactggtaccgcccgttatgcagccagcctccgaggtgatagcagcatggcccgtgcggccactcgtcactattcaggatgtatcacagtggttgggcctgacgcttggcgagttagattggtttgcagatcgtactcgcagaaaaagcagggtgccagaaggccccctcagacactacaggtaccgctggatcgccaagtcttcgggtggacagaggcttctcgaaatccccaagccccggctcaaagaactgcaacgaaaaattctggcagagattcttgacgctatcccaccacaccctgctgcacatgccttcaggagaggtcggagcgtacgtgggtacgtcaccccccacgttggccaacaggtcgtgttgcatatcgatctcagggaattctttccctctattagggcttcacaaatccacgctctgtatcggacggtgggctatccggaacgagttgccgctatgctgaccggtctgtgtacacatattacccctcgtgacgccatacctctcaatggagagcagcaggcgtctaattcaaactggaaacgcctggggagtcctcacctacctcagggagcccctactagtcctgcccttgcgaacctggtggccttccgcttggactgccgattggcgggactgagccagaaagtggaggccgtctatacaaggtacgctgacgatcttcttttttctggcgggaaggaactggctcggtgcgcgtcaaggttccggctactggtgacagcaattgcccaccacgagggctttgagattagagcccgcaagtcccggacgatgcattccggcactagacaacaggtggccgggattgtgctgaacagacagccaaatatcccacgggaagagtatgatgctctgagagcaacattgtacaattgtcagcggcatgggcccaccactcaaaatgtcaatcagcacccgcacttcagggaccatcttttagggaagatcaactactggtccaacatctgccctgagcgaagcaggaagctcagactcctgtttgaccagatcgtctggccatga

SEQ ID NO: 12497 - RNA, 1329 nt, unidentified
  source 1..1329: mol_type = other RNA; note = synthetic construct
atgcatgactttgaggatgagttcccaacaccggatgccgaaagcgtcgcccgggtgtttcttgcgggagctttcagcccagagtcctgcacggctcgtctcaccgtggtgttcggcagagttcaccatcgccgcattgaacgcctggtccggctggtttttgcagtgttccccccccatagtgccgtgcccacattgagacgattgacactgttcctcctgaggtttgagtcatacttccccgaccagttccgcatatcccctccgagagacttaaccggccacagaacgatacctgcagaggccatcactgggagcctaccaatactcaacaacattcgggaactagctgagtttctcgacctgacgcccgaaaggatgctgtggctcgccgacccgcacggtttcgaaaccaaacgtcctagggagagacagaggcactaccggtacagatgggtggaacggaccgggagaaccccacgacctctggagattcccaagcagcggctgaaggccattcagaaaaagatcttagccgaaatcttgaacaagctgcgaccacaccctgccgcttgcgctttccgcaaagggcagagtgtgagagatttcgccaaaccccatgttggccggagggtggttatacggtttgatatcgccaatttttttcctagcatccttcagccccgagtccaggccacattccgggcagtaggttatgtcgaagaagtcgcttttctgctaagtgccctgacaaccaaccggctccctactgaccaactgcacgccgaggcgactggttctggagcacgacacttaagacagcacctcctctctgcccatcttccccaaggcgcgccaacatcacctgcactggccaacctctgtgctttccacctggataggaggttgaccggcctggcagcaaggttctctctgagttatactcggtacgcagacgacctgttgttctccggaaatctgtccgacgctgaaatttatcgcttccgcattagggccttggccattctcatcgatgagggatttgaggcgagatcatctaagtccgcggtgctacgtaaaggaagcagacagcaggcatgtggcgtaattcttaatactaggctgaacatcgccagggaggattatgacgctctgaaggctactttacacaattgcatccgccatgggccagaacttcaaaaccatgagggtgtcgcagattttcgcagcgtgttgcgaggccgtatcgcatgggtacactcgcttaatgtggctaaaggggagaagctgcttgctatgtttgagcaaatccattggaatacctcatga

SEQ ID NO: 12498 - RNA, 1278 nt, unidentified
  source 1..1278: mol_type = other RNA; note = synthetic construct
atgtccgagagaattcggatggtcatggcggctcggcgacagtccaggtggcatgaccagctcgccaagcgtgttcacgacgagttcgccgctgtaatacctcgcccaacccgcgacagattggctgagtttattctgttcaaaggtcgcataccccgcagagtgagggcacccgagcacagagatggacctctgcgaaatacttctctcctgtctttaccagctcccgccatgatccctgctgatgccatcgccgcacgtgtcgcccttccagctattacaactcaaggccagctggccgactggctgagcatatcaccctccgaattagactggttcgcagatcccgccgctctattggcccggtggggagttgcagatcgcggtaccctgaggcactatagaaccagactgctgccaaagccaaggggccggtggaggctcgtggaatcccctaaacctaggctcaaggagatccagcggaagattctggcagacctgcttgatctagtgccagtccatcctgcggcccatgccttcgtgaggggacgaagtatcgtgaccggggtaacgccacatttcgggcgcgacgttgtgctgagtatcgatctgcgagagttcttcccatcagttcacgctgggaggattcacgcaatgtttaggacactcggctatcccgaaagagtggcaagtttgttaacaggattgtgtaccacccgaactcctgcagacagattggcccagggtgcattctcgacggcccagagacagctgtaccagagccttcacctcccccaaggagcccctacaagcccagccctcgccaaccttgcggcttggaggctggactgcaggcttgaaggccttgcgcgaaggtttggcgcggcctacacacggtatgcagatgacctgatatttagcggggattccactgtgcatcgggcactgccgaggctacggatgtgggctactgcgatcgtcttagatgagggctttgctatccaacgccgtaagacccgggtgatgccgtcaggtcagcgtcaaaccgtgggagggctgatcctcaatgcccgtgctaatatccctcggcgcgagtacgaagccctcaaagccactatctttaactgcctgacatacggcccctctagccagaaccgggaacagcaccccagattctatgaacacctgagaggccaaattgcctgggtcgctgcctcttcaccgcccagagctgcacgcttgctcgaggagtttcagcgcattgactggagccggtga

SEQ ID NO: 12499 - RNA, 1341 nt, unidentified
  source 1..1341: mol_type = other RNA; note = synthetic construct
atgcctagcgagtttatcaggaagctatcttgggtattactcgccggcaggtgggaacgtggggaactggaaaatagagggaggctggccttgcgaagggctacctgtcccatgtggatggtgcagctagccaaccgcctgattgtaacttttggcgacaatgtcacagtgcctcagcggagacagttagagctgttcctgtcctgggacgcccccctgcaaaagagaatccgtacctgggatcgcaatggctccttcccgaagttagtagttcctccacagaggatggctcctgcagctgaccgctttattgaatctagactcccagagctcacaacaacttccagtctggctgcctggctgtctataagccccagcgagctggattggtttgctgaccagcgccggtgggaacgcaggcaagtgaacgaggcagcacggcattacagatatctctggattcccaaatctggcgggatgtgtcggcttctggagagcccaaaacctcggctcaaagccatgcaaagggagatactcgactgcattctcgcgaaggtgcccgtacatgacgccgctcacggattctgcagaggccggtctgtgagaacttacctcgagccccacgtgggtagagatatcgtcttcagtgtggatctgcggcagttttttccaagcgtgcgcgtgtcacagatcaatgcaatattcaggacagttggctatccggaggaggttgcgcgtatgttgacgggcctttgcaccaattcaaccccagaaaacgttctgcactccaagagggttccagatgccggagtcgagaacagccgcatgcttagacgctacagagatgtccatctgccccagggaacgcccacctctccgatgctcgctaacctggcagcattcaggctggatagaaggcttaccggactggcctccaagtttggcgcgtcatatacccgatacgcagatgacttaacattctcaggagacagcgattttcgatgcgccttggaacggtttaaaatcttggtgtatgccattgtcatcgatcaggggttcgaaattcgacacaggaagactagagtcatgacacagggtcagcgacagcttgtgaccgggctggtccttaataaccgcttgaacgtgcctcggaattcatttgacgtgctgaaagctactctacataactgtgtgcggttcgggccttccagccaaaaccgggaggccatcgacaacttctcggaacacctggccggacgcatcagttgggtggacagtgttagtccagcacgtggtgccaaattgaaggctctcttcaatgagattgactggtcccgatga

SEQ ID NO: 12500 - RNA, 1257 nt, unidentified
  source 1..1257: mol_type = other RNA; note = synthetic construct
atgccaagccgacggccgtctcccagctatatagccctctgcctggcagtggcttgggagcataagaccggaagaaacgacgaactgcttgaggacgcggtcgctgtgctaggactcactgatagacctagatggctccgtcacctatgtagacatctggcaggtaggtggggcgatcctcttcgcagaccatcgcggggcaaggttgtgcggctgctgttagcatctgaatcattcatcgccgcggtgggggctgttccactgcaagataatctggcccctgccccctattggaccacaatcctgcccgcctggagttggaatttgcccgagtttccatccactggggccctggctaactggttgtccgtgtcaccagcggacttagactggctcgcagatgttcgtgggctcaaccctagaagccccgaccctcagctttggcactaccattattccgtccggccaaaaagtgacgggcgatctaggttgatctctgccccgaagttgcgccttaaacagcttcagagacaaattctgggccagattctccagaggatcccagtccaccccgcagcccatgcttatgtgagcgggcgctccatggcaacctgtctagcccctcatgtcggccgggatgtcgttctgcacctcgatctggacagcttttttccatccatccaggcttcacaggtgcgcgcggtctggacatatgtaggctacggtgcttccgtggccgctatgctgaccggcctatgcactgagaacgtacctgactctgtgctgagccgcctgaatgcgagcaggcaggcagttgacaggttccgggaacgtcatttgcctcagggagcacccaccagtcccgctctctcaaatctctgcgcctaccgcttggattgtaggctttcaggactggccggccactttggagccgcctacacacgatatgccgatgatctgattttctctggtgacgctcacttccggaggcgcctgtttgatttccggacgacagtgggcgccattctgcttgatagcggatttaacctgcaagggaggaaaacgagagtgttaccggcaagtcgaagtcagcgtgtggggggattagtcgtaaaccgccgattgaatattccccggagagagtacgacgacatgagagcaatcctccacaactgcgctaggttcggtgctgaatcccaaaatcgcgaacgacaccctcactacagggagcatctcctgggccggatagcctactga

SEQ ID NO: 12501 - RNA, 1356 nt, unidentified
  source 1..1356: mol_type = other RNA; note = synthetic construct
atggatgagcccgagtttagggagagggtggtactggatgcacttgcccggaccctgctgccgttggctgatgatgtatcagtcgcagtccgagcggctagacaactgctgggctggaaacctgaacggtggtttcgcacactggttgcaaacgtgctggcatggcccgagatgagggcaggtcagatgactgcaggcgaactcgccgctagactctccggcatcccatctttgatggaggcacttgatgaaggaaagggggtggttctggatctgtccgcaatccctcggccccgcatgaggagaagcccagtagctggaatggggcctattgtcagactagagacagttggggactgcctggactggctgggactcggtttgaatgaactggactggctcaccgaccccaagggttggcttcctgcagccggacagagtcgattggcccattaccactgccaatggatccctaaaccagctggaggggtgcggcttatagaggcccccaaaagaagactaaaggccatccaacggaagattcacgaagagatcctcagacacgtgccaccgcacgaagccgctcatgcttaccggccagggcgaagcatggtgaccgctttgaccccccataccggccaggaaacggtgtggcaccttgacttaacttccttcttttggtctattggctcaggccgcgtgaggcgattcttcagacgcatcgggtatccagagggcgtggccggtgtgctgactggactgtgtacttctcgtgtcgccccgggcttattggagcctgctccactctctgagcgcgaaaagcagcagctgttagcaagacatctcccacagggtgccccgacaagccctgctctgagcaacctgtgcgccttccgactggactgtaggctttccgccttgtcggcgcggtacgacgtcagatacacacgctatgccgacgacctggtcttcagttgtggccctaaactgcgaaggcggctccctggattcaggaataccgttctcgcgatcctaatagatgaaggctttcagatacgtcgccggaaaacaagggtgttacgccggggacaaagacagcaggtggggggtctaattcttaatgaaacgctcaacgtgcccaggagcgagtatgacaccctgcgcgccattctgcatgattgcggcaggaacggacccgtcgttgcgaatcgcgaccagcacccatcctttcgggagcacttacaggggagagtagcctggattgctcacgtgtcacccgggaggggacgtaagctcaaggagatgtttgagcgtatcgattggagtgggagtgaggaacccactggcgccggctga

SEQ ID NO: 12502 - RNA, 1317 nt, unidentified
  source 1..1317: mol_type = other RNA; note = synthetic construct
atgacataccgcgcttttctcaggtccctggctttcatactggatcaaggcttttggcatgaggaggccgccctggagcaggtcttggacgtgttacctacacggcagcgacaggccaagtggccaagacgcttgattggcagaattttcactacctttagccgctacacccggccctcattcggagagctctcgagattcctgcagggcgataaagagctcaaggccgacctgagaaggctgacagcaatacctctaattgtatggcgaccaggggaccagacgcgtcctcatcctgtgctccgtgtcagtggcgatctgcccatccttaagagcgtgagggatttcgcaaatttcttgcgcatgccggttaatagcctccaagctctggctgatgttaactctcgcgaggccaggaccttagacgcacggcacagacattataactaccgttggatccaaaagaggagtggcggacagagactcatcgaaatccccaaagagcgtctcaaacacgcccagagccagctgctcgaatgtatcttacgccacgtacccgtgcatgaggccgccagagcctacagacgaggactaagtcttagagatgctgtcgaacaacatgtcgggcagcgcattctgctcaggatcgatctgcaagactttttcccatcgattggggtgggaaaagtccgacaggtgtttcgccacctgggctatccatctgtggtcgctatgcacatggcagggctgtgcacaaatgtggtacctcaagctgttcttgaaacaacctcctctaatcacaggctgagccacgtgtaccagttgccacatctgccccaaggagctcccacctctgctgtgctgtccaatctggccagttacaggatggacgcgcgacttactgggctcgccgcatattggagcatgcagtacactcggtatgcagacgatctgcttttctctggcgactccctttcagctgcgcaggttagccgtcttcggacccagatactggccgttgcctccgacgagggtttcaggatcagacggtataagactaaagtcatgagggcgggaaggcagcagtctgccttgggtctaactttgaattcacaggccaatacgatgagacgagactttgacaacttaagagccctactgaacaacgcggtgcggcacggtctggaatcccagaatcgcgataaccacccgaagtttctcgaacatctcgcaggccgggtggcatatcaccgctccatgaaccctaagcggggggcacggctggatcggttactgtcaaggttgaccaacgaatga

SEQ ID NO: 12503 - RNA, 1308 nt, unidentified
  source 1..1308: mol_type = other RNA; note = synthetic construct
atgaatggggagattttacgggcggcaaggattgctgaggctttgctggctggcccctgggacctcaagagcttgacgggaaggcttaagactacttttcacgcagtagcccggtcaagatggcccagacaaaccgccgtagagttggtggcagaatttccagcccctccacgagccatcagattggcattctggataacgaggaacaggcaccttgcgccgcggcagaaagatgtgccccttgcggatcttccccggcctcgtatgcgaccccatccagcagcagcttctctgctcgtgccagcgctgtgcacccctggagatatcgctgcatggctccgcttggacccgggtcaagtcgacggattagccggggccggcgttcctgaacgtaggagacacgcccgcgcacgcaattacgcatatcgatggttgaagaagagtgacggcagggtgagactgattgagtcccccaaatggcgcctgatggccgtacaacgccagatcttatcggatctcttagaccacgttccaccgcatcctgctgcccacgcattcgtgcgcggtagatctctgcagaccttcctgagccctcacgtccgacgcaactgggtcttacgcctagatctggctgactttttcgctacaatagcagcaaaccgggttgtcgaggtgtttcggttcctgggctaccctgaggcctccgctcagtggcttactcgcctgtgtgtgaacgccgctccaagcgacgtgttgtgcgatggaatcggtcacgccgccgatgctcatgtgcagcggcttagatcccgcctgtctggactccatctcccacaaggcgctccaacatctcccgcgctagctaatctgtgcctgtttagatttgaccagcgactcgccaggctggccgagtcaagagggctgcagtatactagatactgcgatgatcttgtgttctccggggacagagaaaccaggagtgacgtcgtggatctgcggcgtacactctttatgattctggccgacgaaagactgtcagtccggcacgccaaaacacgtatcatgcccgccgggaggaggcagaatgtttgtgggctaaacctgaatcacggcctcaataccccccgagccgcattcgatcaactgagggccatactacatcggtgtggcacaaagggactcaccgccgaggaacagcaggactccagccgtttccggcagcatctccagggcaggatcgcgtgggttagtagcattaaccctcatcggcaggccaagctggtgaaactgttcgaagctatcgcttggtga

SEQ ID NO: 12504 - RNA, 1371 nt, unidentified
  source 1..1371: mol_type = other RNA; note = synthetic construct
atgggtcagcagagcaggcggcttgccgaagcaatcgcccagactgttttaaacggcccctttgcttttgacgcaattgtgagtagactcaagagaatcaccccagggccttgtctgagagggtggaaacaaagggtcgcccgttccgtgctagaccggtttggtgagggtggaggcgtgccatccctgttcactctgcgacagtaccttattgacagtggcttgctcatagatgtggaggcagatgactttcccgaggactggatcgacgagacagaaacaactattatccgcccggatcgggtgccccacgctgtattctgtccacgcatcgcggccttccagaacctcgggctgcctgagtggaccaccacaagagagctggccgattggttcggcctgacagatgggcagcttttatggctttccggaggccggcggtccgatggaaaatctgccttcgagaggtatcgcctgaagtgccaaaggtcatcctcaggaaaggtgcggtgcttagaggtgcccaggtcaatgctgaaatctattcagagggaactcaatagagacttgctcactcgcatccccatccatagctgcgcgcacggtttcgtgcctgggcgatctatccactcttacgttgaacctcatgtgggccaggacgtcatatggaaaactgacctggcaaatttcttcccaagcattacaagatccaggatcgaggcccagtttagactgtttggatacccagatgctgtcgctcgaacccttagtgggctgatgaccgtcagacaggatcggaccaagatagaggaactgtcccagcaatttcccagggatcagttccgagacttagccagcctccttacgcaatctcacctccctcaaggtgcacccacatcgcctgccctcgccaacctggcagcttaccgactggactgccgcctgtcgggactagctactaagttccacgcgaattatacgcggtatgccgatgacctgacctacagcggcggacagcggttccagagaagtttggataccttccgcgtgcatgccttggctattattgtcgacgaaggatttcgtaaccggctccgcaaaactcgtgtaatgatgtcttcaagacgccagacggttgcagggttggtgatcaatcagacacagaatgtaccgcgcgaggagtataaaaccctgaaggctatcctgtttaactgtagactacatgggccggcaagccaaaatagggacggcattcctgattttcaggcccacctgaggggccgtattgaatttgttcgaagcgctaacccagagaggggcgaaaagttgatggccatgttcgaggaaatagaatttcatgcggaaacctga

SEQ ID NO: 12505 - RNA, 1341 nt, unidentified
  source 1..1341: mol_type = other RNA; note = synthetic construct
atgaatttgttcctcgacgcgttggccacggtcgtcctttccggaccattcgatcagaaagctatttgcgcccggataagaaagagtctggtcgtgcgttctgatgcgcctctggaagtgaagctcaccactcggtgggttacccccctcgtgaaagctttcctgtccgccgtacccgctagacctaggcatcggcaggtggtaagctttctgagtacccaacagctgagtgcccaggccgagtatttttcgatagagacatcccggtgtagcccgcccctttttttgcccttaaaacctcagtttgcagagtggggcctgccacagtggcgcacaactggacagctggctgatttcttgggcatatctcccgttagactcgactggctgtgcggccgttaccccgttagagatagccaggaaatcaggcagcgctatcaaatcaggtggcaaagatctcggacggggaagctccggatgatcgagatcccttgcccacagcttatgcgtatccagcgccagttacttcacgacgtgcttgacaggattccagtccatgccgctgctcatggctttcgggctaagcactccaccctcacctgtgtgtccccacatgtggctcaggccgtcgtatggaaactggacttggcatcatttttcctgtctatcccgcgctgtagagtcacagggttattccgaatgctcggatatcccgaggcagtcgccgaggatctgggttggctgacaactaacgcagttccgtcaaaagttctgcaaagaatgaaggcaaagattggcactgaccagttccaggagctagaacgatttgccgctgcaggtcatctgccacaaggggcaccttcttcacctgccttggccaaccttattgcctacagactggactgtaggctaaacggactggcaaccgcatacggcgcgcattacagcaggtacgcagatgacctgctgttcagcggcgattataggttcaaacgatatttggccggatttaggatccaggtgctcgcgataatcctagacgaggggttcctgattcgtcgacgcaagtccaaggtgatggtgcacagccgacgccaacaggcccttgggatcgtgattaatcagcaccctaacctccctcggcaggaatacaaattactgcacgctattctgcacaattgcgtggtgcagggtccacacagtcaaaaccgcgacgggcacctggattaccatgcccacctcgctggtagaatcgccaatctacgcaggcttaaccccgcgagggccgctaagctccagacaatgtttgaacagattaattggcaacggttcgattcatga

SEQ ID NO: 12506 - RNA, 1272 nt, unidentified
  source 1..1272: mol_type = other RNA; note = synthetic construct
atgtcgagcgatgagcttgcgactatcctgttgtcgggcgcttttgaacaggcggcttttgaggaaaggctcgtgatggcagtgggggcaccaaagttctcacgtaagttggcggggcgcgtgattaggcattttggttcaggatcccgccccagcgtcagaatgttagccgagtggttagagagtgaccgacggtaccagaaaaagcagaggagaggtgaactgcagctgagcggccagatactccccgccgaaatggccccagacatgcgcgtagctgccgactggaaaattccgtctatcacgacgagcggagatcttgctcactggctcgatttgcctgtcagccagatggagtggttcgccggagactataactctgtgcccgctgatactaaactgtctcactacacagtgcaaacagttgttaagaagagcggcggctttcgggtgctggaaaagcctaaatggcaaatgaaacaggtccagcgctacattctgcacggaatccttgatcatctgccccctcatccttgctcccatgggttccagaagaaccgatccattctgagttacgttcaaccccatatcgggcggaaaatgctgatcaagatggacctcaaagactactttcttagtatcgagcggtcacgagtcagagcactgttccacttgcttggctaccctccactagtgtccgtccagctagccggctgttgcactaatagactccgcttagctgatgtgccaagtggagtggcacagcgagacaggtataccgtaagccacctcccacaaggtgctcccacctcacctgcactcgcagataggctgctgtatagactcgatctgaggttgcacggactggcccagaaaatgcacatggactacaccaggtatgccgacgatttcgccttctccacaaacgactctgttagaaggccccaagtggaggccttcctaaatctggtcgaccagatcgtgagagaagaggggctgcagttgcacaagaccaagacatctgtgatgcatcattctcagagacagcgtctggcaggcctggttcttaatgagaaacataacgtagctcgcggggaatatgatcggctgcgcgccatactgcaccggtgtggacagaatgggttggacgccgaaaataagaacgaccacccgtccttcttacaacacctcgagggtcgggtggagtttattcggcagaccaacccacgtcgaggcaagaagctgcaaggcatgctcgataaacttgtctga

SEQ ID NO: 12507 - RNA, 1338 nt, unidentified
  source 1..1338: mol_type = other RNA; note = synthetic construct
atgaagattgatccagtattcctggacatggcgagggtgttgctcgcgcacccatgggatcgggcagctgttctcgcatgcgggcacaagctgctgggcagaaagcccaaatggtgggccgctgcagtcgagaagtttgtcgcatggttccctaccagacctccaacagccgccagacttgcccggctgttagccgcacaccccaggttggctgccctgagagataaggataagctgccacagcctcgggccgatctcttacgcgaggcactacaataccaagttgaccatctgagataccctgacttaccaaaactcgccactcccgcccaactggctgactggctgaatgtgcccgagcctgtgcttcgatggctggccgatatcaagtgtctgaacgctcggcaggctcccgcagtgcagaactatcggtaccactgggttgccagacggcggggtggtcataggttgatcgaagcgccaaaggagatattaaagaggctccagaggcagattctggaccgtatccttgacctggtgcctccgcacgatgtagcacacggatttcgcgctggcaggagcatcctcactcacgccgctccgcacacagggcagatcgtcgtgatcaagtttgacctcaaagactatttcccatcggtggccggtaaaagggtgggatccctcttccgctggttgggataccccgacgaagtggcgtggttgctgacctgtctttgcactaccattactccggcagccgtggaagcaacagcacctgcaggggccgacgatgtatctctcacctttcagacactgtaccgaagaagacatctacctcagggcgctcccaccagtccagctgttgctaacctatgtacgttccgactggatcggcgactttcaggcctagcggccaaactgggcgcccgttacaccagatatgctgacgacctcctgttctcaggagatgccgtcttcgcgcgcaaaaggcgatcttttattgcctgcgtttatcgtgtcatactcgaggaagggttccagcctgcattccgcaaaactcgtgtgatggcccgctccacacggcagcttgctacaggtcttattctgaacgagacgctgaatgtgccacgccccgattttgatgaactcaaagctatcctgcataatgcgatgaaacacggattagcctcccaaaacagagctggccatccccattttgtggacagcttgaggggccgcatagcttttgttagccaggccaatcccagaaggggggccaagctgaagttgaagttcgaggcagtcctggagaatgaaaaacgcccggccagtacctga

SEQ ID NO: 12508 - RNA, 1290 nt, unidentified
  source 1..1290: mol_type = other RNA; note = synthetic construct
atgacacccaccactctctggctcaaaaatctcagcactcttcttctggaggaggaacggcaactagatgcttggctcgcccttatccggaaagtgattcctggaaagccaaggaggaactttctgataatcacaagggaagtttggaaggttgcaaagactcgcacagtactcgagaatcgggaacttcaacaaattttccgcgaaaatagaaggttttggaactggcagcggaaatggtacgcaacccggactcctctacccccagccttgatcgtgggccctgccacaccagtgttggatacctccgcttggcatcttcctgagttagccacggtgggcgacctggccgacttctttgccttacagcccgacgatctgggctggctcttgtcacccaaggcccagcattaccatgaacagtggttgcctaagcgcaagggcggccgtcggttacttgagtcccccaaaccgctgctgaagcaggtccagaggaccctactgagagagctgctggacaaggtgccaccccacgaatgcgcaacggggttcagagccggacactcgattgttgacttcgcacagcctcacgctaacaagagcatcgctctgaaaatggatctcgcaaacttttttccttctctcggtcgctcccggattaaacgtctgttcatgtcactcgggtatcgtgagggagtggcactggcgctggcggtactgacaacccaccgatcagcaagtcccgacctgacattcactgagaaggagctgtacagcaggtatcatctaccccagggggctccgacatcaccagcccttgcgaatctggctgccttcaggctggattgccggttggctggtctggctaagtctgccggtgccagctatacccgatacgccgacgatctgctcttttccgggactgaagaactcgcgcgaggtcttcacaggtttgagaatagagtcattatcatcacccgagaggagggcttagaaattaacttcaggaaaacccgccgaatggcagctagtcaaagacaggcagccgctgggttagtctttaaccagaaattgaatgtgccgcgcagagagttcgacaccctgaaagctatcctgcataactgtagaaagcatggcgtcagttctcaaaatcattctcaccaccctgactttcaggctcacctgcgcggaagaatagcctggatagcaagcctccacccagtgaggggagagcgcttgagagccgccttcgaggaactggattggtccaagccaaacgcacaggaatga

SEQ ID NO: 12509 - RNA, 1434 nt, unidentified
  source 1..1434: mol_type = other RNA; note = synthetic construct
atgtccgattacccaaccgccgtcggcttcgagctcacacagcactccgacaggctagcctcagcccgacttgagctgagccctcgtaacgagcgaatcgttcaccgcgcatccttgtcacctgtgtttactatggccccacggcctgtcgtaaaacggtctgtgagcgccgcagagctgaccaagcttctggctgcctccctaagtgcaagatggctgggcgacactgaatccgtgagccgaagattgcgcaaacttactggttctcgcgcgaaatgggtgcaggaactggccgtgtcactgaaccagcagttcggcaaacaagggtacgccagtggagccgagataattagacacttaagaaataacccctacctgcagtctgcgcggaagaataacaagctgtttagactccccgtagcagaggccattagcgcacctgagagcgatagcccaagtatcgagacggatacccagctggttgacttcctgggcctgccgtctcttcgggcattggaatggttgctcctgccccatctgcgcaggcagacaaacgtcgaccattatacccgcagaactctgcaccagaccaacggtaagaccagattaatcgaagaaccaaggcctgtgctgaagagggttcagcgactgattctgactgagatcttgtctcacgtgcccatacatgacgtcgcacacgcttacaggcctgaacggtcggtatttacttgcgctgctccacataccgattgccgtgtcgtgctgagaatggacattagggatttcttcgggaccattacgctcaggagggtggccgcccaattcagacggtgcggctacccgaggccgattgcgttcacactggctcggctctgcacggctgctaccccaattacgagcgagtcaacagaaagggagcaacacctcaccatccctcacttaccccagggagccccttcgagtcccacccttgccaatgcggtggcttttcaactagatcgccgactcgccggactcactcgcgcagttgacgctaattacacacgctatgcagacgacttgctgttctccgggggccaatgtcttgctagccgggtcgatcgcattgcgacaacagtagccgtcatagcaatggaggagggttttcagatcgcacatagaaaaacaaggacaatgttttccgggcaccagcagcgagttttaggcctcactgtgaaccagaagctcaattgtgaccgtcgccagtatgagctgctaagagctatcctgaccaattgtttgcggcacggatgggaatcacagaaccgggattctcatccaaactttgccgaacatcttcgtggtcggatcgcccagatcgtgcaagctaatcccaatagaggacagaggttactccatctgtatgaacaagtgagttggaacgatcccgggtga

SEQ ID NO: 12510 - RNA, 1395 nt, unidentified
  source 1..1395: mol_type = other RNA; note = synthetic construct
atggctccccccagcgtggccaaaagaaccgtaactgcctcacaactggcagacctgatcgcatccgagctcgcaacccgatggctgggagacgtggacgaggtgacaagacagatctctaagctgaccgggtccagagctaagtgggtccgcactttggctacctctgtgacacagcagtttgggaagacaggccatgccacaagaatccaactcctcaggagtttaaggaacgaacctcacctgaggaacgcacgcaaaaagaagaaatccttcaatgttcccgtgttaagtacaactcaaccaactagttctctttttcccaccattgaaacagacgatcagctggtggacttcttgcagctgccttctctcaccgttttggactggctccttgttccacattttcgcagacagactcaagtcgatcactataccaggcgtgtgctgagacggagggatggcactacacggctgattgaagaaccacgaccactgctcaagcgaatccagaggctcatccacagcgaggtcctggtggatgtggtcatacatgatgtagcccacgcgtaccggggtgaacgctccatcttcacatgtgcagcccctcatgtcggccaccaggcagtcttaaaaatggacctccagaatttcttcggaaccataactctgcgccggattgccgcccaattccggaggtgcggattccctcggcctattgccctgacccttgggagactgtgtaccgcaccgccggtgagtgtggtaagccctcagacgggcaaaggcttcgtacaggttaacctcattaattcaggttcagccaactccggaggcaatctgaatgccgtgcgtatgccagctcacttgcctcaaggcgcccccacatctcccacgctggcaaacgctatcgcttttcagctagaccggaggcttctgggtctggccaacgcggttggcgccaactatacacgctacgctgacgatcttttcttttcaggcgaccgcggatttgcgagccggatcgaccgatttgctaccactgtcgcagttattgctatggaggaagggtttaccgtggctcataggaagacccgcaagatgttttcggggcacaggcagcagttattgggtcttacggctaacgagaaactaaacagccaccgtcagcaatacgagcagctaaaggccattctgacgaattgcgtgcggcatggatgggagagccagaatagagaaaatcaccccaatttcgcggatcatttgcgcgggcggatcgcccagactttgcaatgcaacccaaacagagggcagcgtctcatgcgactgttccacgagatagcctggaatgagacacagccaagcagaccctcccctgataaaccggatccctga

SEQ ID NO: 12511 - RNA, 1338 nt, unidentified
  source 1..1338: mol_type = other RNA; note = synthetic construct
atggctgccctcagcctcgttcctcttcggatggacgagaaagcagctgtgaatcgggccgcgtttatcaaggtcctggccttcgagcttagtcggacttggctgggatcacgccagcgcataagacaggtgttgagacggatgcttgggcgaatgcccgcctggtgtgaagaattgtcatccatggtgcatgaggagttttctgccgctgcttacgcgaaccaactgcagctcagacgcttccttggaagggttgccgctcttcggtcagtgtttcgcaaaggacgcaatctcaggattcggactaccgccctgggtcgtgctactgcatatcggtggcccgttccacaggcaagaaatgaagctgaactacaggacctcttatgcctgaggtcaaccgtggctctggattggctaatcaaaccccacgtcgtgagatccacaaacgtagatcattataggcgcaaaatgatttgtaagcacgatggccagatcagactcatcgaagaaccaaggcccctgatgaagagagtccagaagaccatacataggcacctgctggctgctatcccagtgcactcggctgcgcacgggttcatctgtggccgctctattttctccgccgccagccctcattgtgggaagcgtttggtattgtgtatggacctggcaaacttcttcgggagcatcgaccggcgcagaacgagtgccctgtttcgactgtgcggctaccctgctcccgttgccttcctcctgggatgcatttgcaccgccccggagtctaattctccagatatgcctggtggcgagctggtgaaagtaagcaggttaccccaaggcgccccttcatccccatctattgctaatgcagtcgcctttcggtttgatcaaaggctggccggattagcccattccgtcggcgcggactatacacggtatgccgacgacctcacctttagtgggaacgagcagttcgtgaattccgcaagtcggttgattcctttagtgggcgcgatcgcaatagaggaagggtttgcagttaaccacagaaagacaaggagattttacgcaggccaccgacaaacggtacttggtttgacagtgaacgtcagccccgcagctgcaaggcagagctacgagtctctgaaagccctgctcaccaactgcgtgcgacatgggccggagagtcagaatcgcgataacgtcgataatttcaggagccacctccgaggccgaattgcctacgtgggtgcacagcatgccagccgtaacaagaagctgctggaactgttcggaagaatccactgggaccaatccactccacgtgacctacagtga

SEQ ID NO: 12512 - RNA, 1281 nt, unidentified
  source 1..1281: mol_type = other RNA; note = synthetic construct
atggagagcagcttgaccagaagccaactggccatgctgataagtagggatctgtcaaggcgttggctcggcaactcctccgtaatacaccgacggctccgtcgcattacaggctcccgtgctcggtggactgaccagctagcggaggctctccatctacaattcgggagggccggccatgcccaacaagttcccctgcaggtttggctggacggccatccagtcatgaaggccgcattccgcaaccgccagacgttacgcgttgacgtggcaacagccaaccagatcaatcgcccgggatataggtggcccgtacctgccgcagctaaccttctggaactgacggacttattgtgtctgcgcactccacgggccatcgattggctcgtcagacctcacctccggcggagtacatccgtggatcactatgtccgacggcgtatacccgggagacaagggcgaggccgatggttacaccagcctcgaccactgttgatgcgggtacagaggtgtatcgctagagagatactcaccgaaattcccctgcatgccgcagcccatgcatataggagaggactgtctgtgagggactgtgctgctccccacgtgggacatagagtggtgctgaagatcgatcttgagaatttttttgggactatttctctgagacgtgtcacagcgttgttccgcgccgcaggttaccccgatgaagttgccgtgaccttaggtagactgtgcaccgtccctgcaaggacaccttctggcaccgaggactgcaggatcgctgggacgtgtctgccacagggaggtccagcctcaccagcaatctcaaatgctatcgcgttccaaatggaccgacgccttgctggactggccagctcagtgggagcgagctacactcggtacgcagacgatctacttttctctggcggccccgacctggccagtagaatcgatagagtggccaccaccgtgtgcgtcattgccatggaagagggatttcaggtgcagcacagaaaaactagaaaaatgtacagcggtgacaggcagcggttgctcggcttgaatgtgaatacacagcttagtactgaccgctccgactttgaactcctgaaggctatcctcaccaattgccagcggcagggttggcgctcgcagaacagggatcagcaccctgagtttaggctgcacctgcaggggcggattgctcacattggccagacaaacccggggcggtatcagaaacttgcccgcctcttcgatgcaattgattggacctga

SEQ ID NO: 12513 - RNA, 1305 nt, unidentified
  source 1..1305: mol_type = other RNA; note = synthetic construct
atggctgaaaagacacttgaccccgctctcgttagtcggcgccagttttgtcgacagctcgccggctgcatgtcccgctgttggttagggaacgatgctcacgtgcgcgaaagactcgaacaagtgctggactgtcaggcaacttgggtggccgagctggccaagtccttgagcgcgagcttttctgagattggttatgcaaataggtttgccctggagtcatggctaaggaaacagccgacgatcaagctcttcttcaagggaaaaaagagtcggcggctcactgatgaagtccagagagctctggcctcacgcaaccataggtggcctgttcccccgttagattccgacgacgatctatgtcgtctgcttgagattgcgtctcttagggaactccagtggctggtgttgccacacgtaaggagaaatactgctgtggaccactacaagaggacatgcctgaagaaaaaattgggcggatatcgttggatagaggagcctcgtcctaaattgaaggccgtgcaaaggagaatgctggaatctgtcctgccagggattcctctgcacagcgcagctcatgcttatagaacaggttgttctgttcagtcttgcgctgagccacatgtggggcagagagtcgttctcaaactggatctgcgggactacttcggcaccatcagcattttcagagtcaaagccttatttgccaatgcaggctatagttggcccatcgcccttaggttggcccagttgtgcaccgccccagcgagaatggacgacctgagggatgaagccagatcactgaccagaacacgactcccccagggtgctcctactagtccctccatagccaatgctgtggcttaccgcatggatcgacgcctggccggacttgcagctagcgtgggagcatcgtacacgcgctatgccgacgatctcatctttagcggggacgataacttcgccgcccgagtagatcgattcgcaacctcagcggcagcaatagtcattgaagagggcttcgccatccagtttcggaagactcggaagctatttcatggggctgagcagcgcatcctcggggtaacagtgaacgaaaaactgaaccttaacaggagggccttcgagggcctgaaggccgaacttcacaattgcgcccgccggggatggcgaacccaaaatcggaccgagcacgcggactacagagctcatctgcgtggccggatcgcatacgcacaatccttaaacccaacccggggtgcaaaactgctgcaattgttcgagcaggtgaagtggaatgagtga

SEQ ID NO: 12514 - RNA, 1389 nt, unidentified
  source 1..1389: mol_type = other RNA; note = synthetic construct
atgaccgcccgccgcgagactagaattgatataggaagggctaggctcgtgcgcattttaatcgctagactgaaccaccggtggctggaaacgcctgcacaggtactgaggctgacacaggggctgttcggttcgcagcattctctcgagaaacagctcgccacccaactgagtcaggctcacagagaaaaccggttaagcactcagcaaccgctgtcccggtggctgttgagaaacgaacttctgattcgctatttccgcaaaaagcagacaatctctatttgcaagtccatcgtcgattccatcgaaaagagcgagcacgcctatcggtggagggtgccagccgtcgatgatgaagtgcagctcgccaagttcctactgcttgggagctcacaggttctgcagtggcttaccttgccccaccggagacgtagaaccgacgtaaaccattaccgtcggcgcgccattcccaaaagagatggcaccctcagatggatagagtctccatctcccatcctcaaacgtacacagcgtatcattgctgcagacttactgccacacgtgccgctgcacgatgccgcaatgggttttagacgagggcacagtatccatgactcagccgccagacacgtcggcaaggcctcagtcttgaggctggatctccaggacttcttcggcagcattcattttggccgcgttcgaagtctttttgcatacgccggttactcctctaaagttgcttcaacactggcaatgttgtgtaccgcgccaagtgagacagcgccactggacacctcacccccctgtataactcctcttagcaacagtgctagaacttctacacgcagcgccttgcctgaactgcctagccggttgccccaaggaacacccaccagccctgcaattgctaatgccatcgccttccgaatggacaggaggctcgacgggctagcaaccgcagcaggagctaattatacccggtacgctgatgatctggttttttcctttgacagcccatccgtggctttcgctaagcggtttgcgacttctgtggcggtgatagcaatggaggagggcttcaagatgaactttaggaaaacgcgtttaatgaggcgcggtaatcggcaacgggtactgggaatgacagtgaacgagaagcttaatgtgtccaggcaggcctacgaaactctgaaggcaatcctccataattgcgccaagcgcggaccccggtcccaaaatcgaactgaacaccctaatttcagggagcatctcagagggcgaatcgcccacgtcgcttcgatccatactggccgaggcaacaaactaaccgcggtgtttgagacgattgactgggacgatgatgccccagactataggcagcctgactga

SEQ ID NO: 12515 - RNA, 1293 nt, unidentified
  source 1..1293: mol_type = other RNA; note = synthetic construct
atgtccagtcacacagtcaccatagacgtggatttgaagcggtttgctggcctgctccataggcggctgcaatacaggcacctgccagctcccgcttccgttcgagacgccatacagcccttgttcggcagggataagaaactgtgcgaagacctggtgcagcagattgtcgacgcacagcggaatccacagcctctgcgtcatcctcagatgctaacatggttatccaaaaatccggctgtgaagaagagattcagacaccgcaagcgcataaagatccagcagtcccttgtgatccaaattgagagtgacggggtgtatcgctggcccgtgcctccaatcgccaatgaaggtcagctggcagattttctgagtctgtcaacgccacggatcatcgattggttaaccctgccacatcgacgccgcagcacaagtgtggatcactatacaagggttgcctctaccaagcgggacgggaccattaggtggatcgagcaacctgcccccacccttaagagagtccagagactgattgcccagcaaatcctctccactatacctcttcacgatgccgcctcaggctttcgggccggtcattctgttcctgactgtgctcgccagcatgtacggagatctttaatcatcaggatggatatgcggcacttctttggttctatacacgtgggcagggtcagaaacctcttcctcatcgccggatatccgccgcaggttgctcgcaccttggccttcctatgcaccgcacccgcatcgattgaccctgatgcagatgagcttctgcgacgtagccggctacctcaaggcgctcccacaagcccagccattgccaacgcggtcagcttcgccatggataggcgcatcagcgggctctgtaaaactctcaacgtgacatacaccagatatgcagacgatctgattttctcatgcgaccatttcggcttgtctcaggcaaaacgatttgcgactactgtggcggtaattgctatggaggaagggtttcaaatcaattttcgcaagactgcgtttatgcgtcacggcaacaatcagagagtactgggactcacggtgaaccagaaactgaactcagccaggaaagagtacgagactctgagggccatccttcacaactgtcgtcgagacgggccagctggacaaaatcggcatgaccaccccaagttcagatgccacttgcgaggaagaattgcacacattgcaagcgtcaatccccataggggagctaaactcatggaacagttcgaccagatctactggtga

SEQ ID NO: 12516 - RNA, 1335 nt, unidentified
  source 1..1335: mol_type = other RNA; note = synthetic construct
atgcctcccgccacctactcccttgatcaggtagccgccgcttttgccaaagctgcagttgtgggggtgtggaagcgcacagccgtgctggaccagtggcgcaagctcatcgaacccttgccgaacggactgaagtcagtggccatgcaactaattggacagttcgcacacgtccccagtcagcaggttgtagcggaatttctccaatcaaacagaatgtttcagcaggcctacgccaaaaaccttgtgatgcggagggtggggtggtgtgatcatcagatcgtggatgccgccctagctccaaaaagcaggcacgtgaggaactgggaccttccggaattaacctcccccactgatctcgcctcactcttggactgccccgagaaccttctgtggcagctggcagatcatcgtcgctgctattggctgcgacagagccattatcgcttacggatgtctcgtaaacgctctggcggcctcagattaatcgaggcccctaagccaaagctgaagacagtccagagaagaatctggaaaaggatcatcagatggattcccgcgcaccaggctgctcacgggttccaaccgcgaaggagcatccgttccaacgcagccttgcataccggccaatcggtcgtaattcgaatggacctgcaaaatttctttgcatctgtgagcggtgcccgcatcgccgcaatctttcgcaccgccgggtaccctgaaagtgttgcgctgcttctggcccggctctgtacgtcgaaggtgtcaagattcgtgtggcagatgctatgtgacgaaaaccaggctgctgacctgcacggcctcgtcgaccaggtcagtgtctggcacctgcctcagggtgcacccactagcccagccctggcaaatctcgccgcttttaggctggatcggaggttgacgggactggcggcgtctatgagctctcggtatagccgatacgctgacgaccttatattctccggtccaaccgacctcgccaaaaggtcccaagctttcgtggcaaaggtcacagagattatggtggaggagggctttttgcctaatactaggaaaacacgtataatgcggccatccgttagacaatctgtttgcggactgaccgtaaatcagaaggtcaatagtaatcgggctgatttcaagcagttgcaggctattttacacaactgcgttactctgggacctgccggccagaatagagctaatgtggcggattttcgcgcacacctggcagggagaatacagttccaacggttcattcatcctcagcgggctgccaagctggaggcaatgttcgtgcgaattaaatggccatga

SEQ ID NO: 12517 - RNA, 1353 nt, unidentified
  source 1..1353: mol_type = other RNA; note = synthetic construct
atgccaccagaaccactgcctgagtgtatgattgctgccgccgctgaacagttggccggatggcttcagctgaggcttctccccgaggcccagtcactggaagctgccctggaaagtggtctgcctggctccatctctgataggaagccgctgttacgtcggctgtccggcatcaaagagatcgccacgatgccggaggcggatctcgcgaaaatcatcgcggccgacccatggtttcaggcccatggcgcgaggagcgcacgtcattggcgccatcagacaagagtgcgggaaatgaccccacggtgggaggggttacccattctggctaccgaaggcgacctctgcctgtggctagggggtttgaggcccgcagagcttcactggctcgcccaaacagagcgcggagatcacgacccagccggcaagttggcccactacgtccaccgatggattccaaggcggcatggcgcaccccctcgattactggcatcccctaaacccctgctcaagtcactgcaaagaaaaatcctgcgggacctgctcgatcacctgcctctgcacgaagccgcccatgggtttcggaggggtaggagcataagatctttcgcccacccccacacggctaccgactgtgtgctccggctggatctggcagattttttccccagcatccgtttcgggcgagtcgcagccctgttcgagactgctggttatccgtcacccgttgctcggctgcttgctggcctgtgctgccacagcgcacctagggctgtggtgagatccgctggcctacctcgagccctcgctgatagactcttgcgaccccatcttcctcagggcgcacctactagcccggccttatctaatgctgttgccttcagactcgacaggcggttagctggactagcggcagcggcaggagctcagtacactagatacgccgacgacttggcattttccgggggccgcgatctttggcgaggtgctacaagattcttggaccgcgccaccgcaattgttctggacgaggggtttgaggtgaacttcagaaagataagggtaatgcccgcctgtgctcgccaaaggatagccggcgtcgtggtcaacgagaagaccaacaccgtgcgcgagacatatgacgcactcaaggcagccctacaccgttgggagacacgcggcctcccagaagacgatgccctttttcctgaacgccttctgggacggattagtgcgctggctcagttgaatccagaaaagggagccaaactgcggcagcgctatgatagagtaagagagggaagtggattccatgaaatgggatcgcccccaacttctggggggctcttgtga

SEQ ID NO: 12518 - RNA, 1041 nt, unidentified
  source 1..1041: mol_type = other RNA; note = synthetic construct
ccccatccggctgtgatgacagctcgatgggaaggtctgcccctcctcccctcgctgagcgatcttgccgactggctggagatcgcgtccctgagcgagctccactggcttgcgggcattgatagaggacgggaagcacctccatccagagctgtgcactacacttatcggtggatcctcagaaagaatgggtcacctccacggctgcttgagtgcccaaaacctaagctgaaggcgattcagcgcaagatcctaagacagatccttgataaggtccctctgcacgatgccgcccatggattccgtcttcgccggagcataaggaccttcgccgtaccccacacaggacgcgaatgtgttctacgagccgacctggctgacttcttcccatcaatcaggtttgggagggtggccgctttttttgagacgagtggctaccccgcatccgtggctaggttgttagccggcctctgttgccatgcaccctctaaaaggggcattcgggcagccaagctgtctccattctcagccgccaaatggctgcgtcctcacttgccgcaaggcgctcccactagccctgcgttatctaatgcaatcgcattcaggcttgatcgccggttgagtggtctggcacaagcctccggggcccattataccagatacgccgacgacctggcatttagcggcggaagtgatctgtcacgaggtgctgatcgatttctcgccctcgtcgctaccattgccctggaggaaggattagaactgaactatagaaagtccagggtgatgcccgcatgcagcagacagcggatagctggggtcgttgtgaacgaaaccccaaacacgactcgcgcaatcttcgatgagctaaaagcgtgcctgcacagatgggagacaaagggcttcgacgcatgtgctgctgacgacccagagttttctgaccgcttgctgggacggattgccgccttggcccatctcaatcctaggaaaggtgagaaattgcgacagcgctttgaaagactcaggggggctcgtcagtga

SEQ ID NO: 12519 - RNA, 1155 nt, unidentified
  source 1..1155: mol_type = other RNA; note = synthetic construct
atgaccactgccatccccaggctgcttgcacaggcattcctaaacggcaagctccagcgggctgggatgattaaaagaggagcggaactcctgggccagaaatggaagtggcttggcccgctggccacaaggttcctgaaagagttcgggggcgctaaaccacgcttaggcgacgccgtccgattcctgcgacacgacgaagggctgtgcgttgcgcgtgctgggttacggatagctaaatggactccatctaacggggtggctgcaatgcggtggaagttaccagaaatggagtctcctgcagcattggccgaatggctgggcctgacagacgcagaggtggcctggtttgccgaccgcaaaaatatcaataagggtaaaagttcccactacacatattgcgtgtttgaaaagcccggaaagccagcccggctgattgaagcccccaaaacacgaatgaaggagctcttgcgccggctgctaacggacgtatttgagaagatccctgttcatgctgcggcccacggattcgttgcccgccattcaattaagactttcgcagccccccacgctggacaaccatgtctgctcaagatggatctggcaaacttctttccctcgattagccgggccagggttgaatccctcctcatcacagcagggtatgatgagagagtcgctgagctcctggctgggatttgtaccaaccgcgccccacgtgatgtagcaccggatcccatttataccaggcctcatctgcctcagggcgctcctactagccctgccatcgcgaatctttgtatgtttagagccgatcgtcgactgcgaggacttgccgagagtgctggagccgtctacacccggtacgccgacgacttggcatttagcggcgcttctgtgggtgacaggagtgcgttgaggatcgtcaggagaacccaccttagaatcgtgcggagaacccaggcagccgagccagtgaagcatgagagccctaggttgagacattcccgcgctggcagacccgtgcaatgctcctcaatgcgcacggattcacaccagatagctatcaggataattcgcgtgtttggttgctgcggatgtgccgtgtgggtcttccacgatgacagacaacccccgcagcggatcatgggttga

SEQ ID NO: 12520 - RNA, 1323 nt, unidentified
  source 1..1323: mol_type = other RNA; note = synthetic construct
atggccacccatagacatattgcaaaggtgatagcggggactgctgccgctggtcaactgaccgaggatgagatagttgccagggtcgccggcgtcctgggaaagagatggcgctggttgcggccacttgcacggaggatggaggagagatttgccggtcggaccagaccgagagagagcgctgtgcacaggtggatcatcgcagatgacggatttcaccgcgcatgtcgacagcatgcgatagttatcgtagaagaactgccgcatcgcccagaaatgcggcccccaaccggcatcgctatgacctggaacgtgcccacaattactacagtctacgacctggctcactgggccgacctcccactcgacgaactggagtggctggcagaccggcgaggcagagaaccttctgccgaggctaaataccggagatatcgatatagagtgttaagcaagggccagtctcggttccgcctcattgagacacctatctacaggctgaaattactgcagcgacacctgctttctggcatcttggaccatttgagccctcacgacgcagcccatggattcagaaaggggaggagcatccatacctttgcagacaatcacctcggaagacaagtggtgctcaaaatggaccttcgggattgtttcaccactattgacttcggcagggtttcccatctgtttcgccttgcggggtacccggaacgcgtagcagatactctcgccgccattacgacaaatacagtgcccgatcaagtttgggaggctgctagcggcgcgcatgtgttttgccccagtgaacgcctgccttcaatctatgcttccccccaccttccacaaggggctcctacttcaccagccatagccaacttgtgcctgtacaagcttgatctccgtctgacaggactggcgaaagcatgcggcgcctcatattcccgctacgccgatgatctggctttctccggggacgcagatttcgccaggtgtgtgcagagggtacgacaccatatcgccgctatcattcaggaagagggattcgaagtcaatcacagaaagacgcgtgtgatgcgcgccagtactcggcagcgtattacgggtattgtggtgaatcagcaccggaacatacccaggagggagtatgatcagctaaaggctatcttgcacaactgcatttctcggggcctccagtcgcagaatcgtgataaacacaccgactacagagcccacctagcagggcgcgtcgcctttgtcgaggccgtttcccctagtaggggtcagcgattaagggacatgctgaaccagatcgatccctga

SEQ ID NO: 12521 - RNA, 1347 nt, unidentified
  source 1..1347: mol_type = other RNA; note = synthetic construct
atgaaacgcgtcgcggagtggttcgcggtgcttttctccagagctgcaacaatcggcgagatgaagggcgctgctgctaggctgatcgggggacagccacgttgggttgccccaatgctccggcgtgctgaagccgatgcccaagtgagggacccccctagtgagttggtgggactcagcttccagtcttggatgcactggttgttgcatgaccgaggcttcctcgcacgcgtgtctgatccttttgcggccattcaccgcgggccggctgaatcaatgatgttgcctgccgccgcagctatggattggcccgttccccagatccttaccgtaggggacttagctcattggcttgatatctccccagccgagctgcactggttagccaatctggatgctagttggaagttgaccggacgcgagggacgacattatcagagagtcgcacatcagaaaaggtttggggaagtccgcataattgaagccccgcggtatcgcctgaaagtggttcagcgacgaattctgcatggtctactgaatagaattcccgctcacgacgctgcccacggtttcgtggcaggacgatctacccggacttttgcagagatgcacgcccggagccgcatggtgctgagaatagacctccggaacttttttgtgacaatcagacgcttccaaatcgccggcgtgttcgcactggcgggttatccagctgatgtggcctacgtgctcagccgcctgtgctcagctcaaatgtccgtccaggaatttagcgacctcgttggcagccccctcgagtttcggagggccagtggtgccccatcacttgcgcaaaccagaaggctgtacactagacctcacctgccccaaggcgcacctacatccccgatgctggcaaacctgtgcgtttaccggctggattgtaggctgtctggacttgccgccgcagtaggcggtcggtatagcaggtacgctgacgacctagccttctcggcagacctcgacgtgcggcagtccaagcgtctgtgtacccagatagccgccattgtgatcgaggaggggttccaggtacatgatcggaaaacaaagaggatgaggagagggacgaggcagcgcattgccggagtggtcattaacgagcatcccaatgtcactcggcagcaatacgaccagttaaaggcgatccttcacaactgtgcacgatacggccctgaatcacagaatagagatcagtgcgcagattttagagcccacctggaagggagggtcgctcacgtagggatgctaaacccaacgaggggcgcaaagctcaaacgtttgctgcagcagatcgactggggcagatga

SEQ ID NO: 12522 - RNA, 1017 nt, unidentified
  source 1..1017: mol_type = other RNA; note = synthetic construct
atgaagttccctgtccctaagattaggaccctgctgcagctggccaatctcttggagatcgaaccggaacagctgcgctggttagcaaacccttgtggtaggagaagtgctcccgacagctggagccgccactatcgatcacactggattagaaaacgaagtggcggctggcgcttgattgaggcgcctagatcccgactgcggtacgtccagcgcatcctgctggacacaatctttaacgccatgcccccacatgtccttgccttcggcttctgcaggaaccggtcagtgatagacttcgtgaaaccccacgtaggaaaggacgtctgttggaggtttgatctcaccgattttttcacgtcggtgactacagggcgggttgcagggcttctgcgcaatagcggttacccctgcgatgtagcgaatagcattgcgatgctcaccacagtgcaaacttccccgcggatcctatccgtggagcatccaagggccacattttcagtccagtcccccaagcatctccgtcggcacctgcctcagggtgctccaaccagtcccgccatagctaatttatgtgcctatcggcttgacgcacgtctgtctggcttggctcggagcgtgggaggtgtgtgctatagccgatacgccgatgacatcctgttctccggcgattctgaccttgcccgccaatcaggacgtctccgagcccatgttggagcaattgctatcgaagaggggttcgagatcaattacagaaaaaccaggctagcacgcgcttctcagcggcagtttgctgccggaattgtgcttaatgagaagctcaacgttccaagagaaaactttgatcgcttgaaggccatactgcacaattgcgtgaggagtgggccaacttctcaaaacagagacaaccaccctgcattcagacagcatctcgaagggagagtgcagtgggttgagatgttgaacaggggccggggcgagaaactgaggaaattactggaaagaatcgagtggtga

SEQ ID NO: 12523 - RNA, 1338 nt, unidentified
  source 1..1338: mol_type = other RNA; note = synthetic construct
atggcaacgcagagattcgttgcggactatctcgctagtgcatttgtgtgcggccggtgggagtgcgatgacctggttgatcgcggcgcagacgctcttggtaggaggtggagatggttaagacccctggcccaacgtgccctccacactttgggccatgataggcgcccttcccgtttccaggtcctgcgctttctgcgccaggatgagggcttgagacgcgcttgccacaagcacgatgtgcgtgtcggcgggctccagagaaaaccacccgaaatggccccaactgccggacacccagtaaactgggacgttcctcctttagtgaccgtgggagagcttgctgactggctggatctcaagctaacagaactggattggttcgccgaccgacggggacttgagaggaaagtgccgagaggcccactgagacactatcgctattactggctctctaaaagaataggtgggagcgccaggttgatcgagtccccgaaacagcgtctgaaggctattcagaggtgcatcctccacgaaatactggaccggatccctccgcatgaagcagcccacggcttttgccgcggccgttctatcagaagctttgtggcacctcatgctgggcagtccatcgtgctccgggccgatctgagagactttttcccttgtatccccaggcggcgagttgcaggcgtttttcgaacagccgggtacccagaggaagtctcacagtgccttgctgcactgggtaccaatgaagtgcccgacgacgtatggcgaagcttcccacaatatggaaacgtggccgaccggtggaggcatcagaggctctacgggcagccacatcttccccagggtaccgcaacatcacccgccattgccaatctctgtagttacagacttgattgtcggctggccggtttagcccggtcattcaggggacggtacacacgctacgcggacgacctactgtttagtggaggccgagtgctggctcggtctattggcaagttccaccgggtagtgtatgcgatcgcgatggatgagggattcgagataaaccctaggaagactcgcattatgcgccaaggggtcaggcaatgtgcggctggtctgaccgtcaatcggcatcccaacatccccagggacgagtttgatcgattgaaggctattttgtacaactgtgcaagacggggacctgggaatgagaaccacgcccgcctgccagagttccgcctacacttggatgggcatgtgagcttcgtcgaatccgtcaatcctgcccgaggccagaaactgagatcgctgtttgaaaggattcaatggcccgctacctga

SEQ ID NO: 12524 - RNA, 1338 nt, unidentified
  source 1..1338: mol_type = other RNA; note = synthetic construct
atggtgaaccaggaccttgtggcaagcgctctggccgcagcctttgtcgggggtagatggcaggttgacgaactggtagcccgtggagctcgcgctttgggtcgcagatggagttggctgaggccccttgccagcaggctcttacacgtgctgggagaggacagtctgcccagcagatcccaaatcgaacggttcttgctccaggacgccggctttcagagagcctgtttagagcacgctataagggtgggcggaccaggtcggaattaccccatgatgtctccagctgcgggcagtcctgcctcttggggagtccctcccttagtgacagtgggtgagcttgctaaatggcttgggctagaaggcaagcagttggattggtttgcagatcgcaggtctttggagcgaaccacccctgccggacctttgcgacactataaatactactggctgagcaagcggttaggagggtcggcacggctggttgaagcaccgaagtggaggctgaaaatgctacagaggagagtgctgcgtggcattctggataatatccctccccatgccgcggcacacggtttttggcgcggacgatccattcgctcatttgcggctgcccacgtaggacaggctgtcgtgctgaggatggacctgaaggacttctttccatccatcgccaaggcccggattgttgcagtcttccggaccgcaggctatcccgaagatgtgtgccaactcctcgctgccctctgtacaaaccacgtgcccgacgacgtgtggcaacgcttcccgcagtatgggggggctgccgatagatggagacatgagggcctgtatgcaaggccacatctcccacagggtacgcctaccagccctgccctcgcaaatctatgtgcctatcgcctggattgcaggttgacagggctcgcccatgccgtaggagggaaatacacacggtacgctgatgacctgttgttctcaggcggcgaagcgcttgccagatctctgcgaaggttcgaggcgactgcttgttcagtgataatcgatgaggggttcgccgtcaacttccggaaaagaaggatcatgcggcagggggtgagacaacacgctaccggccttgtgctgaaccgccacgtcaatgttgcacgtgacgagtacgatcgtctgaaggcaactctccataactgcgtatgccagggcccaactgggcagaacaggggaggcgttcgtgactggcgcctccatctgcagggccgaatcgcttttgtcgagtccattaatccagaccggggccggcgacttagaagactgttcgatcggattcaatggccccgcgattga

SEQ ID NO: 12525 - RNA, 1344 nt, unidentified
  source 1..1344: mol_type = other RNA; note = synthetic construct
atgagctcccggaagtcaattgcacgtaggctgactgtagcagtcctggcgggccgtttcggaaaggactctatactggaaagaaccctgccactgatacagggctcccccacatggctgaaacgatttgtggaccagttgatccggcggttcggcaatcagaggcctaagaggagctacgtccttgccttccttttgtcaaatagagagttcatcgacgccagtctgaacgaagactttgatgtgcagccatacttgcttccatccgagttttctccaagccctgggaatttcgaagccattgacgtcattcgactccggagcagcggtgaagttgcggcatggctcaagctgaatgagaacgaattatcctggttcgcagacagacaccagctcgaaagactctcaacggtcgggcctctgcgacactataggtacttttggaaacttaaacggcacgggagatgccggttgattgaggcccccaaatttcgcatgcgggagattcaacggaggctgctacgggagatcctcagcaggatccccgtgcataacgcagctcacgggttccgccggggtagaagtgccaattcccatgccgccccacatgtgggtagatcagtggttctgaaacttgatctggaagactttttcccttctgttcctcctatgagattgacacgactcctgatgcacaccggctaccccgaggatgtagcggagatcctgacagccctgtgttgcaatcacgtgccaagcgatgtgtttgactcttttccccatagggatgattggaagctgaggagacgcgccaaacaactatattgtaggccccacatcccccagggagctcccacttctcctgtgattgctaatttatgcgcataccgcttggacacccgactggctggtcttgcccagagtgctaacgcgacttatacgcggtatgctgacgacctgctgttttccggcgatgaccaattctcaagaggcattgataggtttagaatattagccgctgctatcgcaatggaagagggattcgcagtaaaccaccataagacccgtgtcatgaagcgttcgattaggcaagaggctgttggactagtgctcaacgaaaagatcaatactcgccgcgatgagttcgatcgacttaaagccacactgcaccgctgtatcctcaaggggccagaggctgtgaactgcggacagcatgcccactttcgccaacatctcataggccgcattcagcacatcgcccagagctcgcagagtcgccataccaagctcatggccttattcgaccagatcaactggtccgatccgcagtctccgagtacctga

SEQ ID NO: 12526 - RNA, 1326 nt, unidentified
  source 1..1326: mol_type = other RNA; note = synthetic construct
atgaatacccccgaaagtgccgccaggagacttgccgtggccatactcgccggaaaattcgagaaggaagccatcttacagagaactctcccaataatctctggaagcatcacctggatgaagcgtctggtaaaccagatcatcaagcgcttcgggaatcaacggccaaggcgccgcgaccttgtcacatttcttctgcactcgcgcgggttgtctaacgcaagcgagcaagaggattttcaaattcgcgcctatgaccaggccgctgattttttaccatccccaggcctatttgaaaatgtcggggtcttgcctctcaggtccgtgggagagattggtgagtggttcggtttaggtgagtcagaactgctctggtttgccgaccggagacagctggaacgagtgctgccagacggccctctgaggcactatcgataccactggaaactgaaaagacatggaaaatgcaggctgatcgaagcacccaagttccgacttagagaaattcaacgcaagcttctccgtgaaattctgaaccagatcccagttcacaacgccgctcatgggttccgcaaaaaccggagcgctcagtcacacgctgctgcgcacgtgggcaaggctatcgttctcaaaatggacttggaggattttttcccctcaattgcacctgcacagttggtgcgtatcctgatgcacgtcggctatcccgaggacgtggctgaggttctgactgccctgtcctgtaatcacgtgccttacgaggtgttcagcagtttcccccacatggcagatggccggcagaagagacatgcccagcagttgtattgtcgaccccactttcctcaaggcgcaccgaccagcccggctattgccaacgtgtgcgcctttcgtatggacagacgactcgccggactggcaaggtctgctaacgcggtgtacaccaggtacgcggatgatctgctgttcagtggtgacgaaaagtttgcgcggtcaataaatcatttcaggatctccgtcgccgcaattgcaatagaggaggggttcacaatcaaccatcataaaactagggtaatgaagcgaagtgtccggcaggaagctgtgggcctcgtgctcaacgagaagttaaatacgcggcgggatgagttcgacagattgaaggctattctacatagatgcgtactgagggggcctgccgctgttaatgaaggacgccatgccgatctgcggagccaccttcggggcagaatccagtacgttgcacagacaaatcagggcaggcacgcgaaactatctcgcctgtttgagcagattgactggtccgattga

SEQ ID NO: 12527 - RNA, 1440 nt, unidentified
  source 1..1440: mol_type = other RNA; note = synthetic construct
atgtcagtggcgagattcatcgcgcgagcaacacttagatggcgcgccgatcccctcacccataacgggactcgatggtccacagtgcccctgagcaccctgatggagttcgctaatcaggtcgcccgccaacttgccatcgccattcaacagggacggattgaagaggaagctttggtccaacgcatccgcgaacactgcctgggacggcagaggtggttacgcagctttgccaggcgctttgtggctcacttcggtgaggggcgacggtggagacgactaaggatggagcggtttatcctaaaagacgcaggcttcagacgagccgtcgccatgagccagctgtctctcaggagtggcataaatccagccccaggcatgtgtcctgcagcaggagccccggagcactggaagcttcccgagctcgctaccacaggtgatctggcccggtggctgaatctggagcccggagagctggcctggttctcggactccagaacccaggaacagacgctgccagaaggccctttgaggcactatagataccattgggtgctgaagaggggtggcagtgctcggctgttagaatgtcccaaacaacgtctgaagctttttcaacggcatgtgttattccagctcttaaatcggattcctattcacccagctgcacatggcttccaggcaggaagaagcgtacagtctttcgcccagccccatgtcggccgggaaatagtgatgaggctcgatctgcaggacttcttcccctctgttatgaagagccgcgtgctggccatttttctcactgctgggtacccagaacccgtagcggccatgctggctggattgtgcaccaacgctagtcctttcgccgttctcagttcctgtccggccacggtacacccaacccagagatgccaccttaaggatttgtaccgccgtcctcatctgccacagggtgctcctactagcgccgctctggccaacctggctgcctttcgtttggacctccggctgcacggcctggctaaagctgcaggagctgcctatacacggtatgcggacgatcttgtgttttccggggactcagcgtttgcaagaatggtcgagaggttttatatccaggtttgtgccatcgcacttgaggagggatttgcggtgcagactagaaaaaccaggatgatgcgtaggtctgtttcccagagggcagtgggcctcgtcctcaacgatcgactgaacacacctcgcagggaattcgactgcctaaaagctatcttgcacaattgcgtggtgcaaggggttgcagcacagaaccgtgcagatcatccacgctttaaggagcacttggccgggcgaatagcctacatggagtcaatcaatccgggccgcgggattcggttaagaagagatttcgacaggattatctggcctgaccccacttga

SEQ ID NO: 12528 - RNA, 1329 nt, unidentified
  source 1..1329: mol_type = other RNA; note = synthetic construct
atgagactcgccgcaaagatcgcccatgccctcgcgacagccattctgaacggcactctcacaaccgaaggggtttacaagaggggtgcggccgttttaggctgcagatgggcctggcttcgcccactagctaagcgcatcatagcacattttggcgaggggacaaggccccgggtgtttcgtctggaaaggtttattctggccaacggcggcttcctaaaggcttgcgagaaacaccagctgacgctgcggcccgatgcccatttcgaacccgctatgtgtcctgcagctggtccacccaggaggtggaaggtccctagaattaggactcccggggaattggccagatggttgggggtggagttcaaccaacttctgtggctggctgattgccgcacacaggaacagaaactgcctccaggccctttgagacactactgctatcactggcaaccgaagcgagatagtagcgcgcggcttatcgaatcaccaaaaccgaggttaaaaaccattcaacgccaggttttgcacgaaattctggaccgcattcctccacacgccgctgcccatggtttcagagccggaagaagcatacgctcctttgtgaaaccgcatgtgaagcgggaggtagttttgaagctcgatctgaaggacttctttccacggatagccagggcacgggtactggcaatattcctgacggccggctatcccgaagcagtcgccgaactgctcaccggactctgtaccaattctgtcccttccgaggtgatcaaagcttgtccagcagccaccaacccccttagggcacgagaggctaagcagctctaccaaagaccccatctgccgcagggagctccaacctcccctgcattggccaaccttgccgcataccgactggactgtcggcttgcgggcttagctaaagcagccggtgccaggtatacaagatatgcagacgatctggtgttcagcgggggaaaacccttcgctcgtatggtggaccgtttttacatccaggcctgcgccatcgccctagaggaaggcttcgaggtgcacactagaaagactaagattatgcggcgttctctctcacagcgagctgctggcatcgtgcttaatgaacaccccaacgtccctcgccgggagttcgacagactcaaagctgtcctgcacaattgtgtcgtgcatgggccagcgagtcagaatcgggacggagtggctgattttcgggcccacttagcgggacgcgtagctcacgttgaggtgatcaatcctgcacgagggcgaaagctgagggagggatttgagcgcatcgagtgggagtga

SEQ ID NO: 12529 - RNA, 1161 nt, unidentified
  source 1..1161: mol_type = other RNA; note = synthetic construct
tcgcgtactgctctcaccagattcattctcggaaatgctgggttccaggctgtttgcgaagaggaccctgatctgagcctgagtggctcacggcactttgttccagcgatgactcctcagaactcccgtgctgcatcttggcccgtgccaccacttgtggccctacagcagctggctgactggctgggcatcacgcctggcgagttggcctggttcggagacttgaatagcttgcaacgctccgtgccgaacggaccgttgtgccattatgggtaccactggattagaaaaaggggcggttctttccgcctagtggaatcaccaaaagctcgactgaaacagctgcagcggaaggtgctgcacgagctggtcgataaaatacccccccatgacagtactcacggtttcagacagggcaggagcatctgcagctttgtaaaaccccacgtaggcaaacgggtcattctcaagatggacttgcaggactttttcccttccatcaccaggtggagggtcaccggcatcttcctttatgccgggtatccagaggaggtcgcaaggctccttgcagggatatgtaccaacgaggcccccccgcaagtcttaaggagcctccctgcatgtgaacggcaaagggcctggcagctggaatccctgtaccagataccccacctccctcagggagcaccaacatcaccaggcctggctaatttatgtgcctacaagctggattcacggcttgccggactagcaagagcagccggagggacgtacacacgctatgccgatgatctgctgttttccggtgacgatgcctttgcgaggtctgtgaagagattttacatccatgccgcggccattgtgcttgaagaggattttaccatcaatttccataagacacgcattcagggacagtctgtgcgacagcgagccgctggcctcgttatcaacagtcacgccaatatccaacgcgacagctttgacaatttaaaggcgacactgcacaacgcagcccgttttgggcctgcaggccaaaacagagggggcgtggcagatttccgggctcatctgggtggtcgcattgccttcgtggaaatggtttgcccccccagaggggaaaagctccggcgaattttcgagcagatcgcttgggagggatga

SEQ ID NO: 12530 - RNA, 1356 nt, unidentified
  source 1..1356: mol_type = other RNA; note = synthetic construct
atggaacggcccccactgtcctcctccagctttcataggctgaggcgctactgcctcattctcgcgcgcgcattccttgctggtccctgggagagacagggactggtcgagcgtggtcgcgcaacggtccaacggaaagctaaatggttggactctgccgctaagcgtgcaatggaggcctttccaacctgtgccgctctgcgagaggctaggttggcggatcatctagcgggcgacccagacgtgcttaaggctgcgactagcggccgagttccccttcgcccacaagctcttgtcgacctgaggcctgagatgaggcctcctcccggaccgtctgctgcatggagcgttcccgctatcgcaaccccagcggagcttgccgccttctgcgatgtgagcccggttcagctggagggattagccgattgtcaggggcgggaaagacggacacctcgggaacccctgcgaaattaccgttaccgcgctttccccaaagcatcaggtggctttcggattatcgaggcccctaaacccagactccgccggatgcagaggctcctgttggatgaaattctggccaaaatccctgctcacgaagccgcacacgggtttaggccagggcgctctgtgatgagtttcgtagagcgacacgtgggaagacatgtggtattaaagatggatctggcggacttttttccctcgattaccgccgctagagtgctagccatcttcatgaccgcaggctatcccgaggacgtggcaaagctgttagccggcttgtgtacaaacgccgtcccgatgcacctggagaggcttctcggggggacaccagtgggagactggcgatccaggaagctgctggctggcccacatcttccccaaggagcgcctacaagtcctgccctcgcaaacctggccgcatatcgcctggatttgaggctcgatgcattggccagatccgccggtgcccattacactcggtacgccgacgacatggtgttcagcggagacgaatctttcgctcgatcagcaggccgcttcgccctcagtgtatcagccatcgcactggaggaaggcctcgctgtgcgaaaccggaagactcgggtgatgagaagaggcgtccgccagagagctgcagggattgtcctgaacgaaaggcctaaaataccaagggatgactatgataagctgaaggccacgctccacaattgcctacggcatggcccggccggacagaatagagatgggcacatggacttccgggcccacctgttgggcagaatcgcctatgttgctcgtatccaccctggtagaggggaacgcttaatgaggagttttgatcgtataacctggtga

SEQ ID NO: 12531 - RNA, 1326 nt, unidentified
  source 1..1326: mol_type = other RNA; note = synthetic construct
atgagcagttcccgccatccccacagaaggtttgcgttggtgcttgcacgtgccttcctggccggtccctgggaacacccagagctggtggggagaggccgaacagccatcgggagaaaggggcgatggctggacgcagttgctaggcgcctgctggtcgcctttccttcacctgctgccttacgggcccgatggatcgcagaccatctgctggccgatccacagtttcttaaggccatagggaaagctagagtgccactccgtgcagagctgtcaccagtgatgaggccggctccaggagaaccagcctcttggctagtgcccgccattaccacccccgctgaactggctgcattctgcggcgtcacaattacccagctagagggactcgccgattgccaggggagggagaagaaagcccggagggagcctctccggaattatcggtaccgcgtcgttgcgaaacccagtggcggcagtcgcctcgtggaaagccctaagcctcggcttaaagcaatccagcggaggcttctcgacgagatcgtagcccgcataccaccgcacgacgctgcccatggctttagaccgggacggagcgtgtcatcatttgtcgccgggcatgccgggcgacacatagtgctgagaatggacctggcagacttcttcccttcgataactagcgcccgtgtcgaggccatctttatgactgccggctaccccgaagacgtggctaggctgctcgctggactgtgtacaaacgtggtacccaggcacttggaagacggggatggcgctgatcgggctacgggatggcattctagaagactgctggcggaaccccatttgccacaaggagccccatcctctcctgcattagccaacctggccgcccaccacttggacgtgcgactagacgcactggctagagcagcaggtgcgcgctatactcgttacgccgatgatcttgtgttctctggagatgatgctttcgctcgcagcgtccgccgcttctccattcacgttgcagcgattacattagaggagggttttgcagttcgacaccggaaaacccgtatcatgcgaaggggtgtacgccagagagcagcgggcattatgttgaatgtcaggcccaatatccccagggaagactatgatgccctcaaggctattcttcacaactgtgcgcggcatggccctgagggacagaacagggccggtgtttccgatttcagagctcatttgctcggcagaattgcttacgtgtccggcatccaccctcaaaggggtgcacgcctcaagcggaccttcgaccggatcgcatggtga

SEQ ID NO: 12532 - RNA, 1350 nt, unidentified
  source 1..1350: mol_type = other RNA; note = synthetic construct
atgggtcggcctccactcctgagtacccaaaatgccgagttcatcgtgcgcgagcttgctaacgcattcgtggagggcgtgtgggatctggacggtctagttgctagaggggaacagactctggggagacgtccgaggtggctcagacacctcgctaggcgcttattagccgcctttaacgatggtaggcgtccaccggcagctcagatcgcaagattcatccacaatgatagagggtttgatcgggtcagggagaggtatgaactgacaatggagtggtccaggaggcctccccctgtaatgtcgccaggaccaggagaaccagaaagttggcccgtgcctgcaattgtgactccagaagacttggcagaacggctgggtctgaccagatctgagctggattggttcgctgattcacaggctcgcgaaggccgcggatctccagagaaactgcggcactatcactaccgatggcaggccaagcggagtggatccgctaggctgattgaggcccccaagcctaggctcaaagcgattcaacgcaggttgctggacgagatagtcgccatggtacccccccatgacgctgcccatgggtttcgacttgggcgatccgtgcggacatacgtcgagccacacatcggccggacaattgtcctgaagatggaccttcgagacttttttccgtctatttctgctgcctggatcaccgccctgttcctcactgcaggctaccccgagccagttgcacggcttctcagcgggttctgcacaaacagcgtcccccctgacatttgggccgaccccagatgtcccatccaaggccccgagcactggcgtctcagacgtttacaccgacagactcatctacctcagggagcacctacctccccggcaatcgccaatttgtgcgcctatcgactggattgtcggctgcaggctctcgccacgtcagtggaggctcggtacacccgctacgcggatgaccttgctttcagcggggatcaacgattggccagggccgtcgaacgcttccagacccaggtaggcgccatcgcgctggaagagggctttgtggtgcagcatcgcaaaacaagagctatgagacaggccgttcgccaacgggttgcaggcgttgtgctgaatgtgcgccctaatgtccctcggccagactatgatagactaaaggccacgttgactaactgcataaagcagtcaccccagagccagaatagagacggacacgcagactttcaagcacatcttaggggcagaatagcgtacgtggccgcgttgaaccccaaccgcggacagaggctgcgtgctctcttcgaacagattgcctggtga

SEQ ID NO: 12533 - RNA, 1338 nt, unidentified
  source 1..1338: mol_type = other RNA; note = synthetic construct
atggtactgtcagcaagcagccttccgctgcgtctggcacgcaccttactcagtcggcccttcacatggcaggccgtcgaagaggcactcgttgatgctagggggggaccagaccccggcttgactagattggtgaccgtgctgttactgcgactgcgcgctctgcgcacacgagcaaggtctagggccgcactgcatgagctggtggactatctcgataactctcggcgggtcgaaagactatttggggaggtcggcccggaactagcagaacttcccccgccaaccatgctgccccttccaggtgcccccaaacgatggcaggtgcctgccattacgaccgtggcccagctcgcggattggctcagagtgcagcctgacgaactgctggctctggcctgcagatggcggcaggatagagagcatagagatgatcggctgcaacactaccaccgtaggtggcttccacgcaggggaggtcctcccagattgttggaggctcccaaggcccggctgaaagcggtgcagcgtcgcattcttaccggcatcctcaatgctgcccccccacatagagccgcacatggtttcgtacgaggacgtggggtaggcacttttgccgctgctcatgttggagctgcgtgcgtcctcagactcgacgtggctgatttcttcgcatccgttcgcggagcacgagtcaggggggtatttttggcgatgggttacccaatagatgtcgccgagctgctggcatgcctgtgtactacccgcacgcctgatcgtgtgtgtcatcggggcctgcacgacttcggcacagtaggcgcagtgctggccacacgattgagggccaggcacctacctcaaggtgcccccacttcccctgccctggctaacctggtggcgttccacctagacgcccgccttactggattggctcggaggtttggggcacggtatagcagatacgccgacgacctactcttcagtggagtgggtgccttcgtgagaggcgcaaaccgcttagccgtgtatgtcgccgccgtgttattgcaggaagggtttgcagcggcccaccgcaagacacgcagaatgcctcagggagtggctcagcatgcggctggcctcgttctgaacgtccacggggctgttccacggcgagagagggagaggctcgaagctgtcctggttaattgtgtgcgccacggccctgcctcacaaaatagagtcgggcgggtggactttgaggctcatctcagaggccggatcgcccacgttgagcaccaccatgcaccacacgccgctaggctttggaggtggtttgaccggatcgtgtgggaatga

SEQ ID NO: 12534 - RNA, 1320 nt, unidentified
  source 1..1320: mol_type = other RNA; note = synthetic construct
atgcccttatccgtcgagcagcacgcccgggatgtggctaggacgcttgtagctcgcccctttaccgcaccggctattgaggccgtcctggttgttgagtgtgggcgaccagatcctcggttggccaggctggctaaggctctggcgctacgctttggaggactgcgacggcccagagcacgcgaagtggcagattatctggtcagacgccgaagatacgccgagacagcggccgcatgtgagatgcagctgcaagacttgccaagaagatctatgctgcccttaccaggagccccagccacatggaaagtaccggctatcgtgacaaccaccgaactggccgccttcctgcgtgtcggtgctgaggaactcgcagcctggtgcaggaggtggcgaaggagtccgggcagacctgatcctagacacgagcactaccactgtcgttggctcccacggcatggtgccccaccacgtttgctagaagtgcccaagaccgcactgaagcgcgtgcagcgcaggatcctcaccggcattctgcaggctatacctccccatccggtcgcccatgggttcgtgagaggtcggggagttgcaacattcacagcgcagcacactgacagggactgcgtgttgcaactggacatcgaggatttctttggctcgatacaggaaaggcgtgtgagggccgtttttgtcgccgccgggtatccagtagatgtggcagcagcccttgcaagactctgcacaacccatacgcctccccgcgtcttagccgaactggtgagcaacgatagagcacggcggttggccacgcgcttagccatgacccatcttccccagggcgctcccacttctccagctctggccaaccttattgccttccggtgcgacctcagacttgccggtttggcgcgtaggtttggcggtgggtacactcggtatgctgacgaccttctgttctccggaggccccgagtttgccgctgatgctcgaaggtgtgcgactcacgcagcggccatcctggagactgaaggcttcgctgtggctcaccggaaaactagggttatgagacgtggagtagcacaacgagccggggggctcgtgctaaacagacatggagctgtgcctcgggctagcagagaaaggctggaggcaatcctcaccaattgtgttcggcacggccctgcgtcacagaatcgcgcaggggtggtggacttcgccgcacatctgcaaggcagggtcgctcacgtcgcccaccatcaccctcctcacggagtgcgcctcctacgactgctcgctcagattgactggtgccgctga

SEQ ID NO: 12535 - RNA, 1311 nt, unidentified
  source 1..1311: mol_type = other RNA; note = synthetic construct
atgaatcggcctgacttggctgctgcccttgtcgcgaggagaatagtggctggcactattgaacccgccgcggtgacagaagcccttgtcgagactggtgggctgagattgaggcgcgcacggccacttgctcgccagattgttcgacagtttggtggagtgctgcggcctcgttggagggacgtcgcaaggctgctggctggcaaccgtatgttccggcgacaatgccgaggttcagctgcagccggagctgctgcacctcctaccatgcggccagctgctggagcaccccaacagtggcccgttcctcctctcacaacccctggcgagctagccgcatggttacgcctgagtcccgaggagctcctgttccttgctgccagatggagagagaggttaccgtcggagccccgcgtcaggcactatcactacgcctggcatccaagaagacacgggccccccaggctattggaagtcccgaaggccaggctcaagtgggttcagagaagaattctgagggggatcctcgatcacatcccgccacatgcagccgctcatggctttcgccgtgggtgtaatatccttagctacacttctacccatacagggcgggcatgcgtgttgcgcatggacgttcaggattttttcccctcccttcggagaggccggatcgtacgaattttcctgaccgccggctatccagaacctgtggccacactgctggccgatctgtgtaccaccgcgaccccagccgaagtgctcagaccactggccgctcccatatctgctcgggcagcacagctacgggtcgcactgagaagcagacacctgccccaaggagcccctacatccccagcgctcgccaacctgtgtgccttcggggttgatgcgcgcctggcaggattagccaggaggtttggcgctacctttactcggtacgctgacgatctcctgttctcaggcgatgccggattcgccaggtccgccagacggtgtgaggtacgcgtaggcgcgattctcttggaattaggcctgacggtggcccaccgtaaaactcgagtccttccacgcagtgtgtgccagagggctgcgggtctggtgctgaacgagcgacctgggttaccgcgtcgcgaacgggacaggcttaaagccatcctcacgaattgcgtgcgccacggtcccgcttctcagaacagagccaatctgccagactttgccgcacatctgcggggacgagtggcacacgcattggccacacatcctgctagcgcagcccgcctcctcgcattgtatgagaggatcgtgtggtga

SEQ ID NO: 12536 - RNA, 1320 nt, unidentified
  source 1..1320: mol_type = other RNA; note = synthetic construct
atgagcttgctgtctagggacgtggactccctcgtcgatgcatttgtggctggagagtggaccgaacctagtatgctgcatcggtgtggagtgattgtcgacggcaaacctaagtggttgcctttcctgattcaacgagtattgaaacggttccccggtgtgcgcccaacaaggcgagccttaaccgatttcctctacgaggacagacgcttggccgccgcatcagagcggataacaacattaaccaatcacattaggatgaacagtgaattcgactgtcaacttacctcccttaaatcttctgtgcgacctacctggactactgttcggcagctggccgattggtttgatcttccggtcgaacacctgctgtggttcgcggacagctcccaaattggccgtcaacatccacacggccccctctgccattatcactatagatgggtagaaaagcgacgttcagggagacggctgatcgagtcacctaaaccaggcttaagacagatgcagcgcagactgctgaacgagtgtctccggcatctgcccgtgcatgatgcagctcacgggttctgcaagggaaggtcagtagacactttcgtgcagtcacatacgggtaggcaggttgttctcagaatggacctccagaattactttccctccctgaggccctttcgtcttatgcggttgcttatgctcgccggatatcccgaggtggttgcccgcactttaagtaacctgtgcaccaataccacaccaagctccgtcctgagagattactcgagcatctctctcagcaatagcgacagacatttgacagtgctgcttaggcagccacactttccacaaggcgcaccgacaagccctctgatcgcaaatctgctctcctataggctggatgctcgactgcagggtttagcccagagcgctgggattcactactcgaggtacgcagatgatcttctcttttccggcgacgagaggtttcgccgctgcgtcaaacagttccggatccatgtggccgcgatcgtgattgctgaaggcctcaacgttaaccaccggaagtctcgcatcatgctgcagagtcggcagcagcgtgctacgggtctagtcctgaatcagcacccggcggtgtcccgaagagactttgatctattgaaggccatactgcacaattgtattcgcttcggacctcagactcagaaccatagtgggatcgacaacttcaggatgcacctactggggcgcatccagcacatggccagataccatccctctagagctcagaagctaatgcactctttcgagcaaataaccttttga

SEQ ID NO: 12537 - RNA, 1305 nt, unidentified
  source 1..1305: mol_type = other RNA; note = synthetic construct
atgaaggtgtctcacttggctgatgccatgcttgctggagtctgggtgcagcaggagattacggagagagtcctgcaggtagttaagactccgcggcgctgggttccctctttggtacggagaacaatcttagccttccccgaccatcgtccattgaggagcgtgctctgccagttcctgatgactgatgatagtcttcggtcaagggcatgcgacgacgaatttgaggtactggcatattcaggcaacgatgagtttgataaccatcgatttgatgactcggctcgcagaccagtgcgctggcagacatttggacaactggcagaatttctggacctggagatctcggagctctcttggcttgcagacctgcgaggtttacaacgaaccgcccctgacgggcctctgaaccattaccaccgaagatggcagctccgacgcagggctgtccctaggttaatcgaatcaccaaagccccgtctgaaaagcgttcagcgccggattctacagtgttgcctgagtaggctcccactgcacagcgccgctcacggatttcggaagggtcgctccgtgagtacgttcctccaacaccacgccggccagtcctgtgtggttcgactcgatctccatgacttctttgggtttcttagcccaatacggctgttgcgtctcctaatgatgtttggctattccgagagcgtcgccaggaccatcaccgcgatctgctctaccacaactccagaacataccatcgagcggatgccccagaatttcgtggataggagacaggctactaccctgcagcgtctgcggtcacgtcatttcccccaaggcgctcctacatcccctgccattgcgaatctgattgcatggaaactggaccaaagactgactggactcgcgaccaccttcggggccacgtactccagatacgcagatgacctgctgttttccggggacgaagatttcaggagacgggcgcagtggttcacaacatgtgtcgcagccgtggctatggacgagggttttgaagtccagcaccggaaaacccgcataatgacaaggagtgtgcggcaacaggcttgtggccttgtcctgaaccacagaccgactgtgagcaggagagaatacgacgtgttgaaggcaactttacacaacgccgtgaggttcggacccgagtctcagaatagaagccgccactctggcttccggcagcatctattggggaggattaattatgttcgccagtggaatcctgccagggccgtgagactcatggcccttttcgattccatccgctggtga

SEQ ID NO: 12538 - RNA, 1296 nt, unidentified
  source 1..1296: mol_type = other RNA; note = synthetic construct
atgccatccaggatccaccacgcccgtcggttagctactgctctggccgcaggcagtatggcgaaccatgacgaactgattcatcgcgccgctcccctgatgggcgatattcggaaggcccggtggctgaaagcgcttgccagaaatctgtcacttgagttcgcagaggcgccaagaccgacgattaggaaaattacagaccgcatcctccacgatcctggattcacccgggcctggatcttagggaaggcccggatcggtattggtttcactcagcctgaaatggctcctgcaccaggaattgccgtggcatggggcgtgcccgcaatcacaacgctcgctgagctggcagatttgttacgtctccatcctgacgacctgggatggcttaccgccagaaattcatctgagcactataggtacaggtggcaaattaagccaaagtctggaagatacaggctgatcgaaagtccaaaggagttgctgaagggtgctcagcgcagggtactacggaaaatactgaacttaatcccgccccatgaagctgctcacggctttcgccctggcggatcaatccgaaactttgtcgaaccacactccggcaagcctatgctgctcaggtttgatctcgaagattttttccctagcataacctcgacacgaatctttcatattttcctgaccgctgggtatcccgagaacgtggctcaggcactgaccgcaatatgcactcatagcactccctcacagactatcggggagaaaccactcaatagccacgagagatctcgactaacaacccggcatctgccccagggcgcacctacatcccctgctctggccaacctgagcgcgtaccgcttggattgtcgattgcttggtctggcacagagtatcggggccacctacacaagatatgcggatgaccttcttttcagcggggaccagaagttcgctcgcaaatctaaaggactccaggccatgattgggggcataatcttggaggagcgattttccataaatcacagaaagacccgcgttctgaggcaggcccaaaagcagcacgccgcagggttgatccttaatcagaaaccgaacatcgaccgtagagagatcgatcaattgaaagccattctcactaactgcattaggtttggaccagagtcccaaaacagaaataatcatcccgactttgccgcccacctggctggcaaactcagctggatccgcttcattcagccccaaaaggccctcaagctggaaagtctattcgaacggatagactggcccgcctga

SEQ ID NO: 12539 - RNA, 1293 nt, unidentified
  source 1..1293: mol_type = other RNA; note = synthetic construct
atgccttcacaagcccagcacgttcggcgactagccgcagcactcgctgctggacccatggatgaccgggaggctatgctggcacgtgtgaagcctctggtgggtgacctgcggaaggctagatggctggagccactggtgcggaacttaagtctggaattcggagaggcccccaggcccgctatccatcacgttgccgggaggattctagggcatccgccttttgtcaaggcctggatagccggacaaggacgcatcctgcctctccccgtcacgccacagatggctccggctatgggtgcccctagggattggcagatccccgccattactaacctcactgagctcgcagacgaattgcgccttcacggagatgacctggggtggttgatagcgcacgggcaggctgaccactacagacaccggtggcaggcaaaaccaaagagcggccgcttcagactcatcgagagccctaaaactctcctgaagtttgctcaacggcaggtgctcaggaggattcttgacgctattccaccccatgaagccgcccgaggcttcagacccggcaactcaatccgagatttcgttgaaccccacaccggaagagagctgctgctgcgctttgatctcgaggactttttcccttctttatgtgccgcgcgagtgctgcgtattttcctcaccgcagggtatccagaaaccgtagctcgtgccctgacccgccttacaacaagagcaaccccacattccaccctggaggagaaaacccttgcctgggccgagaggaggaggcttgcaacaccccatttgccgcagggagcaccaacgtccccagctctggccaatttaggcgcctttcggttggattgccgccttgcgggtttagctgaagcggcaggcgctcgctatacacgttacgccgacgacctgctatttagtggaggtgccgatttcgcacgccagtctagacggttcgagacagcagtgggcgccatcatattggaggaaggctttcgccccaatcatcacaagactagagtactgagacagggccaaaagcaacacgccgccggcctggtgctcaatgacaaaccaaacatcgaccggcgagactttgatagactgaaagccgtcttgactaattgcgtgcggcatggccctgcgagccagaacagggaccatcacgcggactttgccgctcacttgcaggggaaactggcatgggtcaggttcattcaccctggtaaagaagaaaagcttcaggggattttcgataagatcgattgggattga

SEQ ID NO: 12540 - RNA, 1356 nt, unidentified
  source 1..1356: mol_type = other RNA; note = synthetic construct
atgacgcctaccgaggagcgctggatcgcatccctggccaaaatggctctcgctggagaatgggaagccgccgccttgcttgagcgaggacaagtatggctcgggtctaggcctaggtggtggctccggcttgtgcaccgcctattacgtcagttcggaccgggtacccgtcccaggctgtctagagtggaaagcttcctcaggcgggacccctggctacgtaaggttctgctcaagggagatttaaagggggatgcaaatcccccagaacctgttcagtgcgcggcaagagggcgccctgctacatggaagctgccttccttcactcgccccgtggagctggccagctggttacgtgtctccgtgggcgagttggagtggcttgctgatgcacagggttggcggtctggggaagcctgcgaaagactcgggcactatcactatcgctggctcagaaaacgggacggctcagcaagactgatagagtcccccaagcagcacctgaaactcattcagcgaggtctgcttgacgccgtcgtgagcgcaatacctgcgcacgaatcggcccatggattccagcctggaaggagtacactgacccacgtcgggccacatatcggtcgggaggtggtgctaaagtacgacttgcgggatttttttacacgagtaacgcgcccacgcgttcaggccgtctttcgaacagctggctacccagaggccgtggctgctttgttggcagccctgtgtacccacagaacccccgcgaggatctggaggcagttcccaggcttcgagactgatcctctgatccgagctcgggcccgtaattggcagtgtcctcatctgcctcagggcgctccgacctctccagctttagccaatcttgttgcgtacagactggactgcaggctagcagggcttgccaaagcagccggcgcgtcatacactcgctatgcagatgacctgttgtttagtggcggtagcgaacttgctagaggcgccgagcgctttgggatcatggttggcgccattgcactggaggagggcttcgaactgaacactagaaagacccgggtgctgagaaggggcgtagcacagagggctgtcggactggtgctgaatgataggatcaacgtgcccagggccgagtacgaccggctgaaagccattctccatcactgtgtccggcaagggccggcaggtcagaacagagaaggagtgcccgactttgctgcgcatctggccggacgagtggcttatgtcactcaaacaaacccacagagaggcgcccggctccaacagtggttggatcaaattgactggagtcgctcatccgaaagcgccgccgctacatga

SEQ ID NO: 12541 - RNA, 1338 nt, unidentified
  source 1..1338: mol_type = other RNA; note = synthetic construct
atgcagactgcccgcgacgccgcgagaaccattgctcagctcctactctcaggcccgtttgatgagcctgcagtctgggaacgattgcgtcccttggctgggaggcgtcgctggttgagattttgtattcggcggatgctgacagcctggaaaggcactggacatccctcttcagcgtggatcatcgacttccttctaagtgatgcccgctttcaggctagttggccaacactccggacccctgaacccaggatgtcacccgctgcaggtgcaccattgcagtggccagttccatcgctcggcacacccgatgaggtagcgacctggctggcggtgagccacagagagctggaagctcgcgcagatacctggggcagggaagcaaggactcctgctgggccaatgcgcaacttcgattactcctggagagggaagcggtccggtgcagccagactcatcgaggcccctagaccccgtctcaggagcctgcagaggaaagtcctgcacggggtgctggatgcaattcccccacatgacgctgctcacggtttccggagggggaggtccgtggctaccttcacagccccgcatgtgggtaaacagattgtggtgcgcatggacctgcgcgactttttcgccagcattcacagagcgcagatccaagcgatttttgctacagccggctaccctccagccgtcgctaagctactggcggcactttgctggaacgctgcccctgacgatatttggttggatttccctggaacgttacccgacgaccttgggcggttaccggcagctagactgtatcgcaggcctcacttaccccagggagctccgacttctcccgccgtagccaacctgtgcgcctaccgtcttgattgcaggcttgccggtcttgccagatccgccggagctgcttataccaggtatgcagacgacctgctgttctcaggagacgcagattttgcccggacggctcggcgatttaccctgcatgtcgccgccatagcacgcgaagaggggttcgcagcccaccctaggaagaccaggctcatgcgacagggcgttcgacaattcgccgccggcgttgttctgaatgaacggcctaatgtgccacgacgggactacgagcggctcaaggccatcctgcaccgagcagccagaatcgggccaagtcccagcgccggagagacattgatgacttatcgtgcacgcctggctggaaaaatagcctgggtggcttctatctctccccggagaggcgagaagctgcaagcagtgtttgaacaaatcgattggggcagaccaaatgtcggccatagcctctgtgagtga

SEQ ID NO: 12542 - RNA, 1290 nt, unidentified
  source 1..1290: mol_type = other RNA; note = synthetic construct
atgctgaaagcccgacacattgaatcactgacccggggagtggcagcagcgttactcgcaggaccgtgggaatgggaggccatgttggatagatctgctgacgctcttggcagacggtggcggtggaggagaggcctaataagggacatgctgttgcagcatccttcgcctgtagcctacgaagcactggtgcaggccatcgctgcgaacccccatttccgcggggctatcaacgatcggacgcgaccacatatcgtgcactggtttccatggccaacaggtatggcccccagatatccagcctggcatctccccgtcatcagttcagtcggtgctctagccgctctactcgacctgcctgaggagaagctgcactggctcgcagactgtgaacatcggcagggccggcccgacgaactgttacgtcgccattacagacactattggctgagaaaaccgtcaggcggatggcgcctggtggaggaaccacactaccttctcaaacaggcccagaggggcattttgcacggcgtcctggatcgtgtacccccccatcccgctgcctgtgcattcgtccataccagaagtgtcgtggactatgccgccccacatgttgggagggagttggttttgcacctcgacctgaaggagttcttcccttccattcctgcatctcgagtacacgccatgctgactaccctggggtaccccaccgaagtggctagactggtgacagggctgtgcacatccaccgttcccggctatatttgccgtcagaggccagggggtaaaatatacagcgctcctcacctccctcaaggcgcacctacaagtccagctttggccaatctcgccgcatatcggcttgacgggcgattagcgggtgccgcagcatccgttggagcatgctatactcgctacgctgatgatctcgctttttctggcgacgagccttttgcccgtagcgtgaatcgctttcaagccatggtctggaggatcgtagctgaggaggggtttgatatccatcatagaaagactagactgatgcacaagtccgtgcggcagcgcttatgcggactggtggtgaacgatcaccttagcatcgatcgcagggtgtacgatcggctcaaggcgattctgacgaattgtcttaggcacggtctggaatctcaaaaccgcgacggccacagcgatttccgagcgcacttgtgtggacgggtcgccttcgtggagcaggttaatccggccaggggagctaggcttcgcgaccttctgaagcaggtggcctga

SEQ ID NO: 12543 - RNA, 1440 nt, unidentified
  source 1..1440: mol_type = other RNA; note = synthetic construct
atgaggcgcaaaagtgccggctgcgccctgaggaatgattgttcacgctccacctgtcacgtggattcaagtagccgtccgttcctggctatgcatgcctctcggttcgacacagcgagaatgatagctgaagctatgcttgccggacccccggaacggggtggaatgttagagagaatcaagaccgttttaggagcggccccatcctggagccatgaacttgtcgaccacgccattgcccactttgggactcactgggctgacgtggataccgacctgctcgcaagcgccctggccgataccagtgcttttatgatcgcctggtatgggcgcgataggcccgttgtgatgaggattgtcaggcgaccccccgtacagagactgctgccagcccgtcttgcaggagccgatgtgccacagtggcctacctgtggcgatcttgcacggtggctaggggttagcgcacccgagctggactggctgagcgagagatggagagtcgatgctcgtggtagcgggtcccctctgcatcactacacatatacaggctacgataagcgccggggcggatgtaggctcatcgaaattcctaagggtcggctccgggaggcccaaagacgcattcttcacggcttgctagatagaatccctccacatgatgcagcccatgggttccgcaaaggacggggcatcgtctccttcgctgctcctcacgccgacagggatgtggtcgtgcggttcgacttggccgacttcttcgtgtcggtgagagctgcaagggttcatgcgctgtttgtaacgctgggctacccagcagaggtggctaggacgctgacagcgctgtgcacaaaccgggttccatctgcacgcctgttggaggctgacctcagggatcggttcgactggaccggcagacagaggtatcgcaacaggcacctgcctcagggggcacctacttctccagctcttgccaacttgtgcgcctttagactcgacatgcgtttagcagcactcgctcgctctttggacgccacctatactcggtacgcggacgacctggccttttcaggaggcggtgccttggctcgagaagcaggtcgactgcaggtcagagtggccgccatcgctctcgaggaggggtttgcactgcagctccgtaaaactcgcgtgatgcgaagaggagtaagacaacagctagctggcgtcgtggtgaaccggcaccccaatctcgcgcgcgacgaattcgacgtgctgaaggcaattttgactaattgcatacgccacggacccgcgtcccaaaacagggcagctcatcccgactttcgagcatacctcgccggcagggtagctcatgctcgagcactgaatgccgctcgaggggccaagcttcacgccttatttgcccggatagcctgggatgggtgctcattcggcgcgtga

SEQ ID NO: 12544 - RNA, 1263 nt, unidentified
  source 1..1263: mol_type = other RNA; note = synthetic construct
atgcacgctagtagatttgacactgctagaatgatcgctgaggcaatgttggctggaccgcccgagaggggaggtatgttagagcggatcacaactgtccttggggctgcacccagctggtcccacgagcttgccgagcatgccatagcccatttcgggactcactgggccgatgtcgacaccgacctgcttgccagtgccctcgccgatacttctgccttcatgatcgcctggtatggccgtgatagacccgttgtgatgagaattgtcagacgtccacctgtgcagcgaccacttccggcacgattggcaggggccgacgttcctcagtggcctacatgtggtgacctcgcacgatggttgggcgtgtcagcgcccgagctagactggctgtcggaaagatggcgggtagacgccagaggaagcgactctccactgcaccattacacatacaccgggtacgacaaacgccggggaggctgtcgcctgatcgaaaatcccaagggacgccttagagaggctcaacgtcgcatactgcatgggctgctggatcggattcctcctcacgatgcagcccacggcttccgcaaaggtcgtggcattgtgtctttcgccgctccacatgccgacagggacgtagtggtccggttcgacctggctgatttcttcgtgtccgtccgcgcagctagggttcacgcactgttcgtgactctcggttatccagccgaagttgcccggacactgaccgcgctgtgcacgaatcgagtgccctccgcccggcttctcgaagctgatctacgcgataggtttgattggaccggacggcagcggtatagaaaccggcatctgcctcaaggcgcacctacctccccagccttggcgaacctgtgtgcgtttcgcttggatatgaggctcgcaggcctcgcgcgctcattagatgcaacatacacgagatacgccgacgatctagcctttagcggcggcggggcattagctagggaagctggcaggcagcagctcgctggtgtagtggtgaacaggcatccaaacctggcccgagacgagttcgacgtcctcaaggccattctcaccaactgcatcagacacggacccgcaagtcagaatcgggctgcacaccccgactttcgcgcctatctggctgggagggtggcacatgcgagggctctgaataccgctaggggggccaagttgcacgcgctgtttgctcgaatcgcctgggatggatgcagctttggcgcctga

SEQ ID NO: 12545 - RNA, 1350 nt, unidentified
  source 1..1350: mol_type = other RNA; note = synthetic construct
atgcatgctagcctcttcgatactgttcggaccatcgccgaggctatgttggcgggtgcaccagaaagaggtggagtcgtggaccggatcgcggcagttcttggagctgcacccccgtgggcacacgatgtatctgatgacgcactagcccgctttggggcgcaatgggcagacgtggacacagaccgccttgcaggcatgttagcagacgcccctgccttcctcaacgcttggtacggccctcaccggccagtcgtgatccgagtggtcaggcggccccctgtacagaggccacttcctccccgcttagccggttgcgacgttcccctgtggcccacatgtggcgacttggccgagtggctgggagtgtccactgccgaacttgattggttaagcgatcgttggagagtggacgcccgaagcgctgacacacctcttcaccattacacctacaccgggtatgataagcgtagtggaggctgcaggctgattgaaatgccgaaaggacggctccgggaggctcagaggcgtatcctgcacggcctgctggacagagtgccaccccatgacgccgcccatggtttcaggaaagcccgggggatagtttcctttgcggcgccacatgccgaccgcgatgtagtcgttcgattcgatctcgccgactttttcgtgtctgtgcgggcggcccgtgttcatgctttgtttgatacgttgggctaccctgtggacgtcgctcgcacactgactgcactgtgtacgaaccgggtgccgtctgcaaggctgctagctcccgatctccgggataggttcgactgggccgccaggcagcgctatagatatcggcacctgcctcaaggcgctcctacctcaccagccctggcaaatctctgtgcgtttcgctttgatatgagactcgctgccctcgctaggtcgttaggggctacatatactaggtacgccgatgatctcgctttctcaggaggcgacgtactggctcgtgacgccgagcgactggagagaagagtggcggctatagcactggacgaagggttcgcccttcagctgcgaaaaaccagagtgatgcgacggggaactcgccagcagctagctggggtcgtggtgaatcgccacccaaatttggctagagatgctttcgatctactcaaggccattctgaccaactgcatcaggcacggcccagccagtcaaaacagagccgcacacaccgactttcgcgcccacttggccggcagagtcgctcatgccgcagcactgaatcccgcaagaggggccaagctgcaggcactgtttgataggattacctgggacacatgctcccccggtgcctga

SEQ ID NO: 12546 - RNA, 1350 nt, unidentified
  source 1..1350: mol_type = other RNA; note = synthetic construct
atgcactctagcctgagggacacaacacgcacgatagccgaggctatgctggccggcagtcctgagcgagacggagtggtggcacggatggctgcagttttgggcggagcacccgtgtgggctgacgaagtggccgatgcctccctcgctaggtttggagcccattgggccgacactgccatcgatgcccttgccgccgtcgtagctgaagcacccggatttgttcgggcttggtatggcgaccctcgtccggctgtgatcagggtagtcagacgccccccggtccaaagaccattacctgcccccttggccggttgtgaggtgccaccttgggcaaccccaggggatctcgcagattggctgggcgttagcgtgcccgcccttgattggttgtcggatcattggagggtcgatgctagatcaggggccaccccactccaccactatacctatgtggcagtcgataaacgaagcggaggctgtcgccttgtggaaattcctaaagggcgactgcgcgaagcccagaggcgtatcctccacgggctgctcgatagaatcgcaccccacggtgcggtccacggtttcagaaaaggccacggcattgtttctttcgcagctccccatgctgggcgcgatgtggtcgtgcgttttgacctggccgactttttcgtatctgtgcgggcggcacgcgtccatgctttgttcgctactctggggtacccggtggaggtagctcggactctgactgggttgtgcacaaacagggtgccctccgctagactgcttgccccagatctgcgggacagattcgactggattggccgacagaggtaccgcgaaagacaccttccccagggtgcccctacgtcaccagctctggcgaatctgtccgcctttagattcgatatgcgcttagcggcactggcccgaagtctggatgccacctacacccgttacgcagacgacctagccttctccggagggggagctctcgcacgtgacattgagcggctacagatccgggtggctgccatagccctagaggagggatttgccctccagctgcggaagacccgggttatgcggcgaggagccagacagcaattggccggcgtcgtggtgaacaggcacccaaatctcgctagggatgagtttgaccgcctgaaggctattctgacaaactgcatcagacacggccctgccagccagaatagggacgcgcatcctgacttccgggcacatcttgcaggtcgcgttgcccatgcggctgcgttaaacgctgccaggggcgcaaagctgagagcactcttcgaccggatcgcatgggacgcccatgatgcgggcaggtga

SEQ ID NO: 12547 - RNA, 1350 nt, unidentified
  source 1..1350: mol_type = other RNA; note = synthetic construct
atgcacagctctctgagggacacaactaggaccatcgccgaggcaatgttggcgggacctcccgagcgtgatggtgtggtcgcccgaatggcagctgtcctcggagaggctcagccgtggactcccgagtgtgctggcactgccctggcaaggtttggcgcaaactgggccgacacggacacagacgctcttgcggctctgctggctgaagcaccagcctttgtgagagcttggagcggtgaaaggcggccagtggtgatccgcattgtccgccgccccttagttcagaggcccctaccagcacctcttgctgggtgcgatgtacctcagtggcccacccccggtgatctagcaggttggcttggagtgagcgctcctgagctcgactggttgagcgatcattggcgggtggacgcacgtagtggggctacacctctgcatcactatacatacgtggctgtagacaagcgcagtgggggctgccgactcgtcgagatccctaaagggcgtctgagggaggcgcagcgcagaatcctgcatgggctcctggaccgaatagctcctcacggggcggtacacggcttcaggaagggacatggcattgtgtcctttgccaccccacatgccgaccgcgatgtggtggtgcggttcgacctggctgacttcttcgtgtcggttagagcagcccgcgttcacgccctgttcgctaccctagggtacccggcagaagtcgctcggattctcactggattatgtaccaaccgggtgccgtcagctcggttattggccccagatctccgagatagatttgattggataggccgacagcgctatagggaaagacacctaccccaaggcgccccaacatccccagcccttgcaaacctgtgcgctttccgcctcgaccttagactggccgctctggccagatccgtcgatgcgacgtacacccggtatgccgatgacctcgcgttttcaggaggcggcgccttagcccgagatgttgcccgtttgcaggtgcgggtggcggcaattgcccttgaagagggcttcgccctgcagctcagaaaaactagggttatgagacggggcaccaggcaacaactggccggagtcgtggtcaataggcaccccaatctctctcgggatgcctttgaccgcctgaaggccatcctgaccaattgtatcagacgtggacccgcatctcagaaccgcgacgcccaccctgattttagagctcacttggccggcagagtcgcccatgccacagcgttgaatgccgcacggggggttaaactgagggcactgttcgatcgaattgtatgggacgcaggaggggccggtcggtga

SEQ ID NO: 12548 - RNA, 1350 nt, unidentified
  source 1..1350: mol_type = other RNA; note = synthetic construct
atgagggcatcactcagcgacacagtcaggacaatcgccgaggccatgttagccgggttacctgaacggggcggagttgccagtagaatagccgctgtcctgggagacgcacctccatgggcgcatgagttagccgatgcagcgattgcacgttttggtcctaactgggcagacgccgacattgacgcactggccaggttcgtagccgacgcacctgggtttgttcgggcatggcacggagacagaagaccgggagtgatgagagttgtcagacgcgcgccagtacagcggccacttccagcaccactcgccgctagcgatgtgccccagtggcctacgtgcggagacttagcagcctggctgggcgttagcgcctcagagctcgagtggctctccgataggtggagagttgacgctcgctcatctgggtcgcctctccatcactacacatacgtggcctacgataaaaggcgtggcgggtgtcgcctgatcgaaatccccaaggggcgattgcgggaggctcaacgacgagtgcttcacggactcctggatagagtgcccccgcacgatgctgtacacggcttccgcaagggacggggtatcgtaagctttgccgcaccccatgcggacagggatgtggtggtgcggttcgatcttgccgacttcttcgtctctgtgcacgcggctcgtgtccatgctctgtttgacacgctgggctaccccgctgaagtggccaggaccttgactgctctgtgtactaaccgtgttccctctgcccgcctactggctcccgacttgcgagaaaggttggattgggccacccgccagcgctataggaatcggcatctcccccaaggggccccaacttcccctgctctggcaaatctttgcgcttttcggttcgatatgagattggccgcgcttgcccgcaccctagatgctacatatacccgttatgctgacgatcttgcattctccggcggcgctgcattggcaaggaatgcggagagactggaggtgaaagtggctgcaattgccctcgatgaaggttttgcactgcagctgcggaagaccagagtcatgagacgaggggtccgccaacaactagccggcgtggtggtgaacagacacccaaacgttgcccgcgacgagtttgaccggctgaaggccattctgacaaattgcatccggcacggtcctgctagtcagaacagggacgcccatccggattttcgggctcacctcgcaggaagggtcgcccatgccactgctctgaatgccgctagaggcgcgaaactgcacgccctgttcgggcgaatagcttgggacgccggtggcttcgatacctga

SEQ ID NO: 12549 - RNA, 1350 nt, unidentified
  source 1..1350: mol_type = other RNA; note = synthetic construct
atgtatgcacctcttagcgacaccgtccacaccatcgccgaggcaatgcttgcggggtcacctgagccagatggtgtggcagcccgcatcgcagccgtcacaggtgatgccccgccatgggctagaccactggctgatgccgctacagtgaggttcggccctcgatgggcagacttggacattgatacgttggccagatttgtggtggattcacccggcttcgttagagcctggtacggggccgataggccagctgtgattaggatagtgagacgtcctcccgtccaaagacctctcccattgcccctggcagggtgcgatgtaccacactggcccacctgtggagatctcgctggatggctgggtctggacgccgcagaactggattggctcgccgacagatggagagtggatgccagggggagtgaaacaccactccaccactacacttacatggcgtgtgacaagcgcagaggcgggtcgaggctgattgagatcccaaaaggccggctgcgtgaagcccagcgaaggatcctgcacggactgttggaccgagtccctccccatgagtctgcgcatgggtttcgtaagggacgcgggatcgtctccttcgctgcacctcatgctgaccgcgatgtggtgattcggtttgacttggcagattttttcgtttccgttcgcgctgctcgagtgcacgcactttttgacacgcttggttatcccgcagaggtagcccgcatgctcacagccttgtgcaccaacagagtgcccagcgctcggttactggctcccgacttacgcgaccgcttcgattggacagggaggcagcggtataggaaccggcacctaccgcagggcgctcctacatcccctgcccttgctaatctgtgcgcgttccggttcgacatgaggctagctgctctcgcgaggagtctcgacgccacctatactcgctacgcagatgacctggccttttctggcggagccactctcgcaagggccatcgaccggctgcaagtgcgggtagcggctatcgcctttgatgagggctttgcgctgcagttgaggaaaaccagagtcatgcgccgaggcgcacggcaacaattagcgggcgttgttgtcaatcggcaccccaacctcgcccgtgacgagttcgaccttcttaaggctatactgactaattgtgtgcggcatggcccggccagccagaacagagatgcacacgccgacttccgtgcccatctggcaggacgagtagcccatgctgctgctctgaatgccgcaagaggtgccaaactgcgggccctattcgaacgcattgcctggggagatgctgaagccggaacctga

SEQ ID NO: 12550 - RNA, 1356 nt, unidentified
  source 1..1356: mol_type = other RNA; note = synthetic construct
atgtacagcagcctgtatgacatcacccgtacccttgccgaggcaatgctcgccggacctccagaaacagatggtgtggctgccagaatggccgctgtcttaggggacgcacccccatgggtgcatgctgtcgcacgggacgccatcgagcggttcggtaatctcggaaagcagtgggctgcaatcgagcccaatgatctgtcactgcttgtggctagcgcccctggcttcgttgctgcctggcattctgatgcgaggccgaccatcgtcaggattgtactgaggcctccgcaacaacagcccccaccacctgcccttgatgcacccgacctgcctcgcctgcccactttaggagatttggccgattggctgggactgagcgttcctgaattggactggttggctgatcgttggcgcgtggccccgagatcagagacacccttacaccattacacgtatcgggcctttgacaagagaggagggtcctgtcgcctggtggagattcccaaaggccatctgcgggaggcccaacgcagaatcctgcacgggttactggacagagtgcccccacaccatgctgcacacgggtttcgaaaaggcagaggtatagtatcctttgccgcacctcacgcagaccgcgatgtggtgattcgctttgaccttgctgatttcttcgtcagtattcgggcagccagaatccacgctctctttcggacgctggggtaccctctggaggttgctagggcactgaccgcgctgtgcacaaacagggtgccttccgccaggctgttggctccagatctgcgagacaggctcgactggtcgggacgccagaggtatcggaacaggcatctccctcagggggccccaacatctccggctctggcaaacctctgtgccttccgattggacacccggctcgctgccctagctcactctttggatgccacatacactcgctatgcggatgaccttgcctttagtggtggcgccgtacttgccagagccgctgagaggcttccagcacgtgtcggcgcaatcgccctagaagaaggctttgcactccagtggagaaagaccagagtcatgcgcagaggcgttcggcagcgactagctggtgtggtggtgaatcggcaccccaacctcgcacgagacgaattcgatactctgaaggcgatgttgactaattgcgtaagacacggccccgcctcacagaatcgggtggctcacccagacttcaggggatacctcgctggacgcgtcgcccatgcgactatgctgaacgacgcgcgaggggccaaactacaggcgattttcgatcgtatagtttgggacgccggcgatggcgacgcatga

SEQ ID NO: 12551 - RNA, 1338 nt, unidentified
  source 1..1338: mol_type = other RNA; note = synthetic construct
atgaacgcgagcctgtatgatctcactcacacactggccgaggctatgttggctggaccacctgagcccgacggcgttactgcacggatagcgtccgtgctcggagacagtcccccttgggctcgcgaggttgccgtgaatgccatcaattctttcgggcccagatgggcagacgctacaccacgggatttgtcttttgtgatagcggacacgtccggattcgtgaacgcatggcagtcagacaaccctccgaccatcgcaaggattgtgctgcgaccccccgaacaaagaccacctccccaagccctagccgccctagatcttcctcagtggtccaccaccagggatctggctgattggcttgggctggccatcccggagttcgaatggctggctgaccggtggcgagttgaaccccggtcatcggggacgcctttgcaccactatacttacaggacatttgacaaaagggacggcggatgccggctgatagagatcccaaagggacatctccgagaagcccagaggcgcatcctgagagggctgctggaccgcattccgcctcacgaggctgcccatgggtttcgaaaaggcagaggcattgtctcatttgccgaaccacatgtggactgcgatgtggtcatccggtttgacctcgcggacttcttcgtgagcatcgatgcaaagaaggtgcatgcattatttgccaccctgggctatcctctagaggtcgtgcgcgccctgacagccctctgtaccaaccgcgtcccaagcgccaggctgttagcagctgacctgcgggacaggttagattgggccggaaggcagcgttacagggagaggcacctcccccagggtgcttctactagccccgctctggctaatctctgcgcttttagacttgacaccagactggcggcccttgcccattctttagatgccacgtacaccagatacgcagatgatctcgcattctccggaggtccagttcttgcgcgtgtggccgaacggctacctgtacgcgtagcaagtattgccattgaagagggcttcacacttcagctcaggaagactcgtgttatgccacgcggtgttcgacaaagaatcgtcggggtcgtcgtgaatcgtcaccccaatctggctcgcgatcagttcgacgctttgaaggctactttgaccaattgtgtgcggcatggcccactgagccagaacagagacgcacacgctgattttcgcggctatttggccggtcgggtagcccacgccacaatgctcaacgccgcaagagggagtaaactgcaggcaattttcgatcgaattgtgtgggagggcgtatga

SEQ ID NO: 12552 - RNA, 1395 nt, unidentified
  source 1..1395: mol_type = other RNA; note = synthetic construct
atgcactccagtctgtacgacactacaagaaccattgccgatgctatgcttgccggccctgctgaacccgatggtgtagccgcccggatagctgctgtcctcggagacagcccaccttgggtgagggacgttgccctggatgcgatcgcccgatttggcgagcggtgggcagacgtcgaaccagacgaacttagccggctggtggtgggagcacccggatttgtagaggcatggcggagaggaggccgaccaaccatcgtccggatcctccggcagccagcagtccaaaggcctctgccaccgcccttagcagccctagatctgccacccctgcctccattacctcagctccccacttctggggatctggcggattggctggatttgacagtgccggagctcgagtggcttgcggatagatggcgtgtagccgctagaggtagtgaaacaccgctgcatcactacacttatagagcatttgacaaacgagacggcgggtgcaggctgatagagattccaaagggaaggctgcgtgatgcccagtcaagagtgttgcatgggctccttgatcgagtgcccccccatgacgctgctcacggattcagacggggcagggggattgtcagctttgctgccccccacgcggatcgcgatgttgtgatcaggtttgatctcgccgacttcttcgtctccgtgcgagcagcccgtatccacgcccttttcggcacactgggctaccccgcagaggtagcccgaactctgaccgctctgtgtaccaaccgggtgccatcagcacgccttctggctcccgacctgagggatcgatttgactggtccgggcggcagcgttatagaaaccggcatctgccgcaaggcgctcctacaagccctgcactcgcaaacctttgcgccttcagactagacacgaggttagccgcactcgctcgctctctcgacgctacctatacgcgctacgcagacgacctggcttttagtggcggggctggcttggctagggccattgagcggttgcaagtccgtgtggccgccatcgctctcgaggaaggtttcgccttacacatgaggaagacccgcgttatgcgcagatcagttcgccaacgcctggccggagtggtggttaaccgccaccctaatttggcaagggatgccttcgacaccttgaaagccatgttgactaattcggtgaggcatgggccagcgtcccagaatcgcgacgcacaccctgacttcagaggatatctggccgggagggttgcgcatgcgactatgctaaacgccacaagaggtatcaagctgcgggccatattcgaccgcattgcctgggatgctggcgatgtggacaccattcccgacggaaatggttctcagccttga

SEQ ID NO: 12553 - RNA, 1350 nt, unidentified
  source 1..1350: mol_type = other RNA; note = synthetic construct
atgaggtcctctgtctacgataccgctcggacaattgccgatgccatgctggctgggccacccgatcctggtggtgttgccgcaaggatggctgccgtactaggtgatgcccccccatggctccatgatgtggagcgcgacgcagtggccagattcggtgcacggtgggctgcagtggaagcagacgacttgacccgactggtcgccgaggctccaggttttgtagcggcatggcgttccgattctcccccggctattgtgcgtatccttcctcggccagccgtgcaaagaccccttccagcagcccttggagccctcgatctgccccagtggcctacacctggggaactcgcaggctggctgggaattgctgtccctgacctcgactggttagcggaccggtggagagttgccgctaggggaagcgagacaccactgcaccactacacctaccacgccttcgacaagcgagacggagggtgcagactgatcgagatccccaaaggccgcctgagggaagctcagcgcagcatactgcatggcctcctcgatagagtgccgcctcacgatgcagcgcacggctttagaaaagggcggggaatcgtttcattcgccgcccctcatgcggatagagctgtggtgatccgcttcgatctcgccgacttcttcgcaagcgtgagtgcggcaaaggtgcatgcactgttcgacaccctgggctatcctttagaagtcgtgcggacgctcacggcgttatgtactaaccgcgtcccctcagcaaggctatttgccccagacctgcgggataggcttgactggtctggcaggcagcgctaccgaaaccgccacttgcctcagggagctccgaccagtcccgccttggctaatctgtgcgcctttcggctggacactcggttggccgcactagctcgctccctcgatgccacttatacacgttatgccgatgacctggcgttttcggggggcgctgtgcttacacgcgcaactgagtggatgacagtgagggttgccgctattgcgctggaggagggctttgcccttcagctgagaaaaacccgggttatgcgaaggggggtccgacaaaggttggccggcgtagttgtgaacagacatcccaatctggcccgggacgaatttgacactttaaaggcaatcttgaccaattgtgtaaggcacggaccagccagccagaatagggccgcccatgctgacttcagaggatatctcgctgggcgagtcgctcacgccaccatgctgaacgctgctcgtgggatgaagctgcaggccattttcgacagaatcgtgtgggatgcaggcgatataggcgcttga

SEQ ID NO: 12554 - RNA, 1350 nt, unidentified
  source 1..1350: mol_type = other RNA; note = synthetic construct
atgcagcccgggttccggaacaccctcgtgattgtctgcgatgcaatgttggctggtgccccggaagttgcgggagttgtcactcggcttacagcaactttcggcctatatggcgcttggatggaagaagtcgcacagcaggccgttgacgcatttgggtccagatgggacgccacgcgcgtggatgagctgacacctctcttggaaaatgcacccgctatagtcgccgccttttcgtcccaagcctcccccgaaatcatccggattattagaagggcacctgctcaaaggcctcccccaccacagctggcgcatatcggcttacctcatctgccgactctgcgcgatctggccgagtggctcgagcttaacgactctgacttggcttggcttgccacaaggtggcgcgtggatcctggcgaggccagttctccattgcatcactatagctaccacgcacgcgaaaagagggatgggagacatagactcatagagcggccaaagtcactgatgcgcttcgtccagcacaaattgctgcacgggctgctcgatcacgtgcctcctcatgacgctgcccatggtttcaggcagggacgcaacattgtgtcctttgccgctccacatgcagataaatcactggtcatcagactggacctcgcagatttcttcgccagtattacccaggcccgtgtgcacgctacctttcacgctctggggtacccccttgctgtgtcacgagccctcaccgcactaagcaccaatcgggtgcccgtgcgagttctcagttgcggcgctttaaaggataaatttgactggactgagcagcagagactacgcgcgcgtcacttgccgcaaggggcatctacatcccccgctctggctaatctgtgtgcattccggttagatacccgtctcgcggcccttgccagatctctcgacgccgattatactcggtacgctgatgaccttgcattttcaggagccgctcgtctggagcgagtagcagaccgccttcccctgtgggttgcagcgattgccctggaggagggcttcaccgtgcagcctcggaagacgcgagtgatggccaggggtgtcaggcagcaattagccggcgtggtagtaaatagacacccaaacttggctcgggacaggttcgacgcactgaaggccctgctgacaaactgtgtgcgccacggacccgtgagccagaacagggacggaagagccgactttcgagcgagcctagccggccatgtagctcacgccacaatgctgaatccagctcggggagccaaactgcgagccatctttgacaggatcgattggaatagactcgaaagcgcgagctga

SEQ ID NO: 12555 - RNA, 1338 nt, unidentified
  source 1..1338: mol_type = other RNA; note = synthetic construct
atgcggctcaacttcagagatacactggtggctgcttgcgatgccttactggccgggcctcccgagttggctggtatggtcgcgcgcctagtgtctgtgttcggtacttatagagcttggatggatgacgtcgccagagaagccgctcacgggtttgcacccaggtgggacgccatccctgcacacgaactggctcgctccctggagcaactgcccgtctttgccacagtgtttgggaacgcttcccgacccgaagtggtgcgtatcgtacgcagggctccagtgcagcgaccccttccacctggcctcgagcaggtttctctgcccagactcgcgacccttcgagatcttgctgagtggctcgaggtcgccggtggagacttagcctggctggcaaccaggtggcgggttgaaccaggcgaagccgcatccccacttcaccattacagctatcatgcgcgcgagaagagggacggacggaatcggctgattgagcggccgaagcccctgttgagatttgttcagcacaaacttctacacgacctcttggaccgcgtccctcctcacgacgctgcacatggcttcagacgaggaaggtcaatagtgagcttcgccgcaccacatgctgaccagccactggtgattcggcttgacctcgccgacttcttcgcctctatcacccaggggagggtccacgcagtcttccatgctctgggctacccggttgccgtggctagagccctgacagcgctgtcaaccaatagagtgcctagccgaatgctcacctccggcgccctgaaagataagttcgattggacagagcagcgcagattacgcgcgcgtcacttgcctcaaggagcctccacttcaccagccctggccaacctgtgcgcatggaggcttgatacgcggttggcagccttggcccagagcctagacgccaattatactaggtacgctgacgatctcgctttcagtggggccgcacggtttcagagagtcgccgatagactcccgctgtgggttgccgcaatcgcgctggaagagggcttttctgtgcaaccccgaaagactcgggtaatggcccagggagtgaggcagcagttggctggagtggtagtgaaccgccaccctaatctcgcccgggatcgttttgacgcactgaaggctctgctcacgaactgtgtaaggcatggccccgctagtcagaatcgtgacggtcgggcagattttagggcagccctggcaggccatgttgcacacgccgctatgttaaacccatcgcgcggggcgaaactacaaggcattttcgatcgcatagactggagtcaaagctga

SEQ ID NO: 12556 - RNA, 1350 nt, unidentified
  source 1..1350: mol_type = other RNA; note = synthetic construct
atgaggctcaactttcacgacactctggtaatcacatgcgaagcaatgctggccggacctccagaggtggcctctattgtggcacgcctgatgctgatctttggcgaacatagtccctggatggacgacgtggctagaaaggccgccgatctgtttacaccgcgatggaatgacaccccgatcgacgagctcataagagtcgtcgaggatactccaacattcgtcgcggcatttggcactcatattcgccctgaggcgattcggatcataagaaggcctccagttcaacgacttcctcccaggcggctcgcacacgtggatttaccacatctgcctaccctcagggacttggctgactggctggaactggatgggtcggatatgagctggttagccaccagatggagggtagagccaggtgaggcggtgtccccactgcaccattattcttaccacgcccgggaaaagcgcgatgggcgctatcgacttatcgagcggccaaaagccctgattcggtttgcgcagcacaaaatactgagggaacttctcgatagggtgcctccccatgacgctgtccacggctttcgaaggggcaggaacatcgtgagttttgccggaccccacgccgataaggcactggtgattcgattcgatctgaccgacttcttcgcaagcgtaacgcaggcccgtgtgcacggcatgttcagaactcttggttaccccatcgccgttgcaagcgctcttacagcgctggccactaaccgcgttccctcacgcctgttcacactcggggaactcaaaggaaaattcgactgggacgctcagcagcggttgagagccagacaccttcctcagggagcatctacctcccccgctctggcaaacttgtgtgcctttcgcctagacacgagattggccgccctggctcattcagttgacgcggtttatacaagatacgctgatgacctggcattctctggcgaggctagtttaaaacgcggagccgatcggtttagcgcccgtgtcgccgcaattgcaagggaggaaggtttcaacctccatttcgggaagaccagagtaatggggcggggagtccaacagcggttagcaggggtggtggtgaaccgacacccgaatttggccagagacaggtttgatatgctgaaggctatcctaaccaactgcgtccagcatggccccgcttcacagaatcgtgccgggagggctgatttccgggcttccttggctggacaggtggcccacgctatgatgctcaatagctcccgcggcgccaagctacgtgctatcttcgaccggattaattggtcccaaggtaatagtgccggctga

SEQ ID NO: 12557 - RNA, 1338 nt, unidentified
  source 1..1338: mol_type = other RNA; note = synthetic construct
atgaggcctggaacacctaaaaccatagcccttctttgtgaggccatgctggcaggagaaccagaacccgcggcagttgctgcccgcttggttctggcctgtaatagacacgagaggtggatggaagcactggcgcagctcgcggtagagcggtttgccagggtgtggagagatacagaaccagatgagctcgcctctttatttgcccttgcagctccttttccacccggctggagtgccagggacttacctgcaattgcccggatcgtgaggagagcccctgagcaacagctgccaccgcctaggttggtgcacctggatctaccttccctgcctaccctgagagccttggctgattggctggaactttctgacgaggacttggcatggcttgccactcggtggagggtcgctccacatgaggctgctagccccctacaccactaccgataccatgtgcgggaaaaaccggacggccggcaccgactgatagagcaaccgaagccccttctgaggatggcccagcacaccctcctacatggccttctcgaccgcgtccctccacatgaagccgctcacggattccggcgggggagaaacatcgtgtcctttgccgctccccatgcaggtcagcccctcgtaatccggctggatttcgaggacttctttgggtcagtgacggaggcaagagtgcacggactgttccgtacactaggttacccagttgcagtagcccaggcgctcagcgctctggcaacacaccgcgtgccctcacgtctctttgacgtcggggatctgaagggcaagttcgattggcacgctcagcaaaggctgagagcccgacacttgccacagggcgctgctacttcccccgcactggcaaacctgtgcgccttcaggttggacgtccgcttagctgctctcgctcggggattcggcgctagttatacgcgatatgccgatgacttagccttctccgggggtgataagctgaagtcggtagctcgcgattggcccctctgggtcgctaggatcgcacgagaggaagggtttgccgtccggagccagaaaaccagagtgctgagaaacaatatgagacagcagctggccggtgtggtggtgaatcgtcatccaaacctgtctcgcgagcggttcgacctcttgaaagcaatgctcaccaactgcgttcgtcatggccccgcgagccaaaatcgcgatggccgagccgacttccgcgcatcacttgccggccatgttgcccacgcaactatgctgaatgcggcccgcggggccaagctgaaagcgatttttgacaggattgactggactagaggatga

SEQ ID NO: 12558 - RNA, 1368 nt, unidentified
  source 1..1368: mol_type = other RNA; note = synthetic construct
atgcagctcagtctccaccagacagtgattgctatcgctgaagccatgctcgccggggagccctatagagacagtgtggctgccagggccgcatcaattctaggtgcccagttaccttggctgtccgaagccgccgacgacgcagttcacagatttgggcaccgctgggatgacacccagcctgacgaggtggctccgttcatcgcagacttgcccggcttcgtgtctagctggatgagcgaagaacgactctcagttatcagaatactgaggcgcgcccctgtacaaaggcggctaccaccacccctggctcagatagagattccccagctgccggcccttggcgatttagccgattggctggagttatcccccgccgacctgggatggttggcgaatcgctggagagtcggcgcaagagacgggccttcgccattgcatcattacagctacagggtttgcgaaaaacgtggcgggaggtatcggctaatcgagcgtccaaagtcactgttgcgggcagcacaacacaaacttcttcacgggttgctcgaccgagtgcccccccatgaagctgcgcatggatttcgcaagggtagaaacattgtttcattcgctgcacctcacgtcggacagccactggtgatacgacttgatctggccgattttttcgtcagcgtgacagaggcgcgcgtccactccgtatttcggactctcggctataccagcgctgtggctcgagcaatgaccgctatggtaaccaatagagtaccctccgcccagttgcttgcaccagacctgaaaggcaagtttgattggctcgaacagcagaggttccggactcggcacctgcctcaaggagctagtacctctccagccctggccaatttgtgcgcgtttcgtctggatactcggctggccgccctggcaagatctcttaacgcaaactacacgcgatacgcggacgatctcgccttctctggtggggcccagttaatgtccgtggccgatcgcctacctgtcaaggtggccgctattgccatcgaggagggcttttccgttcagccacggaaaacacgcgtcatgcctaggggtgtgaggcagcaactggcgggcattgtcgttaaccagcatccgaacttcagccgcgacaagtttgacacactgaaggctactctcaataattgtgtgaaacatggagtggcaagccaaaataggtcggcacaccgtgacttcagagcttctctggccgggcatatcgctcacgtgaccatgctcaactccgctcggggagcgaaactgaaggcaatcttcgattgtatcgattggtctgagcccgtgggagatgagcatggcacgagtgccctgtga

SEQ ID NO: 12559 - RNA, 1470 nt, unidentified
  source 1..1470: mol_type = other RNA; note = synthetic construct
atgagccattgcactgctcgcgcgcctctcagaacagcacaggcccgatccaggcacacgggtaccctgattcgcggctctagtttcacgatgcagctggaccttagcgccgcagtgcagctgatagcagaggcagctcttgctggtccttctaagcatgctagtgtggtggagcgtatcgtagccgtagtaggcgccgatccgccctggtgtcacgatgttgcaactctggccgtccagcggttcgcttactgctggcgcgaggcatcgcccgaagacttagcgctgcttatcgtcgacgtcccagcatttgctgccgcctggagtggcgtggataggcctacattcgttcgcgtgcttaagcgggtgcctacccaagttgctccccccgtgagcctggcacacatatctattccactattgcccacactcgccgacctagctgattggctggagctgagatccaccgacctcgagtggctggcggatagatggcgggtcgaaggtcacgcacgacgtctgcaccactacgggtaccatgcttgtgaaaagcgcgacggcagatacaggctcatcgagaggcccaaaccgctgctgagaagtgcccagcacaagattctccaccagatcctcgaccatattccagtgcacgcagcagctcatgggttttgcaaaaggcggaatattgtgtcatttgcggctccgcatgcgggccaggctatggtattgtcctttgacttgcaagacttcttttcatccgtgaccgccgggagggttcatgccatcttccggaccctgggatatcctttcgctgtggcccgagccatcactgccctcaccacaaatagggtcccttccgcctattttgacgctccacccctgaggggtaagttcacttggcatgaacgggagagactccgagccaggcatttacctcaaggagccgccacctctcccgctcttgcaaatctgtgcgccttccgcctggacatgagactgagcgctctagcgagagctttgggcgcgcggtatacccgctatgcagacgatctcgcctttagcggcggatcagtgttagcccgggcttccgaaaggctctcaatccaggttgcggccattgccctggaggaagggttcgaggtgcacagcagaaagacacacgggatgccacgcggggtgagacaacagcttgccggagtcgttattaatcgtcaccctaacttagcccgggattgttacgatcggtgcaaagcagtgttgcacaactgtgccttgcacgggccagcctctcagaaccgagaggcacatggagacttccgcgcccaccttatgggcaaagtcgcccatgccactatgttgaacccacgtcgaggcgcaaaactgaaggtcctgtttgataggatcatatggccagaagatgctcccgcaagaccacccgatgatggaacagtgcacgctatgcctcagtga

SEQ ID NO: 12560 - RNA, 1473 nt, unidentified
  source 1..1473: mol_type = other RNA; note = synthetic construct
atgatcagtgcagttaggagaatgagcccactgtgtgtgctgagaaagacggctcacgcagccctggacgcattgacaaggcgtccagcgagcttccacgcaatgagacttagcccccttcagcggatcacatacgccattgccgatgcaatgctggccgggcctgccgaacccgattctatggtagagaggatgagtgacagcttaggtgtaccttcagactggatgctgggactcgcaaggcgcgttgcaaagagatttggggcgcgatgggattccgtggattccaaagaggttgcgctggtggtggctaagactgccgggtttgtagcagcgtggcgttctgaggccaggcccttcgttgtaagagtcttaaggaggccaccagtccaacaactccctcccccccgtcttagggagatagccctgccgaagctggctactctcggggatctcgccgcttggcttgaggtcgaagtggcagaactggactggtttgctgaccggtggcgcgtcttgcctcagggagctgatacccccttgcaccattacacctataaggctatcgagaaacgggacggcaggtgtcgacttatagagattcccaagtctcgtctccgctcactgcagcgcaaaatcctccacggactgctggatagggttcccccgcatgattgcgtacatgggttcaggaagggacggaacaccgtgacttatgccgcccctcatgccggcaaagccgttgtcgtgaggttcgaccttgccgacttctttgcgtccgtgcatgctcctcgggtgcacgctgtgatgcgcacgctgggatacccgttggaagtggctcggatgctcaccgctctatgcacaaatagggttccatcagcccgcctgctggctgctgatgtgagaggaaagttcgattggctagagcggcagcgatatcggactcggcacttaccacagggggcacctacatccccagccttggcaaatctgtgcgcctaccgactcgacctgcggcttgagggtctagcacgtgccgtcggagctacctacaccagatatgccgatgatcttgcgttttcgggcgacgaagacctggctcgggtcgttgagagactcaaagtgcgagtcgccgcaatcgccctagaagagggtttctcaatccagctgcgcaaaacacgcgtgatgcgccgcggtgtgagacagcacttagccggcgtcgtggtgaaccaacaccctaacctcgcccgcagcgaattcgacgcactcaaggcaatcttgatgaattgtgtgagacacggggccgcctcccagaatagagagggccatgcggactttcgagcacatctgcaaggccgggtcgcccaggctgtgatgttgaacgctgctagaggcgccaagctgaaaggcatttttgaacgaattggctgggaggacattgccaacgatagtagactggactctgaagcttga

SEQ ID NO: 12561 - RNA, 1356 nt, unidentified
  source 1..1356: mol_type = other RNA; note = synthetic construct
atgaggctgtcatctctccagcatgttacctttgctatcgccgatgccatgctagccggtcctccggaacctgacgcgctggtagctcgcatgacagccgctttgggagtccgcgctgattggatgaccggaatagccagaacaacctctagacgctttgctgcacgatgggagcacgtgaagagagacgaactgctgaggatgattgccgccactgagagtttccagctggcatggcacaatgagcaccaaagaccagttgtggtgcgggtcctgaaacgcgcacctcagcaagtagccccacctccccgactggctcatgtggctctcccccagttacccacattgggggacctcgccgcctggcttgaagtggacgacgcggacttgggctggttcgcagatcagtggcgagtgatgccacaggcttcgtccactccactgcatcactacagctataaagccattgaaaaacgagacggtcggtgccgacttatcgaaatgcccaagagcaggttgcgggatctccaacgtaaaatcctgaaggggctccttgagcacgtaccacctcatgagtgtgcccacggtttcaggaaggggcggaacacggcatcatatgccactcctcacctgggaaaggatgttgtggttcggttcgacctggccgatttttttgcgtccgtgcatgccggacgcgtgcatgcactgatgcgcacactgggctacccactagaggtggccagagccctgaccgctatctgcaccaatagggtgccctccgctcggctgctagcagatgatgtgcgggagaggttcgattggcaggagaagcagcgttataggactcgacacctcccccagggggcacctacatctccagctctcgccaatctctgtgcataccgcttagatctgcgtctggctggccttgcacggacgatgtgtacaagctatacccgctacgcagacgatctggccttcagtgggggacgggagttagcgagaggagtggaacgtttggcggtcagggttgcggccatcgcaatggaagaaggcttcagcattcaacttagaaaaactcgggtcatgaggcgcgccgccaggcaaagattagctggcgtggtcgtcaatcagaggcccaacctggccagagatgagtttgacgctttgaaggctacccttaccaactgcgtaagatacggtgtcgagggccagaacagagacggacatcgggacttccgcgcccaccttgagggcaaggtggctcaggtttgctttctgaacccggggagaggcgaaaaactcagggggatactccgtcagattcagtgggacgtctccggcgcacacgagtga

SEQ ID NO: 12562 - RNA, 1368 nt, unidentified
  source 1..1368: mol_type = other RNA; note = synthetic construct
atgcccctttccagcttacagcatgtgacatacgccatcgccgacgcaatgcttgccggctccccagaacccgctagtatggtggagaggatgacgctggtgctgggcgaatctacgaggtggatggacggactggcgaggcacgtggctaagcgtttcgcagctcgttgggactctgtcggtcgccgtgaagtgtcagccgtggttgccgggatgcctggcttcgtctctgcctggcgttccgagcagcctcccaaggtcctcagagtgctaactcgacctccatttcaaagacctccgccaccttggctgcacgacgttgcgctcccccagttgccaactctgggggacttggccgcttggctcaatattgagcccggcgatctcgactggttcgcggataggtggagggtacccgcccatagcgcggctacaccactccatcactacgcatacaaagccatcgaaaagcgcgacggaagatgccgcattattgagattcctaaaccgcggctgcgcgctctgcaacggaaggtactgtcaggcctgctggatcgaatccctgcccacgaatcagtccatgggtttagacatggtaggaacatcgtgacatttgcagctccccatgttgggcgggcagtcgtgatgaggttcgatctgaccgatttttttgccagtgtgcacgctgggcgggtgtattcagctttctatgccttcggctatccactggcagtggctatggcgctcactgccctttgcaccaaccggataccgagcggccgcctattggccactgacgtacgcgagaggctgcagtggcaggagaggcagcgatacagaaacagacaccttccacagggagctcccacctctccaaccctcgctaacctctgcgcattccgactggatctaaggctggctggtctggcacggagcgttggagccacctacacacggtatgccgacgacttggccttttcgggagacgaagaattagcacggatggcagatcgcttgtgtatccgggttgccgccatagcactggaggagggcttcggcgttaatctccgcaaaacacgagtcatgagaagaggtgtgcggcagcacttagccggcgtcgtcgtcaattcccacgctaatgtggctagacctgagttcgatgcattaaaggccatgctgaccaactgtgtgaggcacgggcccagaagccaaaatagagatgaccatcctgagtttcgagcacacctggctgggcgcgtagcgcatgtgggaatggtgaacgccgctcggggagctaaacttcgcgcccttttggagtccatcgagtgggatgaagaaagtgaggccaaggcagaaagcaatgcctga

SEQ ID NO: 12563 - RNA, 1113 nt, unidentified
  source 1..1113: mol_type = other RNA; note = synthetic construct
atggccgcattgccatcctttcggcctccctttcaaaggcccccccctctttggctcagagaagtcgccctgcctcagctgccaactttgggtgacctggcggctcgcttagggatcgagcctgacgaacttcattggtttgccgctcgctggcgagtgccagctcactctgcagccactcccctccaccactacagctataaggccatcgagaaacgagatggcagatgtaggatcattgaaattcccaagccgcggcagagggccctgcaactaaaggtgctttctgggctgctggatcgcatcccggcgcatgaatcggctcacggtttcagaaggggacgtaatattgtgacattcaccgtgccccatgttggcaaagccgtcgtaatgcgttttgacctgaccgatttcttcgcatccgtgcacgccgggcgcgtctatagtgatttccactcatttggcttctcacctgctgtggcccaggtcttcaccgccttatgtacaaaaagagtaccttctggccgattgctggccgcagatgtcagagagcgcctgccatggcaggagaggcagaggtaccggaacagacacctgccacaaggggctccaactagccccgcccttgccaacctgtgcgcctttagatttgaccgccgcttggcaggactagctcgcagcgtaggtgccacatatacacggtacgcggatgacctggccttcagcggagatgaaaacgttgcacggatggtggaacggctctccgtgagggtggctgcaatcgcaatagaggagggtttctcagtgaacctgagaaaaaccagggtcatgaggcgtggagcaagacagcatttggccggagtggttgttaactggcatgctaatgtggggcgtacggaattcgacgctctcaaggcagtgctctctaactgcgttcggcacggcttaagaagtcagaatcgagacgggcatcgggactttcgcgcccatcttgcaggcagggttgcccacgtggcgatggtcaatgctgctcggggcgctaaactccgggcactgctcgaacgaatagagtgggacgaggagagtgaggccaaggcgaagtccaatgtatga

SEQ ID NO: 12564 - RNA, 1362 nt, unidentified
  source 1..1362: mol_type = other RNA; note = synthetic construct
atgccatcttcatacttacagtacgtggccaatgccattgctgacgcgatgctagcggggcctgcacaaccagcttccatcgtggagcgaatggtgctcgctttgggagcgccggctgactggatgagcggtctggctcggagagtgagccgcagatttggcaaacgttgggattccgtcggccgccacgaactttccagggtaatagcagaccacgctgccttcgtgagcgcctggcaaagcgacaacaggccccgtgttgttcgtctcctgacgcgtccaccagtacagaggcaggtccccccttggctgcacggtatcactctgccacagctgcccgccttagccgatctggccgactggctagaagtagaaccaaccgagctcgattggttcgccgatagatggcgggcccctgctcatgcagctgcaactccccttcatcattattcttacaaagccatagagaagcgcgatgggcggtgccgcatcatcgagattcccaagagtagactgaggacagtgcagagaaaggttctccacggcctgttggacaggatacccgtccacgacgcagcacatggcttccgaagggggcgaaatactctgagcttcgcaaccccccatgctgccaaggcagtggtggtaagatttgatctcacggatttcttcgcttctgttaacgccggccgggtgtactcaaccttccgagactttggctatcctttggcagtggccagatcccttacagccctgtgtaccaaccgcgtgcccagtggaagattattggaagctgacgtccgcgagcgaatcgactggctggaaaggcagaggtaccgtaatcgccacctgcctcagggcgcacctacctcacctgccctggcaaatctctgtgcctatcgcctcgatttacggcttgcagggctggccagatccgtgggagcgacttacacccggtatgcggatgacctggcgttctcgggagatgaggaccttgctcggatcgccgagcgcctgtcaatccgggttggtgcaattgctattgaagagggctttgccctgaactttagaaagaccagagtgatgaggcggggcgctaggcaacatctcgctggtgtcgtggtcaacagacacccgaatttggctcgccctatgtttgacacactgaaagctatcctgacaaactgcgtgaggcacggaccggagagtcagaaccgggaagcccacccagatttccgggcccatctagctgggcgagttgcccacctcgccatgttgaatgcccgccggggagccaaacttgaggcaatttttgaaaggattgggtgggagggaggggagggctctggaacaactgtctga

SEQ ID NO: 12565 - RNA, 1350 nt, unidentified
  source 1..1350: mol_type = other RNA; note = synthetic construct
atgccccaaagctccctccaggtcgtgacatatgccatcgccgacgcaatgttggcaggacctgctgacccagcgacgatggtggaaaggatgacccgggtcctgggagaaagtgccgattggatgaccggactggcccggagggttgagagacggttcggagcgcgatgggacagtgtggaggccaagcacctgtctaaaattatcgctgagacagcaggatttgtcgcggcttggcgttctgagaaccggccaagaatcgtgcgcgtcctgacaagacccccagttcaacggccggcacctcgttggctaagagatgtcacattgccacagctgcctaccttgggtgacctggccgcctggctcgatgtcgaacccctggagctggactggttcgccgaccgttggagagtagcagcacacgatgcaactaccagactgcatcactactcctataaggccatagagaagagagatggccggtgccgcataatagagatccctaaatctcggcttcgagagcttcagagaaaagtgcttcatggcctgcttgacaggattcccgcccatgacgctgtgcatggcttcagacgcggccggaatactgtgacttttgctgcaccacatgccgggaaggccgtggtgttccgctttgatttaacggacttctttgcttcagttcacgccggcagagtgtattcagctattcatgctctgggctacccccttgaagttgcccgagccctgaccgccttatgcactaacagggtgccgagcggtaggctactcgctcctgacgtgcgcgaccgtattgattggcaggagcgccagcgatacaggaaccgacacttgccgcaaggcgcacctacaagtcccgcactggccaacctgtgtgcgtttcggttggacctcaggctcgctgggctcgctagatcagtgggagcaagctataccaggtacgccgatgacctcgccttttccggtgggaatgatctctcccgtatgactgagcggctctctatccgcgtagcagctatcgctatcgaagaagggttcgcagtgaacatgaggaaaaccagggtaatgcgccatgccgtccgccagcacttagcaggggttgtggtaaatagccaccccaatctggagcggcctgcttttgacgccctgaaagctctgctgaccaattgtgtgcgacacgggccacgctcgcagaatcgggatgcccacacagatttcagagcccatttggctggccgcgttgcgcacgtcactatgctaaacgccgcgaggggggagaagcttaagggtattttcgaacgaattggctgggatgaaagggaccagagctga

SEQ ID NO: 12566 - RNA, 1293 nt, unidentified
  source 1..1293: mol_type = other RNA; note = synthetic construct
atgctcgctggaccaccagaggccgcagcgatggttgagaggatgactttggtgttaggcgaacgagctgattggatgaatgggctagccaggggcatcgctaagcggttcggggcaaggtgggactcagtcgacggcaaggagctttcgaaagttgtggccgaaaacacaggctttgtcgccgcatggcgcggagagtctagacctcgggttgttcgagtgctcccccgaccaccagtccaaagacctcctcccccctggttgcatggtgtggcactaccgcagcttccaaccctcggagatctggctatgtggctggaggtcgaacctgacgaactggactggttcgctgatagatggagagtcccggcacagtccgctgctacacccctgcaccactacagctataaggccatagaaaaacgtgacggccggtgcagaattatcgaagtgcctaaatctcgactgcgggcgctgcagcggaaagttttgcacgggttactggatcgagtgcccgcacacgatgcggtgcatgggttcagaaggggacgcaacaccgtcactttcgctgccccccatgccggtaaagccgttgtgatccgcttcgatctgatggactttttcgccagtgtacatgccggtcgagtttactctgtgattagggccttgggctatcccctgaatgtcgcccgcgcactgaccggactatgtaccaaccgtgtaccttccgggtggctggtggctcctgatgtaagagacaggatcgactggcaggagagacagcgctaccagaaccggcaccttccacagggagctccaacaagtcctgccctcgccaacttgtgcgcttttagactggatctgaggctcgccgggcttgccaggtcattaggcgccacttatacacggtacgcagacgatctggccttcagcggcggggaagatctggcaaggatggcccaacgggtggagatacgtgtcgccgcaattgcgattgaggagggatttgctgtcaatctgaggaagacccgggtgatgagacgcggtgggaggcaacaactcgctggcgtggtagtgaatagccaccccaatcttgcaagagccgaatttgacgctctcaaggccgtgctcacgaattgtgtgcggcacggcccgggatcccaaaaccgtgagggtcacgaggattttcgcgcacatcttgcggggcgcgtggctcatgcaggtatgctgaacgctgtacgcggcgcgaagctcaaggccatcttcggccggatcgtgtgggacgacggatga

SEQ ID NO: 12567 - RNA, 1344 nt, unidentified
  source 1..1344: mol_type = other RNA; note = synthetic construct
atgtcactctctacattacagaccgtgacaaatgccattgccaatgccatgcttgctgggccccccgaaccagctgctatagtggagaggatgacttgtgcactgggtgagccggctgactggatgaagggcctggcatctagagtggcccagcgttttgcagctcgttgggactccgtggatccctcggccatcagcaaggtggtagcggaaacgacaggcttcgttagtgcatggagaagcgagacacctccccgggtggtacgaaccttaatcaggcctccatcccaacggcctgcacctccttggctgcaggatgccgtcctccctcagctcgcaacccttgccgaactggcggcttggctcgaggtggaacccgatgaactggactggtttgcagatcattggagagtccccgcccaacaagccgccactcccttgcatcactattcatatatggttgccgacaaaagggacgggcggtgcagaattatcgagatcccgaagagccgcttgcgaggcctgcagaggaaagtgctgaggggcctgctggataaaattcctccacatgacgcagtgcacggcttcaggcgcgggagatcaactgtgtctttcgctgcccctcacgtcggaaaagctgtggttatcagattcgatctgaccgatttcttcgcctccattcacgcaggacgagtctactctgtgtggcgcagcctaggatttccaaagggggtggcgcgcagtctcacaggcctttgtactaatagggtgcccagtggtcggttgctagcaccagacctgcgcgaaaaaaccgattggcaggagcgtcagcgatatagaaaccgtcatctgccgcagggagcaccaacatctcccgcgctggctaacctgtgcgcataccgaatggatatgcggctcgccggattggctcgaagcgttggtgcaagctacaccaggtacgcagacgacctagctttttcaggtggtgatgatctggccagaatggctactcgcctgagtatacgggtcgccgccattgccatcgaagagggctttgcggttaatcttcgcaagacccgggtaatgcagcggggggctagacaacagctcgcttccgtcgtcgttaaccagcacgttaacgtggcccgctctgagttcgacgccctgaaggcggtgcttacgaattgcgccaaactcggcgtggagtcccagaacagagacggacacccagactttcggagccacttggccggccgccttgctcatgtcgagatggtaaacgctgcccggggggccaagttaaggaggatcttcggcaggatagtctgggggagatccggatga

SEQ ID NO: 12568 - RNA, 1305 nt, unidentified
  source 1..1305: mol_type = other RNA; note = synthetic construct
atgaattcagcatttgtggccgagaatctcgcagcagcccttctgctcggagagtggactggacgcggactcctagattccgctctgcgggtggtacgctatcgcgaaccctggctgcatcggttcctaagaaggcttaggcgagcatttcctgagccccctgcacgccaggaatttcgcgcgctagtggactggataagtaatgatcggggattcctcaaccgtagcctggacggcgtgtttgagttcgtcagcctgacacccgccatgtcacaatcacggtggcccgtccctcagcttgccacagtgggtacgcttgctcagtggttggaattgacccctcgcgagctcgattggttcgctgacgggcagggtagggaagcagtgcagcccagaggcccattgcggcactatgtttacaaggccataccaaagcgcggaggcagactgcgactcatcgagtctccaaagagccgactcaaggcgattcaacggagaattctggatcagatactctccgttattcctgcccatgacgctgcccacggcttttgtcgggggaggagtgtggtcacctacgctgctgcccacgccaacaaggatgtcgtgctgcgcttggacttagctgacttcttcccctctgtcccagcctcacgtgtccacgccattttctgcactgccggctatccaaaagatgtggcgagaatgctgacgggcatctgtacaaacgttacccccagggatgagctgcccgagagcttcggtgccgataatagaggctggaccctgctgcagagattactgagccctcatcttccgcagggagccccaactagtccggcactcgcaaacttgtccgcttaccgtctggacctcagactgagtgccctggcacaggcatctggcatcgcctttaccagatatgcggacgatttagcgttctccggggacgaggagtttgctaggggggtactgaggttctacgagaaagcttgccagatcgtgatcgaagaaggtttcgccgttcgaccagccaagactaggattatgaggaggggcgtacgtcagcaattagctggagtggtggtgaacgtccggcctaatgccccgcgaggtgaatacgacagactgaaagctattttgacaaactgctcgaggcacggcgttggatctcaaaaccgggagaagcacccttcctttagagaacatctgcttgggaggatcacctggctgacaagccttcatcccgaacgcgggaaaaaattgcgggcacggtttgatcgaatcgactggaatggggggtga

SEQ ID NO: 12569 - RNA, 1530 nt, unidentified
  source 1..1530: mol_type = other RNA; note = synthetic construct
atggtgcgagagaatcgcgtgcgccacagatctggtgtgactccagagactttctatcacctggggcttcaagcccgcgattcacctggtgcctcgaccccaccgatgtcaagagggactggcctcgtggacccactagctgctcttaccttcaccgacgaaatgtctacccagcagaggttcgtcagaaatttggcggcggggatgcttgctggcgaatggacggccgcgggtcttagggaaagtgcctacagagctactggccacacatttgcctgggcacccgccctcgctaaacgagttctggaaacccacagcacagcccccccgtttcctacacttttggccgtgctgaccgccgatgctggcttccagagagctttcgccgccttagcatccgatcgtaatgccgacgaccgcttcccggtgtggcatctgttccctgtacccacccctcccccactaccacgtcccgaatgggcaaaagagctgcctgatctgcctaacgaacccgctctcgcagagtggctaggagtgcccctcgagaggctcctctggctggctgaccccaaagggcgcaataccggtcaccgacccggcagtgttaggacataccgggcccggtgggttccgaagacacatagcagggcacgcctcctggaggtcccaattccagcgctgatgcgggcacaacggaaggtcttggttggcctgctcaactccgtgcccagccacccagcagtgcatggatttcgggtcggcaggagcgccatcacaaacgccgctccacattgcggcagggccgtagttatacggtttgacctggcggatttcttcccatccattccagccggccgcgtcttccgcatgttcctcacgttgggctatccggagacagttgcacggcttttagggagcctctgtacaacccgactgcctacaaaggattggaatgctaggcctaaccccagaacggattctgccgaataccagacgagaatcaggctggcgactagacaccttcctcaaggagccccaacctcccccgcacttgcaaacctcgcggcacatagactggaccgtcggctggcaggactggcttcagcatgcggggctacttatagcagatacgcagacgacctgactttttctgggggagaggacgtcaggaggtctgcctcccggttagctcgaagagtagctctgatagcagccgaggaaggctttacattgaaccggggtaagacccgcatgcagggaagaagtgagcgacagaccgtcacaggagccgtagtgaacgtgcgacctaatatccctagggccgattttgatctgctgaaagcaattttgaccaactgtgtgcgccatggacccgccactcagaatcgggctagtcaccctgactttcgcgctcacttagccggccgtatcgctcatctggccagcgtgaatcccgtgcggggacgtaagttgtgggctacttttgacaggatcgcctgggatgccgattcaacccagtccgggcagtga

SEQ ID NO: 12570 - RNA, 1362 nt, unidentified
  source 1..1362: mol_type = other RNA; note = synthetic construct
atgaccacccagcagaggttcgtccagaatctggcagcgggaatgcttgctggagagtggaccgcggccggcatacgtgaaagtgtgtatagggccacaggaaggcgttttgcttggggccccgcactggctaaaagactgctaaacgcccacgcaactgcccccacctttcccactcttctggccactctcactgctgatgcaggctttcaacgggggctcaccgttttagctagcgcccgcaacgccgacaaccgattcccagtttggcatctgttctccgcacctgcgcctcccccattgcctagaccccaatgggccgcggaactcccagatttgccaaacgagcctgcactggccgaatggctgggtgtgagtctcgagcggctgctatggctggccgacacgaagtcgagaaatacgggccacagacctggctctgtgcgtacctatagagcgcggtgggtcccaaaaacacacggtcgggcacggctccttgaagtgccgattcccgctctcatgcgcgcccagaggaagatcctggcagagctgttaaacttagtgccagcacatcccgccgtacatggcttccgacctggccactctgccatcacgaacgcagctcagcactgtggtcgcgcctgcgtgatccgcttcgacctgactgattttttcccatcaataccggtggggcgtatctttaggatgttcctgaccctcgggtatagcgaacccgtggcccgactgtttgggtgcctctgtactacgcgacttcctgccgaggattggaacagaaggcccaatccaaggaatgatagttctgaataccagacacagaccagactggcatcacggcatgttccacagggggcccctacttcaccggctttggcgaatttgacagcctacagactggattgcagattggctggactggcgagcgcttgtggcgctacctactcccgctacgccgacgacctgactttctccggggatgatacactaaggagatctgcagcacggcttgctcgccgcgttgctctcattgtcgtagaggagggattcgcactcaatcggggaaaaacccgcgtgcaaggtcgcggcgagaggcaattggtgaccggagtcgtcgttaacgtgcggccgaacattccccgagaggacttcgaccagttaaaggccattctgacaaactgcgtccggcacaatcccgccacccagaatcgaacaaatcatcctgactttagagctcaccttgctgggaggatcgcccacgtcgcctccgtaaaccctacaaggggccggaagctgtgggctacatttgaccgcatcgtgtgggacacaaatagcgcccagagctga

SEQ ID NO: 12571 - RNA, 1359 nt, unidentified
  source 1..1359: mol_type = other RNA; note = synthetic construct
atgactgcaaatcggttcgtgtcaaacctcgcggctgctttgctagcaggggagtggtcagtagccggattgcggacatccgtctatcgcgcaacgggcaagcgctttggttggacaccccggtttgccaagcgggttcacacagcgcacgctaccccacccacttttaatgagctgttagcctttctcgggcgggaccctggatttgtgcgggctcttgctgcactggctactgcaaggtacccagccgaccgctttcccgtgtggcacattttcgctcctccagagcctccgccaagaccaagacccgattgggccagcggtctgcctgtgctcccaaacgaacctgctctagcagagtggctcggtgtccccgtcggacacctgctttggctagcggatcctgccgggcggaacgcaatatctaaaggcgtgcgcagctacagagtccgatgggtcccgaaacctaaggggagggctcgcctgctcgagattccagtgcctccactaaaaagagttcagcgtaagttactggcagacctgcttaatcacgtgcccccgcatcccgctgtacatggctttcggcccggcagatccatcgtcaccaacgcgaccccgcactgtggccatgcaatcgtgatcaggtttgatctcaccgacttcttcgcctccgtacccgttggtcgcgtgcttgctctgttccttgccctcgggtaccgtgagagtgtcgcccgtctcctgtccggcctgtgcacaacacgactggcctcaaatgattggaacgaacgacccaatcccctgaatgacggatctgaacacgccacgagagccaggctgacatctcgccacctccctcaaggggccccaacttcgcctgccttagccaacctggtcgcattgcgcttggatagaagacttgccgggttagccgccgcttgtggggctacttatacccgatatgctgacgatctgactttctctggcggggagctcttgcggaggaatgccgctaggtttgtgcgcagagtgacgctgatagcggccgaagaaggattcgccctgaaccgtggcaagaccagggtgatgggtggcggaggtcgacagactgttaccggagtggttgtgaaccagcggcccaatgtgccgagggcggagttcgatagattgaaggccatcctgaccaactgcgtcagacacggccccgcagaccagaataggagtggacatcctgacttccgcagccatctggccggacgagtggcatacgtggctggagtaaaccctgttaggggcaggaaattgtgggccctgttcgaccggattacctggccaggcgcacatacatatccagcaagctga

SEQ ID NO: 12572 - RNA, 1383 nt, unidentified
  source 1..1383: mol_type = other RNA; note = synthetic construct
atggatccccagcagaggttcgttaggaacatagccgcaggcatgttggcaggagagtggagtcgcgctggccttcgggatgcaattcggagagctacagggagagagtatcgatgggcttcgcctctagtgacacggctgctcgcggcacatatcgaaccaccaagctcaatcgccctgctcgacgtgctggtcagagatactaccttcgccggggtattagctaggcttgccggtgcccgaacagccggtgacaggtatccacggcgcaccttgtttgccgtgcctggcgaagccattcctcctgcccccacatggaatgctgacctgcctcgttgggacaccgaacacgattgtgcggatgccctaggcgttgccctccctcagttgctctggttggccgatcccaccggccgaaatccctacagacgggacgaaaccctgcgcacttacagggcacgctgggtgttaaagccacgcggcggtgcccggttattagaggtgccgaaacccctgctccgcaggacccagagaaggctggtcgacctgctcctcaaccgagtcgctccccatcctgccgctcatggattccgagcagggcggagcgcagtgaccaatgcagccgaacattgcggacgtgctgcggtgctgaggttcgacctcactgacttcttttcttccatcgtggctgggagaacttttggcctgttcagaaacctgggatatccggaacctgtggtgcggcttctgggcgcactgtgcaccacaaggttgcctagggcggtctgggatgtgcgcccacacccaacggcggatgggagtgactacccagcctgggtgagagtcaatactagacacctgccacaaggggctcccactagcccagcgcttgccaacttgattgcttatcgcctggaccgtaggttggctcgcctggctgctgcctgtggagcaacatacacgcgttacgccgacgacctgactttcagtggaggtccgggccttctgagggcagctaggggtttagcacggcgggtggcccttattgcggcagaggagggctttcgcgtgaaccgtggaaagtctagagcctacggcagaggaacccgacagaccgtgacagggatcgtaactaatgtaagaccgaacgtcacgcgcgcagagtttgatctcctgaaagccatactaaccaactgcacaagacacgggcccgccggtcaaaatagggctcaggtacccgacttccgagctcacttagccggacgggttgcccacgttgctggggttaatagcgtccggggcagaaaactctgggagctgtttgaccggatcgtctggcccgttgatgagtcttcatccatgatcgatctgaaggattcctga

SEQ ID NO: 12573 - RNA, 1329 nt, unidentified
  source 1..1329: mol_type = other RNA; note = synthetic construct
atgccgaccttcgacgccgagcgattcttatttagcctcgctggtgggttaagggctggcgcatgggccgatgcggatctgagggcagccttgcgaggagctgcctctgatcggccggtaagggccccaggactagtgccaagactccttagaagattccacggaactcccgggtatggcgagctgctgttgttcctcgtgaatgaccctgggctggcaagagctgtggaccggctgacctggtcaagaccacagcccggcccagctaaaccagccatgggacaacctccgcctaggctgggcactctggcgattccagcgcttgctacagaggccgcattggggacatggctaggagtgggacccgaccgtctgcgatggctagccgacctgacaggccggaatcggagacacccacctgggccacttcgcacgtaccgccacaggtgggtacccaaagccgatggtcgcgccaggctgctggaaatcccaaggcctggcctgaagctggtgcagcggaagatactggctgacttgcttgatgcagtccctgcccatcctgctgcacacggctttagacccggtcgtagtgctgtcaccaacgccgccgaacattgcggtagggcggtagtggtgcgcctcgacttggcagatttctttccctctgtcccggccgctagagtgagtcggatttttcgcaccctcggctatccggatcccgtagctcgcctgctgaccggtctgtgcactactcgggtgccagcggatgtgtgggatacgcgtcccaacccagggcctgctgaccatcctgcgagggttcgctttgcaggtcggcatcttccccagggagcacccacatcacccgccttagctaaccttgctgcacaccgtctcgatagacggctcgccagactcgcaacagccgttggggcaacatacacccgctacgccgacgatctggccttcagtggcggcaatgccgttaggcgcggagctgcacgtctcgctcgattggtcgccgtcgtcgctagagaggagggcttcgccgtgaaccctgggaagacccgggtcatgaccagagccggacggcaaacggttactggcgttgtggtgaatgctcgccccaatttgccaagggccgaattcgaccgactcaaagccacactgactaactgtgtcagacacggtcccggaggacagaacaggggagggcacgcagactttcgagcccaccttgccggtcgagtggcgcatctggctgccgttcatcctggtagggggcgcaaggtgtgggcgttatttgaccggatcgcatggcctgcaggctga

SEQ ID NO: 12574 - RNA, 1332 nt, unidentified
  source 1..1332: mol_type = other RNA; note = synthetic construct
atgctggaccgcacacgcttcctgttcgctctggcgggtgcatgcctgcgtgaaccttggactgctaccgggctgagagctgccttggacagagccgctgcaggacatcgcgtgcacgtgcctgggcttgcagccagaatcctggggcacttccctgagccaccgggatacggtgccctccttgcgtttttggtagccgatgccaggctcatgcgtgcactgaacagacccactggcagagccatcccaaaacggggcagacccgctatggacagccctccaccgagtttagccgcagtccagttgcccccacttgccacggaggtggccttagccgctcacctcaaccttgatccagcccggttaaggtggtatgctgatctgacgggaaggaaccgacaccacccacccggtcccttgaggacgtatcgccatcggtgggttgcaaagcctgggggacgcgctcgactactcgaagtccccaccttctccctgaagcgcattcagcggactatccttaccgatattctgaatcacgtgcctccccatcccgctgcacatgggtttcgacccggacggtctgccgtcactaatgccattgagcattgtggccgaagcgtagtgatgaagtttgatcttgctgacttctttccatcagttgccgccgcacgggtggtgaggctgttcagaactctaggctaccccgaagccgtggctaggttgctggctggcctctgtaccacaaggacaccagcggacgtgtggaaagcccgtccaaatcccgccgcggatggttccgaccatgtaagccggttgagactggttgcccggcacttacctcaaggcgccccaacatcgcctgcactggccaacttggccgcccataggcttgatcgccggctagcagggctggctaccgcaataggggccacatatactcgctacgccgacgatctgactttctcaggcgatatcgacctagcacgccgcagtcacaggctcgcaggtctggttgctgaagttgcttccgaggaaggatttgccctcaacgctcggaagacccgagtcctcaggcgtggcggacgacagacagtgaccggagtcgtggtgaacgccaagcctaatctgcccagagcggcttacgacaggctcaaagcgacactgaccaattgcgtcaggaaaggcaccgcttctcagaatcgggagaatcgggccgactttagagctcacctcgcgggtagagtcgcacacgcagcagcgataaacccggcccgtggtagaaagctgtgggccctgttcgacgcaatcgcttgggctgagcctccgccttga

SEQ ID NO: 12575 - RNA, 1386 nt, unidentified
  source 1..1386: mol_type = other RNA; note = synthetic construct
atggcccagagcgcacgtggcaggttcgttgctaacctggctgcagccttagtcgctgggcgctgggaccgacgagttatgcgtgccgctgctgctgctgcagttggagggaagcccgggtggttggccccattagtaaggcgggtgcacgctgcctaccccgaaaagcctcagttcgacccggtgagggcttttctagagcgggaccccaccttggggagggtgattgaccgcgatggaccacctgctgtggtgagggtcttcgttcctcccgccgagatgcttccgcctcccactgcagccggcttggtggaacttccccagctgcccacagaagctgcactggcggagtggctgggcattacaccagcacgcctgctgtggcttgcagacgcctctggccgcaatcgaaaacatccccccgggcctctacgaacctatcaccatagatgggtaccgaagccaggcgggagagctcgtctgctcgaagtccccgtgcatctgctaaaagaggtccagcgggatctgttagagcggctgctcgatagaatccccccacatccagccgctcacgggtttaggccaggtcggagcgtggtgacgaatgccaggcctcactgcggcagatctgtggtgataagattcgacctgcaggacttcttcccaagtgtgtccgcggctcgggttagagctatttttcgtacattcggttatccggaagccgtggctcggctcttgaccggactctgcacaactcgcctccctgctgatgtctgggatgcacggcctaaccctgccgcggatggtagcgatcacccagcctggcaacgcttggccgcaaggcatttgcctcaaggagctcccacctcaccagccctggccaatctggccgcctttaagcatgatcgacggctctcaaaactggcagctgccctgggtgcagactacactcgctacgccgacgatctgaccttttccggcagtgttgagctcgcgcgtggcgcaaagagactggcaacccttgtggccgtcatcgccggacaggagggttttgcggtgaaccacagaaagacacgcgttatgaggagggcgggccgacaagaagtggctggagtggtagtcaatgctagacccaatgtgagacgggccgagtatgatgagatcaaagccatactgactaactgtgttaggcacggacctgcggggcaaaaccgcgcaaaccacccagacttccgggcccatctcacgggcagagttgcccatcttgcagcagtccaccctgcgcacggtcgcaaactctgggcccttttagtccggatcgaatggagagccgccaaggtagcaggaggcgaacaggccgagactgccaccgacaataacaggtga

SEQ ID NO: 12576 - RNA, 1353 nt, unidentified
  source 1..1353: mol_type = other RNA; note = synthetic construct
atggcgaagaccgcccgcgggaggttcttggataatctggccgccgcgcttgttgcgggtagatgggatcggcgagtgatgagggctgctgcagttgctgcagtgggggggaaaccgcgttggctggctcctcttattaggcgcgtccacgccgctttcatcgataagcctcattttggaagggttcgggctgccctcgagcaggacgaacagctaattagagcagtagccgcggacggacctccaccagtagtacgcgtgttcgtgcctccggcagaaatgctacctccacccgccgctgctggtccagttgaactgccgcaattgcccacggaggcagcagtggccgaatggttcagtacagaccccggcaaactcctgtggtacgccgacccagctggcaggaatcgccaacaccctcccgggtttctgagaacatatcggcacaagtgggccgctaaacctggcggccgatccagacttatcgagatgcctaccgagtcactgaagcggcaccagagatggctgttaatctccatcctcaacaggataccaccccatcctgctgcgcatggcttccgaacaggacgtagcgtcgctaccaatgctggaccccattgcggcaaggccgtagtgattcgcttcgatctagccgactttttcccatctgtaagcgccgccagggtgcgagcgatttttcggaccttcgggtaccccgaggtggttgctcggcttctgacaggtctgtgcaccacgaggctgcccgcagatgtctggaacgctcgccccaatccagctccagacgggtccgaccacgcaacctggcaacgcttgaatgcccgccacttaccacagggggcacccacttctcccgctctggcaaacttggtggcctttaaactcgactgtcgcctcagtaagctcgcggccgccttaggcgcagattacactcggtatgctgacgatttgacctttagcggaggcgatgagctggcccggggatcaaagcggctggcaactctggtggccgtcatcgcagccgaagagggctttgcccttaatcatagaaaaacacgggtgatgcgaagggcaggtcgtcaggaggtcgcaggagtggtggtcaataccagacctaacgtcaggagagcggaatatgatactattaaggccatcctcactaactgtgttaggcacggcccagccggtcagaaccgtggtaaccatcccgacttccgggcacacctcactgggcgagttgcccacgtcgcagccgtgaacccggctagaggaagaaaactgtgggccatactggacagagtgacatgggaggctcatgaacctgccgccaggtga

SEQ ID NO: 12577 - RNA, 1320 nt, unidentified
  source 1..1320: mol_type = other RNA; note = synthetic construct
atgctggacacaacactggccaacctgcttgatgcctttctggcagggagctggaccgaggatcgcctcgtagccagagcgaaagctgcgttgggccggtcgcataggtttatccgtccctttgtgcggagagtgttagcagcgttcccagctcctacccattccgatcgactcagggtattcgccctggccgacgaggagttcagaaaggggtggcgaagagcggaaccccatacagcaaagagattcttccctgtccccgtcatggctccacaccaagctgctcgcggatggctgatcccggagatcaccaccgcagagaaggtgtgcgaggtgctcaggatcgataggcaccagttggattggctggcagactgtgccggccgaaaccaccgtgagagctctcctaaactccaccactatcgttaccgctggattccaaaaccctccggccggagtagggtacttgagattcctaagccaattctcaagcaggtgcaacgtaacgtgctgggtcagattctggatgcaattccaccccatgctgctgcacacggctttcggattgggagatccatcctcacaaatgccgtgccccatagtgggagagccgtggtcctaaggtttgaccttgcgatatttttctccagcattagcgccgatgctgtcacagctatctttcggactgctggttatcccccggacgttgcccggcaactaaccggactgtgtactacgaggctgcccaaagccgtgtgggatcagaggcctagaccggccgcagatggaagcgactcactggaggagagacacctcagaaatcgccatctccctcaaggtgcccccacgagtccagcactggccaacctggttgcctttaggttggaccggcggctggacggactggctaagtctttagatgtcacctacactcgctatgctgacgacttggcctttagcggcggcatcgaccttacaaggcgctctgaaaaattccgcaacgcagttgcgcggatagtaagtgaagaaggtttccggctgaatccactgaaaactcgcgtcatgccacagtctgttagacagactgtggctggagtggtggtgaacatccgaacctcaatacctcgcgccgaattcgaccgattaaaggccgtcctaaccaactgcctcaggcatgggcccgaatcccagaatcgcgaagcccaccctaatttcagagcatacctggccggcaagcttgctcacgttgccaggttgaatcctactcgagggcgtaagcttttggcattattcgatcagatccggtggcagtcagcctga

SEQ ID NO: 12578 - RNA, 1344 nt, unidentified
  source 1..1344: mol_type = other RNA; note = synthetic construct
atgtccaccagacatagtattgcacggaacctggctgccgcctttctgacagggacttggtcactcgacggcctagtccagcaaggcgcaagggcctgtggcaaacgagaacgatggttgaggccgttagctaggtgtgtcctagcggctttccctgggccacctgcaggtattgaccccgaggcactggccagatggatggaggagaaccctgtgttcaggactgcatgggccaaatatggcagggagggtcgctttcctcttggacaggtgttctgggtccccccgcggatgactcctagaaccggtgcaccagcaacctggagggtgcctcccttgaccacatctggcgcgcttgctgagtggctggggctgaaacccaaggagctggattggtttgctgactgtcatggcggggaagagaaactgcccccaggcccactgagacactatacttaccgctggttggtcggtcggagccggaagctgcgcttgctggaaatgcctaagcagcgccttaaagcactccagcgacgagtgctccacgatctgctcgatcatctcccctgccacgaagcagcacacggataccggaggggaagatccgttgccacatacgtggggccccacactggacggagaattgttctgcatcttgacctcagagattttttcccatccatccggtcgtctcgcgtgcaggccctatttcggaccgttggctacccctttccagtggcgcgcttattgaccgggctgtgcaccaacgtagtcccgggagaggtatggcacagcagccccgtgcgtggagaaccaggcgaatggaatcgttctccccactaccaggtcccacatctgcctcaaggagcccctacgtcaccggctcttgccaatctgtgtgcctaccggctggactgccggttgacgggacttgccagggccgttggtgctgcgtatacacgttacgctgacgatctggccttctcagggggccgcgatttggaacggagtactagagggttccaggtgcaggtagctcgaatcgcgctggaagaaggttttgaggtgcatacaagaaagacaaggtttatgcgccaaggcgttcgtcagcagcttgccggagtggtcctgaatgagcacgccaacttaaggagggaggagtatgaccgcttaaaggccatactcttcaattgcgtgagacacggccccggcctccagaatcgagaaggacgcccagacttcagagagagcctggctgggcggatcgcttatgtgcaaatgctcaacccttccagagggcgacgtctccgcgagctgttcgataggatcgcctgggaaaagtga

SEQ ID NO: 12579 - RNA, 1269 nt, unidentified
  source 1..1269: mol_type = other RNA; note = synthetic construct
atggcaacttttcacgtggatcctgacttcgtggagcagctcgccgctacgttacgagccggcaattgggtgcggctggctctcaaaagcagggtgtggttcacattccccgacgatcgtgccctgaccgcgaaagtggtcggccaggtctgggagcacttcggaggtagccgaccctcactgaaacagctcactaagttcctcaagaaggctatcagcgcgctgccacacgaacccgaacagagggcagtacccgttgagccagcccctatgacggccagatggcccgtacctgtgctggcaacaccggtccagctcgcccattggctgaatgtgcctttgacccgccttgagtggctcgcagatattaaggaatggactctccggcaagccgatgcaaagctgaggcactacgtgaatgtctgggtgcctagaagaagaggcaaacccaggcttcttgaggcccctaagccccatctgaaggctatccaacggagaattctgcacgaaattcttgaccacatccccccgcatgacacagcccacgggtttaggactgggcgaagtatcgtctcctacgcaagaccccatgtgggaaagcaaatggtcctgcattttgacctaagggatttctttgcttcagtgtcggccgcaagagttagagctatttttagaactgctggctatcctgcagatgtagcttctctgctgaccggcctgtgtacaacccgaaccccagacgatgtgacggttgccgggattcactggaggcgacgccatttaccgcagggagcccctacttccccagccttcgcgaacttagcggcgcgtcgcatggacgtcagattgtccgccctggccgagaaacttggtgccacctacacccgctatgctgacgacttggctatctctggcggacacgaccttgagcgggcagttcgccgggtgaacgtactggttggtataatagcaggcgaagagggttttgaactcaacttccggaaaacacgttttatgcgccagagtgtttgccagcaggtggccggagtggtcgtcaacgtgaaaaccaactgtcgtagggaggatttcgatcggttgaaggccatcctccataactgcgctcggcacgggccagcctgccaaaatcgcgagcggcacccagactttcgccggcatctattggggcgagtggcacacctgaggcatttgaatccagctaggggagcccgcctgcaggctctattcgaacacatcgattggacaaggtga

SEQ ID NO: 12580 - RNA, 1371 nt, unidentified
  source 1..1371: mol_type = other RNA; note = synthetic construct
atgaccgaatggaccttcgacgctgatgatcttgacgaagacgaagaggacgcagaccctcctcctggacccgcagagctgagactggcaagagccctggccctcgcctttctgggcactgatggaagacggcgcgccatgatcgaggccgcactagctaccctgcatgtgcctgatgaggcacgcgctcgggcttggataggtgcactggtggctctagttcggaggactttcgaccccctcaggagggccagcctggatgagctgaccactactatcgctcacgggcgcgcattagctcggagggatcgtggggtgcatgttgtgcgctgggtagccacaccgggcgaaatgagagccccgaggtgggatgtgccacggatcgacaccgttggagacttagcacgctggctggacgtggagatcggcgagttggattggctcgccgatagacgagcgatgctcgtcagagccagggttgggcccttgcatcactacgtacggacctgggtacctaagccatccggcggcgccagactgattgaagctccaaaggcccgtctggccgccatccagagaagggttcttcgcgaggtcttggagcgcgtgcccatgcacgatgtcgctcacggtttcaggcgtggccgctctgtggccacatttgtcgcaccacacgtagggcgcgccgttgtcgtacgggtggacttggaggacttcttcgctagtgtgacccggggccgggtgataggaatctttaggtctgcgggttatcctgaagaaattgcccgcactcttgcggcactgtgcacaacacgaacacccgcctccgaaatgagaggaatcgagcatgcagtccgcgcccgattacgtgtgccccacttaccccagggagctccaacgtccccagcgttggcaagcctcgcagcgtttcggctagacgccaggattgaaggtctggctcgagccgtcggcgcacgatgtaccagatacgccgacgatgtcgcactgagttttgagagggaccgcagccatggcgctattgacagagtgattgcccggattgctgagatcgcccgagaagaagggttcggggtggccagccacaaaacgcgtgtgatgcgccgaggggcgcgtcaatcacttgctggcgttgtggtcaacgaaaggcctgccgtggcacgggaggaatatgagcggcttagagctatcctccaccgggcagctacacgaggaccatcacccgatgagctgggtgcccacagggatctcagggcccatctggctgggagaatcgcctggatagcgcagtggtctgagaggagaggagcgaaactggctgctatgctcgctagaattgactggtcggcttga

SEQ ID NO: 12581 - RNA, 1368 nt, unidentified
  source 1..1368: mol_type = other RNA; note = synthetic construct
atgacggattccactttcgatgattgggaagatgacgacgacgacccagaggacttaccgcccggcagacgtgcatggcgcttgtctagagccctggccctggcattcctgggcacagatggctcacgacgagcaatgatcgatgccgctttggcggccctcagagtgccccatgaagcacgcgcccgtgcttggcttggcggacttgtcgctctagtcaggcgtacctttgaccctctgccaagggcctcgctggacgagctcacaaccactatcgcccactctcgagcactcgcccggtacgatcgcgacgcagaaattgtgcggtgggtcgtaaccccaggtgcgcctctcgaaacacggtgggatgttccccggattgatacagtgggggaccttgctcggtggctggaggtggagatcggcgaactggattggctggctgatagacgcgctatgcttgtacgcgcccccctgggaccactgcatcactatttgaggacctgggtcccaaagcctagtgggggggctagactgatcgaggcccctaaaagtcggttggcgtccatacagaggcgcgttctgcgcgagatcgtggagaggatcccaatgcacgacgtggctcacgggtttaggcggggcagaagcgtggctacattcgtcgctcctcacgtgggaagggccgtggtagtgcgggtggaccttgaggatttctttgcaagcgtgactagaggaagggtgattggcatttttcggtctgcggggtatcctgaggaagtggccaggacactggcagcctcatgtaccacccgaactccgtccagagagatgagaggaatcgaacatgctgttcgcgcacgcctccgagtccctcatctaccccaaggagctccaaccagccctgccttagcatctctcgctgctttccgcctcgacgccagggttgagggtcttgcaagagccattgatgctcggtgcacccgttacgccgacgacatcgccctgtcattcgaaaggccacagtcccacgtagccatcgaccgcgttatcgcgagaatagctgaaattgccagagaggagggctttagagtggcaccccataaaacgagggtcatgaggcatggtgcgcgacagagtttggccggggtggttgtcaacgagaagcccgcagttccgcgggaggaatacgagcggctgcgagctatcctacaccgtgcagccattgaaggacccagggccgaagacctcgccgctcatagggatctgcgggcccacttagagggtcgaattgcgtggataggccagtggagcgagcacagacgggcaaagctggccgcaatgttggcccgcatagaatggactccctga

SEQ ID NO: 12582 - RNA, 1293 nt, unidentified
  source 1..1293: mol_type = other RNA; note = synthetic construct
atgactagagcagatttagctgcgcgcgccatcgctgacgccttactcgatggcgagtgggcactggagcccatggttcagcgccttgggacaacttttggcgccagacgagcatggatgactaaactcgcccgtcgggccttgtcactttttcccagggctcctgccgatgcccgagatctccttgccagaaccgctagaactctacccggatttcccgcggcctgtcgagccagagtgagacactgggcgatccctgaaccacgaatgggccgagtcaggtggccagtgcctacgatcgaaacagcggcggacctttccgcatggctaggcgttgatgcagcggccctggctgtcttggctgacaggagagggttggcaagggacgcagacccgaagatgagacactacacatacgagtggatcgctaagaggaccggcggacggcgcttactagaggctcctaaacaacgcctgaaggccgtccagaggcgtatactgcatggtgtgcttgatgcaatacctgcacacgatgctgcacatgggttccgcgctgggcggtctgtcgtaagcttcgcccgcgttcatgtgggggctgctttggtgctgagagtggacctggaagctttcttccacagtgtgttcgccggcagggtttatggtatttttcggggggccggataccccgaagatgtagcccgcaccctgacagccctttgcacccacagaagcccgcgggatgtgttggctggtgccccaagagatctggttggcgatcgcccccggtccttacagcgccttcggacacctcatctgccacagggagcaccaacctcacctgccctagccaatctggccgccttcgccctggatgtacggctggacgcactggctcgtagttggggtgcgaggtattctaggtatgccgacgacttggtgttctccgggcgagtagcacagccccagaggcttgtggctgccatcgaccacatcgtgagggatgagggattcctgattgctcggcacaagactaggctcctccgtgcctcgacgcgccaagaaattgcaggcgtggtcgtgaaccaaaagaccagcgtcagaagagacgaggttgacaggctccgggccattctccacaattgcgcccgtaccggaccagctgcgcagaacagggacggacatccagactttcgggcccacctgttgggcagagtcgcttgggtggagcaggtgtctcccgacaaagcacgacggctccgggcactctttgatcatctgcgctgggacacatga

SEQ ID NO: 12583 - RNA, 1323 nt, unidentified
  source 1..1323: mol_type = other RNA; note = synthetic construct
atgacatggctggtgagggagtttgcaggagcattgctcgcgggcccttgggagagacgtcccatgatcgcccggctggcatacgtgacgaacctccctgaagctggttggattgtgaaactagtggctgccgttctcaggaagcacggggagccaccggatcacgaagccctgaccgattggctctacagccaccgacctcttcaacgggtactggtcgatcccgaaattaggatcaggcggtggctggagcctccgttggagatggccgactctccctgggatgtgcctcccctgggaagtcgcaaagaactcgccacctggttaggtctggacgtgcagcgactggaggctctggctgacgagagagggcgtgtcagagaagcacgggaacagcggatgagacactatagatatacgtggatagcaaagagagcaggggggcatcgtctcctagaagcccccaagccaagactcagggcggtccagcggttagtcctggacgatattgtcgcaaaggtccccccccatgatgctgcccacggattccgagccggccactcagtagtgggctttgccgctgtccacgtgggccgtgaggtcgttatccgcgtggacctgcatgccttcttcgcctcagtttccaggccgagggtggctgcaatattcagatctgccggatatccccgggaaatcgccggagtacttgcagcattatgcacccatcgaactccaagagacgtgctggcggcggctccatcaagggagtggtccgaactggctaagttgcgcggggctcaccttccacaaggagcacctacttctggcgcgctcgccaatctggctgcctatcgccttgacgtgagggtagctgcacttgctgccgctattggcgcatcgtacactcggtacgccgatgacttggttctctccgggccaagagctttggctcgcgctgccagttccatcgttggccgcattggcgccattgcccatgatgagggctttgcactgaactttcggaagacccgggtcatgactgccagcgatcggcagaggatcaccggtctggtggttaatgagaaattagcagtgacacgagatgaagttgaccgcctacgcgccatcttgttcaattgtgcccgtacagggccagccgcgcagaacagagagggtcatgccgattttcgagcacacctgctgggccgcataagctgggtgagcgccgtggaccggggaaaaggagacagacttagggctctgttcgacagaatcaggtgggacgaggcgcctgctgatgccacagacgaggacgtgcgctga

SEQ ID NO: 12584 - RNA, 1233 nt, unidentified
  source 1..1233: mol_type = other RNA; note = synthetic construct
atgaagtggttggagcccgcgctagcgcgtacagttgctgaggcccttgcggacgctcttcctggtagccgcgaagatcgagaggccagatgcctggacgtgttgggagcctgtgacgaggaagctctcgcaagcttattggaacgggtaccaccagcactgggctggcgtgcattggtggcctggatccttggcgatgacgcatttgggagactgctggctggcggagtcgctgttgaaccaccacgggccatggcaccatcccgctttgaggtcccttcattagatacggagggtgacttagcagcttggctagcggtgaccccccgagctctggaagccttcaccgaccctaccgatgctaccagacgcgcccctaggggtccgatgagacactacacgcacaggtgggttggcgctagactcatagaggcccctaagccacgcttgagagccatccagagacggattctgcaaggagtgctcgacgcagtgcccccccatgatgcagcacacgggtttagacgcggccgaagtatcttcacttcggcagcgccgcatgtgggaaaacccgctgtcctccgagtggacctcaggcgtttctttcagacaattcaccttgccagagttgtagccgtcttctctgccctgggatatccccgggcggtgagtcgagcttttgcacgcgtgtgtacacacgcagtgcccgacgatgagctggttgggcagcctttcctgactagacagcgcctccgcactaggcatctcccgcaaggggcacccacatcccccactctggccaaccttgctgctcacggcctcgacgtccggctttcagccttggctcgggcagctggactggcttataccaggtacgccgatgacctcgtcttctctggcgatgtggcccctggctttccttctcgggtggccagcatatgcgccgaagaggggttcccagtggccacagaaaaaactaggctgagaagggcctccgaccagcaacgggttgtcggactggtggtcaatgatcacctgggggtcgcccgtgtagaacgagacaggctgcgggccatcctgcacaactgtgcccggtccggcgtaaacgctgagaatcgcgcggggcatgccgatttcagggctcatctggagggccgcgtgagctttgtggagcaagccgatccaaggcagggtgcccggctaaggagactgttctgcaccattccttggtga

SEQ ID NO: 12585 - RNA, 1278 nt, unidentified
  source 1..1278: mol_type = other RNA; note = synthetic construct
atgaagcggagggatccatctcgggatatcgccctagccgcgttaggggaaacatggtcaccagcggcaatagagggcgcattggccgacctcttcgcctcagaacaacgatggatgcgagctatggcacgtcgcatgacccggaggttcggtgaagctcccccccttgatgtgctggaggcttttgtgagggccgacagggaccttagacaggccagacgcctgctcgtccggcatccttctctggccatgccccctatgcctccttccagattcggtgcaccccccattgcgagcatgggcgatctggcgaccttactggaggtgccagtggaggatctggattggctagccgaccgcaggggtaccactcgtgacgctgaggctcctgtcagacactatcgggcacgctggatccctaagagaagcgtcggatggaggctggttgaggcccccaaagcccgactacgccgagcacagaggtgtttgttggatcgcgttctggcaagtgtccccccacatgaagccgctcacggctttgtgcctgggaggagcgttctggaccacgccagagctcatgtacgccaggccgtggttgtgaggctcgacctcgaggacttcttcgcctctgtgccagcagctcaagtgcgtgccgtgttccgtactgctgggtacggagaagacgtggccgtcgccttgacggctttgtctaccaccagaactccccctgccctgttacggagtccctgggtttcccggttcgaaacaagacagcggcttgctcatcgccacctgccgcaaggcgcaccaacatcgccctggatagcaaatttagctgcgtacaggctcgatctccgggtgtccgcactggcaagaagcctgggcgctacttacacccggtatgctgacgatctcgtactgtccggcgacgagggatttgcgagaggtgttgagaggctcctgccacgcctgggtgccattgctatcgaagaggggtttgcgcttcagcatcgaaaaacgcgagtcacacgtgccggagcctcacagagagtgtgcggtctggtcgtgaacgagggcgcaagagtaagccgccgagagagggagagactggaggccattctctttaattgcgtaaagcacgggccagctagtcagaacagaggagatcacccgcgctttcgggaccacttgctgggaaggatcgcctgggtggaacaggcacatgaaccgcacgcagctaggcttcacgcccttttcgcccggatcgaatggccttga

SEQ ID NO: 12586 - RNA, 1599 nt, unidentified
  source 1..1599: mol_type = other RNA; note = synthetic construct
atggccgctgctcctgaacatgtggcacgggcaattgctgatgcttttctgtgtggaccgtggaccgccctaggcttaagggcgtctggtgccgaactctttgcacgccgggcccgatggctggatcccttaataagagcaacgctccgcgcatttcctgacccacctcgcgcaagcagagacgctctggcaagattcctgggtccccacgtcgagaggttgacagcccggcttgaaccacctcgctggccacctgtgcgtcgacgtctggtacctgcccccgcaatggccgaaagacgcaggtggcctgtgcgggagttggcaactaccgcagagctcgctcgctggttgggcctgactccaggcgaactggattggtttgctgataggcatgggaccgctgccagggcagttgaccctcgtctggtgcactatagagagacgtggatccccaaacgctccggggtgggtgaacgcctactcgagatcccccgcccccgactaagagccatacaacgcgctatcctggacgaaattctggtggccatcccacctcatgcggccgcactaggattccggagaggacggagtgccttagatcacgcgtccagacacgcagggagggctgttctgattagactcgacctggaagacttctttgctgccacaccggctgggagggtatacgggacattcagagccgctgggtaccctgctgaagtggcccttaccctcacccggttgaccacccgtagagccagtcccgatgcgcggagaagagcgcgaagatggaccccagcgcatggggatggatctggaggcacactccagagcgaaggcggtcggacaagcggacgccttgctgctgctcacctgcctcaaggaagcccaagctcgcctgccctggccaatctggcggcttttcatctggacgtccgtttagccgcactggcagaggccataggtgcccgatactcccgctatgctgacgatttggccttctccggcgaagacacacttgagagggcggccgagaggcttctcccaaggatcgccgccattgtcatcgaggagggcttccggccgaggttccgcaagactaggattgagcgggccactgggcgtcagacccttatgggcttgacagtgaacgtgcggcctgccgtcccaagagcagaacgtgagcggctgcgagccatcctcactaactgtgtgaggcacggccccgcatcacagaatagggagcggcatgcagacttcagggcccaccctaggcgagcacgggatgttggtcgggctagggagagacgatcaagagctgccgctgctcacgccgctagaagggatcggctggacgcgctcagtcagaccgaagccactcagcaggagcctgccccagcttgcggagatccatcccgcggtgatggagcacccagagcgacgaagaccattggcgccacaggtgtcccatctcccgttgccgggtcttcagaccgagacaggtcagaccggaggtgcgacaccgagacttgccgatggagaggcactcgcagaccctatccagcaggtgggagggccggaacttgtccgacagagtga

SEQ ID NO: 12587 - RNA, 1329 nt, unidentified
  source 1..1329: mol_type = other RNA; note = synthetic construct
atgtctcctaccatagtggccgacgccctagccgccgctttcttagatggcgcctggtctgctccagcgcttgccagacgaggggcacgtgctctagggcagagcacgaggtggctgccggcattagccaggagggtagtcgctgctttccccgatggcgcacccagggatcgatttgaagccctcgccacattgcttgcccgagacgcagcagtgaggaaagctggaaggcccgatgctccctggcggctagtcattacagctccaaccctggctatgcgagacgcccatccagaatggcgccttcctcgcctccatactgctggggacttggccacctggcttgggctggaaatcggcgacctcctgtggttcgcagatacacgtggtttgtcccgccgtcggagggctgtggcattggatcattatcaccgacggtggctgccaaaaaggtccggcggagccaggctagtagaggcacccaagcgctggctgaaggaggtgcagcggagaatcctgagggagctcgtggaaagaatacctcctcacgaagccgcacatgggttccgccgcagaagaggagttctgagccatgccgcccttcacgccggaagggatgtggtcctgcggatggacctggaggacttcttcgtgagtattccggcttcgcgggtgtttgcggtttttcacgctgctggctaccccttggaagtcgcgcgcctgcttaccggtctgtgcaccacaagagcccccagtgacccaggcgctccaatgcctgccacgcctaccagggcagagttagaggcacggcaccgcgcaagagagcgatacgccgagagacacctgccacaaggcgctccgacttcacccgctctggcaaacctctgtgcttggcggttagacgtgcgcctcagcgcagctgcaagaactgcgggtgcagtttacactagatatgccgatgatctcgtgttttccggagacgatcggttcgccagatggcctgcggccagatttgcctacgtggtgggcggaattgccatcgaagagggcttcaatgtccagcaccggaagaccaagctcatgagagcggggacacggcagcaggtcacaggtctggttgtcaataggtcagcggctatccctcgacgcgactttgagagatataaagcgattctccacaactgcgttctgactggacccgatcggcaaaaccgggatggccgaccagactttcgtgcccacctggaaggagtagtggcctgggtgacccatgtacagcctgcacgtggggccaagttggccaaactgctggacgccatccgctggtga

SEQ ID NO: 12588 - RNA, 1329 nt, unidentified
  source 1..1329: mol_type = other RNA; note = synthetic construct
atggaccgtcgtatcgttggcgaagccctggccgctgcctttctcgacggaacgtggagcccccagccaatggctagacggggtgccagggccataggaagacctggccggtggttacctgccttagcgcgccgaactgttgaggcgtttcctgaaggtcccccggtagaccgctttgaggacctggccaggtccctggctgaggacaaggcagtcgtgcgcgcatgcgctactccagccccttggcatttggctttcgtggcccccgcactcgctatgagagatgcacatccctcttggggcttgccaaggctcgacacagccggagatgttgccgcttggctcgggctggatgttggcgacctgctgtggttcgccgatacgcacggtttagcccgacacagacgggatcctcgcctggaacactatgtccgccgctggctgcccaaaagaagtggcggcgcgaggctggttgaagcaccaaagaagtggctgaaggacctgcagcggcgaatcctgcacgaacttgtagaaaggattccaccacacgatgcggctcacggtttcaggcgggcccattccattctgacacacgcggcaagtcacgccggacgagaggtggtcttgaggatggacctggaggacttcttcgtcagcatcccagccgccaggattttcgctatctttcgggccgctggatatcccgcagaggtggcacgccttctgacaggcctctgcactacaagctcaccccctgatgccggagctcccgtttcggcagctcctaccgtggccgaactgcaagcgcgtcacagggcacgagctaggtacgcctcccggcatctccctcaaggtgctcccacctctccggcgctagctaatctctgtgcctatgggttggatgtgcgcttaggggctgtcgcccgatctgcacacgcagtgtacaccagatacgcagacgacctagtgttctcaggcgatgagagatttgtccgctggcccgcgaagagatttggcatacttgtggctgggattgcacttgagcaaggattcaccgtgcagcacagaaaaaccaaactcatgcgcgccgctactagacaggctgtgaccgggcttgtcgtgaatcgggcaccgagcatccctcgtcgggatttcgagagatacaaagccacactacataactgtgtaaggtttgggccagagagtcagaacagagagggccatgccgattttcgtgcccatctggaaggggtagtggcctgggtgcggcatgtgcagccagagaggggagcacggttggcacagttgctcgacgccgtctcctggtga

SEQ ID NO: 12589 - RNA, 1332 nt, unidentified
  source 1..1332: mol_type = other RNA; note = synthetic construct
atgcgccatgaaaccctggtcgtccaggctgtagcgtccgccatgttagccgatggcgcgtggtccagtgctgacctggttacacgaggggcaatggtattcgacaagcgaccacggtggatggtagccgccgtgagcgcagtgatggctacccaccctaccagggagggcgtcacagtggccgaactcgtggccctcctgtcttctcgtcccggcgtgatgcgcgccatcagacgagcacacgctgtagtcaggagatgggctatcccgctcgtcacacttgttcccccgagatggcctgtgcccgcgtttgcatcagccaatgcccttgcgtcgtggttggagctgtctcccgccgagctcgcctggtttgcagatgtgaaagggctagggagggatccagagcttgacgagcctcttcggcactaccgcgttcattgggttccgaagcgacgcggtggagttcggctcttggaggcccctaaaccacggttgcgcgatatgcagaggaggatgttacgcgagatactcgacgccatcccacctcacgatgctgctcatgggttcagacgcggtagggatgcacggtcacacgccgcactccacgagggacaagctgtggttctgcgagtggacttagaagattttttcctgagcattagcctggctcgcacggtggcaactttcagaagtgccggctatactgacgacgtggcacatctgctgggcaggttgtgcacacacagaactaacgcctcatgtcccttgccagtgctcggagcctacccaaccgaggcagacctgagagcccgtagaaatgcggaacggctggcgagggcactgcatctccctcagggagctcccaccagtcccgcagtggcaaatctgtgtgcatatagactagacgtcaggctggaagcagccgccgccagtgtaggtgccacctactccaggtatgctgacgacctggtgttctctggcggagaagacttcgctgctagagctcacagatttgccgccctggtgggcggcgtggtcttagatgaagggttccgggtgaaccaccgtaagactcgcattatggggcgaggtgccagacaactggtcggaggtttggtggttaacgctcatgcccaggtgccccgcgctagcttcgatacggtgaaagccatcgtccggaattgcatacagtacgggcctgcgtctcagaaccgtgactcccatcctgattttcgggctcacctgaggggccttgttggctgggctggaggagctgcagatagcccacggagggcgaagctagatgccctttttcggcagattgtctggtga

SEQ ID NO: 12590 - RNA, 1335 nt, unidentified
  source 1..1335: mol_type = other RNA; note = synthetic construct
atgaagacaaaggttcccgaacgagtggccgaggctctcgcctcagcgtttttggcgcacggagcatggactcgcgacgccttagctgaacgcggcagagtgaccctcgccgaagatgcccgctggatgcgaggagtcgtggatcgcgttttggctacattccctgagcctcccagggcacgtttttctgccctggcacggtttattgcatccgtctccattgctgcacccagagagcgtcgagcccccagatggaggcctaaagtcgctcgctggctggagccagagatagcgatgggcgtgagaagatgggacgttccagctattgctactcctggagatcttgccaggtggctgggacttagcccggctgagtgcgattggtttgctgacggcagaggtctagaacgactgcgtcgccccgaggccctcgatcattatcggaggcggtgggttgcaaaacggcggggaggctttcggcttcttgaggcgcctaaggcgcggacaaaagccgtccaacagcggatacttcgggaaatcctagacagagtgccggctcatgacgccgcacacgggttcgtcagagggaggtcagtccggacccatgccgccttgcatgtggggagagcagtggtcgttcgcctggatctggaagacttctttctcagcatcagtgccgctagggtagccggcgtattcagagccgccggttacccggacgacgtagcatggtctttaacgctcctctgcacaaatgtggctccacctagcggcttggtgctgggacgggatgctacccacgacgatgtcgcacgactgcgcagggccgaaatgagggctcgaacacgccacctgccccaaggtgctcccaccagtccagccctcgccaatctgtgtgcacgtggtcttgatgtccgcctgacggccttggccaccaaattgggggcagtgtacacaaggtacgcagacgacatgactttctcgggcgacaggcgtctggcaaggtccagctctcgactggaggcttgggcgtctgctatcgccagtgatgaaggcttcaccgtaaatcacaggaagtcccgggtgatgagagctggcgtgcgccagttagtgactggggttgtggtaaacactaggctgaacgtggcacgagatgcttatgaccgcctcgaggcaaccctgcacaactgtcggaggctgggccctgggtcacagaacagggatgggcatccagacttcagagcccacctagttggtagagtggcccacgtgaagagcctccatccagccagaggagagaagttagcggccctgctggagcagatcgcctggtga

SEQ ID NO: 12591 - RNA, 1335 nt, unidentified
  source 1..1335: mol_type = other RNA; note = synthetic construct
atggccagctacttggagcacgtgtccagagccctggggagtgcctttatgatgggtccatggactcggttggcattaatgggcttgggggagcgcgtactaggagagcgacctccttggttaggaggcctcgtctctcgcacactgagcgcactgccggaacctccacccactgttgaggccgtagccgccgtgttacgggaacaccgcgccttcaggaatgcctttgcggaccaggctagtcgcccccgtgttaggcggtggttacacgctccaccgagcgctcctgcagaagcaccttggccggtccctccactgaggacatttgacgacctcgcgcgtcatctcgaattgcctgatgagcagctgtcttggcttgcggatcctcggggggtactgcgtagagcaccttccgagcgcctgcaccactaccaccgagactttctgcctaagcgggccggaggacatcggctggtggaaacccccaaacctcgcctgaaggcagtccaacgacgtctccttagaaccatattcgatcacatccccccccacccctcagctcatggctttgtcaaggggcgaagccccattacacatgctggccagcacgcaggacgtgccgtggttctgaggctcgatctggaggacttcttcacgtccgtgacctacgcccgcgtataccgcgtgtgccgattcgcagcgtaccccgacgaggtggcaaggcttctcgctggcctgtgtaccacaagcctgccacccccaatctggagaagggcacctcggcctgatcatccggccgatcttcccgcctatcagaggcaacgggagcgcgctcttaggcggcatttgccacaaggggcccccacatccccatctctggccaaccattgcgcttcaaggcttgacaggagactccatgccgctgcggaaagggctggtgcccattattcgcggtatgccgatgacctggtgttctcaggcgatgacggctttgcccgaagtgtgactagattcattccattcgcagccgctattgcaatggacgagggtttcgtggtcaacttcagaaaaacgagagttatgccccgcaacaggaggcagcaggttgctggcctggtggtgaacgctcacccaaatgtctcccgccagacctatgaccgactaaaagcgatcctgactaattgtgctcggcacgggccagcaagccagaatagagacggtcaccccgattttagatctcacctaagagggttgatcgcctggatagatagtgtggcaccaaagagaggagctgaactccgggccctctttgaggccatcgaatggaagggctga

SEQ ID NO: 12592 - RNA, 1329 nt, unidentified
  source 1..1329: mol_type = other RNA; note = synthetic construct
atgactctggatgacgtggttcgcgccttcgctggagctctcctggctggagaatggaccgagtccacagtccgggaaagagcggtagaggccctcggtgccaagcctagatggctctggcccctcgttagacgggtggtccgattagggagcccccctcgtagaaggcaggttgaactagccatccgagcctcatctgccttcgtgggagcatggaagcgggggctggtacagcccaccagagcacttgaagtccgtgctgtcctgtcctcgccacgaatgggtccagttcgctgggccgtgccatctctgggaacagagggggaactagcgaggtggttgggactcggcgtcagcgacctattttggcttgcggatcccctcgctggggaacgaagggctcgagtcgagcgcatcaggaattacgtgtatacctgggtgcccaagaggtcaggaggggtgcggttgattgagtctccgaagcctctgcttaaaacgctgcagaggcgtatcctgcgcgaaataattagtctggttcctgtgagtgacagtgcccacggctttgtgctgggaaggagcacgctgacccatgcctcatcccacatttcacagcgggtggtgttgcgcttagacctgcgcgacttcttcagtactgtgtccgcatggcgggtagccgccgtatttaggaccgccgggtatcctgagaatgttgcacgcttgctcgcaggcttgtgtaccaattccgctcccgaagcagtattacagctcgctggcccgagcctgtcacgctttcagaaacaacggctcagatccgcccatgtgcctcaaggcgctcccactagcccagctgtggcaaacctctgcgcttatcggcttgatcggcgcttggccggccttgcaagagttagcggcacaatctacactagatacgccgatgatctggtcttttccggcgatttcactagaagtaaggattttgaccgcccaaggcctagcattgataggttcgtggcgagggcccacgctatcgtcctggaggaaggcttcacaccacattttgagaaaacacgtgtgatgggttgcggccgtagacaggaggtcacgggaatagtcgtgaacaggcagcccaatgtgagccgggcagacctggaagtttttgaggccaccctgtacaactgtcggagatctgggccgtctacacaaaaccgaactgggcacccagacttccgcgcacaactggcgggcagattaggttatgtggagatggtgttgggtgagcgggcccgatggctgagaacccttttcgagcagatcgactggtctaggtga

SEQ ID NO: 12593 - RNA, 1182 nt, unidentified
  source 1..1182: mol_type = other RNA; note = synthetic construct
atggcaagaacgctgtcacgcaggccgccacccatggaagcggacagagatttcactgagcggctcgcaagatttccaggagcgaaagaggctgtcctgaagagactgccgatacgccggtggttcgtggtgactcctgttcaaagacccggccgatggcccgtacctctcctaccaacaccctccgatctggccaccgcactaaggctcgacgtcgatgccctggattggttcgccgacaacagaggcttagaggctcacacccggagcagagctctgcggcattatcattacagatggttggcgaaaccaaccggtggggccagactggtcgaagcacccaagggacgcaccgtggatatacaaaggtggatcctgcgtaaccttcttgactctgtaccaccccacccggccgcagtagggtttcgaaggggattctccacactcgacgctgccgctcctcatgtgggcagggaggtggtgctcagtctggatctggaggacttttttgctagcgtctctgccgcacgagttgccgctacattcgccgccttaggttatcctcggcccgtggcgtattgcctttcaggcttgtgtaccacaagagtgcccgccgccattttagcggaacagcctcgaggtggcgacctgcctgctgcttggaggcagaggcggaggctgagagatgcccacctccctactggcgcccctacttcgccagcccttgccaatctcgctgcctttgccctggacacgcgattggctgctgcagccgcagctgtgggtgcaacctacacacggtacgccgacgatttgagctttagcggagacgcagaattctcccggcgggctaggcgcttctctgtcttggtgggggcaatcgctattgaggagggatacagggttaatctgaggaaaactcgtcttgccggaaagggcgctcgccaggaagttgtgggggtcgtggttaacgtcaggccagccctcgctcgtgaccgttgggatcggctacgggccatcctgcacaattgccaggttcatgggcccagtacccagaaccgcgacggtcacgaagacttccgcgcatggattaccgggacagtggcggcagccagagctatcgatgcaaagcgagggggccgcttgcttgagatgctggccggagtggattggggccgctga

SEQ ID NO: 12594 - RNA, 1326 nt, unidentified
  source 1..1326: mol_type = other RNA; note = synthetic construct
atgaatagatcggaccggacaagtttagcccgagacttggcagcgacattcctcgccgggccatgggagcgaagggaaatggcaagaagagccgccgcaagcttcggcctccctagatcccctagatggctcagcactctagccagggaggtggtcagggtgtttggtcccgatcccccacacggacgggatggtaggatcgctgcactgatagccccccgcctaagacccttgagacgcgcaggaatcgctcgcaggccagcactggtgcatccttgtctcgtaccagcacgcatggggactgcagctgctcccgtgctgcgtgaacggggattgcccgaagttgccacgcccggtgaattggcggcatggcttgggctcgaccgagatcggcttgcttggctcgccgatgtccggggtctgagtaggcggactcatgatgggccactggtgcactaccgttacaggtgggtgcccaaaagatctggcggggcgcggttactggagatccctaagccagatctggccgcggcccaacgcaaaattttacgcgagctgctggaccgagtgccaccgcatgcatctgccgtaggcttcagaaagggccgcaatgtccttgatcacgccagcgcccacgcaggtgcagctgttgtgctgcgcatggacctgggggactttttcgcctcagtcgccgcaactcgtgttcacgccatctttgttgccctcggataccccgccgccgtctcttcactgctgacaggcctgtgtacccatagaacatccatgtttgtgcgtcatgcgtccaccgaccacgctgcttggtcccgtcttagggagagacatttacctcagggcgccccgacgagtcctgctctagcaaacctggctgctttcggcttggacgttaggctggctgctttggctagcaaggccggagccgcttataccaggtatgccgacgaccttgcattctcaggcggtaccggatttgcccggtctgcggcagccttccatgtccttgcttgcgctattgtgatagaagagagctttgcgccaaaccctcggaaaacccgcattatgcgggcctcaagccggcagcagattacaggcctcgtcgtgaatgcgaagcctagtctgccccgcgacgagctggataggctgaaggccaccctgcacaactgcgtagcccacggacctgcatcccagaaccgcgatggccgggctgatttccgagcatggctcgctgggaaagtggcctgggtggcctctgtacacccggctaggggagctcgattgcgagccatgctcgagagaatcaggtggtga

SEQ ID NO: 12595 - RNA, 1329 nt, unidentified
  source 1..1329: mol_type = other RNA; note = synthetic construct
atgagcgaaagaaacgttgtggctaaagccctggcctcggcttttttggctgccccatggactcgcgctggactgatcgctaacggcgccgaagtcgtaggggggagatttccatggcttgcaagcttagcacgcagtactttacgattcttccctagaccccctcacgaccgcctcgaattgctggcggaaatccttgccacacgaccagccctgaaacaggcttgcgccaaccctaccgctcctgtgaggcttctgaggtggctaacagccgaacctcagatgggcagggccccatggccagtacctgctctgccaacgcaagctgatctcgcggcatggcttggagtgacagacgcccagttggactggctggcggacggaaaaggattggagcataggacctccccgggtaggtggaggcggtatggctacacctggattcccaagcggtcaggtgggcaacggctgttagagcagccgggggaagagctggccagacttcagagaaaggtcctgcattgtatactcgatcggatacccccccacgaagcagctcacggcttcgtgaagggaaggggcattcggggtttcgtggagccacacaccaggcaggcggtcgttgtgcgtttggatctggaggactttttcctgtcagttcgtccgccccgactgtggggcgttttccgtgcagcgggatatcccgatggcgtagctggcgcgcttgttggcctctgtacaaaccggacccctggagccgttgtagcccaagcacgcaaacccactcacgcccaggaggtcgagagcagatggttgctggggcggcgtctcgagagcagacatctcccacagggggcccctacttctccggcactggctaatctggccgcctatcgactagacgtccgcctgtctgctcttgccggtgtgctcggcatgcgatacacccggtatgccgacgacctggccttttccgcagacgcagcaagacccggatccattcggcggctcctgagatccgtgcgcaggatcgtgcgtgatgaggggtttacggtgagagaggataagacacgggtgatgagtaagggacatcagcaatggctggctggggtggtggtcaatgagcatcccaatctacgcagggaagattacgaccggctgaaggccgtgctgcatctctgcaggaccagaggccctgcctctcagaatactggcggtcacccagacttcagggctcacctactcgggcgcatcgcatgggtcacatacctccaccccgccagaggtgcacgcttacgagctttgtttgatcgcatcgcatgggattga

SEQ ID NO: 12596 - RNA, 1329 nt, unidentified
  source 1..1329: mol_type = other RNA; note = synthetic construct
atgagtggacgtacagtggtcgccagagctctcgcatctgccttcttagccgccccctggactgtctctggcctagtggccaaaggaagcgaggtggtaggcgggcgcttttcttggcttaggagcctggcaaggtccgtgttacgcttcttcccccgccccccacacggaagactcgaactgctcgccgaggtattggctacacgggccgctctgaaacaggcctgcgcaaatcctgaagcgcccgttagggtcgtgcggtggctaactagcgagccggagatgggtcgacaaccatggccgatccctgcactgagtactcaggccgacctggctgactggcttaaggtcacatccgcgcaactggattggctcgccgacggcatgggcagagagcacaccagttcaccggggcgctggagaagatacagatacacctggattcccaagcgttccgggggcgaaagactgctggaacagcctggtgaggaacttgctaggctccagaggcaggtactgcacggcatattagatcggataccacctcatgaagccgcttatggctttgtgaaggggcggggcatccggggttttgtggaacctcacaccgggcaggcagttgtgatgcggctcgatcttgaggactttttcctgtctgttaggcccccacgagtttggggggtcttcagggcagctggttacccagacggagttgctggtgctctggctggattgtgtaccaaccgaacacctggcgccgtcgtggcaaaagcccgcagagctgatgacgccagaaaggtcgacgccaggtggctgcttgcaaggcgattggaaagtaggcacttgccccaaggtgcgcctacgtccccagccttggccaacttagcggcctacaaacttgacgttcggctgtccgccttggctgcagctctcggaatgcattatactcgctatgccgatgatctcgcgttttcagggtcagatgcaagggcaggaagcgcacaccgcttactccggtgcgttcggagcattgtgcgggacgaggggttcaccgtcagggaggataagacgcgggtgatgcatcagggccatcagcaatggttggcaggggtggtggtgaatcagcacccctcactgcgtcgcgccgactatgatagactgaaggcgctgctacatctgagccgcacccgaggacccaactcgcagaatactggaggccaccctgactttcgcgctcatctgctgggcagaatcgcttgggtaacacacctgcatccagctcgtggcgccagactccgagccattttcgagcagatcgtgtgggattga

SEQ ID NO: 12597 - RNA, 1329 nt, unidentified
  source 1..1329: mol_type = other RNA; note = synthetic construct
atgagtaaacgcatagccgtggccaatgcactggccagcgctttccttagtgggccctggaccaccgcgggattagtcgagagaggcgctgaagtgatcggagggcgcaccccatggctgcttagcgtcgtccggagcacacggcgatttttcccccgtccccctcatgcccggtttgaactgctggcggagatcctggcgaccagaccagccttgcagagggcttgcgggaatccccatgcccccgtgaagattttgcactgggtagccactgaacctgagatgggcagacagccctggccggtaccttccttgccgacccaggcagagctgactgactggctgggcatgactgatgctcagctcggctggttagctgatgctcgcgggctcgaacgtatgacacccccagggcagtggaggcggtataggtacacttggatccctaagagatcaggcggtgagaggctgttggagcagcccggtctggatctgtctcggttacaaagaaaagtgcttcatgggattctcgacgtgatcccccctcatgaggccgcctacggattcgttgcgggacgaggcgttcgcggctttgccgaaccacacgtgggccaagccgtggtggtgagggtggacctggaggactttttcctctcagtcaagccggctcgtgtctggggaatgtttcgggcagccggatatccagacgatgtggctaccactctggccggtctatgcacaacacgtacgccatcaggagttttggaacaggcccgcagagcagctgatggggaggctctgacagcacgatggaggctggcacgtcgacttgaaagccgccacctggctcagggtgctcctacatcccccgcgctcgcaaaccttgctgcctacagactcgacgtcaggttgagcgccctcgccagtgctcttggtgccaggtatactaggtacgctgacgacctagccttctccggcggcgatgccctagcaagatccacagggaggctgctcaggtgtgtcgcccgaatagttcgggaggaaggattcacggtgcggaccgagaagacgcgcgttatgagacggggtagacaacaacgcctggccggcgtggtggtaaacgaacacccatctgttccacgagcagactatgatcgcctgaaagcgattctgcacctctgtcggaccaggggccctgcatctcagaacactggatctcaccctgagttcagagcccatctactcgggcgggtggcttgggtatcgcagttaaatcctacccggggcgcaagactgcgcgcaatctttgagcagattgcatgggaatga

SEQ ID NO: 12598 - RNA, 1350 nt, unidentified
  source 1..1350: mol_type = other RNA; note = synthetic construct
atggcgttaggggattccgcggtgagcaaccggcagtcagtcgcttcagccctggccagtgcttttctggctggcccatggacctatgagggtatggtagaaagaggagctcacgtggttggaggacgggccccttggctattggccgtggtgaggggtatcaggcgcttcttcccccaccccccagttgctcgcatggagctcctgacagaactcttagcgacacgcccagcactgattaaggcctgccgcaatcctgctgtcccagtccacctgcacaggtggctcattcccgagcccagcatgggacagaggccatggcctgtgcccgaactgtctactcaggccgaggtcgctcgctggcttggagtgactgatgcccagcttggctggcttgctgacgggtctggatttgaacggactagtcggccagggcaatggcggaggtaccgttacgtgtggatcccaaaaagagcaggcggtaagcgcctcctggaacagcctggcgttgacctcggtcgcctgcagagacaggtgctgcacgggctgcttgacctgataccgccccatgatgccgctaggggattcgttcgtggccgaggcgtgagagattttgccgaacctcacgtgggacaagcggtagtcgtacacatggacctggaagacttctttcattcagttcggccctctaaggtgtggggagtattccgagcagcgggctatcctgactcggtgacagaggtcctggcaggcctgtgcacaaatagaactcccggtaccgttgtagaggaggcaccccgagccacccatttaggggagcagaaagccagatggcggatgaccagaaggctcacggctagacatttgccgcagggtgcccctacttctccggccttggccaacctggccgcatatcgcctggacgtgaggctgtccgctcttgccgctgccttgggagctcggtatacgcgttacgccgatgaccttgccttttccgggggcgcatccttgttacaacgacctctccggctcgtccgatgtgtggcagcaattgtcagggaggagggcttcgccatcagagccgataaaacacgggttatgcatcaggggcagcaacagagactggccggcgtggtggtgaatgcacaccctactgtgccaagagaggactacgaaaggctgaaggcagtcctacatctgtgtcgtacccgcggccccacaagccaaaacaccgaggggcatcacgatttcagagctcacctactcggccgcatcgcgtgggtcagtcacctccatccaagcaggggggcaaggttgcgggctacctttgaccgaataacctgggattga

SEQ ID NO: 12599 - RNA, 1335 nt, unidentified
  source 1..1335: mol_type = other RNA; note = synthetic construct
atgtcaactcgccacccggtcgctgcagctttggctagcgccttcctcgcagggccatggacaagggctggccttcgagaacggggcgcacatgtggtcggtggaagacccaggtggctggtgcctgtagtccgtggcatattgcggtactttcccaggccccctcacgctaggttcgagctgctgactgagctgctcgctaccaggccagcgctgattaaagcttgtggcaacagcgctgagccaattagaattcggcattggctggacgtggaaccgcagatgagcaggaggccgtggcctgtacccgagttgaccacccaggccgctttagcccaatggcttggcgttaccgatgcccagctcggatggcttgcagatggctccggtttcgaacgaacaagtcggccaggacagtggcgccgttaccggtatgtatggataccaaagaggactggagggaaacgcctgttggagcaacccggtctggacctggcgagactccagaggaaggttctccatgatatcctggatgttatccctcctcacgcggcggctcggggatttgttagggggctgggcgtgaaggacttcgctgaacctcacgtggggcgggcagtggtagtccgagtagatctggaagacttctttcacgcagtgcgacccgcacaggtctggggagtgttccgcacggccggatatcctgatggtgtcgtgaacgcgcttgccgggctgtgcacgaatcggacaccaggagccgtcgtggaacaggctagacgggccgagagtgcacaggaacttgacgcctgctggcgtctgtcccgcaggttatctgccagacacctcccccaaggcgccccaacttcaccagccttggccaacctggctgcatatagactggacgttcgcctgtcggctctggcagctacactgggggcacgctatactcggtacgcagatgacctagccttctccggcgacgaggtgctagccagaagggtccgcagactgttaacttgcgtgacacgcatcattcgcgatgagggctttaccgtgcggcaggggaagacaagagtgatgcaccaaggccagcaacagcgtctcgcgggcgttgtggtgaatgcccatccgacggtcccccgagaggactacgaaagactcaaagctgttctccacttatgtagaaccaggggacctgagtctcagaataccgagcagcatcccgactttagagcccacctattggggcgcatcgcctgggtggaacatctccatccagccagaggtgcccgtcttcgagccacctttgagcggatcccttgggcccccgagtga

SEQ ID NO: 12600 - RNA, 1332 nt, unidentified
  source 1..1332: mol_type = other RNA; note = synthetic construct
atgtctgagcggcgcgtagttgcccagggtttggccagtgcctttctggctggcccttggactctgaagggactcgtcgagcggggtacagaagcagtcggcggtcgagcgccttgggttcgatctatggccagaagtgcgatgatattcttccccagaccccctcatgcacgtctggagctgcttgccgaggtgttggcgagcaggcccgtgtttcccaaaggattcgccgactcctcgggacgggctaggatcgtgcgatggctgacatcagaaccgcgaatggataggcagccctggccagtcccatccctccctactcaggccgatctggctgactggctaggcgtcacgggcgcacaactcgattggctcgccgacgcccctggcattgaaagaaccagcaaacccgggcggtggagacggtatagatatacttggatccctaagagaagcgggggagagaggctgttggagcagccagggctggatctgatgcaggttcagcggaaggtgctgcacgggattttggaccgcgttccaccacatgacgctgcgcacggctttgtcgccggtaggtctgtgagaagctttgtagaacctcacgccgggcaagccgtggtcgtacgtgtggacctggaagatttttttttctcagtgcgaccagcccggatttgggccgtcttccgaaccgcagggtacccagacggcgtgactaacgcacttgccgggctgtgcaccaatcgcacaccgcaagccgtgttggcacaggccagacagcccgagagtgtaagcgaggtggatgcacggtggagactggctaggcgcttggaatcacgccatcttcctcagggagcccccaccagtcccgctttagccaacctggctgcttaccgcctcgatgttcggcttagcgctttagcgacagccatgggagcacgctatacgaggtatgccgacgacctcgcattttccggtggcgacgcactgtctcgtagaacccacaaactattaagatacgtgtctcagatcctcagggaagagggattcatgacccgggcaggaaagacccgcgtgatgaggcaaggtgcccaacagcgtctggctggcgtcgtggtgaacgcacatccgtccgtctcccgggccgattacgagagactgaaggcaatcctccacctgtgtaggacaagggggcctgcttcacagaatacagaaggccaccccgatttcagggcttaccttctcggccgtatagcttgggttgctcaccttcatccagcgcgcggcgctaaactacgcgccactttcgagcaggtggtgtgggctggatga

SEQ ID NO: 12601 - RNA, 1329 nt, unidentified
  source 1..1329: mol_type = other RNA; note = synthetic construct
atgtctgagcaacgagtggtcgcccaggcgcttgcgagtgcattccttgcgggcccttggactttgaaaggcctggtggagcgcgggacagaagtggtgggagggagagccccctgggtatcctctctcgcacggtccgctatgatcttctttcctagacccccccacgcacgcatggagcttctgggtgatctgctggcttcaagaccggcgttcatgagaggctgtaccgatcccagcgcacgagcacgtatcgtccgctggattactagcgagccccgaatggctagacagccctggccagtgccttccctctctacgcaggctgaactggctgcttggttgggcgttactggagcccagctggactggctggctgatgtgccaggtatcgaaagaacgagctcacctggcaggtggcgcagataccggtatacctggatcccaaagcggtcgggtggggaacgactcctcgaacgacccgggctggaccttctgctcgtgcagagaaagctcttacatgggatattagaccatatccctccgcacgatgcggcccacggtttcgttgctggcaggagcgttctcggctttgcagagcctcatgcccgccaggccgtggtagtaagagttgacattgaggattttttcttcgccgtgaggccagcacggatttgggcagtgttccgcaccgccgggtatccagatggagttgtgagtgcccttgcgggactctgcactaaccgtaccccatccgccgtcgtctcacaagctaggcgtcccgactctttggccgatgcttccgcacgttggcggttggcaagaaggctggagtctcggcaccttccacaaggagctcctaccagccctgccctggccaatctggccgcttaccgcttggatgtgcggctgagtgcactagccgaggccatgggagcccgctatacacgctacgctgatgacatggcatttagcggaggcgatgccttggccaggagaacccataaactcctgaggtacgtctcccagattgtcagggaagagggcttcaccccccggacaggaaagacaagggttatgcaccggagtactcaacagaggctagctggggtcgtggtgaacgaccacccttcaatacggagggtagactatgaacggctgaaagccatcttacacttatgcaggacccggggcccggcctctcagaatacagagggccatccagactttcgtgcacacctactggggcgcattgcctgggtggctcacctgcatcccgccagaggtgccaagctgcgagctacatttgaccagatcgcatgggactga

SEQ ID NO: 12602 - RNA, 1350 nt, unidentified
  source 1..1350: mol_type = other RNA; note = synthetic construct
atggcctgcgagtcagcaatgagtgagcggcgcgtggttgctactgcccttgcgtctgcttttctggccggtccttggacaattcagggattgacagagcgtggactggaggtagtaggcgccccgtccccatgggttgcatcgctagcacgctcagcagtgcgctttttcccaagagcacctcgcgctcggatggagctgctggctgatctcttggccacaagagccgccttccagcgagggttcgaagaccccgaagccagggccagaattgtccgctggcgcgtatccgaaccgcgaatggctcggcaaccgtggccagtgccttccttgccagcacaggccgatctggccgattggctgggagtgaccagtgcccagctggattggctcgccgacgttcctggaatagaacgcacgagtccccctggcaggtggaggagataccgctatacctggatccccaaacggagcggcgggcaaaggcttttagagcgacccggattggacttggcatgcgtgcagaggaaggtgctccacggcattctggacagaatccccgcccatgacgcggcgcatggattcgtctctggacgtggcgtgcgctccttcactgcaccccacgtcggacaggccgtagtcgtgagacttgacctggaggacttctttcttgcagtgcggcctgccaggatctggggcgtatttcgggcggctggttatcccgatggtgtcgtgcgggctcttgctgggttatgtacaaatcgtaccccaggcgccgttatggctcgtgctcccacgccaaccagcttggctactgtggcagcccgctggcgatggaccagaagactggaaagccggcatctaccacaaggcgcccccacatcacctgccctggctaatctggccgcgtaccgtctcgatgttaggctaagcgctctggcagcagccatgggggcacgatacactagatacgctgacgatctggcattctctggtgatgcgtctctcgcacggaggactcggcgcttactgcacctcgtgggtctgattgtcagagaggagggcttcaccccaagggcgggcaaaacgagggtgatgagccaagggactcagcagcgactcgctggcgtggtcgttaacgccaggccttccatcccacgggctgactatgatagactcaaggctctgctgcacctgtgtcgaaccaggggtccggacagccagaacaacacagggcaccctgactttagggcccacctgttggggagaatcgcatgggtgtcacatctccatcccaccagaggggctaggcttcgggccttatttgaacagatagcctggacagcctga

SEQ ID NO: 12603 - RNA, 1260 nt, unidentified
  source 1..1260: mol_type = other RNA; note = synthetic construct
atgcatgaacgggccgtcacagcccttgggcagcactttcagtggctgaccggagtggtcagaaacgttcgtcgtggctttcacaggcctcctgttgatgccccagatacacttgccaggtatatagcccacctgccttctttccgccaagcaatggcccatcccgacacacggcctcggatacggcactggctcgttgccccaaccgacatgggtagaatgcgatggcctgtgcccgcactgcctactactggcgagcttgctgcctggctgggcctaagtgacgaggatcttgattggctggcagataggaagggctacagccacagcgctcgcgacactcgcttactgcattatcagtggcgatgggtcccaaagcgcacaggcggagtgagactcctggaatccccgaaagcgaggctgaaagccctgcagcgccaggtactgcacgcgatccttgacgccatccccccccatgagtcagcacatgctttccagcaggggaggagcgtgctgacttttgcagcacctcatgtgggacagcacgttttgttgcggatggacctggaagacttcttcacctctatctctgccggtagggtcttcggcgtgtttcgaacggcggggtaccccgaagcagtgtcttccaccttagcctccctgtgtacccacgccctcccactgctcgttttgcgggatatgccccgtcctgcatcagtggaagacattgatgctcattggagagctcgcgcaaggctgtcgagcccacatcttccgcaaggtgccccaacgtcccccgctctagctaatctctgcgcttggggattggacgttcggctctcaaccctcgcggccagtatgggggtgaggtactctagatatgctgacgaccttgtatttagtggcggggaggatctgtcccacgcgttagagcggttccgtcacctagtcgagacagtgattagagacgagggatttgtccctaatgtgaggaagacccgcgtactgagacaaagtgtccgacagcaggtagccggcgtggtggtgaatgcacgcccaaacgtgccccgggctgacttcgatactctcaaagctacactcactaactgcattagacagggtccctcaacccagaaccacacagggcatccagatttccgcgcccacttggtgggaagagtggcctgggtcgctagcgtccaccctcaacgaggcgcaagactgcatgccctgttggatgctatcgattggagcaggtga

SEQ ID NO: 12604 - RNA, 1344 nt, unidentified
  source 1..1344: mol_type = other RNA; note = synthetic construct
atgatcgaaccacaggctgctcgcgcgatactcgccgaggcatttctcgggggtgactggtctgccgacggtttactgcagcgggccctcgaagttgtcgctgaacccgcacctaggcaatcactccgcgcgctgatcaagttggtgctaggaaggttccccgcaaccccccccttaaggcgcagagatctcgaagaggtcatcgccagctccaggagcttttcaaaggccactcgcgcccaacgcctcagagtatggcggccttggctgaggtcccctgttatgacccccctggctggcgctccaacaagttggcccgtccctgccctcccaaccacaacagagcttgcggcttggctgggcctggatgtggacgctttggagtggtttgcgggcacgcatggcagagcaagaagggctccaccgggcccacttgggcactatacctattcatgggcaggcaaagccagcgggggataccgactcatcgaggccccaaaagcgcggctgaaggcccttcagaggcgagtgctggacgggattctggctgaagtgccagtgcaccctgccgctcacggattttgtcggggacgcggagttctgtctcacgcagcgccgcatgccggccaaaggttggtgatggccctcgatctgcgggactttttcgcaagtgttcgcgcctcccgggtccttgccattttccggactctgggttaccctgaggccaccgctcgactactgactggactggcgactcacaccgtgagcgcactcgtctgggcgagtgcaccacctcctagggatgccgccgaagctagcgcaaggtttcacgccgggcggttcttccagtcgccccatttaccccagggcgctcccacgtctccggctttagctaatttggccgctttcagattggatcttcggctgaccgccttagctagagccgccgacgccacatatacacgctacgcagatgacctggccttctctggcggagagagatttgcacgcggcgctgagagacttttttccctggccgcccagattatatttgaagaggggttccggctgaacgcagggaagactcgacttctggggcagggaatgcgccaaaggctcgctggcgtggtagtgaacgcccatcctaacctggcacgtcgagacttcgatcagctgaaggctaccttgcataattgccgtcgtgatggggctcaggcacacgacagagatgggcttggtgccggtttccgggcacacctgctaggcagagtagcctgggcagagcaagtgaatcccgcccgaggcggtaaattgcgtacaatcttcgacggaattagatggtga

SEQ ID NO: 12605 - RNA, 1920 nt, unidentified
  source 1..1920: mol_type = other RNA; note = synthetic construct
atggctggcgaggtgtcgcctggactcgggaaactgagcggaggggattacgaaggcctggaactggtgcgggcccgagtggaattcgcctctggtgtgcgctggtttcacccgggcgagttagaccgggtgcatccccatgtcgaggctgcattggtgcggcatgccatcacacgagacttgattgcggccggcaacgctacgaggctcgaacagtcgctcgaggctttctgggagggacgccaagaattctaccggactccgggactgttagatgagctttggctccttcacaggggacccgcccctacagagctgggtgaactgttcgacgctcctcgtgctgaactgctcgcaatcgtcccccagctggcaccaccattaccccagttacccagagaaacgcggttgcttgaagcggaggagctgcatgccgaggcatggaagcaggtgacccccataggcgagctagaggaggacgaagattggtcatctgagtgggagagagcggccccactcggtgctcttgttcctccacggacaagggcggattatttggcggatgaccaagacgacgatgacccagatgatgacgaagaatgggagctcaggcgccggagaaagcagctagcagaggctgctagtgccctgtgtcaggcctttctatctgccgaatggtccgccgacgacctgttggaccgaggacagcggaccttaggcacctcagagccctggctggaggaattggttgacagagtcctggcagcctttcctgccagaccccatcctgaagacgaagatctagtcctgtttctcgctgaggacgaggccctgcatgaacagttgctcgagggcagccttgtcgtttggacacgcttctttgtgcccccccagatgcgtgctgacaggagattccccgtgatgcctctcgagggggcaccagacgtagagaggtggttgagaattggcactggggatctgcagtggctagccgatcaggaacgttggctttacagacacccaagtggaccgctgcagcattatcactaccactggctgccgaaaaggtctggtggcagacggcttgttgaggcacccaaggagctcctgaagtccgtccagcgccaaatcctgcgcgacgtgctgggtcctgttccacctcacgaagcggcgcacggattttgtcggggccgctctgtgaggtcatatgcagagcctcacgccgggcaggagttggtacttgggttcgatttgcgggaatttttccccacaatcagggcacccagggtgtccgccctgtttagagcactggggtatccatccggtgtcgcccagctgctgtcagatctgcgaaccaccgtgacccctagcgatgtgctggaggaaggaccactctccggaggagcaagggggaggctggaacaacgccatcttcctcaaggtagccctacgtctccggctctggcaaacctttgcgcttacggcctgccagtaagactctccgctgctgccgctgccgttagtgctcgctacactcgctacgccgatgaccttgccttctccggcggagctgattttctgcggcaagccagccgattccggtatttggtgatgcgaattgctgccgaggaggggtttgagatcaatccaaccaagaaccgttggatgcgcccccagaggcagcaaaggctcacagggctggtcgtaaacgtccggccccgaccaagccgagccgaattcgacagactaaaagcaaccctccacaattgcggcagacacggccctgccagtcagaatagagcaggcctgccagacttccgcgcccacttagcagggcgtgtgagctggttcgaacagactgatccggtgagaggcgagaggctccgtgagctctttcaccagataacttgggaaacttga

SEQ ID NO: 12606 - RNA, 1323 nt, unidentified
  source 1..1323: mol_type = other RNA; note = synthetic construct
atgaacgtggacgaggtggcaagaggactggcagccgcctttttggccggagactggttacaggaagggatggtggctagaggtcgagaggcactgggaggcaggttcggctggctacctggactggcacggagagctcgcgaagcgttccttgacccacctctgcacgacccagaagcgctggaggacttgctcgctgcggatgctaggctgcaggcagccctgaggcgacgagctagacaaggccacccgcctttggtcgttaggagactgttcctccatcacacggcgatgaggagcgagcgccgctttgctgttccctctttcgacactgaggccgatttggccaggtggctcgggcttgctctcactgatctggattggtttgccgatcgaaaggcctggttaatccacgccccccaagggcctttacagcactatcatcggacctggatccggaagagaggagggggccttcggctgcttgaggcaccaaaagccacattaaaggcaatgcagaggagagtgctccatggcttgctggcacacgtaccgccacacgatgcggcccatggtttcaggcctggacgctccgttgtcactcatgctgccccccacgcgggcaaagctcttgtactccggctggacctgcgcgatttttttccctccgtacctgcaggtagagtggccgccctgttccgttccctgggttacccccgctcagttgctggtctgctcaccggccttgtcactaccagaacacccctggcgacccttgagggggtggatctagatcgggaagctgaggacgccctcaggcggtcacatttgccacagggcgctccaacgagcccttggttagccaacctctgtgccctaggcttggacgtgcgcctcagtgctgcagcagccaaggtgggcgccgattacacccggtatgctgatgacctcgccttcagtggggacgaggcctttcgtcgagtcgcagccaggtttcggacactggtgcatgctatagttctgggcgagggatttgacttgaggccagagaaaacaaggtggatgaccccttctgtgagacagcgacttacagggctggtggtcaatcagcgtccccgcccaagcagggccgaattcgatcggctgaaggcaactctgtttaactgcgcccgacgcgggcccacagcagaaaatcgggagggacaccctgacctgcgtgctcacctccgcggtagagtcgcttggttcgaacataccgacccggctcgtggagcacggctaagagccctgttcgaacgcattgcttgggcccccgccagatga

SEQ ID NO: 12607 - RNA, 1302 nt, unidentified
  source 1..1302: mol_type = other RNA; note = synthetic construct
atgatgctagctactgtagcctcgccggcgagtttgatcgctgcctgccaacgagtcttcggaacaacccctgcgtgggtgccaagggtctgctttgcattgatcgatcggacgggcgacaacttccactgtttttcacgccaggagctggccgacatcctgctacagctgctgttccatggcccgcaaaccgagagaatagcactccccccagtgaggagatactgtacagaacctgcccgacaagcgccaaggcctgcttggcttgccgcccttgctctccccgacttgccctctgtgggtgctctggccggttggctaggagaacccgttggcgctttggcttggctcgctgaccagtggagatccgaggacggcaaccggtccaggttacagcactatcactatcgctgggtgccaaagcggagcggaggagtccgattgattgaaattcctaaggcgagactgcgtcgtattcaacacaaaatcctgcggcagattctggatagagtgccccctcatccggccgctcacggatttctgagaggccatagctgtctcacccatgccgcccttcacgctggtcaggaggtcgttatacgcatggacctgaaggacttcttccctagcatccagtatgcccgcatccacgcactgtttgagaaactcggctatacgacaaacgtcgccggcactctggcaagggtgtgcgtgaatcgcactcctccatccgccatcagggatcaggccgcaggatccctttcatggccagagcggcacgcactcaaaagtccacacctgccccagggatcaccctgctctccagcactggcaaacctgtgcgcctaccgtcttgatcttcgcctcgcatctctcgctcgacctctgggggctagctatagcaggtacgccgacgatctggtcttctctgggggtcccgatttcgctcgctccgcagaaagatttcgtgttagggccgctgcaattgcgctggaggaagggttccaggtaaacactcggaagagccgggtgatgaggaagggcgcaagacagcaagtgaccgggatagtagtcaatgcccatcccaatttagcacggagtgagtacgatcggcttaaagccacactgaccaactgtgtgagacatgggccagacagtcagaataggcagaatcatccggattaccaggcctacttagcggggcgagtttcctacgttaaaatggtgaatgcctctagatctgccaagttgcagcgcctctttgatgctgtggcctggccccaagacgccccttcagcttga

SEQ ID NO: 12608 - RNA, 1188 nt, unidentified
  source 1..1188: mol_type = other RNA; note = synthetic construct
ttgttgtggcaatgcctcggaaggggcgacggaaacgaggacgacaacgacggggatggggatggcgacggagatggcgacgcatgggtggttggcgccgatctgccacccctgagacggtactgtgtcgatccaccagtgaggccagttcctccggcatggttagccgcactagcgttgcctgccctggcttcagtcggtgcgctagccgcttggtttgacgagcccgtgggtgcccttggttggttggccgatcagtggagactgggaggcgaagggcaggagcggttacagcactatcactataggtgggtcccgaagcgctccggtggagtgagactcatcgaaatccctaaagcccggcttcggcgactccaacagaaaatcctccgcgaaatccttgaccgtgtaccaccccaccctgctgcccatggctttcgcaggggccattcgtgcgtgacgcatgcagccctacacgcgggacagaccgtggtcattagaatggatctcaaagatttctttccttctattcagctgtctcgcatacatgctctctttgccaaactcggatattgcgccagcgttgctggtacactcgctcgcctgtgtgtgaatcgaactcccccttcagccttcaacgatagacagctgggggccgcactgaattggacggagaggcaggccctgaagagccctcaccttccccagggctccccatgtagcccagcattggcgaatctgtgcgcatacaggctggatctcaggctgagttccctggcccagtctcagggggccacatatagcagatacgcggatgacctggcattcagtggaggtgctgcttttgctcgacgggccgagagattccacctgcaagtggctgcaattgcactggaggaagggttccaggtgcaccaccggaagacccgtttgatgcgagcagccacccggcaacaggttacaggcgtcgtggtaaatagacatcccaacattgcccgctccgactacgacgctctgaaggctaccttaactaactgtgtaagacatggccccgccactcaaaacagggatcgtcatacagactttcgagcgtacctggcagggaggatagctcacgtgaagatggtcaatgcagaccgcgccaccaagcttcagcggcttttcgaagctatcgcctggcccgcttga

SEQ ID NO: 12609 - RNA, 1371 nt, unidentified
  source 1..1371: mol_type = other RNA; note = synthetic construct
atgaatacaaagcagttcacagtgctggcgttagctgacatggtcctggcaaccgatggctccctcgcatctctcatcggcgcctgtaaccgcgtcttcgacgctgaaccgccctgggttcctgcagcatgcgcagctttaattgaacgtacaggggattacttccattactactctaggagagaactggccgccctgctgcttgagtgcatcgggcacggatctgctggggccagagatgaggatgcagagccaggccacgagcggggtctggaatgccttgtgatgcctgacgtgagaaggctctgtgtggagccagccctcagaccccctaaacctgcttggcttgcggccctggctttgcccgatctacccaccgcaggtgcccttgctgcatggctcaacgaacccgttggcgccctggattggttcgccgaccaatggcgcctagctcgggatgctcagtcaccgcttcagcactatcattatcgatgggtccccaagaggagcggaggtcagcgactcattgagattcctaaagctcgcctgcgacggatccagcagaagatcttgcgggaaattctcgacatggtgcctccacatccagccgcccatggctttcgccggggacattcctgcgtcacccatgcggctttgcacgctggacggcacgcagtcatcaggatggacctgaaggacttcttccctagcatacagctaagcagggtgcacgcgttatttgagaaactggggtacccacacaggactgccggcaccctcgcaagaatctgcgtgaatagaaccccacagggtgccttgcgcgacaagctggctggtggcgcacttccgtggctggagaggcaagcgcttaaatcccctcacttacctcaaggctctccctgtagtcccgctttggctaacttgtgtgcctatcgcctggacataagactgagcgccctagcacagtccctgggcggaagttattcacgttatgccgatgacctggccttcagtggtggaccagcctttgctcgggctgccgatcgatttcacgtaagagtggcagccattgcgctggaagagggctttcgagtgaacaccaggaagactaggctgatgcgtgaagggacacggcagcaagtaactggaatagtagtcaacgcccatactaatgtggcacgcgatgagtacgacaaactcaaggccacgctcacgaattgtgttcgccatgggcccgctagccagaatcgtgacaggcacccagactttaaagcgtacctggccgggagagtgtcgtacgttcggatggttaacgccggaagagcctcacgcctgcagggcttgctcgatgcaatcgcatgggccgcctga

SEQ ID NO: 12610 - RNA, 1380 nt, unidentified
  source 1..1380: mol_type = other RNA; note = synthetic construct
atgaatatcaaacagcataccgtccttgctctggcggacatggccctggccactgacggatccctagcctcgctgaccgcggcatgtcacagggtcttcgacgcagagccgccatgggttccagcggtctgtgaggcactgattgcgcgtacaggtgaacacttccactattatagtagacacgagctggctgggctgctgctggagtgcatcggacacggtcgaggaggaccaggagcggacggacaagacggtgacgacgccgaggactttgcccttcctgaacctatcgcgctcccagccgtcaggagatactgcgtggatcctcctgtcaggcctcccaaacccgagtggttggctgccctcgctctcccagaactcgctaatgccgccgccctagcagcctggcttaacgagccagtgggggccttggattggtttgccgatcagtggcgcctagctagagacgggcagtctcccctgcagcattaccattacagatgggtgccaaaaagaagcggcggcgtgcggttaatcgagattcccaaggcacggctgagacgtattcagcagaaaattctgcgtgagatcctcgatcttgtgcctccgcatcccgcagctcacggatttcggcgcggtcacagctgtgtgactcatgccgcccaacacgccggccaacatgccgtagttaggatggatctgaaggatttctttccgagtatccagctgtcccgcgtgcatgccctcttcgaaaagctcgggtacccttataagacagctggcacattggccagaatatgcgtaaaccgaactccattgggcgcgttccgctcaaccccggatggagatagcctgtcctggtcagagcgacaggctcttaagtccccccatctgccacaaggctccccctgtagccccgctttggcaaatctctgcgcctacaggctggacattcggcttgctgcactcgcagaatcattaggcggggcctatagtagatacgctgatgatttagcttttagcggcggacctgcttttgcacgcgcagctgaccggttccacatccaggtggcagcaatagcactggaagaagggttccgcgtgaacacacgaaagactcggttgatgagggccggtgcacggcaacaggttaccggagtagtggttaacgcccaccccaacatagcccgcgacgaatacgacaagctgaaagcgaccctgacgaattgcgtcagacacggccccgcttcacagaatcgggatcgaaggcctgatttccacgcttatctggccgggcgcatctcttatgtgaaaatggtgaacgccgcaagggcctctaggctccagtctttaatggacgctattgcctgggccgcttga

SEQ ID NO: 12611 - RNA, 1383 nt, unidentified
  source 1..1383: mol_type = other RNA; note = synthetic construct
atgactacggataagctgactgcactggcacttgctgacacaatgttggcgaccgatggcagcatggagtctcttattgctgcctgcaacagagtgtttggaagtcggcagccctgggctacagggatctgtgtcgctctgatcgagcgaacaggtgaatcatttcactatttctctaggcacgagttggccgatatcttgcttcagctgctgggccaccaatttgacgacgacgagtacggcgagtataacgacgacgaatttggtgaagaggactccagcccaccttatatagaactgccgcaggtgcgacggtactgcctggatcagcccattcgaccgccaaaaccggaatggcttgccgccctagccctccctgagttacccacaatcggagatttagcgcactggctcaacgaacctgtaggggcactggagtggttcgcggaccaatggcgtcttgccggcgatgcacagagtcggctccaaaattaccattaccgctgggttgccaagaggtccggtggcctcagacttatcgagatacctaaagcccggctgcgcagggtgcagcagaaaatactccgacagatcctcgacctagcacctcctcacccctcggtgcacggattcagacgcggacgttcaagtgtgactcatgcagctttgcacgcaggcaagcgggtggttattcggatggatctgaaggatttctttcccagcatacaggtatctcgtattcatgctcttttcgagaaactgggctactctcagtctgtggcaggtaccctcgcgcgtatttgcgtcaatcgcgctccttatggactgttccgcgataaacaaacaggaggctccttgccatgggtggagaggcaggccctaaaaaccccccacctgccacagggaagtccatgtagccctgccctggccaatctctgtgcttaccgcttggatatcagactggagactctggcccaatcactgggcgcctcctatagccgctacgctgacgacttagcattctcagggggggctgactttgctagagccgcccataggttccacattcaggtcgcggcaatcgcattagaggaagggtttagggtgaatactcgaaagactagagttatgagagaagggacccggcagcaggtgacaggtgtcgtggtgaatacccatccaaacctggctaggagcgaatacgatacgttgaaggccatgctgaccaactgcgtcaggcatgggcccacctcccagaatcgccacaacagaccagactttagagcccatctggccggcaggatttcttatgtcaagatgctgaatgtaaaccgggctgttaagctccaacggctcttcgaatccatcgcctggaccccctga

SEQ ID NO: 12612 - RNA, 1359 nt, unidentified
  source 1..1359: mol_type = other RNA; note = synthetic construct
atgaatacagaaaagctgactgctttggcactcgctgatatgatgctcgccaccgatggatccatggcctctctggttgccgcctgccatcgggtattcgacagtccccagccttggagcgcgaccatttgcgctgcccttatcgagcgtaccggcgataatttccactatttctctcgccatgagcttgcccatatactcctgctgctgaccggacgccgcttcgatgacttcgaagacggtgacgacgagcccagtcctcccctaattgaactgcccgcagtcagaagatactgtctcaatcagccaatccgaccccccaagccggcttggttagcctctctggcactaccagaactgaagactgttggggatttagccgggtggcttaacgagcctgtgggagctctcgcatggttggccgatcagtggcgcttggctggcgacgaacagagcagacttcaacactaccactaccgatgggtccctaaacggggcgggggactgaggttgattgaaatccctaaagcacggctgcgtcgaatacaacacaagattctcaggcagatccttgacctggctccgccccatccatgtgcacatgggttccggcacgggcatagcagcgtaacacacgccgcgttgcatgcgggcaaaaacgtgattatccggatggacctcaaggactttttcccatccatccaagcttcaaggatccacgccctgtttgagaaactgggctacccaccatcggtagccgggacccttgccagaatgtgcgttaacagggctccacgaggtatatttcgtgacaagcaaacgggcgggtcattgccctggtctgagaggcaggcactccagtccccccacttgcctcagggaagcccttgctctccagccctggccaacctgtccgcttatcggctggacataagattagccagtctggcccagtccctcggagcttcatattccagatacgcagatgatctagcatttagcggaggccctgatttagctcgggcagccgataggttccacattcaggtggctgccattgcgctagaggaaggctttcggatcaatacacggaaaacgcgcgtgatgagaaaaggtacacgccaggaggtggccggagtcgtggtcaacagccatcccaatctggcgagaggcgaatatgatctgctgaaggctatcctgactaactgtgtgaggcatggcccggccagtcaaaatcgccaccgccacccttcgtttagagcccacctcgcaggtaggatctcatacgtgaagatgcttaatgctaacagggcggtgaagctccagcgactgtttgagactattgagtgggcagactga

SEQ ID NO: 12613 - RNA, 1377 nt, unidentified
  source 1..1377: mol_type = other RNA; note = synthetic construct
atggataacgaaaagttaacagccttggccctggcagatacaatgcttgccactgacgggagccctgagaacctcatagctgcttgcgaccgggtgtttgatgccacccaaccatgggcgccaggggtttgcatggccctggtcatgcgcaccggcgagaacttccattatttttctcgacatgagctggccgacattctgctccagcttctcggcaggggtcacgtggactacgacgacgaagacgaggatgaagaggagggtggtgccgatgccccccctttcataaagctgcaggacgtcagaaggtattgtctggaacaacctattcggcctcctaagcccgcttggctcgccgaattagcactgcccgacttacccacggtcggcgatctggccgtttggcttaacgaacccgtaggcgctctgcggtggtttgcagaccaatggaggatcgctcgggatgagcagagccgcctgcaacattaccattatagatgggtgccaaagagatcaggcggcttgcgtctgattgagatccccaaagagaggctgcgccggatacaacagaagattttgaggcagattcttgatcttgtgccgccccatgcctccgcacacggttttcggcgagggcattcttgtgtgactcacgctgcacgtcacgcagggcaacacgccgtggtgagaatggacctcaaggatttcttcccatccatccagcatgcccgggttcaggctctgtttgagaaactgggataccctgagagtgtggccggaacattagctagaatttgtgttaatcgcgccccccacgacctatttagggacaaacagagtggaggcagccttgcgtggtccgaacgacaggcactcaagagccctcatcttccacagggctcaccgtgttcaccggcgctcgcaaatctgtgcgcttatcgcctggatatcagactggagtccctggctcggtcactaggggcaagttacagccgctacgctgatgacctggccttctctgggggagatgaattcgcacgctgcgccgagaggttccacatccaggtagctgcaatcgccctggaggagggatttagagttaatacgcgaaaaactcgtttgatgagggaagggactcgacagcaggtgaccggaatcgtggtcaatgcgcaccccaatattgccagggacgagtacgataagttgaaagccaccctcacaaactgcgtccggcacggaccagaatcccagaaccgcgaatctcacccaaacttccaggcatacctcgctggcagaatctcgtatgtagcgatggtcaatagcgacagagccgctaaactacagcgtttgctcgacgatatcgtgtggcctacctga

SEQ ID NO: 12614 - RNA, 927 nt, unidentified
  source 1..927: mol_type = other RNA; note = synthetic construct
atggctggtgcggccagacgagctgattctgccagtgctctgcccctgccccttggagcacaagctcaaaggaggcccgccccggatagaaatagtcaaggcgccgcggctgcacacccagcaaataatcctgccccagacccaagaccaggagccgcagcatgtggacgccccagaattccagcacgcccggtcgaaagacacgctcggaggcttgcttgcagacctcccaaccgtaggccacatggcccggagggattctttccttcaattcagtacgcacgcatcgtggcattatttgagaaactcgggtatcctgataaggtcgccagccttctggcacggctgtgtgttaataggactcctaacggcgcatggcgcgacagaaaggtggcagaggccgttacctggtctgagagacaggccttgaaatccccccatctacctcaggggagtccctgttcacctgctctcgctaacttatgcgcgtaccgactggacatacggctgactgctctcgctcagtcgctgggggccagctactctcggtatgccgacgacctcgtgtttagcggagatcatgacttcgcccgcgctgccgaacgatttcacattcaggtcgccgccatagccctggaagagggcttcagggtcaacacaagaaaaactcgcctaatgcgtgagggtacccgacagcaggtgaccggcgtagtaatcaatcgacacccaaacatcgcccgcgacgaatatgacaagttgaaggccacactgacaaactgcgtgcgtcacggtcccgccagccagaatagggaagggcggaccgatttccgggcctacctcgctggccggatctcctatgttaacatggtgaacgctaatagggcaacgcggttgcagaggctggcggatgcgattgtgtggtcctga

SEQ ID NO: 12615 - RNA, 1380 nt, unidentified
  source 1..1380: mol_type = other RNA; note = synthetic construct
atggccattgagaagctgacgctattggcgctggcagatacattactggctaccgaggctcacctggcctcccagatagccgcttgcacccgggtctttgacgcaccacaaccctgggcccctcctgtttgtgccgctttactcgctcgcacgggagataacttccattatttctcacgctacgaaattgccgacctgctcaggcagcttctggcaagagcgcaagaggaacgagagggagccgccgctgaagacgcagacacagccgctgctgacagtgcacccctggtcacagaactgcccccagtgaggagatattgcattgatcctcctctcagacccccccaggcagattggttggttgctttgggactgcctcagctgcatagcgtgggggcactagccgcttggctagacgaacctgttggggctctgggttggctggcagaccagtggagacttccccataacgcgcctgcccggctccagcattaccactacaggtgggttccgaaacggtcaggcgggctgcgacttattgagataccaaaggcaagactccgccgtatccagcagcaaatcctgagacagctccttgacttgactcccccacatgccgctgctcacggtttccgtaggggtcgctcttcggtgactcacgctgccttacacgcaggccggcacactgtgatccgaatggatttgaaggattttttccccagcatccagtacgcaagaattgtggctctgtttgagaaactgggctaccccgagaaagtcgccgggcttttggctaggctgtgtgtgaatcgcacccctaacggcgcccttcatggacgccaggtagccgacgcagtcacttggtctgagaggcaggcgctcaagtccccacacctcccacagggtagcccgtgttctccggcccttgccaatctctgcgcctataggctggatatccggttggacgccctggcccagagtttaggggccgtgtactccaggtatgccgacgacctggtctttagtggggacagagatttcgctcgtgccgccgaccgtttccatattcaggtggctgccatcgctctggaagagggctttcgcgtaaatacacggaaaaccagactgatgagggagggcactcggcagcaggtgacaggagtggtgattaaccgacacccaaacatcgccagggatgaatatgaccagctcaaggccaccctaaccaattgcgtgaggcacggaccagcgagccaaaatcgcgatggccgcgcggattttcgggcatacctcgcgggcagaatctcctatgttcggatggtaaacgcacaacgggcagcccgactgcaacgactcgcagatgcgatagtctggagatga

SEQ ID NO: 12616 - RNA, 1434 nt, unidentified
  source 1..1434: mol_type = other RNA; note = synthetic construct
atgagtcgtgtcgctttccctcggaaaacagcccacgcgtctagagactccctcaaggccttgcgttcttttagcttgaggatgaccataaaaaaactcacagtgctggcactcgctgatacaatgcttgccagtgaacgtaatctggattcactcatcgccgcttgtggcagagtatttggggcaccaccaccatgggcttccgaagtctgcgcggcattgatcgagcgtaccggcgagaacttttactatttctctaggcacgagattgcggggatcctcttgcagctactgagccatgataacgctgatgacgacgatggcgacgatgaagcacccgagccgatggagcttccccctgtacggcgatactgtattgaccccccaattcgcccgccgagagatgcatggttggccgcactcgccctacctgagctgaggaccgtgggcgacttagctgcctggctcgacgagccagtgggagctctagagtggttcgccgaccaatggagactggccggcgataaggaaagcaggctgcagcattatcactacagatgggtgcccaagcgctcaggaggactgcggttgatcgaaattcctaaggaaaggctgcgctccatccaacagaaaatactgcgccagattctggatcctctgcccccacatccagctgcccacggttttcggagggggcattcctgcctgacccacgctacgctccatgctggacggcacgtcgttatccgaatggacctgaaggatttttttccctcagtgcagctgtccagaatccatgccttattcgagaagcttggctaccccgataaagtggccggagccctcgcacgagtttgtgtgaatagggctcctcacggcgttttccgggacacgcacgatggcgccagcgttacatgggccgaacgccaagccttgaagtccccccacttacctcagggttcaccctgcagccccgcacttgccaacctgtgcgcctacagactggacgtacggctggaggccttagcgcaggccatgggagctagttacagtaggtatgccgacgatctggctttctctggcgacagagacttcgcaagggcggctgagcgcttccacatccaagtcgcagcaatagccctggaagagggttttcgaatcaacactcgcaagaccaggctgatgcgggagggtactcgacagcaggtgacaggggtggtggtcaatgctcatcctaatattgcgcgagacgaatatgaccgccttaaggctactctgaccaattgtgtccggcatgggccagctactcagaacagagactctcaccctgatttccgcgcctaccttgcagggagaattagctatgttaaaatggtgaacgcgtcgcgggccgtgaaacttcagaggctactcgccaccgtcgcatgggcatga

SEQ ID NO: 12617 - RNA, 1341 nt, unidentified
  source 1..1341: mol_type = other RNA; note = synthetic construct
atgactattgctaaactaacagctctcgccctcgcggatacgatgctggcctccgacggtagcgtggaaaaactgatcgcggcttgtggccgcgtatttggggcaccacaaccctgggcgccgaaactttgtgccgccctgtccgaacgtactggcgacaactttcattacttctcacgccacgaaattgcagacatcctcctccacctcctgggccatgactataatgatgatgaggagcgccctgtaattgcactgccggcagtccgcagatactgcatcgacccacccatccgacccccacaggatgagtggtttgctgccttggctctgcccgagcttcccacggttggtgccctagccgcttggttagacgaaccggtcgacgccctggattggtttgcggacctgtggcgtgtggagtccggccaacagagtcggctccagcactaccggtataggtgggtaccaaagcgcagtggaggcctacgcctgattgagatccctaaggcccgattgcgccgcatacagcagaagatcttaaggcagctgcttgacaggctgcccccccatcctgctgcacatggattcagaagagggagatcatgtgttacccatgccgccctgcatgcaggcagacgaatcgtcattcgaatggatttaaaggacttcttccccagcattcaatactccagaatccacgcgcttttcgagaaacttgggtattctcctactgtggcaggtaccctggcaaggatatgcgttaatcgggccccttgtggcgtgttcagcgatccaatggaggggggatctctgccatgggcagaaaggcaggcgctcaaaagccaccatctgcctcaagggtcgccctgctctcctgctctggctaatctttgcgcttatcgactcgacatgagactccaggcactggcccagagtttgggcgcctcttattccaggtacgcagatgatttagccttcagtggtgaccaggatttcgcccggaccgcagaaaggttccacattcaggttgccgccatcgccctggaggaaggatttaggattcaccacagaaagacaaggctcatgagggaaggcactcggcagcaggtcacaggggtggtggtgaacacccacccaaatatagcccgggacgagtacgatcggctgaaggccaccctgaccaactgcgccagacacggacaagctacacagaatcgggactcacatccaaactttagagcatatttggctgggcgtataagctacgtgggaatggtgaacgctaaccgggccttgaagttgcgccgtctttttgatgctatcgcttggcctgcttga

SEQ ID NO: 12618 - RNA, 1371 nt, unidentified
  source 1..1371: mol_type = other RNA; note = synthetic construct
atgaatatcgaaaagctgactgtcctggcattggctgatacaatgctcgctagcgacagaagtctcggcagtctgatttccgcctgtggaagtgtgttcggaatgagccccctttgggcacctagcatctgcgccgccctgatcgaaaggaccggggagaacttttatcacttctcccgccatgagctggccgacatcttactccacctgctgggaaggggctccgacgacgtacatgacgatgaagatgaagacaatccagaagaatataccgaggtcgctgaaagacttgaacttccggaggttaggcggtactgtatcgagcctcccattcgacccccacagactgcatgggttgccgcactcgcactgcctcagctcccttcagtcggtgccctcgctgcctggctagatgagcctgtgggtgctctcgcctggttcgcggaccaatggaggctggcctctgatgcccaatctcggctgcaacactaccactacagatgggttcccaagagaaacggaggccagaggctgattgaaatccccaaagcacgcctccgcgtcctccagcagaagatacttcgccacctgttggatagactgccacctcatcccgctgcccatgggttcagaagaggacattcttgcgtgacccacgcagcgctgcatgctggtaggcctgtggtagtgcggatggacttgaaagatttctttccctccatacaattagcgcgaattcacgcactgtttgagaagctggattatccacccgccgtcgctggcacattggctcgtatctgcgtaaaccgggccccacagggggtgtttaaagaagctgggtcgctgccctgggctgagaggcaagtgttacgaagcccacacttgccccagggctccccatgttcaccggctcttgccaatctatgtgcataccgactggacatgcggctggaggccttagctcagagcctcggcgcgacatattcacgctacgccgatgacctcgccttttctggcgatcgggactttgcaagggccgcggagagattcaatattcaggtcgcggctattgcactagaggagggcttccgcataaatactcgtaagacacgtcttatgcgtgagggtacccgccagcgactaaccggagtggtggtgaacgcccatccgaacatcgccagagatgaatacgaccggttgaaggctacgctgactaactgcgtccggcatgggccagcaagccagaacagagacaggcaccctgatttccacgcacacctggccgggaggatttcacacgttaaaatggtgaatgccaatcgggctgttaaattgcagcgcctgcttgaggccatcgcctggacggtgtga

SEQ ID NO: 12619 - RNA, 1374 nt, unidentified
  source 1..1374: mol_type = other RNA; note = synthetic construct
atggatatcgacaaattggcggtcctggccctggctgatacaatgttggcctccgacggctcaatggccgccttagtagcagcctgccatcgcgtattcgcagctccacagccgtgggcgccaagaatatgtgctgcccttattgagcacactggcgagaactttcattacttttctaggcacgaactcgccgataggttgtggcagctattgggaagggccacctcggacgccgacgttgatgtggatgactttgtcgcgttagccgcgcccccctttatcgctcttcctccggtgaggagatattgtattgacttgccgcagcgaccacctgctccagggtggttggcagcactagcacttcccgagctggcaaccgttggggatctggcagcctggctaggtgagccagttgccgcgctcgattggttcgctgaccagtggcggctcgatggacctgcccaaacacccctgcagcactatcattacaggtgggtccccaaaagaagtggcggctggcggcttattgagattcctaaggaaagactgcgacggctccagcagcgtatccttaggcagctgctggatcgcgtgcctccacatcctgctgcccacggattcagacgaggccacagctgcctgacccacgctactctacatgcagggcagcgtgcagtgattcggatggatctcaaagacttcttcacaagcgtgcagcctgctcgcatacacgccctcttcgctaaactggggtaccccccaagtgttgctggtaccctggcccggctgtgtgtgaatcgcgctccacatggggtgctccgtgacaggcagggagacgtcgctctcccttggagcgagagacaggcactgaagactccccacctgccccaaggcgcaccttcatccccagccttagccaatctgtgcgcataccgcctggatctgagactcgctgcattggctcgcaccctgggagcctcttattctcgctacgccgacgacctggccttctccggtggagaagagtttgcgagagctgctgcgcgtcttcatatccaagtggccgcaatcgctctggaagagggctttcgggtcaacacccgcaagacacggctgatgcgggctggagcacggcaacaggtaacgggggttgtggtgaatgcccatcccaaccttgctagggacgaatatgatcgactcaaggccatgttaactaactgcgtcaggcacggtcctgccacgcagaatagggcaggtcatgccgactttcgggcccacctcgccggaaagatcagccacgtgagaatgttaaacccccagagagcaggccgactgcaagccgtgttcgatgcgatccgctgggacctgcactga

SEQ ID NO: 12620 - RNA, 1377 nt, unidentified
  source 1..1377: mol_type = other RNA; note = synthetic construct
atgatacctgctcccagtgtggcactcgctctggctgatacactgcttgccggtgaagccagcccagatggactggctgcttctgccgcaagcgccctaggtactgcctatgcctggggacccgccatgtgcggtttcattctgcagcgtaccggcgataagttccgctacttttcgaggcacgagctggcggcaataatcttggattccgatgcttttcatgccgcctttgagcccggaaaagaggccccccaaattaaaagatattgcttacagctccctgttaggcctgagccagacgcttggctgagcgctctgtccttgccagccatccccacgttaggggaactggcgctgctcctgaatgtcgagcttcaggatctgggctggttcgccgaccaatggagaagagggtcagctgaagcagcacccttgcagcattaccactaccgctgggtagcaaaacggagtgggggctggagactgattgaaatcccaaaacagcggctgcggcgtatgcagcagacaatccttagaaagattctggaggacgtccccgtgcatggagcagctcacgggttcagaagagggcactcatgtgtcacccacgctgcattgcatgccgggcaacgcgttgtgattagaatggacctgaaggatttcttcccttccatccaggcgtctcggatacatgcactcttttccaaattggggtattctgattcagtggcgggcaccctggccaggctatgtacttcacgcgcaccagctagtgccttcgcagacccgcacacaggaggaagccttccctgggcagctcgtcgagcgcttaggagcccacatctcccacagggctccccctgttctcctgccttagccaacctgtgtgcatggcgcctcgacctcaggctcgacgcattatgcggttccattggcgcaacctactcaaggtatgctgacgatctcgtttttagtggcggccgggagttcgagcgctctgttgaacggtttcatgtgcaggtggcggcaatcgccattgaggaagcctttggggtcaacacacggaagacgcgcgtgatgcgagcgggagtgaggcaacaggtcactggcgtagtaatcaaccagcaccctaatctgagacgagacgagttcgacaggctgaaagccgtgctcaccaattgcgctcggcacggaccggtggctcaaaaccgagaaggccgagagaactactggcactaccttgccgggaaggtggcctgggtcaagatgttgaatcctgccaggggagccaagctagaaaaggtgtttgccggcatcgactggcctgaagccggtagtggctctgttgctgccccggcttccgagagcagcagctga

SEQ ID NO: 12621 - RNA, 1479 nt, unidentified
  source 1..1479: mol_type = other RNA; note = synthetic construct
atgccactgcgcggatatcccgtggggacaattctcctatgcaactcgccccatgaaccaccatgtgccgccgctcacctgtcttcatcctttacccggttggtagagggatcccctcctccccagagctaccctagcatgattcccaaggacgcggtggcacttgcgctggcagatacgatgctggcaagggacgctactctagccggcctgatcgcaagcgctacttgggctttcgaccatccgtggccctggattccggccctttgcgaggagatccacgcacgcacagctgcacatttctactacttctccagagatgaactcgccaggataatatttgagctggatgtctttcacgcagcatgggatggcgaaggtccagcgccacagttgcagcggtactgcctcgacctgcctgtggttcctccagccccagactggttagccgctctggctctgcctgcattgccctctgtcggtgaactggccaggtggctcggactccgacccgatgagctgggctggtttgccggccaatggcgcaaagacccaatgcccgcagcccagcttgagcattatcattatcgctgggtgccgaaacggagtggcggagttcgattgatcgagatccccaagcctcgccttagagccatgcaggccatcatcctgagagagttactggatcgagtaccagctcatcccgcagcgcacggcttcaggaggggacattcttgtgtgacacatgctgccctccacactgggcaacgggtggttatccgcatggatctcaaagacttttttccctcaattcccgcaagtaggatccacgcgctgttcgctaaactgggttacagtcagacagtcgccggtgtcctggcccgtctttgcgttaatagggtgcctgctggcgtattgcgtgaaccggccggaggaaacgctctaacctggacccagcgacaagccttaagggccccccacctgcctcagggttcaccatgctctccggctctcgccaacgcttgtgcctggagactggacgtgcggttagagacattagcccagctcctcggggctagatacagcaggtatgccgatgatttggtgctgtccggcggtagagagcttgagagagcaatggaccgggtgcacgcacaggtgggagctattgccctagaagaagggttcgccattaacactagaaagacgcgagtaatgcgtgctggcgtgcgccagcaggttactggcattgtggtcaatcggcaccctaacatagcgagagacgagttcgacgtcctgaaggccaccctgaccaattgtgtgagacacggccctcaggggcaagaccgcgaaaatcgtcccgattttcgggcttggctcgccgggaaggtcgcgtatgtgaccatggttaatccacaacgaggggggaggcttcagcggctgttcgatgcaatcgcctggcctcacccacctttgtga

SEQ ID NO: 12622 - RNA, 1380 nt, unidentified
  source 1..1380: mol_type = other RNA; note = synthetic construct
atgattcccaaagatgccgtggcccaggcactggcggatactatgttggctcgggatgctactctggctggcctcattgccagcgcaacctgggcgttcggtcacccatggccatggatacccgacctgtgcgagcagatccactcacgcacggccgagcacttctaccatttcagcagacacgaacttgcccagatcatctttgaactggatgtattccatgacgcatgggatggggatggtcccgccccagagttggagagatactgtcttgacttaccgctagtgcccccgccccctgactggttagctgctctggccctgccagcccttccttctgtgggtggcttagctaggtggctgcgcctccgagtggacgacatagcttggttcgctgatcaatggcgcgttgacgctgccccagccgcacaaatggagcattatcactacaggtgggtacctaagcggagtggaggcgtccggctgatcgagatccccaagcagcggctgcgtgctatgcaggccacaatcctccgcgaattgctggacagggttccagctcatcccgccgcacacggatttaggagaggacactcgtgcgtcacacacgccgccctacacacagggcagagagtagtcattaggatggatctgaaggacttctttccatccattccagcatcccggatccatgcactgtttgcaaaactgggctattctcagagtgtcgccggggtcctggcacgactctgtgtgaatagagttcctgcaggcgtgctacgcgcacccgtggatgacaacgccctgacttggatgcaacgtcaggctctgcggacacctcaccttccccaagggagcccttgcagccctgcactggcgaacgcttgcgcctggaggctcgatgtacgacttgacaccttggcccagtcattgggggcgcggtactctaggtatgccgacgacctcgttttttccggaggaagagccctcgagcgagcgatggaccggtttcacgcccaagtgggggctattgcgattgaagagggcttcgccgtgaatgccaggaagaccagaatgatgagagcaggcgtgcgccaacaggtgactggaatcgtcgttaatcggcatccaaatatagctcgtgatgaattcgaccttctcaaagctacgctcaccaattgtgcacgccatggcccgcaggctcagaatagagatcaccatccggacttccgcgcgtacctagccggaaaagtcgcatacgtgaccatggtgaaccctcagcgaggtcagaggctgcagggcctgtttgaaaccattgcctggttgtccgccccagggcagcctgataacaactcaggcaagcagtataactttccctga

SEQ ID NO: 12623 - RNA, 1317 nt, unidentified
  source 1..1317: mol_type = other RNA; note = synthetic construct
atgataccggcccacagcgtagcacttgccttggccgataccatgttggcgggcgctgctggcgttgctgctctcatcggaagcgcggccagagcttttgaggtcgagcataaatgggtgccgcccctgtgtgaagccattcacgtgaggacaggggaacactttcactccttctctcgcatggagctggcagccattatcttggacgacgagcacttcctaggcgcgtgggaaaacgggaaagcacccccacagatacgtcggtattgcatctctcttcctgtagtgccagaacagccagcatggttagtggccctggctttgccggccatccccactgttggcgaccttgcacgttggctcaccgtccgcccagatgaactcggctggttcgctgaccagttccgcctcacacacgatgccaccagccggctacagcactaccattatcggtggctcccaaagcgctcaggaggatggcgactaatcgaaatccccaaacagaggctcagggctatgcagcaaaagatcctgcgagaaatcttggatttagtgcctgcccatagcgcagcccacgggtttcggaggggtcattcatgcgtgacccatgccgcactccacgtcaaccaaagagtggtgattcgcatggatctgaaggacttctttccctctatccctgcctcgagggttcatgcaatgttcgtcaagctcgggtattcccagtctgtcgcaggcgccctggctagactgtgtgttaatagaacacctgcgggtgccgctgcagctgttgacatttcctgggcagagaggcaagccctgcggagtccacatctgcctcagggcagtccttgttcccctgcactggcaaacgcgtgcgcttttcgactggatatacgcctgcaagccttggccgccagcatgggagccgtgtactccaggtacgctgatgatctggtgttctcaggagacgcccagttagcgcgggctcttgacaggttccacgtcagagttgcagctattgcactgggagagggttttcgggtgaacactcgcaagactcggatgatgggagccggtgtgcgacagcaggtgacaggcatagtagtgaactgcagacccaatattgccagagacgagtacgacgctctgaaagccacccttacgaactgcgtcagacatgggcccgccagtcagaataggatcgggcacgataattttcgtgcatatctggagggccgggtagcgcatgtgcacatggtcaatccagcccgagctgagagactccgcaatctgtgtgccgctattgtgtggccctga

SEQ ID NO: 12624 - RNA, 1326 nt, unidentified
  source 1..1326: mol_type = other RNA; note = synthetic construct
atgaaccccaagacttttgtggccctggccctggctgatactttcttggccagagaggcttctctggatgcaatgctgcagggggccaggtgggcgttaggcaaaaagtggcgctggattccgagcctgtgccgagccattcataagcaaaccggcgaacaactgcactcccatggaaggacagaactggcggcgctcattctcgcccatgaagggtttgccgacgcttggttggacagcgagccccctcaggtacggcatttctgtctcgacccacctgtagccgctgaaccaccagcctggttaagtgcgttggctctccctgttttggctacagccgctgacctggcccagtggctgaaagtgacaccgtcggaactcgattggtttgctgaccagtggagaaactctcaggcaactaccaccgcactgcagcactatcaccatcggtggatcgccaagcgatcagggggattaagactaattgagatccctaagccacatctcagaaccatgcagacgcaagttttgcgcggacttctggacagaatccccttgcaccaggcagcccacggctttaggaggggccacagctgtgtgacccacgcagctctgcacgcgggtaaacgcgttgttatccggatggatctgaaggacttctttcctagtattcccgcagccagagtccacgcactcttcataaagttgggctacccgcccaaagtggctggcctgctctcaaggctttgcacataccggacccctggcaacgtccttaatcagcctgggcaaaaaatcccctggcaggagcgtcaggccctacgtactcggcacctaccccagggatccccttgttctccagcactggctaacctgtgcgcctataggttagacatgcggctgcaggcgcttgcaaccgctcttgatgccagatactcccgctacgcagatgacctcgtgtttagcggggaatcaggactggaaagagcaatggatcgattccacgtccaggtagctgcaattgcactggaggagggctttgccgtgaatgctcgaaagactcgcatgatgcgatccggtgtgaggcaacaagtcacgggtatcgtggtcaatcgccatccaaacataccacggcaggagttcgataaacttaaagctgccctgacaaattgcatacgccatgggcccgcctctcaaaatagagagggccgggacaactatcgtcagttcctcgccggacgcgtgtcctatgcccagatggtgaatccccagaggggtaagcggcttcacaggctgttcgagcagatcagttggccagggagctga

SEQ ID NO: 12625 - RNA, 1338 nt, unidentified
  source 1..1338: mol_type = other RNA; note = synthetic construct
atgactcctcagaccttcgtggctctggccctggccgatacatttctcgccagggaggcgagcgtggaagcaatgcaacaaggcgccagaagggcactcggcaaaaaatggcgctggatacctagcctctgcagagctgtctacaagcagtttggagatcgcttgcatcgccatgggaggacagagttagcggccctgatattggctcaccagggctttgcagacgcctggttagactccgaacccccacagatccggcacttttgcctcgacctgccactgcccgcaggcaaacctgcttgggtcagtgccctgccccttcctgctctggcgacaaccgccgaccttgcccagtggctgaaagctggtcctagcgagctggattggtttgcagacaagtggagaacttctcctcctcccgctgccgccttacagcattatcatcatagatggattgcgaagcggtcagggggacttcggcttctcgaaattccaaaaccacgcctccgaaccatgcaagggcagatcctgagaggtctgttggatctgcttccgctgcaccctgctgctcaggggtttaggcgcggccactcttgtgttactcatgcagccaggcacgcaggtaagcgagtggtcatcagaatggacctgaagaacttcttcacatctatcccagccgccaggatccacgcattgttcaccggacttggctacccttcccgtgtggctggtattctttcgcgcctgtgtacccacagaacgccaggctccgtgttgaatcatcaagacccagcttcagcaggggcactgtcttggcaggagaggcaggtgttccgccagcgacatctgccgcaaggatcaccctgcagccccgcactagcgaacctctgtgcctatcgtttggacctaagattgcaagccctcgctgccagtttaaacgccgggtactcacgttacgccgacgatctggctttctccggagacggagaactagagcgggccatggatcggttccacgtccaggtggccgccatagctctcgaagaggggttcagcgtgaatacgcggaaaaccagaatgatgcggagtggcgcccgacagcaggtaacaggtatcgttgtcaatcggcacccaaacattccccgccaggagtttgataatctgaaggcggcactgactaattgcattaggcacgggcccgcttcccagaacagagatggaagggataatcaccggcagttcctcgcaggacgtatcgcttatgtaaggatggttaacccccagcgaggcaagcgcctgcaacagctatttgacaagattgcctggccgaagggctga

SEQ ID NO: 12626 - RNA, 1344 nt, unidentified
  source 1..1344: mol_type = other RNA; note = synthetic construct
atgactccgaagacgttcgttgcccttgcgctggccgacaccttcctggcacacgacgcctccacaaatgccttgatcgccggcgcaaggagagcattgggaaagaagtggcgatggatcccaagcctctttcggaccatcttgaaacagcacggagaacaactgcattgtttgggacgctcagaactcgctgccttaattctagcccatgacggcttctcagacgcttggcaggagtcttctcctccccagatacggcactactgtctggacgcacctttggctgtcgaacagccgggttggcttgcggcccttggattgcctagactggcctcagtagccgagctggctcagtggttacaggtcgcacctctcgagctggattggttcgccgataagtggcgaaataacatgccagccccatcagctctgcagcattatcattataggtggttacagaaacgttccgggggcctgaggttactcgaaattcccaaactgagactgcgcgcgatgcagtcccaaatccttcggcatttgctggacctggtgcctccacatccagccgcacatggctttcgcagggcccacagttgtgctacacacgcagcacttcatgccggcaagcgggtggtgatgagaatggacctgtccaattttttccccagcatacccgccgctcgcattcacgggctcttcgttaagcttgggtaccccgctaacgttgctggggtattctctcggctgtgcacacataggaccccagcaagcgtcctggctaaccccgataaaggcctaagatccgctcacgtgatgtcttggcaggaaaggttagcactccgcacaagacacctgcctcaaggatccccttgcagtcctgctctcgcgaacctgtgcgcatatcgtttggatatgagactgcaggccctggccgtgagtctgaacgcctcgtactcgcgatatgctgatgatctagtgtttagcggtgaccaggaactcgagcgagccatgcaccgctttcacgtgcaggtagccgcaattgccctcgaggaggggttcagcgtcaatactcgaaaaactcgtatgatgcggagcgctgtgcggcaacagatcaccggaatagttgtgaatagtcacccaaacatcgctagacccgattttgataatctcaaagctgccctcaccaattgcattcgccacggcccggccagccaaaatagggaggggagggacaactacagacagttccttgcgggcaaggtggcatacctacacatggtgaacccccagcggggtaagaggctgcagcagctgtttgagcaaatcgtctggtctgcggactga

SEQ ID NO: 12627 - RNA, 1323 nt, unidentified
  source 1..1323: mol_type = other RNA; note = synthetic construct
atgacctcaaaaacactcgtggccctggctctggccgatactttcctgtccagagaagccggtctagcgtcaatggttcacagtgcagcctgggcgcttgggaagaagtggaagtggattccctccctttgtcgtgccatcgtggagcaggctggcgagcatttttatgattactcacgagacgaactggctgcattgatcctggcacatgctggattctccgatgcatggcaggacaacgcccctcccaggatcaaacattattgcctcgacctccctatcgctcccgagaaaccagcctggctgtcttctctggcactgcccgagctggctactatagcggatcttacacaatggttaaagctgtctgccgctgaattagactggtttgccgataagtggagggagcaatcaccaaccgcaagagcactgcagcactatcgatataggtggctggtaaaaaagtccggaggactgcggctgattgagatccccaaacagcgcctgagatcaatccagacccacatcttaagaaagctcctggatctagtgccgccacacagcgccgcacatggtttcagaagggctcacagctgcgtcactcacgctagcctacacgctggcaagcgggtagtggtccgcatggacctcaaaaattttttcacgagtatctcgtacgctagaatacatgctatgttcgggaagcttggctacagctctagtgttgccgccgcgttggctcggctttgtacacataggaccccgctaggcgtctttagcgagcgggagattacaaaaacaattccttggcaggaacgtcacgccttgaggacccctcatctcccccagggatccccttcttctccagcacttgccaacttgtgtgctcaccgactcgatatcaggctggacgccctggccaatagtctcaacgcccgctacagccgctacgccgacgatctgaccttctccggagaatacgaactcgaacaggctatggaacggttttccattcaggtggcagcaattgcccttgaagagggtttcagtgtgaatacccggaagactagattgatgagagccggcgtccgccaacaagtgacgggcttgttagtgaatcggcatccaaatacacctcgcgaagagtttgacatcttgaaagccactctcaccaactgcattcgacacgacccagccagccagaatcgagaggggcgtgagaactacaggcagtatctggcggggaggatagcgttcgtgcacatggtcaacgcaaaacgcggggttcggctgaagcagctctttgagaagataaagtggtga

SEQ ID NO: 12628 - RNA, 1341 nt, unidentified
  source 1..1341: mol_type = other RNA; note = synthetic construct
atggacattcccaagcaggtcgctctggcgatcgctgacgctttgctggctggcgagtgtagccacattgcacttatgaagaatatgtcttgggtgctggggaaaaagtggccttggataccttccctctgccccaagatctaccttcatgccggaccgcatttctaccactacagcagacatgaaattgcagccatcatcctggatgaccacggctactacgacgcttggcgcggtaaagacaagccgcagattaaacagtattgcctgttaccagccatagccccagagaagccagcttggctgcaagctctggctttacccgagttcaataactcggccgatctggcacggcatctgaacctcacagttaatgagcttgcttggttcgctgatcagtggaggcaagatgcccaggccgcccctcagttaagacactatcactacagatggctggaaaaagccacaggcggctggcggctcctggagattcctaagtcaagactgcgcaatatccagcggaagattctccagcgaatcctgaatcaagttcctccccatgccgctgcccaggcctttcagcagggacgaagttcaatcagccatgccgcacagcacaccgggaagctggtggtagtgaggctcgatttgaaggactttttcacatctatacccggtagtaggcttcacgcgctatttgcgaaactcgggtatcccgaaaaagtagccggtaccttggcaaggctgtgttccaatcgtactcctaccgtgattgctaaggagaaaacccgatacctagcccctctctcaagcgcacacttgctgaggagtccacacctgccgcagggagctcctacatccccagcattggccaacctgtgcgcttatcggctagatatgcgcctccaggcattggccgactctatgcaggcctcttattcccgctatgcagatgatcttactttctccggcgacgagcagtttgaccaatcactgagaagggttatcccacaggtggcagccatcgtcctcgaggaagggttcgtccttaactacaagaaaactcgcatcatgcgagctagcacacggcaacaggtgacgggaatagtggtgaacagacattgtaacatcaaaagggccgactatgacacgcttaaagcgatactgaccaactgcctccgtagtaatcccgcctctcaaaaccgtgaaggacacgctaattttcgggcgcatctggccggcaagctagcctacatgcgcatgatcaaccccgcaagaactgcaaagttacaggcgttgtttgaacaaattaaatggccagatagcgcagtcatgatttga

SEQ ID NO: 12629 - RNA, 1341 nt, unidentified
  source 1..1341: mol_type = other RNA; note = synthetic construct
atggataaaccggagcaggtcgcacttgctctggcggacgcgttgttggctggaccatgcgacccggtcattatgatgaagaatatgagatgggtgatgggaagaaaatggccttggatccccgcactctgtaaaaagattcacagacataccggggaccacttttaccattactctcgacatgaggtggccgatatgatcctcgcagacaacggcttcgataacgcttggtttcggagtgaaagcccacctgtgattcgccattattgcttactgccgccagtagcccccgatagacctgtgtggttagaaatgctcaatctgcccagtctcgccaatagcgatgaattggctaactacctaaacctgccacacggtgagctggcctggttcgcggatcagtggagggattcggccccagaatccactgggttgaggcactatcggtacaggtggctggacaaacctaccgggggcgttaggctgctagaaatgcccaagcagagacttcgtaacatccagcgaaagatcctccgacagatcttggacagagtgccccctcacgcagctgcacaggcctttcggaaacggcattcttgtctctcccacgccagcttgcatacggggaaacaagtagttctgcggctggatctcaaggacttcttttcctctatccctggatcacgcattcattccctctttgctaagcttgggtaccctcagagcgtcgccgcaatcctggctcgcctttgcacccaccgaactcctaacacagtcctggacgagattatggcacggcagggagctccctggcaagtacgccacatgctcaggtctagacacttaccccaaggcgctccaacatccccagcccttgccaatctgtgtgccttccggcttgatatgcggctgcataccctggctgccagtatgcaggcaacatattcacgttatgctgacgacctgacattctcaggtgacgaagagctagcaagggccctccagcggttcataatccaggcgggcgccattgcgatagaggagggattctcactgaatcacaaaaagactagaatcatgcgcgctaccggtcgccaacaggtgactggcatcgtgattaaccgccactgtaatataaggcgtagcgaatttgacaggatgaaagccatattaactaattgcgtgcgcaatggcccagccacgcaaaacagagatcatcacgccgatttccgagttcacctggcaggcaagctggcacacctgcatatgatcaacgccgccagggccaccaagctgcagacaatttttgagcagattaactggcccgctaagcccgagtga

SEQ ID NO: 12630 - RNA, 1359 nt, unidentified
  source 1..1359: mol_type = other RNA; note = synthetic construct
atggacgccaaggacttcgtagcactggcactagctgacgcttggttggctgagccagctgggcaggacttcacaggaagggctaccgtgttgttcggccaacctcacccctggattccacgcctagctcgtcggattaaaaggcagttcggcaccaccgagcattatgatcggaggacagcgctggcacaatttatacgggctgacgatggttataccactgcttggtcctcctacgctaaaccgcgactgagacaatacgtctttgccacacctcagatgcgcctccagagcgcatggctgagcacagccaagctgccacccctggcgacatgtggagcactggcagagtggttgggtcttacaacagaggagcttgcatggtttgccgatacccgagggatgaaccgaactgctacgggaaagctgaaccactaccaataccagtggagaaaaaagagatctggacagtaccggctgatcgaaagcccaaaagaacgcctgcgggccattcagaggaagatcttgactggcatcctcaatcaggttcccccccacgatgccgcacatggcttccgacgccagcgatcttgtctctcttttgtggccccacatatcggaaaagactgcgtgttgaggatggacctgtgtaattttttcggcaccattaccgccgcccggattcacgccctctttagagcactgggctatcccatggctcccgcccgtctcttaacgggcctctgcacccacagtcttcctcagcagttcatcgatcaattacataccgccggcatcgaattatcctgggcggaaagacgtgcgtaccaggcacctcaccttcctcaaggagcccctacttcaccggctctggccaacttgtgcgcctatggattagatgtgaggctaagtgcccttgttgcgaaacatggtgcagattacacgcgctatgcagatgatatagccttctcagggggtggggcctttaaaagccaggcggccgacatctccacattcgtggccgtagtggcccaggaggaagggttcgccgttaactttagaaagacgagaaggatgcccacttctcagcgccaacagctgaccgggataattctgaacaagaagcctaatgtcaggcggaccgactatgatgccctcaaggctattctccataactgccaacagggggaccccgctagtcagaataggagccggcacccagactttcgcgctcacctgctgggcaagatcaattatgtcaaacagatcaacccgcagagaggcacaaagctcctgactctttactcggaaataacttggcctgagaatccctcacagactgcaccagagcagccatga

SEQ ID NO: 12631 - RNA, 1347 nt, unidentified
  source 1..1347: mol_type = other RNA; note = synthetic construct
atgactcccagagatcaggtggccgagggacttgccgatgccctactcgcaggtccctcttccgtggatgatcttgccgcacgggctgctgaggcacttgggagaaaacacaggtggatcagaccattcgcccgtcgcgtcttcaaacggtttggagcagcccttgctcatgcccagcgaggcgagctgatcggattcattcagacggaccctggctactgcaaagcctggaaagcggctgggaagctccgcatccggagatacttctttggggtacctagcatgggcccacgtccaggggcattggctaggtgtgtgctgccagaactgcctacttcagctgatctggccgcctggctcggaatcaccatacccgagttagaatggtacgccgacttgaggggcatgattggtagctcggacggcgccctctgtcattaccattataagtggattccaaaacgccacggtgactacagactgatagagagccctaaaccgaggttaagcgccatccagactcgcatcttgagagagatacttgaccttattcccacccacgaggctgcccacggctttcgaagaggccggtcttgtttaacctatgtcgcccctcacgtgggaaagctggtagtgttgaggatggaccttcacaacttctttggtagtatccccttcgctagaatcaatgcgctctttaagactctgggataccccgaagagacagcgaagtatttagctggtctgtgcacgaaccggctgcctgcacgagttgcgctgaagatcccaggagctgatccggggttcgtcctgccctggcctgaatgcaagaagctcaatgagaggcatttgccacaaggcgccccgacctcccctgctttggctaatctgtgtgctctgcatctggacttccgcctcgccgccctagcttcaaaagtcaatgccgactacacacgatatgcagacgatctggcattcagtggcaacgaaggggtgcggagaaaaattggggacctatctacaaccatagccgcgattgctctggcggaagggttcgaggtcaactttcgcaagacaagggccatgcataagtccgatcggcagattctgaccgggatcgtggtgaacgaacgtgttaatatgcagcggaacgagtatgaccgtctcaaagcaacactctataattgcctgcggtttgatcccgattcccaaaatagggaaggccacagggactttcaggcacacctgctgggacgcgtgaaccacttgaagaatctcaaccagaggcgaggcgcaaagctgcaggccttgctcgaacgcgttgagtggcaagcaggcgctggatga

SEQ ID NO: 12632 - RNA, 1338 nt, unidentified
  source 1..1338: mol_type = other RNA; note = synthetic construct
atgacctccaaatcacgcaaacacttcgtcgcctgcggcttggcagatgcactcttagctgggccacccgggatcactgaatttgaggccagggccaagcaggctctggggagaaagcctaggtgggttctgcccctgtgtaagagaatttttgcgcggttcggatctgggttgggcacacaacagcgggcgaaactgattgaattcatagagacagaccagggctatctcgatgcctggctagctgatacaaagcccagaatccgccattattttctggctactaacagcatggcaccaagagtgggagcgctggccctgtgtcccctaccaaacatcccgacatcagtggatttggccgcctggcttgatatcagtatagaggacctcgagtggttcgccgatgtgcgccacatggtgaaagcccccggccctctgtgtcactatcatttccgatggctgcctaagaggtccggtggttggcgtctggtcgagatacccaaacagcgccttcgggacctgcaaaggaaaattctccgcgaggtcctggacccagtcatgccacacgatgcagctcatggctttcggcgcggccgttcctgtttgaccaatgcagctcctcattgcggaaaggacgtggtgcttcgaatggaccttctgaactttttcacgagcatccccgcctctaggattcacgcactcttcacaacgctgggataccctgaccctgtagccaagcgcctcaccgggttatgcacttgcgaggtcactacccgcatgcttccagcacttccggccggagcagaacccttaccatgggcaatgaggaagcggtacgctgagcgacatctgcctcagggcgctcctacaagccctgcgctggctaacctctgtgccttgcacctcgactttcgtttggcagggctggctgagtcgttaggtggagcatacacccggtacgccgatgatctggccatcagtggcggtgaaccgctgaggagaagggttggggccatcaccagtctcctcagcgctattgccagagagcagaagtttgacattaaccacagaaaaactcgggtgatgcacaggtcagacaggcagcggttgaccggggtggtggtgaatgaaaagccaaatgtctctagagctgagtttgaccaactaaaagccgtgctgcataactgcgtagtacacggtccccagtctcagaataggatgggacatcccaatttccgtgaacacttgagaggccgggtttcctatgttgccggccttaatggcgctagaggagaacgcctgcgactcgcgttcgaggaaatcgattgggcccgatga

SEQ ID NO: 12633 - RNA, 1332 nt, unidentified
  source 1..1332: mol_type = other RNA; note = synthetic construct
atgggaaatgggctgagtagccttgcaacaaacctgcggcttctcgccctgagcgtcctagctggagcctgggataaaccagggctcatcgagcggttggagcaggctcttgagtacagcccaactgacgccgcacaactggcctcccgattattgttccactacgaggctggccagccgccgagtagacagagactgatggcctttctcgctaacgaggtcagtctgcagcagcggtttgcatcgcccgacgccaagcctcccagattagttctcgaccccccccggatgggtagacctccagaaagactcataacactgccactgccacctctggagacacgtaaggacctggccgagtggcttggactctttgaccacgagttggcctggtttgcggatctcgaacggcgccaatgtaaagtgaaggagtccaaacttcatcattaccgttaccagtggatcgaaaagcggtcagggaaactgaggctgattgaaatccccaagcctaggataaaagcgatccagcgaaggatcctgagggagattctcaaccgcgtaccaccgcatcccgctgctcatggcttctgcaggggcaggtcctgccgctctttcgttgcttctcacctcggcaagccagtgctgttgaggatggacctgaaggactttttccatagcgtgccaatcgctcgtattggggccctgttccggagggtgggataccctgcccatgtggcctggttgcttcagggattgaccactcactcaacctcccccgctctggctggcgaagctttcgaacgcctgccatggcagcgacgcaagcacctgattgacaaacacctacctcaaggcgcaccctccttcccggcattagccaatttgtgcgcatggcgtttcgattgtagactccaaggagtggccgagcgcttcgggctagactatacgagatatgcagacgatcttgcgtttagcggcgataggaatctcctgcgcctagccccttttctgaagggtcttattggcgccattgccattgaagaaggcttcgagatcaatcacaggaagactagattgaggacccaggcacagtctcaacgcctggcaggaatggttataaaccagcagcccaatctccctcgcgaggagtttgatcgactcaaggcaatcctgtataactgtacccgatggggtcccgaatcacagaaccgggaaggggtagaggattttcgggcgcacctggaaggtcgagtcgcctacgcgttatggctgaatcctgagaaagggcggagactgaaagatttatggagatatatccagtggtctgaatga

SEQ ID NO: 12634 - RNA, 1044 nt, unidentified
  source 1..1044: mol_type = other RNA; note = synthetic construct
atgggcagaccgcctgataagctcctgaccttccccctaccaagcttgagtacagtcaaggacctccagcagtggcttgggctgtttgatcacgagcttgcatggtttgccgacagggaaaggcggcagtgcaaagtcaccgaatcgagactgcaccactaccgctatcagtggattgagaaacgaagtggcccacctcgccttatcgaaattccaaagactcgcctcaagatgttgcagcgtcaaatactgagggagatcctgaatcgcgtaccaccgcacccttgcgcaaagggttttgtgcgcgggcgatctattaaacatttcgtcgagccccatctcggtaaggaagtggtgcttagaatggacctgaaggacttcttccatactgttcccgtgtatcggattggcgcaatgtttcataggttagggtatccctggtctgtggcctatctgctccagggcctgtgtacacacacgtcctcagcattgttggccggagacacattcaatgcgttaccctgggctatgcagaagaggctgagggacaaacaccttcctcaaggagcgccaacctcccccacactggccaacctggctgcttttcgcttcgattgtagactgcagggagttgctaaccgattctccttggactacacgcggtacgccgacgatttagcctttagcggggctagggaattgctcagactcgcgccatttctacagggcctgatcggagccatcaccatcgaggagggattcgagatcaaccacagaaaaactcgggtacagacccaagcccagagccagcgactaggcggcatggtgattaaccaacgtcccaaccttccgagagaagagttcgatcggctgaaagcaatcctgcacaattgcgtgcgttgggggcctgagtcacagaatcgcgagggagttgatgactttaaggcccatctcggtgggagggtggcttacgccgtctggctgaatcctgaaaagggcaaaagactgcggcaactctggaaacggatacagtggctggattga

SEQ ID NO: 12635 - RNA, 1302 nt, unidentified
  source 1..1302: mol_type = other RNA; note = synthetic construct
atgagaaggctgatgctgagcatccagttcggtcgatgggatcgggagagtctgggggatcggttacgtcgcgcactggacggcggacctcctgatcctgacaggctagccgcgcgccttcttttccagttcccgcccggtcatccaccttcgcggtcacaactcgccggtttgctggccgctgacagagaactggcagctgccagccaatccggaggcaagggcttcgaggcccggattgtgttagacacgtctgtgatgcaggcccccaccgggcacttctcaacccttcccctgcccacactcgatcatgcacgggacttaggcttgtggctcgggctgaaccagcgcgagcttgcttggttcgccgactgcgaatcccggcagaccagcgtgcgcaatcctaaactgcatcactaccgatatagatggctcgcaagacggagcgcaccacccagactcctggagattcccaaggccaggctgaagctgatgcagaggcaggtgcttcaccatctgctcgattgtgtacccccccatccggctgcccacggatttcgtcgacacaggtcttgtctgtcttttgctacaccccatctgcagaagcctgccgttcttcatatggaccttgaggactttttccccagcataccagccccaagagtcggggctttgtttaggcggttgggctatccgccaggggttgcacgcgtgttacaagggttgtgtactcacgccgtggccccagctttggtaggcgcagagttcgacgccctcccttgggagacaagaagacgcctccaagcaccccacctggctcaaggcgctccatcatctccagccatcgctaatctgtgcgcgtggaggctggattgccgactgcagggactggccgatcgcttcgaactcgattacaccaggtatgcagacgacttggctttttccggtcctgctagtctgctgcgcaggggtccatttgtccaggctctaataggcgcgattgcggccgaggaaggatttcgcatcaatcatcggaaaactaggctcaacactcaggcgcagagtcagcggctagctggggttgtggtcaaccagaggccgaacctccaaaggagagactacgatcgacttaaggcgacactacacaattgcgcccggttcgggcctgaaggccagaatcacgaaggacgacaggattttcgtgcccacttagccggacgcatcgcacacgtcgcatggctcaaccctgacagaggcgcacgtctgaaagccctgtgggccagaatctcctggccagattga

SEQ ID NO: 12636 - RNA, 1356 nt, unidentified
  source 1..1356: mol_type = other RNA; note = synthetic construct
atgcctacgcaccgcactaaaatcaggcgactcacgcaggccttatccacggggttgtggcagaaagacacaatcgccgatagagccagtagggcgcttcatggggggccacctgatcccaggagattaaccgcgcggctgctgttgcagttcggagatgctcagcatccacctcccgctgaactggaagcatttttaagacacgaccacgaggtggcctccgcattgcgctcgattacagacaataacacccccgccctgttgcttgaccccagcactatgcaaccgcagcggcataggattagtttacctctgcccgtccttgataccgtgcgagacttgcaacagtggctgggtgtgtcagcaggagagctggcgtggttcgctgattgcgacggacgccaggctaaatctactacccagcggctccaccactaccgctacagatgggcagaaaagcgccggggaggttggaggctgatcgagcagccaaagagcaggctgaaggccattcagcgacaggtgctccgcgaaatccttgaccgagttccaccccacccagccgctcatggcttcagaaggggacgcagctgcctgtcttttgttgcaccccactgtggccgtccactgctgctcagattagacctgagggattacttcacacgggtgccggtggcccgaattggtgcaacatttcggcgtctgggctacccagctgccgtagctcatactttgcaggggctgtgcacccacgccatgagtgcgtcactagcagacccacccgcaggggctgttgactggcaacaacggcagtacctccgatcaaaacaccttcctcaaggagctcccacatcacccgccctagcgaatctatgttcttggcatctcgacgccaggctaagtggcttggctcatcggtacggcctggcctatacccgttatgcagacgacctggctttctctggcaccgatgcgctgagacacgacgcaccgtttctccgggatctgatcgctgccattgcactcgaggagggctttcggatcaaccaccgtaagaccagactggtaactgccgcccagagacagcgcctgacaggcatagtcatcaatgcccaccctaatcctcctcgctccgaattcgacaggctccgggctaccctgtttaactgtgtgaggtacggacctcagagccaaaacagagacgctagaaccgatttcgccgcctatctggcagggaagcttgcctatgtcactcaacttaatccaaacaaggccgtcagactccatcgcctctggaggcagatagattggcaggagtatgatggtacttccacaatgcatgatgatggcagctga

SEQ ID NO: 12637 - RNA, 1149 nt, unidentified
  source 1..1149: mol_type = other RNA; note = synthetic construct
atggaggccatgctggccggtgatgctgaggtccgagctgccctggatcgatccgatgatcctgacttgcctgcgattctgctggatcccccagttatgcatccccccgcggaccgacgcatttctttaccgcttcccagaatcgagacttggagggatctcaggcagtggctgggcgtcttcgacggcgaactggcctggttcgcagacagagaaggacggcaagcagatgtcgtggagccacgtctgcaccactaccggtacagatggcttgccaaacctgccggagggtggcgtctaatcgagcagccgaagacccggttaaaggctatacagaggcagatcctcaggggagtcctggatcgtgttccccctcatcccgctgctcacggctttaggagagggcacagttgccgatctcacgccgcagtgcatacaggtcgcgccgttgtactccggatggatctgcagcacttttttacctcagtgcccgtggcacgcattggggccatgttccgacggctgggatatccggcaggagtggcacacctgctccagagcttgtgcactcactgtctgtcccctcctttagccgcagctcccgatggagccctcaactgggaacaacggcagagactgcgggccaaacatctcccacaaggtgctccaaccagcccagccctggctaatctttgtgcttggcgtctagactgcagactagacgggcttgccaggagattcgggcttgattatagtagatacgcggacgatctcgcgttttcagggccacatggcctggtggccaacgtggactttattgaaggcatggtgggcgcaatagctttggaagaggggttccgcgtcaatcataggaaaacacacctcgccaccaggtcccagtgtcaaaggctgacaggcatcgtagtgaatgccagacctaacctcgaccggcgggcttttgacaggctgcgagcaacgttgcataactgcgcacggtacggtcctgccggccagaacagagacggcgttgctgacttccgcgcacacttggctggccgcctagcatatgcccgctggctgaatcccgacaaggcgagacgccttgagcgcttgtggaggcagatcgactggccaagcgatggagactga

SEQ ID NO: 12638 - RNA, 1308 nt, unidentified
  source 1..1308: mol_type = other RNA; note = synthetic construct
atgcccagaaagttcaaacaggcggagtggctggctagctcggtgtgcacaggtgcctgggagcgtgctgcagtggctgagagattggcccgggctttaccagccgacggtcctgatccggtcgcacttgctgccagtattaggaaccgcttctatgaggacggccctccaaacctgaaagccctcaccctatttctgatcgaccaccctcttcttcagcccgtgttccagaagggggggattcggggactgttgctggacccacctgttatgggacggcggcaggataacctggcccctcttcaactgccagaactaccaaccttaagggacgttggtctttggctttgcctgtccgatgcagaaatatcttggttcgcggatactaggctgcgccagggtcgcgttacggaggaaaagctccatcattacagatatctctggatccccaaacgttctggagggatacggctgatcgaaacgcccaaagtcaggctcaaggagatccagcgcatgatagtatcacggattctgagacacgttccacctcatgattcagcccacggctttactcgcggcagaagcattaaaactttcgcagcgcctcatctcaggcagcaggtggtactccggctggacctcaaggacttcttccactccgtgcccgtagcaaggatcgccgcactgttccgtagattaggctatccacccaatgccgcgagagtgctgcaggggttttgcaccaacagtgtgtctcccagcctggccggcaagccttttactcggctgagctggcacgataggaaacgattgcaaggccgtcatctaccgcagggagctcccacaagtgcacaattggcaaacctgtgtgcttgggggttggactgccgactgaaggggttggccgatcactacggctaccagtatacaaggtacgccgacgacctcgcctttagcggtccatcctctcttgcaggaagagctcgatttatcgaggcccttaccggggctattgcacaggaagaaggcttttcactcaatcacagaaaaaccaggttacgcctggctagtcaacgacagcgactcgcgggggtggtggtcaatgagcgcgtgaattgttcccgcgccgactgggatcggctaaaggctaccctgcataattgtgtgaagcatggcccggagtcccaaaaccacgataagcaccccgatttcaaagctcacctgaagggcagggtcacacatgccgcctggctgaaccctagcagaggaggaaaattgcagttcctctttaatcagatcgtctggtga

SEQ ID NO: 12639 - RNA, 1266 nt, unidentified
  source 1..1266: mol_type = other RNA; note = synthetic construct
atgcatgccggagcatgggatagggctgctctggctgagagactagctaaagtgttgcctgccggagcccctgatcctgcacgactcgctgctcgtatttacaggcggtttggggagggtccaccaccaagcgtgacagcgctggcggctttcatgcgggaggaaaagttactggagcctctcttcgaaggaaaagggatccgcggcccatcactggagccttatgcaatgggccgacggcctgaccttctcgctgctgtgccgttacccgacctccctactctcagggatgtcggtaggtggctgggtctgtctgatgaggaggtcagctggtttgcggacgtgaggttccgccaggacaagctgaccgagccaaagctgcatcactaccattactcgtggattccgaagagatccggcggcttgcgcctaatcgagatgcccaagttccgcctcaaagagatccaacgtcgcatagtgcgggagatcctcgggcgaattcccccacacgattgcgcccacggcttcactagaggcagaagcatcagaacctttgctgaaccccataccgggcaatacgccgtgctgaggctggacttgaaagatttcttccacagtgtccccattgccaggattgcagccttattccggtccctggggtatccacccaaaatagcccgagtgctgcagggcttgtgcaccaatgccatctcaccaccgctggctgggaagccctttgaaaagctcccttggcatgaaagaaaagcccttcaggacaaacacttaccccagggagcaccctcttccgcacctctagccaatctgtgtgcatggcgccttgactgtagactggagggattagcaatcaggtacggctatagatatacaagatacgcggacgacctcgcccttagtggtccgagtagcctggcacgcagagccgaattcatagaagccctggtcggcgcgattgcaacggaagaaggattttgccttaattatcggaagacacggttgaggttgtcatctcagcggcagcgactggccggcgttgtagtaaacgaaaaggctaactgcggtcgggctgagtgggatcgtttgaaggccactcttcacaactgtgccaagcacgggccagagggccagaaccgtggaaatcatcctgcctttaagtcccacctggaagggagggttgcccactttgcatggcttaaccccgcccgcggtgagaaactgaaaagcctgctcggacgcatcgtttggtga

SEQ ID NO: 12640 - RNA, 1317 nt, unidentified
  source 1..1317: mol_type = other RNA; note = synthetic construct
atgactaactcggtgagggccagaaggttagcactgagtattatagatggcgaatggactcagcctgctgtaaccgaccgcctcaggcgagtactggaactgcacccacaggatattaagcagttggcggctcggttgtgtttcttgtatgagcagccgccagcctctttcaaaagattggctacactcctcctcaacgaaccgctactggagtacttctggcagcatgccgcgcagcaggacattcccggtattctgctcgataccccacagatgcagcccccacccgctaacctgcggtgctttcccctgccccgactggacaccctgaaagacgtcgctctttggttggcagttcagcccagagagctggactggcttgcagacatcaacggtcgccaggcacaagtggtggagccacgtttacatcactatagatatcgctgggtcaacaagcgctccggaggccagaggttaattgagatccctaagtcccagctcaagcgcatacagcggctcatccttcacgacatccttgatcgcatcctccctcacgatgctgcgcatgggttcgtgcgtaatcgctcatgcgcctcctacgtggcagctcatgttgggcaaccggtgattttgcacctggacctgaaggatttctttcattccgtccccattaccaaagttctggcattttttaggaccctgggttaccctgccgcagtagccaggacattaatgggattgtgttctcatggcgtgtcacctagtcttgccggaaaaccatttgcagatcaaagctggcagcggcgtcggcaattacggcaccctcacctgcctcaaggtgccccaacaagcggcgcccttgccaatttcagtgcctataggctggattgcagactcgccggactggctaggagatacgggctgagatactcaagatatgctgacgacctcgtcttttccggacccgagacgctgcgaccacaagcagcctggatagagtctgtgactggcgccatcgcactggaagagggcttctgcctgaaccacagaaagacccgggttcgttctcaaagccagagccagaggatcacaggactagtgatcaatgagaaaatcaatatctcacgaacggactacgatcagctgaaggctacactccacaattgtgtccggcacgggagcgaaagccagaaccgatgtgcccatcctgatttccgcgcccatctagccgggagaattgctcacgtgactcacataaatccccaacggggcaaaaagcttcagcagctatttaatgcggtgcattgggaagactga

SEQ ID NO: 12641 - RNA, 1371 nt, unidentified
  source 1..1371: mol_type = other RNA; note = synthetic construct
atgaatacccttaggcgagatatccaaacactcgctgcctctctgctagctggacgctgggccctgccagacttaaccgatagactgcagagggccttacattggccgcaccctcccgcatcactcttagcagctaggctactgcgggatctcggagagcaccacgcccctgaagcgagaaccttggcttcgtggctcctgcaggacgctctcctcctcgcacatttggagagggggagtgatgcccggcctcacatagagtggcttctggatgcccacgtaatggaggcacaaccacccgctatggcagccgacgttccgcagcttcctaccacgggcgatttggctgactggcttagaattagccccggggagttgggatggttcagtgacctatggtgcagtcaggcgagggcctctagagaacccctgaggcactaccgataccagtggcggcacagggaagacagacccagactcatcgaaattcccaaacccagactgaagcggcttcagcggagagtgctgcacgagattttggacccaccccagcctcatccagctgcccatggcttccgagccggtaggtcctgtttgacatatgcgcgcccacatactggacagcctgtggtggcacgcatggacctccgagattttttccagagcgtcccgatccgccgcgttacagcgtttttccggtgtttggggtatcctgcacctgtagctcgggtgctgcgcggtctgtgtacccatggggtgtccagggatgtgctgacaagagccggcctggatctgccctgggagcgaagacagcgactggccagccctcatctgccacaaggcgcaccaacttcccccgcactggcaaatctgtgctgttatcggttagattgccgcctgacgggcctcgctgataagctgggtctaagatacacccggtacgccgacgacttggctttctctggcgcagaatcactccgtcacggctttgagcgttttcacatcctcgtcgccaggatcgctctggaggagggatttgagctgaatacacggaagacaaggttgatgaccgccgcacaacgtcagtcactgaccggcatactggtcaacgcccaccccaacctcccacgtagagaatatgacagccttaaagccattcttcacaactgcatacgcactggaccggcagctcagaatcgcgctgggctgcctgacttccggggacatcttcgaggcaggatcgcttacctggcccaaatcaacccagacagaggggcccgtctgcttcggttatgggaggccattgaatggccagacaggagggctactgactccgccgatgcggaaactgcgggtagacgcgcccgctga

SEQ ID NO: 12642 - RNA, 1344 nt, unidentified
  source 1..1344: mol_type = other RNA; note = synthetic construct
atgtcccgcctgcggcgggatctccgaactctttctgccagccttctggccggaagatgggccaggcctgacctgagtgaccggattcagagagcgctggaatggactcacgctccggccagccaactggcagcaaggctcacccgcgacctcggagatcaccatccaccacaggcccagcggttggaggattggcttaggcaggattccacacttgtggcgcggttagagcggggcagcgaccatcatccgcaggttcgctggctgctggacgctcctgtcatggaggcacagccagcagctctagctgcccgggtgcctcagcttcccaccatcggagacttggctgcctggctcagactatcgcccggggaactagaatggttatccgaccgatggtgtcagcagtctagagagacaagggaacccctgaggcactatcggtatcaatggcgaccacgagccggacgtgcgccaagattaattgaaatgcctaaaccgcgcttgaagcgcatacagcggcggattctcagacacatcctcgacccactgcaaccccatccggcagctgagggcttccgcagagggagatcatgccttacacacgctgaggctcacacagggcaggccgtggttgtgagaatggacctcgaggatttctttcagagcgtcccagtcagacgtgtgaccgctctcttccgatgtctggggtatcccgctcctgttgcccgggtactgcgtggattgtgtactcactgcgtcagcggtgacgcatggacccgcagtggcttggatatcccatgggagaggagacagcgtctgtccagtccccatctcccacaaggtgcacccacgtcacccgcactggccaatctctgttgctaccgtctggattgccggctgacaggtctggcagctaggctcgggttaagatacacctcttacgccgacgatctggcatttagcggcgccgagacactgcgacacggctttcaaaggttccatgtattggtggccaggatagctctggaagagggctttgccctgaacactcgcaagacgcgcctcatgacttcagcgcaacgacagatcttgaccggcattcttgtgaacgccaggcctaatctgcccaggcctgaatatgatctgcttaaagccaccctccacaattgcatcagatacggacctaaggagcagaaccgcgagggccttcctgacttcaggggtcatctactggggcgcatcgcgcacctgtctcaggtgaatcccgaacggggcgccaggttaagaaggttgtgggaggagattgattggagtaacgaagcttccgaagatcgcctgtga

SEQ ID NO: 12643 - RNA, 1311 nt, unidentified
  source 1..1311: mol_type = other RNA; note = synthetic construct
atgagccagctgacccgaaatgccaggttggttgccctttgcattgtcgacactgcctggaacttgcccgcactgacagaacgcctgactattgtcctagctggaggccctcctgatccacagcgattggtggccaggctgctcttccattgcgaagccggccgaagccccagttttcagagaatcgtggacgtgctcgaggctgatgttgacttcgtaagacaccatgctgacgcagcttaccacttgcagcctggggctgcaacaatgcaaccgttgcccgattcacttgtgaccttcccattacctactattcccacactgaggcatctggccacttggctgggactctcagacagagagctcgcctggttttgcgggggccacagacgttatacgactgatcctaaccctgtatttcaccattatagatatcactggcaggatcggtgctccgggattccacgcctcatcgagcaaccgaaacccaagctcaaagccctgcagcgcgaagtgctgcggaatattctggatagggttcctccccatgacgcagcccacggctttcggcgtcataggtcgtgcctgaccggtgctacaccccatacgggccaagcgacccttctgcgcatggatctgcaggactttttcaccagcataaatcgcgcccgcgtggctggagtattcaggatcctcggctacccagcggctgttgcaactgcactggccggcctctgtaccaacagatctgtgctgaaactttctgacaacccaatcgctaatatcccctggcagaccaggaaaaagctagaggcctggcacctgccacaaggagccccaacatccccggcgttagccaacctgtgtgcctggaggttggactctcggcttacaggtttagccgcgcactgggatgctaacttcacaagatatgcggacgatctggcattatcagggggacggcagctacggaagcacaaatcccacaaggaagccctgatcgcagcaattgtgctcgaagaaggctttcgcataaaccatcggaaaaccagatggagcacgtccgcccaacgtcagcgctactgtggggtcgtggtgaaccgacatgctaacgtcgagcgggcagagtacgatcgattgaaggctatcctgaataactgtgtgcggcacgggcctgtcgagcagaatagagccgagcaccctgacttccgcaggcacctgcagggaagaatcagtcatgtcgctcagcttaatccagcacgtggtaataagctcagtaagcttttcgacaggatacactggccccagtga

SEQ ID NO: 12644 - RNA, 1557 nt, unidentified
  source 1..1557: mol_type = other RNA; note = synthetic construct
atgagtgcacccatccgcgcattagcccgggcactggctctagcgcttcttgccgacgctgattctccggagagaagatcgcttcgtgctctagctgccagagcgggtcattgcttaggccacgccgccccagaacctgggaatccacctttgcctgaggtgctctttgagcagctgagacgactgtctactgtctcaaccgcagagtgggttcgcctcgagcctgaagacctcgccacctggctctgtcgtggcttctggtggcgaaaggcgggagtccggaatggtacggcgccatggccgcttcaagacgacggagagctgatcaccgaagatgacgacggtgacggggatgatcccagcgccactccctggcatcttcggacggatgcgcagctcgcgcaaagcttccggacatgggcagcatcacccaggactaggggaccactgcactggctgcttagaccgggaacagcaggtccagcacctgcctggatgggacgggcacctcagtgctccgcacctgtgctggctactgctcaggacctggtgcagctcctgggggtgcctctcgaggatttactgtggctggccccagaccacgcacactggagagaaccacaaggcggctgtgccttgccggcctctcactaccggtatcggctgctgcctaaaccaagcggaggactgagactgctagaagcccccaggcccagactagccacagcccaaaggcgcatactggataggctcctggcagacatcccggtacatgaagctgcccatgggtttgtccggggcaggagtgtgggatcccacgctcaggcccacacaaggcaagccgtggttgtccgctttgatctggctgatttcttcacacacataaacgctaccagggttcgtaccttatggagggctcttggccatggaaggcctgccgctgagttgctgaccagactcacaaccactagaactcctgccccagttcgagagcggttgtgggaaggctctgcacccacctcagcccagacaattgtccagaggcgcacaactcatgcccgattggcgcagttgcacctaccacagggcgctcccaccagtcctgcccttgctaacctttgcgctttcgggctggacctcagactccacgccttggcacagcgctttggtgccaggtacacaagatatgccgatgatctggtgttttccggcccccagaacctgcaaggccagtttggggctctccgcgcatgggtgggagctatcgcccaagacgaaggcttcgcgctgcgaggtgacaaaacccggctgatgcccgcccatagacgacaaagcgtgacgggcctggtggtgaaccagcgtcccaattactcccgggagcagtttgacattctcaaagcccgcctgcatcgtttagcccgcttgcccggcgtagacgtagcagagcgagctcggttggagggggaaatccactgggctgggcagtggctggcaccaaccaggaaggagaagctgcagcgcctcttcggggctattcgcttcactgatgccccctga

SEQ ID NO: 12645 - RNA, 1599 nt, unidentified
  source 1..1599: mol_type = other RNA; note = synthetic construct
atgacgttgtccgcacccattcgcgctctggcaagagcattagcactggctctgctagctgatgctgattccccagaccggcgatcacttcgggcactcgtagcaagagctggccattgtctcgggcatgccgccccagaaccaggaccttccccactgccggaagtgctactggaacagctcagacgcctgagtacagtcagtgcggctgaatgggccaggttagaacccgaggatcttgctaattggttgtgccgaggtttctggtggagaaaagccggagtgcgcaatggcactgcgccatggcagcttcaggacggaggcgacctggtcactgagggcgacgatatcggattttgggaccctgaggataatgatggcgacgcacccagtgccaccccttggcatctgcgaaccgatgcccaattagctcagagcttccgaacttgggctgcatctccacgcactggcaggcctcttcactggctgctgaggcctggaacagcgggtcctcctccagcatggatgggctctgctccccagtgttctgtgccgatgctcgcgacagcgcaggacctgttccagctgctgggtgtccctttggaggatctgctgtggttagcgcccgatcacggccactggagggaacctcaaggcgggtatgctctccccgccagccactatcgctatagattgttgccaaaaacctcaggtgggcttcggctgctagaggccccaagacccaggctcgctaccgcacagaggcgaattctggaccgtctgctggcgggcatccctgttcatgaggccgcccatgggttcgttagggggaggagcgtcgggtcacacgtgcaagtgcacacacgtcaggctgtagtggtgaggtttgacctcgccgacttttttacccacataaacgccacccgcgttagagcactctggcgagccttgggtcatggacgtcctgccgccgagctgctgactaggctgaccacaacacgcactccggctcccgttcgggagagactctgggaggataacgctccgacgtccgctcagaccatagcacagcggcggtcgacacacgcgagactcgcacagctacacctccctcagggagccccaacttctcccgctctcgcaaacctgtgcgccttcggactggatctccgccttcatgccctggcccagcggtttggggctcgttacacccgctacgccgacgacttggtgttttccggtccccaggacttgcaagggcagttcggggcattgagggcctgggtgggtgccatcgtgcaggatgaagggttcgccctgcgcggcgataaaacaaggcttatgcccgctcaccaaagacagagcgtgaccggactagtcgtaaatcaacgacccaactacagccgcgagcagttcgacatcctgaaggcccgtctccatcggctggcacggttaccaggagttgatgtcggcgagagggcccggcttgagggagaaatccactgggcaggccaatggcttgcccccacgagacgggaaaagctcttacggctgttcggcgccattagatttaccgacgccgcccaggacaaggggtga

SEQ ID NO: 12646 - RNA, 1590 nt, unidentified
  source 1..1590: mol_type = other RNA; note = synthetic construct
atgaccaagactcccgcaaggactcgtgcactggccaaggccctggctatggccgtgcttgcagacgctcgggagccagaacgacggactctgcaggccttagccgctagagccggagcttgcctggggaacaacaccactctggccgactcccctgtccctttgcctcctccactcctagagcagctgaggcgcttatcacatgcctcaggcgctgaatgggcccgactggagcctgaagacgtagcaacatggctgtgctggggcgtgtggtggagaaaagctggcttaaggaatggtagcaccctccaaagcctcaccacaacctttagtcagcaggaagagaaggatcaggacgcctgggacgagctagtcggcgacgacgatgagaatgccgagccagcgttacccctccaccagtggccagatccccagcttgctcgtgccttccggacatgggccgcaagccctagaacaggagagcccttgcactggctactgcgatctgctacagcaggggctcatcctgcttggatgggtcgggaaaggactacacctgtgctgctgaccgcaacagatgtgactgaaaccctggcaatcagcctggatgatctgctgtggctcgcccccgagcatgctcattggagggaaaggcaagacggcggtcacgctttgcccctttctcactaccgctatcggctgcttccgaagccatccggaggcctgaggttgctcgaggctccaaggccccggcttgcttccacccagaggagaatcctggattctctgctggcaggggttccggttcacgaagccgcccatgggttcgtgcggggtcatggagttgggacgcacgcccaggtacacactcagcaggccgtagtcattcgttttgatctcgcagattttttcatgtgtattacagcgacccgggtgagagccttgtggagggcattgggtcatgggaggccagcggcagaactcctgacaagattgaccaccacacgcacgccccaagccattagagagcgtctacttgaagcagcccctctcccccgcgaggcaatagctcaccggagagccatcaacactagactgaaacagccacacttaccccaaggcgcccccacgtctcctgccttagccaatctttgtgcgttcggcttggatctgcgactcaatgctctggctgagagattcggagctcggtatacccgctacgcggacgacctggtcttttcaggctcgaaggccctccatcagcaatgggtggacctccgtgcgtgggtgactgcaatcgctcaagacgaaggcttcaccttgcgcgccgataaaacgcgggttatgccggcacaccagcggcagtatgtcacgggactcgtggtgaacgagcgagcgaactacagtcgcacacaatttgatattcttaaggcgaggcttcacagactggggcaacagccgcaggtggacatatccgaaagagcccgcctcactggagagatccagtgggccagtcagtggctggcaccaacccgacgcgccaaactacagcgcttgctgcacgctatcagatttagcaatgagctgtga

SEQ ID NO: 12647 - RNA, 1590 nt, unidentified
  source 1..1590: mol_type = other RNA; note = synthetic construct
atgaagaagatttccgcacgcacccgggccttagccaaagcacttgccatggcggtactggctgatgcacgggagcctgagagacacacattacaggccctcagtgctcgcgcaggtgcttgtctgggaggaaggactacacctgccgactcccccgatccattgcctgaacctctgtctgaacagctccgcaggctcagcaatatgagcgatccagagtgggcccgcctggaacctgaggacgttgccacatggctctgttgggggatatggtggagaaaagctggtgtgaggaacggctctgccctgcaggccctaactgcaaaccgggggcaagacgccgaagagcaggatgcctgggaccacctggccgatgagggcgatgaggatgccgaaccggcccttcccgttcaccagtggcctgatccccaactggcccgtgcctttagaacttgggccgccaatgtcagggcgggagaaaccctccactggctgttgcgtccagctgcagctggtccacaacccgcttggatgggcagggactccactacccccgttctgctcaccgccacggatgtgacagaggccttagctatctcattggacgacctactgtggctcgcccctgagcatgcccattggagggaaaggcagaacggcggccatgctctgccgctgagccactatcgctacagactgttacccaaaccatcaggggggctacgtctgttggaggctccaagaccctgcctcgctagtacgcagcgacgcattcttgacagtttgctggcaggcgtgccggtacacgaagctgcgcatggcttcgtgcgtggacggtcggtaggaagccacgcccaggttcatacccaccaagccgtcgtgattaggtttgatctggctgacttcttcaccagcatcacggctaccagagtccgggcactctggcgagctctcggtcatggccatcctgcagcagaactacttacacgactcacgactacccggaccccacaggcagtgctcgatcgacttctggaggcaacatccattccaccagaagcaatcgcacagagacacacaattggtgcgcggcctaagcaaccacacttgccccagggagcacctacatcacccgctctagccaatctctgcgccttcgggctggaccttagactgcacgccttggctgagcattttggggcccggtatactaggtatgctgacgacttggtgttcagcggcccgaaagcccttcttcaccgccagtgggtggattttcgggcctgggtcaccgcgatagcacaggacgaagggtttactttaagagctgacaagacccgagtgatgcccgcgcatcagcgccaatacgtgaccggcctggtcgtcaaccagagaacaaattactctcggacacagtttgacactctgaaggctcgactgcatcggctggcccagcaacctcccgtgaacatctcagagagggcacgcctggctggagagatccagtgggcctcccagtggctggctccaactcgcagtgcgaagctgcagagacttccccacgcaatcaggttctctaatgaggcgtga

SEQ ID NO: 12648 - RNA, 1521 nt, unidentified
  source 1..1521: mol_type = other RNA; note = synthetic construct
atggccgttctgacagacgcacagggcggtccagagagacggactccacatgctctcgctgctcgtgccatggcatgcttaggcactcccgctgcccaggatgccattttacccgacagtctcacagagcagatcaggcggctatctctcgtgtcagcccttgaatgggctcgccttgagctggacgatgtggctacatggctgtgctggggcagatggtggaggaaagccggcgtgcgcaatcctcacgccgttcacagcgagcccgagatagacgatgacgccactttcctgtttgacatgagcgaggatgaagaggcgcacgagcaggggtccgcagatgtacccctggccctttgggccccacaagatctggctagggccttccgggaatgggcagcatcccctagatccggagcgcacctgcgatggctcttgcgaccggcaacaactggtccccagcctgcatggatggatcatgcccctgggtttgctctactggctacggccgctgacgtcacccaggcattaacactgtcgcgcgaggatctgcagtggcttgctcctgagcacgcccactggagagagcatcacaattcagggctggcactaccgccctcacactaccggtatagacttctcgctaagcccagtggagggctgcggctgttggaagctccaaggccacggttggcccaagcccaacgacgaatactggacaagcttctggcctccgtgccagttcacgaagcagctcacggctttgttaggggccgtggtgtgggtagccatgctgtggcccatgcccatcaggccgtggtcatcaggttcgacctggctgacttctttacgtctattaatgcgactcgtgtgcaggccctctggaaagcactcggacatggacgatctgctgcccagcttttgacccgtctcacgactgccaggaccccttccgctgtcagggaacggcttctcgaggcactgggaagtagctcagcccacttagcgcagcgcagagcgctcaatcagcggctcagccgcgcacatttgccacagggcgcacccacctctcctgccttggcaaacttgtgtgctttccgcctggatgtcagactgcaagcattggcccagaggttcggggctaactacacaagatatgcggacgatatggtattcagcggaccccgggcccttagaggccagtttgctgcactgcagtcatgggtgtctgccatcgcgcaagacgagggattcaccctgagagccgataagacacgcgtcatgccagcccatcagcggcagtacgtaaccgggttagtggtgaacgaacgggtgaactattcccgcgcccaatttgataaactgaaagcccagctacaccgcctctctcaacagccgcgagttgcagccagcgaaagaagtagggtcgctggcgaaattcagtgggcgagtcaatggctggcgaccaccagggctgcaaagctgaagcgcctgttcgacaccatcaggttttccccttga

SEQ ID NO: 12649 - RNA, 1605 nt, unidentified
  source 1..1605: mol_type = other RNA; note = synthetic construct
atgaaaacacccgtgaggtctagagtgctcgccaaggctatctctatggccgtgctcgctgatgcgcagacaccagagcaccgcaccccacaggcactggttgctcgcgtccaagccagcctgggcctagaaccagctgccggttctccactgcccgctttcctcttggagcaactccagcgcttaagtgcaatgtcaagtccagagtgggctagatgggagccggaggatgtcgccgcatggctctgctgggggagatggtggaggtctgctggccttcgttggggcaccgaacacagcggtgccggtgtagaggacggagccagtgcatgggacggggacgatgaagacatcgccgagcccgatggcgatggagaaggcgatgatatcttaccaggccttcctccgactgactggactgcaccacgcctagggcaggcctttcggatttggacagctaccgccagaagcgctgtcccccgaagatggttactacgacctgcaggggcaggacctcttccggcatggatggaccgcgggaccacagtgcccgtattggccactgcgaccgacgtcgcgcaggttttggctgtaagtgtcgaggatctcctgtggctggccccccaaggagcattttggcgggaaagacatagcgaggggcactctcttcccgcttcccactacaggtacagactgctgccaaaacccagcgggggattgcgcctgctggaatcccctagaccgcgactcgtgcatgcccaaaggcggatcctctatacactgctggctaacatacccacacacgaggccgcccacggtttcgttcgtggacggtccgttggctcgcatgcacggattcacactggccaggctgtcgtgattaggttcgaccttgccgacttcttcacgcagatacacgcaacccgagtgcgtgctttgtggcgcgccttaggacatggaagggctgcggccgagctgctgacccaactcactacggctcggactccagctggagtcagggaccgccttctcgaatcaatgcctgagctgcccacaagcattgcacagcggcgtgctaccgcccagagacttgcacggccacacttacctcaaggtgcacctacctcccctgccctcgcgaatctgtgtgctttcggcctggatgtacggttgcaggcactggcgcagaggtttggggccaactatacaaggtacgcggatgatctggttttctcaggccctgacatgctgcgacggcagtttatcgcgctgagagcctgggtggcagccattgcccaggacgaggggtttgcactaagggctgacaagacccgtgtgatgcctgcccatcagagacagtttgtgacgggactcgtggtgaatcagcgggccaactattcacgcgtgcagttcgacactttgaaggctcgcctgcatcggttggcccaacaggctcaggtggatgccggcgaacgagcgaggctggaaggcgaaatcagatgggcctcccagtggcttgcacccgcaaggaccgccaaactgcaacgcctcctggccgctatcaggtttgggagcatggactccggtctggccgccaagggctga

SEQ ID NO: 12650 - RNA, 1602 nt, unidentified
  source 1..1602: mol_type = other RNA; note = synthetic construct
atgaaaacacctgtacgatcccgggtgctggccaaagccatcgctatggcagtcctggccgatgctcagacacctggtcaccgcaccccacaagccctcgttgctcgggtgcaggcatgtctggggcttgaagccacagctgggcccacacttccggcgtgtgtgcttgagcagttgcggcggcttagcgccatgccctcccttgaatggagccgttgggagcctgaggatgtggctacctggctgtgctggggccattggtggagatccgctgggctcaggcaagggggcttaccatgggcagcaggccatggtgacgccccaacttgggagggcgacggagatgactttgccgagccggaaggcgaaggcgatggaggaggcaccttgccgggtctgccacctacagactggaccgctccccgcttagctcaagcgttccgaatctgggcggcaaccgccaggactgcagtacctcgcagatggctgctcaggcccgctgaagctggaccacctccagcatggatggagcgctcaacggctccccctctcttggctaccgctgcagacgtggcccagatgttagcagtcagtctggatgacctgtcatggctcgcctctcagggggctttctggcgagaaaggcacgccaccggccatgcactgccaccatcccattatcgttacaggctgctgcccaagccgagtggcggtcttcgcctgctagagagccctcggcctaggttgatgcacgcccagcgcagaatactggacacattgctggcagccattcccctgcatgaagcggctcacgggtttgtacgtggtagatctgtgggatctcacgcccaagttcacaccggccaggccgtcgtgatcaggttcgatctggccgatttctttacccagattcacgcgactagagtccgcgccctgtggagagcactaggacatggacgagccgccgccgagctactaacacggctgagcacgactccaactccagcaggcgttcgcgagagactccttgagtgcatgcctgaagtgcccgcctttgtcgcccaacggagggcaatggcccagcgtctggcacgacctcacttaccccagggagcccctacttcaccagcgcttgcaaatctctgcgccttcgggctggacgtgagactacaggcgctggcacagcgctttggcgccaactatacaagatacgccgacgacctcgtgttttcgggacccgaaaccttgcgccggcagttcatagcgttgcgtgcttgggtggctgcgatcgcgcaagacgaggggtttgctctgcgggccgataagactcgggtcatgcccgctcaccaaagacagacggtgaccggcctggttgtcaatcagcgggctaactactctaggactcagttcgatacactcaaggctagattacatcggctggcacagcaggcctgggtggaagcaggggatagggcacagctcgagggagagatcaggtgggccagtcagtggttggctcccgctcgagctgccagactccaaaggctcttcgacgccattcgcttcgctcccgttgatggtgaggccgccgctaaagactga

SEQ ID NO: 12651 - RNA, 1575 nt, unidentified
  source 1..1575: mol_type = other RNA; note = synthetic construct
atgcatgtacatgtgcatgcacgcgttctggccaaagccatcgctttggcagtgcttgctgacgcccaggcccctcaaaggcgcactgtcgaagcgctgagggcaagggttcaggcatgtctgggacacgcccccggggaagaacaaaggccccttccggcacccctgcaggaacaactccgacggctcgccactctccctacaagggagtgggcgcggttaggagccgaggatatcgggacctggctccgggagggattttggagacgcatggccggtgtgcggacaggagctccatcagccagaggcgccagagttcccgatgattcctttgacgaggaggacaacgacaccgacgatgacggtatgcccgcagctccaccgtctcagtggactgctagagccttggccgaggccttcagacagtgggcctcccacgtgactcccaagaggtggttgctgcgaagcgcaacaacgggacccttgcctgcttggcgtgattctgatggagctagagccggcccattgttagccacagctgctgacctggcaggcgccttagcagtgagtctggaagacctgctctggctggcgcccgaacacgttcactggagggagaggcagccagacggcggtcatgctatggcccctagtcactaccgttaccggctcctgccaaagccttcaggtgggctcagactgctggaggctccgcgacctcgacttgcccaagctcaacggcgaattctggatctgctgcttgccccaatacccgtccacgaggcagcacatgggttcgttcgcggctgtggcgttggatcccacgctcaagtgcatgccggccaagccgtggtgatccgctttgacctggctgattttttcacccacattcacgcgaccagagtaagggccctgtggcaggccttagggcatggtcacgccgctagcgacctcctcactcgcctgaccactgcccggactcctgctgcagtgcgagaacggctgagggatgcctgcacaccactcggccatcctagctccgagcattggcatgcgaccggaagacacctcgctagcgcccatctgcctcaaggcgcacccacatcgccagcactggcgaacttatgcgctttcggcctagatcttcggcttgaagctctagcccgccggttcggcgcaagatatacgcgctacgctgacgaccttgtcttttcagggcctcagacccttttgcacgccttcgtacggttgagggcgtgggtgagtgcaattgcacaggacgagggttttgcactgcgggctagtaaaacccgtgtgatgcccgcgcaccagaggcagtatgtcaccgggctagtcgtgaatcaccgcgtcaattggtccagagcccagtttgatacattgaaggctagactgcacaggctggcccgacaagcctgcgtggatccaggcgaacgtgcacgcctggctggagagatccaatgggcgaggcaatggcttgccccgacgcgttctgctaaactacagcgcctcttcgaggcaatacggttcgccgattctgggagcagagacgggtga

SEQ ID NO: 12652 - RNA, 1584 nt, unidentified
  source 1..1584: mol_type = other RNA; note = synthetic construct
atggccaccccatctcgcatactgagtaaagccgtcgcaatggccctgctggctgatgcacagacaggtgcagctgccaggcggccatcagcactggcagctcgtgccagccactgtctcgcgtcaaatgccggcgctccctcaggagcacagcctcttccagcaaccttcctggagcagttaaggcggctcagccagttgcctgcccgcgaatggcagaggctggaggtggaggacttagccacgtggctacggcatggacggtggtggagacaggcaggactcgtggccagtagtgggcctggcgaagaactggacgagcctgtgggcgattttgcagatgaggatctcttctttgatgacgacgatgagtctattccagatccccccgccccagcactacagagtaatgctcaactcgctcaggcttttagggtgtgggccgctcaacccagcgtacaggtgcgcagatggctccttcgtccagctcagcctggaccccaaccgccttggttggacgagcgtacacacggtagccgagctgctccaaggtgggcgacagcgaccggacttgcacaggccttgaatttggagttggacgaactcctttggctggctccggctcatgctcactggcgagaacgggccggcttagccatgccaccaagccattaccgacatcggctgctgcctaagagatcaggagggctccgcctattggaagcccccctccctaggctggctcaggtgcaacggtccctgctcgatcaggccctgaaccccatccccactcacgaagccgcccatggttttgtgcgcgggaggggtgttgcttcccacgtagctatgcatgctgggcaagccgttgttgcaagattcgacctgcgcgacttctttactcaggttcacactacaagggtgcgtgccttatggcgtgctctggggcactccagagccatggccgagttactgaccggcctaaccacgacaagaaccccgtctgcggtccgagagagactgctggatgccgttcccacggtcccctctgctgcagtagccggtgcgttggcacagagacgggccagagctcaggcccttgcaaggggacatctgccacagggcgcacctactagcccagctatcgccaacctgtgcgccttcggactggatgtgcgcttggcggcccttgcccaacgctttggagcgaggtactcccggtatgcagacgatctggtgatttcgggcaacgaggaccttcggcgccaatggcccaatctccgagcgtgggtgtctgcaattgtcagggacgagggcttcgccctgaacgccgataaaacccgcctgatgacagcctcccagcgacagcacgtcaccgggttggtgctgaatactcggcctaacctgcccagggcccagttcgacgtgctgaaggcgcagcttcacagattggctaagcaggcaggggtcccgctccaagaaagacctaggctgcttggccagctacagtgggcacggcagtggctggttcccactagagccgccaaactccaagcgctcttcgacgctatccgctttgcagactga

SEQ ID NO: 12653 - RNA, 1533 nt, unidentified
  source 1..1533: mol_type = other RNA; note = synthetic construct
atgaaggcagctaatcacgtgcgacacgccgctttagccgttgcccatgcatggctggccgacagtgacgctgaaggaggaagactgggccacgcactgatggctagagcccagagctctctcggtcttgctccccaggaccaaccagattggctgcgcgcttggagtctccggctgcagaacctgcccgacccaatgtgggccagacttgatgtgtggagactggccagcaccctatgcggcgaaactagcttgggcgcggcctgttaccctgagcgcaggatggccggccttaccgacgagaatgccacactgcctgacccagcagcttcctggaactggggcgaagagggcgaggaagacgtcgtggattggttggacgacgagcatcctgcccgagccgagactgactttgagatctgggtcgaaaggagtcacaggcgggtgcgtcgctggcttttgcgaccagcgcgaatgcaagtggctaccatggccctccacgatctggagctgcccacctggccggattctgcgctactggctgaagccctggctatctcggtcgacgatctagcgtggctagctcgcccggcatggcaattagccccccgtgaccagcctcacaaggccctttctgcctcacattatcgccatcggctcataccaaaggcccgtggggggctgagattactcgaggtcccgaaacagaggctcgcagctgcacagcagcaaattagagtccagctgctggagcgcattcccgtgcatgaggctgcacacggttttgcccgtggcaggagcgtactcacacacgcagccacccatgcaggacagcctttcgtttgcgccttcgatctgcaagacttttttcactccattactgcggcacaaataagggccctttggagaactttggggtatcccgcagggatcgctaccgaactgaccgcactcactaccactgtgacacccgcccccgttcgcgagagactcttggaagacgcctcagttacgcggacgcaggctagacggttggccttacctcatctggctcagggcgcttcatcatcccctgccctcgccaacctgtgtgcattccagttggacctgaggttgagcgctcttgccgagagattcggcgctcggtattctcggtacgcggatgatctggtattctccggacccgcatcccttcagaggcacttcgccgccctacacggatgggtgcgagggatcgcggaagatgaaggatttgcgctgcaccctgagaaaacacggcgcatgccacgacatgccaggcagaggatcacaggtgtcgtggtaaacgaccagccaaatctggctaggcacgattacgatctgctccgggctgaacttcatcagctgagcctccagaaggaggctgtgtccgatgaggtgctggcaagtttacgcggtcgggttgcgtgggcctgccagttagtgacgccagcaagacaggaaaagctcaaagcactgttgattcggtgttctgcagggagccaaacaccttga

SEQ ID NO: 12654 - RNA, 1536 nt, unidentified
  source 1..1536: mol_type = other RNA; note = synthetic construct
atggctctggcagtagcccacgcatggcttgctgactccgacgcagacgggggacgacatcagcggagccttatcgctcgagctcagaattgtctagggctcgccagtagtgatcaacctgattggttggtgacctggtctttgaggctccaccacatgcccgacccaatgtgggccaggttggatgtccagcgcctcgcttcagccctcgtggagcaacagtctctcggcgccgcttgctatccccaatggagggtaataacacaggccgccgccgaaaagggaattcctgacgacgaagagcctgacccacacggactgggcattggctgggccgaaggttacggcgaggaggatgacgacacagagagtactaacgcagcccctaattttagtcagtgggttcagcaggagcgaccagcggttcggcgttggttgcttagacctgctcgcatgcagatcgccgccatggcactccatgatctgggtctgcccaactgggctgatagccagcaactggcacaagccctaggcattggagtttcagacttggactggctggcaaggccagcctggcagtttgcgcctcgtgaccagcacggtaaaagcctcgctgcatcccattatcggcacaggctcaccccgaaggctagaggtggattacgtcttctggaggtgcccaaacagcagctggccgctgtgcagaagaagattcacgtgcagctgctgtctaggatccccgtccatgaggccgctcatggcttcgtcacgggaagaagcgtgctgacccatgccgcacttcatgctggccagcccgtggtgtgcaccttcgatctgagggattttttccatagtataactgcagctcaaatccgcgccctttggcgctctctgggttacccagctgggatcgcggcacagctgacagccctgacgactaccgttactcccgcaggggtccgggaaagactgctggaggatgcctccgcgacaaggtcccagatcaaaaggctggcgacaccccatctgactcaaggagccgcctcttctcccgctctggcaaatctgtgtgcattccacttggacatgcggttatcggctttggccgagcggtttgacgcccggtacagcagatatgcggacgatttggtgttctccgggcccgatagcctcagaagacactttgcgtcactcagaggctgggttcgcgggattgcccaggacgaaggctttgctctacacccagataagacccgacgtatgcctgaccacacccggcaaagaattaccggcgtcgtggtcaacgaaaagccaaacctttcaagggccgactatgatctcctacgggctcagctgtaccgactggccgcacagcaggatcctgcgtcagatgaattattagcaactcttcgcgggagagtagcatgggcctgccagttagtgtccccaagccgccaggaaaaactgaaaacactgctctcccgcatacctcgcgacgatgccccgcacaaaatggtgaagccgatcttccaatga

SEQ ID NO: 12655 - RNA, 1332 nt, unidentified
  source 1..1332: mol_type = other RNA; note = synthetic construct
atgaatgataggcactggatcgcacggggaattgctcgcgccctccttgctcgattcagggagaacggcgacttctctgctgaggggctgcttgcgcaggcgagcatggcactcaacggtaaccctccctggctcaaacgccttattcgcccattggccaagctgtccctacccacatggcagaattttacggtggataccctcagcgaaaggttaatgaaagacgcccgcttcgacgaggcttttaggcaggtcgaaagccccaggatccggcagctttttatgcatcgtgctacaatggggctgcggccctttgcactgcaggattgtgagttaccagccattaccgacgacgtcatgctggccgagttcttaaaggtgtcaaccgaacagctgcattggctcgcccccgaattgccgctcgaacgtctgcctggtgctggccactacagatatcgcttaatacctaaggctagcggaggcctgcggttattggagatgccaaaagcgagaatgaaggccgcccaacgacagctgctcgataagctgttgaatcgcatcccactgcacgaagctgcccacggtttctgcgcaggtcggtcggtgatctcccatgctctgatgcattccggccaagatgtggtgatcagatttgacctgaaagactttttcacgagtatcaccgccgcgcgcgtccatgccattttcaggactcttgggtaccccgagggcgttagcaaggccctgactacaatctgcacaaacagaacttcacggatgattgtcgaaaggttgcttgatgagcggggggttcatgccggcgcagcacaaaggctgaggattccgcatctggcccagggagcaccatcatctccaactctggctaacctagcagcattttccctggatttgcgtctaagtggcctagcggacaagtttggggctcgatatagcagatatgctgacgatctggttttttcaggagagaaacacctgagagctgatttcagagtctttgccgtatgggtgaaagccatcatcgaatccgagggcttcatactccaccctgacaagacccgatgtatgcctgcccaccagcaacaacgcatcaccggagtggtggtaaatactaagaccaacctctctcgtgaggagttcgaccacctgaaagcacggctccaccagtgcgtggtgaatggagttgccagtcagaattctatggggcaccctgacttcaaagcataccttcagggccgaatagcatgggccagacaactgaacgccagtaaggctcagcggctccagagattgttcgatcagattacatggtga

SEQ ID NO: 12656 - RNA, 1413 nt, unidentified
  source 1..1413: mol_type = other RNA; note = synthetic construct
atgccaccagctcatcacaggcggtggctcgcgacagggttggctcatgccttcttagccgaccacgaacaacccggagcacggacaccagaagcactcctggccagggctaaggtgtgcttggggtgtgagggagcagcccctggatggctagcctctctggctcaagctgttgccatccggtgggcccgacagggtctgatcgacactgtcgattcgttggcccagatgctcttgcagcgtcccgagtgggccctggacaaacaggcgttcgacgagggggacgaggagccaagtgacgattcagcaaaccgtccggagccggtacctgtcggacagtgggctgtgagacactggctgttgcggcctgccagaatggctgcaccaccatgggggctacagcacatcgatacccccgatttgccaaccgctgctgactgggtgcaatggcttggcattgaacccgacagacttctgtggctgacccacccttcacagcactggagagaaggcagcgaacgaccccacgccacagtagcccaccattatcaccacagactgctcccaaaacggtccggcggccttcgcctgattgaggcacctaaaagcgagcttaagcaggtgcagcgccttctgttagataggctcctcgcccagctgcctacccatgaagctgcacacggattcgtccgcgggcgtggagttcacacacacgcgcaagtgcatgccgcccagccctgtgttatctcttttgatctgcgcgattttttcccgtccatcggtgctgccaggattcgggccttctggaggtcctggggatatcccgaagccgcggcaaggatgctcactcagctctgtacgactcgaacgcccgtcgcagtaagagagcgactgcgcgaggcacaggcactggatttcaacgctgcgaagcggctggccacccctcatctgcctcaaggcgcacccaccagtccagctctcgctaatctgtgcgcatttgggttagatctcagactggagggtctggcccatcgctttggcgctaggtactcacgatacgctgacgacctcgtttttagtggtcccgcacccttagcccagcgctttcgtcagcttcatgcctgggtcggcgccatagccgcagacgaaggcttcgcacttcatcctgggaagttgaggagggccttaagccaccagcagcagagaatcactggcctggtggtgaacgctcagccgaatattgctcgggcagattacgatctacttcgcgcagagctgcatcatgctgtgcggtccgccagcgttgacgcgcaacaaagggcccacctccagggcagagtagcttgggcgtgccaggccctagccccttctagagtggcgaagctgcaagctctgctggcccgcatagcctga

SEQ ID NO: 12657 - RNA, 1413 nt, unidentified
  source 1..1413: mol_type = other RNA; note = synthetic construct
atgactacgacccagcatcggagatggttggccacagggctggcccacgcctttcttgccgaccacgaacagccaggtgctcgcacgccagatgcgctattggcgcgggctagagcctgcctgggatgtgagggagccgcaccagagtggctggtgagcatggctcaggcagtcgcaacccgttgggcgagacaggggctgatagacacagtcgatagcctggctcagactctcgtacaacgtcccgagtggagtgcaggcgagaacgctctggacgatgatgatgaaacagtggacgatacagcaacccaccctgaaccggtcagtgtgggggagtggacagtgcgccattggctgcttagacccgccaggatggccgctttaccttggggcctccagcatatcgacagaccggacctccctaccactgaggactgggcccagtggctcggaattaccaccgatcggctgctgtggcttactcatcctagtcagcactggagggagggaaacgagcgccctcacgctacagtcgcacaccattaccaccataggctgcttcccaagcggtcagggggtctgaggttgctggaggcaccaaaaaccgaactcaagcaggttcagaggctcctcctgcacagagtcttagcgcaccagcccgcccacgaagctgctcatggctttgtgaggggccgtagcgtgcacacacatgcccaggtgcacgctgcccaaccttgcgtaatctcctttgacttgagagatttcttcccctcaataggagccgcccggatccgagctttttggcgcagctgcggctatcccgagggcgtttcacagatgcttactcaactctgtactaccaggacgcccgctgctgtgagggaacgcttgcgagaagccaaggcccttgattttcaagcagccaaacggctggcctccccccatttacctcaaggggcccccacttccccagccctagcaaacctttgcgcattcggcttagacctgcgccttgagggtctggcccaccgattcggcgcacgatattcaaggtatgctgacgacctggtgtttagcggcccggcttcgctggcatcccgtttcagacagctgcacgcttgggtggacgccattgcggcggatgaaggattcgtgttgcaccctgggaagttgtctagacggctatcccatcagcagcaaaggattaccggtctggttgtcaatgcccaaccaaatatcgcccggcaggactacgatcagctcagagcagagctccattgtgctgcgcgcatggggccagttggagcacagcaaaaggcctacctacagggccgggttgcatgggcttctcaggccctggctccagcacgagtaaccaaattgcgctctctcctggcccaggtgcagtcttga

SEQ ID NO: 12658 - RNA, 1419 nt, unidentified
  source 1..1419: mol_type = other RNA; note = synthetic construct
atgacaactagtcacagacacgggctggcgatcggcttagcccacgcactgctagcagaccatgagaggcctggcgggcttacagcatctgcactgctagggagggcgagtgcatgtttggggtgcgaaggcgctgctccctcttggcttaggcggctgacccagtcaatcgccactcgatggcagagacacggcgctatcgataccctcgacacccttgcccaggctctgttggatctgcccgattggggagccctgttccatgacgatgacgacgctgaaggcgatgatacacccgccgtaaaccccgacgaggataagctgcctctcagcgcctggagagtccgcagatggctgttacgccccgctcgtaccgttcctcctgtgtggggcctcccagccatagatagaccagactggccctctgccagcgattgggcagacggtctgagcttgaccccggagcggcttgcgtggctcacacatccgtctcttcattggcgcgaatcgtcagaacggcctcaccagagagtggcaagccactaccgccacgctctgcttcccaaacggtcaggtggactgagattgctggaggcaccgaagcctgagctcaagcaggcccaacggcgcttactggatacatgcttaactcaattgccctgtcatgaggccgcccatgggttcgtgcgaggtagggacgtgcatagccatgctgcggttcatgcagggcagccatgcgtgatcgctttcgaccttagggacttttttcccagtatcggagctgcccgaattcgggctctctggcggtccctcggctatcctgaaccaactgccgacctgctgactcggttgtgcacaacgcgaactccagccgccgttagggagcgcttgcgtgaagacggcggtctgcactttctggccgcgaagcgcctagcaagacctcacctgcctcagggtgctcctacctccccgagtctcgctaacctctgtgcctttggactggacttgaggctggatggcttggctcaccgattcggagctcgctacagccgttacgccgacgatctcgtcttctccggcccagtctcactgcaacaacagtttaggtccctgcaggcatgggtgaaggcaattgccgccgacgagggattcgtcctgcatcccgggaaacagaggcagatgagagcccaccaacagcagagaataaccgggctcgtggtgaatcagcacgctaatttgccaagagaggattatgatcggctccgggccgaattacaccaagcggcacgttccggaccagtagacgcgtccaagcaggcaaggctccagggacgagtggcttgggcctctcagcacctggccccaaccaggattacgaaactgaaagcacttctagctcgggttgaggcccgcgcctga

SEQ ID NO: 12659 - RNA, 1536 nt, unidentified
  source 1..1536: mol_type = other RNA; note = synthetic construct
atggcaacctctgacggatggcatacccggagagctattagagcagcaccgctcgcacaggacagatcccatccaacaggctggttagcacatcaggtgcactatccacaccatactcctaggatgacagcgttgcaccgccgcctaggcctatccatagggctggcccatgccatgctcgcagatcatcgtaggcctggaggaagtgcagcgccggctttactcgcccgcgcatgtgtgtgtttagggtgtgaggatgcccctccaccctggctggcatcattggcccaggccgttgctctgcggtggcaaaggcacggccccatcgacacgttggacagcctcgcccagttccttgctggccagctggagtgcgacgacactgagccagatgaggatgacgatcttgccgcccccgctattaatgacctgtggtcagatcgaccaccttctacttggcgagtgcggcactggttgttacgtccagcacagaccgcacagccagctgcaggactgcctgctgtggaacggcctgatctcccaactgaggatgcctgggctgcttggctgggactggatcctcaacgcctccggtggctgagccacccttcagttgactggagagaagaccaccaccgaccccaccgcaggatagcagctcattatcgccacgtcctgctgccaaaacggtccggtggcctccgtctgcttgaagtccctagaccagacctaaggcaggcccagcggaggcttctggatggctggctgtctttggtgcccgctcatgaagccgcccatggcttcgtaagaggccgtaacgtgcactcatttgcccaagtgcacgctgggcaagcctgcgtcattcgatttgacctccaggatttctttcccagcctgggtgctgctcgtatccaggccttctggtcggcctggggttaccccgaacctgtagcgcggatgctgacccgcttgtgcaccacaaccacgcccgcgatggttcgcgaacgcttgcaggaggcgccctccatggatgctatgtccctgaagagacttgccagaccgcatctccctcaaggggctcccactagcccagcactcgcaaatctgtgcgccttcgggctggatttgaggcttgacgggcttgcccggaggtttggtgccgtctacgctcgatatgcagacgacctggtgtttagtgggcctcagagcttataccgggaggccagagccctccaagcttgggtgcaagccatcgcggaggacgagggcttcgccctaaacgccgcgaagcagcgacagatgagggcgcaccagcagcagagagtcaccggtctggtgatcaacgaacgccccaatctccccagggaggactacgataggcttcgggcaacactgcacagagcagccctgagtggacctgctgatcccgctgccagggccagacttcagggacaggtagcgtgggcctgtcaatctctcgcaccgagccgcgttgctaaactacaggccctgctggctcggatcgccccaacatga

SEQ ID NO: 12660 - RNA, 1362 nt, unidentified
  source 1..1362: mol_type = other RNA; note = synthetic construct
atggccgcagatcgcacacctcgatccaatgcaatcgcactggcacatgcactgctcgccgatgcggaagtacctggggctcgctcgttgacagccttgcacgatcgggtcgccgcatgccttggtctaactgcccccctgccacctgggctgttccagatttgtaccgagctcgcggcctggcctgaaccgatgtggagacagcatggattagactcactcgcggacgtgctcctgcaacgtcctgagtggccagctccccctcatgcatggcaggccagacactggttgctgcgacctgctcgcatgcagttagccccaatggccctggctggtgtggctctgcccgaactgcctactcacgccgccttggcagcgtggcttgggactactcccgatgacctacagtggcttgcacatccctctcagcggtggcgtgaatcccaacccacagaccggccgcatcgctctgtagctccccactatagataccagcttctcacgaagcctgggggaggactgagactgctagagatgccactcccaagactgaaaacccttcaacggaggctgctgcacggcctgttagcgagagtgcctgtccatgaggctgcccgaggatttgttgctgggcgcggagtacggggtcacgctaacctacacgccgggcagccctgcgtcctttgtttcgatcttcgggatttcttcggcagtgtcggtggaggccggatacacgccttgtggcgcagcctgggttatcccgagggtgtggcaaggactctcattcagctgtgtacgacacggaccccgccagctgttcgggagaggatggctgatgcaggttctctggaccgccctgcagccaggagactggcaagtgcacatctccctcagggagcgccaacatcaccggctctggccaacctcagcgcctttggcctggacctcagactggatggcttggcctggaggtttggagcgaggtatagcaggtacgctgacgatctcgttttctccggccccgccgccttacgaagagactttagagtgctccacgcctgggtcgaagccatcgccttggacgagggcttcgcactaaatcccgctaagacccgttgcctcccagcgcaccgccaacaacgggttaccggggtggtggtgaatgagcgtcccaaccttccaagagccgactacgataggctgagggccgaactgcatgccttgggccaccagaccagggtacccgctgctttgaagccaaggcttcaggggcgaattgcttgggcccgacagtggttagctccagagcgcgcagccaaactgcagcggctgctggaacgcatcgcttttgacggcgcctga

SEQ ID NO: 12661 - RNA, 1392 nt, unidentified
  source 1..1392: mol_type = other RNA; note = synthetic construct
atgactgtggcggccccactcacttatcctcgatggatagccctggccctggccagagcattacaggccgatgacgagtctccacgagcacgggaggctgatgccctgcaagccagagccgaacagtgcctgggggtggagtctcggccttggctgaaacccctgtgtgtcgcgctggctcggtggacaaccccagtttggagagcccacagcattcgtagcttcgccgacgctttgctggaaatggacgccttccacgagggcttcgacctggaaaggttttctaggccaaccgttaggcgcttgctgctccggccttcccgtatgaggcccctaccttttgcattagagcatttggtcctccccgacttagccactgaggccgacctggctgcttggctcggtctgaccctggatgagcttgaccatttcgcggggcccgcaagacgttatcgagaagcagtagccacacctgagaggcctcatgtggccccaaccccacactaccgctgccttttggtaccgaaaaggaggggaggccttcggttggtcgaagcccccttaccgcggttaaaagcggtccagcgcagactcttggacgggctgctgaataccctaccctgccacgaagccgcccacggtttcgttccagggcgtaacgtggctaccaacgctgcagtccatacgggccaggattttgttatccgcttcgacctccgcgattttttcccaagtattggccgcgcgcgaatcgcagcaacattcaggacactcggtttttccgatgctgtggtggagcgcctcactacgctttgtactgcaaggacaccggctcctgtcagggagcgactacgggaggacggaagtattgatttcgatggcgccaagagactggcctcaccgcatcttcctcagggcgctcccacttcgcctgcccttgctaatttgtgtgcttttccactggatatgaggttggatggactcgctcacagatttggcgcccgctacacgcgctacgctgatgacctggtattttccggccccgcaaccctccggagagatcaacgagagtttcgggcatgggtacaagccatagtggaagacgaaggatttaggctccgaagagataaaaccagagccatgcccgccggaggtagacagcaagttacaggcgtggtggtgaacgaaaagcccaatctggctcgcgaagattttgaccgtctgaaggcggagctgcacagactggtggggtcaacagacgtggaccctgcgcagaggagcgtcctacttgggcggctggcttgggcacggcagttccttgcacccatgcgggtggagaagctgcagcgcatgttcgacgctatcgccttcggagcagcaaagaacctctga

SEQ ID NO: 12662 - RNA, 1392 nt, unidentified
  source 1..1392: mol_type = other RNA; note = synthetic construct
atgtcattagccgcacccctcacctacccccggtggatagcccttgcactggccagggctctgcagacagacgatgatgcccctaggggtcgcgaggctcatgcattgcaggcgcgggctgaacagtgtcttggcgctgaggctcgaccctggttaactcccctctgcgcggaattagctagatgggcccggcccgtttggcttgcccattccatggccagcctggccgatgccctccaagccttggaggcctttcacgccggcttcgatccagagcggccaagaccaaccgtccgtcgcctgctgttgaggccttcacggctgcggcctcctcctcttgcactggcaagtctggtgctaccggattggagcacagaagccgacctcgctgcttggctcgggcttaccctagacgagcttgatcacttcgcaggacccgcccgccagtatagggaacggactgcaacccctagaagaccacacgctcacccgacaccgcactaccgtggcctgttggtgccaaagcgtaggggcgggctcaggcttattgaagcacccatgccgaggctcaaggccgtgcaaagaaggttgctggatgatttcctgcagcccctgccatgtcatgaggcggcccatggcttcgtgagagggaggaacgtggcgactcatgccgctggtcatgcgggccaggacttcgtcattcgctttgaccttcgggacttctttccatcgatcggccgcgccagagtatctgccacgttgcgcacgctggggcttccagacgcagttgtcgaaagactcgtcctgctgtgtctgacccggacccctgcaccactgagagaaagattacgtgaggatggaagtatcgacgcagacggtgcaaggcgcctggctagctttcatctgcctcagggggcccctacatccccagctttagccaatctgtgcgctttccccatggacctcagactggacggattggcccagaggttcggcgccagatatacccgctatgcagatgacctcgtgtttagcgggcccgcttctctccgacgcgatcaacgagcactgcgcgcctgggtgacagccatcgtggaggatgagggatttcgcctgcgaagggacaaaacacgggctatgcctgcaggtggacggcagtccgtaaccggggtggttgtcaacactcgtccaaacctggctcgcgaacgatacgacggactgaaagctgagctccaccagctaggcctacggtcccggtctgctcctgttgatcccgctctacgaggacccctcttgggtagactggcctgggcgcgacaatttctggcgccctcaagggtggagaagctcactaggatgttggcagccattcagttcaatgccgacagatga

SEQ ID NO: 12663 - RNA, 1383 nt, unidentified
  source 1..1383: mol_type = other RNA; note = synthetic construct
atgagccacgcaaccccgctcacttatactcgctggatcgctctggccttagcacgggccctgcagaccgatgatgaaacacccggtggaaggggtgctcgagctctccaagctcgagccgagcagtgcctcggagttgaggctcgactgtggctgcgccctctgtgtgttgtgctcgcgcgatggccagacccggtttggagagcacacagtgtgcggtcactggcggatgaactgcaggacacatctgcctttttagacggctttgatgccgccttgcatcccaggcctcgggtccatagggtactactccgtccctcccggagaaggccccttccattcgcactggaacacctgtccctccccgattggcaaaccgaagcagagctggcagcctggctgggactgtcaggggaagagctcgatcactttgccggcccttcgcagcgctacagggagacagtagccacccctcggaggcctcacatagcagcgactaggcactaccgctgtcttttgatcccaaagagacggggtgggctgcgcctgatagaggcaccaatgcccagactgcgggcacttcagagacgcctgctggatggcctgctccatgcgcttccatgtcacgaggctgcccacggatttgtgccagggagagacgtcgctagccataccgcttgccacgccggccaggacttcgtcatccggttcgacctccaagatttttttgcatccgtggggagggcaagagtggctgccatttttaggaccctcggttacagcgacggggtcgtggagcgactggctactctttgcacaactcggacccctgcaatggttagagaacggcttagggaggacggggcgctggatttagacggtgctaggcgactagccgccccccatctatctcagggagcccctacaagccccgagctcgctaatctgtcattgttcggcttggacttaagattagccgggttggcagagaggttcggagcgagttactctagatatgccgacgatctcgtaatctccggacccgcaacgctgcgtagggatcaggggcgacttcgcgcctgggtgagagctgtcattgaagacgagggcttccggctgaggccggataaaacaagagcaatgccagcgggaggcagacaacaggtgaccggtgtggtggtcaaccagcgccctaacctcgctagagaagactatgaccggctgcgcgctgaactgcatcgccttgccggcatgccaagagttgacgccgccttgcgcgatcctttgcgtggtcggctggcctgggctcgtcagttcctagctgccacgcgcgtggccaagttggaccgtatgttcgatgccattgtgttcggcgaggcctga

SEQ ID NO: 12664 - RNA, 1377 nt, unidentified
  source 1..1377: mol_type = other RNA; note = synthetic construct
atgacctcaagcgctagcctgacatatccccggtggatcgctctggcactggccagagccttccagacagacgacgatgccccaggaggacgatcccctcaggccttattgggccgtggcatggcttgcgtgggggaagagcatcggcggtggcttttgccactgtgtcagcacctggccagtttatctgcaccagtttggttagggatgaccccccgcaccttggccgaacacttagatcaacgccctgagtttttcgacgcctgggatccggctggtccgagacttcaggttcgccggcttctcctccgccctgctaggatgactcctccacctttcgcactggaagacctgcccctgcctgcatggcacactgtcgctgacctggcagcaggattgggcattgacctctctatgctcgacgtgctggcgggtccagctcagagataccgcgaggctgaagctcggcctcataggccacatgtgcaagccatccggcattacagggccgtccttgtgcccaaacgacgtggcggcttgcgactcattgaggcacccatgccggctctgaaggcggtccaaaggaggctactgcgctccctgcttgacttggttccggtgcacgaggccgcacacggctttgtagccggacgcaatgtggcttcacacgcgggactccacgctggacaagactgggtcttcaggttcgacctgcaggatttttttcccgggattggggccgccagaatacgagcactcttccgtaccctaggcatggaggaagcagtcgccgaatatctgactacactctgcactgtgcggacccctagagctgtgcgcgagcgactacaggatgacgggggcctaacatggatagacacgcggagactggccgcccctcatctaccacaaggggctccaaccagcccccagcttgctaacctgtgtgcatttaggctggatttacggctggatggcctggcggcaaggtttggggcccagtattctcgctacgccgacgatctggtgttctcgggtgcaggtacgcccgccttggatgctgtcaccctgcacgcatgggtgaaagccatcgttgaggaggaaggatttagactgaggcccgataagaccagactcatgagagccgggggcagacagacagtaacaggcctcgtcgtgaacgagactccccacatcgccagggcggattacgaccggctgagagccgaaatgcatagactcggacgcgagccagcagttgatctgtccctccgtgcgccccttcttggtaggctcgcctgggctcggcagttcgtagctcctactcgagccgccaagttgcagaggctgtttgacgcgatcagtttcgtgcagtga

SEQ ID NO: 12665 - RNA, 1377 nt, unidentified
  source 1..1377: mol_type = other RNA; note = synthetic construct
atgacgccaccagctcccctgacctactcacggtggattgccctgtctctggcccgggcatgtcagactgatgacgacgctcctggaggtcgaactgcgtccgctttgctaggccgtgccacagcctgtcttggcgcggaacatcgcgcttggctgctgccattgtgcgaacaactggcacgcttaagtttgccagtctggcaacagatgacacctaggctgttagccgaccacctcgaactcatgccagcatttgtggcgggattcgaccctgagcggcctccagtgcatgttcggcgcctgttactgaggcccagcaggatgcgacctccaccctttgccctcgagcaccttccgctgcctccatggcatacgcttgccgacctggctgccggcttaggactggagttgtctatgctagaggtgctcgcaggacccgcacagcggtttcgagaggccgatcccaccccgcatagacctagagtccaggccactgcacactacagaagcctcctggttgacaagaggagtggtggcctgaggctcatcgaggcaccgttgcccgcgctgaaagctgtgcagagacggcttctgcggacactgcttgaccgcgttccggtacacgaagccgctcagggcttcgtcgcagggaggaacgtagcaggccacgctagaatgcatgccgggcaggcatgggtctttcggtttgacttgaaggatttctttccatccattggggcggcaagaatcagagctctattccgcaccctcggctttactgaagctgtcgcagataccctgactacactgtgcaccgtgcgtactcccagagctgtgagggagaggttgcgggacgagggcggactttcgtggcttgaagctcggcgtctcgctagtgcccaccttccacaaggagcccccacctctcctgtcctcgccaatctctgcgccttcgcgctggatctcagactggatggcttggctgtgcgcttcaacgcccagtattcccgatacgctgatgacctggtatttagcggtcccaccacagagggactcgatgccgtgtccctgcatgcttgggttcgcgcaatcgtggaggacgaagggttcgtgctgagggccgataaaacgcgcctgatgcgcgccggtggtagacagacagtgaccgggctagtggtcaatgagacaccccacctgagccgacccgactatgataggttacgggcccagttgcacagactcgggcacgaggcacaagtacctatgtcactgagggcgccacttctcgggagactagcctgggcccgacagttcgttgctccttcacgcgccgaaaagctgcagcgtcttttcaacgccatagcattcgtgcaatga

SEQ ID NO: 12666 - RNA, 1428 nt, unidentified
  source 1..1428: mol_type = other RNA; note = synthetic construct
atgaccctggccgccccactcacctatcatagatggatcgcgctggcacttgcaagagcaatacaggcagacgacgatcaaccccaggggcgcgaggctcatgccctattgggtaggacgtcagaatgtttgggcaaggagcatgtcccctggctgagagccctctgccaagcactggctcggatgactaaaccacagtgggaccgtttcaccacccacacccttgctgatcacctggaatcaatgcacgaattttttgggtgggcccatgtacgtggagacggggatcccgacgacgagagtgaggaggatccggatggcgagccattcccaaccccccgagtccgacgattactcttgcgacctgctagaatgaccgctcgcccctacgccctggaagcacttgagttgccggtgtggcacactttgccagatctggccaacgggctcggaattgacctcgacatgctggaagtccttgccggcagggcgcaccactacagagacgctgtggcgacacctctcaggccacatgtcagggccacgcaccactatcggtccctgctggtgcccaaaaggagagagggcatgaggctgattgaggctccgatgcctgctctgaaggccgtgcaacgtcgcctgcttgacgtgctcctcgctcgggtacccgtacacgaggctgctcacggttttgtaactggaaggaatgtggcctctcacgccgccgcacatacagggcaacattgggttctgcggttagatctgcaggatttctttccttcgataggaagagcccgcatcgcggcacttttccgcaccttaggatacgccgaaggggtggctgataggcttactacgctgtgtaccgtccgcactcccgtcaatgttcgcgagcgcctaagggacgccggtgcaatcgactttcacggagcgaagagactagcatcccctcacctgccacagggcgctccaacatcccctcatctggccaatctttgcactttcagcctcgatctgagattggaagggcttgcctaccggttcggcgcgcactatagccgatacgccgatgacctggtgttttctggctcccgggacactaggctggcccctacagctctccatgcctgggtgcggacaattgttgaggaagaaggcttccgtctgcggcgcgataagaccagactgatgagggcaggcggacgacagacagtgacaggagtggttgtgaacctcaagcccaacctcagccgccccgactatgaccggttacgggctgagctgcatagactaagtcatcaggccgcagtggatggcgcattacggagccctttgttgggtcggctggcctgggcacagcagttcgtagctgcctctagggccgcgaaactgagacgtctcttcggtgctatccgctttgttccttga

SEQ ID NO: 12667 - RNA, 1350 nt, unidentified
  source 1..1350: mol_type = other RNA; note = synthetic construct
atgactaggagctctagttatagaaactggattgccacggccctggcgcacgctttcttggcagatgcggctcaagccggcggtcgaagtgccgaagctctgcacgcacgcgctgtgcagtgcatgggcgaagatgctccatggctaagagcccttgcagcctcaatcgcaacagagtttagtcggaggcgagacgcacatactgtgcctactctgagcgcctggctgtgtgagctgccccaattggacgacgccttcgatccagagcgggagcacccacgggtgaggagacttctgctccggcccgcacgcatggttagagctccgtgtgccttagagggactgagactgcctcgatgggacactcctgccgacctcgcagcatggctgggtgtgccattggaaagactggaatggttagttggcagggcccaggatttccgagagacacaggccgggcgcaccagatcagctcactaccaccccctcctgaaggctaaaagatccggcgggctgaggctgattgagatacccaagcctgcactgaaacaggtgcagcagaagctgctctccgggctgcttgatgccataccaacccacgaaagcgttcacggatttgtccggggccggtcagccatttctcatgctcgggagcatgctggacgcgcggtagtgatcgcctttgaccttagagatttttttaacagcatcggagtcgcacgcgttcgagctctctggcggaccttgggctatgcagaaggagttgcggaagccctagcccgtctcacaaccactagaacacctctggccgtccgagagcggttggtcgaagctggtggcatcgacttcatggctgcgaagcgtctggcctcgaggcatctaccccaaggtgcccccacgtcccctgcacttgcgaatctctgcgcattcggactcgacttgagactagacgggctcgcttggcgtttcggggcccattattctaggtacgctgatgacatcgtgttctccggccccagagagcttgctgccaggagcaggaacctgcaggcttgggtcgaggcaattgtgcgcgccgaagggtttaccctccatccgggaaagaccaggcgtatgagggcacaccatcggcagcaggtaaccggcgtggtggtgaatgagcgcccgaatgtggctagggacgcctacgatcggttacgcgcgcgcttacactcttgcgcagcctccggctgcgatgccgagacatggatgcagctgcaagggcaggtcggttgggcctgtcaactggtcgccgcaagtagagctgaaaaacttcagcgcatgttggcggccgtaccagtgcgtcggtga

SEQ ID NO: 12668 - RNA, 1353 nt, unidentified
  source 1..1353: mol_type = other RNA; note = synthetic construct
atgacccattcctatcgccattggatcgcgactggactggcccacgctcttatggccgatgccgatcaacccgggggtcagtccgcccaagcacttcaggcacgagcccagcagtgtatggggactcgcggtacctggctcaagcccctagccgaagcagtggccagggagttcgcgaggaatccacgccaccatactgtagcgaccctggccgaccacatatttgaactgccccaattcgatgctgctttcgctcctggccagcctaggcccagagtgagaagactgctcctgcgcacagctcgtatggccgctcctccattcgaactggcaggtttggagctcccgagccttcccactctcacggatctggcggcgtggctagacgtgagcctggaacggctgcagtggcttatcgcacccagccagaatttcagagagacagagcctgctcccggacgagctaatgtgcccccaggattacactatcacgccctcctgaaacctaaaaggtctgatgggctccgcctgatcgagattccaaagccagatttgaagcgagtgcaacggagattactgagcggcctgctggacaggattccggtgcatgaatgcgtccatggcttttcaaaagggcgatccgtgctcactcatgctgcagaacacaccggccaggccgtcgtgatatgccacgatttgagggattttttcaactcgattggcatcgctcgcattcgcgccttgtggcggacgcttggatacccggagggagtatcagctgcgcttgcagccctgtgtacagcgcgtacacctagggcagttcgggagcgcttactggaatgcggcagtatcgacaggagaggagcagccaggctcgcctctccacaccttccacaaggcgcccctaccagcccagccctagcaaacctgtgtggcttcgctctggacctgcgattagacggtttggcatggcggtttggggcccggtacagtagatacgccgacgacctggctttttccggacccgctgacttgatgccacggaggcgaaacctccaggcctgggtccaggcaattgcccacgctgagggttttgccctgcatcctgataagacccgggccatgccctcacaccgtcgtcagagactgacaggggtcgtggtcaacgagcggcctaatctcgagcgctgcgcttatgacaggttgcgggctcagcttcatgccctggccgctctgggctgtgatgaagccaccagaatgagactccaggggcaggtttcttgggcctcacagttagtttgcggctcccgggcacgcaagttggacagactcctagcagcaatcagttcttga

SEQ ID NO: 12669 - RNA, 1401 nt, unidentified
  source 1..1401: mol_type = other RNA; note = synthetic construct
atgccgaagcccaaccactcctatagaaggtgggttgccacgggacttgcacacgccctgttggccgatgcacacaaacctggcggcgcgacttcgcaggctttacacgccagagcgatccagtgtctgggcgccgatcacccctggctactgccactgatagccgccatgggccctcattcagtagggcagtggcgccgtcattccgtggctagcctggctgagtacatcgatcagttgcccgccttcgacgccgcctttctcggacaggacagccacccccatattagacggctgttacttcgtcccgacaggatgctggccccgccatttgagctcgctcagctgggtctgcctcgtctggcctcacatgccgaccttgcccagtggctcgggatttcccctgagcgactgcagtggctgatcgaaccggcacagaacttccgcgagagcgaagcagctccagggcaaccacattgtcaccctggaaggcactaccgccagctgctgaaacagaagaactcaggtggcctacggctcgtagaggccccaaagtccgaattgaagcgggttcagaaacggctgttgagcgggttactgaataagattccagtgcatgaaaaggtccatggtttcgtgcgcggacgcggtgtgctgacacatgccagtgaacacgctgggcggcacaccgtcctggcatttgacctcagtgacttcttctctagcattggcgtggccaggataaaagccctatggcagacacttggataccccgaagcagtcgcacgagcattagccgctctctgcaccactcgcacacctctggcggtgagacaaaggctcatggacgccggcgggatcaacttttttcagcagcggcgccttgctagtgcgcatctccctcaaggagcccccacctctcctgcactggcaaacttgtgtgctttcatgctcgatttgaggcttgatggactcgcatggcgttttggtgcgaattacagcagatacgcagacgatctggtgttttctggttcagagttgttagctcgcgatcaacggaagttgacgggatgggttgccgcaatcgtagaggctgagggcttccgagttcacccccgcaaaacacgagtcctcctgaaatatggcaggcaacgggttaccggggtggtcgtgaatactaggcccaatctgggcagagatgattatgacagactgcgggcggaactgcacaggctagctggagcggacagattagacaagggggtgaagcaaagaatgtggggccgaatcagttgggcttgccagaccgtgtgcgcttccagagcagccaaactctacaggcttttcgaggctcttccaaatgaccaccagggcgctgggtatgatgcctctacttcttga

SEQ ID NO: 12670 - RNA, 1368 nt, unidentified
  source 1..1368: mol_type = other RNA; note = synthetic construct
atgcctgccagttcgacctataggcagtggctcgctagagccttggcgcatgccctgcttgccgatgcccttctcccaggcggctgtttgagagatgcactgctggcgagggcagcctctactcttggaaagcgccccgcatggcttgcaggtttagtcgacgccctgctcccattcgacccactcagggaggacgtgcaagccctgggacgacggatcgcagttcttcccgcctttgatcctgccttcgacgctgagcatcccccccgaattcggcacctaatccttcggcctgccaccatgttaagaagaccgctgggcctgcacgagttggaactgccagcattggctacacacgctgacctggcgtcctggttaggcctcgactccgaacagctggcttggcttgcagcaccagctagagcttggcgaccacctggtgctggtggaagggctgccgctacccactaccgctgcctcttgatgccgaaaagaagtgggggcctgcggctcattgaggcacccatggccacactgaaggccgtgcaacgccacctgctggatgggcttctggatcacgtgcctgctcacgaggcggctatgggctatgtttccggccgatctgtcattgaccatgcagccgctcatgctgggcgggcagttgtcttgaggttcgatctcagagatttctttaacagcataccggcttctagggtacacgccctgtggcacacgcttggttacccagacggagctgctcggactctgaccgccctcactactgcccgcacacctgttgctctgcgcgaacgcctgcaggatgatggcgggttagatgtgctgggcgccaagaggctcgcctcagcacacttgccccaaggtgctcccacttcacccgccctggcaaacctgtgttgttttaggctggacctgaggctgaatggactggcaaaacgcttcgacgcgagctacacccgctatgccgacgatctcgtaatcagcggaccagcggcttgcgctaaaagacgacgtgagttgcaggcatgggtggaggcaatagtgcgggacgaagggtttgccctacagcctaggaagacactgacgatgcccgctcatcagagacagcaggtcgccgggatcgtcgtgaacgcgcatcccaatttggaccgtgccagcttcgacagactaaaagcccggttacatcgctgcacccgtgatggaccaagtcctgcagatgacccccaacaactccgagggcagctcgcctgggtgacacagcttaaccctgcccggggcgccaagctgcaaaagctctttgaagggatccggtggctaaatgtggccccgtcctcaacccctgtgcgttga

SEQ ID NO: 12671 - RNA, 1425 nt, unidentified
  source 1..1425: mol_type = other RNA; note = synthetic construct
atgcctcccccaccttcatcgataggattgattaccttcatgacgcgggagctgtcctatcgggaatggctgagccgtagtctggcacgcgccttgcttgcagatgcacgacaacccggagggacagctcccgatgcattacacgcgagagctgccgccacattgggcacagacgccgcttggttgaagcctctagccgaagttctcgggaagcggagccaggccacctggcaaagaacagacttacccgcactggccaaggcaatccatgatatgccggagcttgaccttgcctttgcccaagacgagctaccacatgtgcgccgcatcattctccgaccagcccaaatgctgccccgccctctcggacttgaccacttcgcactgccagaagtgccgactctcgcagaccttgcgcgttggctggaactcgagcctgacagactggcatggttgacctccgccactcaggtgtttagagaaccagatgcttcctctccctgcccagctagccactatcgctaccagctgcagccaaaaagactgggcggtctgagactcctggagattcctaaggccgacctgaaacgtgcccagcggaggattctggacgatctgttgcagcatgtgccagtgcatgaggccgcacatgggtttgtgcagggcagaagtgttgcttctcacgccgctgctcacgccggcaaagatgtggttatcggattcgacttaagggacttctttccatccgttagggcgtctcgcgtgcacgccatgtggcgaactcttggttatcccgaaggcgtagcgcgagccttgaccgctctgtgcacacaccgtaccgattctgcggtgatcgagcggctacgggatgacggcggtctagactggctcggcgctaaaaggcttgcggcacctcatctgccgcaaggcagcccatgttcacccgccctcgccaatctctgcgcattcaggttagatctgcgcctggagggccttgcttgggtgtttggggctacctacaccagatacgccgatgatttggtcttttccgggcctgcgactttacgggcacagttcacggcactgcgggcttgggtcagtggtatcgctgctgacgaaggatttgccctgcacccccgcaaagtacgctgtatgcctcagcaccgacagcagcgggtgacaggcgtcgtcgtaaacgataaggctaacgcccctagggaggacttcgacagactcaaagcagtcctgcatcggtgtgttatgcacgggcccgcagcccagaatcacgctaagctggatgacttcaggggacacctcctgggacatatagcctggatcgggcagtttagcccgactaggaaggtcagactgatgaggctcttcgataggattgactggcccgatgccgctcagcctccctcatga

SEQ ID NO: 12672 - RNA, 1389 nt, unidentified
  source 1..1389: mol_type = other RNA; note = synthetic construct
atgactactagagaaccaagctatcgcgagtggatcgctagaggtctggcgcacgccctgttagcagatgccaggcagccaggtggaactactccggatgcgctccgtgcgagggctgaagctgctttgggggccaatccaccttggttaacattgttggcagaagatctgggcaagcgcagtctagctacctgggagcggaccgatctccctggcctgacacaggcgatcttggagacacctgcactggagctcgcctttgagcaagacgaaccgccgcggattcgcaggctgatcctaagacccgccgacatgtttcccagacccatggggctcgaccacttcgccctgccacgtctgcccacctttgcaaaccttgcccaatggttagagatagaaccggatagactcgcttggctgaccgccgcctctcaagccttccgagcaccagatgcatccagcccaagacccgcctcgcattacagatatcagctgcagcctaagcggctgggcggacttcggctgctggagatacccaaagctgacctcaagaggctccagcgacggattctcgacgatctgttgcagcgcgtcccagctcacgaagcggctcatggattcgtgcaggaacgctctgtggcatcccacgctgccgcccatgtagggcaagaggttgtgattggattcgacttgcgagacttcttccctagcgtccgtgccagccgggttcatgcactgtggaggaccttgggctaccccgatggagttgctcgtgctctaacagcactctgcacgcatcgcacatccgcggccgtcatcgaaaggcttcgggatgacggtgggctcgattggatgggcgcaaagaggcttgccgagccacatctgccccagggatccccttgtagtcctgcactggcgaatctatgcgcctttagacttgaccttagactggagggactggcttgggcattcggcgctacgtatacccggtacgccgacgatcttgtgttttcaggccccgccacactcagggagcagtttaacgccttacgagcttgggtggacgggattgctgcagatgagggttttgccttacacccaagaaaagtgaggtgcatgccacggcaccatcagcagcgcgtgactggcgttattgtcaacgaaaaggcaaataccccccgcgtggacttcgacaggctgaaggctgtgcttcaccagtgtgtgctgcacgggcccgcctctcaaaatagagccaaagtcaccgacttccgaggtcacctcctgggccacatcgcctggatcggccagtttaaccctgccaggaaagcacggctgatgcgcctgttcgaacgaatcgagtggcctgccgtatcacagcctcccgggtga

SEQ ID NO: 12673 - RNA, 1509 nt, unidentified
  source 1..1509: mol_type = other RNA; note = synthetic construct
atggcctcacacagcggcgctcaggctgctcttaggatccgcgcagaccagcttgcgcatcaccggcttgttgaaggtcccggcgcaactaccttcatcggattcgctgcaagtggcttcatgacccgggagctgagctaccgggagtggattgcgcgctctttagctagagccctgctggccgacgccaagcaacctggtggcactgatcctggagctttgcgtgcaagagccgcagctacattgggtgccgacgcaccatggctgaagccactcgcccaggccttagggaatcggtcccaggctacatggcgaaggaccgatctacctgcccttgcccgcgccatacatgatatgcctgaatttgacgcagccttcgagcagaatgaacctcctagagtgcgccgcattattctgcggcccgcccagatgctgccaagaccaatgggactggatcactttgcactcccccacatcccgacgcttgccgagttagctcagtggctagagctggatgccgacaggctggcatggctgacgtcggctgcgcaagcgtttcgagcccctacagaccccgacactaggcagcccgcatcccactaccggtaccagctgcaacccaaaaggctgggcggcatgcggttgctggagattccgaaggccgacctcaaacgtgcacagcgcagaatcctggatgatctactgagacatgttcccgcccatgaggcggtacatggattcgtcctgggtagatctgtagcaagccatgccgctgctcacgctggcaaggaagtggtgattgggttcgacctgcgtgacttctttcccgggataagggcatctcgcgtccacgcaacctggagaaccctgggttatcccgaaggggtggcacgggcccttacagcactgtgtacacatcgcaccgacgatgccgtgatcgaacggctcagggatgacggcgggctggattggatcggcgctcgaagacttgccgctccacaccttccacagggctccccttgcagccctgccttagccaacctctgcgctttccgactcgacctccgattggagggactggcctgggtgtttggggcctcctatacccgctatgcagatgatctcgttttttcaggaccagcctctttgcgtgcgcagtttaacgctctaagggcctgggtgagcgggatcgctgctgatgagggcttcgaactgcacccaaggaaaattagatgcatgccgcgacacaggcaacaacgggtcaccggcgtggtcgtcaatgacaaagctaacactccaagggaggactttgaccggctgaaagccgtgctccacagatgtgcaacacaggggcccgcgtcccagaacagagcgaaggttgatgatttccggggacatttgttgggatcaatagcctggattggacagttcagtgctacccgcaagactcgtctcatgagactctttgacaggatcgactggacagatgccactcaaacgccgagttga

SEQ ID NO: 12674 - RNA, 1365 nt, unidentified
  source 1..1365: mol_type = other RNA; note = synthetic construct
atgtccagatccttggccagagcactgctcgctgatgccaggcaacccgggggtacagcaccaggagcattgcgagctagagcagcggctactctgggggccgatgctccttggctcaaggctttcgccgaggctttaggacagaggagccaggcaacgtggcagcgcactgacttgccagccttagcccgcgctatcgacgatatgcctgcgttcgatgcggcattcgcacaggacgaagccccccgagttcggaggataatcctcagatctgcagaaatgttccctcgcccactgggtctggaccactttgctctgccacgaattcccaccctagctgagctggcccagtggctcgagctggatgcggaaagactggcctggctcacaagcccggcccaagcattaagaacttcgcacgagcatgatgcgcctgggactgctcccgccagtcactaccgatatcagctgcagccgaaacggctcggtggccttcggctgctggaaatccccaaggccgatttgaagcgcgcccgtagacggattttggacgacctcctgcaacacgtgcccgtgcacgaggcagcacatgggttcgtgcaggggcgttcagttgccagtcacgctgctgcacacgcggccaaagaggtggttattggctttgaccttagggatttcttccccgccgtccgcgcatcaagagttcacgcgacctggcgaaccttgggttatccagatggcgtcgcgagggccttaactgccctctgtacccaccgtacgggcgctgcagtgatcgagcggctgagagacgacggcggacttgactggatgggcgccaaaaggctggctgctccccatctacctcaggggtccccatgcagccctgctctggctaacctgtgtgccttccggcttgacctgagactggagggtctggcctgggtctttggcgccacctacacaaggtacgctgacgatctcgtgttttcaggacctgccagcctaagggcgaggttcacagccctacgcacatgggtgggagggatagccgccgacgaaggctttgaactgcatccgagaaaggtcaggtgcatgccgcagcatcggcagcaacgggtaaccggagtcgtggtgaacgataaagcaaatgcccctcgtgaagagttcgaccgcctcaaggctacccttcatcgctgcgctcttcatggacccgccggccaaaaccgcgctcaggtaccagattttcgagcacatttgctcggacggatggcatgggtgggccagtttaatccagcccggcacgcaaggcttctgcggatttttgagcgcatcgcctggccctctgcctctcctacaccatcctga

SEQ ID NO: 12675 - RNA, 1383 nt, unidentified
  source 1..1383: mol_type = other RNA; note = synthetic construct
atgacacgggaacccaactatagggaatggatcgctaggagccttgcaagggccttacttgcagatgcgcggcaacccggtggtacagctccaggagctttaagagctcgagcggccgctactttaggttccgatgcaccctggcttgcaccgctgattgaggcactagctcgccgctctcctgccacctggagacgaactgacttgccagcgttggcgcaggccatccacgacctcccagagtttgacgccgcattcgagcaggatgagccacccagggttcgtcggataattctccgacccgcccaaatgtttccgcgccctctcggccttgatcacttggcccttccggcactgcccacccaagctgagctcgcaagatggttggacctggatccacagagactggaatggctggcaagcccagcgcaagccttcaggacgccccaaggaacctcccctgctcctgccagacactacagataccagctacagccaaaacgcttagggggtctgcgattgctagagatccccaggccagagctgaagagagcgcagagggggatcctcgacgcactgttggccagggtaccggtgcacgaagctgcccacgggtttgtgcctggccggagtgttgctagccatgcggctgcccacgcaggaaaggctgtcgtaatcggcttcgacctgcgtgacttcttcgccggggtacgcgccagcagagttcatgccacttggagaacactgggctaccctgacggagtggcacggactctgactgccctgtgtacccatcggacagatgccgcagtgatagagcgcctgcgtgacgacggcggcttggatctcatggggggtaagagattggctgaagcacacctccctcaggggtcgccttgttccccagctctcgctaacctgtgcgctttccggctcgatcttcggctggaagggctggcttgggtgtttggcgccacctatacgagatatgctgacgacctggtcttttcaggcgacgagtctcttaggctgaggttcgacgcccttcgagcctgggtgggaggcattgctgccgatgaaggatttgagctgcacccccgcaaactgcgttgcatgccccggcatcgacagcagagagtcaccggggtcgtggtgaacgatcggcccaatgcacctagagcagatttcgatcggctgcgcgcactgctccatcagtgcaccctccatggccccgccagtcaaaatgccgctggtctggccgatttccgcggacacctcttaggccgcatcgcctggttcggccagttttcaccaacacgtcaggcccggctgaggaggctatttgacaggattgaatggcctgcgggagccgccccagcctaa

SEQ ID NO: 12676 - RNA, 1425 nt, unidentified
  source 1..1425: mol_type = other RNA; note = synthetic construct
atgcgtgaaacccggtttcggcacctgatcgcaaggggactggcccgagctctccttgctgacgccggtaagcctggcgggacagcattgcctgccttgcaagccagagcagctgcagcactgggccaaaggcctgcctggttgcgagaacttctgcagcccctgactctgctctcccccatcacttggcagaagttcgatatcacgagtctggctcgccgcctggaggattcaccggctttcggactcgcctttggggatgaggacgatgacgaagatgaggacggtgaagccgatagttcagagccacaggcgtcccaagcaatcgatgaccgcgatgatcccgaacctgaaaggcccccccgaatccggcggcttattctaaggccccccgctatgaggccaagaccacttggactacaggcctgtaccctcccagatattaccaccgacgccgacctggcgagatggctacagctgtcccgagagcagcttaggtggttagcacccgccaccaggcctgtggtcgaacattataggtacagccttcaggcaaaacaggctgggggtctgcgcctgttggagacaccaaaggtcgagctcaaaagagtgcagcgccatatccttcacgccttattgtccgaggtgcctgttcacgaggctgcccatggctttactgcggggagatctgtgaagacacatgcagccgcccacgtaggtcaagccgtggtgattagattcgacctgcgggacttttttggttctattggagcggctcaggtcaacgcggtttggcgaacactggggtatccagaaggggtggcacgcagtctcacagccctgtgcacacaccacactgccggcatggtgatcgaacggttgcgggacgacggcggattagactggatgggagctaagagactcgcaagcgcccatttaccacagggggccccgacttcacccgcacttgctaacctttgcgcgttcaacctggacctgcgtctcgagggattggcctgggtgttcggcgcttcttacacccgatacgcagacgacctggtgtttagcggacctgcttcgctccggttgcagtttagggctctccacgcttgggtagccgagatagtccgggatgagggcttcgcactccacccggataagaccaggtgtctgcctcggcatcagcgccaacgggttacgggggtggtggtaaatgtccgcccaaatgttcctagggatgacttcgacagattaaaagcctgcctgcatcaaagcgcgctgcacggccaggcctctcagaataaagagagactggccgattttagatcccacctcctaggccgcattggctgggtcggccagttcagcatgacccgtcaggcccgtctgatgagactgttcgacaaaatagattgggctaactga

SEQ ID NO: 12677 - RNA, 1389 nt, unidentified
  source 1..1389: mol_type = other RNA; note = synthetic construct
atgcgcgatatctcatatcgcacatggattgctaggagcttggctcgcgccatgctggcggactcagatcaacctggcgggacttcggctgccgcattgcaagctagagcggcggctaccctcggcgataacccagcttggctgcacacagtcgtggcacccttagcccagcttcccgccgtatcttggcagaagatggatctcgactctctaacccaacgaatattggcacctgcccctcggcagccaaccgtagttgacgacgagaatgatgacgaagagatccaagccgagagtccttttgacgccgcgtttgccaatggcgcacgtccacacattcggcggctcatcttgcgccccgcatccatgcaacccaggcccttgggtctggaaggctgtgaactgccagacctgccaacggtacatgacctggctgagtggctcaagatgccgctggatagactggcatggctgggacctgaaaccccattgggagcagagcactatcggtacaaacttctccccaaaaggaccggcggcttacgactgttagaaatcccgaaagtcgacctaaagcaggtgcagagggccgtttatagcggactgctccagcatgtgccagtccacgaagccgcacatggctttgtgcccggcagatctgtggctactcatgctgccatgcacgccgggcaagccgttgtgatcaggttcgacctgagggattttttcggaggtataggggccgctcgagtcatggctctgtggcgtactcttggctaccccatcggggtggctagatgcctgaccgcactgtgtactcacagaactgccagaatggttgtggatcggctgcgggacgatggaggtctggactggcttggcgccaaaaggctgaggtccgcccatcttcctcagggtgcaccgacaagcccaacacttgcaaacttgtgcgcgtttggacttgacctcagattggatgggctagcgtgggcgttcggagctcgctacacgagatacgccgatgacctggtgttctccggaccggctgcactacgcccccagttcagagctctccaggcttgggtcgccgctattgcagaggatgaggggttcgccctgcaccctgccaagaaccgatgtctgcctcagcaccggcagcagcgcattaccggggtcgtggttaatgcccagcctaacacaccacgccaggactttgacaggctcaaggcatgcctgcaccagtgcgtgcatcagggtcccgctagtcagaaccacgccaatctcgtggatttccgagggcatctccagggccgtattggctgggtcgggcagtttaatgccgcacgggccgccaagctgatgggattattcgagcaaatcaggtggtga

SEQ ID NO: 12678 - RNA, 1359 nt, unidentified
  source 1..1359: mol_type = other RNA; note = synthetic construct
atgccaccctccacccacagactgtggattgcccgcggtcttgcacacgctcttcaggcggattgtcaacagccgggtgggacggaagctcacgcgttactcgcaagagccaccagggcattgggacacaggccaccctggcttccaccagtgatcgaagccttaggagccgctgccgtgcggaggttggacttacagggcctcagcgaacggatcgctggactgcccgcatttgacgcagcctttgctccaggccaacctgcgccacgcattaggcggctaatgctaagaccgccacacatggccggtgcccccttaggactccatgaggcccccctgcccgcgttaactacacacgaggctctgggcgattggctagggcttgcccccgagagactggcatggctcgtgagtgaggcccagcactaccgcgaacctcctggtggaagacctggtgcagcccggcattatcacgcgcttctcagacccaagagacttggcgggctgagactcatcgaagccccaaaggccgagctcaaactggcccagaggcgattgctggacgggttgctcaatgccgttccggtgcacgaagccgctcagggatttgtgccgggtcgcagcgttcgagcccatgcacaggctcatgctggggcgccagttgtactgcggttcgatctgcaggatttcttccctagtgtgcctgcttcccgcgtccatgccatctggcgcaccttggggtaccctgctggagttgcacgcgccctgacagccttgtgtaccacaaggactcccgctgctgtgagagctaggctgcgggaggcaggcgctatagacggaggtggggcacaaaggctagcggctgcacacctgccccaaggagctcctacgtctcctgcgcttgccaacctgtgttgttttcgcctggatctccgtttagccggactggcagctcattggggagcccgatataccaggtacgcagacgacctggtcttctctggacccgccgtcttacgggagcggagactggctctgacatcatgggtaggcggcatttgcgcagacgaaggcttcaccctccatgccagaaaaactcgctgcatgcctcaacaccgtcagcagtgcatcactggcgtcgtcgtgaaccagcatcccaacctgccacgggatgagtttgaccgactcaaggcgtgcttgcatcgacggctcttgcacggcgccacagatgccgctgaaagggaggcactccgtggccgtattgcatgggccgcccagttgaatcctgcaaggggggagaaacttctggctctgttcgcccagatacgatggccacagcctggatcagtgcccgggtga

SEQ ID NO: 12679 - RNA, 1341 nt, unidentified
  source 1..1341: mol_type = other RNA; note = synthetic construct
atgagatcgtggacttatagggagtggatcgctcgcgggatcgccagagccttacttgcgggcgatgaccgaagtatgcctgcactccgctcacgtgctgctcaagctctcggaggcagccccccttggctaggacactttctggggcgactcaaatccatggatgcgggaatctgggcccgcacagacttggatgcactgacatggcggctgctccgcggagaaacactgtcacgggccgtgggcgctgaagatcgaccaaggattcggaggctgatgcttgccagccccgtcatgttgcctccacccatgggcctggatgtgctgggcttacctgcactccccaccaccggcgacttggcagactggctgggacttactgtagaccggctcgattggttagccggcgagcagctagattggagggaagacgcgcgccgcgccagacattatgtactccacgcatcacctaagtccgctgggggtctgcgactgatcgagagccctaaaccagagctgaagcgtgcacagagacggctactggcgggtttgctcgaccgggtccctgtccatgaggggtgtcacggcttcgtgagaggccgtggagttcggtcccacgcccaagtacatgctggacaggcactcgtgctgcgactcgaccttcaggacttcttcccgtgtgtgagggccgctcaggttagggccgtgtggagaaccctgggataccccagggaggttgcggaggtgctgactagactttgcacgacaagagcgtgcgcagccgaccttaggcccctaagagctgccggcagactggaatggaccgccgctaaacgctacgcagccaggcatttgcctcagggggctccaaccagccccatgctggctaacttgtgtgcgtttgatctggatctcaggctggatgggttggctcaagctttcggaggtgaatacagtcgttacgccgacgacctcgcattctctttcgctcaaccacttggtggtcgccaggccgcctttcatgcatgggtggcagccattgccaaggacgagggttggtctttacacccacagaagtctcgagcaatgccggccggcgcacaacagagagtgactggcctggttgtcaacgaaaagccgcgcccagctagggtggattatgaccggctgaaggccgtgctacaccagtgcaccctgcatgggcccgccagtcagaatcacgcccaggtcgaagattttcgggcccacttgcttgggcgcattgcctggattgctcagggctccgaggcacgggctaggaaactgcaggccctgtttgagcggatagcctggacggggtga

SEQ ID NO: 12680 - RNA, 1206 nt, unidentified
  source 1..1206: mol_type = other RNA; note = synthetic construct
atggcccagcggtgcgctgatatgcccggtgagagatggcgtcggctgaccgttagaagccttgcgacctggattgagcaggacggccactacgacgatgggtggcgtgctcacgagaaaccgcatgcccgccgttatattcttcgggaagcggccgtaatgcagcctcttccagtcggcttggagcagtgtcaggtcccatattggcctcacgtcggagcattagcagactggctaggagtgcccgcagccggtttatggagactcactcgagcacctcagtggcagaggcaagcccccctaggggagcaacattatcacgcccaacttctggccaagaggaccgggggctggagactgctcgaagttcccgctccccacctgatgccgctgcagagaagagtactcgatgacctgctggatagaatcccaccacatgaagccgcacacggatacacccgggaaaggtctgctcgtagtcacgctgccgcacataccggtcaggccgtggtgctcaaattcgatcttcaggattttttcaccaccgttcggccaagcagggtgtctgctctgtttgccaagctgggctacagtgaggaagtggctcgggcactcacagcactgtgcacgacagccacccccgagcctgtgttgcggaggatgcatgaggcggggcagctgacatgggaacagctacagagactccgcgaatcccacctgccccaaggagctccaacatcccctgccctggcaaatttgtgtgcgttccggctcgatctgcgattggacggcttagcttttgctctgggggcccgctatactcgctacgccgacgatttggtattctcaggacccactcatctcgccactgcacgcgagcgaataacggccaggataactcgaattgtcgtggaggagggattttccctgaacacacgcaaaacaaggtgtcagaaggccggtggccggcaaagcgtctgccacatcgttgtcaatgaacgacctaatctgccacgagacgagtttgataggttgaaggcaatcttacacctctgcgtgcgggacggagcctcaagacagaacagggatgctcatcctgactggcaagcgcatcttcgcgggagagtggcctgggctactcagctgaacccggctaaaggcctccgcctgaagagggtgttcgaccgcatcgactggggcgtgtga

SEQ ID NO: 12681 - RNA, 1335 nt, unidentified
  source 1..1335: mol_type = other RNA; note = synthetic construct
atggcctccctagtgcgtctcacagcgctagctctggcccgagcgctccaagtaggacagcggactcctgacggaatggcagctaggatccgagcctgtctgggggctgaagcaagctggtgtggcccgctggtcgaaaggtgcgcagctatggccggggagaggtggagacggctgagtgtgcggagcttggccgatcttatagagcgcgaccagggcttccacttcgcctggattgcccacgagccgccctgtgtccgtaggtacctgctgcgggaagccgacagaatgaacccattacctctcggcctcgacagatgccaggtgccattttggccccatgcaggagctctcgcagcctggttgggaataggcacaggcggactgtggcgtctgactagaccctctgactggcaacggaggacccctatggtggagcagcattacaggtcacacctgcgaccgaaacggacgggtggttggcgccttctggaggtgcctgaaccttacctaatgcctctccagcgccgagtgctggatgatctgctcgatcgcattcccccacatgaagcggctcacgggtatacccgggaacggtcggtgatcgatcacgctcggcgccattgtggacaggccgtcgtactgcgctttgacctcaaggatttttttacagccgttaaggcctccagagtgcacgccttgttcacaacccttggctaccctgaagaagttgcgcgagccctgaccgccttgtgcaccgttgctactccagagccagctctgcgcagacttagagctgaggggggtatggattgggagcaggttcagcggttgagggatccccaccttccccaaggcgctcctaccagtccagccctcgcaaatctgtgcgcttttgggctggacgtgaggttagcccatctcgccacctcactcggagccaggtattcccgctatgcagacgacttggtcttaagcggccccgcccgcttgagaactgcattcgctaggattgagcgtcacgtgtctcggatcgtcatcgaggaaggatttgcactgaaccctaggaagacacgctgtactggggcaggcagaagacagacggtctgccatgttgtggtcaacgatcgacccaacctgccacgcgacgagttcgacaggctaaaagcaattttacaccagtgcgtacgagatggcccagcgacccaaaatcgggagaatcggcccgattggagggcccatcttcgtgggagagtggcttgggcaacacagctgaatgctgcaaaaggtgccagactggcgagacttttcgagaggatcgactgggccgcttga

SEQ ID NO: 12682 - RNA, 1305 nt, unidentified
  source 1..1305: mol_type = other RNA; note = synthetic construct
atggccagggctatgcaagccggtccgagaacccctcagggcttagctgctaggatgcgggcatgtctgggctgtgcagagcacccttggatcaccgctctgagtgcccggtgcgctcgaatggcagccgaaagatggcagaggctctctgcacgggcacttgccgggctgattgaaagggacgcaggcttcgagcatgcgtggcaacaggaccccaggcctttcgtgcggagatatatcctgaggcctgggggacatttgcgcacagctccgctgggcctggataccgtggaaagacccgcctggacggacgaagctgctcttgcacagggattaggtctgagcgacgctgctttgtggcgtctgactctgccaacaccctggcagagagcggctcccctctctcagcagcactacgcttggaggtggcaactgaagcgccacggcggatggaggccgttagaggtgccagctgcctatctccgagccgctcagcgcaagttgctcaagcatctgctggatggcatcccaccccatgagaaagtgtatggttttgttagaggacgctcagtcatagatcacgcccaggtacacactggccagccagtggtcatcaagtttgatctccaggacttcttcacctccatcaaggcgtcaagagtgcatgcgttgtggaccacacttgggtatcccgagactgtggccacactgcttacccgcctgtgcactgtggcaacccccgaacctgtcctacaacggtggagacaagaaggtggggcgacgtggcaccaagtgctcagggctcgggagcctcacctacctcagggagccccaaccagtccagcactggcgaatctgtccgcctttcggttggaccttcgactggatggcctggcacaagcctacggagcccggtacagtcgctacgccgatgacgtcgtcattagcgggccaagggccttgttagcagccagaggcagactggaggctgctgttcaggggattgttgaagcagaggggttcgccctcaaccagcggaaaacacggtgcgaaactcaggcctcccgtcagacagtctgccatatcgtggtgaaccagcgccccaacgtagcccgcagcgagtttgaccgcctcaaggccatactacacggctgtcttagggaggggccctctgcccacaatcgagcaggattggccgactggcgtgcacatctccatggtcgagtagcatgggttgcccagctcaatcctgccaaagcgaaacgtctgcaggccatgcttcagcacattgattgggctctgtga

SEQ ID NO: 12683 - RNA, 1251 nt, unidentified
  source 1..1251: mol_type = other RNA; note = synthetic construct
atgcatgcatgccttgataataaaccctcgtggtgtaagccgctcgcagaacggtgcgcacagatgcctagggaaagatggcgccgactctccgtacggaccttggcctctctcatcgaggaggacataggatttgctcatgcctggctggcccatcagaaacctggcgttaggaggtacatcctgagagtgaggcaggggatggggtcactccccttaggtctacaccgttgtcagctgccctactggccaaataccggcattcttggcccttggctgggcgtctctgctggaagcatgtggcggttgactagaccatctgcctggcaacggcgcatgcctctgggagaacagcattatcggtgtctgcttctgcccaagcgtacaggtggttggcgattgctggaagtgccccatccgtacctcatgcggctgcagagacagctcctggaccacttgctcgacaggattccagcccacgaagctgcgcatggatatgtcagagagcgctcagtggtgcaccatgcccaagctcacgcggggcaagcagtgattctgaagttcgatctgcaggacttcttcacaagtgttcgcgccagccgggtgcacgccttattccacacccttggctatcccgacagcgtcgccagagagctcacagcactgtgtaccactgctacacctgagccggtcttgaggcgcctgcaccaagagggacagctaccttggcaccgactgcagcagctccgagaaccccatttaccacagggcgcaccaagctcacccgcgttagctaacctctgtgcctttagacttgatctgcgcctagacggcctggcacacgctctggatgctcggtacacgagatacgctgatgatattgttataagcggtggaaccgggctgcgcgccagttatcagcggatcgcccaatgggtggccagaatcgcctccgaagagggctttgcattaaatttccgcaaatctaggtgccagacgatcgggagtagacagactgtatgcaatatcgtggtcaatcaacaccctaacctacttcgggaggagtttgacaggctcaaggctatccttcataactgcgtgaggcacggaccagcgtcccagaaccgtgatgcccaccctcagtggcagatgcatctgaaagggcgcttggactgggcctcccaattgaacccaggcaaggcagagaggctgcagcgactgtacgctcgtattgactggaagcagccctga

SEQ ID NO: 12684 - RNA, 1344 nt, unidentified
  source 1..1344: mol_type = other RNA; note = synthetic construct
atgacaagcgtgagaaggttcaccgccctggccatggcaagggcgatgatggcgggtcccccaagagtcgatggactcgccgctagattgcaggcctgcctcggtcggaaggcagcttggtacagaagcctggccgagagggttgcccaacttcccggggagcattggagggcagccacaccacaagccctcaatcgactcgccgacctcgtggaggccgacgattcctttgaggcagcttggttagcccatgaacgcccccaggtgcggcactatttcctcgagttacccggtggtatgcagccccggccattgggacttgacgaactcgagctgccagattggcccgacgtccctgcactgtctagatggttggggatacctgccgcgggtttatggcgcctgactctcgcccgggagagacaaaggaaacagcctctgggacagcaacactatcgctcgcagttgctacctaagcgctccgggggattccgactgctggaagtgcctgaaccgtaccttatggcgctgcagaggaagcttctggacgctgtgctaaaccgagtcccaccgcacgaggcagcatgtgggtatactcccggccgtagtgtgctcgaccacgcaagagctcacgccggccaagctgtggtgctgaagttcgacctgcaggacttttttgctagtgtacgtcatagccgcgtccacgcgctgttcgcaacgcttggctatcccgctgccgtggcaagggctcttgctgctctttgtacagtcgccaccccagagcctgttctgcatagacggcaccaggccgggtcactgtcttggccacagttgcaacgtctgcgcgacgcccatttgccacagggtgctcctacctctgctgccctggcaaacctgtgcgcttttagactcgacctccgcctcgatggcctggcatttgccttgggagcaaggtacactcgatacgcggatgatctcgtcatttccggtggggccgaactagggggtcttgctgagagggtggaacgatgggtgggacgcatcgccttagaggagggcctggccttaaaccatcggaaaacccgatgtcaaacagccgggcgtcgccagtcagtttgcagcatcgttgtgaaccagaggccgaatctgccccgggatgaattcgatagattgaaggccgtactgcatcagtgcgtaaccgctggccctgcagcccagaatagggaaggccacgctgattggcggggccacttgcagggacgggttgcttgggctgcacagctgaatcctgccaaagcggccaaactgcagggactgctagcacagattgactgggcgcggtga

SEQ ID NO: 12685 - RNA, 1338 nt, unidentified
  source 1..1338: mol_type = other RNA; note = synthetic construct
atgcctagcatccagcgagttactgctctggcgatcgcccgcgcgttattagccggtccacaggaaccaggagggctggcagccagggtcagactctgcctagggacaggggcctgcgactggcatggcgaactggctgccaggattgccaagttgtcggccctccattggcagtacctgaccccgcgggccttggcaagactggtggagatcgacccaggatatcagcacgcctggattagcgatgaacgccccactgctcaccggtggattctaagggaagctcaaggacctaggcccgcaccactcggacttgagaggatacaacgccccgcctggcctcatgctggtgctcttgcagcttttctcggaatgcctatcgaggggctgtggagattgacgcttcccgccgatcgccagaggagacgacccctagccgagcagcactatcggtgcaggttactggcaaaaagatccggcggcatgcggctgcttgaagttccggagccgcacttgatggcagtccagcggcgcctgttggacgcgttgctggattttgtgccaccccacgaagccgctttcggtcacgcccgtgggaggagtgtagtggaccatgctgccgcacatgctggccaggccgtagtcctgaaattcgacctgcgcgacttttactcaagtgtgcgggcctccagagtgcatgcactttttgcaaccctcggctattctgatgaagttgcccgagcactgaccgcgctcacaacagtggccaccccagaagcagttctccgacgcttacgggaggcgggttcactcacgtgggaacaactgcagcgtcttagggatccccacctgccacaaggggcgcctacttctgccgctttagctaacctctgcgccttcggcctggatctcaggctggacggactcgcctacgctctgggagccagatacaccagatatgccgacgatctcgtgcttagcggcggtcctgagcttgcccgatggagagatcggattgagagatgggtgggcagaatagctcgtgaggagggattcgcgctaaaccaccggaagactcgttgtcaaagaagcggcgctcgccagacagtgtgttctatcgtagtgaatgccaagcccaatctgcctcgtgctgaatttgatcgcttgaaggcaatcctgcacaggtgtgtcgtcgacgggcctgcagcacagaatcgcgacggcattgagaggtggcgggagcatctggcaggtcggatagcttgggccgctcagctgaacgctgccaaagcggcaaggctgcagtccctgttcgcccgaatcgactgggagcgatga

SEQ ID NO: 12686 - RNA, 1314 nt, unidentified
  source 1..1314: mol_type = other RNA; note = synthetic construct
atgtcccacaggaccaccgctattgcaattgctcgcgccgtcctagccactcctgtctcacggtcccagatccttgagagaatggcacgctgtacaggcttttctgaggcaaccgaccgagccctcgtggacggtcttctcgaggctgggctggccagccattggactattgctcaggtggcagacgcccttggggcggatcctttcttccaggccacctgccaagagactcgccatcgcccactgatccgcggttggttcatgacacgcgcctctaccttggcagcaccgccagtgccgttaagggccgtagaacggcctgcatggccaggagttggacatctggccgatgacctgggcgtatccgccgaaggcttgtggcgcttgacaagatcggccagctggcaaagacaggctccattggccctgcagcactacaggtatgaactcctgcccaaaaggacagggggttggcgtctcctggaggtgcctgagccttacttgcgaacgctacagcggagagtgctggacaggctactggcacatgtcccccctcacgaggctgcatgcgcctatgtccgtggacggtctgtggccgaccatgccagagcccacgtcggtcaggcagtgctgcttaagtttgaccttcaagactttttcgctaccgttcgggcgagccgtgttcaggctaccttcgccaccttaggctactcacagccggtggccagagccctcgcaagactgtgcacgactgccacacctgagcccgtcttagaacgactgcggatcgaagggggactggcctggacacaagcaatgcgcctcagagatgcccacctaccccagggagcgcccactagtgctgcgttagccaacctgtgtgccttccggctcgacgtgaggatagcagctttggctcggactcttggggcccgctataccaggtacgctgacgatatagtcctcagtggggatgcaggccttttgcgggctgcggatcacgttgaagcccggctgggcgcttttgccctggatgagggctttgcactgaatcacagaaagactaggcgagtgacccgagcgaggagacagcaggtatgtaacatcgtggtgaatgctagacccaatctgccccgcgatgaattcgacaggctcaaagcccagctgcatctgtgcgcaacaagaggagctgccgctcagaaccgtgccggactgccagattgggagcaacacctcaggggcagggttgcatgggctgaaaccgtgcgagcggcatgtcgggagttttggacggcggatgctggcacaccatga

SEQ ID NO: 12687 - RNA, 1311 nt, unidentified
  source 1..1311: mol_type = other RNA; note = synthetic construct
atggggcatgcaaggatgatgacagctagggcgttagcgcatgcaatgctggccggcgccccaagagaagaagcccttgcggcccgtatggcagcatgccttgacgccagaccaccctggctagcggacttagcacgtgccatggctcgcgttccgggggaagtttggcagcgcctcgacgtagcagctctaggagagcgcgtggaggctcacgcagggtttgccgatgcatgggtgagcgatgctcgccctgatgcgcgacggtggttgctgagaagtccggaagatctccctcccgctccagccggtttagcacgtcctcactggcctacggtgggcaccttggctagggggttgggactgactcctgccgggctgtggcgactcacattgccagctgactggcaacgaagacgccccctggcacaccagcattataggcagcaactggtgcctaagcgctctgaaggttggcggctactcgaggtcccagcccctcatctgagggctatccagcggcggcttctcgcgcagttattatccggcttgcccccgcatgacgccgcttttggatacacccctggccgatccgtggtagagcacgccatgcgtcacgccggacaagccagagtgctgcgcctcgacctgtcagatttcttcagcactgtcagggccgctagggtgcatgccctgttcagaacactcgggtattctgctgccgtcgccagggctttgactgcactttgtacaaccgctacgcccgaggcttggttaagggccgagcccagactggcctttctccagagacagcggttgcgcgacccacacttgccccaaggtgcacccacaagccctgcagttgccaatctgtgcgctttcgccctggacgcccgacttaccggcttagctgaggcctttggtgccagatactcgcgatacgctgatgatctcgtcttttcaggccccgcatccctaccagtccgcactctggtggcctgggtaaccgccatcgccgaagacgaaggcttcgccgtgaacccgaacaaaaccagggcacagggagtggcgcagagacagagtgtgtgcgggatagtagttaatgagcggccaaacctgccccgcgacgcatttgatcggctgaaggccactctgcaccggtgtgtggttgatggcccagccggacaaaatcgggagggccacgcagatttcagagcgcaccttcagggaagggtcgcatgggccgctcagctcaaccctgcgaaagctcggaagctgcaggctcttttcgaccggattgactggagggcttga

SEQ ID NO: 12688 - RNA, 1317 nt, unidentified
  source 1..1317: mol_type = other RNA; note = synthetic construct
atggacgctgcacgaactacgaccgccagggccttggcaagagcaatgctggcgggacctcacgaagccggtggactagcagccaggatggccgcttgcttggacgccagaccaccatggttggctgctcttgccgaggccatggcaagggtgcctggcgaagtttggcgcaggcttgacgtggcaactttagcaagacgggtcgatgcccacgacggctttgcggaggcctggttctcggctgcacgtccagaggccagacgatggctgttaagagcaccagatgcacctgcaccagcccctgctggactggaaagaccagattggcctacggtaggagcgttggccagagggcttggaatgacccccgcaggcctttggcgactgactctgcccaccgattggcagagatgccggccgctcgcacaacaacactaccgccaggccctgattcctaaacgtggggaaggcgcggggtggagactccttgaggtgcctgagccccatctccgcgctgtccagaggagactgctggcacagctcctcaatggcttgcccccacatgacgccgccttcggatacgccaggggtaggtcagtggtccagcacgctgccaggcatgtcggtcagggacgggtgttacggtttgatctgggggatttcttctcaaccgttagggcggcccgcgtacacgctttgtttaaaactctgggctattccacagctgttgctagggccctgaccgcgctctgtaccactgccacacccgaggcttggctgagagctgaaccccgcctgggttggctccaacgccaacgtctacgggacccccatctcccccaaggtgcaccaacatctccggctgtggcaaacctctgcgcttttgccctggatgcacggctgacaggactggctgaacgcttcggggcccgctattctcgatacgctgacgatttagtgattagcggacctgcggccctcccagtacgtagtgtgggtgcctgggtcgctgctatcgccgaggacgaagggttcgtcgtgaacccgcgaaagacacgcagccttggcatagcccagcggcagtccgtgtgtgggattgtggtgaacgaccggcccaacctgcctcgcgatgagtttgatcggctgaaagccgtcttgcatcggtgtgttgtggacggccctgctgggcagaatcgggatggccacgctgactttcgaaggcacctgcagggcagagttgcctgggccacccagcttaatccgggcaaggccgagaagctgaaggcgctgctagacaggatcacatggcccggctga

SEQ ID NO: 12689 - RNA, 1317 nt, unidentified
  source 1..1317: mol_type = other RNA; note = synthetic construct
atggatcacgctcgccgtatgacagctcgtgcactggcgcgggccatgttagcaggtgcgagacgcgaagacgcgcttgcagcccgtatggcagcttgtctggatgagtccccgccttggttggcgggattagccgcagccatggcacggatgcccggagaagtatggaggcgcctggacgtggatgcccttgctgctcgcgtggaagcgcatgaaggcttccttgaggcttggtgcggcgatggaagaccggaggcacgtaggtggctgttacgccctccacaggagcctggtgcagcaccagccggtctggaaagacctcactggccgaccgttggggcactagccagagggttggggatgactcccgcgggactgtggaggctgactctgccagctgattggcagagaaggaggcccctggcccgacaacactacacccagaggctgtgccctaaacgaggtgacggggcaggctggcgacttctcgaggtacccgctccccatttgcgcgccgtgcagagacgcctgttgacccagctactggacgggttaccccctcacgaggctgcgttcggctttacaagaggccggtccgtcgttcaacacgcagccagacacgtcgggcaaggtcgtgtgctccggtttgacctcgcagatttcttcagtaccgtgagagccgccagagtccacgctctgttcgccacactgggattttcaacggctgtagcccgagcactctccgccctgtgcacaacttctgcccccgaggcctggcttcgccaagaagctcggcttccatggctgcagcggcaaaggctgagggatccccatttgccacagggtgctcccacctcaccagctctggccaacctctgtgcattcgccctcgacgctaggttgagcggactggctgctgcgtttggcgccagatatagccgctacgctgatgacctcgtcatctctgggcccgccgcacttccagttagggctgtttcggcctgggtggccgccattgctgaagacgagggcttcgtggtgaacaggaggaaaactcggagtctaggtgccgcgggacgacaaagcgtttgcggcatcgtggtgaatgagcatccaaacctccctcgggacgcctttgaccgcctcaaggccatactgcaccgctgtgtcgtggatggccctgcagggcagaatagagagggtcgggccgactggcgagctcatctgcagggacgagtcgcttgggccgcccaattgaatcctgcccggggtgcaaggctcaaggccctatttgaccggattgattggcatcggtga

SEQ ID NO: 12690 - RNA, 1299 nt, unidentified
  source 1..1299: mol_type = other RNA; note = synthetic construct
atgaccgctagggcactggctcgggcaatgctcgcaggaccacgggatgccgctgggttagctgcccgtatggcggtgtgcctgggggaaagacctccctggctagccgcgttagcccaggcaatggcgagagttcccgccgaggtttggaggcgtctggaggtcgccacacttgcggagagggtggaggcccacgaaggctttgccgctgcttgggccggagaagctcgtcctcgggctagacactggttgctgcgccctcccgatgagcttgctccagcacctgcaggcctcgagaggcctcactggccaactgtaggcgcactcgcacgcggattggggcttactccggcaggtctttggcgactcacactgcctgttgactggcaacgacggcgaccgctcgttcagcagcattacagacaagccctggtggccaaaaggggtgatggagccggctggcgactgttggaagtgcccgcaccccatcttcgcgctgtccaacgccggctgcttgctcagttgctcgacggactacccccccacgaagcagccttcggttatgccgctggccggtcggtcgtacagcatgctgcacagcatgcaggccaggcgagagtgttacggctggacctgagcgacttcttttccactgtgagggccgcccgcgttcatgctctgttcaagactctggggtactcaaccgctacagccagagcccttacagccctgtgtaccacggcagtcccggaagcatggctcaggggtgagcccagattatcctggccacagcgccaaagactgcgcgatcctcacctgccacaaggcgctcccacctcaccagcgctggctaacctgtgcgcctttggactggacgcccgtttggcaggactagcggcacggctgggtgctaggtacagccgatatgccgatgacctcgtgtttagtggcccagcctctctgccggtgcgacagatcgctgcctgggttagcgctatagcggccgatgaggggttcaccgtcaatcctagaaagaccaggagtctcggggtagcccagagacaggccgtgtgtggcattgtggtgaacgctcaccctaacctacccagggcggagttcgaccggttgaaagccacgctgcacagatgcgtcgtgaacggcccagccggggaaaatagggatgggcacgctgactggcgggcccatttgcagggaagagtggcatgggcagcccagctcaatccagctaaggccggcaaactgtcccgcttactcgcccgcatcgactggtctaggtga

SEQ ID NO: 12691 - RNA, 1293 nt, unidentified
  source 1..1293: mol_type = other RNA; note = synthetic construct
atgacagccagagctttggcccacgcaatgctcgccggacccaggtttgaagctgctctggccgctcggatggcagtgtgcttggacgagcagccgccctggttagccggtctagctagggcaatggcccgggtacctggcgaagtttggcgacggttggacgtccagaccctgggagagagagtggaggcccacgagggtttcgcagaggcgtggttcggggaacatcgtcccgaagcccgacactggctccttcgctcccccgatgagttaccacctgcccccgcaggactcgaaagacctcactggcctactgtgggcgcgttggcaagaggccttgggatgaccccagccgggttatggcggttgacccttccacctgactggcaaagacgcagaccactggcccagcagcactacaggcagcagctgattccaaaaagaagcgctgggtggaggcttcttgaggttcctgcgccgcatctgctcgctgtgcagaggaggctgctgggccagctactgaatggattgccgccccacgccggggcttttggttatgccagaggccgctctgtggtgcaacatgccgccctccacgctggacaaggtcgcgtactgaggttcgacctgtcggatttcttctcaactgtacgcgccagtcgcgttcacgctctctttaagacgctggggtacagtgccgcagtcgctcgtgcactcacggcgttgtgtacaactagcacacccgaagcgtggctacgcgctcaagggcgactcgactggcagcagtgtcagagacttagggatgcacatctcccccagggtgcccctacatccccagctctggcaaacctgtgcgcatttgccttagatgcccggctggccggcttagccgagcaattcggcgctagatactctcgttatgctgacgatctggtcatctcaggtcctgccgctcttcccgtccaggccatcagcgcatgggtggctgcgattgcggccgatgaggggtttgtggtcaatcctcggaaaacccggtccctgggtgtggcacaacgccagagcgtttgtggcatagtcgtgaacacccatccaaacctgccacgggatgaatttgaccgcctcaaggcaactctgcatcggtgcgttgtggatggaccagcctctcagaatagggacggacatgccgactggcgagcacacctgcagggaagggtggcttgggctgcacagctgaaccccgctaaggccgagcgtctcaggaaactgctgggccggatcgactgggcgcgatga

SEQ ID NO: 12692 - RNA, 1344 nt, unidentified
  source 1..1344: mol_type = other RNA; note = synthetic construct
atggcaaggctgtccagattgacagcccttgccctagccagggccctgttagcaggtccccatcaggcacaaggccttgcagcccggatgactaattgtctgggcttagggctcgagccacgcccatggttggaaactctggccctgcgattggctaggatgcccggcgaaagatgggcacgtctggagcccagatctctggccaccctgatagagaaagagcaagcgtttcgggatgcttgcgctagtgcggcacctccccgtccacaacggtatttgctcagaccacgcgaacacaaggctggcgcacccctaggcttagaggcctgtgatctcccggaccttccccacgttggagcactcgcggactggttagggcttcccttgggtggcttgtggcggctcagcaaaccgcgagactggcagaggcgtgagcctctctcagcccagcattacaggttccagctgatggctaaacgctcgggcgggtggagactgttagaggtgcctgaacctcaccttatgggagtccagagaaagatcctcaggggcctgctgcaacagctgcctctgcacgaggccgccatggcttatgctccgggaaggggtgtgcgagaacacgccgcactccatgctggacaggccgtgctgctgcgctacgatctctgcgacttctttgccgccgtgcaggccgcacgacttagagctctttttctcaccctgggatatccccacgaagtagcagtttccctcgccgcactctgcagcgtagctacgccagaacctgtcctgcgccgcatgcatgaggcaggacagttgacatggacccagctgcagaagctgagaggcgctcatctaccccagggtgccccaagctccgctaccctagccaacctgtgtgccttcaggctggatctgcggcttgacgggctggctcaagcgctaggggctaggtactcccgctacgcggacgacctggtgttctctggacctcagcatttgcggcaagctcaggcccgaatcagcgcatgggtcgggcgtattgccctggaggaggggttcgccctgaaccacaggaagtcacggtgtctcagtgccggaggtcgacagatggtctgcggcgtcgtggtgaatgccctccccaatctgccacgcgccgaatttgatagattgaaagctctgctgcaccaatgcgtgttgcacgggcctgcatctcagaaccggcagcagcatgctgattggccagcacaccttcggggtcgggttgcttgggctgcccagttaaaccctgccaaggcgcaacgcctccaggcactgcttgcgagggtggactggacaagatga

SEQ ID NO: 12693 - RNA, 1341 nt, unidentified
  source 1..1341: mol_type = other RNA; note = synthetic construct
atgtatgcttctcgcctgcgtcacctggacgcccttgctctggcaagggcgctatgggcaggccctcaaacacccgcgtccctcaaggcacgcgctgaacaggctctgggagctagccctcactggctcgctgacttcattgacgagcttcccaccgtctcaggggccacttggcagaggcaggaggtagatgatctcgccgctcgaattgaacagactcgagcgtttgtgaatgcaccgcgggttccgggcttaccgtttgtccggcgctggatccttagggcatctcgcatgcgccccgcaccacttggactggatgatctggatctgccacccttgcctcattctgccgccatcgctgactggcttggaattacgctggacgacttagactggttcacccatgacagacggcccgcgttgccgcttcatgctcagcactatgccttcacactgcagcccaagagaagcggtgggggtagactcatcgagagcccacgttcacgactgaaagcgttgcagggtcgggcactgcacgagctgctcgacaaagtgcccgtacatgaggcgtgtcacggatttgtcgccggaaggagcgtgttgactcatgcccggctgcacgtaggacagcctgtggtcctacattttgacctaaagaacttcttcggccacatcctgtcgtcccaagtggccgccgttttccacacgctcggatatccacccggcgtcgcaaggcaacttgccgctctctgtaccgtgagtacacccgagcccgtgattgaacggttgagagatgacgggtgggttgattggcaggatgctagagccttacgtagagcccacttgcctcagggcgccccttcatcaccaatgctggctaatctgtctgccttccagttagatctgagattggatgggctggcacacgtcttgggggccacatacagccggtacgccgacgatctcgttctgtccggccctccatccctgaggaacagtttcgacagaatcgcagcttgggtggggaggatagccctcgaagaaggctacgctctgaatcatcgcaagacccggatggctacccaagcttccgcccaacgtgtgtgcggggtggtcgtgaacgcccacccaaatctcccaaggcgggagtttgacagactgagggcagtgctccatcgctgcgccttacacggcccagctagccagaacagggatggccacgccgactttcgagcacatctgtggggtcgcgttcagtgggctactcagctcaacgccgcaaaagcgcctcgactacatgcactgtggagtagaatcgagtggatagccagtcctgcctga

SEQ ID NO: 12694 - RNA, 1332 nt, unidentified
  source 1..1332: mol_type = other RNA; note = synthetic construct
atgcacgcccacaggcaccgccaccttaacgcactcgcgttggcacgcgcattgtgggctggtccacaagctagaacctcacttagagctagggccacccacgccttagggcacgaacctgcttggctgacacttctgctggacgagctccagcctgtctccgaggctacatggcagcggcaatctgtcgaagatctggccgataggctcgagcggaccgatacttttgctgacgcagtgcggacaacgcccagacccttcgtgagacggtggattctgcgcgcaagtcgcatgcatccagcccccttaggactggaggggcttgggcttccgcctctccctcattccgccgcaatcgccgcatggttgggaatcaccctcgacgacctggattggtttactcatgatagacgtcatctgctccctctgcaatcccaacattacggctttactcttcagccaaaacgaagtgggggcggccgtgtgatagagtctccccgatcgaggctcaaagccctgcaggggagagttctgcatgatctgctggacaaggtcccggtgcacgaggcgtgtcacggcttcgttaccgggagatcagttctgacacatgctcggttgcataccggtcaacccgttgtcatgcacttcgacctcaaaaacttctttggcaggatcctgtcctctcaggtggccgcggtattccacactctgggttatcccagaggagtggcgcggcagcttgcagctctgtgcaccgtaagcacgcctgaaccggtgattgagcgcctgagggacgatggttgggtggattggcaagacgcccgcgccctaagacgagcacatgttccacagggcgctccttctagcccaatgttagcgaatctctgcgccttccagctggacctgcgcctcgatggactcgctcacgtgctgggagccacatatagtcggtacgctgacgacctagtcctatcaggacccgccagccttcggagtgcatttgagcgaatcgccacctgggtgggccggattgctttagaagaagggtacgccctcaatcacaggaagactcggttggctactcaggccagcgcacagagggtgtgtggcgtcgtggtcaatgagcacctgaatctgccacgtgccgaatttgatcgactaagggccgtactgcaccagtgcgcattgcacggacctgccagccagaaccgagacggccatgccgatttcagggcccatttatggggccgcgtgcagtgggcgacacagttgaaccccgcaaaggctgaacgcttgcaggcccgttggcagagaatagactgggctccatga

SEQ ID NO: 12695 - RNA, 1065 nt, unidentified
  source 1..1065: mol_type = other RNA; note = synthetic construct
ccactcggcctgcacgatctgcttttaccagagctggatcacacagaggcactcgcccagtggctcggggtgtctctggaaacactcagatggttcacggcctgccctccgagacgaaggcatgctgatctgcagagacaacattatgcctttcgactattacccaagcgctccggagggggacgtctaattgaggctccccgctcacgccttaaggccctccaaagaagaatcctggacggcttgctcgacgccgtacctgttcatgaggcctgtcacggcttcaccagggacaggagcgtgttgacacatgcgcgagtccacgtgggtcagcctgttgtgatccggttcgatctgatgaactttttcgcctccatcacggcggcacaggttagggctacttttcagacattgggttacccagcaggtgtggcccaggacctgacagcgctgtgcactttgctgacccccgaacccgtcatagctcgtttacaggacgatggctggcttgattggcaccaagcccgctgtctgcggagtcctcacttagctcagggggctccgtcctctccaatactggcaaatttgtgcgccttccagctggatctgcgactggccggacttgccgatactatgggtgcccggtacagtcggtatgccgatgacctggtcttcagcggaccagcgtcagtaggcagttcctttgacagactggctgcatgggtcggccgtattgcactcgaagaaggctacaccgtgaaccatcggaaaacctggttggcatctcaggccacccagcaaagggtctgcggagtggtggttaatcagcatcctaacctgcctagggaggcgtttgaccgcctgagggccctactacaccagtgtgcaactcacgggcccgcaagccaatcggacagagctctcgatgaatttcgcctgcacgtgcttgggcggatgacctgggccgagcagatcaatccctcaaaagctcgccggcttagaaagctcttcgacaggattgtgtgggacgctgctccagcacaagagctcccccagagcggatga

SEQ ID NO: 12696 - RNA, 1317 nt, unidentified
  source 1..1317: mol_type = other RNA; note = synthetic construct
atgaccagggaccgcagaactggcagcagactcgaactgctggctctggcctgcctggaactgtggcaggatgttgtgtcagcaggctggccccccagtgatactctgctgacagccctggaacgcgtctttgatgacgtgcctgccccccttagaactgctgctagagccgtgacgcccgcagatctaggtctgccaccgactgcaggcgtcgcagatgcagaggccgtagcagcccggttaggtgccctcttggacccagaggcccaggagctcttggcacgattacctgtgcggcgggtgcctctgcctcctcttagcaacgacgctcgcgtgttagcccccgctgatgtggcccaaagactggggttgaggtgggacgagctcatgtggctggctgacccacaggagagattacgcaggggtgcccccgagcaagggcattaccgctacgtgagagtgccaaaacgtcgggggggggagagacttctggaatgcccccggccacgtctcctatctgtccagagggccgtgttgaggagatttctggagcccttggtgccgcatgacgcagcaatggggttccgccctggcgttgggtttgttgatcatgctgcgttgcacgctggccaggctgtggtcctgcgactcgacctcgcgtcgtttttccaaacagtacggagggccctcgtcgtacgcgcattgatgcacggcgggctagcccgacctacagctcagctgctgggagcgattgcaacccatgttacccacccatccgctctgcgcggagttagcgagtctgaacgcgcgcgtcttcggagtccccatctcccacagggtgctcctacatccccggccctagctaatctcgtctgccggcggcttgacgccagactgacaggacttgcggcctcagtaggagcccggtatagcaggtatgctgacgaccttgtgctgtctggcggcggccaccttgctagagatgccgaacgcctggtgaccaccgtgggagctattgccatcgagtgtggcttcaccctcaacatgaggaagacgcgcgtcatgagggcatcccagcgtcagcagttggggggtgtcgtcatcaatgcaggcccaagtcttcctcgtcacgaactggagcggttagaagccactctcaccaactgtgtgcgacacggagtggccggacaaaatcgggcgggcgttcccgatttcagggctcacctgcaggggagagtagcctgggctcgagcactgcgaccatcaaggggagatgccctggccaggatattcgagcagatcgactggtccacatga

SEQ ID NO: 12697 - RNA, 1290 nt, unidentified
  source 1..1290: mol_type = other RNA; note = synthetic construct
atggctctccgcctggaagccctggctctctcagctgttgagcagcacgcctcccgggaagacggcagtacactggccgatgcccttgatcacattgcgactgatgcatctccccgcttaaggcgtgcgtgccgcagagttcccctctctgcactgtcagctgagctggcccatcctcctgttgatcttgaccggctgatgcgggccattggtgcccgattgagcacacgggctcgcagcgaacttgccaccctgcgagtcagaaggtttcccttagtgagtttgggggacccagcccagcctttcccgtccttcggtccaagcggcctggacacccggttaggcttgagctctactgagttacattggctcgcagatcctcaatgtcggagagacagactgactgtgaccgaatcccactaccggtatgtggttgtgcccaagaggcggcacggggtgagacttcttgaatgccccttgcctcgcctgaggagagcgcagagggcactcttggatgaggttctggcccctctgccagtacacccctgtgctgccggattcaggcgaggaatggggtttgtcgagcacgcagcaaggcacgccggtcaggacgtagtgctccgtgtcgatctccgggatttctttccgagtatccatagaggcatggtggtccgagcccttgtggatggcggcactccactcgctaccgctcatctagctgcagccctggcaacgcatactacacatcgggacgtcgcaaggcggtttgacggaagcacaagggctaggctgcgatctgcccacctaccccagggtgctccatctagtcccgccctcgccaatttggtgtgccgacgtctggatgcaagactgcacggactagcggagtccctgggagcaacctatagccgctacgctgacgacctcgttttctccgggccgagacaccttctggatgacgccgcccgcatcgtctcactagtagggcgcattgctagctcttgtggcttcgctctgaggccagagaagaccagagtcatgtcagcggctcagaggcaatcgttgggcggggtggtagtgaatacccgacccacgctggccagacctgaactcgagcgcctggaagcaatactgacaaactgcgtgcgccatgggccagccggtcaaaaccgtgctgacgtggcagactttgcgtcccacttacgtggcagagtggcctgggtggagcagctgcatcctgcacggggagccaaacttcgcaacctctacgctcagatcgcctggggatga

SEQ ID NO: 12698 - RNA, 1338 nt, unidentified
  source 1..1338: mol_type = other RNA; note = synthetic construct
atgaacgcgagcagacccctctggcggcatcgactcgctcgagcactagccgccgcatttctgtgcggtccgtggaggcacgctgaactcgtggctaggggagcggcctgcttaggtgaaaaaccgccttggctgcctattgcagcgcgctggacaagacacgcattcccctccccccccgcttctattgagccagtcgtagagcgactgctccgccttccctcctttcagcttgccactacaggccgtcccccaacccctaaatggcggaaggcattcctttatgttccccctgatcccgttgcccgcttcgccgtacctcctttgccgtctgacggggcattggctcgatggcttgcaatcccagaaccccttctggcttggctggcggatgttagggggctgaatcggaggactgctgaagccagactgcacaattaccatcccagatggctccctaaggctcacggcggggtcagactcctggaggaaccaaaacccctgttgaaacaggcccagcgccgtatcttggccggcctactggctcatctcccgccacacgcggctgcacaggctttctgctccggaagaagcgtgcacagtcacgccgccttacacgccggacaagctgtggtgatacggatcgacctggccgactttttcggaagcatcggccgtgccagagtacgggccctgtttgaggcagctggctatccacgacctgtggcgcgatctctagccggcctttgtacaactgccacgccaccactagtggttgcccgcttaccccggccagttgatgccgcagaggtgccttacgcagcctcgcagcgacggcatcttctggcacctcaccttccacaaggagccccaacaagtcccgctattgccaatttgtgtgcctgggaactggacgtcagactcactgcactggcaaccaccttcggcgctcgctactcacgttatgccgatgatctgacgttttcaggaggtcctgaggtggcgaggagggctggtcacctggttgaactggccatgttcgcggcttacgcttgtggctttgccgtccggcacggcaagaccagagtggtgaggagcggagccagacaggtcgtgaccgggttggtggtcaacgagaggccgcatgtcgcaagggccgagagggatcagctcaaggccatactgcacaactgcgtgagacatgggcccgccgggcaaaatcgcgagaaccatccagactttcgcgctcatctgttgggacgcttaggctgggtggctgcaggggaccctaggcatggtgcaaagctgcgggctctcttcgaccggatcgcctggtga

SEQ ID NO: 12699 - RNA, 1005 nt, unidentified
  source 1..1005: mol_type = other RNA; note = synthetic construct
gacgctggtgtcccacctctgccaacccctggagatctggccgcttggctcggactgaccacagatcgggtcgactggctggccgataggcttcggccagaggaacgtcctgcagcaggggcagtgcactatcaccaccggtggaaaggcagacgactgattgaggcgcccaagaggactttgcgatctgtgcagagaaggatcctggacggcattctcgccgatgtcccacctcatccagcggcagtggcgttcaggccaggagtctccgtcgtagacggcgcagctcgtcacgtcggacagccaatggtggtgcgatttgatttgagagattttttcgcctcagttcggcgcgctagagtacgcgctatcttcgctcgcctaggttaccccgacccggttgccgatctgctggccaaccttacaacccatgccacccctgccgctgtgttcgatgccgtcgctccccgtgacgcagaagcccatagggctcacgtggaaaggcgccgcaggtttgccgaacgtcatcttcctcaaggggcgccgagtagccccgctttggctaatctcagcgtgtacggtctggactgccggttagcagcactggcccgcacgttgggggcaacttacacacggtatgccgatgaccttgtgctgtccggcgactttgctcccaaccccgtcgtgcgcctcgtagaccgaatcgtgcggtctgaggggtttgcgctgaacgccgccaaaacccgagtgatggccgcgtcccagcggcaaagagtgactggagtggttgttaatgctcgccctaacgtggccagggccgatttcgacaggctcaaggctgtattaacaaattgtgccagacacggcgcagccagccagaatagagatgctcaccccgcctggcaggcacatttggaggggagggtggcctgggttgcctcagttcaccccgagagaggcgctcggctaagagcactcctggcccagatagactggagtgcatga

SEQ ID NO: 12700 - RNA, 1254 nt, unidentified
  source 1..1254: mol_type = other RNA; note = synthetic construct
atggacgcagacaccctcgctgacgcctggctaagtggcgactggactttggccggcatgcgatctagaacccagcgtcttatccatcccgacaggctttccaagagcctggcctctatgattttaggcttttggctggagctaagggatcggccgcacgaacggcgaagggcaactctggccgctgctattaccgctcatagagccttctttcgcatcgcccgaaccaacacgtatgggacagttctggacgcacctaaaatggtgcccccaccgagagcttgggatgtactgccactggatacacctgccacagcaggagcgtggttggggctcacggcaacagatgcgacctggctgactgatccaaggggaatcgccagacattacgacagatactggagtgggacaaggcttatcgaagccccccgacgtcgcttaaaggctgcccaacggcgcatcgctgccgaactcctggctgcaattcctccccacgaggctgcacacggatttcgcagaggaagatcagtcttgagcgcggtacacccacatgctggcagagaggtgttagttgtggccgacctcaccgccttttttccctccgtgcgggtgtctcgagttcacgcaatgttccagcgcgtcggctatcctgaagaggtcgcccggttcctgacccggatgtgcactacaagatgccggactctgcccaaagccgaacacgaggttacgcctggccaggctcagctgtatcgggcgagacatctgcctcaaggggcccctacatcccctgcacttgccaatctctgcgcttttcacctcgacgctcggctggctggattcgcctcgtcactagggggcacctacacccgctacgctgatgatctcattttctcaggtcccgcggtgcttggtaggggtggattcctggcaactgtgtccactatagccgtggagcagggcttccgcttgaacacagcgaagagccgggtcatgcgccgttctcagtgtcagctggtcttaggcatggtcgtgaacgaggcaccaaccctcccaagggcccagctggaactcctggaagccgagctgttccgttgtgcaaggcgcggtcccccggtacatcaccagcatggggttgcctggcttcgagatcatttggcgggaagggtggcctgggctaaacacgtgaatccaaggagagcacaaaggctggtggagttgctcgccgccatagactggagtggggcacacagctga

SEQ ID NO: 12701 - RNA, 1293 nt, unidentified
  source 1..1293: mol_type = other RNA; note = synthetic construct
atgccaccagtcaacaaattgaatttcttctcaaagcaccttgccatgtggctgagccaggccgactggcatttcgtaactcttctgtctactgctattgaatgtgtcgatgaactgccggacgactgtgattcactcatcaacgagttactcctgcgatatcctgaaaagccgtctgagccggccttagccggtcaccttcagtcgtcataccggctgagttcctggttcaaaaggggccagtccgcacccaagatcatgagatttaaccttgatagccccacctttatagaaagggacaaccgggagtatcctagaattgacacaccaggagatctggctgactggctgaaaatcactccctcacaactcgagtggttcagtaattgctggaggttcgacagcaacactcctcggtacctacaacactaccagtaccagctaatggaaaagagagatggtaggatgaggctcatcgagaaacccaaaacaaccctgaaacgactacagcggaagatatatcaggagatactctctacgttagaaacacatcctgccgtgcacggctttcgcaaggacagaaactgcattagccatgcgtccgttcataccggcaagaagtaccttctgatgtttgacattacagattgttttcagtccattcactggcccatggtcaaagtggtgtttaaacggatggggtacccagatgccgtgtccatcctgctgacagccttatgcacccacagtgttagattgaagcctgcacagttgaaactgttcgataccgcgcagaggaaccgacttagacagagacacctaccacaaggagcccctacgtctcccgcgttgacgaatgctgccctgcataggctggatatccgactgaccggcctggcccatcactttggtctggactactcccgctacgctgatgatctcgctatgagcggcaatacacatcgggactggcggttccttgagccactgatcgggggaatttgcctcgacgaaggggttaccttgaattataagaagactcgcattaagaagagccaccagaagcagcgtgtggtcgggatagtggtgaacagtaagactaacatcgatcgtaattactttgacaccctcaaagcaatcctgacaaattgtaccaaatacgggctcgacagccaaaatcgttatcgccacccccacttcagagcacatttgctgggacgcatccaatatgtaaaatctttgaatgagaggcgcggcgctaagctcgagaagctgtatcaggcaattaactga

SEQ ID NO: 12702 - RNA, 1284 nt, unidentified
  source 1..1284: mol_type = other RNA; note = synthetic construct
atgaacaccaaaggatttttctgtcggcatttggctatctggttctacgaagaaacctggcacttcaccaccctccttgccatctttatagacgtggtggagaacctcccgagtgatgctgatctgctggtgcacgagactctgctagaattccccgacaagacaagtgccgaaaacatcgctgcctttctctctcgttcccagcgggttttgcattggttttcagacggcgccgataaacccgccattataaggatcaacttacagcagtctcctgtagttaagctcgtgaacagcaagctccccgaactgaattctataggcgacctcgccgggtggctgggaatctctatcggccaactggactggctggccgacctcaagcgatatgattccagccgtccagaaagatttaaccactatcactaccgaacaactgagaagcgggatggtaggttacgcctgatcgagagcccaaaacgcctgctgaagtccattcagcgccaaatttccgatgatatcctgatttacgcgcctgtgcacaatgctgctcatgggttctgcaaaggtaggaactgccaatcacatgcctccaaccacattggaaagaattacctgtttctgttcgacttggcgcattgcttccagagcgtgcactggctgcaggtttttcgcgtatttacgcaactggggtatacgcggactattgcaagatatctgacatccctggcaacacacagggcatacagtaatcacgttttactagaccgtcttgatgtggaccagcgaatccgccttcgacagagacatctcccacagggcgcacctagttcgccagcccttagcaatgctgtcctctctagattggataaacggctaaacgggctggccaaaagccttcggctggactattctagatacgcggacgatctcgccttttcaggaaacgagcacagggactggcggttccttgagtccctggtcggcgctatatgtaacgaagagggcttcgcattgaattacaggaagacaagacttgtgcgccctggtcagaggcagaagattactggcgtggtcgtcaatcaaaagaccaatattgaccgccgatattacgattcattgaaagcagtcctgactaattgtctaagaaacgacttagacagccagaatagattcaatcattcagatttcagggctcacctgagggggcggatccagcatgtgaagagtctcaacgagagcaaaggaaccaaattggagaagatcttcgagcagtttccctga

SEQ ID NO: 12703 - RNA, 1293 nt, unidentified
  source 1..1293: mol_type = other RNA; note = synthetic construct
atgaacaagaaaattcggttctgtcgccaacttgcagagtggttcctggtgtccgattggcactacagtacattactggccgtgtttattgatgtggccgatgaactgcccggagacgcagacgaccttgtctctgaattgctggctgaatttgacacgaaaccagagctgaaccctatcgtggactatctgatgcagtccctgaggcttggctgctggttctacgacgatcacggccccagggtggttccagtctgcttaattaacagtcagctcagcagactgtctaatgatgcactacccgtgctcaataccgagtctgacgtcgccaattggcttaacgttagtattcaggagctgacctggctggcggaactgtatcgtctggaccccacgagccctagctacttcaagcactaccactattccatcgctaagaagaggaacggttcgcccagactcatcgagtctccaaagtcaaggcttcgggctatccagaggaaggtgtactccgagattttggaccatgcagtgatccatgattccgctcatggattcctgaagggcaaaggatgcaagacccacgccagccagcacagtgggaaggatatcctctttactttcgatttgtcacattacttccattctatacgttggccgaatgtatatgccatcttctccggactagggtatactaattcggtgtcaaagattctcaccgcccttactactcatcgctgttacatgaaggatcggtgcttgggtgagctcgatacagatcacagaagtctcctccgagaacgacacctacctcagggagcccctacaagcccgagcctttcaaacgcagtactctattttttggactgtcgcttatccggactggccgcctccctgaacatgaaatactcacggtatgctgacgatctcgctttttcaggcgataccgggcgcgactggagatttttagagcctttggtcgggtctatctgtctggaacaagggtttaggctgaaccaccggaaaacacgcattatgaagagccaccagaagcagcggctgaccggcgtagttgtcaatacaaaaccaaatgttgacagaaaacactacgaccgactgaaagcaaccctcactaactgcctgagacatggcctagagtctcagaacagagacaatcatccagacttctttgcctatctggaaggcagcatagcgcatgtgggccacttgaatagcgctcgcgggaaaaccctgaaagccatgtacgatagggtgatagcgacacaaggttga

SEQ ID NO: 12704 - RNA, 1275 nt, unidentified
  source 1..1275: mol_type = other RNA; note = synthetic construct
atgattcagacgtttaccagagagcttgcccagtgcctgtatcactccgagtggcactttaccaccctcctggctgcatgcattcagaggatagacaatcttcccgacgatattgacggcttcatctctcagctgcttaacgtgtacaatgaaaagcctgccctggagctcctggctggatttttggagcagtctcgctgggttcgaagctggtttgtggtgccagccagagcaccgcgattccgtatctataacctggaacccgtctcgggcactacaagagccgaactccctcctttagattcaccagccggtcttagcctctggcttgggttaagtccaggccacttggattggatcgcaggcctcaagagggtggatgcgtctaggccacgccgtctggataattaccactactccctcctgcggaagcgccatacaggcagccggctgatcgaatcccctaaaactatcctgaaggctgtgcagcggagaatcctaaacagaattctgtgtcacgctcccgtacacagggccgctatggggttcagaaaaggatgctcaagtctcgaccatgccaggttgcattgtcggaaacgctacgtgttttgttttgacctcgagaattatttccagtcaattcagtggctacctgtgtggcgcgtttttcgcacgctcggctatcccaagaagacagcaaattacctttccgccctgtgtactcatgcctgcccccctggagccctggctagatttggtttgggggaccattataaccgactgctgagggagcgccacttaccccaaggggcaccaaccagcccagcattgagcaacgcgatcatgctcggcctagacagacggctgagtggtttggcccggcgacttgagttggattattcaaggtacgcggacgatctcgtgctttctgggaacggaaaaaggaattgggacttcctggcccccttagtcggctctatttgcctggatgagggattcagcctgaaccacaggaagaccagacgtctcacaaggtcgcaatcccaaaaggtggtcggggtcgtcgtgaacgaaaaaattaacatagaccgccggtactatgatgatctgaaggcaaccctattcaattgtgttcgattcggaccggacagccaaaatcggggccagcacaaagatttttgcgctcatctgctggggaaaatccattacgtagcttccgttaacactagtaaaggtcagaagctgctgcagttattcgaccggatagcgttctga

SEQ ID NO: 12705 - RNA, 1335 nt, unidentified
  source 1..1335: mol_type = other RNA; note = synthetic construct
atgcggtatgatcggtggctggccgctagactggcagatgcctaccagagcggggcacccatagccagagagatgcaacagcgagccgccatggcattaggcgagcagccagcttggcttgcaccactcaccaggaggatgtggcggagattccagcaggtgtgggaaaccacgtctgcacatactctgacagaagctatcctagccgacaggggattccaaaggggcctggccttatcatctaggcccattcaggtacggcgaatctttcttcctccacctcaggagttggctccagactccctggccgcacgttatagactgcccgcacttcgatgcgccggagacttaatgcactggttgcggctcactccggaagacctggattggttgacacaagccagaggcgcacccagtggtgccagttccgctttgggccactacatttaccgatggcttgataagccaagaggcggagctcgtttgctggaggcccccaagccttggctcaagaccatccaacgacggatccatcaggagattctggcccctctgccactgcatgaggctgtgcacgggtttcgcgcccagcgaagcagcttaacacacgcaaggattcacattggccaaaccctcctcctgaaatttgatctgaaagatttctttccctctgtgtcctatgcccagatttatcgtgccttccgcaggctggggtacgggcatcaagtggcccggttgctaagcaagctgtgttcccacgtaactcctgacgagatcctgcgccagccgcttgcaggctacctggagagggggaatgaactcttcagaagggcgcatctgccacagggtgctcccacctctcccgctttggctaacctagctgcggcgcacctcgatcggagactcagtgctcttgcagactcaatgggcagacggtactcgaggtacgccgacgatgtggtcctttcagggccccgcatgtcaccaggagcgatcgctcgcctccaggctctagttggcgccatcgcactggaagagggatttgtcttaaatacaagaaagtccgcagtgatcggtcagggagcccgccaacaggttggtgggctggtcgtgaatgccaaggccaacattcctaggaaagactacgacgaattgaaagccgtgctgcataactgcctccgcttcggacctgacggccagaatcgccagggacacggtgattgggctgctcacctccgcgggaaaatagcgtatatggccggaataaacccggagaagggccggaaactgctggcgctctatcagcgtatcgtctggcctcaggaaagcgtttga

SEQ ID NO: 12706 - RNA, 1335 nt, unidentified
  source 1..1335: mol_type = other RNA; note = synthetic construct
atgagatatgataggtggcttgccgcccgccttgccgatgcttaccagtccggagccccgaccgttcgagaaatgcaacagcgcgccgtggtaactctcggtgaacagcccacatggttagcgtccctcacgaggcgcatgtggcggagatttcagcagggttgggaaggtgcaagcgcctacgcactgagtgaggctatactggcagaccgtggcttccagcagggacttgctgtcagcgccaggcccgttcaggtacggcatatctttctccctccaccgcgagctctccctcctgacagtctcgcctcccagtacggactccctgcgttgagatgcgcaggtgatttgatgcattggctaaggctgacacccgaggacctggactggttaacccaggcaaggggagcaccccggaaagctgcaagtgccctgggacattatacctatcggtggctggacaagcctagaggtggggcacgcctgcttgaagctccaaaagtgtggctgaagggaatccagcggagaatctatcaggagattctggcgcccttgccactgcacgaggccgttcatggcttccgcgctcagcgttcatccttgactcacgcccgggtgcacgttggacaagcgctgctgctcaaattcgacctgaaagacttttttccctccgtggggtatccccaggtctatcgcgtattgaggagactgggctacggtcacgaggtcactagactgctcagccgcctgtgtacccaagtgacaccaaatgaaatattacgatcgccagcagctcggcacctagaaagaggcgaggagctattccgtagggcccatttgcctcagggcgctccaacaagcccagccttggccaatctcgtggctgcgcacttagataggagactgtcagccctggccgattctatgggccgccggtattcaaggtacgctgacgactttgtgttatctggggctctgatgagcccgggcgctattgagcgactccaggcactagtcggagctattgcccttgaagaagggttcgtgcttaacacccgaaaatctgcggtcatcggccagggcgcacgacaacaagttgggggggtcgtggtgaatgctaaggccaacatctctcgcaaggactacgatgagctgaaggcagtgctccacaactgcctgcgtttcggccccgatggccaaaatagacaaggccacggggattgggcagcccatctgagggggaagatcgcctacgtggccgggattaaccctcagaaaggacggaagcttctggccctctaccagcggattatctggcctcaggagtcagcctga

SEQ ID NO: 12707 - RNA, 1338 nt, unidentified
  source 1..1338: mol_type = other RNA; note = synthetic construct
atgaactatcagagatgggtcgctacgtcactggcagaaactctcctctcaggtcctagggacgtcgccagccagagacaacggctgaccaaagtgctgggagaagagcccgagtggctctccccattagtggccttgggtcggtccccagatttcgttaagggcgaggactctgagactctgaagcggcaactgaccgaggcaatcttggattgcgaagacttccttctcgctttcgtcgaagaagatactacaccccgcatacgccacatcaagtgtcagacattacccccaacatttccgagtaactgcccggtcgaagtttgtaatttacctaaactggccaccgaaggagacttgctggcttggttgcacttatcgcaccatgaccttctgtggttgatcaacgagtacagggaagagtttggccaggacagccgactccagcattaccattacagatggctggagaagccacgaggaggcgcacgacttctggagagcccaaaacctcttctgaagtctctccagagaaggattcacagggaaattctgagtcccctgccactccattcaggcgtacagggctataggcagggacactcctgtctcactcacgctcggctccatcagggccagagcctgctgctgaaattcgatctgaaggatttctttctgagtatcgggtaccagcaggtttacaggatctttaggagactgggatataaccaccgggtcacccagatcctgtccagattgtctactaataaaacaccccgagccaagcttagaccaccacccggcattatgacagaacgcgatatccaattgttcagacggcctcatttacctcagggggctccgacctcccccattctgtcgaaccttgctgcggcgatgctagacaatcgcctcagtggacttgccaaaaagatgggctatcgttacagccgttacgcagacgacttcgtgctctcagggcctgggatgtctcaacacgccgccgagaaattgcagcacctagtgggggccatcgctgaggaggaggggttcagcctgaatacccggaagtccgcggtggtgggacaaggtcaacgccagcaagtggcaggcatagtagtgaatgagaagacgaacctctctcgcaaacagtttgattctctcaaggcaatgctgaataactgcgccaggcatggtcccatttcccaaaatcatcagcaacttcccaactttcaggctcacctgaaggggaaaattgcctatctacgtagcctgaatcctcagaagggcgataaactgatgaccctatatcagaagatacagtggcctgaccagtga

SEQ ID NO: 12708 - RNA, 1323 nt, unidentified
  source 1..1323: mol_type = other RNA; note = synthetic construct
atgaattataagcggtgggtggcatcatgtctcgctgacgctttcataataggcccccgggattctagtgctatcctgcttcggtggtcaaaagtgttgggggagcagcctgagtggctcaggagattgtctaaagagattctcagtccagaaactgcacaccacgaaaacctgaatttcagcatggtcctggagagaatccaggcttccgaggactttgacgaagcgtttagtgagagcgaccagcctccacgcgttcgatacgtatacctgccagaggccgagtatagcttctctgctgaacagcatgagctgccgaagctggcggggatctccgatgttctaaattggctcaacttgactgttaatgaccttgaatggttgtgtgggaattacagaaatgcacccggcgcttccagtaagctggcccattaccattataggtggctggaaaaaagaagaggcgggagccgccttttggagtctccgaagcctctgctgaaaagcatccagcagaagattctgcacgacattttaagtgccgtgcctcagcatcccgctgtccacggtttccgagccggccattcctgcgtgtcgcatgccagacaacacctggaacaacctttattgctgaaattcgatctcaaggatttcttcgcctccatccactatcccatggtcttccaggtatacagaaagctcggttaccctccaacggtgtgccgaatacttacaaagttatctactaacgtctcaccagtgaaaatcctcaaatccaggcccgacacctgcattgacaaggacgacaactattttaggcgtccccaccttcctcaaggtgccccgacctcaccagccctaagcaatctggccgcgtcgaaactggataaaaggctgacagggctggcagataccatgggatttaggtactccaggtatgcagatgaccttgtgtttagcggacctcggctcaaacgcggaagcattgataaacttcaatctctagtgggcgccatagtcctcgaagagggctttttattgaatacacgcaagtccgctgttgtgggacaggcgcagcgccaacaagtgaccgggattgtcgtaaaccggaaggccaacatttctcggcagcagtttgatcagatgaaggcaattctgcaccactgtatccaccagggtccacaccatcagaaccgtgaccaggtgcccgattttcaggcacatctcaagggcaaaatcagctacatgcagtcaatcaacccccagcgcggaaacaagctgatgaagctgttccaacaaatccagtggcagaacgccgattga

SEQ ID NO: 12709 - RNA, 1284 nt, unidentified
  source 1..1284: mol_type = other RNA; note = synthetic construct
atgaatgcacatcgctactttgcttatactttagcccggatctgtctgcagagcagctgggagcgagaaccaatggccgaggccgtggagctgtcactacagggtcagggcccgtgggtcaatagcctgattaggcaggttttgcatcgtttccccagaaggcctgggctgccggcactgttcgattttttgcggcagtccgagggcctagccgcaatcaggctccggtaccagccgaggatctgcaggtatcctcttaccctccctcacgtggtgctcccatcttcattgccccctttagacagcgtgggcgcactgtgtgaatggctccggttggcacccgctgacctggattggttcgcggataggtcaaacagagcggccgggcacgcagctcctaaagtgcgacactaccacgtgactacgataccaaagcggcaaggtggcatgagactgctcgaggtacccaagtcaagattgaagcagatccagcggcgcattcatgacgatatccttctgcaactccccctgcacccagcagctcaagggttcgtccgaggacgatctccagttgcgcacgcgggccttcacgttggacaagccgtggtgcttcgctttgatctgcgggattgcttcctacatgtccacggcggacgagtgtttcaggccttccgcgccttagggtttcccgaggacgtctcccgccttctcatgggcctgtgtacacatcgcctcccacagtggctatccacacagcttcccttagacgaagttcagcgccagaaagctaggcagaaccacctgcctcaaggagcccctagttcccccctgctgagccattttgccctcagaggggtcgacgtgcgactcagcgcttacgctagtgcactgggtgccaattattccagatacgccgacgatctggtcctgtcgggcggtgagcatctcagacacagtttcagggccattgaagcgagggtgggcgccatcgtggcagaagagggattcgccttgaattttcgtaagagtcgctgcgtctctgctgcacagcgccagcaagtaaccggggtagtggtaaatcgtcagctgaacgtgccaagagtgcagtttgatgccttgaaggctgagcttcataactgcgtgcaacagggctgggtttctcagaggcctacccacgtcgccgactatcgggctcacctgcttggacggattggttgggttatgcaggtcaacccccaaagaggggctaaactgagaggactgttcgaacgtatagactggtga

SEQ ID NO: 12710 - RNA, 1395 nt, unidentified
  source 1..1395: mol_type = other RNA; note = synthetic construct
atgtatggcggcgctcgctgtgcacggaaatacacacaaaaccaaaggctggtgctggaaccactgattctgaatgacatggacgcacactataagaagctgcttatcaggcaactcgctagggcagttcttataggcgagcattcccctgccggtattacgagaagcatcactcattgtctaggtataggtacagagcaggcacgcgctttggccgtggagatttccgccgaacatctgtttagagcctacccgcaccatgctgaattattccttcgtacaacactgcaggaaagcaccactttaaccgcaatttttgcgggacgggatctgagggttatcaactggccccttgccgctctgcagagtcagcagaatccacccgctaagtacctgtggcaactaccagtgataaagagtgcagagcaactggctgacttcttggacgtgcagctgaatgatctttattggttcgcacaacggttcgccaagcccaattcctcttttaagcagcagcactactactatcgctttatcactaagtctgacacctcactccgtttactggaaataccgaaatcacgcctccggtgcttgcagcgaactattctcaaaaaagtcctgcagccaatgcccgttcacgaggccgcccatgggtttgtgaaaaacaagaactgtgcatcttttgcggagccacatgtagccaagtccctgatcgtcagcatggatctcgagaattacttcctccacattcctgtcgcccggattacccgtctgttccaagtcgctggatacccagttgacgtagctagcttgctggctgggctctgcactcaccgaacacctaatcaaataatcgcaaacacccccggatctcacagtaaatatctgcacattaggcatttgcctcagggcgctcctaccagcccaatgttggccaacttagccagcttctggctggacgtgcgcctcaacgcgttggcgaaaacgatgggatatcactatacaagatacgcagatgacctggcattctcgtgcgattccgataaccataaccccaaaaggctgatccgctccgtgagtgatatcattcaggccgaagggtttcggctcaatcaccagaagacccgagtgcagaaacctggccagcgacagtgtctggcggggctagtagtcaatgagaagctcaccatccccagaaacatcgtgaagaggttgcaggccgaactttacaactgcgtgcagcacggccccgaaagccagaatagacttaacaaggccgattacaaatcacacctggctggaagaatcgcccaggtggccggggtgtcaaatgtcaaagccgagaagctattcgccctctttgaccagatctcttggcctcaggagagatga

SEQ ID NO: 12711 - RNA, 1299 nt, unidentified
  source 1..1299: mol_type = other RNA; note = synthetic construct
atgaactaccgcaagctgctgatccgacagctggccctgtccctgttggaaggcgcccatcaccccgtcggattggctaactccatcgccggttgcgtaaacctcactcttcgcgatgccctccccctagccgaagaactggctcggaacttagattggggcagtctcactgttatgcagctggagcagtggcttgaagcatccgagaggctcgccgtgctgtatcgcagccagagactcagggtcgttaaatggcctttgacagcgatacctgcaccacagagagcagccttaggttccgcctggggccttcctccattccataatacagaccatctggcgcagtggtgcggattaagcccaggcgatctcaactggtactctcagcgataccctaatcagaggcccgacgcccggaaactgcagcactaccactaccaaccccggcacaagtctgatggtagtcaacgaattctggagacacctaaatcacgcttgaaatcactgcagagaaagttgaatcacgacttactcaacaaggtaccggtgcacgacgccgcacatggtttcgtggcgggacggtccgtcaaaagcttctctcggctgcacgtggaccgaccagtcgtgctggcaatggacctcaagcatttttttctttcgatagcacctggccggcttgtgaggctattccaacgtctgggatacgacctcgctgtgagtaaggcccttattggcttgtgcctaaaccagaccccagaggctgtgttaagcccaattcattgtctcgccacaaggcagaggtatagacaaccccatctcccccagggggcacctacctcaccggttcttgccaatctgatggcatttaggctcgacctgagactggaggctgccgctcatgggcagggattctgttatacgagatatgctgacgatctggcctttagtagccatcgccacgatcgcgccgctactcgcatcctgcaaagacaggtcagatctatcgcggcagatgaaggattcgcgattaaagaggaaaaaacccgggttatgaccagggcagggaggcagcaacttgctggggtggtggtgaacaagaaacagagcttgcccaaggcagagattaagcaactggaggccatcctgaataattgtgtacgatacggcccgcactcacaaaatcgcgctcgtcacccacagttccgtgcctggatggaggggaagctagcttatgtccagcatttggctccccaccactttgaacggctgcagagacactttgagctgatccagtggtga

SEQ ID NO: 12712 - RNA, 1338 nt, unidentified
  source 1..1338: mol_type = other RNA; note = synthetic construct
atgtcaaatcagaaccagatcattggatttatctcacacgccattcttgccggcgagtggcagaccgacgctatcaaggaaaggattgggcgaagcattggctaccagtttaacgcaagactcctcataaaagaactgatgtctgagttcgaacttacacaggcccagacccagcataccgccatacagcagttcttgaagaacaatgtgacttttcagcagtgctggggggagcagaggcagctgatccagctcgataaaatctatatccccaagcaggatcgttgtcggcccccaagacaactcaaccacatcgagttgcctgccttaaatacggaacagcaactgggagactggttcaagattagtgtgaatgatcttatttggctgtcgggcatctgggagaagccatatgatgctaagagctgcaaattgtatcactaccactaccagtggctgaagaagcacaatggcaagaagcggttggttgagatcccaaaaagccggattaaatctcttcagaagaagatctccattcagtgccttgattccattccgatccaccagaacgcacatggttattgtaaaaacaaaagctgccaaacactggtgcaacaacacatcgcgaaacccactatcctgaagatggacctccagaatttcttcgcctctattgactaccggaagatatttaacttgttctttagcctagggtacaataaggatatctcgcgcctcttcgctcatctgtgtactacagctacaccattgtctgtcctgagtgctgaactcattgcgggacaacaaaaggactactggcaccaacgcaaactctatagagagagacatttaccgactggagcaccttccagtcccgtcatctcaaatctgtgcttttttaacctggactgtcgactgaccgcgtttgctgaaaaaatgggcctgaattatagtcgttatgtcgacgatatggttttctctggcggacgcgaattttacaataaatccgactacctgatcaaaaccatatcaaagatctgtcagagcgagtacttcttcataaaccataaaaagacgcagttactgaaacctcatcagagccagcaggtatgcggtctggtggtgaatcagaagcctaacttaacccgcaagaactacgaccagctgaaggccattctatataattgcgtgaggacatcccctaagcagcaaaataggcttaaccacgcaaacttcaaagagcatctcgcaggtaagattgcctacctgtcccagataaacccccaaaaagggcaaaaactggccgacctatttgatcagatctgttggatggagtga

SEQ ID NO: 12713 - RNA, 1296 nt, unidentified
  source 1..1296: mol_type = other RNA; note = synthetic construct
atgcagaatttagcaagaactagccgactgctggcagcttccataatcgatggaccatgggagactgggcctctggcaaggcggatcgcacatgcgatttccctaaggggttttaatcctgagcgcctagccctggccttggtgagacggttcggcaagggaaaaacccccgtgctgcgggatctaaccgcagccattgctgccaacgaacacttcgccgtctgctttgagagtactggccggcctgcatggttccgtatgggagtcgagcccccgcaaatgacaagacctccaagcaatctcgtcactttccctctccccgtcattgaaacggccaaggagctgagcgcttggctgaatgtggatctgtctactctggaatggctggcggacacaaggcgaagacagaagaatgcaaaggacttccgcttcgtgaactattcctatatatggaaaaagcgaccaggcaagccaccgaggcttatcgaatcccctaagagcaagttaaaggccactcagcggaaaattttgaccgagatccttaacaaaatcccaccgcatgaggctgcccacggcttttgtagaaatcgttctatcattacgcacgccctgctccataccgagaaggacgcggtggcttgctttgacttgaaagacttcttccatagcatcccacccgctaggattatggctatgtttcggaccattggatatccccaagaagtctctaggagactcacaaatttgtgcatacacacccctaaccctgagtttctcgggaaaacgcttgaaaccctgccctgggccgtgcggaagaaaattctcattccccacttaccccagggggcacctacctcaccagctttggccaacctgtgtagctttcacctcgatacccgcctgcaggcccttgctgaaagtatgaacctgacatactcgcgctacgccgacgatttaacattcagtgggggtaaagaactcaagagtcgcttctcttatctgcggggtacagtacagggcatcgcccaagacgagggatttaccatcaatccagaaaagacaaggttgatgacacaggcgcagagacaggtagtgaccggggttgttgttaacaagcgaccaaacatatcacgtactgaatacgacagacttaaagccacgctttacacatactcaaaatcaactggcctggatggcctgatcaaggctcagctccgcgggaaagtggagtttgtgagggcactgtccccccaacgcggtgagaagctgttcgagctctggaaaaagatcccctga

SEQ ID NO: 12714 - RNA, 1299 nt, unidentified
  source 1..1299: mol_type = other RNA; note = synthetic construct
atgcccggatataaacagaccactaggctgttggctgcctccattatcggaggcccttgggagtccgggccattaagcagaaggattcatcacgcgatatctctgaagggcctcaattcagagaggttagcccttgacctggtgcaccgattcggagaaggccgcacaccctctgtcaaggagctcgcctcagcaatcgcagctaacaaacacttcgaaaagtgcttcatggccagcgaaggtcaggcggagtggttgagaatgggcgtagaacctgcccaaatgaacccaccgaaaggggacctggccacattaccgttgcccgccttggcaacaagccgcgacgtgtgtgaatggctagagatcgatcagcccgccctcgaatggtttgctgacactaggaagcggcaaccgcatgttagggacgagcgccttctgcactacacctacctgtggaaaaggcggagggggaaaagtcccagactgattgagagcccaaaggggaaactgaagaagttccagcgtaagatcctctcggagatccttaataagataccacctcacgaagcagcgcatggttttgccagaaacagatcgatcattacgcacgccctgctgcataccgagaaagaatgtgtcgctagctttgatttgaaggacttcttccacgctgtgccacctgcacggatagcctccttatttcgagccctcggttaccctcacgaggtgtcaaggatcctatccggcttatgtcttcacgcgcctgatgcccattatctcggaagcccattgacaaaccttccttttcccgttcagaagaagattctgtctccccatctcccacaaggcgctcctacctctcccgcactggcaaatctttgcgcctttcgtttggatgtccgcctgcagtcactggctcaatccatggacctgacctatagtagatacgctgatgacctaaccttctccggtggaaaggatctaaagaaacaattcagttacctccgcgggactctcagcgagattgctgcccagcaggggtttaaactcaaccctgagaagacacgactgatgactcaggcccagcgtcaggtggtaaccggcgttgtggtgaataagcggccaaatattagtcgggcagagtacgaccggctgaaggctacactctatcagtgcgctgaaggagaggaaaaagatgcactgctgaaacagtctctgcggggcaaggtggaattcgtccgcactctgaacccccagagaggcgagaaacttctgcgactgtgggagaaaatcacgtga

SEQ ID NO: 12715 - RNA, 1053 nt, unidentified
  source 1..1053: mol_type = other RNA; note = synthetic construct
atgggacctagtaaatggaacgtgcccgagctacacgtggttggggacgtcgcagcgtggctcagtgtcagccccgaggagttgcgttggttctcagacacatctggggtagaaagagcaaggcgccggcagtctgctcgcaactacgtgcatcagtgggtggcccgcggagagaagcttcccagattactggaggcacctaaagctaagttgaaggcactgcaaagggccgtcttgcacgggctcctcggtaagatcccagtgcatgatgccgcccacggctttgtcgctggacggtcagctctgacgcatgctcgattgcacgtaggcaaaaaggtggtagtgagatttgacctgaggcactttttcacatctattgataccgcaagagcctttggcgtgctgcgctggctcgggtatacacatgaagtgtcggccgtcctcattgggttatgcaccactcggactcccaaccacgtgctgggtagggccccgattccagatttggcggaaggcgaggtgctcaaccagagattcatgatgctgaggcagcttgaggcgtggcactttcctcagggcgcccctacttctccagcctgggctaatctctgtgcttggtggctggacgtcaggctgtcagcttacgccaaaaaattcggtctgacctacagccggtatgcagacgaccttgtgttttccggcgatcagctgtcctccataagccgcctacgtgatgttgtggatggcgtcgtgagagcagaaggtttcgtcatcaacagggctaagaccaaggttatgcatgcccatgctcgccaattcgtgaccggagttgtcgtaaatgagcgaccgaatgtgacacgtgttgaattcgatcaactgaaagcactgctacaccggtgcgaaatgaagggagccctttcccagagcaaaggaccagttgaccagttccgggcagagctggaaggcaaggttgcctgggtggcccaacttaatgcggctagaggggccaaactgaaggcccagttaagtcgaatcgactggacggagggctga

SEQ ID NO: 12716 - RNA, 1353 nt, unidentified
  source 1..1353: mol_type = other RNA; note = synthetic construct
atgaatgagagggagcggagtccatggcccactcccactagtctaagaagaaacgatgccaggtttattgccaggcagccatggaataggaccgacctgctgcgcgccttatctgtggcattcggtagcagcggcatccctctgagagacttagtggaccgccttctcagggctgtcacggcaccccaacgggagcttatcgccatccagagggttctggagggctcaccattcggggtcgaacggtatcgtgcgttcgaacggcgtccaaacgctgtcgaccggttcgatctcccgcgtataagctccgcgcctgctctccacgattggctgggattgcctaccgagtgggctagttggtttaccgacttcagagagttggaacgcaaacggcagcccccgaaaaccaaacattaccctcgatggtggacggcgagaaggtggtctattccaagacttatcgaggcccccaagtcacaactgcgacggatgcagcgcaagctgctacacgaactgctcgagcgggtgccatttcacccagccgctcatggaggagtgcggggtaggtctgccgttacacatgccagcctccatactggccgacgcgtagttgctcagttcgacttggccgatttctttccttcaattacattcaaacgcgtgtccggattttttgtggcactcgggtaccccaagcctgtagcccgcgaggtagctgcactgacaacaaccaccacaccagctgagctgctggacctgcagcagctccactctggaggggatcgcgtggtgttccaccaacttgttatgcgattacgagaacggcatctgcctcaaggggccccaacctcgcctgctcttgcaaaccacctcacttttatgctggaccagcgactgtccgaagcggccaagagcatgggcttgacctattcccgctacgtcgatgatttggccttttccggggacgtccccgtgtcacttgaacgtctggagagaatagtcgagtctaatgtgatcagcgagggcttcactctgcggcatagaaaatctcgtctgcacacttcctcaaccaggcagcgcgtgacaggccttgtcgtgaacgttaagccccagcctggcagaagagaatttgaccggtttagggccctgttgcaccagcaggccaaaacgcccaccttaccgctggccgaactcgaagggaaggcagaatggttctccactggccgacccgcaaggagagctaagcttagaaggctactcgatgccattaatagcgcagctgcaagcgctgctgcaggagctgctgccagtacagcggccgagagtagagcaggtgcagatagggcccgctga

SEQ ID NO: 12717 - RNA, 1338 nt, unidentified
  source 1..1338: mol_type = other RNA; note = synthetic construct
atggtgttcgataaacttgcagagttgctgctggattctgattggactcacgaggctattgtacgcttactaacagcgtgttaccggcccccacttagcctcaggaaaactcgccctccaaagcatgaactcttggctaccagtatccttacggctttcccaagtcctcccagccaggctaggctcatagagcatctgcgactgagtccaggcgccaggaggggattccggtatggaaaagtgcagcaggtaaaacttgatgcacagatggctggcggccaaatgcgacacacccccaccctgcaaagcggctgggattatccaaggatctcaaacctccgggagctagccgaatgtctggggatactcgatcagactctgaattggctggcgcggggccctcgtggtaatcatgcatgcgcagcgcattaccggatacaggcggtagagaagcgggctggtggctgcaggctgatcgaagcacccaaagccactcttaagagaacccagcgggaaatcctgaggcacgtgctaaatcgcctccctgtccacgttgccgcacatggatttgttccgcaacggtctacattatctcacgcccgcctgcatgttggacagaagtggatgctgagaatggacctcgaggacttcttcccctccatcgacggctctagggtgtttgggctctttcgctctctggggtatccgtacgaagtggtgcaggcattgaccaaccttacaactcacgtgctgtccattgatgccattcgcgagtcggtgcgccacttagcccgtaatgcccgtaatgaaagaacgatcacagacctggctaggctgtactttagacggcacctcccccaaggtgcccctacaagcccaatgctcgccaatttgattgcttaccggttcgactgccgtttgactggtctggctaagacctgccacgtgacctacagtagatatggagatgaccttctgttttcagggtcatccacctgtcactcatccctttccaaaatagaggaccacgtgggagccatcgccattgaagaaggattcagagtgcgacacagaaagacagcatttattcctaacagccagagacaggccgccgtcgggatcgtcttgaacgagaagcccaacgttgccagacatgagtatgaccagctgaaagccattctccataactgcgtcaggtacgggcctgaaagccaaaaccgcgtcggccacgacaattttgcagctcatctgctgggccgaatccagtggttgagatccttacacccgcagcgcggcgagaagctgttcgagtgttttaagcgaatccatttcgggtga

SEQ ID NO: 12718 - RNA, 1437 nt, unidentified
  source 1..1437: mol_type = other RNA; note = synthetic construct
atggatgagttgagtgacagaagctcatatgcaagcgccgcccaacggagagttgccactgcgttagcccgggcatgtatggcaggggaggcatctcctcctgctatgcgagcccgggccgaaagagtcttaggccacccaaccccatggcttgtccccctggccctacaccttcacttcgagtgcgcgcctcctgccggtgaagtgtggcatcctagacagcatgaccaggtggtggccgccattcttgcatttcccgccttcctggccgctttcgagcagcctgaaggcgcacctggcgttagggcctactacccatttcaccaacccatgggacacccgcccgagccactagctggcttgcttctcccctctctggctacgatcggcgacctggccgactggctcgagatgacaccgtctctgctggactggtacgccgatgcggctgcatggtccgttagaagtagagtcgagaagagagatcattatcactcccgctgggtcgctaaagcagctggtggtgcgcgcctgatcgaagcccctaaagagaatcttcgctttatccagcgccgtattttgcgcgaaatactcaatcgcgtacccgtgcatgaagcggctcagggatgcgtgcggggaagaagtgtggtggataatgcacgaaggcatctgggcagcgctcttctgctcaagctggacctgcgggatttctttgttggcatcagcggcgcccgggttcacgctttatttaggacactcgggtacccacgtgagactgcaagatacctgaccggtctgaccacacgctgttctccggcctggcttctgaggcaagtgccgcaggaggcctacccaagccccgaagagagatgccgacgacgagattgggctcgccagtttatgggcagacacttaccacaaggggcccccactagcccagccttagccaacctgtgcgcatatcggttggatttgaggctggcgggagcagctagggaatgccaagcgggctattcacggtatgtggacgaccttgtgttctcctgtgccgacggagatctcgctcgtggacgccgtatcgtgtcaatggtacaggagattatcttggaagaggggttctccccaaactggaggaagacccggctggcccctgcttgtgcttcacagcggattacggggctagtcgtcaacgaacggctcaatttgcctcgaacagaatacgaccggctcaaagccatactgaccaactgtcgcaggcatgggcctgcaagtcagaaccacaggggagtgccagacttcggggctcatctgcagggacgcctctcgtggttcaggcaggtgaatcccgagagaggtgccaggctccaggcactgtttgatgctgtcccctgggagcacgaccgtcccgatgattccgtacccgggctggcaaggtga

SEQ ID NO: 12719 - RNA, 1398 nt, unidentified
  source 1..1398: mol_type = other RNA; note = synthetic construct
atggacgaaatccctgacttgccaaactatcccctaaacgccacacgcaaagtggctatagccctggctcgagcgttcttggctggcgaaggttcaccggccgccatgagagttaggggcgagagggtcctgggacgctcctattcctggctggtgggcctgacccttcacatccattttgcgttagggccggctctcggacgtggatggcaacctgagttgcatgaccaaatcgtgacccacatcctcgcctttcctgacttcttggccgcctttgaaatacccgacgaggttcctcaggtccgaggctactttcccttccacgcatcgatgaggagtccccccgtacccttagccggccttgcacttccctcactggctactccgggggaccttgccgactggctagacgtttccccttctatgctggactggtatgccaacacggctgcttgggtatacgcacccggggcaagtaaactggaccattaccactatcggtgggttgctaaggccagggggggtgtgagattgattgaggccccaaaggaaaatctacgcttcattcagaggtgcatcttgcgcgaaattctcgatcgggtgcctgtgcacgaagcagcttacggatgtgtgcgcggtcggtctgcagtgtccaatgcgcgtcttcatagcgcctcaccactgctcctaaagctcgatttgagggactttttcgtctccattcctggcgccagagtacatgccatgttccgtactctggggtacccccaggagacagcacggtacctctctggcctctctacacacaataccccagcaagggtcctcagggaggtaccacaggaggagtatccaagccccgaggaacatagacaccggaaagagtgggccaggcagtttaccgggcgccatctgccacaaggagcaccaaccagtcctgcactggcaaacctctgcgcttaccgactggatctgcgcctgagcggagtcgcgcgagaatgccaagctcggtactcccgctatgtcgatgatctcgttttctcttgtgccgatgatgatcccgctcgaggccggcgtatcctgactatggtgcagggcataatccttgaagagggtttcgtgcccaattggaggaaaactcgaatggctccggcgagcacatcacagagagtgaccggactggtggtgaacgatcggccaaatcttcctagacgggagttcgacattttaaaggccatcctgacgaactgtagaaggcacggacctgccagccagaatcgcctcggtctgccagattttagagcacacattctgggcagactgagctggtttcagcaggtgaacgccgagagaggggaacggctgaagttactgttcgatcaggtcagttgggactga

SEQ ID NO: 12720 - RNA, 1380 nt, unidentified
  source 1..1380: mol_type = other RNA; note = synthetic construct
atggacgagccctggtttcccccccctatcactccgcacatacgtcaggtggccgaggccctgactagagctttcctgtatggtgacgatcggcctggccctatgagggaacgcggaacacgcctactcggaagcccctggccttggcttacagatctgtgtctgagactgcatttcgaacttggtcagggcaggccctggcagcccgaacaacacgatgaaattctcgccctgattctggcgtatccacctttcttaggggccacacctccccgcgttcgtggcttttttcctcttcagcccagaatggcacctaggcccggagcactagccggagtagcccttcccgcgttggcctcaacaggagagctggccgactggctggagttgagccccacccagctggattggtttgcgaatcccgggggccgaagaccgcaagctccagaattggggcactaccattaccggtggatgcagaaacggcaaggtggcgcgcgactgatcgaagctccgaaggcccgtctcagggccttacagaggaggatcctggccgaaatcctgaaccgcgttcctgtgcatcccgctgctcagggctgtgttcgcggaaggtccgtcctgtccaatggggccctgcatacgggcgcaccgttactgctcaagctcgacctacgtgacttctttgtctctataccaggagcccgggtccacgctctctttagaacactcggctacccacgggagacggccagatacctgactggcttgaccacccacggtactccaccaggggtgttgcgccaggtccctcaggaggagtacccctccccagaggagcggagacagagacaggcatgggcccggcagtttatggaacgccatctccctcaaggagcccctacatcaccagcacttgctaatctctgcgcctatcgcctcgaccttagattagcaggggcagctagggaagccggggcagtatactctagatatgtggacgatctggtgttcagtcttcccagtcacgatccaggtcgagggcgccgaatcttgaccatggtgcaagagattatcttggaggaaggattcacccctcactggcggaagaccaggattctgccggcgagcacccgtcaatctgtgaccggcctcgtggtgaatcagcagctcaaccttccaaggcaggagtatgaccggctgaaagctatcctgactaactgccgacggcacggccctgctagccagaacagggaggggaggccagatttcagagctcatctacagggtcgcattgcctggttcgcacaagtccacccaccaagaggcgctcgactgatggcattattcgcaggcatagattgggacggactgcggtcgtga

SEQ ID NO: 12721 - RNA, 1497 nt, unidentified
  source 1..1497: mol_type = other RNA; note = synthetic construct
atgagttcttcatccgcgacaaggcaggccggagagggtactgccttccaccggatcgccaaagcgccaatggacgagttttctgagtcgcccgaaccacctgacctgccagaaaaagctatgcggcaagttgccgtcgcccttgcacgcagtttcctagctggcgagagatccccagccggcatgaggcaacgaggaacggctgcactgggtcatgcttggccctggctcgtacagttgtccttgcatctgcattttgagcttgggcaggatttacaggctagaaagcacgatcagatcgtggccttcattctggcatttccgagattccgcgccgcatttgatactccgggccagcaccctcgggtacggtcttacttccccttccatccagtgatgggcacccccccacctcccttagcagggttagcgtttccagccctggccacacccggcgatctagctgattggctggggataactcctagggaactggattggttcgccaatgactggaactctaccgccgcacagcctaaatttaagcactaccactatagatggcttgcgaaaaggagcggcggggcaaggctgattgaagctcctaaggaaaatctcagggcgatccaacgccatatcctacatggaattctggaccacgtgccagtgcacgaggccgcacatggatgcgtgaagggcagatccacactcgataatgcccgtcgacatgccggcgctcctttgctgcttaagatggacttgcgggacttcttcgtttccatccccgcgagaaggatccatgcactctttcggtccttagggtaccccgtcgctaccgcatcatatttgacccgcctgaccacacacgcaacaccggcctacttgctccagcaggtgcctcaagctgagtaccccagccccgaggaacgtagacagaggcagatttgggcccgccaatttatggaacgccacctgccacaaggtgctccgacgagtcccgcccttgctaatctgtgttcatatcgtctagatcttcggctcgctggcgccgcacgagaatgcaatgctcgctatagccggtacgttgatgacctcgcattcagctgcgacgataaccaggcccacggaagacgaatactggccatgctgcaggatataatactggaagagggctttaccccaaattggaggaaaaccagactcgctagcgccgccacaactcagaggttgacagggcttgtgattaacgcacaccccaacctgcctcgcaaggagtttgacacgctgaaggctattctgaccaactgtcgccgattcggagctgcttcacagaaccgggacggtcggcctgacttcaggagccacctccaggggaggattgcctggtttcgtcaggtcaaccctgagcgaggagagaaactcagacgcctgttcgaacagatcgactgggcctctgcggagactatccggaatagagccagaatcagtctgacttga

SEQ ID NO: 12722 - RNA, 1389 nt, unidentified
  source 1..1389: mol_type = other RNA; note = synthetic construct
atggatgagttctccgatgaccctgagctgcccgaacttcctacaaaggcgatgaggcaaatggccgtggccctcacacgggcctttttggctggagagcccaaccccgccggtatgagagagaggggagggatcgcactggggcaagcatggccatggttggttcctctctccctgcacttgcattttgagctcggcagcgagttacaggccagagagcacgaccggattgtggctctgatcctggcctatccccgcttcagggctgcatttgctgtccccggagagcgccctaaggttagggggtactttccgtttcatcccccaatggggaggccaccacctgccttggcagacctagctctgcctgctctggctacccctggcgatttggccggttggttgggcctgacaccgggtgaacttgactggttcgcgaatgcatggcaccagcccgcggcaaccggtaagcttgatcattaccactaccggtggctcgcaaaaaggtctggcggagcgcggttaatcgaagcccctaaggagaacctgcgtgccattcagagacgtatcctgcacggcatactggaccgggttcctgtccatgaagcggctatgggatgcgtaaaagggcgaagcgtgttggataatgctagacgccatgccggctcacccttactactcaaaatggaccttcgcgactttttcgtatcaattccagcgcgacgcgtgcacgcgttgttcagaagcctcgggtacccaagcgccacagcaaggtgtctcactggcctgacgactcacgctacccccgcagctcttctaagacaggcaccgcagaccaaatatccttctccagaagagcggcgccagcggcaacaatgggctcgacagttcatggaacaccaccttccgcaaggagctccaacttcgcccgccctggccaacctgtgtgcctatcgcctggacctgagactcgctggggctgctagagccggacaagccaggtactcccggtatgtggacgatctggccttcagttgcgccaatggcgatccccgacatggcaggagactcctgaacatgctgcaggatatcgtgctcgaagagggtttcaccccaaattggcgcaaaacccggctggcacctgccagtacggcacagaggcttacaggtctgctagtcaatgcccatccaaacctgccaagaggagagtacgaccgcttaaaggccatccttactaactgccgtcgacacggccccgcctctcagaatcgtgatgggctgcctgacttcagagcccacctcttagggaggattggctggtttggacaggtgaaccccgcacgaggcgaaaagctgcatcggctctttgaacagatagattgggcatga

SEQ ID NO: 12723 - RNA, 1401 nt, unidentified
  source 1..1401: mol_type = other RNA; note = synthetic construct
atgaacgatcccgacgactttgacgatgacttcgacccagatgaccttctaccggcaagggcaatgcgcagtgtggccattggcctggtaagggcctttctggccggctcgtcagatcctgccagccttcgggagcggggacgtagagcattgggagagtcacctcggtggctgccctccttagtgctgcacctgcacctcgagctgggtagtcagtttaccactcgacagcatgacgcactccttgatgccgttctggcgtacaggcaattcagaaatgccttcctgcctggctctaccagacccaggatcctgtgtcacttcaccttccatccccctatggatgaacctcccgccgtattggccggagtggcagttccgactctgcctaccagtggggatcttgctgactggctggggctactgcccaacgaattggcctggttttgtggaaactggcgagaacagccatcacagccaaagctgggccattatcggtataggtggctcaacaaagctaatggtggacgacgcttaatcgaggccccaaaggagacactcagatctatccagagacgaattctgcacggcatccttgacaaattgccggctcataccgctgcaacggggtgcgtgagagggctgagcgttgtcgacaatgcccggagacacgctgactcccctctgctgcttaaaatggatttacgcgacttctttgcaagcattccagccggtcgggtgttcgcactcttcaggactcttggatacccccccgcgtccgctcactgccttacacaactctgcacacacgccacgcctatgcgagtgctccgcgaactgccacaggatggtcacgggagctgggagtggagacgccagcagcaggaatgggctcgtcggtttaatacccgccatctgccgcagggggcaccaacaagccctgctttggctaacctgtgtgcgtacaggctcgacttgagactggcagggctagcaagagaatgcagggccacctattctcgttacgtcgacgacctagctttctctctgccaagacacgattccgcccgcgcccataggatacagttactcgccgaggaaattatcctgcaggagggatttgcgcccaatcggaggaaaacacggttgtgcccagcgggccaaactcagactctcaccggcctggtcgtgaataggcatcccaatctccccagagctgagtatgatcggcttaaggccatattgactaactgtcgtaggcatgggcctacaggacagaaccacgatcagcaccccgattttcgcgcccacctgcaaggccgcttagcttggctccgacaagttaaccctccaaagggcgaaaagctactggtcctcttcggtgagatcgactggggctga

SEQ ID NO: 12724 - RNA, 1398 nt, unidentified
  source 1..1398: mol_type = other RNA; note = synthetic construct
atggacgatgaggaggcacacccaccctttggaccggagcatgccggcagggataaggcccgagtggctctggggcttgctagtgcctttttagcaggctcacccgagcccgccagtttgcgagagaggggaaggcgcgcgcttggtagagattggccgtggcttcctgctctcgctttgcggctgcaccacacattcggcaaagccttcccaccacaccgactcgatgatctgcaaagactgatcgtgcgcgaccctgatttcatagcatcattcgctgattctgaaggcggtcctagaatccgggcctggtttccactgcaccccagaatggctccccccacaatcccaggtttgcccgccctcccacagcttgctaccctggacgcactcgcagactggctggaagtgaggttagaagacctggatcggctcgctgaacctcaggcgtggcgtcctcccagatcagcatcgcctctggaacattaccggtatcactggaggcagaagcgtgatgggggccttcggctgattgaggcccctaaacctcggctgcgacgcttgcagcggcgcattctgcacggtctgctagacctggtgccagtgcaccctgccgcaatggggtgtgtcagaggccgcagcgtgatcgaccatgctggtcagcatgccgggcagcccagacttgtcaagctcgaccttcgtgatttcttccccgggaacagagcctcccggattcacgcgctgtttagatctctcggataccctaccatggttgctaggcacttaaccggccttacaacgcactgctccccaccgcgcatactcagaaccctgccccacggagagtatgatagccccgagcagcggctgaggactagaaggcgtgccatggccttatgcgaccggcatctcccacaaggcgcaccatcttccccggcgctggctaatctgtgtgccttccgcctagacctgcgattagccggggctgctttggcatgtggagctcggtattcccgttacgtcgacgatctgtcttttagcggagcgttcgacgctgcccggggtcataggatgctggccatgattgacgacatcgtgcgagatgaaggctttgacccaaattggcgcaaggcggcagtagtgggagcaggagctgcccagagactcaccggcctcacagttaacaggcaccccaacctgccgagggcagagtacgacaggctcaaagccatcttgactaactgccgccgccatgggcctactagccaaaataaagccgggcatcgcgatttcagggcacatctattgggccgagttgcctgggcctgcgccgtaaatccagccagaggcgaaaagctacggagtatctttgacaggattgtctggcctgagggatga

SEQ ID NO: 12725 - RNA, 1398 nt, unidentified
  source 1..1398: mol_type = other RNA; note = synthetic construct
atggatgaggaagaggccgatctgccctttgggcctgcgcatgcaggtagagggctagcccgcgtagccttggggttagccgcagcttttctcgcgggctctagtgaggcagcggggttacgggaaaggggtcggcaagccttgggtcgcgattggccttggctgccctcccttgcgcttcggatacacttcgccttcggcagcgaattctctcctgatcgcctagaagatctgcagtccctgattctgggagatccaggctttgccaaggcattggctgaccccgatggcgggcctagaatccgcgcttggttcccattacacccacagatggccagccctgttgtgcccggcttgcaagctctgcctcagctcgccactctggatcagttagccgatctcctggagttgagcgtcgacgacctggactggtttgctgacccacaggcctggagagcaccgaaaccagactctcccatcgccaggtatagataccactggcgacgtaaacgtgacggcggcctaaggcttatcgaggcacctaagccccgccttaggaggctccagcggaggatactgcacggactcctggatcccgtacccgtacaacccgccgctatgggatgtgtgcggggtaggggagtgatcgatcatgctggcctccacgccgggcaaccaagactggttaaactggatctgcgggatttctacccagggattcgggcctcaagaatacacgccctgttcagatccctgggctatcctaccaaggtcgcccgctatctcactggactcacaacgcattgtagcccccctcgcattcttcgggctctgccttacggcgagtacgacagtccggagcagaggatgcgtacccgacgacgagccgtctccctttgcgaccggcatctcccacaaggcgcacccagtagcccagcactggcaaacttgtgcgcgtacagactggaccttcgacttgctggagctgcgcgggcatgtggtgcacgatattcgcgctacgtggacgatctgtgcttttccggcgcttttgacgcagcccagggacacaggattctcgccatgatcgacgatatcgtgcgggaagagggattcgaaccgaactggcggaaggctgcagtggttggtgcgggagctgctcagcgtctaacaggactgaccgtcaatcgccacccaaatctgcctagagctgaatatgacaggctgaaagccattttgacaaattgccagcgccatgggccgtcatcacagaacaaggggaaccatcgcgactttagagctcacctccagggcagagtggcctgggcatgtgccgttaatcccgcccgtggggagaagctcaggtctttattcgacagaatcgactggaggcagggctga

SEQ ID NO: 12726 - RNA, 1383 nt, unidentified
  source 1..1383: mol_type = other RNA; note = synthetic construct
atgtcaaggcttccaaagccccctatcgatccggctattctgcatgtggcacgcggactcgcacgggcttttctacacgaagctggcggcatcaccgatctccaacagcggggcaaggccgcgttaggcactgcacatgactggcttccacgcatggtgcgccgtctggatcagcatttcggcctgccgctcagaccagcccaatttgaggatatcgtgacctgtattgctacactccctagcttcatcggtgcctttgaacggcggcccgtgcccaaaattcggagatatttttcctttcagcctcaaatggctgcgcttcctagaaccctggcaggcctggatttaccagcccttccaaccgttggagacttagccgcctggttagccctgagtatggacgagctggagtggctggccgacgtacactctattagcagcaaaacagggagcgaggccctgcgccactaccattatcagtggaaggcaaaggcgtccggtgggcatagactgatagagagtccaaaacccctcctgtgtgcaatccaacggaagatcctgcacggactccttgacaaaatacctgtacacgatgcggctcacggatgcgttccccatcggtccatactttcaaacgcccaagtgcacgctggatctcctctgatcctgaagatggatttgcaggatttcttcacatctattcgtgccagccgcgtccacgccttgttcaggacactgggttaccccgaggaagtcacaaggtaccttaccgccttgacaacgcacgtgacaccgtcgtttatcttccacactcagcctagacctgagggcctgactagtaaagcactccagaccagacgaaagcaggccgagtcctaccgagcccgacacttgcctcaaggagcacccacctccgctgctctcgctaatctctgcgcctggaggttggacctacggttggctgcagcggctcaggaaagtggggtgcgctatactcgatacgtggatgacctgattgtctctttcccatcacatactcgcgcacatgcctggagaatttcactcatgattgacaccatcatactggaagaagggttcactccgcaccccagaaaaacgaggctaacctctcagagccaggcgcagtgggttactggtgtcttggtgaacgagaagcccaatatcgctcgctccgattatgacaggctgaaggccaccttgacaaactgcatgaggcatggcccccacggacagaatagggaagccctgccagacttccgagcaagactgcagggccgtatcgcccatgtcaaacacataaacccagcaaggggggagaagctccagacgctgtttgacgccatcgggtggcaggctatttga

SEQ ID NO: 12727 - RNA, 1524 nt, unidentified
  source 1..1524: mol_type = other RNA; note = synthetic construct
atggaggggcggactgcttttggcgccaaagctgccgagggcggaagagtcgaggacagttacgatgacgaggaagcagccgccgcttggttagctgcccgagctagggccacacaggcagttgcaacggccttggcccgagcctttctcgctgcctgtgcttctcaggcgcaaacagcggcagatgcaggaggtcccgttgctgctcctcacacagctactggcgccagagctgctgcagcagccatgcaggcatgcggccgacgagtgctgcgtaggaagtacccctggctcgcgcggcttgttagacacgtccaggccgcagcaggagactgtccaaggcctgcgcagcatgatgaagtccgggccctcatcctggagtttcccccgtttcggtctgccttcgaagacgatgaaccccctagggtgcacgcctggttcccatggcacgagtgcatgcgtgcacccccacggagacttgctggcctgaatcttcctcagctcgacacccccggcgacttggcagcatggttgcacgtgagcgtgggggaactggcctggtttgcggaccctggtggatgggctgaggcaagcggagtagaggccctgagacactatcggtatcgctggaatgccaaagccggcggcggatggaggctgttagaaatcccgaagcctagactagccgcactgcagcggaagatcctcagagagattctggaccgtgtccctccccatgctgcggctcaaggcgctgtccgaggaagatccgcactgggcaacgcagcgatgcatgccgattgtgggctggtacttcgcctggatattgaagatttcttcccaaggctggccggcgcacgtatagctgccttgttccgcactctgggttatgctcctgcggttgcccgtttgctcgccggtctatgttcccacgctacccccgccgcggtgtcaagtactgcaccatgcgccggcctaccaggcatcgatggacttcgcgccaggagggacttggccgacatgtacggtagcccacatctgcctcaaggggccccgacatcaccagccctggcaaacctggccgcctacagactggatctccgacttgacggagcagctagggcctgcggttggaggtacaccagatatgtggatgatctgtttttctccggccctggaggaagcccagcacatgctctgcgcaccgcccaaatgctccaggggatcgtgctggacgaagggtaccggccgaactttaggaaaacccgcgtgatgccccgggggaggagacaattagtgaccgggctcgttgtgaatcggagagcagccataccccgcgaccagttcgatcgcttcaaggctatgttgacgaattgcctccgccatggggctgcctctcagaaccgcgatggggtagctgacttcagagcttcggtggcgggtcggttagcttggttcgagcaggtcaatgtggccagggccgccaagctgcgagctctttttgacgcaattaactgggcgtga

SEQ ID NO: 12728 - RNA, 1464 nt, unidentified
  source 1..1464: mol_type = other RNA; note = synthetic construct
atgcgaatagctcagcagggggaaggggaagagccctatgcacacagatttgcagcccctactgctgcgatggatgccgttgctattgcgctggccagagcttttcttgcagcggtcacacagaccgccgattccgctgctggtgctgctgaggccatggaacccagccaacgtgccttggctgccgctatgcaggcatgtggcaggcgggtgttggcgaggaaatggccttggctggcaaggcttgtgcgccacatcctcagcgaaaccggaccccaattacgcccagcccagcacgatgaagtcagagcgctgattctcggctttcctcccttccggcttgcttttgccgcagatcagccacccgccgttcatgcctggttcccctggcatgatgccatgcgctctgcgccaagggcactggcacagcttgctttgccgcagatcgacacacctggcgatctagctgcctggctcggactaacggtgggcgagctcgcatggtttgccgactcgggaggatgggccgcacgttctgacaccgagaggcttcgccactaccgctaccggtggcttgcaaagccttccgggggttggcggctgctggaaatcccgaagcctagactggctgcgctgcagcggaaactcttgagagaaatcctcgacagagtgcctccacatggtgccgcacagggagcggtcagagggtgtagtgccgctaccaatgccgccgcacatacaggcagagggctggtgttgcggctggacatcgagaacttctttcccactttaggggctgggcgcatcgctgctctgtttagaaccctggggtatcctggggcagtcgccagtctcttagccgccctcacaacccacggaactccagccgctatagccggcgctgcacccttgggagagtatgctggagccgccgatctgcgagcaaggcgagatatagcccagctgtatcggagagcacacctgccccaaggtgcaccatcttcccccgccctcgccaatttggccgcgtacagactcgatgtaaggcttgctggagcagcccgagcatgcggctggatttacaccaggtacgtcgacgacctttttttctccggcccagcgactactccggctcaagcacgccggaacgcccaaatgttcctgtcaattctgtgtgacgagggctacacgcctaattgccggaaaacaaggatcatgccacggggcaggaggcagtgcgtaacaggactggtggtgaacgagcgtccaggcattgcccgggacgaattcgaccgtttcaaggccctcctgaccaattgcctacgccatggcgcagctagccagaacagggccggtgtggccgatttccgcgcttcagttgccggtcgactggcctggttcgagcagattgacagcgccagagcagcgaagctgcgccgattattcgaggctatcgagttttga

SEQ ID NO: 12729 - RNA, 1434 nt, unidentified
  source 1..1434: mol_type = other RNA; note = synthetic construct
atgcgcgccgcaccaatgcacgatgaaagtcatccccgcttcgactcgcaatacatcgagcctgatctgctggccctcgccacccaactagcaaatgccctccttgcgggcgagcagcgaagtccagcattacggaaaagacttcaaacagtgcttggacggaattggccgtggttggcgcagctcatcagacaggtccggctggattttggcgacgggatctccagcgccgagcacgatgaacttgtcaggagcatcctggccttcgctccacttcgccgagcctttgagtccgatggtgaggtgcctcgcgttcgcggatggttcccttttcaaccaccgatgggggctcccccagcacgattaggtgccattgacctgccagccttggcaacgcccggagacttggctgactggctcgggttgcgaatcggcgaactggactggtttgccggctcactaaggccccaggttgcggctaacgggcccctttggcactacagctattgctggctggcaaaacgtaggggaggatacaggctcatcgaaattcccaagccccggctgcggaatttgcagcggaggattctgagagacattcttgaaagggtgccagtacatccagcagctcatggctgtgtccgtggacggtccgttgtgtcagccgccttgcctcacaccgggaccgatgtagttctgcagatcgatctgcgcgagttcttttctacggtgacagccgcccgggtgcatgctgtctttaggactttaggctacccaccggccgtagcccgtctgctaacaggtctagcgactcacagtactccccacagcgtgttacgggcagcgcctgtagctgagcatgcggacgcccaggctaaaagatctcagatgcaaagacaggtgctgctgacagtgccgcacctgcctcagggagcaccatcatctcccgcgttgaccaacctgtgcgcataccgactcgacctccggctctcaggtgctgctgcagcttgcggcgtggggtatacccgttatgtcgacgacctcatattctccggggatgtggccttcgcccgcaaaattgaacggtttaagagcatggtttatagcattatagtcgatgaaggtttcgagccccacttccagaagactagagccaggacccaggccactcctcagcacgttgtgggcctggtggtcaacagaagactgaatgtgcctagatgcgagttcgatgctctgaaggcactgctccacaactgcaggtgccatggaccagccggccagaacagacatgcccatcccatgtttaggcaacacctgcttgggtgtatcgctagggtggcccaggtcaatcctgctcgagccgcacgcggctgttgtggtatatctgcaccctccacaggccctgaccgcgctaagcctagatgtgcttga

SEQ ID NO: 12730 - RNA, 1107 nt, unidentified
  source 1..1107: mol_type = other RNA; note = synthetic construct
atgggtgagccaccagcctcacttagggccaaggccaaggagttaccccggcttgccactcctggagacttggctgactggctgggcctccctattggcgaactggactggttcgccgcgtccttgaggtcggacctaacagcagatggccccctctgccattatcgctacaggtataggtacagatggctggccaaacggcgagggggttaccgactgattgaaattcccaaacctcgcatgcggggcttacaacgccgggtgctccatcggatcctggagcaggtgccggcacacgatgctgcgcatgggtgcgtgtcagggcgcagtaccattagcgcggccttgccccattccggcaaaaatctggtactgcagatctacctgcaggacttctttactggggttaccgccggtcgacttcacgctatgttcaggacactgggctaccctccagctgccgctagaacactgacgggccttgtgacgcattctaccccctatagcatactgagagcatctccttcaccagaactcggtcagaacgatgatgcgggaaccaagagcagaaggcacgctatgctccgaatcgcacacctaccacagggagccccctccagtcctgctcttgccaatctgtgcgcttatcgactggatctgcgtctctctggggccgcagcagcttgtggaattggatatactcgctacgtggatgacctgatattctccggggacgacgcatttgccaggaagatggaacgtgtcaaaagcatgctctactccattatcgtggacgagggctttgagccgcactatcggaaaactagagcacaacgtcaggcaacctctcagagaatagtcggcatggttgtcaaccagaagccaaacgtacctcggagagagtttgatacactgaaggccatcctgcacaactgtcgcaggcacggaccacaagggcaaaaccatttgtgtcatccccactttcgccagcacctcctaggccggatcagtcgcgttgcccagctcaatgctaatagaggtgagcggttattgagagaattcaggcagatcgattggagccccgctgtgttgccgaaggccggatga

SEQ ID NO: 12731 - RNA, 1509 nt, unidentified
  source 1..1509: mol_type = other RNA; note = synthetic construct
atggccttcgcactaccacaccccatgggcctcaatccgcacgacgacgtcgcactaagagccttcgcacagcatctggcacgtgcactcctggctggcccttggactccgatggctatgcgagcccgactcaggagggccttaggccttgctcggggaggagcttctcctgattggctgcgtcagctcgtgagacagttacacgcacaaccaccattcgccctcccagcacagccacaacgcagaaaagctgcaggtgctgccacagggcctgtcccaggttcagcccatttgcaggctgtggctgacgcagttgcccagtgtcccgcgctccagcaagcatggagcgccactcccgctcatgctccatggcggattaaaggattctttttgccccctcctcctcctaagccggcagccatcgccaaactgcagcctttcgtgagagagctgccccccttagcgcaggtgggagatatcgcggcctggctggagctggaaccaggtcagctggactggcttgcaaattgccaggataggcccacccccagccctaagctagcccactatagggcccactggctccctaaaggccaaggcgggttaccccgcttgatcgaggctcccaaagcccgcctgaagcagattcagcggcggatccttcaggagcttctggcccccattccactccataacgctgcccatggaggggttaggggaaggtcggccctgtcccatgcccaagcccatgctgggatgcccgtcctgttgaagttcgatctgcgcgatttttttcccagtatacgggctgcccggatccacgccatctttgcatgcctgggacacaccccagccgtctgtcgagttctgaccgcgctcgtcacaacgcgcactgctcatggggtgcttcggacagccccgctaaccgctccaccacagagtgctccgtgtggcgcgggaacaggtccttctctcgcagtgcaacaggcgcagctgagacagctgtatggccagcgccatctccctcaaggcgcacctagctccactctcctggcaaaccttgcaacggcccggttggatatgaggcttgcggcagcagctgccgccttacagggtaggtacacaagatacgtggatgatctcgccatttcacttccacagctgcctcgcgcgcaattgttgcgcatgcagcgcctggtacggaggatcgtgcatgaggaagggtttgtgctgaatgaagccaagtgtgggctgtacaccgcctcccaggcgcactacttgaccggcatttgcataaacgctcaccccaatctgcctcgagccgcctatgaccaactgaaggccatattgcaccagtgcgtactacacggcccctctagccagaacagggacgggcaccgtgacttccgagctcaccttcagggcagaattgcctggtgcagatccctgaacccagctcgtgctgctaagctgcagagactgtttgaaagaatcgactggcaagactga

SEQ ID NO: 12732 - RNA, 1296 nt, unidentified
  source 1..1296: mol_type = other RNA; note = synthetic construct
atggacaagagactgtttagtcacaatttggccgtccacctttcgctctgcccctggagcctagatcagatctctgcttgtttgcgcagaaatctgcctaagggcgctcataaatataccaccgaaattgctaacgagctccatatcgggttacccacaatctttacaccatcagtttcggcgatagaaattgtgctccgtagggcgatacggctggaaagtacttaccagttttgccggaaacaagggaaatggccggctctcaacctgagctccccaactatgtgtcctacccccgcatttgaaggccttgacattcctcagctgcctacaactgcctctgtcgcggactggctgtcaataagcgagagaaggctagattacctggccgatgagcagaatcggcatgaggagcacggcgaggccagcattaaccactaccactacattttcaaaaacaagaatggagggggtattagggtgatagaggcccccaaggaaaacctcaaatcaatccagagggccatcctgaagaatatcattggaatcgtgcctcctcatgatgccgcctttgggttcgtgaaagggcgaaattgcctcaaagcggcaaacagacatgtcggcgaaaaggtggtgctgtgcttcgacctgaagaatttttttccctccattggcgcaggtcgggtgttcggcttattccgctgtttggggtatccagatgccgttgctcgggtgcttacgagcctgtgcacctccttgaccccaagaaggatactggaacgctttcccttggaggaaaggtcaatttataacaaacgtcatctcccacaaggagctccgacatccccagccctggcaaatcaaatctgtttcggactcgacaagcgccttaatgccctggcaaagtgtctcggcgcacagtattctcgatacgctgacgacctgacattcagcggcgataagcatatcgctaggcccctgcagtacttcctgccagtaatcgcccaggacgaggggttttctctgaatcgcgccaaaacgcgcgtgatgcctcgagcatctcggcagaccgtcactggcgtgctggttaacgagcacttaaacatcgaccgccgttccttcgataaactcaaggctatcattcacgcatgcggtaagcctggagatcgaagacttttggaccccagtttccggaaatccttaatgggaaagatcgattgggtagagagcgtcaacccgcacaggggtcaaagactgagacagctacttagtaaggccgttgagaaccacatctga

SEQ ID NO: 12733 - RNA, 1293 nt, unidentified
  source 1..1293: mol_type = other RNA; note = synthetic construct
atgaaccggaatgaagtatctcttaatctcgcccgaagcataactagaggtgaatggtccaaggagttcattaactctaatctcctcagaaggctgcctagcactgtccacaagctggtaccagctatctcagaggatctggtgaccgagctgtcagcacggtatgccccgacagagaaatacgttgctgagcatctgctatatgaccgtaacttcgagaggatctatcgctactgcgcccgaaaaggtatatggcccacccccgatttgtcaccccccgtcatggcacccatcccagcctttcaaaagatcgacctgcctcaaatccccacactttctgctctcgccgaatttctgtttctgactccagagcagctcgagtacctggcggacaggaatgggcgccatgaagaacatggggacatggccgtgaatcattatcattacgtgctgaaacctaagaggaccagtgggcatcggctcattgaagcacctaaagagcggttaaaagccattcagcgccacattttgcgtagtatactggataaactccctacccaccccgacactttcgggttcgtgagatccagaaactgcctgcagggagctaatcggcacgccggtgaacaggtggtactcagatttgacctcaagaatttctttccaagcattagcgcaggcaggatctttggactgttccggtgtctgggatacccccacaacgttgctgttgatctgacggcactgtcaacaaccaagacgccagcccgtgtcttggagagattgttctaccccgacagagggctatacaagaccacccatctgccacaaggagccccactttcccctgccctcgcgaaccacgctgcctttggcttagataggaggttggccggactcgcaaagagattggacgctaactatagtcgctatgctgatgatttgactgtgtctggcgatcacactattacgtccaaccttctaaggctagttccgcagatcattaaggatgaaggcttcgccttaaacacctccaagacacgggtcctgcctcagacaacacgccagactgtgacaggcattgtggtgaatgaccacctgaacatagaccgcaaaaccttcgatcaccttaaagcagtcatccatgcttttcagaaggaaggcgatcaccgactgagtgacccagcgttccgggcaagccttgagggcaaaatcgcttgggtggaggccatcaatcctagccgaggtcagaagctttggcgcttactggacaacgcggagaagccgtcgtga

SEQ ID NO: 12734 - RNA, 1275 nt, unidentified
  source 1..1275: mol_type = other RNA; note = synthetic construct
atggccgcctcattatccgcaacacagtggcaagctcatgccctggaaagggttttcaggagccgcttaccaactccactggcccagtacgcagccgagtttagcgctggtcttatcgccgccctgccgtctgcttatgctccggaacctgccgcagtggctgccgttctcgtccatttgacctcctttgagcaggtcacagcctgggctgtgaagaacggccactggcctgtgcctgacctcagagaaactcagtttctgcccatcgccgctttcgctgacctcagtgtccccaagctcgccacaatggcacagctaggcgactggctggggctgagccaggagagactcgcctacctcgccgatactcaggcccgacacgaagagcacggcgagacagcaattaaccactaccattacgtactgcagcgcaagaaggggcccggacttcggttgatcgaagcgcctaaacaaaggctgaaggcagctcaacaccagatccttagacaaatgctggatccactgccagtgcacgacgatgcatacggattcgtgcgcggccgtagttgccaggcacatgcagctcgccatgcaggaacacaaatggttgtgtccttcgacatgagacagttttttcccagcatttccgccggaagggtgttcggcctgttccggtgtcttggttatccctctgctgtggcccaccacctgaccggactctgtacttctgccacgcctcccaggattttgcagagattaccatacgctgatcgagtcgtctatagagccgctcatcttccccagggagctccgagctcaccagcgcttgcataccatgttgcgttccggctagacaggcgactcagcgccttggcggacagtttagacgccacctatggcagatatgctgacgatctaagtttttcaggggaccggcgcataaccgaaccactgatgagactggtacctcagattttgcgtgaggagggcttctgcctcaacccctccaaaacccgcgcaatgcctcagactgctcggcagtcagtgacggggatagtggtgaatcagcacctcaatatcgcgcggggccagtatgatcggctgaaagcagttgtgcacgcctgcggaaagcctgacgattctaggttggccgatcccgtcttccgagggaggctggagggccaaatcgggtgggtagcatcgctgaaccgtgcgcgcggtgctaaactgcaagccctgtttaataccgcgcttgatggggccctgggtggctga

SEQ ID NO: 12735 - RNA, 1368 nt, unidentified
  source 1..1368: mol_type = other RNA; note = synthetic construct
atgtcttgcactttgagattgacaatggaacgccacgagcgtcacatgaatgatcagcatttggccttgcttctggctacgagactgaccggaccgtggagcgtgcaggatatcactcagtccctgtgtagacatctacccgccccactgcacacacaagctgaagcaatttcccagaagctgctgagaatccacccagggccctatgctcctcccatcaaacagatcgcaagaacactcagaaacgcggacgaatttccccgcattaaggcccattgtgttcgatacaatgtctggccagcggccaaccttacgcctcctcagatgatgccaatcggggcccttgcttctctcgatctacctcagattcccaccctggaggatctcgccgactggctcctgatccctactgatcagctgaactacctggccgacccgcaaaagaggcacgaggcccacaacgagatggctgttaaccattaccactatcatattcaccccaagagtaatggagcatcccgattaatcgaggcccccaaacagcgcttaaaggctgcacaggctcagatcctgaggggcattctggcacacgtccctgatcacgacgaagcatttgggttcaccaagggccgtaactgcatgtcaggggccaccagacatgtgggcgagcaggtagtagtcggattcgacgtgaagaatttcttcccaagtataggagctggccgaatttttggcttatttcgctgcctaggatatccggagagcgtcgcaaggtttctcaccgctatttgtacaaatgtgactcccagccggatcctgaatcgactgcaggcgcctgagaggcaacaatttaggcatcctcatctgccacagggtgccccaacttcaccagctctctccaacaaggtcgccttcacgctggacaggcggctttctgggttagcaactcggcttggggccaattactcgcgctatgcggatgacatatctttcagtggggacgtgggtataacacatcctctactgcaacaggtgccaaggatcctccggaatgaaggcttcgcccccaatccggccaaaacccgcgtgatgcctaggggaggtagacagagcgtgacaggcattgttgtgaaccagcaccttaacatatcacgagagaaattcgaccacttgaaggcggttattcacgcttgtcggctgcccacagatctgcggcttgatgacctcgcatttaggatgaaattggaaggccaaatcacctggatcgagtgcattaaccccgtgagaggttgcaagttgcggcggctcctcaaaaagagcctgaaagcccgcatcgccgaaaccaccaaaactggccgtgcactgtga

SEQ ID NO: 12736 - RNA, 1332 nt, unidentified
  source 1..1332: mol_type = other RNA; note = synthetic construct
atggacaaacgcgatctggccagtaatatcgccatctcccttactaacgggacctggtcgaaagatcaggtgaccgcgcagttaatgcgtcggtttcctaaatccctgcaccgatttagtaaccagctgtctgcagaactgcttgctgcgtgccccacaatttatgctccgagtgccaatgctgtgcaaaacgtgcttcagatgtctgcaatttttgaacgaatattccgatactgccagagacgcaatatctggccaaacccggtcttggtcgagcctataatggcccctacagccacattctccgaactcgagattccccagcttccaacagtggaggccctggcagattggctcctcgtgccgatcgacagaatagattacctagccgaccccattggccggcacgaaaaccacgaggtcgcagccgtgaaccattatcactatctgttgcacccaaagaagtccggggggttaaggctgattgaggcccccaagcatgccctgaagagcattcaacgccaaattctgcgaggtattctcgataaggtccccacccatgatgatgcttttgggtttgtgcgtggaaggtgctgtgtgggggcagcagctagacatgcaggagagcaggtcgtggtaaattttgaccttaaggacttcttccccagcgtaggtaccggccgcgtttttggactgttcaggtgcctcggttacccaaacactgttgcaggcctgctcacgggcctttgtacaactagaaccccccatcgcttgttaaagcgcttgaaccccgcggacagggcccaatatcgtgaacgccatctccctcagggtgctcctacttccccagctctggctaaccacgtggcattcgctctggatcggcggctagccggcttagctcgatctataggagccaactactctaggtacgccgatgatctcagtttctctggcgacctacagatatcagcaacactcctgggcattgtgccacagatcgtccacgaagagggcctgagcctcaatcctcacaaaacccacatcatgagcgctggatcaagacaattggtgactaatatcgttgtaaaccggcatgtgaatgttaccagagaaaagttcgacaaaatcaaggccaccatccacgcgtgtgccaagcccgacgacgagagactgtcagacccagtcttcagggccaaattgctgggacagatcgggtgggttgagacagtaaatcctaagaggggcctgaaactgagaaaacgggcgatcgaggctattcggaaagccacgatcaggtcacctagccggaatacgagcactcagatctga

SEQ ID NO: 12737 - RNA, 1299 nt, unidentified
  source 1..1299: mol_type = other RNA; note = synthetic construct
atggattccaagagccttgctagaaatctggcccaatccctggccatggggccatggtctaggcagttcataagagccactttagttcgacggctgccgcgtcaactgcacaggatgattgctgggctcagtgaggaactgattaaatccctgccatgcgcctacgcgccctctgtgaaaacagtggcaggcgctctgggacgaagcgacagatttgaaaagattcttaggcattgcatcagacatgacgtttggcctgatcccgacctgtcaagtcctgcaatggcccctgtggctgcgttcgcgactctggatctccctcagctcgctaccctcgacgcacttgcggagtggcttttcttacctccagaccgccttgagtacttggctgacaaagattcacggtatgaggagcatcgggacgccgccgtccaccattaccactatatcgagaaagtgaaggcgtcgggcggagtgcgcatcatagaagccccaaagcctcatcttaaggcagctcagcgacggatcttgcgaggcatcctcgacaaagttcccgtgcacgccgacgcttttggtttcgtgtcgggcaggaattgtttgaatggtgccaataggcacgtcggcgaagatgtagtggtctgcttcgatctccgcaacttctttcccagtattgggctggcccgcatttttggcctctttcgatgtataggctacccgcacgaggtagcaaggctgttgaccggcctgtgcgttacgaccacacctatgcacgtggctaatacactgacaaccgtcgacaggcagacctatagacgcccccatctgccacagggatctcccgcttctccagccctggcaaacctggcagccttcccgctggatcggagattaagcggattggcaaagtcactggacacgaactactcccgctatgccgacgatctctcctttagcggggaccgggaaagtgtgggggcactactaagagctgtacccggaatcgtcgccgatgaaggattcgagctgaatcagacaaagacacggattatgagcgctacttctaggcagatggtgactggaatcgtggtcaacgatcacctcaacatcgatagacgtgagtttgacaggctaaaagccatcatccatgcttgtggtcggcccggggacactagattggccgatccagttttccgctctgccctgctcggtaagattgcctgggtggaagcagtcaacagccagcgtggccaaaagctacttaccctgttatcattgagcataacctcccgccacgcatga

SEQ ID NO: 12738 - RNA, 945 nt, unidentified
  source 1..945: mol_type = other RNA; note = synthetic construct
atgagtcctgtggcggtcttcgccgcactcgacatcccacaacttgccaccttagacgctttgtccgattggctcctcttacccatagaaagattggactatctggcggaccttcatagtcggtacgagaaccacggcgacacacaggtaaatcactaccactatgtcctccaccgaaagaagtcgggggggatgcgagtaatcgaggccccgaaggcaaccctgaagactgttcagaggcagattcttcatgggatcctagataaggtgcctgctcaccccgatgctttcgggtttgctaagggaaggaactgtctggatgccgcaaaccgtcacgcgggagaacaggtagtgatctgtttcgacctgaaagacttctttccctccattggcgccggaaggatctttggtctgttccgctgtctcgggtatcctcatcaagtggcaagctgcttggccgctctgtgcacgtccgtgactccgagtcgcgttgtcgagcacatgtctggtccagatcgggatacatatcgcaaaccacacctgcctcagggttctccagcctcaccaggcttggcaaatcttgcagtgttcacactggacaaacggctgagcgccctggccaagtcagtcgacgccaattactctagatacgctgatgacctctctttttcaggcgattcccacgttgcaggcattctgctgcgtgccgtgccccagattattgaagatgagggctttcagcctaatagcgccaaaacccggataatgagcaagactagcagacaagtggtgacaggcgtcgtggtgaaccatcatctaaatgtcacccgcaaagctttcgaccagctgaaagctataatccatgcctgcgggaaggctggagatttgaggttaaacgaccccgtgtttagaacctccctgctcggtaaaatcggatgggtttga

SEQ ID NO: 12739 - RNA, 960 nt, unidentified
  source 1..960: mol_type = other RNA; note = synthetic construct
atggacagaggtgccctggcagttaacctggctcagggcctgtgtagcgggggatggtcagctcctgaggtgggagctatactggcacgtcgtctccctggagcagcgaggagattggcccctcggatcgcgtccgaattagtcactgcagcccccggcccgtatgcaccaactgctcgaattacacgcgccgttctgcaacggtgcgagagcttcgagcgcctctaccgctggtgtaatagaaatgatatctggcctgctcccgacttgagcaggccctctatggctccagtcgccgcctttgcccgactggatctgcctggccttgcgacacagaaagccctcgccgactggcttctgctaccaccagagcgccttgactacctcagtgatcctgcgtctagacatgaaagacacggtgactttgcagtgaaccactatgcttatgttctccaccggaagacacatggcggactgcggcttgtcgaggcacccaaaccgaccctcaagtcactgcagaggcagattctgcggggcatactcaatcgagtgcctccccacgatgacgccttcggtttcgtgagaggtcgcaattgtagaggcgctgcccggagacatgcaggcgaacaggtggtaatctgctttgatctgaaggacttcttccccagcattggagctgggcgggtatttgggttgtttaggtgcttaggctacccccagccagtggcccgacatttaaccggactgtgcaccaacaccagtccttccaggatcacggatcggctaccaccccccgataggcccatgtatcgccgcccacacttaccgcaaggagccccttgttctccagccatggccaacttggcagctttcgggttggatcgttcactgtccgggcttgctaggagtctcggggctgggttttcgaggtacgccgacgacctggccttctccggctga

SEQ ID NO: 12740 - RNA, 1305 nt, unidentified
  source 1..1305: mol_type = other RNA; note = synthetic construct
atgaaaccccgtgcactggcctatcgcctggctgtcagtgccacccagggtgcttggagcctgccagaagtccaggctgttctcgcacggcgacttcctcccgcacacagacatctcgccaaggatatcgcggcagcgatgctgtcatgcggcgaaggctccgaccttactccaccaccccaggtggttgctcgcgctttacctggcacccccgccttcgaaaacctctacctgcactgtaggaacacaaacgtgtggcctgctccagaaaccgagcctccagtgatgaggccactgcctccgtttgacgggctggatctgccccaactgccaacggaaggagagctagccgcttggctcatgctgagcccagagaggctggctcaatttgccgacttggctggcagagctgaggcctctcccgaaacagcgattaaccattacttctacagggtcgtacctaagcgggctggaggcgtgcggcttattgaggccccgaaaccggccctgaagggccttcagagacaggtgctgcgcggcatcctggatcctgtgcctgtgcatcgcgacgccttcgggtttgtgaggggacgcggtgtcactgcaggagcagcacgtcatgccggggaagcagttgttctgcgcttcgacctggccgattttttccactcagtggggcgggggagagtctttggcattttcagagccatggggtaccctcacaatgctgccagatgcttggccgggttgactaccacagctgcacctccgtggataatggagaggcttggagcgggtgaccgcccctatttgcggatcccccacttgccccaaggagcacccacctccccagcactcgccaacctcagcgccttcggactcgacagacgactcgccggtttagcgaggcggcttggagctgcatggagtcggtatgccgatgacatctgcttttctggcgacccagacattgttgcgcctttaatggccgccgtccccggaatcgtggctgaagaggggttccgcctcaatgctgccaaaacacgggtaatgcgcgcccaggcaagacagtgtgtcacgggcctagtggtgaatcgacatctcaatctgcccagagaggagttcgataggttgaaggcgatcatacacagggcggcctccccaggcgatgctagactagctgatccccgttttcgagccgccttagccggccgtattgcatgggcagaggccgtaaatcctgctcgaggtgcaaagctgcgggctaggctggaggccgcattagctcagaaagtggccctgtga

SEQ ID NO: 12741 - RNA, 1275 nt, unidentified
  source 1..1275: mol_type = other RNA; note = synthetic construct
atgaccccgcaatcccctaaacgccttgcccaaaacttagcggagtctttaagtctgtccgtgtgggataaaagagggattgctgactgcctgtgtaggcgctttcccccagcgctgcaacggttcacccagctgcaaactcaaggtctgctcgaccattttccaacacagattgcccccggacgaaccgcagtggcttcagcactcgctcagtcatctgtgtttgcccgcattcatcgctactgcgtcctgaactcggtgtggccagctccagaccttagggccccaaagatgcagcctctgcaggcctttgcccacctcgagatacctcagctggccactctaggggacttggctgattggatgctgctaacaccccagcagctggattattatgctgaccagaccggccggcatgaggagcacggagacatggctgttaatcattatcactaccaccttagcccaaaaatcggcggaggacatcggctgatcgaagcgcctaagccccgattaaaaagcctccagcgactgattctcagagccatcctagaccacatcctgccgcaccccaacgcatacgggtttgtgcagggcaggaattgcatagaagccgcagcccggcacgtgggagaaaaggcagtagttgctcacgacctgagggattttttctcaagcatccagggaggccgaatctacggcattttccgcgctttgggctatccgccaaatgtggcccatgccctcactgggttatgtacagtcaccactcctgccagaattcggaacaggatgggtttccatcagcgccaggcattgagagtggcacacctcccccagggtgctccaaccagtcctgcactcggtaatcttgcggcccatggacttgatcgaaggctgaccgggcttgctagatccctcggggctacatacacaagatacgccgatgacctgaccttcagtggggatgagcacataatccgtgcaatttgtgtcgcagtgcctgacatagtctccgaggaaggcttcgccttgaaccccgctaagactagactgatgcccagccaccgtcggcaggtagttacgggcattgtagtgaataacgccacgaacgttgacaggagggagttcgatcaaatcaaggccgctatccacgccagagcatggcagacagatcccgcgctccaagcgcgtttgtctggccagatcgcctgggtccggcagctgaatcctgctaggggcgcaaagttggaacgcctgatggcccgggcctga

SEQ ID NO: 12742 - RNA, 1161 nt, unidentified
  source 1..1161: mol_type = other RNA; note = synthetic construct
atgatcgtcgagtttccccagcgctacgctcccgatgccaatcggatagcagaaatgctctctaagcaactggtggtgagacggctgtttaaacattgtaataaggccgacgtgtggccatctttgcctcttgaaccccccaggatgctgccagtggccccattcgatgcgcttgtactgcccactttgcataccgccatcgacctggctgactggttgctgcttacgcctgagcagttggacgccttcgttgataggaatggttggagggagacacaccccatgcctggcgtgaataactacttctacagaatgagccccaagagctcaggaggtctgcgtctcatcgaggcaccgaagccgcgacttaagtcactgcagcggctcattaaccaccgcatcctcgcaaaagtgccaacccatccagactcctttggcttcgtccgcggtcgcaactgtataggagccgcgcaacgccatgccggagaagaggtcgtaatcgggctggacctaaagaactacttctctagccttcggtatggaagagtgtacgccttctttcgtcacctgggctatccagtttcagtggcccatggcctgagcggcatctgcacaattgttaccccttccaggatcagacagcgaatgccatatgagcagcggcagacactgatggagcctcacttacctcagggcgctccgagttcccctgctttagccaacttacttacatacagactcgataggaggctggcgggtctggcacgtagtttgggcgcaaattatacaaggtacgccgatgacctcaccttcagcggagatagtggcgtgcgggatgccgtgctaaccaccgtccccgaaatcgtcgaagaagaggggttcagaatccgaactgggaaaactcggattatgccttgctataggagacagatggtactggggatagtggtcaacgagacgattaatatttcccgaaaggaatttgacagactgaaggctatcatacaccagaaggcatggaaaaacgaccccgctgagtttgagaaaattctggggcaaattgggtgggttgagcaggttaacccatcgaaagcgcaaaagctctatgcaaaactcgaactagctaatgctcgcgaacacgtgcagggatcctctacttga

SEQ ID NO: 12743 - RNA, 1311 nt, unidentified
  source 1..1311: mol_type = other RNA; note = synthetic construct
atgcaccccgaccagcggaattcgctcaagattttcgccagattggtggccccatcccttgccaaaggtcggtgggccgtttcagacgtaacgggggcgctgaaaagacggctaccagcccagttccagagagaagcacagctcatcgcagaggacctcgtggccttcctacccgcaatgactgcaccaaacgccggggctatcagtaaggctctttgcgcgtgtgacgcatttgtgcgactgcacggtgagtgtctgcgccgagggttgtggcctgacccagatctgaattctgggaagatgctccctttgttcccctttgccaggctggatctccctaacatcccgactttcgccgcgctggcagactggctcgttatagacggaggaagattgatgtacatggctgatatagccaaccggcacaatgagcatcctgatgcacccgtgcatcactacctgtatggcctgcggcctaaacctaccgggggttatagggttatcgaagcacccaaaagtggtctgaaggcccttcagcgccagatcctgagggggattttggataaggtgcccgtgcactctgacgctttcggcttcgtacggggcaaatcctgtgcccaggctgccaatcgacattgcggagctcagaccgttgtgggctttgatttacgagactttttcccaaatttggctgccgccagagtatttggtttatttaggagactaggataccctgacgccgtcgcacgcactctgactggactatgcacaacaaccacaccccagagagtccgtgcccggcttccacatcttcagggccaacttatgagaacaccccacctgccgcaaggagcaccttcctcacccgctttggcaaacctcatcgcgttcactctggataggcgcctcgctggcttagctagagccctggatgctcagtatagccgctacgcggatgatctgacctttagcggagacgcgggaattgcacccgtgctgaccagggccgtgccacatatactccaggaagagggctttgtcctgaatccacgcaagacaagggtcaggaacgctgcccagcgccaagtcgtgaccggcatcgtggttaaccagcatatcaatgtcccgcgagctcggtatgacctgattaaggctaagattaacgctctgcgccacaccgatgaccttggccgtctgggccacgcacactgcctctctctcgagggccaaattgattgggtgtgtacgctgaaccctagccgggggcagaaattaaggcaactgtacgcccgtgccattaatggtgggtga

SEQ ID NO: 12744 - RNA, 1236 nt, unidentified
  source 1..1236: mol_type = other RNA; note = synthetic construct
atgccagaactgactggggctttgcagaggcggctacctccccagttccaccgcgaagcccagctcattgctgctgacctgatccctttattgcccgtcatggttgcaccaaccgacggcgcaatcacaaagggactgctgaactgcggcgcattcgctcggctgcatcgggaatgccttaggttaggtatttggcccgccgcagatctgcagtctgaccaaatgaggccttacgcgccattcgcccaattggacttgcctgatctgcgcactgaagccaatctggccgactggctcatgctcgattattctagagtagcctatttcacggatattagtaatcgtcagaatgaccaccccgatgcgcctgttcatcactacctctacggactgcgacggaaaagctccggtggcctgagagtgatagaggccccaaaatcaaacctgaaaagtatccagaggaggatcctgcacggaatattagaccaggtccccgtacataccgacgcatttggttttgttcggggaagaagctgcgtccaaggagctgcgagacactgcggagaggagtgtgtggtgcgtttcgacttgagagattttttcccctcaatccagagcaagcgagttcttggcctgtttagaaggcttgggtacccgaggtgggtcgcacagagccttacaggcctgtgtactacagctactcctggtcgcgtactggtcggcctacccccacagcaacgccagcagatgagggtgccacacttacctcaaggcgccgcaacctcgccagctcttgccaatcttatagcctttacactcgaccggcggttgtccggtctagctcgctctgtgggggcagggtactcacgatatgccgatgatctgacattcagtggagacattggcatcaccggcgtgctcgaggatgccattccccagatcatcgctgatgaggggtttgtcattaacccgaacaagactagggtgacccacagatccgagcgccagaccgtgacggggatcgttgtgaatcagcatctcaatatctctagaaagcagtatgatcagattaaggccattatccacgctttgcgacgacctgacgacccgcggagactcgatcaagcgttttgtctgtccctggaagggaagatagactgggtgtgtgccgtgaacccccatcgcggaaacaaactccgtcgcctgtaccaggtgaccattgaggacttcggctga

SEQ ID NO: 12745 - RNA, 1302 nt, unidentified
  source 1..1302: mol_type = other RNA; note = synthetic construct
atgaaccgcacccagttcgcatcgagcctcgctcctagtctgctggcccctagatggtccgagactgagctatctcagtgtttgttgcagagactccccgggcagcaaaaagctctgtccgctcgacttacagccgaattattgcagaccttccccggcccagtagctcctcccgaaaggcagctggtcgcaggacttagaggcaggcccacattcgaacggctgtaccggcattgtgctaagcaggctatttggcctgcccccgtcctcactcagacgagaatgcaaccggcgtcaggattagggcggccagaagtgccacacctcgatactcccggcgattttgccgattggttgcctctgcctgaagatcgcttgaactatctggccgatgtggacggccgctacgcttgccacgcttaccgcacaataagacactaccacgccgtcgctgaagctaagaagagcgggggccatcgtctgattgaagcgcccaaatcccaactgaaagcagttcagcgacagatcctgcagggcatcctacgtcagattccagtgcatgaggccgcctacggatttgcacccggtaagggttgcgccgacgcagcaagacttcactgcggaagggacgaggtggtgtgtttcgatctcgcggacttcttcccttcagtgtcctttgcgtgggtctttggagtcttccgtcacctcggttatccggaggcagtgacaaggcttctggccggcttatgcaccacggagactgccccggacgtgcttgtgcagtttccttttgccatgcgacaattgtataggatcccacatctcccacagggtgcaccaaccagccctgctctggcggacattctgctctttaatctcgactgtcggctgaatgctcttgccacaaaactcggggcctcttatacccggtacgttgacgatttgacattctctggccccgccggcttaggcagaggactactgaagctggtaccggagataatccgagacgaggggtttcgcagcaacccaggaaaggtgagggttatgcccagtggggggcgccaagttgtaaccggtatcgtcgtgaatgcacatcttaacatgcgaagagcagagttcgatcagctaaaagccgagattcatgcctgcggcagacctggggatctgaggttgtcagacccacactatcgggcaaggctgatcggacggatacaatggctgcggcacctgaatcccatcaggggcgagaagctgctgactctcctgggacgcgccgaagctcagaaaattaccgcctga

SEQ ID NO: 12746 - RNA, 1314 nt, unidentified
  source 1..1314: mol_type = other RNA; note = synthetic construct
atggccaggtataccaaacaggacctgttgtttgggcccttgagccagggcctttcccagctggaatggacgttctgggatatcagacaccacctggagcagcgtctaccctctcggctcaggtctgtctctcacagattagcgcgcgaactcaagcagacatttcctgccactgcagcccccgacgacaggcaaatcctgctttacctgaagcagtcaccagctacagacccgttgttcagacacttcacgctgacaggtgccattccagatccattgatcgaccctcctcagttccgccctgtacccgccttggatggccttggcttacctgtgctgactacatccgacgacctggctgcatggctggctctgcctcccctacagctgactaggtttgcggacttattgggactcagtgccaatgcagatagcgcctttgctcctcactaccggcatcacctgatcgccaaacgaaatggaaccctccgacttatcgaggagccccgccccttcctgaaaaagttgcagcggcgcatactccgggacatgatcgctcatattcccacccaccctgccgcctttggcttttgcagaggtaagaattgtgctcaagcagccgcacgccatgcgggagaagagatggtagtgagttttgatctcagcggcttctttccgtccattcatcaccaccggatttatgggctgtttcgttccttcggataccctgcagcagttgcccgacatctggccggactgaccacagccctcacacccagagacgtcctggctacagcccatctagctgatagggatcaccttaccgggaggcatctgccacaaggggcgccaactagcccggcacttgccaacctggccgctttcaccctggatacccgattggcgggcctcgcaagatcgctgggtgctaactacacgagatatgccgacgaccttaccttctcaggagatgctccaattgcaaacccactccagcgcatggtccctcaaatagttcgggattgcggctttgtgctgaacgccgcaaagactagaatacagccagctcatcgccggcagacagtgactgggttagttgtgaacaggcacctcaatctgccaagggcggactatgaccatctcaaagctgtcatccaccacctcagagatcccgtggatccgcgccgagcagaccgtatcttcatcgatcaacttgccggtcggattgcttggttcgaacaggtgaatcccaccaagggcgctaaactaagggagtggctggccaacgccttacagactgggaccattggctga

SEQ ID NO: 12747 - RNA, 1326 nt, unidentified
  source 1..1326: mol_type = other RNA; note = synthetic construct
atgtccggtcgtagcgtgtctgaccgggtgtttggccccctggcagctagccttgtacgtcaggcttggactgccctgacactgaggcaacacttacaggcccggttgccacaggctctaagtgctgaggcgcccgggcttgctagagatctgaaagcagctttccctgggacagcagctcccgaccggaaacgggtggccttgtggctgtcgatgtgcccgctagccggcgatctcgtgactatcgccagggcatctggagccccaatcccacctcccttagaccccgaccgatttcagcccccacctgcgttcgctggactcgacctcccacctctgggtacccttgccgacctggccgactggttagccctgaccctgccccagctcagtcgcttctctgatctccacggtattagcgccgctcaggataacccatttgcacctcattatcaccaccacctgctcgagaagcgcgatggaactcagcggctcttggaggaacccaagcccgttctgaagcatctccagaggagagtactgaggcagatcctggccagaatcccacctcatcctgccgccttcgggttttgtgcgggacggagctgtctgcaagcagcccaacgtcacgccggcgaagcccttgtagtgtgctttgacctgaaagccttcttcccctcaattggctggcaccgcgtctacggcctgtttcgcgcattcgggtacccccctgccgttgcaagacatcttgcgggtctgtgcactgccataacaccgccaagggtcctagctgctccacggctcgcagccagggaccttctgacgaatagacacttgccgcaaggagcccccacatcccctgcactggcaaatcttacggcctatgcgctcgatgccagattagcgggccttgccagatccctaggcctgacatacacccgctatgccgacgatctgaccttctcaggggatacacgaccggctgcagctttgcaccgggctgttgcagacatagtgcgcgattgtggctttaccttaaaccgagacaagaccagggtccagccacgacatcggaggcaggtcgtgactggagtggtggtcaatcggcatctcaaccttcctagagcagattacgaccgcctgaaagcagttattcaccatttgcgtaacccagacgatccccgaagggctgatagggtgttcctggatagattggccggcagaatcgcgtggctcgaacagattaatcctgccaagggggctaagctgcgcgacagactggctgcagctttggccaccacaagggctacccgccaccatggatga

SEQ ID NO: 12748 - RNA, 1302 nt, unidentified
  source 1..1302: mol_type = other RNA; note = synthetic construct
atgtccgtgctagtggaccccgtcttcgctgcccttgccagtggcctcgtgcacgtggattggactgcggatcaaatcgctgcccacttgcgcagacgcctcccaaggaggttccagtcaagagcgggggacatagccagacatctgcatgatcggtttccaggcgcggctagccccgacgaagaacgtatcgcagccgcactgtcagatgggcctgctgcaagggccttggtgcggttctccgacaagactggggaactacctgcatacatttggacgcccgctagattccaacccattccagctttcgccacatgtggattgcccgcccttaccactcctgaggagctggccgactggttggggctgaccactgcgcaactgacaaggtttgctgatctgaaaggtctgtcagcgcagacggataatgcttttgctcctcattataggcaccatctgcgacccaagcgcgacggaactctccgcctcatcgaggagccgaagccgctattgaaaacacttcagcggaggattctgcgcgggattctggcacgagtcccacctcacgatgccgccttcgggtttcgggctggacgtaactgtaccatggcagcagctagacacgcgggagaaggtggtgtggtccggttcgacctggctgcattctttccctccattgcccagcaccgggtctacggcctctttagagggtttgggtatcctgccccagtggcccgtcatctgaccggactttgcactgcccacacacccgccagggttctgacaacgcctggcctggcagcagctggtcacctgtctagccggcacctaccacagggagcaccgacctcgcctgctctcgctaatctggtggcctttaccctggacaccagactcgcaggccttgccaggcgcttagacgcaacctacacacgctatgccgacgatctttgcttctctggcgatgctcgtatagccccagtactgcgggctgcattacccggcatcgttgccgattgcggctttcacctcaacccggctaagaccagagttcagccagcccatcatagacagacagtaactggaatcgtggtcaaccaacatttgaatctgagcaggcgggactacgataggctcaaggcccagatccaccacctgagtgaccctgccgaccctagacggggtgatcgagcgttcctcacccgcctggagggacgaatcgcctggttagagcagcttaacccccataaaggcgcaaaactccgagctcgcttagcagccgccttgtctccaggcccctga

SEQ ID NO: 12749 - RNA, 1317 nt, unidentified
  source 1..1317: mol_type = other RNA; note = synthetic construct
atgctctccctacatgtacttctccctttggcccaccggctggcaaaccagccttgggaccagccattactggcggcctgtctgcggagttatttacctccccccctgaatcggcaggctaatcgcctggcgaaccggctgattaaagatttccccggaacaactgctcccgatgcgcagcagattgccaaggctttgggccagacgaccaccgcagccagacttgccactctcgcgcgtcaacaaactcggcctcctagccctgatctaaatcccccacacttccgcccaaatcccgctctccacatcccagccatccctgttatggaaaccatccccgacctggcattttggctcgggctgaccgaggaccaactaacacgctttgccgacctcagggggctctcagcccgtagtcatccggagttcgggtcgcattacaggcagcacctgatccctaaaagcgacgggactctgaggctgatagaagagcctcgcccgttcctgaagagacttcagagacgaatcttgaccggactgcttaatcatgtcccacctcatcctgccgcccacggattcagacctggccacagcgtccttacagcagctagggcgcacgccggcgaacaaattgtgctcaggttcgacttgaggcacttttttgcttctatcacaatcgctagagtctacggactgttcagaacaatgggctatcccgcaaccattgctcggcccttagccgggctcacaactgccattaccccaacagaggtgcataaaacccctcacttggccggagcagagctctttgcagctcgacatctgccacagggtgcgccgacttctccagcattggccaacctggccgcttggtttctggatctgcgtctggctggtctagcccgctctgttaacgcccagtacacacgctacgccgatgacctcaccttctccggggataggcgaatagctccagtgctgttggatgcacttccccacattattacggaaaccggctttcgactgaacctctcaaagacccggataatgcccgctcatcagcgacagactgtgactggcttgacggtgaacaggcatcttaacctgccccgcgaccagtatgatcggctcaaggccacaatccaccacttaacgtgcccagatgaccccagacgccaggacccagcattcctggcccagttaagcggcagaatcacctgggcagagcaagccaatccccacaggggtgcaaagctgcgggaggcacttgctgctgccctggaaagactgccgccaccgccaatatcccccatctga

SEQ ID NO: 12750 - RNA, 1326 nt, unidentified
  source 1..1326: mol_type = other RNA; note = synthetic construct
atgactcgtcctctccggcctccgtttccagacagggctgctcttgcccctttagccgcctccttggctcagcaagactggacagaggcagccttggtgctgcacctgcggcaacgtctaccaggggaccagcctgccagagccgcaagactggccaggagcctcttgcagtcgttccccgcaaggtcagcccccgatgcagctcagatcttgcgccacctccagcaatcaccacagggaagagccgtacttgcccacgcacgccgttatcagcttctccccgcccatagtttaacccctcccgcacataggcccattccaccacttcatcacttggccctgccaccactcgcaacggaggcagagctggccgactggcttgctatcacccctgaccagctgacccggttcgccgatctacggggccttagcgctcgaactgactcaccgtgggctccccactatcaccaccacctgatcgcaaaatctaatgggcaactccgtctgatcgaggaacctaagccattcctcaaaaggctacagagacgaattctcgccggtctgctgaatcacattccgccacaccccgctgcgtatggtttcgtccccggtcgcaattgtatacaggctgcggcacggcacgctggcgaacaaattgtgctgtgcttcgacctggcccagttttttcccagcataaccgatcgccgcatctacgcgctgttccgcgcactcggatatccagcacattgcgcaagaagtctcgccgggttgacaactgcactcacgccggctcatgtgctccataccgccaacttggccgctagggaccagcttagcaaccgacatttacctcagggagcgcccacttcccccgccttagctaatctgagcgccctgcagctggatagaaggctggccggactggctcattctctgggcgcgtcctacactaggtacgccgacgatctgacctttagtggcgatgcgcggattgctccgattctgcagagggcggttccacaaatcgttgcagaacaggggtttagactgaatcccgccaaaacaagagctcagcctgcccatcaccgccagactgtgaccggcataacagtgaacgagacattgaacccagctcggggctcctacgatcttcttaaggcaaccatccaccacttatctcgacctacggatcctagacggcacgatcgggcgtttttggccaacctacacgggcgaatcgcttgggtcgcccaaattaaccctgccaagggagccaagctccatgaccgcctgcatgctgcactgctgacaccccaggactcttga

SEQ ID NO: 12751 - RNA, 1188 nt, unidentified
  source 1..1188: mol_type = other RNA; note = synthetic construct
atgccagcctccttcgttcgggcccccgaaacgctagccgaagcactcatcagggcttttcccggacccgtagcccccgatcctgcacttattttaggcctgctggcccaccaacctgaaatcgcacgcctgctcagtcacgccaggaggcacgatgtggcgccagctgtatggttacagccgcccccatttagacctgctccggctctcgctgacctacctctccccaggctcgccacgtgcgatgcattggccgactggttagcactccccccagaccgcctgaccctttacgcagacctccgcggactaagtgcccgcacagactctccctttgccccccactatcaccaccaccttcttcctaaagcggatgggtccttgcggcttctggaggaaccaaagccaatactgaaacgacagcagcgacaggtcttgcatggcctgcttagccgtgtgccaccacatgatgcggcgttcggcttctgccctggacggaattgcatcggggcagctgctagacatgcgggtgaggccgttgtgctggggttcgatctggtcgatttcttcccgtcgatcgggatacagagagtttacgccgtgtaccgaaccctggggtaccccagagctgttgcttgggcactcgccggcttgtgtaccgcgttaactccgcctaagatcctcgctaccccagctctggctgccagagaggccctgtccaccaggcacctgccacaaggtgcccctacaagccctgccctagccaacttgtgtgcacatgccttggacagaaggctggccggactggccaggtcacttggtgcaagctatactcgatatgccgacgacctggccttctctggcgacacaaggatcgctcccattctgcggactgcagtccctcggattgtggcggaggagggatttagactgaatcctgccaaaacccggcagatgccggctcatcaccgccaatgtgtgactggcctggtcgtgaacgccggggtgaacacacctcgtgcagccttcgaccagctcaaggcaactttgcatcgccttgcacgggctggcgatcccaggagaacagatcccggctttctggctcgtctgtcaggtcagattgcttgggtggagcaggtcaatccagctcggggagctagactccgcacccgatttgacgcactgtga

SEQ ID NO: 12752 - RNA, 1338 nt, unidentified
  source 1..1338: mol_type = other RNA; note = synthetic construct
atgcccccagccttcaaccgaccagtggtttccctagcggtactgggccctattgcctcaagcctcgtgcaggccgaatggaaagaagccagcttgaagcaggtgctcctgcaacggctgcccgtgaggatgcgtaaccaggcgggtcgagtggctggtcgcctgatccaggcctttcctggaggatccgcacccgatgttgggcgcctgagacgaatgctgcaggatctgtcaatatcagccaggctgcgggaccatgcgaggcgaacagacagtctgcccgcacccgtactcgaccctcctcgatttcggcccgtcagtgctctcgacagacttgatctgcctaagctcgcgactccgggggacctagctgacttcctggccattactcccgagcagctgatccggttcgcagacttaagaggcctatcggcacattccacggacccgttcggccctcattacttatgccaccttaggccaaaaagaaatggtggccaccgcctcatcgaggctccaaggccttttttaaagacacttcagaggaggatcctacgtggcatactggaccacgtcccaccacaccacgctgcttttggcttcaggaggggacgcaattgtgtccaggcagcagctcgacacgctggagaacgggtggtcttagggtttgacctgacagatttctttcccggcttggacgtggcaagagtatacggactgttccggtctttggggtaccctgctgcaactgcccgggatcttgccgggctctgctctgctctgacccctcgtagatatctgctcggtcacgatcccacgctcaccggcagacttcatgccaggcacctgccacaaggcgcaccaaccagccctgctttggccaatctcctggccttccggctggactgtagactcgcagccttggctagaagccttgatgcccagtatagtagatatgccgatgatttaagtttctcaggcgacgcgagaattgcgcctatcctgttgcgcgccgttcccgaaatctgcgcagaggaggggtttcgccccaaccatcggaagacacgcgtgatgccatcccatcagcagcagaaagtgaccggaattcttgtgaatcaccacaccaacctgccgcgggtcgagtacgatagactgaaggccattctccatcgcctgcagcaacccgatgacccaaggcgccaagatatggcctttttggggcatctcagcggacggatcgcctggcttgcccaactaaacccgcaccgcgcagctaggttgtctcagtctctgcagctggtgagcgcctccgctcgtactgttcccccagctcggtga

SEQ ID NO: 12753 - RNA, 1323 nt, unidentified
  source 1..1323: mol_type = other RNA; note = synthetic construct
atggcacccttgcaccctgacgatccacccccactaccccctgttgccgctgtgttcggacctctggccgctagcctcagccagtctccctggcaggaggacgcccttcatcgcttgctgttgacccggcttcctggccccctgagagctcaagctcgccgaatagctcagggcctgatcggcgcctttccaggaagtgttgcccccgatgccgcacgcctctgcaaggttctgagggatctcccaggcgcgagaggactgagagctcacgcagctcggacaggtttacgcccggcacccgaactgacccctccaacatttctgccagcccccggtttagccgggttagccctcccagtgctcacatctccggcagacgtcgcggacttcctggccatttcaccagaccagctgatccggtttgccgatctccgggggttaagtgctaggtcaccagatcctttcggcccacattacctatgtcagctgcgtcctaaacggcgggggggatggagattgatcgaggcccctcgcccgtttcttaagaccctgcagaggagggtgctctccagccttctggcccacgtaccgcctcatcccgcagcatatggctttcgcagaggtcgtaattgcataatggctgcagcacgccatgctggagagccccttgtagccggctttgacattgcagacttctttcctagactcacagtagcccgcgtgtacggcctcttccgagcgttgggatatcccgccgccgtagcgagagacttagcaggtctgtgtactgccataaccccagccgccactctagcagcgctacctgcccgagacgctcctatttggaggacgcgccacttgcctcaaggcgctcccacttcccctgcactggctaacctgcttgcttggaggcttgactgccggttggctgggttggcccggattctgggggcaacatacactaggtatgccgacgatctgaccttctcggggccagctaggattggcccaatccttagggatgctgtgccagcgatcctccgaggagaaggcttcgcgcccaacctggccaagacgaggctgatgaccgcccagggtgcgcaaattgtcaccggggtgatggtgaaccggcatgtgaatctgccccgagcagagttcgaccgtctgaaagctgtcctgcaccacctcgccagacccgatgatccgaggcgacaggatgccgggttcctcgcagctctgtccgggagaatcggatgggtggaacagatcaatcccgcccgtggcgctaaactgcgggcaagactcgtcgccctgactggatga

SEQ ID NO: 12754 - RNA, 1284 nt, unidentified
  source 1..1284: mol_type = other RNA; note = synthetic construct
atgcatctccagcaggccataaggtccttggcagcgagcctctctcaagctcagtggacttactttgataccaagctcattctgcagcagagactccccccacgccttcgaaacttggcccccagcttagcacgccgactggttagcgcacttccccaaccctacgccccttctgccagaactattgcccagaccctagcctccttcccggagacagggcagatcgctcgatataccgaaccaaggaagctggtggctcccttcccgattgccccacagaagtttgcccctattgatatcttcaggtcgctaaacctcccagatctgagttcctgtgacgagttggctgagtggctggccatccctcccattcagctcgtcagatttgccgatctcaatgggctcagcaacaggaccaagaatgcattcgcaccgcactatcgctttcacatcatcccgaaaagagacggaacaagccggttgatagaggagccaaagcccgccttgaaacggctgcagagacgcatccttaggtcaatccttaatcaagtacctaccagtcctcacgctttcggattcgtccaggaccggacatgcatccaagctgccgcacgccactgtggagaaccagtggtggtgtcttttgacctaaagaactacttcactagtattacttaccccaggatctttggcgtcttcaggtgcctgggttacccagcggatgttgctcggcatctgaccgggctggtgacgctggtgattccagctcatgtgcgggcccagttgggccgtattggccaccacgacctgcgaaggcgccacttaccccaaggggctcctacaagtcccgctctggcgaacttatgttcatataacctggaccgacgtttagctggactggcgcagagcctggacgcaacttatacccgttacgcagatgacttgacgttttccggtgagacacatattgccagaacactgtgctccgtggttcctgatatcataagagacgaaagattcactaccaatcctgataagacgcgcgtgatgccatctcatacctctcaggtcgtaactggtatcgttgtgaaccaccatgtgaatatcaccaggaaagactttgacagacttaaagcacgcattcatcggctgcggtcacagggcaaggacgatctggaaacactgcagcaccttgatggccaaatagcctgggtcgaacaggtaaatcctctgaaaggcgccaaacttcggcagcggttcgagcacgcgctctcactcacatga

SEQ ID NO: 12755 - RNA, 1188 nt, unidentified
  source 1..1188: mol_type = other RNA; note = synthetic construct
atggcgttcgcctctcacctggccagcgagatactgctgtggtacccgaaaacttatagcccctgtcagtctgacctggctacgacccttagtagacttcccgagatcgccgacgtgtggaattatgcacgtcagaaaaatgtgtggcctaggagtagaattgacactcctgagttcctgcccgctccggccttagagggcctagacatcccacacctggctacatgcgcagatttagccgattggctactcatctcccaggaccagctgactcgatttgccgatttgaagagcctgtctgcttccactgataatgcatttgcaccccactacaggtaccacacaatctctaaagccagcggccaggcgcgactcatagaagagcctaaaccctttctgaagaccctccaaaagagaatccttaaaggcattctcaaccatgtgccaacaagcgaaatctcgttcgggttcacccgaggaagagactgcctgcaagcagcttcaaagcactgcggagaagacgtcgtggtgacatttgatctcaggtcattctttccatcagtgcggcagagtagggtgatcgggttgtttcgttgtctgggatatcctgatgcagttgctcgtcatctggcaggcctgactaccgtcattacgcctgccttcgtcttaaagcgcttacggctcgaaaatgataggtttctcccaaaccgccatcttcctcaaggcgcctccacctcccctgctatcgctaacctttctgcatacgcgttggaccgcagactgatgggcttggccaggagactggacgcccaggttacccggtacgcggacgacatcactttctcaggaccccgagagattactacccccctgaagcatgccgttccagaaataattgccgacagcggttttgtcgtaaacccgcagaaaacacatattatgccccgcacacagtgtcaggtgacgacagggcttgttgtcaacgatcacattaacatactgcggcgggactatgataacctccgggctgaattgcaccatctgcttaccctggatgacccaaggagacgcgatgccagttacctattcgctctcgatgggcgcatcacctgggtggagagggtacacccagtaagaggtcagaagctccgcgagtccttcaatcaagtgttgctgcggggtaattga

SEQ ID NO: 12756 - RNA, 1290 nt, unidentified
  source 1..1290: mol_type = other RNA; note = synthetic construct
atgaatcgggcaaatcttgctcagagtttagccggctcactggtgtgctgcgactggactctctgggccgtggagcaccaccttactagccggctgccctctgggtggtctaagaccgcctcaaacttggcctccgaactcattgcagcgtttcccgcaccgtatgtgccatcccaagcagccctggttcagagacttatctccagcgactatctcacccggattctggatcacgctatgaaacatgacctccggttcagcccgatactggattcggctcgttttgcgcctatccctgccttcgagggcctggacatccctcagatgacaaccctgtctgacttggctgactatctagcactaaacaccgatcagttagtgaggttcacggacttgatgggcctgtcaaatggtacagataacgtgttcgctccacattaccgctttcacctgattgccaagcggaacggtagacagagattaatcgaggaacctaagccggttctgaaatccctccagaggcgcgttttccagactatcctgaacaaagtccccgtacatgacgaggcttatggatttgtccctggacgatcctgtcgcgacgcagctgcaaggcataccggcgaacaggtagtcatcggcttcgatctgagaaattttttcccttcagtgagctatggaaggatttacggtctgttccgagcccttgggtacccagacggggttgcgcaccatctgtgtggactctgcaccattaggacgccaccccacataagagcacgtatgtcttacgatgatggacgggggctagaagccaggcatctcccacaaggcgcccctacctctcccgcattggctaacttagtgtgccacaggctcgactgtagactgagcggcctggctcacagtctagatgcgcgatttactcgatacgccgatgaccttactttctccggcgaccggcgcatggccaatgctatactcaaagtggtgcctcaaattgtcacaagcgaaggcttcgccttgaatcccaccaaaacacgctgtcaaggacagcatgggagacaggtcactacaggaatcgtggtcaattctcacattaacctgcccagggagacatacgactacctgaaagccgtactgcatcacctgatccagccaaaggatccccgcagaggcgatccagcctttctcaagagtttgagtggtcagatcggttgggtggagcaaattaaccccgggaagggggccaagcttcgtgagaagtttgatcagatcatacagcactga

SEQ ID NO: 12757 - RNA, 1332 nt, unidentified
  source 1..1332: mol_type = other RNA; note = synthetic construct
atgcaggaggagagaactcctcccataggccgtactgcactagcatctgctctggtccatgcactgagtaccaccgcagcatggactgaaacggcactggtggacaccttcactcatgtcttgcaaggggctgcacccggttccgtggcttccttagctaggctgctggccgcggatgctagtgttgcctgcggtcccgaaaggcggttgggacagattatcgaggacgctccgtcattcgtcaggatcctccaaaccgtccaaaggcgacgcttggttctcgctcctcccctaaccccacccctgtttcggcctgcctctagatttgcagggctaccccttccttgcctcgcgacctccggggaacttgcagcgtggttggggttaacaccaactgagctcgattggtttgcagccaccctgccccaacgtggagagacacagccgccactgcagcactacagcctgagggccgtggctaaggcttcgggcaggttacggctgatcgaggcgccgaaaacgagactgaaagccattcagcgccagattctggccgggatcctcgcacatgtaccagcacatcccgcggcccacggcttcattgctggacgatcagtgctgacagccgtgaatcctcacgcaggagaaggcctggtggtggcggtagacctcgcagacttctttccctctactcctataggacgagtttggcgcctctttaggcaccttggatatcccgacgccgtggctcacctgttaacgggcctggtaaccactaggaccccgagccctgctcttgacggtctgttgctgcctccagagacacgtagacgccttcgagtccggcatctcccacaaggggctcctacaagtcccgcccttgccaatctggctgcctacggtctggatgtgagactctcatccctagccagcagactggatgccagctactctcggtatgccgatgacctcgttttctccggcagcggccctcagttgagacagagccagcgatttctccggctcgtctctgagattgctgccgccgagggatatgcgctccacccagacaaaaccaggataatgccatcaagcgggcggcagcaggttctgggtgtgacagtgaacgcccatctgaacttgccacgcccatcctacgatcttcttaaggctatccttacaaatgcctgtagacacggcctggccagtcagaaccgggaaggactgccccacttcagagatcacctaaatggccgcatcgcctggttcgaacaggtgaaccctgcccgcggcttaaagttgcgggccctgttcgaccgcatcgccgaatga

SEQ ID NO: 12758 - RNA, 1323 nt, unidentified
  source 1..1323: mol_type = other RNA; note = synthetic construct
atgaccgctagagccgcacagtacctgggcaaaagggccccacgttccctccagcgtctgatcgagcatgtgatagcctccgccagaacgccctatccccctagttcggaacacgtggctagggcactgctgaactccacatattttgatgctgctgcccgcgctgttcttcaggcagactcccccccaaaagccgtccttcattcacccgcctttgcccctgcccgggcttttgctggactgccaattccccgaatcgagacagccggcgaactagcagcgtggttcaagctaagcgtggacgagttggattggcttgcggacactcggaggggacacggtagagcgtctcaggcccagctccagcactacagctacgccctggctgcgaaacgggttggagctcccagacttattgaatctcccaagcctcgtctcaaggccgcacagcgccgcatcctccatgaaattctggatcacgccccatcacattctaacgcacatggcttcgtgcgaggacgatcctgcatcagcggagcacaaattcacgccggtgaaccggtggtgctgcggttggatttgcagagattctttaccgggattcgagcaagtcgcgtccacggccttttccgggccttaggctacccaagcgagacagcccgcctcttgactggcctgtgcactacctgcactccccagatagctactgcagccatcgaggattggaggatcagacaggaatatggtgcccctcacctacctcagggcgctcctacaagtccttccctggcgaatctctgtgcgtggcgcctggaccaaaggttaggggggttggctcggaggctggcaatcaactacagcaggtatgctgacgatctctgtttttcaggcgatcgggcccttgctgctagagcaccgtctttcgtttctctcgtggagacaatcgccagcgaggaggggttcgtagtgaactcggataaaaccaaagtcatgcgcgcctcctcaagtcaacgggttaccggggtggtcgtgaatcagcacgtcaatgcacagcgtcatgactacgacgctctgaaggcaaccttgcataattgtcggacctctggggaccctgaaacgcaaaacaggaagggactcccagacttccgagcccacctggagggcagaataaactgggtagaacaactgaatccccaccgcggcatgaagctgcgcctgatgtttgacgccattcattggccagctggggccagagacgctggtgatagaagggccgatgcgagcaggaggccgcctttaccattcgcaggagaggcagactga

SEQ ID NO: 12759 - RNA, 1329 nt, unidentified
  source 1..1329: mol_type = other RNA; note = synthetic construct
atggccgacagggctctcatcgcgagggagctagctgcgtttctgttagcaggggcttggacaaagggccgcttgctggctcgaaccaggcagtacataggcaattcagccccaaaggccctgcagagactcatcgaacacgtgtttgccctggtcgaaacaccttatccccccgcacctgacgaactggcacgcatgctcatggcctctcgggactttgatgttgccgctagacgcatgctgcgcgctgatagacccctgcagctggcactccacagtccgaagtttgccccatgtcggagcctggctggattgcccgtgcctaaattggaaaccccgggagacttagccgcctggctgggattacccatggaactggtcgactggcttgcggatactagacggggacacgcccatgccgctactacccagctccaacattattcctatacttttgtcccaaagcggatcggcgcaccccgattaattgaggcgcccaaggctcgactcaaagccgtacaacgtaggatcctacacgagatactagaccatcttcccccacatagtagcgcccacggcttcgtgcgcggacgttcatgcatatccggtgcccagctgcacgtgggtgagtacattgtggtacgactggaccttcgcaggttcttctcctcaatcggctcggcccgcgttcatggtttattccgtagtattggctacccttgggcagccgctaggttgctgaccgggctctgtacaacctgcacaccagcgaaaactctcgcagctctgaccgattggcgtgaaaggcaggagtacactgcacctcaccttccgcaaggagcccctactagccccacgctcgccaacctttgcgcttggcggctggataacagattgacaggcctgggcagaaggctcgggatcaattattctcgctacgctgacgacctctgtttctctggggggcgggccttcgctaaacacatgcctagatttctttccctggttggcacaattgtgggcgaggagggatttgcgctgaacggtagaaagaccagcttgctgagggcaaacgcagcacagagggtgacgggaatcgtggtaaatcagcacgtgaatgtcgcccgggagcagtacgatgcccttaaatccatcctgcataactgccgcgtttcatctgatccaaccacgcagaaccgggacagccacccagacttcaaagcacatctagatgggcggattggttgggtcgagcaagtgaatcctcatagagggagaaagttgcgactgatgttcgatcagattaagtgggctagcgctcgggcctga

SEQ ID NO: 12760 - RNA, 1317 nt, unidentified
  source 1..1317: mol_type = other RNA; note = synthetic construct
atggcctcttccacgaccatagctaagggactcgccgccgcacttgtcgctggagtgtggaccgagagagccctgctcgcacgatgtgagggcttcctgggtgcggctacacgagccagtcagaaaaaacttatatccgcccttttggtaagggcctacgaccgatatccacactccccagcaagcttggtgcggtggctcctgagaagccctgcttttgagcgagccgcagcccccttattacgtgccggacccaagcctcccgtcgttctcaagccaccactcttctggccagctcctcccctggcaggcctagatgtaccgaagctggccacacctagagacttagccgattggctggagatctcagtggaacaactggactggtttgcctgtgcgaagcggcaggccatagctctgtcgttcccaaagttgcgccactacgagtgtgcactggtgaggaaacggtccgggggaagcagactcatcgaagctcctaggcggaggctgaaagcgattcagcgtaggctacttcgggaggttctggaccacgttcccaccagcgatcgcgcctacggttttgtgcgggggcgctcatgcattgacggggctcaggtgcatgcggcggaggaagtggtggtcaccctggaccttcaacgcttttttcagtctatcgcagcaagaagagtgcatgccactttcagaggcatcggctatccttgggccgttgcacggctcttgaccgggctgtgcacaactagggctcccagttggggtttcgcagatgtcccctatacagagtttgactggcgcgcccgcaagatgttggaagcaccgcatctgcctcagggggcaccgacttctccaactctggccaatctggcggcctggaggttagatcggaggttggccggcctcgcaaggaggctagatgctaactacactcgttatgctgacgatctcgccttctcaggccggcggaatatcgctagtccaacatttctgcgcgctgtgggagagattgtagtcgatgaggggttcgtgcttaatcgtcctaaaacgcacattatgagacgaggagccagacaggaagtcaccggcattgtagtgaacgaacacgtcaacctccccagagatgcctacgatgctctgaaagcgaccttgcacaactgcattcgcaacggtgctgcagtggagaatcgcgacggacacacagacttcagagcccatctggacggcaggatcggctgggctgaaaccgttaatccccatagaggggctcggctgcgcgcaatgttcgaacgaatcacttggtga

SEQ ID NO: 12761 - RNA, 1302 nt, unidentified
  source 1..1302: mol_type = other RNA; note = synthetic construct
atgcccactagacattgggcggcgaataatctagcggccaggcttctggcaggtccctggactcaggaggcaatcgcaattgtcatcgacgccgtgcttgggccggttgaccttagagcccgcgctgatctgataactgacgtggccgcgctggccgaagctacgtatcctcccacacctcaagcattgactacgtatttagtcagaagcagaagctttaaacctcaccccgagcgtccgataccagccgttcttgcccctcctcgattcgcccccacaccaccatttgccggtctgcctattcccgctctggcgacgcagggcgatttggctgcctggcttgggcagagcccagaacagctggactggctggctgatgaaaggcgaaggcattcgagggttacccgccctcctctccgccactatcattatacatttgcctctaagcggaccggtgcccccaggttaatcgaagcacccaagccacgcctgaaagcaatccagcggcgcattctacgggagatcctgtcacccgtacccacacacccgagaatccacggctttgtggccggacggtcatgtctcaccggggcacaaattcacgctggggaagctattgtcgctaccttcgacctcactcaatttttccccagtatcggcctgccgcggattcatggcctcttcaggtccctgggatacccctgggccgtagcacgacgattgactggattgtgtactaccacaaccccatctggcgtgttccccgatccacagcacccggaccatgcactgtaccgcgttcctcatctccctcaaggtgctcccacctccccagccctcgctaacctgctggcctggacactggaccgccgcttggatggcttagccagatccgcagaggctaattacaccagatacgccgatgatctcgctttcagtggggacgaggcgttcgtcgctagaatcgatagatttcgtcggacagtcgagactattttggaagaggaaggctttgcccttaatacagccaaaacccgcataatgcctcgatctacgaggcagagggtgaccgggatcgtggtgaacgagcactgcaacataggacgtgctgagttcgacaccctgaaggcaatcctccacaactgcacccggacaggcccagcagcccagaacagagaagccatccctgattttaggacacacctggacggaaggattgcttgggtggagcaggtgaatttcccacggggactcaagctgcggcgtctattcgatcagattgactggactcctccaccatga

SEQ ID NO: 12762 - RNA, 1257 nt, unidentified
  source 1..1257: mol_type = other RNA; note = synthetic construct
atggaggctcgcgcagcagcctacttgggcaagtcaacaaaacgctggcagaaaaggcttatcgctgagattgtatccgctaatggggcaggttatccaccctctcctgccgccttagcagatcgcctcctggcttcatcgcattttgacagagctgtggctatagtgcttcgccaaaagactccccctcctatggtgctggatcctcccgccttcgcacctgcaccagcgtttgccgcaatgcaccccccacgcatagagactattggagatctggccacctggctagaaatccccatagcaaggctggactggctggctgacgagaagagacagcattcacgggcaaatctcccaattctccaacactatcactaccggttcgtgcctaagtctagcggtgcgcccagactcatagaggctccaaaggcccagctcaaagccctccagagacgtattttggttgaaattctcgatttggcgcccgtgcatcccagggctcatgggtttgtcagaggtaggagttgtctgacgggcgcccaagttcacgctggggaacagcttgtggtctgcgctgatctgcgagactttttcccctctatccgagcggcacggatccacgggctgtttagaagctttggatacccgaccgccgtcgctagagcacttaccggactgtgtacgaccagcacaccccggagcatcttccagcgaattgacgagggacagcagttcgactggttcacacgacggcgctactccgcacctcacttgccacagggtgcccctacatccccggccttagctaatctgtgtgcctggcgttttgaccaacggtgcgatggcttggccagggccctaggaggcagctatacccgctacgccgatgatctgaccttctccggggacgcagccttcgctgccagaactagtaggctgattgctgccctcggcaaaatcatcggcgaagaaggcttcgcgatcaacgagtctaaaaccaggcttatgcgtagggcccgcccacagcgtgttacaggcatcgtggttaacgaccatgtgaacgtaccacggagagggtatgatgagttaaaagccctgctgcacaactgctgcaagcacggacctgcctcccagaatcgcgaccggaggactgacttcagggctcatctggatggcagagtggggtgggtcgaacaggtcaatccgaaccggggagcgaagctacgaactgcctttgacgccatcagttggagttga

SEQ ID NO: 12763 - RNA, 1332 nt, unidentified
  source 1..1332: mol_type = other RNA; note = synthetic construct
atgtcatttgagaactggactgcctggcacctggccgagatcctgattgctaccgactggaccccgcaggcgatggaagatgccgctcggaaagcactcggaggcaacagacagaggaaatggttgccacggctgatagcagacatcatggggtccagccccaccgcatacgctccaagtcctagaaccgtggccggcttgatcctggacagcagggcgtttcgaggactgcgccttaatgacagagagcggccactgtttgataggtattttctacctgcccccattttctcccccacacccgctttccgtgatcttgcagtgcccgagttggccaacgctctcgattctgctcggtggttgaacctgtcccccaggcacctggattggttcgccgacatcgaaggctatcgatcttcagctgccgccgagtccacacgccattacgtacaggcttggattcctaagcgaacaggcccaccccgattaatcgaggccccgaaacagattctgaaagatctgcaacgcaagattctgcgcgagattttagaccctgtcgctgttcacgacagtgcacatggatttcggcgcggtcgttcttgcatcactgcagctcagctccatgccggggaggatatggtgataaccatggatctgaaggacttcttcccatcagtgcctatcagaagcgtacacgggatctttaggtcacttggttacccctgggcggtggcacgtcttctcacaggcttatgcagcaccactgccccggcaagcctattcgacaatccaccaggcgactctggtcatgacgaagagacgaggcggctctttcaccagcgacaccttcctcagggcgcgccaacttcccctgccttggctaatctgtgcgcgagacgcctcgacggtagactcaacggcctcgctcattgcatggaggcccggtacactaggtatggagacgatctggcattcagcggggatcgtgattttgccgctcgctcgggcgcctttctgagaatggcgagtgcaatatgtgcagctgaaggattcgccgtcaatcaccgaaagacccggataatgaggcaaggggattgtcaacgcatcacagggttgacggtgaatagtcacatcaatgtgcctaggggcgcatatgacagactgaaggccattcttcataactgtaccaggcatgggcctgccaatcagaacagagaaaaccacccagacttccgcgcccacctagatggacggattacatgggttgaaaacgttaatcccccccggggtctgagactcaggctgatgttcatggccgtcgaatggggatga

SEQ ID NO: 12764 - RNA, 1203 nt, unidentified
  source 1..1203: mol_type = other RNA; note = synthetic construct
atgttacggagactggcagcctttgccgatcactctggccaaccaccctcccccgactggttgaccgacttttttctcgcagctccagagttcgctggagcagtggcccgtatcctaaaggagccacagattcttcattgtgtgctcaagcccgcaaaattcgcgcctgctaaaaaattcgccggacttaatgtccccaaaatcaactcctcaggagacttggccgcatggctgggcctctccaatgagcacctggagtggctgagtgatactagaaggcagcatagtcggactgccatcccagttctccagaactaccagtacacattcgtgttgaagaaacatgggccgcctcggctgatagaagagcctaagccccgacttaagaccatccagcgacgaatcctgcgagagattctcgatagagttcccgtgcacgcctgtgcccacggcttcgttgctaagagaagctgtgtcacgagtgcccaggctcactgcggagaattcatcgtgctggccgcagatttaaaggactattttgcaagcatcccagctgcgagaatccagggcatctttcgtgctattgggtatccatcttctgtagcccgcttactgacaggcttgtgcacctccggtacccctactagcgtgttcgcttctaggagcggtgggcgcatgtgcgattggcagaccaggaaactgtatgaacagccgcacctaccccaaggggcacctacaagccccgctctggctaatctggtcagttttagcttggaccgcaggatttcaggccttgccgcccggttcggagccaagtacactagatacgccgatgacctggctttttccggcgatgaaatatttgataggcgggtcgacactttcctggagcatgtggcgatgattgccgtcgacgaaggcttcatgcttaatgcggccaaaaccaggattatgcgccgctcgcaatcacagaggataataggagtgacagtgaacgaccacattaacctccctcgcgggacgtttgacgaactaaaggctatcctccataattgccgtaagttcggccctaatacccaaaacctgctcggtgtagcaaactttgaggagcacctgagaggtcggatcgcctgggctgcctcactgaacccagcaaggggggcgaaacttcatgcaatgttcaatctgattcggtggacatga

SEQ ID NO: 12765 - RNA, 1326 nt, unidentified
  source 1..1326: mol_type = other RNA; note = synthetic construct
atgaatacccctccatggattgcacgaaatctggccgccagctttctgggctccgcttggaacaagaacgatttacgccttgccgcaactaagacactgggactagccacgagggctgcacagcgagcgctcataaatcgcctgttcgacgcacacaatgcccccacaccaccctcagaggactggctaaccagttactttctcatgtccgaatggtttgagatagcttccctccgggcccgtgaacatcctagaggggtgaatgccgtcctaactccaccacgtttcgcgccaagccagcgatttgccgattttggtgctcctaagctgacagctccgggggaactcgccaaatggctggcagtctcaatcgagtatctggactggtttgccgatcggaagaggatgcaagctaagaccgatattcccttgctgcagcactattcttataaattcgcgccgaaaaagagtggccctcctaggctgatcgaatcccctaagccgcagctgaaagccatgcaccggttgattctgcgggaaatgcttaattgtgcccccgtgcacgagtgcgctcaaggtttcgtacgccgccggagctgcttaactgccgccaagatccatgctggagaacatgtattgattaccgcagatctcaaagatttcttcctgaacactaggctcagcagagtgcatggcgttttccgcaacctgggttacgcccagccagttgctagactgctcacagccctctgcagtaccagcaccccccagtcgctgttcgccagacttcccgtgtctcagaggcatgactgggaaacccgtaagcggttcgaagcccctcacttgccccaaggggctcccacatccccagccttggctaacctgtgtgcatggagactggattgccgattattcggcttggccaaatctttcggagccaattatacccggtacgctgacgacatggcattctcaggggataaggcctttgccgacagagtggctgggtttgtcgcggcactggagacgattgcagcggacgagggttttgcactcaacagacgcaaaacaagggtgatgagaggccacacttctcagcgcgtgacgggcgttgtcgtgaatgagcacgtgaacatcgctagaaaggactacgatcgcttaaaagcgatccttcataactgtaggagaaatggacccgaggcagagaaccgagcacagatacggacatttagggctcaccttgacggccgggtgaactgggtcgagactgttaaccctaacaggggaaccaaacttaggcgtatctttaatgagatctcatggtga

SEQ ID NO: 12766 - RNA, 1131 nt, unidentified
  source 1..1131: mol_type = other RNA; note = synthetic construct
atgaaaaaggatgacccagccaaggcactagccgctgctcttcttgcaggggaatggagccgatcagcactggagaaaagagccataacagccctgggcgctaggtctaaacgccgcgcttcccgtattgtggacgatatctggactaaccacaaggccccatacgtgccccatcgcaacgaactgaggaggctgatatatgcatcgaacgcgttcgccggcttgggtgagactgccattaccaggctgaatgagcttaaacccaaggaacagccgcctcggtttgcacccctgcctaggtttcagaatgctaacctccctccactcgccaccgctggagacttggcccagtggctcgggttaagtccgtcacaattagattggtttgcggacgagcgcaggacactagcgagagcttcagacacactccagcactattcccagacgtggctgcctaaacgttctagcggctggcgcctgatcgaagctcccaaaccgaggctgaaggacatccagcgacgaatcctccgggggatcctggatcccattcctacccatgatgcagcattcggcttcgtgccaggtcggagttgcactacagcagccgctaagcacgccggtgaaggcgtggtagttaccctcgatctgcgagatttctttgtgtccgtgcctgcccacagagtgcacgcacttttccggtgcttaggatacctgtggagtgttgcgcgtctcctgactggactttgtaccgccgccactccacacgcaaccttggcttccgaccagctggaccatgagactcggcaaaggctcagggctagacatctgccacagggggcaccaacaagccccactttggctaattttgccgcccgcagactagatgcccggctcgatggactggcgcggagatttgaggcccgatatacacgctacgcggacgatctgaccttcagcggggacgagagattccacacctctgtcccccgcttcttgattgccgtagcccaaatcgccagggacgagggctttgcacttaatgctgccaagacaagaattatgcctcggcacacgagacagaccgtcacgggaatagtcgttaacgaccatatcaatgtcgctcggccctga

SEQ ID NO: 12767 - RNA, 1326 nt, unidentified
  source 1..1326: mol_type = other RNA; note = synthetic construct
atgaaaagcaacaggcacttggttccaattcttgcattcatgctgttggatgggccttggacccccatggccttgaaacggcgcgctgtcagaatcctgggtaggcgatcaaggacccgggccatcgagctcgtggaagagatcctggcatccataaaaacaccttacgctccacagtttaaacagctggaacgcgcgatcgtgagctgttccagcctgcacaagattggcgaagcgacagccgacaggctaggcaaactgtctgtgacagtgccccctccacgctttgctcccttagcccccttcagaggagccggacttcctggcttcacaaccactgcagccctggctcattggctggccgtaccactcggccaaatcgagtggctcgctgacagcaaacatactctttcccacgccacttcagacgttctacatcactatgcctgtcattggatccctaagcaaaccggatcgtggcgcctgattgaaagccccaagccgcggctcaaggcaatccagcgccgcatcctgcacgacatactcgaccacatgccagtgcacgacagtgcgtttgctttcatcaagggcaggtcatgcgccacagctgccgctaggcatgcaggagaggatgtggtgattaccgtggatctcaaggattttttcttaaccactcctcctcgtcgaattcatgctatcttccgttgcctggggtacccgacgtctgtcactagggtcctgaccgggatttgcacgacagccacccccgcagcagtgcttgaaaccaatgccgacatagctgctcgtaaccatgagactcggaagagatatgcctctccccacttaccacagggtgcccccacgtctcccaccctagctaatctggcagccagaggactggattgccggcttacgggcctggcttcaaggttcaatgcaaggtacaccagatatgccgatgacctcaccttcagtggggacaaggcgttgcttgcaagaagcaatcggtttattcgggccattcaggagattgttcaggatgagggctttgctctcaatgccagtaaaactcggatcatgccgcgaagtactagacaatccgtaacaggattggttgtgaaccagcatatcaacatagcccgccctgattacgataacctcaaagcgacactgacaaactgtgcacgacacggggccccatcccagaatagagagggccacgcggacttcagggcacacatggacggtcgcgtagcctgggtcgaaaacgtcaatcgtagacgaggggagaagctgcggagaatttttgaaaagatctcttggtga

SEQ ID NO: 12768 - RNA, 1311 nt, unidentified
  source 1..1311: mol_type = other RNA; note = synthetic construct
atgtcccgccggacagaccatttcccggtattggcactggcgttgttacagggccgctggacacgaaacgccctgagaaaaagagcaagagatctgctggggccccgttctaagactcgggcgaacaggcttgtcgatgagatcttagctgtgcacaggttaccgtacactcctggttggcgtacgctcacgaagattgtggcaggagcgagcgccctgcatgggttaagtgatgctaccatcgagcgagtagcttcaacccctggccggcagcaccctcctcgatttgagccgattgcgccccttcaacctgccagcgctccaacactggctactaccgccgatctggctacctggctagaaatcccaatcgatcacctcgactggttcgccgacgaacgcagaacactggaccgagagcaggacaaggccctgtcccactatgcctaccattggaggctgaaacggagcggtgcatggagattgatagaggcccccaaaccacgcatgatggcggtgcagcggaggattctgaaggacattctgaatcggcttgccccacatgaggccgcacacggttttgttgccggacggtcctgtgttactgcagccgccaagcatgcaggtgagcacgtggtggttacagtcgatctcagagacttttttctaagtgcccccgtgggaagagtgcacgcaatattcaggtgcctgggctacccccatgcagtagcacgcgcactcaccggactgtgttcaacctccacaccacggcatgtcgctgcggaacacttcgaccacgaagctcagaggaggcatgctacgaggcacttgcctcagggagcacccacttctccagcattgtcaaaccttgctgccttgggcctggatagaaggctggctggcctagccaatcgctttggggctcggtatactagatacgctgatgatctcactttcagtggggactctccattctgcgcccgtgtgcctggcctccttaaagcggtggctgacattgcccgtgatgaaggcttcgcccttaacgccgcaaaaacccgcatcatgccccgccaccaacggcaaagcgttaccgggattgtggtcaacgatcacatcaactttgccagagatgacttctataggctcaaggccgctctgaccaattgcgtgaggcatggacccgcctcgcagaatcgcgacgctcatcctgactttcgcgcccaccttgacgggcggatcacatgggtcgaaagactcaatctccgacgaggcgagaagctgagaaggctgttcgacgctatagcctggtga

SEQ ID NO: 12769 - RNA, 1344 nt, unidentified
  source 1..1344: mol_type = other RNA; note = synthetic construct
atgccctcccagaaccaaatagctggcgaccttgccgccgctctcctaggaggagcatggacccgtagggccctgctgaggagactgtctgggtatttgcggaataaagctgcccgctcaaatgcccgactggtggacgagattctggaacgtaccgaaggctcctacccacccagtccattcgccttaaagaggttcattcttgactcccgggcctttccacgcgcagcagcagtacttcttcgcacaacggtccccgtggcagctgtgttgacaccgccaaggttctggcctgctgccggtaatgcagctccaggagttcccgagatcgaaactcctggggacctggccatttggctgggcgtgcctatctctcgactgcaatggctagccgacgagcagcgaagacaccacactactgcaatcccgatgttccagaactataggtaccgtttcatgcccaaggctagtggcggttggcggctcatcgagtggcctaaaccccacctgcgggctatccaggtcaagatactgcgagagatattagatcggttgagcgtccatgaggccgctcacggctttgtacgcggccgatcctgtaaaacggcagccgccatgcatgcaggtgaggctgtggtggcatgcatggacatcagagattttttcggaagcgtgcggctccagcgtattcatgccattttcagaagaattgggtatccctgggccgtggcgcgcttactgagctgtctgtgcgtgacctctactccagcgtccgtttttgcgcgcgcccctgatgacgcaggcttggattgggagacaaggaaaagattctcagaacgccaccttcctcagggagcaccgacaagtcctgctctggctaacctcgtcgttggggaaatggacagacggctggaaggcctagcccggcattgcgatgccaggtacactcgctatgccgatgatctgtcattttcaggtgacgagacattcgccaggaggatagggggttttctggggtcggccaccgatattgtacgagacgagggctttagcatccacaccgcgaaaaccagaatcatgaggcggggagcgagacaagtggtcactggactcgtagtcaacgagcacgtgaacattctcaggcacgattacgacacactcaaggcgatcctgcacaactgtgccaagcatggggctgaatctcagaatcggagcggggttcctaactttccagctcatttggccggccgcatcgcctgggtcgaacatgttaatcccgtgagaggagctagacttcgcaccctctacaataaggtggcatggaccccccgggctgagatctga

SEQ ID NO: 12770 - RNA, 957 nt, unidentified
  source 1..957: mol_type = other RNA; note = synthetic construct
cttccacctgagctagactggtttgccgacacccgacggcagcatggggtgactgagaagcgcccgctccagcactacagctacgcctgggtccctaaaaggcggggagcaccccggttaatcgaagcaccaaagcccagacttaaagccctgcagaggcagattctccgcgatattctggacagaattcccgtacacgaagctgcccacgggttcgtcaagggcaggagttgtttgggaggagcagcaaggcacggtggtgaggcagtggttgccacgcttgatctggccgacttttttccttcagtaccactcgagcgcgtccacggcatatttcgctgcctgggctatcctacagccgtggcccggttattgaccggcctgtgctccacaactactcctagaggagtcctggcagccgcccctggagttaaaagaccccccggcgcgttcgttcctgaagctgctccgcatcttccccagggggcacctacaagcccagccttggcgaatctgtctgccaatcgtctggatgcccgtctggaccagttagcagagtacgctggtgccaggtataccagatacgctgacgatctcgctttctccggggatgacgagtttgccgcgggtatcggctctttcctggctaccgtggaggaaattatccgggctgaaagattcgccccaaatcggcggaaaacccgcatcatgaggcgagcaggaaggcaacaagtcacggggttggtggtgaaccagcacctcaatgtgcccagaccggactatgatcgactcaaggcgatactgcataactgtgctaggcacggcccagcaggccaaaacagagacgggcacccagatttccgcgctcatctggatggccgagtgggatgggttcagacagtgaacccccatcgcgggctcaagctgcgtctgctatttgaggccatcgcttggtga

SEQ ID NO: 12771 - RNA, 1338 nt, unidentified
  source 1..1338: mol_type = other RNA; note = synthetic construct
atgcactggcccaattcttcccgtcaccggctcatagccagaaatattgccgtgactcttctggccggcgcatggactgagagagcgatggccgatcgcctggagactctattggggagcaccacaagaagtactcagcggggactgatcggcgctatctttgataagtctgggggtccatatcctccatcacttgctgagctgaccgcctccatactggaagcgcctcaatttccagcagcggcccgactcgcattagaatatactaccagattagatatcgcaaccagacagcctaggtttgcacccattgcccgctttgcagacctagagatcccacggctgacaactcctggcgatgtggctgcctgggctggcttgagtattcccgaactggaatggttcgcagacgagcgtcgccagcacggcagaacagccattcccatttttcagcattatacctacgccttcaggaaaaagtcaagcgggcccccacgactgatcgaggcaccaaagccacgtctcaaaactatccagaggaagattctgcgagatatcctcgaccacattcccgttcaccccgccgcgcatggcttcgtagaaggaaggtcaccacgcaccggcgccgctcaacatgttggtgctcccgtggtgattgccgtcgatcttgagaacttctttctgtcagttcctgtgggaaggatccatgctttgttccggtctgttgggtatcctgacgaagccgctagagctctcacccggctgtgcacgaccatgacaccacgctccgtaattgacagggtcccgaatcctgcacgacatacgcgtgccgctttggccccgtacctcgatccccaccttcctcaaggcgcacccacatccccggctcttgccaatctggtcgcttggcgcctcgacgtgagactcgctggtctagctaattcctttggagccaaactgaccaggtacgccgacgacatagtgttctctggagacttaacggcccctggtaagacccagtctctgatcgccgccatcgcggagatcgtcgaggacgaggggttcggactgaacgataaaaagacacggataatgaccgcaagccagcgacagagtgtcacagggatcgtggtgaactcgcgcctgaacgcacggagagacagctacgacagccttaaagccatcctccacaattgtcgcctgaacggtttcgaagcggaaaaccgggagggacatgcagatttccgggctcacttggagggccggattgggtggatcgaaagtctgaacccgacaaggggcaggcgcttgagagatatttttagcaggataccttga

SEQ ID NO: 12772 - RNA, 1305 nt, unidentified
  source 1..1305: mol_type = other RNA; note = synthetic construct
atggctcggaacattgcaaatgtgctgctgagcggcctgtgggctgaaagggctatgctgctgaggttgcagaccgccctgggcaaggccacagccaagagtcagcgcgccctgatcgcggaggtactcaaagccaacccagcgtcttatccccctcctgccgccgaactggtacgcactattttctcagcaccgagctttgagaaggccgccgctagtgccctgctaagcaaggctccattacacatggccttacgcccccctaaattcgcccctaccgcagacctgagcgactgcgatgtgccggcacttcccaccagcggagacgttgctcggtggctgggtttacctctcgagcacttagattggtttactgacgagcggagacagcacggtcgtactgccataccagacctccagcattacgtctacgcctttcgagccaagccacacggacccccgaggcttattgaagcccctaaacctcggctgaaaactatgcagaaacggattctacacggaatcctggatagtgtccctgtgcacgaggcagcacatgggttcgtgaaaggccgaagctgcaagtcaggagctgagcaacatgcagaggcagccatcgtcatatgtttcgatatcgcagacttctttctgacgtcccccctgggccgagttcatgctctgttcagagggctcggatacccacatgcggctgctcgagttctcacacgcctttgttctacctcaacgcccgagacagtctttgacagaatctcttctccaaggaagcacacccgggcggcccttcaagcttactgtgaaccccacttgccacaaggcgcacctacatctcccgcactcgcgaatctcgtggccagaagacttgatatacggctgacagggctcgctttgagtttgggtgggaggtattcaagatatgcagatgacctgaccttctccggcgatgccgcattcgctaaaaagacaaactcgttgatggctgctgtggcgggtatcgtggaagatgaggggtatgccctcaacgaaaggaagacccgggttatgacgtcctcccgtagacagcagattactggaatcgtggtgaatgctaggaccaacgcacccagagacgcctacgatcagctgaaggctactctgcataattgcaggaaaaccgggctagccgctgaaaaccgagacggccacgccgattttcgcgcgcatttggccggccgcattggatgggtcgcatcccttaatccagcccgcggcgacaggctacgtgcaatgctcacagagatcgcctga

SEQ ID NO: 12773 - RNA, 1350 nt, unidentified
  source 1..1350: mol_type = other RNA; note = synthetic construct
atgaggttcgaggagctaattgccaggaacctggctgctgcctggctagcaggcccttggaccgaagccggactctttgagcgagggcaggaggtgattgggaaggcgggcaggagaagattcctgcaattagtaagggccgccattcaggctgcaccatctgattaccctccctctcccggttggatcacagcctttcttcgagaacgtgacggtctgcctgattacacagagaggttcctgaacagcagacggtccatcagcctagccctggaacctgcccacttcagtagcagtctcagcttggcacctctggacgtccccagactggaaacaccacacgatttagctgtctggatcggtgtaccgatcgagcatcttgattggttggcggatagtcgcaggcaggcctactcaacggacatccccatgcttcagaattatcgctacgcattcgtgcccaaacgtactggcccaccacgcctgctcgagtgtccgaagcctctcttgatggcggctcagcggaagatcctttccggcatcctggacaagatacgcgcccacgacgccgctcatgggtttgttgctggccgaagctgccttagcggagctagtagacatgctggagaggatattgtgattgccttagatctcaaggatttcttcctgactaccccagtcagacgggtgcacgggatctttcgcgcactgggctatccttgggccgttgcgcgcctgttaaccgggttgtgtacttcagctgtgcccctgtccgtgttcagacgtctccctccagcagagcggcacgactggaagactaggcagctctttaactcacgacacttgccccagggtgccccgacatctccagcacttgccaatctggcagcttaccgcctggatgtccgtttgaccggacttgcccgatctctcgacgcaacatacacgaggtatgccgatgacctcgccgtgtccggttctctgacagaccgaaatgctcagaagatactggccaccgttagatcgattgctagggaagaaggatatgaggtgcatccttccaaacaacgggtaatgcgctccgacgcgcggcaatgcattactggagtggttgtgaaccggcacgtgaatgtgccccgcgaagactttgacaggctcaaagccaccctgcacaatgcagcacggcatgggccaaggagccagaacagagacgggcacgccgatttccgggcacatctggatggccgggtcacctgggttgagaatgtcaaccccaacagaggagccaaactgagacggttgtttgacgcgatagtctggaaagaaggctcaggcgacgctatcggctga

SEQ ID NO: 12774 - RNA, 1065 nt, unidentified
  source 1..1065: mol_type = other RNA; note = synthetic construct
atgcttgatgcactggacctgcctccacttccccacgccgaagccttggcttcctggttaggaatagatgccgacgagttggtggtgctcgccgactgtgagggcagagagcgaagacgtgcagccagagcccaacactaccattatcggagggttgctaaacccgggggcggggaacgacttattgaggcgccaaagccacggctgaaggcagtgcagaggcacatcctccacgggatactggatcgtgtcccacctcatgacgccgctcacggattcgtgcccggtaggtccgtgtggacaggagctgggcgacatacaggccgcgaaatggtaatcagggtggatctccgggacttctttgcctccgtgcgtggcgctcgggtatttgccttgttcgaaactatcgggtaccctaggagtgtatgcagcctgctgactggattgtgcaccaatgccacacccgcgacagtttggggtaccccctctcatgccattagcaccgctgcactgagagaacgctggcaccgcatccaacgatatgctgcacctcacctgcccgctggtgcaccttcatcccctgcattagcaaatttagcggcacacaggcttgaccgccgcctagcaggactcgctcatgccgttgacggctcttacaccagatatgctgatgacctgaccttcagtggcgatgcactcaggcgaggaacgctcgcattctttagctcggtgtgccggattgtggtcgaggagggctttgaagtccacgcgagaaagacgcggttccatcaccgcagccagcgtcagctagtgactggcgttgtcgtcaacgagcatccggccgcccggagatcagcctacgatagactcagagccatcctgtttaactgtgtgaggcacggtgcgcggagtcaggctgatagggacctggccgctttccgcgctcatctgagaggccgcatcgagtggtttgcccattcaccggctagggccgccaaacttcacgcgctgtttgaccggattgacttctctgagccagatgatgacccacccgccgatgggtga

SEQ ID NO: 12775 - RNA, 1002 nt, unidentified
  source 1..1002: mol_type = other RNA; note = synthetic construct
gcactggccgatgtgttggcgcttgacgacgcggctcttcgtggactggcggacctcgaagggcacgaacgaaggaggaggcccaccgcacgccattatcactatgcctgtgcccgtaaggccgacggaggggaaagactgatcgaggctcccaaacctcgactgaaggctgcccagaggcgcgttctgagacggctcctggatcgagtcccccctcacgacgcagcacatggctttgtgcgccgccgaagtgcagtgactagcgccgagctgcatgctggacaagcgatggtgatcagggttgacctgagagactttttcgcctcgatcccagctagcagggtccacgctattttcggtgcactgggatacccggtcgctgtccgccgactactcacagggttgtgcacaaacgctacgcctttagccgtttggggtcccgcctccccctcactttctagtgtggcactccgcgaaagacggagacgcctggcacagtacgctggaccacacttgccagccggtgctcccacttctcctagcctcgcaaatctggcagccctcgggctggataggcggttagccgcactggccagatcaatggactgtagatatacgcggtacgcggacgatctcactataagcggaggtgatgcccttaggcgtggtgcccatgcttgcgtttccactatatgccggatcgccgtagaggagggcttcgtgattcacccacggaaaacccgtttgcagccgagaggcgtgcggcagaccgttacaggcttggtggtgaacgctagaccaaacgtgcctcgcgacacctacgatcggcttagggccacactgtttaattgcgtaaggttaggcccacgcacccagtctgatctacctctggctgagctcgaagcccaactaagaggccgggtagagtggtgtgccgtcaatcccgggagagcagccaagctgagggctctgttcgatgctattgattggtccgcggcctga

SEQ ID NO: 12776 - RNA, 1059 nt, unidentified
  source 1..1059: mol_type = other RNA; note = synthetic construct
atgaccgagcccctcaggtttgaatccgaagtggagctggccagatggctggccctaactccagccgagctttggtggtttgccgacgtcgagggcatagggaggaccagagttaacggccctctggctcactatcgatacaggtttcatgcaaaacctgatggctccacgaggctcattgagattccaaagttgagattgaaactgatccagcgccgcatagctcgacgcctgctagctccgctccagctccacgactctgtccatggcttcgtgcggggccgtagtgcaatcactggagcccgagtgcacgttggacgcgcacttgtgctgagagtagacctgagagaattctttgcatccgtttccgccggtcaggtacgggctgtgctacggaggctcggacatgctgatgcagtcgcgagggccctgactgggctctgtacaaattgcaccccgagagcagcttggacaggcagcagtacccccgctaatgcagaggccgtccgtcagctgtggcataggcggcaacgctacgcatcaccacaccttccaacaggggcccctactagtcctgccctggcgaacttggtggcgggcacacttgacctcaggttagcagctttggctaggagcttcggggccgcgtacaccagatatgccgacgaccttactttctcgggcgatgctccctttagaagggatgcagaacggttcttcgaactggtttgtggggccgtcgccgagcacggatttgctgttcacggccggaagaccaggtttcagggggctgaaacgcgtcaacaggtgacaggagtggtggtgaacgtgcacacctcattggtacggcgggagctggagcggttagaggcgatcgttcataactgcgtgcgcttcggtcccgccggtcagaatcgcagcggacatcctgatttcagatctcatttagccggacgtatcgcccacgtggcctctgtccacggtcgacacggtgctcgcctgagagagcgcttcgctgcaattgactggagccccctggatgaacgatcagaagcctga

SEQ ID NO: 12777 - RNA, 1272 nt, unidentified
  source 1..1272: mol_type = other RNA; note = synthetic construct
atgaccgatccgtttctgagggcccatgaagcagctgaggttgccgcagacttctcacgaacctacacatcatggacttggcccgaggtgttgaccgcccttcgagtactgctgcctgccgaagtgactgcagacgtcgcagatagaatcttcgagttgtcccctcatgagccccggcatccagccactgtggtgctggaggccctcgcaccatggacacacccagaaccccaacccagaaggccgctggtcctgcacgaacctgagagctccggcacagtgctagacgatctccctgacctgtacgatgtcgaacaggtggcccactggctggatttcacggtccctgagctggagtggtttgccgaccgagggcagtggctcaggactgctaggcccccactccgacattatcgtatatggcggagagataagcgggaaggcgtgcgcgttatcgaggctccaaaaccgcgtatgagagaaacccaacggcggttactccgccgcttggtggagagaatccctgctcactctgctgcacgcggatttgtacccgggtcgagtcctgccgctttcgcttggccacacacagacagacctgccgtggttagggtggacctgcggcactgttttgagagcattactgtacagcgtgtccgcgctgtcttccgcgatgctggctttcagccccatattgcccggctcttagcggagctttgcaccacggcaacgcctgtggatgaacttagagggctggatcacatgcacgcggcactacttcgggaacgacacctgccccagggtgctccaaccagtccacacctggctaaccttgtgatgagaagcctcgacaggcggctggacggatacgcgagacgcaacggcttaagatatacacgctatggtgacgacctagccatcagcggcgatgcaatagatgcagaccgggtcctgtggaccgttctgcgcattgtggatgcggagcgtttcactgtacaccccgacaaggtccgaatcatgcattcccatcagagacagaggctggccggactcgtggtgaatgataggccacaggtggctaggtctgagtatgacaatcttcgcgccctcttgcacaacgcccgtcgccatggcgcagcatctcaaaatcgggccgatcatcccgactttagagcccacgtttacgggttgattgcctgggtcggtgcgaccggagaagctaggaggcggaggttattggacctggccgccacagttgactgggaaacatga

SEQ ID NO: 12778 - RNA, 1272 nt, unidentified
  source 1..1272: mol_type = other RNA; note = synthetic construct
atgactgagccatttctgcagcctcatgaggctgcagaagtcgccgcggccttctcgagaacatataccgcctggacttggcccgagatacttgccgctgtaacagccgtcttgcccgctgaggtcaccagcgaagtggcagctgggatcattgaactctctcctcacgaaccacgccaccccgcaacagtcatgatccaagcactcgccccatggacccaccctgcaccagttgctgctcagccggtggtggtgcacgaacctcggagtgctggcaccgtgtccgatgcccttccggacttatacgacgttgagcagttcgcccactggctggatttcactgtgccagaactggagtggtttgcggacagaggacaatggttgaggacggctcgtccccccttaaggcattatagaatttggcgccgagagaagcgggatggagtgagggttatcgaggctcccaagccaagaatgcgagaaacccaacggcggctattgcgccgactcattgagaggatacctgcacatcccgctgcacggggattcattcccggctccagcccagcagcctttgcttggcctcacaccgatagaccggtggtgcttagggtagatctgagacattgctttgagacaattaccgtgcccagagtgcgggccgttttcagacaggcgggttacccaccccacatcgccagactcctcgccgaactttgtaccactgccacgcccgtcgacgaactgcgtgggatcgaccacacccatgctgcgttactccgcgaacgacacttgcctcagggagccccaacgagccctcatctcgccaatctggtaatgcgtccgctggaccgaaggttggatggctacgcccgccggcatggactacgttacactaggtatggcgacgatctggccatatccggcgatgcaatgaacgctgacagagccctgtggacagtcctgcggatcgtggaggatgaaaggttcacagtgcatcctgagaaagtccggattatgcactctcaccagcgacagcacctggccgggttagttgttaatgataggcctcaggtcgcccggtctgactacgacaacctgcgcgcactgctccataacgcgaggcgccacggggctagttcacagaaccacgacgagcatccagactttagggcacatgtgtatggtctgatcgcgtgggtaggcgcaacaggtgagactcgcaggcgcagacttctgaatatggcccggactgtggattgggactcatga

SEQ ID NO: 12779 - RNA, 1272 nt, unidentified
  source 1..1272: mol_type = other RNA; note = synthetic construct
atgacggaccccttccttacagccgcagatgcggctgagacagctgccgctttcgcacgaacatatgccgcctggacttggcccgaggtggtagctgctttacgggctgttattcccgcccactttgtcgacgacgtggctgagcgggtgtttgagttgtctccacatgaaccaagacacgcggccgaactgatgacagaagccttggccccatggacccaccctcctgaaccggttcgcgaaccactcatactcagagagcccatcagccctggcactgtcccggatgaacttcccgacttgtacgatatcacccagctcgctcactggctggatttcacagtgcccgaacttgagtggttcgcagaccggggaggttggctcaggactgcacacccccctttaagacactaccgcatatggcaaaggccgaaacgcgacggagtcagactattagaggccccaaagcctaggctgcgcgaaacccagaggcgtctcctgagacggctggtggagaagatccctgctcatcgcgccgctcgcggctttgtccctggaagttcagccgcagcctttgcctggcctcatacggacagacccgtggtcttgcgggtggatctacgacactgcttcgaatccattaccgataggcgcgtgagggcagtgtttcgcgatgcggggtacccaccacacatcgcgcgggttctggccgagctgtgtactaccaccacccccgtagatgagctgcgcgacatcgagacaggtcatgcggctctgctgagggagcggcacctacctcaaggggcacccactagtccacacctcgcgaatctggtcatgcgccctcttgacagacggctcgacggttatgcaaggcgtcacgggctgagatacacccgatatggggatgacctcgcactctcaggcgattctatggatgcagacagggctctgtggactgtgctgcgggttgccgaagccgaggactttacagcacatgacgataaagttagaattatgagacgacaccaacagcagaggctggccggcttggtggtaaacgaccgtccgcaggtggcccgtagcgattacgataaccttcgagctctgctgcataacgcacgacagcatggcgccagctcccagaatcacgatgatcatccagacttcagggcccatgtatatggccttattgcttgggtgggagccacgcgggatgagagaaggcggagattgctgaccatggctgacgcagtcgactgggacgcctga

SEQ ID NO: 12780 - RNA, 1269 nt, unidentified
  source 1..1269: mol_type = other RNA; note = synthetic construct
atgaccccatcactgtcagcagatgaaatcgctgaggtggcggcagcattctcaaggacatacgcagcttggacctggcccgaagtgttagaagcagtacatgctgtcctgcctagcagtatcgctgacgacgtgtctgtgcgactctttgaattatctcctcaagagccccggcatcctgctgctgccctgacagacgctttgacaccctggacagcccctgcacccaccgttcgacctcagattagcttacaggaacctacatcgaccggtaccgttatcgacgggctacccgacctctatgatgtggaacagctcgcccactggctagacttcactgtaccggaactggagtggttcgccgaccgtggcggatggttgagacaagcccgaccgcccctgagacactacaggatctggcggcgggcaaaaagagagggagtccgcgtgatcgaagcccctaagccacgaatgcgagagacgcaaaggcgtctcctccgccgccttgtggagcagatcccagctcatcccgctgccaggggctttgtcagaggtagtagcgcggctgcttttgcctggccgcatactgacaggcccgtggtactgcgcgtggacttgcgacactgcttcgaatccatttccgtgcgcagagtgagaggggtgttccgggaggcggggtatccacagcacattgccagggtactggcagagctctgtactactgctaccccagtcgacgagcttcacgacatagaggccggacatgccgcgttgctacgtgagcgtcatctgccacaaggcgcccccaccagtccacacctggctaaccttgttatgaggagcctggatcggaggctgacgggatacgcgcagcacaacggcctgaggtatacgagatacggagatgaccttgccctttccggggacgaaatgaatgcggatcgggcactctggactaccttgcgcgtggtgagggccgaggggtttactgtccaccctggcaaggtccggatcatgcatcggcaccagcaacagcgccttgccggtctggtggttaacgataggcctcgggttgcacgggccgacgtcgataatctgcgggccctgctgcacaacgccattcattatggtgcctcttcccagaatgtcgatgatcatccagactttcgcgcacacgttcacggcctcatagcctggattggagcaacaggcgaggctagaagacgcagactgctcgagatggccgatcaggtggattgggatagatga

SEQ ID NO: 12781 - RNA, 1272 nt, unidentified
  source 1..1272: mol_type = other RNA; note = synthetic construct
atgatcgaacccagcctgcctgcagttgaggtcagtgaagcggccgcggtgttctcccggatttataccgcctggacctggccagaagtactgcgcgccttagattcagtcctccctggggagatcgcacctgacgtggctcacaggctctttcgcctgactagggctgaacccaggcatccagcagccgctctggtggatgcactggctccttggactattccgcggcctgccgtcccacgacatatagaattacacgagcccacttctacgggttccgtgctcgacggactgcccgatctatacagtgtggaacagtgcgctcactggctcggcctgaccgttcctgaactggagtggtttgccgaccgggggaactggcttaggactgcaggccccccccttaggcattaccgcatctggcatcgaacaaaacgggacggggtgcgggtgatagaagcaccaaagcccagaatgagggagacacagagacgattactgcataggttagtcggtaaaattccagcccaccccgctgctcgcggctttgttccagggagcagtcctgctgcgttcgcgtggcctcacaccgacagatgtaccgtgttgcgtatcgatctgcggagatgcttcgagactatcactctcagacgagtaaggggggtctttgatagggcaggctatccaccacggatagcccgcctgttggccgagctgtgtactacgacaaccccggtcgacgtgctccatggagtgacaagcgctcacgccgccctgcttagggataggcaccttccccaaggagccccgacctcaccgcacttggctaacctggtattgagatctctcgaccgtagacttgacggctacgcccggcgaaatgacctgcgttatacccgctacggcgacgatcttgcactctctggcgacacattggacgtggaccggacactctggatggtggtgcgcgttgtgtctgcggagggattcgtcgttcacccagacaagctgcgaatcatgcacagacatcagaggcagagactggccggtctggtggtgaacgatcgcccccaagtcgcccgttccgattacgataccctgcgggcactcctgcataatgcaatccgcgagggagccgcctcccagaatagatcgggccaccgtgatttccgggcccacgtatatgggctaattgcctggattggagctacaagccctgctcgcagacagagactattggagatggctgccgcagttgattggcagtcatga

SEQ ID NO: 12782 - RNA, 1275 nt, unidentified
  source 1..1275: mol_type = other RNA; note = synthetic construct
atggccgctcccgtgctgactgtagccgaagcagctgaggcggccgctgactttagccggggttatgggggatggacttggccagaggttctcagggctgcaggtgccgtgttgccagagggaatcgccgaggatgccgtggagcggcttttcgccgcaaacccgagggaaccaagacatcccgcccaagcttttaccgaagcgttgcagccctggactctgccaacacccgcaccacctagagtcatcgaactatccgatccagttcctgtgggaccgatgccctacggcctccctgacctgtacgacgtggagctgcttgctcagtggttcgggctgaccgtgggcgaattagagtggtttgcggacagaggccgttggttgcggaacgctcgaccaccactgaggcattacaggatctggagacggcacaagcgggatggagtccgagttattgaagcacccaaaccgtggatgagggagactcagcggcgtttactccgaagggtggtggagaggatgcctgcacatcctgctgccaggggattcgttgccggcagctctaccgctgccttcgcttggccgcacacggatcgcccaaccgtggtacgcgtagaccttcggcattgtttcgaatccatcacagtgggccgggtgcggagagtctttgcagatattggcggctatcgggcccccatagctagggtcctcgctgacctctgcaccacagcgacccctgtcgacgagctgaccggtgtcgaatatggtcacgccgccttgctacgcgacaggcacctacctcagggcgcacctacgagtcctcacctggccaacttagtgatgagatctctggaccgtcgactggccggatacgcaagaaggaacgggctcagatacacacgctatggcgacgatctggccgtttcgggggatgggatcgacgcagacagagtgctgtgggtcgtgatgagaatcgtggccgcggaaggattcgtggtccaccccgagaaggtgaggattatgcaccgccatcagcggcagcagttggctggtctggtcgtgaatgatcgcccccaagttgcccgagacgattatgacaatcttcgtgcactccttcataatgctattagagatggggcagcgacacaaaatcgcgatgggcacgacgattttcgcgcccacgtatacggcctcatagcttgggtaggagccacttcacccgccagacgccagcgactgctggagatggcccgtcaggttgattgggcacgctga

SEQ ID NO: 12783 - RNA, 1269 nt, unidentified
  source 1..1269: mol_type = other RNA; note = synthetic construct
atgtctgagccctcattgccagctggagaagtggccgcagctgcagccgagtttagccggatattgacggcctggaccagaagcgagattgtgagagctgttatcgcggtgctcccatacgacgtggctgccgaagcgggaaaccggctctttgaacgcaccccccacgaacccagacatcctgccgcagcattcgttgccgcactccagccttggacgctaccgacacctgtgaccagaacatgggatctgacagagccagtcagagcagatgggttaccagctggcctgcccgatctgcacgacgtcgagcagttcgcctactggctggacttcaccgtgcctgagctggagtggtttgcagatagaggcgggtggctgagaactgctcggccaccattgcgccactaccgcatttggcggcgagccaagagagacggagtccgagtgatcgaggctcctaaacccaggatgagggagactcagcgtcggctgctcaggcgactggtggaaagaattcctgcacaccccgctgccagaggcttcgtacctggtgggtccactgccgcttttgcgtggccccatacagaccgcccaagtgttctccgagtggacctcaggcattgtttcgagacagtgaccacagcaagggttcggcgcgtctttgctgatgtgggatacccacccgcaattgcccggttgctggctgaaatctgcaccactgccacaccggtcgacgagctcactgacatcgaccacacccacgcttccctgctacgctatagacatcttcctcaaggcgccccaactagcccccacttggccaacctggtgatgcgcagtttggatcgtagacttgatggttacgcccgccataatggtcttaggtatacccgctatggagatgacctggctctgtccggcgacgatttcgacgcagacagggccctctgggtcgtgctgcaggtcgtaggggatgaaggctttttagtccaccccggcaaggttaggataatgcataggcatcagcagcaacgactggccggcctggttgtaaacgatcgaccgcaggtggccagggccgattacgacaacctgcgtgctcttctacacaatgcaatccgggacggggcgcaggcccaaaatcgtgatgcgcatcctgatttccgggcgcacgtgtatgggttaatcgcttggattggatctacgggtacccttcggcgcgacaggcttctcgaaatggccgcccgggtagactgggattcatga

SEQ ID NO: 12784 - RNA, 1290 nt, unidentified
  source 1..1290: mol_type = other RNA; note = synthetic construct
atgctgctggaccattcaatgacagacgcgaccctggctttcgaccaggtgcgtgagctggccgccgaattcagccgtatttacacagggtggacctggccagaggtcctgagggcactcagggctgtgttggccagagatctggctgatgccgtggcccctcgcgtgtttgaattagcccctacggaacccaggcaccctgaggcagttcttgtggaggctctctctccatggactctgctcccacccgatccacagctggtgctgcgaccgcaagaaccacgatcttcagggaccgtacccgaaggcctccccgatctttatgacgttactcaattagcccattggctggattttactgtccccgagctggaatggtttgccgatcgcgggggatggctaaggacttcacgccctcccttgaggcactaccgcatttggagacgctccaaacgcgacggcttccgtgtgatcgaagctcctaagcctcgaatgagagagacacaacgcagattactgcgacggctggtggagcatgtacccgcacacccttgcgccaggggatttgtcgccggatccagcaccacggcgttcgcatggccacacagtgatcggccggtcgtactccgcgcggatcttaggcactgttttgaaacaataacaactaccagagtcagaagggtcttccacgacgttggctatcccgcccacatagcaagaattctagctgagctgtgcactaccgccacccctatcgacgagctcggtggcatcgatttggctcatcgagccctgttgcgggatagacacttgcctcagggtgccccgacaagcccacatctcgcaaatctggtgatgaggggactggacagacggcttgacggctatgcccgagcaaatggtttaagatacacgcgctacggagacgatctcgcactctccggagattcgatggacgccgaccggaccctttgggtggtcctgaagatcattgagactgagggtttcaccgctcatcccgataaagtacgggttatgtaccggcatcagcagcagcggctagcgggcttggttgttaacgatcggccccaagtgagccgggcaagttacgacaatcttagggcactcttgtataacgccgccgctcatggcgcccagagtcagaaccacgctgaccacccagactttcgtgcgcacgtgctggggcttatctcttgggtgggggctaccaacccaacaagaaggcagcggctgctgcagatggctgacgcagtggactgggattcctga

SEQ ID NO: 12785 - RNA, 1278 nt, unidentified
  source 1..1278: mol_type = other RNA; note = synthetic construct
atgactaggccacaaccgcccttcactacggatcaggtgcgcgtgcttgccgcagcaatcgctgaccgcatcgtggattggacttggcctgcagtcgtgagagcagtgggcattgaacttccagccgagatctgcgtcgacgtggctcaggaagccttcgcactggcaccagacgagcctacacatactgccgaaatatttagactggctttagtgccctggacagttccggatcctcccgctacgagggtcgtcgagcttcctggcccaccacctgcaacagcactcgcgcatgatctgccgctgctgagcgacgttgaacagttcgctgtgtggttagacttcaccgtgccagagctcgaatggtttgccgacagaggaacctggctacgcaccgcgaacccaagactgcgccattacagggtctttcgtagggagaaacgatccggagtgcgcgtgattgaggctccaaagcccaggatgagagaaactcagcgcagactgcttcggagactcgttgttcgcatacccgcacatcccgctgcccgaggtttcgagcctggctcttctcccgccgctttcgcatggcctcatagtgacaggacgacagtcctcagggtcgatctgctgcactgttttgagtcgatcggcgtggggagagtacggcgcatattcgatgaggtgggctatcccccgcatatcgcccgtctgctcgctgaactgtgcaccacttcaacacccgctgatcagttgtccggcattgattacgcccacgccagtctgctcagacggcgacacttgcctcagggctcccctacatcaccccatctcgccaatctggccctagcccaggttgaccggcgaatcgcggggtatgccaatgcgaatgggctgcgttatacaaggtatggtgacgatcttgcggtgagcggggacgacttggacttgccaagggcgctatggaccgtaacccggatcgttgatgattgtggatttgccgtgaacaccaagaaaacccgtgtgatgcataggcaccagcaacagcgactcgccggattggtcgtgaacgataggcctcgggtaagccggcacgactacgacgccctcagagccttgttacacaacgccgccctgaccggagcacaggctcaaaaccaccacggtcacaatgattttcgcgcccacgtatacgggctgattgcttggattggagcaaccggtgaggtccggcgacaacggctgcttgacatggctgaccgggttgattggactgcttga

SEQ ID NO: 12786 - RNA, 1278 nt, unidentified
  source 1..1278: mol_type = other RNA; note = synthetic construct
atgacacgaccggaaccaccatttaccgccgcacaggcacgggcaatttccgcagccatagcggatgccatggcggactggacatggccagaagccttaagagccgtgggagcgcaactacccgccgagatctctgccgacatagcccagtccgcttttgctatggctcccgcagaacccgctcataccgccgaagttttccgactcgcactgcttccctggaccgcagctgattcgccctccggtcgtatcgtggagctgaccggacctacgccagtcgctggtttgccacacgggctcccccctttagccgatgttagcgagttcgcatcttggctcgacttcacagtgccggagctggagtggttcgctgacaggggagggtggctacggacagctaatccacgtctacgccattatagggtcagtcgtcgcgagaagagaagcggcgttcgggtcatcgaagcccccaagcccagaatgagagagacacagcgtcgactcctgcaccgcttgattgccaggattcctgcccatagagcagcccggggcttcgaacctgggtcatcaccggctgcctttggctggccccacagtgatcgaccaactgtgctgagagtggacctgcagcattgctttgaaagcattggagcagggcgggttaggcgggtggtagaggacgtgggctaccctcctcacattgcaagactcatcgctgagctgtgcactaccagcactcctgccgatcagcttacgggcattgatcacgcccatgctagtttgctgaggaggcgccatcttccccaaggtgccccaacttctcctcacctggctaacttggcattggcccagctggaccggcgccttgaaggatatgcgaacgccaacggcctgagatacacacgatacggggacgatctggcgatctccggggatgagttcgatgcaggtcgcgcactctggactgtcctgcgcatcgtcgacgactgtggactccacttaaatgcggccaaaaccagagtaatgcatcggcaccaacagcaacgcctcgccgggcttgtggtaaacgacaggcctcaggtttcaaggcgggagtatgacgccgtgcgcgctcttctgcataatgccgccatcaccggcgctaacgctcagaatcggcacggccacaacgattttagggctcacgtgtacggcctgatcgcttggataggcgcgaccggagaagtgaggagacagagactgctggagatggcagatagggtcgactggaatcgatga

SEQ ID NO: 12787 - RNA, 1278 nt, unidentified
  source 1..1278: mol_type = other RNA; note = synthetic construct
atgaccagacctgatccgggcttcactaccgaccaggtgaggactgtcgcagctgccctcgctgataggatcatcgattggacatggcccactgtcatgagggccgttgctgcggagcttcccgaggaaatatgtgtggacgtcgcacaagaggcattcgcagtggccccacatgagccaccccatttggccgaggtgtttcggttggctctgtcccgctggacactgccggaaccacctattcctcgcgctgtggagctccctggtcccactccagtaaccgacctcccgtatggcctgcctccactgcacgatgtggcccagttcgcggcctggttagacttcacccctgccgagcttgagtggtttgcagacagagggacttggctgcggactgctaacccccgtctccgacactatcgagttttccgtagagagaagcggcagggcgtgagagtgattgaagccccaaagcctcgcatgcgggaaacacagagacgactgctgcgccggctggtatcacggattccagcacacccagcggctaggggatttgaaccgggatcatctaccgcagcattcgcgtggcctcatagtgacagacctacagttctgcgattggacctggagcattgctttgaatccatcggggccggacgcgttcgcagaatctttgatgacgttggctaccccgctcatatagcaaggctgctggcagaactgtgcacaaccagcacacccgccgatcagcttggggggattgacctgacgcacgctgccctgttgagacgaaggcaccttccccaaggcgctcctacctctccccacctcgccaacttggctctagcgcgcttagaccgccggatcgacggttatgctagagccaaccggctgaattacacccggtacggagatgatctagcactctcgggtgacgacttcgatcacggccgtgccttatggatcgtgcgccggatcgtgtccgattgtggctttgtcgtgcaccccgataaagttcgtgtcatgcataggcaccagcaacagaggttggccgggctggtggtgaacgaccgtccacaggtcagtcgcgaggactatgacaaccttagggccctccttcacaatgccgcaaggagcggcgcccgatctcaaaatctccaggggcataataatttcagagatcatgtctacggcctcattgcctgggtaggagccacgggacacgaacggcggagaagactactggatatggctgacagggtggattggagcaggtga

SEQ ID NO: 12788 - RNA, 1329 nt, unidentified
  source 1..1329: mol_type = other RNA; note = synthetic construct
atgactgaacctagtcgatcagccccccagccatttttatcagtcgccgatgccgcagtggtcggtgctctgttcgcacgccaccatactgcatggacgtggcctgaaacgctgcgggctgtagattccgccctgattgacgctctgcaggccggtgttaccgctctggccgatgtacccgatggtctggctcgcgccatctccttgagaattctggatggcggcccccttagagatcccgtagcggtgtttgtccacgccgctgcaagatggaccctccctgctgacgctgcgccaaggagcattgagacaccaggacccaccccatccgtgggactgccagatgagttgcctgaactgcacgacgtcgaacagttcgcccactggctcgacttcacagtgcctgagctggagtggttcgccgatagagagggtaggctccgtactgctcgcccgaccctcagacattatagggtgtggaggagggataagcggagcggggttcgagtgatcgaggcacccaaacccagaatgcgggagacacaaaggcggcttctgcgccggttagtggagcgaatacccgcacatcaggccgcccgaggtttcgagccgggttctagcaccgccgcttttgcttggccccacaccgaccgtcctacagtgctccgagtcgatcttagacactgtttcgaatccgtacctgcagcacgggtgcgcagggtctttgcagacgtggggtatccagcctcagtggctcggctccttgccgaactgtgcaccactactacgccgatagatgaactgacaggcatcgacagtgaacatgccatgctgttgcgcggtagacatctcccacagggggctcctacctcgcctcatctggcgaatcttgccatgcggtctttggacaggcggatcactggatttgccgagttaaacggcttgcgctacaccagatacggggatgacctagcaatctctggggacgagatggacgcagggagggctctatggacagtcgccaggattatcagagcggaaggctttactgtgcacccagaaaaggtccggataatgggacggcaccaacagcaacgtctcgccggcctagtggtgaatgacaggccccgcgttagtcgggtggactacgacaatctgcgtgcactcctgcataacgccatccgagatggagcgacagcccagaaccgtgagggccacccagagttcagaagccacgtttatggattgattgcctgggttggagctaccgatccggctaggcgccgcagacttctggcaatggccgctgacgttgactgggacgcgtga

SEQ ID NO: 12789 - RNA, 1272 nt, unidentified
  source 1..1272: mol_type = other RNA; note = synthetic construct
atgacaacgcccgttctaacagctgatgaagtcaacgacgctgccgcctggttctcccggacctatacaggctggacctggcctgagctgctcagagccttagagagtgtgctccctgcggccattgctcgtgatgccctgccagccctgttgaccctgtcacccgctgagccgagacatcctgctgaaagcctcagaagagctttgaaaaaatggactcaaccccccgcacggcatccaactgtgcccatgcctgagccacctccacgtgacaccatcgccgacggactcccacagttgtactctgtccctgaggttgcccagtggctggatctcaccaccggggagctggaatggtttactgatcacggtgggtggctccgcactgcaccaacacggctgaggcactaccgcgtgtggacacgcgaaaagcgggatggcgtgagggtcattgaagccccgaagcctaggctgagggaggctcagcggcgactgcttaggctgcttgtaagtcggatccctgctcacccagctgctactggttttattccaggaagctctaccgccgactttgcacgaccccattctggcaaagctacggttttaagggccgatcttaggcactgcttcgagtcgatcactgcaccccggatagcagaggtgttccgcagagccggatacccgcctgagatcgctcgcctgcttgcggacctttcaacgaccgccacaccagcagaccaactggctggagtgcccgccgaacatgccacatacctgaggggacgtcatctaccccaaggggcccctacaagcccacatctcagtaacctagtgatgcgcagccttgatcgaagactgaacggctatgcacgggcaaacggtctggcgtatacccgttacggggatgacctggccttgtctggagacgccatggacgcagatagagccctgtgggtcgttctcaaggtgatagcttcagagggcttcactgtgcacgccggtaaggtaaggattatgagacaccaccagagacagaatttagcgggcttagtcgtgaatgacaggcccagggtgtcccggagcgattatgacaacttgcgcgcactgctgcacaatgcccaacgccacggggcctcctcccagaatcattccgggcacccggaatttcgagcgcatgtcctcggcctgatcgcatggatcggcgctaatgaccccgcacgacgcgagagactcttgcacatggcgaacgaagtagattggacccggtcatga

SEQ ID NO: 12790 - RNA, 1266 nt, unidentified
  source 1..1266: mol_type = other RNA; note = synthetic construct
atgactacccccgtcctcactacagatgaggtcaacgatgctgccgcatggtttagcaggacttacaccggctggacctggccagagcttctcagggcactggagtccgttctgccagctgccatcgcccgggatgccttacccgcactgctcacactctcgcctgtggagccccgacatccagccgaagcactcaggcgcgccttgaagaagtggacccgacccccagccaaaccaacgattgtgcccccaagcgtcccccctccacacgatactatcgccgaagggctgcctgagctgtactcggtgtctgaggtagctcagtggctggacctgacaaccggcgaattggagtggtttgccgaccatggaggctggctgaggacagcgccaagtaggcttcggcactatagggtctggacccgcgaaaaaagggacggggtcagagtgatagaggcccctaaaccgcgcctttgtgaagcccagcgtagattgctgcgccttttggtaagccggattcctgcccatccggccgctacagggttcatccctggtagctctacagctgattttgcccagccccactccggcaaggcaaccgttttgagagtggatctacgccattgtttcgaatctataacggctcctagaatcgcagaagttttccgacgcgctggatacccgccggcaattgctagggtgctcgctgacttatgcactacggctactcccgcggatcagctagctggcgtgccagctgagcacgccacctacttgcgtgggcggcaccttcctcaaggtgctcccacttcaccccacttatccaatcttgtcatgcggtcactcgaccggcgtctggatggttatgcccgcgcgaataggctcgcctataccagatatggggacgatctggcactatccggaaacgcgatggacgcagatcgggcgctctgggttgtgctcaaggtgatcgccagtgaagggtttacagtgcatgcaggcaaggttagaattatgcgtcagcaccaacgccaaagcctggccggactggtcatcaacgaccgacctcgcgtgtcccggagtgactacgacaatctgagggccctgctgcacaaccggagcgtgagcaatcagatgagaagagaggtactgggatgggcatggctggtgtcaggcgaccgggcttccggttcactgatggtggcattctctgggagtagaggcggacgaggacgaagagtaaacaggtctggctgcttagcctga

SEQ ID NO: 12791 - RNA, 1269 nt, unidentified
  source 1..1269: mol_type = other RNA; note = synthetic construct
atgacatcccccgtgctcactgtggaggaagtaggcgaggctgcggcacgcttttcacggacatatactggttggacctggccggaacttcggagagcccttgattctgtgctgccggaagcaataacaagagacgccttgccgattctgctcgcgtggtatccagacgagcctagacatcctgctgcagccctaaggcaggttctaaccgagtggactcgtcccgctggagcaccaaccaccgtaccactgcctgaacctccgccccgaacgacaattgtcgatggccttccccaattgtacagcgaggcagaggtggctcgttggctggggtttactgccggggaactggattggtttgccgatccaggaaattggctccggaccgctcccccaaggttaaggcactacagggtgtggacgcgcgaaaagagggacggagtgaggctgattgaagcccccaaacctcggttgcgggaggcacagcggagaatactgcgactgctcgtaagccgaatacccgcccacccagccgctactgggttcattcctggatcttccacatcagcttttgccagaccccattctggttctgcaacagtgttacgcgtcgacttgcgccattgtttcgaaagcatcaccacccctagaattgctgaggtgttccggagggctggctaccctagttcgatcgcccgactgttagcacacctctgcaccactgctaccccagccgaccagttagccgatgtgcctgcctcccacgcagcctatctcaggggccgtcatcttccacagggcgcacccaccagtcctcatctgagcaacctcgtcatgagatcattggatagacgtctgcaggggttcgccgacgctaatgaccttgcctacacccgctatggagatgatctggcgctctcaggcgatgctatggatgccgaccgggccctatgggtcgtactgagggtgatcgcctccgagggctttacagttcatgccggtaaggttagaatcatgcgacggcaccagcgccagaatctggctggcctggttgtcaacgaccgaccacgcgtgagtagggccgagtacgacacactgcgggcactgcttcacaacgctaggctgcacggggcgagcagccaaaaccactccggtcaccccgacttcagagcgcatgtcctcggactgatcgcctggatcggggcaactgatcccactcggagagagcgcttgacgaggatggctgaccgcgtggactgggcgatgtga

SEQ ID NO: 12792 - RNA, 1119 nt, unidentified
  source 1..1119: mol_type = other RNA; note = synthetic construct
atgacctcccctgttctgacagtggaggaggtgggtgacgtggctgcctggtttagccgcacgtatactggatggacctggcccgaacttaggcgcgctctggattcggtgttacctgaggcgattgctcgggatgcactgcccacgctgctggcaggatttcccgatgaacctcggcatcctgcagccgccctgaggcaagaatggtttgccgaccccggcaattggctccggactgctacaccacgacttcgccattaccgggtctggaccagagagaaaagggacggggtgcgtgtcattgaggccccgaaaccacgcctaagggaagcgcagcggagactgttgcgtctgctagtttcaagaatcccagctcaccccgcagcagccggctttataccgggctcatcaacctccgccttcgctcagcctcactctggaagtgccaccgtactccgtgttgacttaaggcactgctttgaaagcatcactactccacgaatcgcggaggttttcagaagggccggttacccaccaacaatagctcgcctcctggctcatctctgcacaactgccacacctgccgatcaacttactggagtccccgccgcgcatgccgcatatttgaggggccgacaccttccacagggtgctcctacctctccccacctgagcaatctggtaatgagatgtctcgaccgccgtttgcagggcttcgctgtggcaaacggcttggcatacacaagatacggcgacgacattgctctcagcggcgatgcgatggatgccgatcgcaccctgtgggtggtactcaaggtgatcgcctccgaggggttcactgtccacgcagggaaggtgagaatcatgcgccggcaccaaagacagagtctggccgggcttgtggtcaacgacagaccgagggttagtcgggtggagtttgataacctgcgggccttgctgcacaacgccaggcagcatggagcttcttcccagaattattctgggcaccctgacttccgagctcatgtcttcgggttaattgcatggatcggagcaacggaccccacccgcagagaaaggctaacacggatggccgaccaggtggattggacccgatga

SEQ ID NO: 12793 - RNA, 1266 nt, unidentified
  source 1..1266: mol_type = other RNA; note = synthetic construct
atgacagagcgcagacttaccgctgacgaagccggggatgctgccgcatggttctcccgtacgtacactggttggacctggcccgaattaaggagagcactcgactctgttctgccgagtgacattgcgcgagaggcactgcctgcactgttccagtggcatagggtcgaaccccgacacccagccgctgctttgaggagggtgcttgcccgctggactgtacctcctgccccacgaccactgtcagttgcggagcccgtcgatcccgggaccatcactgagggtttgcctgctctctacgcggttgccgacctagccaggtggctggatctgaccgttggagaactggagtggttcgcagaccatggcggctggttgagaacagctgcccccaggctcagacattaccgggtgtgggcgcgcgctaaaagggatggagtccgcgtgattgaagctcctaagcctcgcatgagggaggtccagcgtcagttgctgaggctgttagtgagccgtatccctgcacacccagcggctaccggatttctgcccgggtcctccacagttgacttcgcccgaccgcatgccgggaaggcaacagtgctccgggcggatctccggcattgctttgagagcatcaccgcccccagagtaaccgacgtgtttcgaagagagggctacccacccgcgatagctcggctgctagccgaggtttgtacaacggcaaccccggtggaccatctgacaggtgtgcccgcagaacatgcagcttatctccgcggacggcacttaccacagggagcaccaacttcaccccacctgtccaatctggtgatgcggagtttggatcggcggctgcacggttatgccgctgcaaacgggctcacttacactcggtatggcgatgaccttgctcttagcggagatagaatggacgctgggagagccctatgggtggtgctcaaggtcatcgcttctgaggggttcacggtgcacgcaggcaaagtaagagtgatgcgcgcccaccaacgtcagacattggccggcctggtcgtaaacgagcgaccacgagtctcgcgggccgaatatgatgcccttcgggccctcctgcacaatgccagaaggcgcggcgcttcaagccaaaaccacgccggccaccctgattttagggcccatgtgcttggacttattgcatgggtgggcgctagtgaccctgacaggagagagcgcttgctgagaaccgccgatgaagtcgactgggcctcttga

SEQ ID NO: 12794 - RNA, 1272 nt, unidentified
  source 1..1272: mol_type = other RNA; note = synthetic construct
atgacagaacctcgacctcctgcccggttgtcacccgctgaggtaggcgacgcagcagcatggttttcccgcacttatactggctggacctggcctgaactgttgcgggcccttgatgcggtcttgcctggggacgttgctcgcgaggtacttcccagcctcctgatgctcccgagagagcctagacatccggcagccgcgctacgtcgagttcttcggccctggacagctcccgcaccgcaactagccacaatgcccgttcctgcccggcgtgatactgtggctgaggacttgccagcattatattctgtgagagaggtggctgactggctggatctcacggtcggggaacttgaatggtttgccgatcacggaggctggctgaggacagcaagccctagcctgagacattaccgcgtgtggacccgggaaaagagggatggggtgagggtaatcgaagctcccaagcctaggctgagggagatgcagcggaggattttacgtcaactggtcagtcatatcccagcacaccgcgccgcgaagggtttcgtaccctggtcctcaaccgccgactttgcttggccccacagtgctaaagccatagttctccgggccgacctcagacattgttttgagtccattacagcgcccaggatcgcagatgtgttcagacgcgctgggtacccaccaacggtcgctaggctgctcgccgatctctgcacaaccgcgtccccagcagacaagctgcgaggagtcccatctgaacatgccgcttacctgcgtggaagacacctaccccagggagcaccgacctctccacatcttagtaatctggttatgcggtctttagaccgcagactgtacggctacgctgctgccaacggactgacctatactcgctacggcgacgatctcgctctctcaggccacgagatgaatgctgaccgcgccctttgggttgtcctgaaagtgatagccagcgaagagttcactgtgcacgccggtaaagtgagagtgatgagggcccatcagagacagaccctggccggtttggtggtgaacgatcgacctagagtgaggcgggccgattatgacaacctgcgggcgctgttacacaatgccaggcggtccggtgcctcaagccagaaccacgccgagcacccagatttccgagcccacattctcggcctgatcgcatgggtgggggcatcggatccagtcagacgagagaggttgctgcgcatggccgacgaagtggactgggaggcttga

SEQ ID NO: 12795 - RNA, 1281 nt, unidentified
  source 1..1281: mol_type = other RNA; note = synthetic construct
atgtcagagacacaccccccgacacagttgtccgctgctgaggcccatgacgctgctgcgtggtttagccgctcttataccggatggacttggccagagctgctgcgggctcttgaaagcgtgctgccccccgacattgctagggatgccctccctgggctgcttgccagtcacagaagagaaccacggcacccggccgaagctctgttgagggctttgcggccctggataatcagaacacctaaacctcccacaacggttacagacgttcctcctgccagagatacaattgcagagggactgcctactctctactccgtgcgagaggtcgccgaatggctggacttgactattggggagcttgactggtttgcggatcatggagggtggctcagaactgcagcaccaaggctccgccactatcgcgtttggacccgggaaaaacgggacggcgtgcgtgttatagaagccccgaagcctagactgagggaggcccaacgccaaatcctacggcagcttgtagcgcgaatcccggcacaccgggcagctacaggattcatccccggctctagcaccgcagattttgtgcgaccccacagtggcaagccaacagtccttcgcaccgacctgcgacacgcctttgagagcataaccgcctcccgtgtggctgacgtattcaggcgtgtgggttacccacccgccatctcaaggttgctcgctgacctttgcaccactgccacccccccagatcggctaagaggcgtgccatctgcccatgcagccagattaagagtcagacacttgcctcagggtgcacccacctccccacatctatcaaatctggttatgcgctctctcgatcgacggattcaggggtacgcccgcgcgaatgacttaacgtatacccggtatggcgacgatctggcgctctcgggggaagctatgaacgctgatcgtgcattatgggtggccctgaaagtgatcgcgtcagaaggcttcactgtgcatgcaggcaaggtgcgggtgatgaggaggcatcagcgccagaccctggcaggactggtcgtgaacgatcgaccacgtgtcagtagagccgattacgacaatctgcgcgctctgctgcacaatgcaaggcgccatggtgccgcctcccagaaccacacgaaccatcctgacttccgcgcccacgtactcggtctgattgcctggatcggagccagcgatgacgtcaggagggagagattactcaggatggctgacgaggtcgattggactcggtga

SEQ ID NO: 12796 - RNA, 1302 nt, unidentified
  source 1..1302: mol_type = other RNA; note = synthetic construct
atgactgactccgatccagcccccaggctgtcattagctgaagcacacgaagctgctgcctggttcagcaggacctttaccggatggacgtggcctgagttgctccgggccttggaaagcgtgctcccagctgagattgcaagagaggtccttcctgcactcctgatgcgccacagggacgaaccaagacaccctgcgcaggcattgctgcgagtcttacggccctggattatcgccagtccacccgcccagctgtcagtgactgtgcctgacccacatgaccccacaactccgccggagcgggacacaatcactgaggggctgcctacactgtacaccgctggcgaggtttctgaatggctcgacctgacaatcggggagctggagtggtttgccgaccatggcaattggctgagaactgccgctcctcggttacggcattaccgggtgtggagtcgggagaagcgagatggagtgagggtcatagaagcccccaaaccccgccttcgtgaggtccagaggcgaatactgcgccagctggtgtctaaaattccagctcatcgagctgccacaggattcttgcccgggagttctaccgcggatttcgctcgtcctcacgctggccagcccacagtgcttcgcgcagatctgcggcattgcttcgaatccattaccgccccacgggtcagggatgtgtttagacacgccggttatccgccaccgatcgcgaggcttctggctgatctgtgtacaaccgccacccctgctgatcagctgagaggcatgcctgccgaacacgccgcccttcttaggggccgacaccttccacagggagcacctacttcgccccatctcagcaacctggttatgcgctccctcgatagacggttgcatggctttgccgcggccaatgatttacattataccagatatggtgacgacctggccctgtccggtcacgagatgaacgcagatagagcactatgggttgtactccgcgtcatcacggacgaggggtttacggtccacgcaggaaaggtgcgcatcatgcgtgagcaccaacggcaaaggttggcgggattggtggttaacgcgcgacccagagtatcaagggctgaatacgacaatctgcgcgctctgctccataatgccagacaccacggggccgctagccaaaaccatgccgggaatgaagacttccgcgcccacgtgctaggccgtattgcatgggtgggcgccggtgatgaggtaagaagggagcgcctcctcgcaatggcagcagaggttgactgggaaaactga

SEQ ID NO: 12797 - RNA, 1059 nt, unidentified
  source 1..1059: mol_type = other RNA; note = synthetic construct
atgcggcggtggcaacaaccagagcatcggggacaccccattgaccttccgggaccagccccgatcgactctttaccctatgagctgccagtgctcaccggtgttgatgatgtagccgcctggctggctttaacccctgccgaagtcgattggtttgccgatcgcggctcatggttgacaactgcccgcccagccctgcgacattacagagtttctcacagggagaagcgcaccgggacccggatcattgaggctccaaagcctatgctgcgagaaacgcagcgcagaatcttgagacgcctcgtgcagagaattccagcccaccccgctgcgaggggattcgtacctggtggctccacagccgcattcgcctgggcacactcagatcgaccagtcgttctgcgcgccgaccttcggcactgctttgagagcatcaccgtgtcccgtgtgcgtcacgtgttcgcgcaggctggataccctgcaggcgttgcacgcgtgctggcagagctctgtactactacaactccacccgaccagctaatagatgtggaccctgcgcacgctgggctgttgaggaggagacacctgcctcagggagctcctacaagcccccacctcgctaaccttgctctactgcgcctcgatcagcgattagacggctatgcgaggagaaaccagctgagatacacgaggtatggtgacgatctagctgtctctggggatgccatggacgccgaccgtgctctttggaccctgctgcggattgtcgaggactgcgggttcgtggtgcaccccgagaaagtgagaatcatgcccgcacatcagagacagcgtctcgcaggcctggtggtaaatgatcggccgcaagtcagtcgggaagactacgataggttgagagccctgttgcataacgcagcacgccacggccctgaaagtcaaaatcattccgcacaccccgactttagggcccatgtctatgggctcatagcctgggtgggcgctactagcgaaacacggcgaaggaggctgcttgacatggccgatcatgttcattggtga

SEQ ID NO: 12798 - RNA, 1323 nt, unidentified
  source 1..1323: mol_type = other RNA; note = synthetic construct
atgaccccgaacgaactgtccggggatgagcttcgcgcagtcgctacgcacgctgcagatgccattacagactggacatatcctaggattagaggggccgtgcatgcggctctagcagccactaccccacggaggtttgcccttccacatgtcgtcgccgatagagtagccacggatgccctggctctgtcaccagatcggcctgacaacgtggcggccttcatcggtgaggcgctgcaaccgtggagaagacctgatccaccaccccctccccccgataccagactcaggcttcaacccgcggaacctcagccccctaccggaatgcggcacggattaccccccatcgcggggtatgaggagctcgcattctggttgaatttgactgtgggcgaactggattggctggctgacaggggacgatggctggaacacgcacggtaccccctccagcattaccggattactcggcgggagaaacgaggcgggcacagaattattgaagccccaaaacccttgctccgcgaaacacagcgtcggctgcttcgccgagtggtggagcatattccggcacaccctgctgctagaggatttgtccgcggctccagcactgccgcctttgcttggcctcacgcagaccgtgcagctgtagtgcgagtcgatctacgacattgtttcgagagcatcggcatctcagccgtgcgcgcagttttcacaagtgccggctaccctccgcatatcgcacgcgtgctggccgacttatgcacaaccactacccctgctgaccagctacacggtatagactgggaacacagggatctcttgaggcgttctcacctgccccagggagctccaacctctccccacctggctaatcttgttctgaggcggctggacagaagaattgatggctacgccaagcggaatgacctccagtacacccgctatggggacgatatcgcagtcagcggtgactccatagatgcccacaagactctccgcgttgtactggcgatagttgaggattgcggcttcacggctcatccaggaaaggtgcgtatcatgtacgcccaccaacaacagcggctcgcagggttggtggtgaatgataggccacaggtgtcgagggctgactatgacgccctgagggccctcttacataacgcagttcaccacggccccgacagtcagaaccatcatggtcacccagactttcgagctcatgtccacggactgatctcttgggtgggcgccacaaaccctacaagaagaaggcgcctgttggaccttgccgcccagatcgactggaataccgagcagtga

SEQ ID NO: 12799 - RNA, 1293 nt, unidentified
  source 1..1293: mol_type = other RNA; note = synthetic construct
atgtccgaccccttatttagccctgatgaggctgccgaaattgccgcacatgtggaggcccacttgactgcatggacttggcctgagatgcagcgagccctgatcgcagcagggctgagtccggagttcgccgacgttgtgggcctgagactgttcgacccctctgacgacgttgtcgcaggtgcatctgatattgaaagccgcatccttggggcgctgcgagacaggacagcacccttgccagagacggatgacaggtctgccccagctgtgtgggagctgaccgagccttccagcactgggagagttcgtgacgacctgcctgatatatacgacgtggagcagctggctcactggcttaacttcactgtcccagaactggaatggttcgctgaccggggcagatggttaaggaatgctcgagagcctctccggcattaccgggtgttcagggtcgaaaagcgtgatggctttcgcgtgattgaagcccccaagccccgcatgagagagactcaacgccgccttctccggaggctggtggaaaggatacccccacacccggcagcacggggatttgtacggggcagtagtaccgccgcttttgcatggccacacacagaccgcccggtcgtgctacgggttgacctaaggcactgcttcgagtcaatcgatgcccgaagagtaagacatgtgttttcagcggctggatgttccccagctatcgcccgcatcctgaccgaactttgcacaaccgcgaccccacccgatgctattcatggcctggaccctgtgcatgccgggctgctaagggaacgtcacctcccccagggtgcaccaacgagccctcacttggcgaatctcgttctgcgtggaatggatcgccggttggccggttttgcggcccacaatgatcttagatatacaagatatggcgacgacttagctctctcgggagatagaatggacgcagaccgggtcctctggaccgtactccgcgtcgtcgccgatgagggcttcacagtgcaccctgccaaaaccagaatcatgcacgcccaccagcaacagaggctggctgggctcgtggtaaacgatcggcctcaggtttccagagcggatcacgatgccctccgagctctgctgcataacgctatacggacaggcggtgccgcccagaaccatgacggacaccccgatttcagggctcatgtgtacgggaagattgcctggatcggagccacctcacccgctcgaagggacaaacttttggatatggcctctcatgtggattggtga

SEQ ID NO: 12800 - RNA, 1314 nt, unidentified
  source 1..1314: mol_type = other RNA; note = synthetic construct
atgaccactgacagtacacatccgggagactcaaccgacagcgcccatccagacgacttaggcgggctgggtcctgagatccgcatacccgcacggtccctcgacctgctcatcaataggctcgaggtggatcctcggtggtccgttcatgctctgggagatatgcttgccgctacgacagctcctgcgaccgctactgcactgctgggcttgttgttggaaaagttcccagaacggcccgagcctgaagctgtacgacgagccctgtggtcaatggtaatagagaatagatcgcacgtcttcggcgagctgcctacgccagagatgacctttgccctgacaccattggccgatgccactgacgttgcccgatggctgggcttgacagtgggggagcttgaatggttcgcagaccggggactttggctccgcagtaagaaaaccgcactcgcccactatcggtacgtgacaatcccgaagagagatggggtgagagtgatagaggcgcctaaaccccatctgcgtgaaattcagaggaggatcctgcgcgagattcttgaccggattcccccccatagggcagcccaaggctttgtagccggacgttctaccgcctctttcgcctggccgcattcagatagaaatgtagtgctcagggtggatcttaggaattgttttcccactattacatccgcaagagtccgcgctgtctttgccgccgtgggctatcgacgaacatctcggctgctcagcgagatctgcactaccgctactccaccagatgtgcttcgcggcctagatttcgcacatgcttctttactgcgcgctagacaccttcctcaaggtgcccccactagccccgccttagccaacctagttatgcgcaccatggaccggaggatctggggttacgcacggcataacaacctccactattcccgatatggggatgacctagctatctccggcgacgttatggacgcaggacaggtcctgtggaccgttctgcggattatagctgatgaagggtttacggtccacccagacaaaaccaagattatgtacagccaccagcgccaacagctggcggggttagtggtcaatgaccgtccacgcgtgggcagagtcgactacgataatctgagggctctgttgcacaacgcgatcagaactggagcacacgcccagaacagggacgatcaccctagattcagggaacacgtgtacggtaagattgcctggatcgctgcgacaagtcccagcagaagaaacaccctgctcgccatggcagaaagggtggattgggatcgttga

SEQ ID NO: 12801 - RNA, 1278 nt, unidentified
  source 1..1278: mol_type = other RNA; note = synthetic construct
atgaatgattcctattcacttggaggcttggggccgcgcatgagactgactgcagatagtgtcgaacatctgctcacgcgcctcgaggtagaccctaggtggactgtttccgccttggtggaaatgctcgttgccacggtcgagcagcccgtggtcaccgaactgctgggcatgctcctggacaggtttcccgagcggccaaccgatttgggcgacgtacgcactttcctagctcccctaataggtgagccaagaagcagggagttcgatgaccccgcggatccggtgatgcgtttcgatctgccccgccttcctgactactctgacgttgcaaggtggctcaacctgactgtcggggagctggaatggttcgcggacagagggcactggttaaggactaaggatggccctctgcagcactatcggtattggcaggtacccaaaagggacggggtgcgcatgattgaggcccctaagccacatctgagggaaatccagagacgggtgttgcgcacaatactggatcatattcctccacatagggcagcccagggctttgtcccaggaaccagcaccgcatcatttgcctggcctcacactgacagaccagtggtcgttcgtctcgaccttagggactgtttctcctcgattggtacagcacgggttaaggccatcttcgccgcagtgggatacgagcgaacagctcgggtgctcgccgaactctgcaccacaaccaccccgatcgcccatttacgggacattgaccatcgacaggccgctctgctgcgacagagacacctgccccaaggtgctcccaccagtccagcccttgccaatttggtgatgcgtgcaatggaccgaagaatctggggatacgctcagagaaaccggttacactattcccggtacggggatgatcttgctatttctggcgatcacatgaatcccgaggcagtgttatgggtggtgcttaggatcgtggcagatgaaggatttaccgtgcaccctgataagacaaaaacaatgcgagcccaccagagacagcaactagctgggctggtcgtaaatgaccagccacgggtcgccagaagggactacgataacctgcgcgctttgctgcataacgccatacgcacaggcgcgcaagctcagaaccgtagcgcccaccctaactttcgggctcacgttcatggcaaaatcgcttggatcggagcgagctctcctcgccggagaaatacgctcctggccctggcagagcaagtggactgggatcgatga

SEQ ID NO: 12802 - RNA, 1311 nt, unidentified
  source 1..1311: mol_type = other RNA; note = synthetic construct
atgggtgacctattcggaggtcctcagggcgtttcccatccccgcagatacgattctgcccaagttcggttggcggtgcacgctatcgacaggttacgccgccctgtgacacctgacagatcagccgaggtatggaccagccgcgagattaatggagccctggttactgtgctcgacccagtagtggctgatgacgtcactcgactgttagtgacggcattcgctgcacccccccatcgcgatgacttggccgcttttctggccgcaatccccgcagacagaaccgtgcgagtggccgagcccgtagtttctcaccccgtgttcgccgtccggcctatcgacgatgtcaccgcactggcccactggctcgctatgtccgttactgaacttgattggtttgccgcccgtggcaggtggtcaagacgtgcaaaaccacagcttcggcattatagagtgcaacggctgcccaagagggatgggggcttcaggattattgaagccccgaaggagaggctggccacagctcagaggcgaatcctggacgagattctgagcgccgtgcctccacatccagcggcacatggatttgtgaggggccgcagtgtgcagagctacgcgagcacacacgctctgcatgataccgttgtgagagtagacttgcggagatgttttgaacacgtcacatacccgagagtccgggccgtgttcgctgcaatagggtacgcccccgcagtggcagcctaccttgctagtctgtgcaccacgacaattgcgattgatgatgaaaaactcgtcgatccaatacacgctgccttactgcgggagagacatttaccacagggcgcccctacctctccagctctgctcaacctcgtgctcaggcgcatcgactttcggatcgcaggctacgcggccaagcaccgtatcgcctatacaaggtatggagatgatctcgctttctctggggatgacctggacgccggaaaacttgtctggtttgttactagggtcgcggcagccgaaggctttgtcgtgcacccttccaaaacccgcatcatgcacgaccaccagagacagcaattgggggggcttgttgtgaaccgaggggtccgcagttccagagccgacttcgatgctctgaaggccttgctgcataacgcaataaggcacggtgctcagtcacagaatcgagacggtcacccggatttccgggctcatgtatatggcaggattggctgggtgtcgactggatcccctgcacggcgtaagcggctacgagacatggctgcgcgcgtggactgggagagctga

SEQ ID NO: 12803 - RNA, 1308 nt, unidentified
  source 1..1308: mol_type = other RNA; note = synthetic construct
atgagcgacgatcggacatctccgggcataggggcacggaggagattcgacagtgtgcaagtcgatcggatcgtgatcgctatcgatgagttacttcgatccgtggaggctccccgagtggctgacgtgtggacctctcgtgagattgacggagctcttgtggacgtgctggatcccgtagatgctgatgacctgactcgtgccctactggccgccttccctgcacctcctcgatctggaccagtggctgctttcgtggcggatctgccagcagcccctcgagtcgtcgtgccagagctgagagtctcagctcccgtcttcgaggtgcgccaggttgaggacatcgccgcccttgccggctggctaaatatgagcctggaagaactggaatggttcaccgccagcggtcgacggagtcggagactgaagccagccctgcgccattatagggtgtctcgcattccgaagagggacggtgggtacaggataatcgaagcacctaaagagaggctggctacagctcagaggaagattttagaccagattctgactggattgccaccccatcccgcagcccatgggtttgtgagggggcgtagcatcacatcattcgctgctaagcatgcactccacgacaccgttgtgcgcgttgacttgcgcagatgctttgaacatgttacgtacccccgcgtccgtgcagtgtttgctgccattggatacgcaccagccgtagccgcatatctgggctccctttgtacgacaaccattgccgtggatgatgaagccttggttgacccgcatcatgcagccctactcagggaacgccacctcccccaaggcagtcccacttccccagccttgctcaacctcgttttaagacggctggattttcgggtagccgggtacgccgataaacaccacatcacttataccagatacggcgacgatctggcgttttccggcgatcagatcgagattggtagattgctttggtttgtcgagcgggtggcagctgcagagggcttcgtcgtacacaggaggaagacccggatcatgcacgaccaccagagacagcaactcgccggcctggtcgtaaatcggggagtcagggctggtcgcgcggagtttgacgctctcaaagccctcctgcataacgcgatacgagatggagcgcacagccagaaccgggaacgtcaccctgacttcagggcccacgtttatgggagaatagactggctgtcgacaggctcacctcagagacgcgagagacttcgcactatggccgcacaggtggcgtgggatagatga

SEQ ID NO: 12804 - RNA, 2592 nt, unidentified
  source 1..2592: mol_type = other RNA; note = synthetic construct
atggaacagtggatcacgacttccgaagctgccgccagactaggcgtgaaacggggcaccttgtactcctacgtatctcgaggggtgctcacttcaaggcgcatgcccgggcagaacgaatccttgtttgaccgaacacagatagattcactggccgctgccaagcacgacggaagacgttcgggggataggctgcttcggttccgggctgtggctagcggagtgtccgcaattagggacgaccggttgtacctccgcggtagggacatcgaggagctgtgcgccgatatggatttcgccgatgtcgcccagctggttctcgacagcagtgaggcgaggcctgtccccgacgttgacacgaccgtggttcacggcgtgtccatcgagaggcggatcccccttacagtcgcactagtggcagccgctgaccctctcagggccgatcttagcgacgtgggcgccagagtcctgggtctactcccacatctggcagcggccgtgcctgaaattgattttgcccatagatgggtggatctgctagccaccgttctgatcgataacggcctcgctgcgtctaccactgcagcacgcgtagccgcttctgcaagggcgggaatcttcgacgcactactggccggttacgccgcacttgctggtcccctccatggaggagctcctgcgacagcacgcgcccttctggatgctgttgtagggggtgctgctgttgaccgtgccctggcagatgcagtggtgggaggcctcgtgcccggatttggccacgtgatatattcagggcccgaccctagggctcagattgttcttgatagagtgcgcgcggagcgtccaaggagttcagccttagccgcggcagaagcagtcgaacagcgggtcggcagaccaatgaatatcgacttcgccggcgccgtcgtcactcacgaattagggctgccggctaggtctggggaagtactttttgtgggcagccgacgggcttttagagagcctccgccagctgcttcgtctctctgtggaggaggagtacgcagagggccggcagctctcgctcgtcaaagcgacggcctgtcttgtagcgctgctgccgtgaggacactgtcgtctcgcagatcacctcggaccaccacccgccatctgatcgggggagcttccggagcgttcaccgttggccccagaagtcgcgctcaggctgcccattctgtttgttgggtgagagcggacgacgataagagcggtcggactgtcttacccgccgcggagagggaggatgtcatcgaaccagggatgagatccccattccgcttcgaccaacaccgagtgcaccgagcagtcggcgctgtagtcgggttgttgggggcagcagccggtgatgatgccggtgatgatgccggctcacttcgcacagcccccgaattggacggcgccttagttgcagtcatcgaccccgtcgatgccgacgaccttgcacaggccctgattcgagaattcgcctcccccccgagttccgagagactgacggcctttatagcggccattcccgcagccccgcgagtaagatggcctgagccaaggactagtgcccctagattcgacgtcaggcaagtggctgacgtcgaggccttagcccactggctcaatctggatttgggtgagctggaatggttcgcggcacgcggacgttggtctagacgcacagccgagccactcaggcactatagagtgaaacggattgttaagagggacggcggatttcggatcattgaggctccaaaagagaggctggctactgtgcaacggaaagtgctagatgaaattctggtacatgttcccccacacccttccgctcatggctttatgcgaggacgtagcgtggaatctttcggctcacggcatgcacttcacgacgtagtcgtgcgagttgacctgagaagatgtttcgagcacgtgacataccctcgagtcaaggccgtattcagtgcaatcgggtatgcaccagctgtcgccagctatctggcctgcctgtgcaccacgtccagagctattgaagaccggcaccgcgtggactttgaccacgccgtgctcttgcgcgagcgtcatctgccacagggagcacccacatccccagcattgctgaacttggtcctgagaaggctcgattacagagtggctggctatgccgcgaggcatggcgtgacctacacccgttatggggatgatctggcgtttagcggagacgatgtggacgtgggggggctcttatggttcatagagcgggtggtgaaggccgagggctttgctgtccatcgggacaaagttcgcgtgatgcgagatcaccaacggcagcagctgggcggtcttgtggtgaatcgcgggcctaggagctgccgcagtgactacgatgcactgaaggccctgctgcacaatgccatccgggacggcgcagagagtcagaaccgcgatgataggcctgattttcggtcatacgtttatgggcggattggatgggtgagcactggtagcgccagacgaggcgagaagctccggacaatggccgctcaggtggactggcacaggtga

SEQ ID NO: 12805 - RNA, 1299 nt, unidentified
  source 1..1299: mol_type = other RNA; note = synthetic construct
atgggggcagggttgagcagaccacgccgctttactgcaagggagactgccatgatggcaggcgctgtggcacagcgccttatgcgcgttagaggttccgacttgggcccagagtggactcggcctgaattaacagacctgctgatgcgggtggtgagtcccgcagacgcggaagaagtggctcgcgctatcctggaggccttccctgcacctccagccgatcccagagaggcgatcagagagctgatcgatgccatgtgcgacggaccattccgattcgtggctgatcccgatgtgtcgacccccgtgttcgatgtcaagcggattgctgacgtagaagccctggccgcctggcaaaacatgtccctccccgaactagactggttcgctgccaggggaagaagaagcaaacggctgcccgaaagactccgacattatcgggtctggcggataccaaaagcacacgggggcttcaggattattgaggcgccgaaagagaggcttgccacagcccagaggcgcattctggacgatgtcttagctgctgttcccccccatccagctgcccacggatttgttaggggtcgatctgcagtcagctttgccggcccgcattccctccacgacaccgtagtgcgtatcgatctgaagcattgtttcgagcacgcaaactacagacgcgtcaaggccgtgtttactgctatcggctatacccctggcgtgtgtgaatacctggccgcgctttgcaccacaacgtgcgctatagatgacgcagcccagctcgatcctttccacgctgcactcctgcgagaacggcacctcccacaaggagccccaacgtcacctgccttgctaaacctgattttgagacgcatggacatcaggatagccggctttgccgagaaaaatcgactcacatatactcggtatggagacgaccttgctttatctggtgatgacatcgaccctaaactggtcacctgggtggtcagtagcattgtgcacgatgagggcttcagggttcatcccgataagcttagggtcatgggtgatcaccaacggcagcagctggccgggttggttgtaaatgctgggcctagagcacggaggaccgactttgacgccctgaaggccctgctgcataatgctgtgcgagatggcggggagtctcagaaccgtgagggaaggggggactttcggggatacgtttacggtcgtatcgggtgggtgtcaacaggctcaccgacccgtagacgcaagctaatggcgctcgcagcgcaggtagattggtccgtgtga

SEQ ID NO: 12806 - RNA, 1302 nt, unidentified
  source 1..1302: mol_type = other RNA; note = synthetic construct
atgacaggacagggcctcgagcccccacaaaggtttaccggacatgacgccaacgccatggggtttgcggtcagcagaaggatgatgaggctgaggcctgctgaacgcgcggatgcctggacatggctaaccctgcaggagatgttcgcagacacagtgtggcctgacgatgccgatgagatcgctcaggctgtattggccgtgtatcccgaaccgcctagccggattcaggaagcgctgactgccgtgattgtcgccatgcccggaaggagagagccctttgcagccgacccaggcagtagttctcccgtcttcgatgtgcggcagatcgcagacgtggaagaactcgcagcctggcagaatttatcaatgcccgagctagactggttcgccgccagaggcagaggatcacggagagcccctacaaggcttcggcactatcgcgtgtggcagataccgaagagacacggggggctgagaataattgaggcccctaaggagcgtcttgcgacgattcagcggcggatcctggatgatgtgctcgcccatgtgcccccacatcctgctgcccatggctttgttcgcggccggtccgtcacttctttcgccggtcctcacgctctgcatgacgtcgtgctgcgtattgacctgaggcactgctttgaacacgtaacctatccacgcgttaaagctgttttcaccgctatcggctatcagccgggtgtcgcggcctaccttaccgctctatgtactactacgattgctgtggatgaccagagattgaccgattccctccacgccgcattgttacgagaacgacacctgccacaaggcgcacctacttcaccagcattgcttaacttagtgctcaggcgaacagacatccgaattgcaggtttcgctgcagctaataggctgacgtacacacgctacggggatgatctcgcactttcgggagatgacgtagacgtgggacgtgtcctctgggccgttagctccatcatacgcgacgaaggctttaccgtacacccagacaaagtgcgggtgatgggggagcatcagcgacaacagctgaccggtctggtggttaatgccggcccccgtgcagcaagagcggattacgatgccctgaaagccttgctgcacaacgctatcagggacgggggccaatctcaaaaccgcgctgggcgggatgacttccgggcttacgtttacggaaggatcggttgggtgtccacagggagccaggcacgcagaagaaagctgactgagatggctgcccgagtcgactgggagcgctga

SEQ ID NO: 12807 - RNA, 1302 nt, unidentified
  source 1..1302: mol_type = other RNA; note = synthetic construct
atggtcgggaagcaaaccgcagcccaacccgaccggtttagtcgcaacgatatccacaggatgagtgcggtcataagaaggttgctgggacctcctctcgatgatggctacgctgaacgggtttggactcgcagagagctgaacggcgccctggtcactgctgttgaccctgttgacgcggaagaggtggccagggagctgctgatgcgatacccaacaccaccaccgttgcccggcattgccgatgccgttcggagagtggtcgccgtcttgactgctcctgtgatccgcgaaccagtgggccccccaagattcggactccctgaaataggtgatgtcggcgcccttgcctcctggctgaatgtctcggttgacgagctcgactggttcgccgatcatgggctgtggcttcagagggctactccgaggttgagacattatcgcgtaacacgaattccaaagcgtcactctggatttcgcgtgattgaggcccccaaggagagacttgcaacattacagcgcaggattctggacgctatcctcgctgacgtgcctgcccatccagcagcccatgggtttgtgcgcggacgttccccgtactcattcgccgctccccacagcttgcacgacaccgtcattcgggtggacttaaaacactgcttcgagcacatcaccgcggctcaagtgcgggctgtgtttacggctgttggctacagatctgcaacagcacggtgcctggcagagatatgtaccacagcaacagcgttcgatgatctgcccggtgacgaccctttccacgctggattgctcaggggccgacacgtccctcaaggagcacccacctcacccgccctggtgaatctcgcccttcgtaggctcgactttcggatcgcgggctatgctgcaaagaatggactggcctacaccagatatggtgatgacctcgcgctatccggggatgagatgaatgtggggcagctgctgtgggtagtgcggaacgtcatcgtagacgaagggttcactctgcatccagagaaagtgagagtaatgggagatcaccagcggcaacagctggccggcttagtggtgaatgtgggtccccgaagcaggaggagcgatttcgatgaactaaaagccctgctacataacgctacctgtacgggtgcccgggcacaaaacagaggcgctcatgccgattttcgagcccacgtgtatggccgcatcggttgggttgcaaccgggtctgcagcacgtcgacgcaagcttctcgcccttgctgccgaagtagactgggacgggtga

SEQ ID NO: 12808 - RNA, 1272 nt, unidentified
  source 1..1272: mol_type = other RNA; note = synthetic construct
atgacggcaggcctccggagcgaacagaggtttagtgccgacagagccgcatcgttggctaactggatcctggaagatagggacttgctgtgggatagctgggctgtgtctgccagactatcttggcagctgcctcctgagattgcggacgaggtggccgatgccattctagtggcgctgccagaacaacccagcgcaccggaagtgctcgccgaattcctggcagccattccgtctgagcctgtgattatcatccccagtgagcctaacccacctgtggttgccgccgggttgcctgtgatcactgacgtaggcgagcttgccgcgtccctaaatctggacattggcgaactggaatggtttgctgaccgcggcacctggttacgtacagctagagtccccttgaggcattacaggataactcggataccaaaacgcgatggagtacggatcattgaggctccaaagccgcggctggccgagatccagagaaaaatcctgaggaggatccttgaccatagagatccccaccccgctgcttgtggtttcagaagggggaaatccgtggcacacttcgcatggccccacactgaccgacctgtcgttcttagactcgatctgcgacactgctttacaaccatcggtaccgctcgcgtaaggcgggtcttcgccgattgcggctactccccagccgtctcacgcgtactcgccgaactcagcacaaccacgacctcatccgacgccttgggagatttagacccatggctggccgcaatgctgagagcccgtcacttgccccagggagcacccacaagtccagcacttgctaatctggtgatgattcgcctggaccgtaggctggcaggatacgcccgaaggcacgctctccgctatactcggtatggtgatgatttagcgttctccggcgatgccatggatgccgatcgggtcctttgggctgttctgcgcatagtggcagcagagcggtttgtggtgcatcctgacaagactagaataatgggtcggcaccagcgccaacaactggctgggctcgtggtcaatgaccatccccaggttcctcgagcggagttcgacgccctcaaggctctgctgcacaacgccatcaccaccggggcttctacacagaatcatgcaggccatccagactttagagcacacatctatgggcgtattgcttgggttggagcgacaaacgcttcacgacgcgagcggctccttgccttagccgatcaggtcgactggagcgcgtga

SEQ ID NO: 12809 - RNA, 1254 nt, unidentified
  source 1..1254: mol_type = other RNA; note = synthetic construct
atgcgccggtaccccagatccaccgctgaaatgctcgccgccattgtcgacgccgctgatcccgaatggacacgcgagggcctagccgacgccttatcagcacacaggcgggggctggatgatgcccaagccgatgcagtcgcgggccatctcctcgttgccttccctcgacaacccccagacagaagggacgccatcgccggacgtatagtggagctggccatgccacctatgcgggagcgacctgcgttgcgcgagttgtgggatggattaccccgctatacagactactatgcgctggccgccgcgtacgatatgactgtaccagagctggactggctcgcagaccgcggtacatggctgaggtctaggacgggtccgcttcagcactaccgggtgactccaatccctaaaaggagaggggcccgtgttctggagatccccaagccccggctgagagagacacagagacgaattttgagaagggttctggaccggcttccccctcacccagctgctcaaggcttcgtggctggaacaagcccagccacctttagctcaccacacgcaggccgtcccgtagtgatacgcatcgatttgaggagatgcttcgagactattactgttgctagagttcgtgcggtgtttgccgcagtcggttatccaccggctgtagcacgggccctagctgacctctgcactactaccacccctgcagagagacttgtcggcgtggaccctgtgcacgccgcaatccttcggtccagacatttaccccagggcgccccgacatctcctgcactagctaaccttgtcatgcggaccctcgataggcgtattaccgggtacgctcaccgacacggcctggtctacacgaggtatggggacgatatggcactgtccggaaccattgatgatccttctgcagtggtgtgggtggtgaggcagatcgtggccgacgaagggtttacggtgcatggtgataagactagaatcatgtatgcgcatcagcagcagcggctcaccggcttggtgataaacgacaggccccgcgtctgtcggagcgaatacgacgatctgcgcgccctgctgcacaatgctatcagaacaggagctcgagctcagaatcgcgacgatgtaggagacttcgaagctcatgtgcgggggcgcattgcatgggttggcgctaccagtccagccaggaggcagaaactgctggaaatggcaagtcgagtcgactggagctcggattga

SEQ ID NO: 12810 - RNA, 1284 nt, unidentified
  source 1..1284: mol_type = other RNA; note = synthetic construct
atgacaggcgattacctttacagtcccgattgggcgagactgcttgcagacctggtggtggctgctcgggcacgatggaggaggagtgaccttgctgctgccatggcagaagtgttggacgacgcagaagcagatgggaccgcgcacaggatcctgcaggccttcccaagagagcccgtggacgttcgggccacattagctggctacctggtggagctgcgcagtgtgtcagaaccgctcagcgagccccaaaccggcgcattgctggctgctagtgcgcgtaccccagtgctgtgggcaggtctacccgtgctgaacactcctgccgagctggccagcttcctggacctcactattggggaactagactggtttgcagatcatgggaactggttgcgttcacatcgcggtccgctgcagcactatcgtcaacgacgaatcgccaaaaggtctgggctccgactcctggaaattcccaagcctcggttaagggaaatccagcggaaacttctgcgaacgctcgtttcggtcattgaaccacatcctgccgcgcatggatttcgccctggacgcgatgcaagatcattcgccgctccacacgcaggtgggcctatagtgttgagagttgatttgcgggatttctttgcctctgttcccggagctaggatccgggcggtgtttgtcgcagtgggatacccacccccaatcgccgccttactggctgatctgtgcaccacagctactcccatagccgccctgtgtgggctggatcccgccattgccggccttctacggggaaggcacctaccacaaggagcctcaacttccccagcgctcagcaacctcgtcctccgcaatacggatagaagaattgccggctatgtagcaagacacggcttgcgttatacaaggtatgccgacgacctcgctgtgagcggctctggatttgatcctgccgccgtaagatgggtcatcgagaagattgtcactgacgagggattccgcttgcatccggacaagacctctgtcatgcgcagccaccagagacagcggctggcttccctggtaatcaacacccggcctcaggtaaatcggagcgagtacgacgcccttcgggcccttctgcacaacgctgcttccacaggtgcagcggctcagaatagggggggccatgagcacttcagggagcacgtttttggcagaatagggtgggccggtgcctccaatcctgacaggcgcagagtcctgttaggcctcgcagagcgagtggattggtcccgctga

SEQ ID NO: 12811 - RNA, 1266 nt, unidentified
  source 1..1266: mol_type = other RNA; note = synthetic construct
atggcggattgggcctttgactccggaacagccgccagacttgcgcgcgttgtagtggagtcgcgaacttcttggcgcgctgctgatgtggctgaagccctcactcagctgctgcccccagaacaggccgaagagctggcagcgcgcatgttggcagccatgcctagtccgccagtcgatgtcggtcccgccgttactggctacttggccggacttcgtcggcaagatgcccctgccaccattgcctttgaggtccggaccgctgagctttgggcagggcttactcccctggctgatcccgctgctctcgctcgtttgttggacataacagtcggtgagttggagtttttcgcagaccggcgaggctggctgcggacaaaaccgaccgcactgcagcattacaggtatcgaaccctgcccaagcagtctggactgagagtgctcgaaatcccgaagcctaggctacgggagctccaacggcgggtactgcgtcattgcgtagcccctattccaccacacccagcggctcacggtttcgttcctgggcgcagcgtgcataccttcgccgaaccccatacagggagccgcgttgtgatcagggtggatctgcgggacttttttttaactgtggctcgcccacagatcgaggccaccttccataccgtaggctatccccctgcagtgggtgaagtcctggctgccttatgcacaaccgcgacggctcccgctgcgtttgcaggaattgatagtgctaccgccgctcgactgaggaggcctcacctacctcaaggggcccctacaagtcccgccctcagcaatctggcaatgtttgaagtggataggcgccttgccgccttcgcaggaagacacgggctgtcctacacgagatatgccgacgacctggccttctccacagggttaggcgagccggcaatcgcagtgagcgctgtcctggctgtgactagaaaggtggttgcggctgccggccacagactacacccaaggaaagtgcttgtgagacgagcccagcagcgacagcagttgactggcctggtcgtgaaccggacgccacaacctcccagggccgagtttgataccctccgggcaatcctgtacaactgtgcccgtttcggcccagagtcacagaatagagacgacttagctgacttcaggggccacctcctcggcagaatgcagtgggttgcatcaggatctgcaacaaggcgccgcgccctcgcagaactgttcgacagaatagcatggtga

SEQ ID NO: 12812 - RNA, 1278 nt, unidentified
  source 1..1278: mol_type = other RNA; note = synthetic construct
atgactgtggtggaggtggctcggcgagttccgagaagctggcgccatgcagtggccgacagggttgtgctcctcacagaggagatgtggacggccgaaaccattgcgtcactggtgagaggcaccgttcccgatgaactcgtcggtcctgtcgtggaagcattgctgtctggccacccacaacctccagtccaggtcgtggatggacacgttcgtcggccaaggaccgcaccccttgtagcagcccttgacgccgtaaggatcgtggagactctagactctggaggccccgtagacgttcctgggttggctctgcctgacgtggcatccatagctagaatgctcgatctgactgttccggaactggagtggtttgctgaccatggcaggtggttgcgacatgcacgcccccctctacgccattatagggttgccaggatggtgaagccagccggcggctttcgggtgattgaggcacctaagcctagactggctgaggctcagagacggatcctccttcgggttctggatcctgccggtgctcatcctgctgctagagggttccgaccagggggatcggtgttggcctatgcctccccacacgtgggctccctttctgtcgtccgcctggacctaagggattgtttcagtaccgtggctgtcccacgtgtgcggagcgtgttccggagacttggatacccagcccccgtagccacagtgttggccgatctctgcactgtagccacacccgctgacgagttgcgcggattagatccctggcgggccgctacgttacgttccaggcacttaccgcagggagccccctcatcacccgccttagtgaatctggccctccaccgcctggatgcgagactgacaggccttgcgcacgcacagggggctaggtataccagatacggtgacgaccttgcctttagcggcgcacgagatcctgcactgatcgcgggcgtagcgccgaaaatagtcgctgccgaaggactgagcgtgaacccccggaaaacacgcattatgcgtgctggtgcacgacaggaactggccggtgtggtcgtcaatgcacgggctcaagtcccacgggcagaatacgacgatctcagagccctgctgcacaatgcggcaaggagtgggggggagagtcagaaccgagatgggcaccccgactttagggccttcgtttacgggaggatcgcctgggtggcccagggaaacgagcaaagaagactccgattgctggcgatggccgctcgtgtccgttggtga

SEQ ID NO: 12813 - RNA, 1278 nt, unidentified
  source 1..1278: mol_type = other RNA; note = synthetic construct
atgactgccgttgagatcgtgaggggcctgccaagagcacagcgctatgccgtggctggtcgcgtggtgtccctaacagaagatctgtgggccgccgatgtgattgcccccctgattagaggcgccgtgccagatgagttggttgatgccgctgtgcaggccctgttagctggccatcccgagcctccggtgcgttttgtggacggcgatgtcctgcagtcaggacctggaccactggttgcggccctcgacggtgttagaatagtagttgccttagagcccgctggtcctggcgacgtaccaggactcgccctgcctgatgtggctgcggtgacgagacttctggacctcaccgtgcctgagctcgaatggttcgcagatcacggaatgtggcttcggcatgcccgaccccccttaaggcactatcgggtgtctcgaatggacaaaccggccggaggcattcgtatgatcgaggctccaaagcccaggttggccgaagcacagcgacggatcttgcggcgcgtcttagaccccgctggagctcatcctgctgctagggggttcagaccggggggatcggtacttgcctacgctgccccccacgtcggagctagaagtgtcgtcaggctggacctgcgcgattgcttctccaccgtgacagtcccacgggtacgcaatgtgttcagacgacttgggtattccgcacctgtggcaggcgtcctagcagacctgtgtactgtgtctacaccagccgatgaactgcacgggctagacccatggcaagccgcgacaatgaggagccggcatctgccccaaggagcacctacctctcccgccctggtaaaccttgctctccaccggcttgatgcccgtctcaccggcttggcacgcgcacaaggggctagatacactcggtacggggatgacctggccttttcaggcgccctggaccctgctctcattgcagccgtggtgccgaaaatcgttgcagctgagggcctcagtgttaaccctagaaagacccgaatcatgcgagctggtgccaggcaggaattggcgggtttggttgtcaacgcccgggcccagatcccaaggagcgagtacgacgcgctgagggcactgctccataatgcagcgcgcagcgggggggaaattcagaatcgcgacgggcacgacgactttcgcgcacacgtctatggcagaatagcatgggtggcccagggcaacgatgctagacgtgagcggctgctcgctatggcggcaagggtcaggtggtga

SEQ ID NO: 12814 - RNA, 1278 nt, unidentified
  source 1..1278: mol_type = other RNA; note = synthetic construct
atgtcggccgtcgagattagccgcaggttaccccgggcatggcgctatgcaatcgccgaccgtgtagaaatgttcactgaggagatgtggaccgcagatagagtggctgtagcaattagaggcatcgttcctggcgaactggtgcccacagtggcgagagaactattggctgcccatcccgcaccccctcttgctattatagatggaacacctgttgcgccagacagggacgcaattgtagtggccctcgatacagtgagaaccgtcgagcgcttgggggctagagcacctctcgaagtacccggagtcgctctcccggatgttgccgctgtcgcaaggatgctggacgtcaccgcgcctgagttggagtggttcgtggatcacgggcagtggctgaggcacgctactggaccactaaggcattatcgggtgcgacggatggctaagccatctgggggcgtccgtgtgatcgaggccccaaaaccaagacttgccgaagcccagcggcggatccttcaccgagtgcttgatcctgccggagcccatccagccgcatgtggatttagacccggtggttccgtccttgcctatgccgccccacatgttggggccagatccgttgtgcggctggacctgcgcgattgcttctcaacggtgaccgtggatcgcgtgcggggagcttttcgtcgtctcggttaccccgtcccagtcgctgggctcttagccgacttgtgcaccacctctactgcggtagacgaactgcgcggcttggacccttggcaggctgcagtcctgcggtcaaggcatttaccgcagggcgcccccacgtctcctgctttagtgaacctggtgctgaggggactagacgctcggctgactggcctcgctagagctcaaggcgcgaggtactcccgatacggcgatgacctggcctttagtaatgcccgcgatgcagccctcatcgcgggtgttgtgccgaagatcgttgccgccgagaagctgagtgtaaacccccgcaaaacacgaattatgcgaagcggtgatcggcaggaactcgcaggggtggtggtcaatgctcgtgcgcaggttcctcgagcagagtacgacgcactgagggccctgctgcacaatgctgcacggtttggacccgagagccagaacagagacggccacgaagatttcagggcccacgtgtatggcaggatagcctgggtggcccaagggaacgacgcaagacgggagcgcctgagagctatggccgagagggtgcgctggtga

SEQ ID NO: 12815 - RNA, 1278 nt, unidentified
  source 1..1278: mol_type = other RNA; note = synthetic construct
atgactggcgtcgaattgagccgtagactgcctagggcctggcgatacgccatcgcggatagagtggagttcttcaccgctgcccagtggactgaggaatttgtcgctgcggctgtggccgacctagtgccagtggaccacgccgttcctgttgcgcgcacgttattggccgaacatcccgccccccccctctctattgtcgacgacctgcctgtcgctgctgaccgcaatgccttattgtctgcattggaggctcaccggactgtgcagctgctggaatccaaggggtccggcacacctcctggcatagccctaccggatgtgggatcgatcgctcgcatgctcgatctgaccatcccagagctggaatggttcgccgatcacggacagtggctcaggcatgctgggaggcccttgaggcattaccgggtccggaggattgcaaaaccagccggcggagttcgggtcatcgaggctccaaagcccagacttgccgaagcacagaggcgtatcctgaggagagtgcttgacgatgccggtgcacaccctgctgctaggggctttcggccaggaggcagtgtcctcgcctatgcggcccctcatgtgggtacgcgttccgttgtgagacttgatctgcgcgattgttttcccaccgtcacagctccgagagtacgcgccgcctttcggaggctagggcatcctgcaccagtggccgctgtgctggcagacctgtgcaccgtagctacacccggtgacgagcttagagggctggatccctggcaggctgcagccttacgcggtcgacatcttccacagggagctcccactagccctgcactggtgaacctggtactgcggcgccttgacgcccgattaaccggactcgcgcggtcacaaggcgccagatacacacggtacggcgatgacctggcctttagtggagccctggactccagtctcattgcgggggtggttccaaagatcgtggctagcgaggggttgtctgttaaccccaggaaaacccggataatgcgtgcaggcgctcgacaagagctggcaggcgtcgtggtgaatgcaagagcacagacaccgaggggggagtatgacgatctcagagccctgctccacaacgcagcccgattcggagccgcaagccaaaaccgcgacggccacccagatttccgggctcacgtatatggtagaattgcatgggttgcccaggggaatgagcaccgcagggaacgcctcctgtcaatggcggcacgagtgcactggtga

SEQ ID NO: 12816 - RNA, 1281 nt, unidentified
  source 1..1281: mol_type = other RNA; note = synthetic construct
atgacaagcgtggaggtcactcggagactccagagagcccaacgctacacaatcgccgcacgggtggaatggtttactcctactcagtggaccgtggatcgagtcgcaggggccatctcaggagtagtccccgcagatgaagccagtgcggttgcagctgccctcatcgccgcacatccaagagccccactggacccacaggatgacggaccaccagtcctagccaaccccgctgccctggttgcagcattggacgggtataggacggtggagctgctcgaacctgacggccctctcgacgtaccagggcttgccctacccgatctgagcgctgtggcacgcatgctagatctgaccgctcccgagttggagtggtgcgctgacccaggcggatggctgagacactcatcgaaacccttgcgccactatcgcgtgaggcgtattcctaaacctgcgggcggcgtgagggttattgaggcaccaaagccccggttagcagaggcccagcaccgtgtgctgagaagggttctggacccagccggtgctcatcctgctgccagaggattcagacccggcgggagcgtgctggcatatgctagcccccatgtgggggccagtagcgtcgtgaggctggatctgcgcgactgcttttccaccgttaccgtctcccgggtacgggacgtgttccggaggatgggttaccctgcccctgtcgcaagagtgctcgctgatctttgtacagtcgccacgcctggtgacgaactgagggggcttgatccgtggcaagcggcggtgttacgatctaggcatcttcctcagggagcccccagctccccagcacttgttaacctggtcctgcggaggcttgattccaggctcactggcctggctcaatctcagggtgcccggtacacacgatacggcgacgacttagccttctctaaaccgagagatccctccctcattgccggagtggtgccgaagatcgtggctgccgagggtttcagtgtgaactctacaaagaccagagtaatgcgcgccggaagtcggcaagaattggcgggcgtcgttgtaaacgctcgcgcacaggtgccccgtgccgaatatgatgctctccgagcgctgctccacaatgccgctcgatttggagctgagtcacagaatcgggacggccactctgattttagggctcacgtgtacgggcgtatagcttgggtcgggcagggcaatgaatcacggagagagcgcttgctgaccatggccgctcgcgttcgatggtga

SEQ ID NO: 12817 - RNA, 1278 nt, unidentified
  source 1..1278: mol_type = other RNA; note = synthetic construct
atgaccgcggtggaagtaagccgcagattaccccgcggtacgctgtatgcgatcgccgctcggctcgagtggttcaccgctagccagtggactggagagtttgtcgctgccgctatcggcgatctggtatccactgatctggcgggacctgtcgctcgcttcctcatcgccgcacatcccgacgcaccgttacggattgtggacgaccgccctgtacgggcagatttgggcgctctgagagccgctctggatggcttccgcactgttgacctgctggacgcacccggcgtgttagatgtcccaggcagggcacttcccgatagtgccgcggttgcccgtatgcttgacctgacagcgccggagttggagtggtttgccgaccatggccagtggctgcggcattctgcagctccactgaggcactacagggtgaggcgaatggataaaccagccgggggcgtccgagttatagaagcccccaaaccacgtcttgccgaggcccaacggaggatcctgcgtcacgtgctcgaccctgctggtgctcaccctgctgccagagggttcagaccaggagggtctgtactagcttatgcaacccctcatgttggggcccgctcagtcgtccggttggatctcagggattgtttttccaccgtgacagcccctagagtgcgggcagttttcagaaggctagggtacccagcaccggtcgccagagtgcttgccgacgtgtgcacaacggccacaccaggtgacgaactccgggatctcgatccttggcaggcagcagtgctgcgcgctaggcacttgcctcaaggagcccccacctcacccgcactcatgaacctggtgctgcatcgcctagacgcccggttgacaggactggctagggcgcacggtgccatgtacactcggtatggcgacgatttggcctttagcggggctcctgaccccatgctcattgcaggcatagtgcccaagatcgtggtggctgaggggttttccgtgaacccagcaaagaccagagtgatgcgcgccggcactcgtcaagaacttgccggcgttgtggtgaataccagggcccaggtcagtagggacgagtatgatgacctccgagctcttctgcacaatgcggcgcgattcggtgccgagtcgcagaaccgggaaggaagagcagactttagagcatacgtatacgggagaattgcttgggtcggacagggatctgagcgacgcagagaaaggctgctggccatggccgccgctgttcgatggtga

SEQ ID NO: 12818 - RNA, 1248 nt, unidentified
  source 1..1248: mol_type = other RNA; note = synthetic construct
atgcctgcggtggaaattgcgcgcgcattggccagagcccaactgaggcaggcaatccgcatagctgtgcagttgcatcccgaagagtggaatcgggtcgagctagctgctgacctgggcgctgtgttacccgccgagctagccgaagaggttgctcgcttcgtcatagcgtcggcacctaccaaacctcgaggtgccatcctggccaatctgctgcaagacttcagggtcgaaagtttgctggagccggaaccagcacgggagacacctgaccggccacttgtcgatctcgccgctgtcgcagcaatgctcgacgtaactgtcccagagctggagtggttcgctgacacaggctcttggctgaggcactctagtcgtccactcagacactatcgggtgcgaagaatgtctaagcctgctgggggcgtaagggtaatcgaggcaccaaaaccgcgactgtgcgaggcccagcgcagaattttgagacacgtactggacgctgcagctcctcatccagccgctaggggctttctccccggtggtagcgttctgcggtatgccgaaccccatgttggagcggggagcgtgattcggctggacctcaaagactgttttaccaccgttggcgcatcacgggtcagggcagtgttccacagattagggtatcccaacgctgtggcgcgagtcctcgcagcactctgcaccactgaaacgcccgccgatgaacttcacggcctggatgcctggcaggccgctacactcaggtttcgccacctgcctcagggagctcctacgtccccgacattgatgaacctctcactgaggcagctggattcccggcttaccggacttgcccgcgctcaaggagcaaggtacactcggtacggggacgatctggcatttagcggcgccccagatgcttcccttattgccggcgtggttcccaagatcgtggcggcagaaggcttcgccgtgaacccacgcaagactcggatcatgcgtcgcgggtcccgacaagagttagctggattagtggtgaacgacagagcccaggtgcctcggcacgagtacgatgccctaagggcgctgctgcataacgccgccagatttgggcccgccagccagaatcgtgatggacatgacgatttcagagggcacgtgtacggcaggatcgcctgggtgggacagggtaatagagaacgtagagagcgccttctcgccttggccgaacgagttccctgggagtga

SEQ ID NO: 12819 - RNA, 1245 nt, unidentified
  source 1..1245: mol_type = other RNA; note = synthetic construct
atgccttcggtggacctgtcccgcccactgacaagggcgcagcaagctcagtctgccctgctggtaggacggattgacccggccgagtggaatcgcattgagctggccgctgaccttggcgctgcactacctgctgagttggcggaggaggtggccctatttgttacggaagccgcacctaccaaacctcacccggctgtcatcaggcgattactgcagacttatcgggtcgattcagcccttgaacctgaagcagggggcgctgtgcccggaagagtactggctgatctcgatgggctcgcagcaatgctcgacctcacagttccggagctcgattggtttgccgacacgggccgctggcttagacattctgccgccccactgaggcactaccgcgtcagaagaatgcctaagaccgctggcggggtgagagttatcgaagccccaaaaccaagattgagggaggctcagcgccggatactgcgacatgtgctggaccccgcagcaccacatcctgcagctcgaggtttcgtgcggggagggagcgtgctacactacgccgaagcccatgtcggcagtgcggctgttgtacgtctggatctgaaggattgcttcacaaccgtgggagagaatagggttagggccgtcttccgccaactgggataccccgcgccagtagcccggattttggcagccctctgtactaccgctactgccggtgacgagttgaggggattgggggcctggcaagctgccacactgagagcccgtcacctgcctcaaggtgcacccaccagcccagcgctgatgaacttagcgttgcgacgtcttgattccagggttgccgggttagctcgggcacagggtgctcactatacccgctacggcgacgacctcgcactgtctggagccagggacccctccgtcatagcagccgtggtccccaaaatcgtgagaagcgaggggttttcagtgaaccctaggaagactcgtatcatgcggagcggcacaagacaggaactcgctggggtcgtggtgaacgccagagctcagccacccagacgcgcatatgatgatctccgcgcgcttcttcacaatgcagcacgatttggccccgatagtcagaaccatgatggccacgacgacttccgggcccacgtgtatggtcggattgcctgggtggctcagggcaatcccactaggcgggaacggttactggccatggccgctcgagtgccctggtga

SEQ ID NO: 12820 - RNA, 1245 nt, unidentified
  source 1..1245: mol_type = other RNA; note = synthetic construct
atgaccgaacgcccagcgcttccccccgagtttgctcgaagactggccgcagctgccattgacggcacttggacacgggccggcctagtgcttcgctttgaggagtcaggggttccagacgctgctaggatcgccgcgcgtctgcatgatctgatgcccacacctcctatcgatggcatcgattctgtcttccgtctcctctcggacttaccactgatagagcgcgccgaacccatagtggacgaggtttctggaaacgattggcgcttcgacgtgccacagtggtctagaacagcagcagtggccgaagccgtagggctgaccagcgctgaactagactggttcgcagacccgggtggttggctgagaacaaaggcgcctccactccagcactatcgctacagaattaggcccgataatcgcctgttggaggcccccaaagagcgtctcagggaggtgcagcggaggatcctgaggactgtgctggatagggtccctccacacgctgcagcgcacggattcgtgcggggaagaagcgtgcacaccttcgctggtccccatgccggccatgaagttgtcctccgaattgacttgagagcgttctttcctagtgtgtctaggacgagagtccgggcagtttttgacgcgcttggctatcctacccgagtgagtcgggtgctggccggtttgtgtaccacttccacacccccgggagtcctggcagagcttccttttgatgcagcctcccggctgagaggggctcatcttccgcaaggagccccaactagccctgccttagccaatctcgtggcacacagactcgatcgccgactagccggactggctagagctcaccgggtagcttatacaaggtacgctgacgacctggctttctcaggctcagatctggccgtggataggttaattcatgcagtcggcaggatcgtgactgacgaagggttcgccgtccatcccgggaagaccagagtgatgcgagcacatcgctgccagcacttggccggcctggtagtgaatacgcgcccacaggcttcccgggctgagtatgacgatgtcaaggccttgctctttaactgcgtacggcacgggcccgacagtcaaaaccgggatgggcgacctcactttagggaatacgtctacggccgcatcgcctgggttggagaaagcaacgagtccaggaaacggagcctgcacgcccttgccgcacgtgttgactggaccggctga

SEQ ID NO: 12821 - RNA, 1218 nt, unidentified
  source 1..1218: mol_type = other RNA; note = synthetic construct
atggcaagcacgaacgctacacaagcccgagattccggtgagactcctgccagggccgggttaattttaagatttgaagagactggtgcgcccgatgctggaaggttggccactcggctgtatgatttgatgcctacccccccaatcgacggcgtggactctgtgtaccggttgctgagcgagctgccacaaatcgagcagcccgaacctgtagtcgaagtgtccggcaatggttggaagtttgatgtgccccggtggagtcgcacatcatctgttgcggaagctgtgggcctcactcctgccgagctggactggtttgcagatcccggaggatggctgaggatgaaagcgccacccctccagcactaccgctatagaatacgatcagacaatcgcctgctcgaggccccaaaggagaggctcagggaagtgcagcggaggattctcagatccgtcctggatggagtacctccgcatgcggccgcacatggattcgttcgcggacgcagcgtccatacattcgccgcgcctcatgcagggcacgactgtgtgctgcggatcgacctgcgggcattcttcccgtctatttcccagacccgtgtgcgtgcaatcttcgatgcccttggctaccctgcccccgttgctcgagttttggccgggctttgcaccacctccacaccacccggtgtactggctcagataccttttgacgcagccagtagacttcgaggtgcccatctaccccagggggctccaacctcacctgctctggctaatctagttgcccaccgccttgataggcggctgacaggccttgcaagggctcaccactctgggtatacgcgttacgctgacgacctggcattcagcggcagcgatctggctgtggaccgtctcattcaagccgtcggaaggatcgtggcagacgaggggttcagcgtgcacccaggaaagaccagagtcatgcgcgagcatagaagacagcacctggccggcctagtcgtgaacactagaccacagaccgcccgggccgattttgatgacttgaaagctctcctgtttaactgcgtcagatatgggccggagtcacagaaccgcgatggccgaccccacttccgggaatacgtgtacggcagaatcgcctgggtagccgaaagtaacgaaagtcgcaaacggtcgttacacgcactcgcagacagggtgaattgggctggctga

SEQ ID NO: 12822 - RNA, 1251 nt, unidentified
  source 1..1251: mol_type = other RNA; note = synthetic construct
atgaccgccggaagagcactgcagcctgagattgcacgcaggctggctgttgaagccactgtcggcgcatggactcgtgccggtctgatcctcagattcgaagaagccggcgagcctgatgccggaaggatagccacccggttgtatgatctcatgccaacaccccctattgatggcgtagatggtgtgtatcggctgctttctgagttaccccagatagagcagccagagacggtggtggaaagcagtgggtcagactggaagtttgacgtcccccggtggagtcatactgccgctgtcgcggaagcagtgggtctgacacctgccgagttggactggttcgccgatccgggaggctggcttcgcaccaaagccactcccctccagcactacaggtacaggatcagaagcgataatcggctgttggaagcccctaaggagcggctccgcgaggtacaacgccgcatcctgcgctctgtgcttgatagggtaccccctcatgctgccgctcatggtttcgtgagaggtcgtagcgtgcatacctttgcggctccccataccgggcacgatgtcgttctccgaattgatctgagagccttctttccatcagtgagccagacccgcgtgagggccgtttttgacgccctggggtacccaacaagagtgtcccgagtactggccggcctttgtaccacatccagcccatccggcgtgttggcacaactgcccttcgacgctgcctcccgactaaggggcgcacacttaccacaaggggctcccacatctccggcccttgcgaatctggttgcgtatcgactcgacagaaggctaactggactggcccggacccacagagctggctacacacggtatgcagacgacctggctttcagtggaacggaacttgctgtggatcggctcattcacgctgtgggcagaatcgtcgcacatgagggcttttcagttcacacagggaaaactcgtatcatgagggcacacagacgacagcatttagcagggctggtcgtgaacacgaggccacaagcggcccgtaccgaatacgatgacctgagggctttgctctttaactgcgcacgctacggacctgactctcagaatcgggacgggcggccgcacttcagagagtatgtctacggacgcatcgcttgggtgggagagtgcaacgcctcccggaagcaatcgctgcacgccctagcggcaagggttgactgggctgaccagcgacgctga

SEQ ID NO: 12823 - RNA, 1242 nt, unidentified
  source 1..1242: mol_type = other RNA; note = synthetic construct
atgactggcagaagagccctgtcctcggctgtagctcgccgtttagccgccgtggccacttctgggagttggacgagggcggccattgcacagaggtttgaggagattggcaccccagacgccgatcgaatcgctacaaggctgtttgatctgctacccacccccccagtcgaaggtgtggatagtgtgtaccgcttgctgtccgagctccctcacattgatgaaccggcccccgtggttgagcaaccagaccacgagtggagattcgacgttcctaagtggacgcataccgtcgctgtcgcacaagcggtggggctcacacctgccgagcttgactggttcgccgacccaggcgagtggctacggaataaggccccgaccctgcagcactaccgttataggatccgaagcgatcaccgcctcttggaggctcccaaggagcgtctgcgcgaagttcagcgcagaatcctccggggattgttagatcgggtgccacctcacgctgctgcccatggattcgtgcgcggacggagcgtccacactttcgcagcccctcatgctggtagggacgtggtcgtcaggattgacctgcgggccttctttcccagtatatcccaggccagagtaagagcggtgtttgactcactggggtaccctccacgggttagcagggtgatgacgggactgtgcacaacttccactccccctgacgtactggcaaggcttcccttcgacaccgcatcacggcttagaggcagccatctgcctcaaggcgccccaacctctccagccctggctaatttggttgcataccgattagaccggagactgacaggattggctaggagctctcgggctgaatacacacgctatgcagatgatctggcattctctggcgtggatcttgctgcagaccgcctcataagtgctgtggggcgcatcgccgcagacgaaggattttcagtacacccccgtaaaaccaggataatgagagcccataggcgtcagcatctggcggggcttgtgatcaactcccacgcgcaggctgcccgaaccgaatatgaccagctccgagcactcctatttaatagcctccgcactggcccggatctgcagaacagggatggtagaccctacttccgagaacacgtctatggtagaatcgcctggattggggagtcaaaccctaaccggaaaagagcactgcttgccctcgcggatcggatcgaatggacaggctga

SEQ ID NO: 12824 - RNA, 1230 nt, unidentified
  source 1..1230: mol_type = other RNA; note = synthetic construct
atgacagaccaacgagcactcccgcccgttatggcccgtcacttagctgaggttgcagacgccgggccctggactaaatacgccctgacgcagcgattcgaggaagctggggccagggatgctgtgtccattgcccatagattgttcgacctcatgccgtctccgcccatagagggggcggaatcagtctatcggctcctggtagagctccctcgtatagaccgccccgcaccaattgcccctagggtgctgtggaagttcggcgtgcctcaatggagtcagaccgctgctgtagccgaagcagtgggactgacacccacggagctggactggttcgccgaccgtggaggctggctacgcactaaggccccaccactccagcactatcggtatagaacccggggggatcgactgctggaagcaccaaaggagcggttaagagaagtgcagcggaagatcctgagagccgtcctggattccgtgcccactcatccagctgcgcacggattcgtggtgggtagaagcgtgcacacttttgctgccccacacgcgggacgagaagctgtggtgaggattgatctgcgcgcttttttttcaaccatcacacaggctcgcgttcgcgccgtttttggcgctttgggttatcctgaccatgtcgctcgcgtcttggcaggcctgtgtacaacagctacccctgccaaagtgctggcgcctcttcccttcgaatctgccacacgattacgtaccccacacttgccccagggtgcacccactagccctgcattggccaacctcgtttgccataggctggatagaaggcttaccggattggccaggagtcatagagccgcctacagcagatacgcagatgaccttgctttcagtggctctgagctggccgtagaccggcttgtccacgctgttggcctgatcgtcgcagacgagggcttcactgtgcatcctcggaaaaccagaattatgagggcccaccggcagcaacaccttgcaggactcgtagtcaatgaccggcctcaggccgcacggtccgattacgatgatctacgagccctgctatttaactgcgtgagatacggtagccattcgcagaatcgcgacgatcttccacattttagggaacacgtctacggcaggatcgggtggatcggggagtccaacgagacgaggaagcgcaccctcctctcactggcggatcgcgtggactgggcgtga

SEQ ID NO: 12825 - RNA, 1239 nt, unidentified
  source 1..1239: mol_type = other RNA; note = synthetic construct
atgccgtctagaccccccagggcctttacccgattggaggccgatttattagccgccgcagctgttgctggaccgtggacaaggagcggactcgaagagaggctcggtgaagctggtgctgccgaccctgtgctgctagccaggcgagtcttggaccttatgcccggggagcctatcgaaggcgagtcaactgtgcggaacgtgctcgctgagctccctgagctgccagcaagacccgtcgaggtgacagtcgaaagctctctgtggaagtttgatgtaccacggtggcagacaccccacgcactttgccaggcgtttgacctgaccatgcctgagctggaatggtttgccgatgttcagggcagactgagaggtaagccggggcggctccaccactataggtaccacaacggggctcgcttgattgaggcacctaaggtgcgccttagagaggtgcagcgcaggatccttaggaaagttctggatcggctgcctgtacacgcagccgctcatggattccgacgcggtcgtagcgtacatactttcggctcaggccacgccggcgcagatttagtggtccggattgatctgcgctggtttttctctaccattacagcagccagggtaagagccgtgttcctcgctgtcggctatcctccatccgtggccagcttgctggctggactgtgcaccactgcaacccccgtccccatcctacgcggtatgccattcgagcaggccactctgttgcggaccagacatcttccccaaggggctcctacgtctccagccctcgccaatatggtggcgcggaatcttgacagacgactcgctgggctggcgcagagtcaaggcctctattatacacggtacgcggacgacttggcattctccggagatgtggtgaatgtggaacagctactgtggactgtcggagccatagtcagagatgagggctttttcgtgcatccatccaaaaccaaggttatgagagcccatcatcgccagcggctggctggactggttgtgaacgcccacccacaggcatcccgtgacgactacgaagctctgaaagcgctgctgtacaattgtgtcaggtacgggcccgcatcacaaaaccgggacgggaggacgcacttccgagaacatgtgtcgggccacatcgcctgggtgggcgaaagtaacagccgccgacgtgaaaagttacgtaggctcgagcaacgcatagtttggagttga

SEQ ID NO: 12826 - RNA, 954 nt, unidentified
  source 1..954: mol_type = other RNA; note = synthetic construct
atgagcagagcactggacgcaggctgggctgctcgtcttgcagctgctgccatgtccgggccatggacaaagaatgccctggcccagcgttttagcgagattggctttgaccgggccgaggaaatcgccaggcggctacacgatttagcgcccactccgccggtagacggggttgatgccgtggatcgcttattggcggagctgcctcgcctagagggccctataccagtgcgcgcgcaacgacctcaatggcttttcggagtgccccggtggaacacgttacctgccttggcctcaagtctgaatctgacaccaggtgaactcgattggttcgccgacccacgcggatggcttcggacaaagcctgacaggctccagcactatcgggtcaaaaccctccccagcgggagggtcgttgagatccctaaggaacggctgagggaagtgcagagaaaagttagggtgagcgtgctggatgccgttcctccccatcctgctgcccacggatttagagccggacgtggcgtcgtcggatttgccgcagcacattctaattcggaggtggtgattcgcgtggacctgcgcgccttcttcactacaattaccgccaccagggtgagagccgttttcgcagctcttgggtacccaccctgggtcgcgggtagattggcaggcctgtgcactaccagtaccccaccagcagctctggctggtgtaccctttgaaatcgccagtctgatgagagctccccacttgccgcagggtgcaccaacatctcctgctctctccaacctcgttgccggcaacctcgatcgaaggctatccggcgtggctcggcgacatgctctgacttataccagatacgcagacgatctcgcgttctctgggtcagacgtagacgtgtcaagactgctggccatggtgcccccctgtgtccgaacgagggcatcctga

SEQ ID NO: 12827 - RNA, 1308 nt, unidentified
  source 1..1308: mol_type = other RNA; note = synthetic construct
atgcagcggtctaccgtggacgagggcttttggagcctgcatcataggagaatttttatgagccggatgatctccgtggaattggcagcagaacttgcaagagcgttcgagttactggatgatgagtgggcccaagctcgcctagctgaggcgttcggcgcagtcatcgaacccggattagcggaggagatagcccgtcgggtcgtggacctgatgccagtagtgccagtggaccccgtggccaccttatgccgactgctggccgagctgccaaaacttccaacaattgtggttcccttggacccaccagaggttcggatgagatttggggcggtcgagattcctgacctggcaacgctcgcaatgctacttaatgttactccttctgaattggagtggttcgcggaccggggaggatggctaaggcgatcaacacagcccctctctcactaccgatataggcgcctccctaaggcgaacgggactagattggtcgaggcccccaaggtccgattgagagaaatccagagacgcatcctgcacaaggtccttacagggatccctgctgacccggcttgccatggctttgaaaagggaagatccgccgccacatttggcgcaccgcatgctggcgcacctgtggttgttaggatggatctcagggacttcttccctactatcggtctggcacgggtgcgcaccgtattcaccgcctgcggttacagtccagctgtcgcccgagtgctggctgaactctgtaccaccgccagtcctgtcgccgaactgagagggcttgatcacgcccagaggactctgctcgctgtaccccatcttcctcaaggtgcccccacctcacccagacttgctaatttggtggccagggggctggatcgtaggctgactggttacgcaaaccggcatggcctcacctatacacgctacgccgacgatctcgctctctcgggaaacgccaatacagctcacctggtgtggacagtgacgcgaatagccgaagatgagggctttactgtgcacccggccaaaacacgcatccggagggctcatcagagacagattttagccggactggtagtgaatgctcatcccactgctccaagggatcggtatgatgccgttcgggccctgctgcacaactgtctccgcactggagctaccgcccagaacctgcacggccacaatgacttccgtgcacacgtctatgggttgattagctggataggcgagacgtcccctcaccgtcgcgacaaactgctgaccatggcagatcgcgtggactggaccaggtga

SEQ ID NO: 12828 - RNA, 1257 nt, unidentified
  source 1..1257: mol_type = other RNA; note = synthetic construct
atgtcccgggccattggcctggagttggcggtgagactcgctcggtcattcgaacttctcgacgacgactggggcctgtcaccactggctgaagccttcgcggaggtaatagaaccgggaagcgctcaggagatagcaggtcgggtcatcgatttgattcccatcgagcccgtggatccggtgaacacactgaggagggtgctggttgacctccccaagctgcccacaactgtggttgcgctcgatcctgtggtcgtaccaatgcggttcggtgctgtggagatacctgacctcgccgctctcgcgttgctgctcaatgtcactcccgctgaactggactggttcgccgatagaggagggtggctacggagagcctctcagcccctctcccattatagataccgaaggctgccaaaggcgaccggagtgcgtctggttgaagcaccaaaagtccggctacgtgagattcagaggagaatcctccaccgtgtgctggcaggaattccagccgaccccgcttgccatggctttgagaaagggtgcaacgctgctacattcgcaacccctcacgcaggagctgcagtcgtgatccggcaggatctgagggacttttttccaacagtcgcagttgcccgagtacgagccgtgtttgccgcatgtggctacagcactgtagtcgccagagtattggcagagttgtgcaccaccacgagccccgtcgcggaattacggggactggactactctcagcgcacattactcggtgcaagacatcttccgcagggcgccccaacttcgcctagactagccaatctggtggctcgcggcttggatagacgactgaccggatatgccaatcgacacgggcttacttatactcgctatgccgacgatctggccctgagtggggacgcagatcttgacaccgcccgcctgatttggaccgtgaccaggatcgctagggatgaaggcttcaccgtgcatactgggaaaacactgatccgccgcgcccaccaaaggcaggttcttgctgggttagtggttaacgatcgccctgccgcccctagggacaggtacgatgcagtgcgtgctctgcttcataactgtcttagaacaggcgttagtgcccaaaatcgcgacgagcacaacgattttcgggcccacgtgtacggcttaatctcctggattggggagacgtctcctcaccgccgagacaagttgctggccatggctgaacgggtcgattggacgggttga

SEQ ID NO: 12829 - RNA, 1293 nt, unidentified
  source 1..1293: mol_type = other RNA; note = synthetic construct
atgtcaggggcagtgcctcccgatctagccagggaactggcttactcctttgagttcttgggtgcggaatggtcccgaagcaatttagccgaggcatttgctgaaatagtagaacctggcagagcggaagagttagctcgtcgggtgaccgatttgatgccctcggagccactggacccagtgggaaccctccagcggttgctcgccgaacttcctaagcttgctactattgttgtgagccttccaccagccgccgacgaactggctgacgagttacctcgcactcaacctgcgcggacaagattcggagctgtcgacatcccggatttggccgccctttgtgcgctgctgaacgttacaccggcagagctggagtggttcgctgaccacggaaactggctacgccgagccgcacagcctctctctcactatcgatacaggcagctgcccaagacatctggggtacgcctcgtggaggcaccaaaagtccgcctgcgtgagattcagcggagaatcctgcatcgtgttctgagcgagatcccagcccatccagcctgccacgggttcgagaaaggccgctctgcaacgacctttgctgccccccatgccggtgctgaagtggtggtcagagtggacctgagggattttttcacgagcatcggtgtggcccgggtaagagccgtcttcgccgcttgcggatacagtcccacggtggcacaagtcctggcagatctgtgcaccactgccaccccggtcgcagaactacgcacccttgattttaatcagagaaatctcctcagggcgagacacctgccccaaggagctccaacatcccctaggttagccaatctgatcgctcatgggcttgaccgacgactggccggatacgccacccagcacggtttggtgtacaccaggtatgcagacgacctcgcaatttccggcaagtcagacctggatcccggccgcacaatttggctcgcaactaaaattgcgaaatcagaggggttcagcatcagacctggcaagactcgtatcaggcgcccccatcagaggcaaatactggcaggcctggtgattaatacacacccagccgtgccccgggacagatatgacgccctgagagctctcctgcataactgtctccggacaggccctgctacccagaaccgggatggccacaacgattttcgcgcccacgtctatggcttgatatcttgggttggggagactagtcccgctaggcgggataggcttttggccatggctgatcaggttgactggagtaagtga

SEQ ID NO: 12830 - RNA, 1257 nt, unidentified
  source 1..1257: mol_type = other RNA; note = synthetic construct
atgaccggagcagtgccagctgagcttgctcgcgagttggcatacgcttttgagttcctcgacgcagagtggacacggtccaacctggccgaagcctttgcagaaatcgtggaaccggagagggccgaggatcttgccagacgagtgactgatctgatgcccagtgagccccttgacccagtcgggacattgtgcaggctgctggcggagcttcctaagatggccaccgtcgtagtccccctggaacctttatctgcccctgttctgttcggcgcagctgagctccctgatagagcaggactttgcgccctcctgaatgtgactccagatgaactggattggtttgccgaccatggcggttggttaaggcgcgcaagcaagcccctcacccactaccgctacaggcggctgagaaaaagcgacggcgtccgactggttgaagcccccaaggtaagattacgcgaaatacagcgacggatcctgagacacgttttgtccggcatcccggctcaccctgcttgccatggcttcgagaaagggcggtcggcctctacatttgcggagccacacgcgggtgccgaagttgtggtgcatctcgacctgcgcgactttttcaccagcatcacagtggcccgtgtacgcgcaattttcgccgcgtgtgggtatgccccagctatcgcccagattcttgccgatctgtgtaccaccgcaactcccgtggctgaattgcggggcctggactatgatcaacggaacttgctgagagctaggcacctgccccagggtgctccaacatccccacggctggctaacttaatagctcatggcttggacagaagactcactgggtacgcgatccggaggggcctggagtatacccgttacgcggatgatctagccatatcagggaaatctgatctcgacgcagccgagattctgtggctggtgacgaagattgcaaagtcagagggatttgccattcatccgggtaaaacgcgcattcgcaggccccatcagcggcaaatcctcgctggcctcgttgtgaactcccaccccgcagtccctagagacaggtacgatgccctgcgtgccctattgcacaattgtcttaggacaggacctaccgcccagaatcgtgatgggcaccatgacttcagagctcacgtgtatggactcattgcatggatcggagaaactagccctagtcgacgggaccgcctaagggccatggctgaccgagtcgactggagtaagtga

SEQ ID NO: 12831 - RNA, 1251 nt, unidentified
  source 1..1251: mol_type = other RNA; note = synthetic construct
atgtcccacgccgtctcgggtggattagccgcagaattggccgcccactacgccgacgccgaaataggctgggagagggccgcgttggcagaagtcttcgcagaagtgattgagcccggcagagccgaggagttagcgggaagggtggtaggcctgatgcccagcgagccactagatggcgccgcaacattacgccggttgctggccgaactgcccgtgcttaccgtttctaccgttgccctggagcctgctcggcgacgaatgcgatttggagccacacctattgatgacctcgccgccctcgccgccctacttaatctgacacagcccgagcttgaatggtttgccgatagagggggctggttgagacgctctgccagacccctgacccactatcggtatcgccgccttccaaagagcaccggcgtgagactggtcgaggcaccaaaagtccgtctccgcgagattcagaggaggatcctgaggcatgctctggcgggtgtgcctgcgcatcctgcttgccatggattcgagaaaggccgaaacactgctacctttggagctcctcacgctggggcggcagtggtagtgcgtatcgacctcagggatttcttctccagtattgaagccgcacgggttagggccgtttttgccgcctgcggttacgctccagcagtggctcgcgtgttgggcgaactgtgtaccacagcagcgcccgttgctgaactgagaggtctggatcacacgcagcggactctgcttggagctcgacaccttccacaaggggcccctacttcaccccggctagccaatctcgtcgcaagagctctggacaggaggcttgatgggtacgcgcgcgctcatggactggcatacactcgctatgccgacgaccttgctttcagtgggccagctgacgcggatgctctcgcttgggccgtgacagcgatcgcacgagacgaggggttcgcagtgcatcccgggaagatcagggtacggagagcccaccagcggcaagtgctggcaggtctggtggtcaacgctggccctgctgtaccgcgggatcggtacgatgccgttcgggcactgctccataactgtctgagaaacggagctgctgcccagaatcgtgacgggaggccggactttcgcgctcacgtctatggcttgatcgcatggataggcgagacgaatccacacagaagagcaaagctcctcgcaatggccgcccgtgtggattgggacgcctga

SEQ ID NO: 12832 - RNA, 1323 nt, unidentified
  source 1..1323: mol_type = other RNA; note = synthetic construct
atgaacaggcccgcgttgccggcactagttgctgccaggctggctgacgagttcggaagatgcgggggccgctggcatagagacgatctggctgaagcctttgccgctgttcttgacagggaaagggctgaagtattcgccgtgagagtaataggcctgatgcccacagagccaatcgactccgtggtcaccttacgggctctgctcaccgaactgcccgcacttccaattgtgatcgcccagctcgaacccgttccggacgagctgcggtttggagcccctgaactccctgacacttctgccgtggcacggatgctgaacttaacgcccgatgagctagattggtttgccgaccacggaggatggttgcggcgtacacgcgagccccttgctcactaccggtatcgccggatccccaaaaaagacggagtcagactggtcgaggctccaaagcctcgactgcgcgagatgcagcgcaccatcgctcgtcgcatactcgctggtattccagcccatcctgcgtgtcacggcttcgaaaagggggcgagtgccgcaacttttgctgcaccgcatgccagagctgccgtggtggtaagactggacctgcggcacttcttccctagcattggtgtggccagagtgcgtggcgtctttagagcctgcgggtacagggagaatgtcgcaaccgtgctggccgacctgtgcactaccgcaaccgcaattagggctttgactggtttagaccacgagcaagctagtctactgcgcacgcctcatttggcccaaggggcaccaacatcacccaggcttgcgaatctgattgccaggaatctcgatcgacgcgtttccggatatgcccggagacacgggcttacctacactagatacgccgatgacctggcactcagcgatcctgccgacaccgatgttgacgctatgatctgggcgctgacacggatcatcgaggatgaggggtttgaagtgcatcgggataagacatcggttcgacgtccccaccagcgccaagtattggccggccttgtggtgaacgatcgacctgcggtcgctagggcccagtatgatgccgtgagggcactcctccacaactgtttacggacgggcgcagccgcccagaatcacaacgctcatccaaatttccgagcccacgtgtatggctccatagcatggattggcgcaacatcaccaacaaggagacagaaattgctcgacatggccaagcgagtggattggactcagagcgacgctgcaggctctggactggcagctgatgcggtcgaggatttccatgaaggtgggggctga

SEQ ID NO: 12833 - RNA, 1260 nt, unidentified
  source 1..1260: mol_type = other RNA; note = synthetic construct
atgactagacgggcagtgcctccccaacttgccgacttgcttgctgacgagttcgacgccgcagatagaacttggcagcgctccgatctggcagaagtttttgggagctttgtaaacgctgtacgggccgaagaactggcccagcgagtcatcgcgctcgtcccaacagagcccgttgaccgccggaattcactgaggtctatcctagctgagctgccggttttgcaacgcgttgtcaatttagtggaacctgcccaacatgaattgcgtttcggtgtgcccgaactcaccgacctccgttctgtagccagcatgctgaacgtgacgcctgcagagttggactggttcgcggatagaggcggctggctccggaactccactgaaccactgacccattacaggtaccttcgccgccccaaagcgagcggagtcaggttaattgaggcccccaagccacggctcagggagatgcagcgaaccatagctagaaaagtgctggccagcgttccagctcaccctgcttgtcacggcttcgagaaagagtgctctgccgcctcatttgctgacccgcacaccggatccgatgtggtggtgcgcgtggatctgaggaattttttcagttctatcggggtcggcagagtgcgcgctgtgtatagagctattggttacgattacgcaatagctaatgtgttagcgcatatctgtactacagcaacagccgtttccgccctgcgcggaattgacaaccagcacgctagcctcctgcgaatgcctcatttggcacagggcgcccctacttccccaagactggcaaatctgattgcccggaatctggaccgtagggtggctggatacgccacaaagcacgacctgacgtatactcggtacgcagatgaccttgccttctcagggcccgctaccaccgatgttgacgcgttgctatgggccgtcagtcacatggtggatgacgaggggtttaccgtcaatcggcggaagacgagtgtgagacggcgacaccagcgacaactcctagccggcctcgtcgtgaactcgcagccacgtgcacccagagaggcctatgatgcacttcgcgctctgctgcataactgcgcgagaacaggggcccatgaacagaacacagacggccacaccgattttagagctcacatctatggtaggattgcatggatcggagagacagatccgcgacggaggcagaggctcctggatatggccgccagggtagactggaacaggtga

SEQ ID NO: 12834 - RNA, 1356 nt, unidentified
  source 1..1356: mol_type = other RNA; note = synthetic construct
atgcgacggatctcatggcagcaacgccctaagcctcttgggacactgcgcgtgcgaccaggagataaggacaagtcacggtctagtgcaactgtggcacggcccctgatgcaggggagattttctctgcctcatgctcaggccattgctcgcgcttttggacggagggagcttagttggaggagagaaaatttggccgaggtattcgctggattcgtggaggccggactggccgaaagccttgctagccaggttattgataatgtgcccctcgaacccattgagccgtatcccacgctggtagcacagcttcggagcctgcgttgggagattgaccttaaccctccactcgcgaaacctctgagatttggcgtgcctgagctcccagatgtgagcgcccttgcccagtttctaaatctcacaccctcggagctggactggttcgctgattgcggaggctggttgcgtacagccagcggacccctgtcccactataggtatcggcagctccccaggaggtccggtagacgtttggtggaggcgccaaaacctcgattacgagaaatccaacgcaccattaacagacgtatcctggcttgtctccccgtccacagcgcttgccacggcttcgagtctggccgcaatccggcgactttttcagcgccacattcttctgccgggttgcttatcaggatggacttgaaaaactacttctccagtatcggggagccaagagtacgggcaattttcgaggccatgggttacagcgaggtcgtgagtaggtccctcgctggcctgtcgacaaacgcgtccagtatcgccgccctccgagggttggaccacgaacagagaaccttcctgagagttccccatctgcctcaaggcgctcccacctcacctaagctgggaaacttagcagcccgcggcctagatcgcagactctctgggtttgctctgcgcgtcggcatgacctacaccaggtacgcagacgacctcgcattttccggggctgacgggataaatgccggctccatcgtgtccgccgttgaacggatcatcgccgctgaaggcctattcgtgaacaggcagaaaacgttaataaggcgcagccatcagcgacaaatcctggccggattagtcgtcaacgatcacccgcaggtgccacgggactcttatgacaaggtcagagccatactgcacaacgcagcacgcaccggtgcagcagcccagaataggggtggtcacgccgacttcagagcccatgttctgggactgatatcatggattggcgaaacaaatccagatagacgggaacggctgctggatttggcagctgaggtggattggactacttga

SEQ ID NO: 12835 - RNA, 1251 nt, unidentified
  source 1..1251: mol_type = other RNA; note = synthetic construct
atgacaccaagagcggtatctccagcagtggcccatgcactcgctgacgaatttgcgaggggcgggttccgctggaggcatagtgagctcgcagaggcctttgccgcaatcatcgacccggttgaggcagagtccctggcgttacgtgtggtaggcttgatccccagggagcctatagatccacaaaccacccttcaggcagttcttgcagacctacccgaactgcccgagacagtggtggcacccgaaggtgaacccggtgggttgcggttcggagttcctgaaatattggattgcggcgcactggccactatgttaaatctgaccacagccgagctggagtggtttgccgatcacgggggatggctccgtactgcaagggaacccttgagtcactatcgttaccgaagactgcctaaatcaaccggcgttcgcctggtggaagccccaaaacctcggctccgggagatccagaggacaattaaccgccgcattctctcaggcataccggcccatccgagctgtcacggatttgagaagggccggagcgccgaaactttcgcaatgccccacgcccaagccgacgtagtggttcgggtggacctgagagacttcttttcatctatcaccgtggctcgcgtccgggcggtgtttagagcctgcggttatccagactccgtcgccactgcgctagcagacctgtgcactcacgcctcggctattgcccccctgcgaggacttgatcacagacaacggacactgctgcgcgtcccacatttgccacagggggcacctactagccccaggctcgctaatctcgtcgccaggaatctggacagacgcattagcggctacgcccgacggtctggactggcttatacccggtacgccgacgatttggctctttccggaaccatggatgctgatagtgctgtgtgggcagtgacgagaattgccgaagccgagggcttcctcgtgaaccctgctaagacctccgtcagacgacagcaccagaggcagatcctagctgggctcgtcgtgaataaccgccctgccgctccaagatacgcttatgatcaggtccgagccctgcttcataattgtcagaggacgggcgctgccgctcagaacagacaagggcacaacgatttccggagccatgtgtacgggctgattgcgtggatcggtgagacatctcctgcccgccgtcagaggcttttagctatggctgagctggtagattgggactga

SEQ ID NO: 12836 - RNA, 1263 nt, unidentified
  source 1..1263: mol_type = other RNA; note = synthetic construct
atgtccgagacattctggcaccaccatactgcacgcatggtcgctgcccggcttgtggacatcgagtggaattcaactgaacttggggaggtcttagccagatttgaacacgtggccgacgtggaaacactcatcaccagactgctggagcgacggattcatgccccagactctacggaggttgcagccgaattgctcgaggtgattgggtacccaggagatcccttcgtactgcccgctccaccggttaggcccacacctacggtgaggttcggggtgccagcctttgcaaccactgctgagctggccgcctcgctcgatgttacagtaagcgaactggactggtttgccgacgtgggaggttggctgcgacgtgcagctcctcctcttcgccactacagggccagggaggtcgctaaatccaggggcggcacccgcatccttgaaataccaaagccgagactcagagagatgcagagacgcgttcttcaccgggtgctggaccatgtcgtgcctcatcctgccgcccatggttttcgcgcgggcagaagtgccgtaaccttcgcccgcccccatgaaggtcgggatgtcgtggtgcgagtggacttagcagacttcttcccgacggtaacaagaccacgagctcgcgcagtgttcgaggcttgtggctatccctacagggttgcctccgtgttagcgggcatttgcactaccgccatgccagtggacgaagtcgccggtttgccaaggagccaggctgccctgctaggagtccctcacctgcctcaaggcgctcctacctctcccgcgttggcgaacctagtcgcacgcggactcgataggcgtgttgcgggcctagcaagggctagggggctggtatatactcggtacgccgacgatttggccctgtctggcccctcagataccgacgtgtctaccctgttgtgggcactcgataggatcgtccgggacgaggggtttgtcgtgaatggagataagacacacgtcgccagagcacaccggcgtcagacactggcagggctggtggttaacgaaagcgcagccgctcccagagatcgctatgatgcgctgcgggctctgctgcacaattccgtgagaactggggccgctgcacaaaaccgagcaggagtgcccgactttcgagcttccgtttatggacagatagcctggatcggcgagagtagcccttcacggagaagccggctcctcgctatggctgatcgtgtggattgggagagttga

SEQ ID NO: 12837 - RNA, 1227 nt, unidentified
  source 1..1227: mol_type = other RNA; note = synthetic construct
atgccatggactggagctgaactgggggaggttctcgggcccttcgatcggtggttcgatgtcgaaaccttgatcacccggctcagcgacgcagtcagggatgctccggactcggttgaggctgccgtggagctcctggagggagttgggtacccgggccttccatttatccccacccccccccctcggattagaccatatcggttcggggtgccagagatcagcacaccagcggacttggcaacctccctcggggtcaccgttcccgaattagattggttcgccgatctgggtggctggttaagaagggcagcgcctccacttcgacactaccgcgcagtggaggtgcctaagaaagccggaggcaaagctggcggacgctcagacctaggtaacatacggatcctggaagtccccaagccacgaatgcgagaaatgcagaggagagtgcttcataggattgtcgatcacgtagacccccaccctgccgctcacggttttcgtacaggccgaagtgccgtaactttcgccagacctcatgagcagcaagatgtcgtggtgcgcgtcgacttggctgacttttttgcaacagtaacagcacccagggtccgggccgtgtttgaggcatgcgggtacccgtcaaaggtggcagcactactggcaggaatatgtactacggccatgcccgtagatgaggccagccgtctgacaactagaagggccgcggttatgagaacccctcacttgcctcagggcgcccctacatctcctgctctggccaacctcgtggctcggaggctggacagacgtgtagcgggtttagccagagccaggggactgacctatacacgttacgctgacgatctggccttgagtggtccatcctccacggatgtcgggaccttgctgtgggccctggaacatattgcacttgacgagggctttgaagtgaacgctgctaaaacccacgtgcgcagaagccacacgcgccagactcttgcaggcctcgtggtgaatcgctctgccgctgtgccaagggaccgatatgatgatctgagggctctcctgcataatgctgcccggactggagccgccgctcaaaatcgcgatgagcttcccgacttccgcgcacatgtgtatggcctgatcgcgtgggtgggcgaatcttcccctattcgccgggttagactgctcgacatggccgcgtcagttgactgggacgcctga

SEQ ID NO: 12838 - RNA, 1353 nt, unidentified
  source 1..1353: mol_type = other RNA; note = synthetic construct
atgcatgctccacgggctgccctgaggcgaagacgtgagtctatggtggctccagtcccccttccactagccaccgtgaccccacctcccgagaaccctcattgggcccggcatcacgttccagcaatcgccccgctgcttgtggataccgcctggaccagggccgccctagacgaaatgctcgtcccctttggtggcttcctggatgtcgacacattgaggagaagactgatggacgctattacaggtgctccctatactgtggacatcgcggtgcgggtcctgctggaagctggctttcctggcccaccgccaaggataagtattccccgcgctccactcgttgttcgcccttggcgattcgacgtaccccgatacgcatcagccgctgagctggctgcatctctcgacgtgactctcgatgagttggactggttcgccgacttgcaggggagactgtgcagagctccaaccccgctgaggcactaccgtgcactgaccatccctaagagcgccggcgcacacagactgcttgagatccccaaacctaggctgagagagatgcagcgtcgcgtgctacggcgcatagtggaacggattgaacctcacgatgcggcccatggattcaggcggggaagaggggtccataccttcgcggccccccacagacaacaggacgtcgtgattcggatggacgtgcggaatttctttcccacgatcacatttgccaggatccggggggtgtttgcggcctgtggctatcccgatgcagtggcagcagtgcttgccgggatttgtacaaccagcctgcctgtagacgaagcaagaccgctcccatggcgcgaagccactgatttaaggggccgccacttaccccaaggtgctcctacatctcccgcactcgctaacctcgtagcgcgcggagtggatcgcagactcgctggtttggcccgggccagaggacttgcatatactaggtatgctgatgacctggctttgagtgggcctagcagcactgatgtgcggacggtgatagggacagtcgatcggatcttaaggcaggagggctttacacccaatgaggcaaagactcgcgtcaggcgatcccaccgcagacagtccatgactggcctggtagttaacgtctcgccacaggttcctcgtgaagagtacgacgccttgcgcgctctgctgcacaattgccgcaggacgggagcagccgcacagaatcatgacggggttcctgatttccgagcctacgtactgggcagggtggcctgggtgggagaatcaaacgatacccgacgtcggcgattactcgcccttgccgatgaggttgactgggcgtcctga

SEQ ID NO: 12839 - RNA, 1200 nt, unidentified
  source 1..1200: mol_type = other RNA; note = synthetic construct
atgcttgtggacgcgagatggacccgctcgggactggaggaagctcttgagagtttttcccatcggcacgacgtcgacgccctagttaccagattactggacctcatgccgtctgcaccattagatgttgaatctgggctgtccctgcttaggggcatgcctgtcctccctatgtacttgcctcctcgtcctaaaccacccagttggcatttcgacgtaccccgatatagcagcaacatcgacctggcgcgctccttagatgtgactccatgggaacttgagtggttcgcagatctcggcggctggttgcgcacaaagccctacccattgcagcactataggactcgaacaattgacaagcgcgatggtcacaggctgctcgaggtgcccaagcccaggttgcgggagatgcagcggaggctcttgacccgaatactggacagaatccccccccatgatgcggctcacggcttcgtcaggggacgctctgccgtgaccttcgcacgtccgcacgagtacgctgatgtcgtgatccggatggatctggcggattttttcacctctatcagaagaccacgggtggccgcaatttttgctagcgccggatacccaagaactgtagcccggactctggctggtatttgcaccacggagacacccgctgaacggttatccggcctgccacacgatagagccgttgccttgcgagcaccgcatctacctcaaggtgctcccacaagccctgccctggcaaatctggtcgcccgtcgactggacaggagacttgccggctttgcccgcaaaaatgggctcacttacactcgctatgccgatgacctcgcgttctcaggaagtgctgatgtgcgcgttgacaaactcataacagtggtgacaacgatcgtgcgtgccgagggctttagcgttaatgttcgcaagacccggattagaagggcccatcggaggcaggtcctagctggactggtggtgaacgaaagtgcagccgtgccacgagctcggtatgacgccctgagggcactcctgcataactgttcaatcaccggggcttcagagcagaaccgggacggtctgcctgactttaggtcacacgtatacggggtaatcgcatggattggggaatccaatgaagtgagaagagcagtccttcacgacctggccgctcgcgtggattgggatagctga

SEQ ID NO: 12840 - RNA, 1248 nt, unidentified
  source 1..1248: mol_type = other RNA; note = synthetic construct
atgtctcgccagtttagtccacagatggccgcttggctagcctccctggctgctgaagctccctggactaggggcggcctggaggaagctttcatgcctcttctgggtgacaaggccgcgcggctcgcttatcgtctaattgatttactgccttccgcgccctacgacactgagtcactcagagggctgataactggactccccctactgccggagccccgatcagttgaaccgtcccgtcgcagagatggggtaaagccctggctcttcgaagtcccaagatacgtcaccacgggcgacttagccgagagtctgaatctgaccattccagagatcgaatggtttgccgacgcccacagtagactgaccgtggctcctgagccacttaggcactacagagttacccccatcccaaaacgagtgggcgcgaggttactggaaatacctaagccaaggttgagggaaatccagcgcaaaatccttcggaggatcctcgataacgtaccagcacatgcagccgcacacggattcgtcaaggggcggtcgcctcgaacattcggcattcctcacgcaggccgagaagtagttatgagcgtggacttgaaggacttttttcccacagtcggcattaatagagtcgttgctgtcttcgacgcactcgggtatccccgtaacgtcgcctggaatctggcctacctctgcacaacctccacacccgccggtcagctgggtggaatgccttatgctaccgcctcacttctcagaagccgccatcttccgcaaggagcgcctacaagccccgccttggcaaatttggtggcaaggcggttagatatccgcttgacgggactcgcccggtctatggggttgcggtatacaagatacgcagacgatctggcgttctctgggtctgccgatgtagacgcagttctgtgggtggctagacaggtgatcgtggatgaaggttttgtggtgaacccagtgaaaactcgggtgagaagggcccacaagcgccagatactgaccggcctggtggtcaatgactggcctgccgtgccacgtaaagagtacgacgagcttcgggcaattctccacaactgtgccgtgaccggacctgagccgcaaaaccggcatggggttcccgatttcagggcccatctgtttggacgaattgcacgcatcggcgagactaacagcgctcgccgaagaaggctgctggagatggccgagcaggtggattgggcttga

SEQ ID NO: 12841 - RNA, 1224 nt, unidentified
  source 1..1224: mol_type = other RNA; note = synthetic construct
atggccgcttggcttgcctctcttgccgccgatgcactatggacaagatcggggctcgaagaggcctttctccccatcctgggcgagaaagcacccagactcgccgatcgccttatagacttgtcaccggtagccccatacgatcccgagtccttgaggggcttgattactggtctacctctactccctgaaccggccacagttgagccttcacgccgcacagatggattcaagccctggctgttcgaagtgccccggtacgcatcaaccggtgacctggccgaatccctggatctcacaatcagcgagatagaatggttcattgacgctcagtccaggctgagaactgctgccactccattacgacactatagagtcacgcctgtcccaaaaagggtggggttccgcatcttagagatacccaagcctagactgcgtgagattcagcggaagatcctccgacgaattcttcataatgttcccgcgcatagtgcagcgcacggattcgtcacgggccggtcacctagaacttttggtatcccccatgctgggcacactgtggtggtgtctgtcgatctgaaggattactttccttccatcggaatcgaacgagtggttgccgtatttgatgccttgggctacccaaaaagcgtggcttggtctttagcatatctgtgcaccacagccacccctgctgaacaactgggaggattcccctacgcaacagccagtctgctgcgcactaggcatctcccacagggggctccaaccagcccagctttggccaatctcgtaagcagacgcctggacatcaggttaacggctctggcgaagagtcttggggcaagatataccagatacgctgacgaccttgcatttagcggcgatatcgatgctgacaaaattatttggagcgcctccaagattatcgcggacgagggatttgcagttcacccttacaagacacgcgtccggagggcacacaaacgacagcagctcaccgggctggtggtgaacgattggccgagtgtcccccggaaagagtatgacgccttgcgtgccatcctgcataactgtgccgtgaccggcccggacccacaaaacctctctgcaattccagacttccgtgcgcacctgtatggccggatcgctaggattggcgctacctctgcagtgaggaggcggaagctgctggagctggccgaacggatagactgggagtga

SEQ ID NO: 12842 - RNA, 1419 nt, unidentified
  source 1..1419: mol_type = other RNA; note = synthetic construct
atggcccatggacgggtgtctgtccgggctacagaccttaggggaaacccgtgggttgggaaaaagaactgggcccttcgtcccacccccgtacgtactctcagggtgcatgatggggcagaacacgaacgtttccggagccctgtagccgcagctccgtggatagcgatgacagaacggcagtttaacgctcagttagccgcctacttggcccagctcgctgctgacgctcaatggacgagagaacgactggaggaagccttcatgccaattttgggcgaaagggcacccagactggctgaccgactgatcgacctgtatccatcacagccgtttgaccaagcctccgtccataggctgatcgcagagcttccaagaatccctgaggctatctcccacgagcctgtgcggcgatctaatagccctaagccatggcggttcgacgtgccccgctacttcaccacaggcgacctcgccgagtcattaaatctaaccatccctgagatcgagtggtttgccgatgcccactccagactgactaccgcatcacctccactccgccactatcgcacaactgcaattccaaagcgcgtaggcgcacgactgctagagatacccaagccacgcctcagagagattcagaggaagattctgcggcgcatactggatcatgtccccgcccatggtgctgcacacgggtttgttaagggtcgtagccccagaacttttggcattccccatgccggcaaagaggtcgttatatccgtggatctgaaaaacttcttccccagtatcggtataagcagggtcattgctatcttcgatgcactcgggtattctaggagcgtggcttggaatctggcatacctgtgtaccaccagcactcccgctggccagctgaacggactgccttatgccacagccagtttattgcggacacgccaccttcctcaaggcgcacctacgagtccagctctcgccaatctggcggcccgcatgttggacatccggttgaccggatttgcaaggtcaatggggctgcgctactccaggtatgccgacgaccttgctctgagtggcgacgcggatgtcgataaagtgctgtgggttgccaggaggatcatcactgacgagggatttattctgaatccgctaaaaacccgcgtgcggcgagctcacgaaagacagcagctgactggtttagtggtgaatgattggcccgcggttcaaagacgagaatacgatgagttgagagccattctccacaactgcactcgcaccgggccaacgtcgcagaacagatctgatatggaggatttccgtgcgcacctctacggcagaatcgcgagaattggagaaacctctcctacacgacggcggaccctccttgagatggccgaaagggtggactggacatga

SEQ ID NO: 12843 - RNA, 1251 nt, unidentified
  source 1..1251: mol_type = other RNA; note = synthetic construct
atgtccgagagacagtacatccctccaatggccgctgctttggctcggcttgcggctgacgcaccttggacaagggagcggttggaagaggcctttatgcccctcctgggagcccgagctagtaggctggccgatcgcttggtcgagctccaccctgcacctcccttcgacgaagcctccgtacaccggctgatagccgatctgcccctgttacctgagacggcttcgataactccagagaggcggacctcaagcttcgctgagtggcgtttcgaggtccccagatatgtcactaccggggatctggcagagagtctcaatcttaccattcccgagattgaatggtttgctgacgcccagtctcggcttcgaacagcccctgaacccctgcgccattaccgtacaacgccgattcccaaacgggttggcgccaggctgctggaaatcccgaagccaaggctaagggaaatacagcggaagattctcagaagaatactggaccgcgttccaccacactctgccgcccatggctttgtgaaagggcgctcacctagaacttttgggatcccgcatgccggccacgaggttctcgtgtctgtggatttgaaagatttctttccaagcatcggtattgaccgtattgtggcaatcttcggagctctcggctacccccgcacagtagcttggaacttagcctacctatgtactacctctacgcccgctgagcagctaagcggcttcgcctatccatccgcgagcctccttcgaaccaggcaccttccacagggtgccccaacaagtcctgcgctggccaacctggccgcaagaaagctggacatccgactgaccggactggcgggctcaatgggcttgcgctatacccgctacgcagacgacttagcattctccggcagttgcgatgccgacgtgctcctctggactatcaggcagattgtgcgagatgaaggattcggactgaaccccggcaagaccagagtacgcagggcccacaagaggcagcaattagctggtctggtggtcaatgaatggccggcagtgcccaggcgagaatacgatgggttgcgtgcaatccttcataattgcatcctcacaggacctgcggcacaaaaccgggcaggggtccctgactttcgggctcatctgtatgggcgcatcgcccacattggtgagactagcgccgcaagaagacggagactgctggaaatggctgagcaagtggattggtcctga

SEQ ID NO: 12844 - RNA, 1224 nt, unidentified
  source 1..1224: mol_type = other RNA; note = synthetic construct
atggccgctttcctcgccgaactggcatccgatgtcccgtggactagggacagattggaggaagctttcatgcctgtgctgggagtgaaggcactgcgcctggccgataggctcatcgacctctatccctcccctccgttcgatgaggaatcactgtaccgcctgatcgcggatctgccccgactacccgacaagaaaagtgaggagcccgagagacggacaagcgggcctaaaccctggagattcgatgtgccaagatactttagtactggagatctcgctgagagcctcaacttgacaatcgacgaaattgagtggtttgcggatgcccaacagagattgaagacggcctcgtcaaccctcaggcactaccgggcgaccagcatcagcaaaagaagtggcgccagagtgttggagatcccgaaacctaggcttagggagattcagcgcaaggttctgcgccgtatactggaccaggttcccgcccatggtgcagctcatggattcgtgaccggtcggtccccacgtaccttcggcataccccacgcaggccgagacgtagtcttggcagccgacctaaaggatttttttcccagcattggaatcgggcgcgtagtggccattttcgatgctctgggttatccacggacagtcgcttggaatctggcatatttatgtaccacctccgctcctgctggagagttagctggcgtcccctatgagacagcgtccttgctgcgaacgaggcaccttccacagggagcccctacttctccagcccttgcgaaccttgccgcacgaatgctggacattcgtctgactggcctggcacggtcaatgggcttaaggtacacacggtacgctgacgacctggccttctcagggacctgcgacgttgatcgggtgctgtgggtagtgcgccatattgtcagggacgaaggctttatgctgcacccaaataagacaagagtgcgcagatctcataagaggcagcagcttactgggctggtggttaatgaatggcctgccgtgcctcggtctgaatatgacgaattaagggcaatcctacacaactgcgctcgtaccggcccagaggcccaaaacagaagtgggcatggcgattttcgagcccacctctacggtcgcatagctcggatcggggagactagcgccacgaggcgacggaaactccttgaactcgcagaacgcgtcaattggtcttga

SEQ ID NO: 12845 - RNA, 1257 nt, unidentified
  source 1..1257: mol_type = other RNA; note = synthetic construct
atgaccgagcgtgagctaactccccaggctgcagctacattggctagactggccgccgatgcagagtggaccagatccggcctcgcggaagcttttgagccgttagtgcccgcaaaagctacttggctggcggaccgcgtgattaacctgtatcctagccccccctttgacgaggcatctatcttcgtcctgctcagagatctaccattcatcccggaaccttccgtgagctcacagcgaccgacgcggaacagtgataaaccatggaggttcgaggtgcctcggtacgagacaactgggcagttggcccgtagcctggatctaacaatctccgaaattgaatggttcgcagacctgcagggccggctcagaactgccccattcccccttcaacactatcggagcgctcgactggacaagcggcaaggcattcgtctgttagaagtgcctaagccgaggctgagggaaatacaacgcaagatcttgcgccgcattctggacagaataccctcccatccagccgctcacgggtttgcgaaagccaggtcaccccgcacattcgcgatgcctcattcagagcgagacgtggttatatctgtggaccttaggagattttttcctagcatcggcttcgatagggtagtagccatcttcgaagctgtcgggtaccctaggacagttgcaaaaaccctggcagctctgtgtactactgtgaccccagccagtgagttgacaggaatggatcgacctaccgctgcccgtcttagggctacccatttaccacagggagccccaactagccctgcccttgccaatttggcagcccggcagctggacattcgcgctaccggattggcacgaagtggtggcgctcgctacagtcggtacgccgacgacctcgcattttctgggggaccagacctggatgttgatcgcctgctctggcttatcacgcaaatcgcacacgatgaaggcttcacaattcatcccgataagacgcgagtcagaagagcccatcagagacagcagcttaccggactcgtcgtcaactcatggcccgccgttccaagggaggagtatgataccctccgcgcgctcctgcacaactgcatagcatcgggtcccgctgagcagaatcggcaccaccacaatgactttagggcccacgtgtatgggcggatcgccagaattggtgagacaaacgaaaccagaagggccaagctcctgtctatggcctcccgggtgaattgggactga

SEQ ID NO: 12846 - RNA, 1326 nt, unidentified
  source 1..1326: mol_type = other RNA; note = synthetic construct
atgaccgaaagggagctgactccaagagctgccgccatcctcgctaggttggccgttgacgcggactggaccagatccggcctggatgaggcatttgcccggctgatcccagcaaaggccaccaggctggcagatagggtgatgaatctctatccaagcccgcccttcgatgaagcaagcatctttgtactgctgcgggatctgccattcctcgccgagccatccattagcagcgagatccctactcattttggaggaaaaccttggcgcttcgaagtgcctaggtacgagacaacaggcgacctggcccggtcattagatctcacgataagcgagatcgagtggttcgcggacctgcatggccgactgcgatcagccccttaccctctccaacactaccgctccgcccgccttgataagcgacagggcatacggctactggaagtccccaagccgcggttgagggagattcagagaaagattctgagaaggattctggatcgtatcccccctcatcccgctgcccatggattccgtaaggcccggagtccacgcacctttgcgcttcctcactcggggagagcagtggtggtgtctatggacctacgccggttctttccctctatcggcttcgatagggtcgttgcgatctttgaagccgtgggttatcccgggacagtcgcagcacacctggctgctttgtgcaccacagtgacacccgcagttgagctcattgggatggatcgccccacagcttcaagattacgcgccacccacttaccgcagggtgctcctactagtcctgccctggcaaacctcgttgctaggcagctcgacattcgtgcttctgggcttgcacggtccgtcggagcacactacactaggtatgcagacgacctagccttctctgccgctgccgacctcgatgtggaccgacttttgtgggtcatgagccagatcgcgtacgatgagggcttcgccgtccacccaggaaaaacgcgggtgggccgagctcaccaaagacagcagctgaccgggttggtggttaacagttccccggccgcccctagagaggaatatgacaacctgcgagctctgcttaataactgtatcagagcgggggtgtcaggtcaaaatcggcgcggcgccgatgactttagagctcacgtatacggacgcatagctagaattggcgagacaaatgaagcccgccggactaaacttttgaacatggctgctagagtggactggccaacgccagtatttgaaccccgtaattctggtagtaggaccgcccatacccccgcaactgaggaagacaggtga

SEQ ID NO: 12847 - RNA, 1269 nt, unidentified
  source 1..1269: mol_type = other RNA; note = synthetic construct
atgaacgatagggagttatccccacgagccgccgctactctggctagattggccgccgatgccgaatggacccagtctgggcttgaggaggcctttagccggtttatgcccgccaaagcatcacggcttgcggaccgaatcattgatctgtacccctctccccctttcgacgaggcctcaatcttcgtcctgctgagagatctcccgctcatagcacagagttccaagtccagccagaggtcccccatacgtggccgagtcgttccatggaggttcgaagttccccgctacgaaactacaggccagctagcgcaaagccttgatctgacgatttctgaaatcgagtggtttgcagatctgcaggggaggttgcgcaccgccccttttcctctccagcactatcggtcagcacggctggacaaacggcacggggtgaggctgctggaggtaccaaagcctaggctaagggagattcagcgaaagatcttgcataggattctggacaggattcccccccatcctgccgctcacggattcagaaaaggtcggagcccgaggacgtttgcaaccccacatgctgagagagaggtggtggtgagcgtggacttgcggcggttcttcccttccattggcttcgatagggtggtggctatctttgaggccgtcggatatcgccgcagagtggctgctaacctggccgcattatgtacaacagtgaccccagcgggagaactgactggaatggacagagccacagccgcccgcttgagaaccactcacctgccccaaggagctccgaccagtccagctcttgcaaatctggctgctcggcagcttgacatacgcgccgcaggtcttgcacggaccatgggtgctcgatatacacgatacgcagacgacctggcattctctgggcctgccgatctggatgtcgataagctgctctgggtgctcagtcaaatcgtccgtgacgagggctttacaatccatccagacaagactagggtgagacgcgctcatcagcgtcaacagctgacggggctagtagttaatgcgtggcctgcggtacccagagaggaatatgataacctccgtgctctcttacacaactgcctcggctcggtcgccgcacagcagaatagaaatggcttaactgacttctgcgcccacgtttacggaagaattgcccgcatcggcgaaacatcagaaacccggcgccgcaaattgctcgagatggccgcgagagtggactgggaagggagtggctga

SEQ ID NO: 12848 - RNA, 1251 nt, unidentified
  source 1..1251: mol_type = other RNA; note = synthetic construct
atggccgatagggaactcacaccaagatctgcagcggtcttggctgcactagccgcggatgttcagtggacacggtccggcctccaggaagcattcgcagctctggtgcccgcaagagcctcttggctcgccgatagggtgatcaacctctttcccatgccacccttcgatgaaagcagcatcttcaggcttctccgtgacctccctttcataccagagcccctggtcagtagccatactccgcctcctggaggcaacgttaagccctggcgatttgaggtgcctagacatgaaacaacggggcagctcgctcagtctctggatcttactattgacgagatggactggtttgcagacctgcaaggcagactaacacgtgccccattccccatgcagcattaccggtccgctcgcatcgacaaacgggtagggagccgcttacttgaggtcccgaagcctcgcctgagagaaatccagcggaaagtgttgaggcgcattttggaccgtgtgccagcccacccagctagtcatggtttccgaaggggcagaagtgcgagaacattcgctattcctcatgcaggtcgggaggtggtcgtgtccgttgatctaaaaaatttctttcccagcatcggctttgatcgggtggtagccatttttgaggctgtggggtatccgcccaccgttgccagcaatctggccggagtgtgcaccaccgttactcctgccgccgagttggttgggatcgatcgcccgacagcttctagactcaggtcgactcacctgccccaaggtgctcctacctcaccagcattggccaacttagccgcccgccaggtcgacatacggttaaccgggctggcccgatcaatgggtctgcgctacacccgatatgccgatgacctggcgttctccggctcaccagaggtggacacactgctttgggtcgtggggcaggtggcccaagacgaaggatttgcacttcaccccgataagactagggtcagaagggctcaccagcgacaacagctgacgggcctggtagtcaacgactggccagcagtacctcgggccgagtatgatgccctgcgggctctgctgcacaattgtatgacgactggcgctgacgtgcagaacctcaatggatcagcggactttagggcccacgtgtacggacgtatcgcacggattggagaaaccagttccacccgcagggagcgccttctggctatggctgcaagagtggattggtga

SEQ ID NO: 12849 - RNA, 1251 nt, unidentified
  source 1..1251: mol_type = other RNA; note = synthetic construct
atgcgcgactttgagctggatcctgaattggcaagaagattggcagtagccgctgccgatgccccatggactctctctggccttgaagaagcattcggcacagtgtttggagtgagtcctacgctgttagctgttcgcgtacttgatctgatgccagcccctcccttcgagccccagacactttatcggctgcttcgagagttacctcgtctacggccggtgccgctgtcactggataccaatgaaagctccgtttggagatttgacgtcccccgctacaacacatccgtcgatctggcccgtgccctggacctcacaattagcgagttggaatggtttgctgatcgtggggaatggctgcggaccaaacctctgccgctcagacactaccgacctatgcagatctcaaagaaaaccggtgcaagattgcttgaggtgcccaagcccagactgcgggagatacaacgaaagatcctcagaaggattctggatttggtgccacctcatgatgcagcccatggctttgtgagaggacggtcgcccctaacattcgcggcaccacacgctcagtccgagattgtgatcggggtcgatctggcccagttcttcccctccatcagcgggtctagggtccatgctgtcttcaccgccctaggctatccgccagcagttgcaggcgtgcttaccggactctgcacagtggctactcctgctgacactctcaggggcctaccctacgctcaagccagccaactgcggaccgcacatttgccacagggagctcctacatccccagccttggcgaacctcgttgctcgcaagctcgacataaggctgtcaggtttagcccaagccaactggctgacttacacgcgctacgccgacgatctcgcgttcagtgggatcgaggtggctgacgtgggaaccctgctgtggagtgtggaacagattgccagggatgaaggctttgcgatccacccacggaagaccaaagtaatgcgaccacaccggcgccagcacttaaccgggctggtcatcaatgaccagcccagctatcccagggatgactatgacaggctgcgagcgctcctctacaatgccgcatcaacctctgcacaggagcagaacagagacgggattgagaatttccgtgcccacgtctatggaaggattgctcacataggcgagacttctacgactcggcgccatactctgcttcgcctggccgagagggttgactgggacggttga

SEQ ID NO: 12850 - RNA, 1335 nt, unidentified
  source 1..1335: mol_type = other RNA; note = synthetic construct
atgagcctggatagggtgccacttgtgcagcaactggtgaggagagcccttgacggacggtgggaaagccacgccatcctggcacgatggcatacgctcggcgctaggccatgtatcactcttcgcgctctcgcccacttagccgttcattgcgccgggaggggtatccggccgacagaaaagcgcctgattaggactctgctaagttccccactcttatcccgctggctgagacagcagcacagaacgctgctgccactacctccccctgccccaaagttcgagcccgtcgagaaattggcacacctcgccctccctccactcaccaccgagacagatttggcccagttctttcatatggaactcgccgagctgtcttggcatgctgaccctcagcttcgcctgcggcatcagcccgatggaaggctccaacactatacctaccgctggttacctaggcgcaatgggtcaccgccccctagactcctggagattcccaaaccctggaccagacaattgcagcggcggatctgggatcagttgctgaggccagtcccagtccatgcagcctgtcatgggttcgtgccggggcgatcacggttgactgctgcagcacctcactgcggtaaagaagccctactccgaatagacttgaaggacttctttgtgagcataccccgatggcaggttcgggccctgtggatgacactgggatatcccgaagctgtggcccgactgctggctggtctatgcaccacagtaacccctgctgccgtactggacgcatgtcccgcgcctccacaggatccctctcaacgctggtggtggaggaagcgagcgagcactccacacctgccacaaggctcgccttgctctccggcacttgcaaacctgtgcgcttggagactggacacaagactgacagcatacgcgaccgctgcaggcctggactacactcgctatgcggatgacctgttgttttctggctcagctcggactcttcggcgtcctcaaagacggcacgcactgatggagatcattagatccgaggggttttgtgtccatcccgacaaggtgcggctcatgacccagagtcagtcccagcaggccctgggattggttttaaaccagcgcttaaatcttcccagggcttccttcgaccagttgaaagccgagctccaccacgccctccaccatcagggccttcctagtgaggcttcagcccgcagccagaagctggcccaactccgtggcaggattcaggaaatgatcgatattcacccccgtagaggacaaaaactgctggcgctttggcagagactacttcgtgattga

SEQ ID NO: 12851 - RNA, 1005 nt, unidentified
  source 1..1005: mol_type = other RNA; note = synthetic construct
atgcctccaacaaggagtgctcgggcaccagctctcgatagcttagatcagctgagacgctggctgagactatcaaccggggagttgctgtggttttgtgatgtctacggaaacggacggcgagcctgcgcaactgcccttaggcactatcgacacagatggatcgctaaacgctcaggtggtctgcgacttcttgagatccccaaggcacgcctcaaaaggatgcagcggcgcatactggacgagctcctgtctcacgccgcaatccatcctgcagccactggcttcgtgcgcggacgtagctgccttgaccacgctaggacccatgttggtgcgcggtgggtggtgacgagtgacctgagggactggttcgggagtattcccagagcccgcatcgcggcccagttcagacgtagcggcgctagcaaacatgtggctgacgcgttggctcggttgtgcaccgcctgtaccccctctgctatagtggacctggccgcggtgcccgatagagctcacttgcgagttcctcatcttcctcaaggggctcccacgtcccctgccttagcaaatctggtcgcatcaaggctggaccgccgcctagcaggatacgccaggcatgccggcctcaactactcgaggtatgcggatgacattgccctgtccccacagccaggcgtagaaacccctccacaaagagccctggaagcactgcagagaattgcccgttcagagggatttagagtgaatccccggaagatccggatcaagcggcacggctcccgtatgacagtctgtgggattgttattaacgagcggctgaacttggctagggatgcctatgaccggctgagagccgcagtacaccgactcgcatctagcactgatgtggatccgctcgaaatcgcccgggtccgagggagattatcttggctagagtccctcaatccgaggcgcgctgccaagttacgcaggctgctcgaaagcaggggcacaccatccacatga

SEQ ID NO: 12852 - RNA, 1377 nt, unidentified
  source 1..1377: mol_type = other RNA; note = synthetic construct
atgactgacgccgcaacccctgcttctcgcgtgttggctaggactcctcatcctctgccacgtgatgttgcagctgcgctgggcgacgcctttttggccgctgaggcctgggaaagggctgctctgattgatgctggtgccgacgttcttggtgccagacggcgctggttaggcccgctagtgagagacgtgttaacggaactggccaggccaccaagcgatgcccccagactccttgtatccgtcatcgtacggagcagtgccttcttggaggcggtgcggaaggccgaagagagaggttcccccctccgcatacggcaccgtgtaatcgctccctccgtctcacgcgaacctaccggtgccttgcccgctattggagatgtcaccgacctggcagcactgctggagatcgatctcggccggcttcagtggctggcagacgtcaagcactggaataggcgggccagatcgccagccctgcagcattacaggtatgaatggaggagacgcccagggcgagttcctaggctgttagagatacccgagcaacggctcagacgtgcacagagacgcctgctacacgccgtgctcgccctgatccctgttaacgatgcagcgcacggctttctccccggacgttctgccgctacaggtgctgccagacacattggagcggagacagtgatctctttggacctgactacctttttcgcccgggtcaccgcaccccgcatttatggagtcctgcgacagagcggcttctcagaacccgtggctcacaccatgactgggctgtgcacaactgcggtgccacccgctgttcttgccgcaatgccgcccggaggatctccagatgagagatttgcactccggcgagcgttagcgagcacccatctccctcaaggcgcccctagcagcccgatgctggctaacctggcaatcaggcgactagacagtcggctcacgggctgggctgacgcattggatgccacttatacacgctacgcagacgacctggccttttcagggggaccagcacttgcacggagggctgatgccttcattcggggggcaaggaggattattgctgatgaaggccatgaggctaacgcccggaaaacaagagtgcgagggagaggcgtgaggcagtccgttaccgggatcgtggtcaacgagcgactcaacgtgtcccgcgatgactacgatcgactgaaagctatcgtacacaattgtgtggtgcacgggcctgccacacagaatcgaggtggggtggccgacttccgtgcgcatctgcttggaagaataagttgggtcgagtcacttaatgctaggcgcggtgaacgcttgagggccgagttcgccagaatccgctggtga

SEQ ID NO: 12853 - RNA, 1371 nt, unidentified
  source 1..1371: mol_type = other RNA; note = synthetic construct
atggccgccaccacagcttcccgagtgctagcaaggacgcctcgcccactgccctcttcagtcgcagcgtcgctcgccgatgcctttctggccagcgaagtgtgggcgcccaaggagttgattcgcactggagcattcgtgatgggtgctagacggaggtggctgacaccccttgtcggcgatgtgatgtctgctttcgtgcgagcaccagttgatgccccacggctgctcacttcagtgatcctccgggctcccgacttcattgaggccgtccgaaaggccgatgagagacggtcgccgcttaggatccatcaccatgtagtgggccctagtacatcccagccccccagtggcccgttacctcgaattgactccatacccgacttggctgtgttgctggatctggacgtgggccgcttgcaatggcttgccgacacaaaacagtggaaccgcagagcccggcctggtcctttgcatcactatcaatatgaatggagagcacgcccaggtaggattcctcggctgctcgaaatccccgagcaaaggatgcggcgggtacagcgaacactgctagaacgggttctcgggttaatccccgtcaacggagccgcccacgggtttgtgcctggaagatcagctgtgactggcgcagcacaccacacaggaagcgacatcgtgatcagcctggacctgacgacattttttgctagggtgaccgcaggcagaatattcggaaccctcagacagagtgggctctctgagcccgtttctcatgtcataaccggcctttgcaccaatgcagtccccccgagagtacttgcagccatgccaccagggggatccccagaggagcgctttgctctcagacaggcgctcgccactagccatttacctcagggcgctccgtcttccccaatgttggccaatcttgctatcagaaggctagatagccgtctgactgggtgggcagacgctgtggacgccacctacactaggtacgccgatgacctggccttcagcggcggaagtaccctggccaaaagacctgatgcattcatcaggggtgtccagagaatcatagaggatgaggggcacctggctaatccaaggaaaactcgcgtccgtaggcagggtgttcggcagaccgttaccgggattgtggtgaaccaacgcgctaatgtcagccgtgccgacttcgaccgcctgaaggcgacgattcacaattgtgtactgcacggccctcatacccagaaccataggtccctggatgatttccgggctcacctgctggggcgtatttcatgggttgaatctctcaaccccccacgtggagcgcgattacgccaggaatttctgcggatccgctggtga

SEQ ID NO: 12854 - RNA, 1380 nt, unidentified
  source 1..1380: mol_type = other RNA; note = synthetic construct
atgactgaagcgctcacaccggccaccagagtgctggcacgaactccaagagccggtgcatcagcaatcgccacagcccttgccgatgccttccttgcagcagacgcatggactgcaccccacctggtggatgctggctctttcgtgctgggagctcgcagacgctggcttcctcgcgtggtggacgacgttatggtggactttgtgcgagcccctgtggatagcccccggctactcatagccgtaatcagggatagtccagcgttccgggcggctattgagaaagctgacgcggcccggacccccattaggatccaccaccacgtggtcgccaccaccaggtctagagaacccgccgccgggttacccagaatcgacgatatcgctgctctggctgtgctactggagctgaccgatgggcagctggcgtggtttgccgacaccaaaaggtggaacagaagggctcggcccgggcctttgcatcattacagatatgaatggcgcagcaggccaggaagggtacccagattgctggaagtcccagaggagaggctccgacgggtccaaaggcgtctgctcgagcgggtacttgggctaatcccagccaatgacgcagcccatggttttatgccaggtagaagtgccgttacgggagccgcaagacacgttggcgctggaatagtcgtgtctgtggatctgacaacgtttttcgctcgcgtgtcagccgggagagtctatggaactctgcggcagtctggctactccgaaagcgtggcccatacaattgcaggggtatgtaccagtgctgtccccccccgtgtcttagctgcaatgccgcctgggggcactccggaagaaagattcgcactccgccgggcccttgccgcaaatcacttgcctcaaggtgctccaagctcacctatgattgctaacctcgcagtccgacgtctggattccaggctgactgggtgggctgcggctgttgatgccgcgtacacacgatatgctgacgacctgacattttccggcggaccaagtttagccgctcggcctgatgcgtttatccgcggcgttaggaggattgtggaggatgagggccattcgctgaacgagcgcaagacgagaatacgtaggcaggccacacggcaggctgtaaccggcattatcgttaacgagcggctcaacttggtgcggggcgactacgaccgtttgaaggccatcatccacaattgcattctccacggtcctagctcccagaatcgcgccggagttgccgacttccgagcacatctgagaggccggattagctgggtggagtccctgaatgcccagaggggagcacgccttcgcgctgaattcgcccgaatagtctgggcatga

SEQ ID NO: 12855 - RNA, 1398 nt, unidentified
  source 1..1398: mol_type = other RNA; note = synthetic construct
atgaccagtactgccgccgcgagggctttaggtcactctccccaacctgctgcctccgccattgcaagagcactcgcagacgccttcctcgaaactccgtcttggacgaggcccgaattgatggccgcaggagctcgtgtcctaggcgcaagaagacgctggttgggccccgtcgtcgatgagatccttggagacttggttcgtgcccctcacgattccccacggctgcttgccacgctgatagaagattcgccagctttcagagagggcgtgtccaaagctgcagcccggagagcccctcagcagatccactacagacccctggccccacaacaccctccagctctgagccatcccctcgaccccgaaccgccacttcctaggctgcgtacgctgcccgagcttgctgccttgctcgatctgagcctcggccacctggagtggttagccgataccaaaaactggaacaggcgggcccgaccggggagtttacaccattaccggtacgaatggagaactcggccaggacgcgttcctcgcctgttggaggtgccagaggacaggatgagaaggacacagcgggctctgcttgatcagctgctgtctaggatccccgcgaatgacgcggcccacggatttctacccggaaggtctgccgtcacaggcgctgcaagacacgtagcctctgacatagttatttctctggatctgaccaccttttttgcacgcgtgacagctaccagaatctatggcactctgaggcaggcgggttacgacgagcagattgctcacgcaatcaccggactgtgtacaaacgctgtgcctcctcgggtgttagccgcaatgcctcccggcggaagcccagaagagcgattcgcccttaggcgcgccctagcagcctcacatctgccacagggcgctccgagtagtccaatgctggcaaatctggctgtgcggcgcctggactcaaggctcactgggtgggctgagaaggccgaggcttcctatactcggtatgccgacgatcttacctttagcgggtcaggagtgatcgcccgacgacctgatgcatttgtcagaggcgtacggcgaatcattgcggacgagggtcatattgctaatcccgctaaaacacgcgtgcggaggcaaggtacccgacaagccgtgacagggattgtcgtgaatcagcatccaaacttgagcagagttgaattcgataggctcaaggcgatactccataattgcgcagtacacgggcccgctgcgcaaaaccgctcagatgccagcgacttccgtgcccatctcctcgggcgcatttcctgggtggaaagcctgaaccctggtcgcggggcaaagttgcgtcgggagttctcccgcatcgactggggctcgccttga

SEQ ID NO: 12856 - RNA, 1410 nt, unidentified
  source 1..1410: mol_type = other RNA; note = synthetic construct
atgagcgggtcgtttggaaagcgggcagtcccgaacactgccgtggttatcatggcagcgcataggagctatcgggctccccacccttctccatccgctatctcccacgccctggcttacgcctttttagctagcgacgtttgggaaacaaaacagctggtggatgccgggtggagcgttcttggtgctcatcgccgttggttacgcgccgtagtagcagatgtcgtcgcggcttatcaccggccaccaactgactcaagccgggagctagccgcatttattcgcaacagccctgcattcgtagacgcgatcgcaaaggcacgtcaacagagaaggcccatccggatacaccacctggtggtggctccctcccaagccagggatgttggcggcctcgtgcctcgaattaacaccgtggccgagcttgccgagctattgggccttaccataggccagctggactggtacgcagacaccaaaaattggaatcgcagagcacccgtgggacctctgcaacactaccgctatgagtggaggactaggcctggccgcactccacggttgctcgaagtgcccgaggaacggatcagaagggttcagcgcttgcttttagatgccgtcattgcgcttattccagtcaatgacgccgcccatggtttcattgctaaccgcagtgccgtgaccggtgctgcgttgcataccggccgggagatagtcgtctcactggatctgacaacgttcttcaccagagtcaccgcttcaagaatctacggggtgttccggcagtccggctttcccgaaaccgtggcacatatcctgactggcctctgcacgaattccgtgccccctcgagttattgcagccatgcctcctggcggggatgctgatgaaagattcgctctccgtcatgcgctcgctgccaaccacctgccacagggagcaccatcaagtcccatgctggccaatctggctattcgaaggctggattctaggctaacaggatgggcccacagtgtgggggccatctacacacgttatgccgacgaccttgcctttagtggggaccgagatttggcacgacggccggatgctttcataagaggagtccaaggtgtggtgcgggaggagggccagacaattaaccccaggaagacgcgcgtacgaaggtctggagtgaggcagaccgttactggaatcgtggtaaacgatcatacaaacatctctagacacgactacgacctgctgaaggccactctccataattgtgccaccctcggtgtggagcgtcagaatagaggggggcacaatgacttcagagctcacctcctgggaagaattgcctgggtcgaaacactgaacccgttgcgcggcgaagccctcagacagaaatttgcactgatcaggtggtga

SEQ ID NO: 12857 - RNA, 1398 nt, unidentified
  source 1..1398: mol_type = other RNA; note = synthetic construct
atgactgatgccccaccgcagacaaccgggtcacccatcagtggggtgccaagggtgagaagagtgccccaccctacaccagccgccattgcaggcgctctgagctatgcgttcctagctgctgaccaatgggccaccaattccttgattgatgctggcgctcgcgttttaggcgcccgtcgtcgttggctacgcacagtcgtcgcagatgtggtggccgtgtatcatagaccccctgcagacagtagccgggagcttgcctcctttgtcgtgcagctgcccgcctttgtggaagccatcgcaaaggccaaacaacagcgccgtccaataggactccaccactttccagctgctccctctcaggccagggataggggggatccagtaccagtagtggacaccgtcggtgaactggccacactgctcggagtgaccgttggccacctggagtggtgcgccgacaccaaaaattggaatagacgagctcctgccggcagactacagcactatcgatacgaatggcgacagaggccaggaagaacgcccaggcttctggaggtgcccgaggagaggattcgcagggtccagcggactctgctcgataccgttatcggactcatacccactaatgtggccgcccatggctttgtagcgtcacgatctgcagcaaccggcgcggcattgcacacagcgcgagagatcgtcgtgactctggatctgactaccttcttcactcgggtgacggcagctcggatctacggggtttttagacagagcggcttcccggaatccgtcgctcatattctgacgggtctgtgcaccaactctgtgccgcctcgggttatagctgccatgcctcctggagggagtgcggacgaaagattcgccttgagacaggcgctggcaggaaaccatttaccccagggtgctcctagcagccccatgctcgccaatctggctatccgccgattggatagtcgccttacagggtgggccaacgcgattggcgccacatacacacgctatgccgatgaccttgctttctctggcgacagggacctggcaagacggccagacgcatttatccggggagtccaccgcatcgtcctcgacgagggccataacgttaaccctaggaagactcgggtaaggcggtccggtaccaagcaaactgtaacgggaattgtcgttaacgaaaggaccaatatatcccgccacgactacgacgcactcaaggctctccttcataactgtgctcaacacggtccggattcacagaacctgtcgcatcatgtggatctgcgggcacacttgatggggagaattgcctgggtgaccgcactgaatcctcacaaaggggaggtgttacacacaaagttcgcccttatccgttggtga

SEQ ID NO: 12858 - RNA, 1413 nt, unidentified
  source 1..1413: mol_type = other RNA; note = synthetic construct
atgagcctgcgtttttggagtatgaccatggacgcagcctcttctacacgcgctaaggccggccttagagggatccgcagaccacacccagccccctctgctgtgtcacaggcattggcatatgccttcctggcaagcgaggtatgggcggccaaagaactcgttgatgctggcagtctggttcttggtgcgagacgtcgctggcttcggccggtagttgccgacgtgatggcggcttaccatcgcgcccctacagggtccactcgggagttggccgccttcatcgctaccgtccctgcttttgtggatgcagtggcggctgccgcacaacaacgaaggcccattaggatccatcgcgtggtggcaacagccagtcaagctcgacccgccggtggaccattacccgcaatagacacggttgccgatttggcagtgctactggggctgtctctcggcgaattagagtggtttgccgataccaagaattggaatcgaagggcgcctgcaggggctctgcatcactatcggtatgagtggagagccagacctggtcggaccccaagactcattgaggtgcctgaacagagactgcgcagggctcagagggctctgctggaatgcgtgataggcatgattcccctgaacgacgcggctcacggctttgtccctggcaggagcgccgtaactggcgctaccctgcacaccggacgggaaatcgtcgtctcgctggatctcacaacttttttcgcaagggtgcgggcctcacgagtgtacggagtgcttagacaggccgggttcgctgaatccgtcgctcatgtgattgccggcctgtgcacaaactccgtaccaccaagggttatcgctgcgatgcccgacgggggatctgctgaggagcggttcgcactgcgtcatgccctcgctgacagacatctgccccaaggcgcgccgtcttcacctactcttgccaatctcgccatcaggaggctggattcccgtttgtccggctgggccacgagtgtcggagctacctacacccggtacgccgacgatctcgcattcagcggtgatcgcgagttagcccgcagaccggacgcctttatccgcggtgtcgagcgaattgtgcacgaggaggggcacagcgtgaacccacagaaaactagggtccgccgttccggggttcggcaaagcatcacaggaatagtcgttaacgaacacacgaacatcagccgacgggagtatgatcagcttaaggcaattctccacaattgtgcagcccacggccccgaatcccagaatcgggaccaccataatgacttcggagcacatctgttgggtagaatagcctgggtgtcaactgtgaaccctctaaagggaagatcactaaggcagaaattcgccctcattgactggtga

SEQ ID NO: 12859 - RNA, 1017 nt, unidentified
  source 1..1017: mol_type = other RNA; note = synthetic construct
atgccggtcccccggcttgatacactggccgatctcagtgctttgctcgggctcgacatcggcgagcttgaatggttcgccgatgcccggggatggaatcgtagggccccagaaagactgcagcactatcgccatgagtggcgaacacgacctggcagaactccccggctgctagaggtgccagagcagagaatgagacgcgctcagcgcacactgctggacaccgtgattggcgtgctgcctgctcacgacgctgcgcatggctttatgccaggacgtggcgtgatctctggggctgaggctcacctaggttccgcagtagttatctccctggacctcgtctcattcttcagccgagtgagcgcccgacagatctatgcagtactgcggagggctgggttacctgaggtggttgcacaccgggtgaccgccctgtgtacccatgctgtgcctccggctgtcctcgcaggtatgcctccaggggggagtcctgaggagaggtttgccctgcggcaagcgctagcacgaccccatttgccacagggcgcccctagctctcccatgttagccaacctggctgtgagaaggctggatgcacggctttctggatggtcagacgccgctggcgcacggtacacgagatacgccgacgacttgtcgttcagcgggggagccgaactcagtagacgctctgacgcattcgtccgtggcgttgccaggattgtggccgccgaaggtcacgagctgaatgaaaggaagacccgcgtgaggagagccggagaacgccagtccgtaactggcgttgttgtcaacgataggttgaaccttgcaaggcgggacgtcgatcagctgaaagccatacttcacaattgcgcggtgcacggtccagaatcccaaaaccgcgccggacatcccgattttcgcgcacacctggagggacgtttaaactgggtcgagtcattgaatcccgcacgcgctgcgagactcagacgggattttgaaaggattgcgtggtga

SEQ ID NO: 12860 - RNA, 1392 nt, unidentified
  source 1..1392: mol_type = other RNA; note = synthetic construct
atgagcgacagtccaggagctactggtgcaggacgagcggccctcgtgttaggcagagaaccccatccctcttctgcgggggtggccacagccttggcatttgcattcctagctgccgatgtatggagtccatccggtctgtccaccgcagggactgccgttttaggtgtgaggcgaaggtggctgggacccctgatcagggacgtcctggaggcgtaccgacagccacctcacgacgcctccttggaattgtcgagagtgatcggggccacagaatcttttagggctgcggtccgacttgctgattccagaggagcccctctgcgcgtccttcaccacaaggttgctgagagccgggcaagagaaatgcccggcctggtgcctcacatcgatacaccggcagacctcgccaggctcctggaactctcagtaggcgaccttgactggttcgccgacgccaagcagtggaatagacggagcgctgtggcagctctgcaccattatcggtacgagtggcgtttgcgcccggggagaactccacggttgctggaaatccccgagactcgcgtgcgggcagctcagaagcgtttactcgtagaggtcctcggcctgatccccacacacgatgcggcccatgggtttgtcccgggaagaagcgccgtgactggcgctagtcggcataccggctcggatgtggtcgtgtccctagatctcacaacgttttttgcacgggtgaccggcgcagccgtttacggaaccctgagaagggcaggattgccagaggccgtagcctacgctattactggcctctgtacaaccgctgcccctcccagagttctaagcgccatgcctcccggaggggatcctgatgagcgcttcgctctgaggaaagcactggcctccactcaccttccacaaggcgccccttcttcaccaatgcttgccaacctggccatccgacgcctggacgcaaggcttcaaggctgggcggcagctgctggtgggacatatactaggtatgctgacgacctggctttctcaggcgggggacagttagcacggaggccagacgccttcgtgaggggtgtgcagcacattgtgatagctgaaggccacaccgccaatcctcgcaaaacacgcgtccggcgtgccagcgtgaaacagaccgtgacgggggttgtggtcaacgcgcgaaccaatatgtcacgtcgcgacgttgatcgcctgaaggcaattattcataactgcgtcctgcatggtcccgagagtcagaatacggctgcccatgccgattttagagcccacctcctcggcagacttagctggctggaatctttgaaccctgagcgcgctcggaccctgagaaccgagttccggaggatagagtggtga

SEQ ID NO: 12861 - RNA, 1299 nt, unidentified
  source 1..1299: mol_type = other RNA; note = synthetic construct
atggctcttgccttcctggccgctgacgattggtcggccactcgactctctgccgccggatcactagttctcggggctaggcgcaggtggcttggaccactcgtacgggatgtgctggcggcttaccgcgaacctccacatgatgcctcccgcgaattaaccaccgttatcagcggttccgatgcattccgtgccgccgtggatagagcagacgccagaggcgctcctctgcaggtgacccatcacctcgtggcccagagccgaggaagagaggcacctgctcctgcaccactgctggatacagtcagcgggctggcgcggctgcttgatctgtctgtgggcgacttggactggtttgcagacacaaagcattggaacaggcgtgccccggctggtgctttgcaacattaccgatatgaatggcgtctgcggccagggagaactcctagactcctcgagatcccaggttccaggttgcgggcaacgcagcgcaagctactggtgggcgtgctcgggtttattccaacacacgacgctgctcacggattcgtgcccggcagatccgccgttactggagctagcaggcacacagggaaaaatgtggtcatctcagccgatctgactagtttctttgcacgcgtatctggcgcccgcgtttatggcaccttgcggagggcagggatccccgaaactgtcgcttacactattaccggactgtgtactacagccgcgccaccccgcgtaatagcagccatgccgcccggaggaaacctggacgagcgcttcgcgttacgaaaggcgcttgctgccacgcacttaccccagggtgccccttctagccctatgctggcaaacctcgccattcgtaggctggatgccagactcgagggatggagttcagcggctggggccgtgtataccaggtacgccgacgacctggcattttctggtggaggtgcattggcacggcgggctgacgcatttgtgagaggcgtggatcggattgtgacctccgagggccatacacttaattcacacaaaacccgcgttcggggcgcctctctcaaacagacagtcacgggcgtagtcgtcaacaagcataccaatatgagtaggagagatatcgacgagctgaaagccatattacataattgcgtggtcaacggccccgacagtcagaatcaaggcgcccaccccgacttcaggagccacctactggggcggctgtcctggttggaagcggttaaccccgctagggggcagaagcttagagtggagtttggccgaatccactggtga

SEQ ID NO: 12862 - RNA, 1386 nt, unidentified
  source 1..1386: mol_type = other RNA; note = synthetic construct
atgacgtccaaactgaggggtgccacacccgcagctctggtactggccagacgtccgcacccatcctctagcgaggtggcctccacactggctctggctttcctcagtagcaaattctggcacgccacagcgcttagtgaggctggctcggcggtattgggtgcgcgtagacgatggttgggcccactggtgcgggagacacttactgtttatcgcgaagctccccatgatgcccccagggctctgaccgcattcatcgccgctgctgatgtgttccgcgctgccgtcgctcacgctgatgcttctggcgtccctatcgggcttgcccaccatcggattcctttgacccgagccagacctgtgccaggagttgtgcctcccctgggcaccctcgctgaacttgccgactttctggagctccccattggcgacttggactggtttgccgacactaggcagtggaacaggcatgcccctagcggcgcacttcagcactaccgctatgaatggagagcacgtgcagggcggactcctcgtctgctggaaataccaggcgcgcgcttacggtcagctcagaggaccctgctcaccggggtaatcggcctcgtgcccacacacgatgcagcccacggttttgtgcccggcaggtctgcagtgaccggagcaagcagacacaccggcacggatgtggtcatcagtctggacctgactaccttttttgcacgcgtgacaggggcgcgaatatacggtacgctgcgcagagcaggattgcccgaagccgtcgcctatactatcaccgggctatgtacaactgcggctcctccacgcgttattgcagctatgccggcaggtggacggccagaggaaaggttcgccctgcggcaagccttagctgccacccatcttccacagggagccccttcatcacctatgctagccaatctggccttgaggcgcctggattccagactcgccggatgggctgctgccgcttctagcgtctacacccggtacgccgacgacttggcgttctccggagacttaactctcgcgagaagggcagatgccttcgcccgaggggtggagagaatcgtcgcagcagagggacaccttgttaatccgcataagacacgggtacgccgcgccagtgtgaaacagactgttacagggattgtggtcaacacgcagaccaacatgtcccggcaggagagcgacagactcaaggctataatccataattgcgcacggcatggccccgaaagccaaaacaggggggcacacccagaatttcgagcccacctgctgggccgactatcatggctcgagacactcaatcccgcccgggggaggaagttaagagccgagttctctaggattcattggtga

SEQ ID NO: 12863 - RNA, 1404 nt, unidentified
  source 1..1404: mol_type = other RNA; note = synthetic construct
atgtctgccggtgctgccgtgcctaggccaactccagccgcactcgtgttggctcgccgaccacatccctctaccgatgccctggctgctactctggccgctgcactcctcggcgcaaagacctggagcaagactgagatgatcgatgctggggcacacgttctcggagccagaaggcggtggttgggacctctggccacagagatcctgagctcctacccccgcgcaccaacggacagtccgagagagcttgcggcacatattattgactgtgccgctttctccaacgccatcgaagccgccacctcaaggggggttcccaacattatcgcgcattaccccctaactccccctctgaccccacctcaagccagagccgttacatccgcgttaccgcggcttgacacacttggcgacctcgccgcctttttaaccctgacccccggcgagctggattggtttgccgatacgggccagtggaatcggaccgcacgacctggggcgttacatcactatagacacgaatggagggtgcgcccaggtagaacacctcgtctgctggaagtccctgggaccaggttgcgcgcactccagagaaccttactgcatgacctccttgggctgattccaactcatggggcagcccacgggtttgttccaggacgttctgctgtgacaggcgccgctcgccatacaggaactgctgcggtgatatcactcgacctgactacattctttgctagcgtgacaggaagtgcaatctacggcactctacgccgagccgggtacccagaatcagtggctcactcaatcacaggcttgtgcacgcatgctgtgcccccccgtgtaatagccgctatgcctccaggaggtgatcccgccgaacgagccgctctgagaagagccctggctgcaccccatctacctcagggggctcccagctctcctgtcttgggcaacctggcattgcggcggctggatgccaggcttgcaggttgggcagacgccgcagctgctacctataccagatatgccgacgatctggcgttcagtggcggtacagacctgagacggagggccgacgcttttgttaggggcgtcacccgcattgcactcgctgagggccacactgtcaaccctcacaaaaccagggtccgaccggcatcggtacgccaaagcgtgacgggaatcgtggtgaatgagcaccccaatattagccgcgtagatgccgaccggctgaaagctatcctgcacaattgcgagctgcacggtccggctggccagaatagggcaggacacgccgatttccgtgcgcaccttctcggacggatatcctgggtcgagcagttaaacccagaacggggcgccaggcttagagcgtccttcggacggattcgatggtga

SEQ ID NO: 12864 - RNA, 1254 nt, unidentified
  source 1..1254: mol_type = other RNA; note = synthetic construct
atgattgaggttggagccagagccttgggcgccagaagaagatggctggggccactggcctcagagatcctgagctcctatcccagggccccaaccgacgctccaagagagctggccgcccacataacagggtgcactgccttttctaatgccgtggaggaagcgacaagcaggggcgtgcccatcaccatcgcctcttatcccctgacaccccctcaagcgggcgctgtaacaagtgctcttccccggctcgataccctgggagacttggccgcattactaggcctcaccccgggcgaactcgattggttcgcagacactggccattggaatcgacgggcccgcccaggtgtcctacatcattatcgctatgagtggagggctcgtccgggaagaactccgcgacttcttgaggtgccagggactagattacgggccctccagagaacacttctgaacgacctgctagggttgattcccgcgcacccagccgcccatgggtttgttcctggaaggagcgcagtgacaggcgcagcacgccatacgggagcagctgttgtgatttcgctcgatctgacatctttcttcgcctctgtgtccgcacagaatatctacggcaccctgcggagagtcggttaccctgaagcggtggcctactcactgaccggtctgtgcacacacgcagtcccgcccagagttatagcagctatgcccccaggaggagatcctggtgagagggccgctttacggcgagctttggcctccgctcacctgccacaaggtgctcccacctcccctgtgctcgggaacctcgcaattcgacgcctggacgccaggttggacggttgggctgaagctgcagaggctacttacacccgctacgcggacgatctggcctttagcggaggcgatgctcttcatcggcgtgcagatgcgttcgtacggggcgttaccaggttagtaacggccgaggggcacaccgtcaatccccacaagactcgtgtccgccctgcgtcagtgcggcagagtgtgactgggattgtcgtgaacgcaaggcctaacctcgtgcgcgtcgaagccgaccgccttaaagcaatcgtccacaactgtgtagtgcacggaccagccggccaaaataggggcgctcatcctgacttccgagctcacctgctgggccggatcagttgggtggaacagctcaaccctcagcggggggcacgtctaagggctacgtttgcccgcatcaggtggtga

SEQ ID NO: 12865 - RNA, 1176 nt, unidentified
  source 1..1176: mol_type = other RNA; note = synthetic construct
atgattcggggccataccccccacagttcgacggctgacgtggcatcagctttggctggggccttcttggctgcagatgcctggacagaacgggatctggttgccgcaggtgcccacgttttaggggccaggaggcgatggcttccaccactcgtgcgggagacacttgctgcgtatcgccgcccacctgtggatgcccctagagaactcggcgactttgtcgaaatgacagctgcgttcggactggcagtcgttgccgctcacgatcgacggacccccattcgcattgaacatcgggtattggtcgccgctagagccgtaccagccacacctgccgtgcctagggtggacggactggacgacctcgcagacctgctgggcttaacacccggcgagctcgactggtttgcagaccgccgccactatactcgtcgtgccaccgatacccggctgcagcactaccggcacgaatggcggactcgtccacagaggactcctcgcctgttagaggtgcccggatcccgcctggtggcagtacagaggacagtgctggccgagctgcttgggccactaccagtccatggggccgcccatggttttgtaccggggcgaagcgcgatcacaggtgctgctagacacaccggcgcagcagtggtgatcgccctggatctctctactttctttagtcgggttaccgccggcagggtctatgccaccttgcggagagcaggatacccggaggctgtggcccatgccatcactggcctgtgcacccatgcagtgcctccgagggtcattgcggccatgccttccggaggcgatgccgatgaacgctttgctgcaagaagagcgctcgccgcagctcacctgcctcaaggtgcacccacatcccccatgctagcgaacctgtctgtccgtcgattggacgcccgacttagcgcatgggctgagagagtggatgccacctacaccagatacgctgacgacctcgctttcagcggtccaccggcccttgctcgaaggtcagacgctttcataggaggaggggagagaatcgttacggccgagggccaccccccaaatgcaaggaaaacgcctgggaggccagctagacccccacctagaggaccaggcaatgcggggacagatcccccccatactcctcgcactggctga

SEQ ID NO: 12866 - RNA, 1113 nt, unidentified
  source 1..1113: mol_type = other RNA; note = synthetic construct
atgcgtgccgcactgcgcagggccgtaaaacgcggaactccggtaatcattgcacaccacgttctggcagaaccggtcgctcccgcctctgcatcccctgtacctcggctcgccagtgtgaccgagctcgctgctgccctgcacctggagataggcgaattggaatggttcgccgatacccgactacagcttcggcgggcgtcatctacgaggctccagcactatcggtacgagtggcgagaaaggcctggtcgcctccctcgacttctggaggtgccagggaggcgtttaagggccgcgcaacgcgctgctcttgatgctgtgatagggttagcccccttgcacgatgccgcgcacggctttgttccgggaagaagcgctcgcactggggctgaaaggcatgtggggtccgaggtggtcatcgctctcgatctaacgacattcttcgccagagtcaccgctagagacgtgtaccgcgccttgcgtgctgagggtctgccagaatctgtggcatatgtgctgaccggcctgtgcactcatgcagtcccatatcgggttgcagcccatcctccacgcggaggagacttggatgagagatttgccctgcagaaggccctgacagttccccatctaccacaaggcgcccccacttcccctgcactggctaacctgtgtgttcgtcggcttgacgcccggcttgcgggttatgctgaagccgccggagccgtgtacaccaggtacgcagacgatctcgctttttcgggagggcctgccttagctagacgagcagacgcttttgcacggggcgtccggagaattgtggctagcgaggggcacgagctgaatgaccataaaaccagaattcggacagccagcgtcaggcagagcgtgactggcatcgtggtcaacacacgccccaacgtgacaagagccgagtacgacgcgctgaaggccaccttgcacaattgcatcagggatggcccagcaagtcagaacagggcgggtcatgcagagttccgcgcacacctcctgggccgaatctcctggatcgcttcactcaatcccgccaggggagaaagactgcgagccgagttcgacagaattccctggtga

SEQ ID NO: 12867 - RNA, 1095 nt, unidentified
  source 1..1095: mol_type = other RNA; note = synthetic construct
atgcgagccgccctagctgacgctgcacacagagggcgtccactgggtattgctcaccatctgatcgcagaaccgcccagcggtacacatcctggtagcttagctgaactcgccgccctcctggaactcacacctggcgagctggattggttcgccgacacacagctgagacagaggagggcccccgatggaccactgcagcactaccgctacgagtggagggagaggccagggagattgccccgactcttggaagtacctggcagaaggctgagagccgcccagcgagttctgctcgaggaagttgtaggcctgctcccactgcatgacgctgcccacggctttgtgccaggtcgctccgttcgaaccggagccgaaagacacctgggccaggaggtggtcattgctttggacctaaccacttttttcgccagagtgagcgcacgcgatgtgtaccggctgttgagaggggcctctatccctgaagcggttgcatatacaattaccgggctgtgcactcacgctgtcccctatagggttgctgcacaccctcctcgcggaggagatctcgacgaacgcttcgccctccagaaggcccttacagtcccccatttaccccagggggctccgacctcacctgctcttgcgaacctgtccctgcggaggctggatgccagactggctggatatgcagctgcggctggcgcagcatacacgcgttatgccgacgatcttgccttttcaggaggccccgcattagccagacgggctgacgcatttatacggggtgtggagcgtatcgtggcagcggagggccacctaatcaacgcacataagacccgagtccggaaagccgctgtgcggcaaagtgtgactggggtggtcgtaaatagggtcacgaatgtgactaggaccgagtttgacgcgcttaaggcaactttgcacaactgtgtggtccacggcgctgcctctcaaaacaggggcgcccatccagatttccgcgcccatcttctcgggcggataagttgggtggcagcgttgaatccagcccgcggagccaaacttcgggaggagttcgaccgcatccattggtga

SEQ ID NO: 12868 - RNA, 1380 nt, unidentified
  source 1..1380: mol_type = other RNA; note = synthetic construct
atgaaggaaacaacagtgtctgccgccgcccttgtacttgctcgtcacccacacccgtctgtacccgcactggccacagcactaggacacgccttcctggccgccgaccaatggactgcgagggagctgattgcatccgcagccagaactttgggtgcccgccataggtgggtggggcctttggttgccgaggtgctggctgcatatcaccggcctcccatcgatgctccgcgcgaactagccagcatgatcgaggcagctgaggcttttcgggctgccgtggctcgagctgagcagagaagagctccgatacgaatcgcccactacgcagtggaacctggaacggcaaggcctatgcccgcaggtgttccccgtatcaacggccacggggcgttagcagagctcttgggattaagcccaggcgagcttgattggttcgccgacaccgcgctctggaatagacgaggcacaagcgagcggttgcagcactaccgttatgagtggcggcagagggaaggacgcgtaccgagactgctggaggtgccacagcggagactcaaaggggtacagcgcagtgtgctggcatccatcctcggccccattcctgcccatgacgctgctcatggctttgtgccagggcgatctgccgttagtggtgcggccttacacaccggcaacgatgtcctcattgctctcgatctgtccacctttttcgctcgcgtcccagccaggcggatattcggcaccttgcgccaagctggactgcccgaggctgttgcgcataccgtttcaggcctgtgtactcatgcagtgcctccaagggtgatagccgcaatgcccaggggaggcacagcggaagatagatttgccttgcgaagggccctggctacgcctcatctgccccaaggagcccccacttcaccagcactggctaacctggcaatccatcggcttgacgctcggctttccggttgggccgatgctgctggggcaacctatacaagatacgcagatgacctcgccttttcagggggtcctccacttgcccggagagctgacgccttcgtccgaggagtcacccgcattgtggaggccgaaggccactctctgaaccgcctgaagactagagtgcgtgcctcgagtgtccggcaggtggtgaccggtattgtcgtcaatgaccggactaatctcccccgagccgaatttgaccgccttaaagccgtcctgcacaattgcgtgatgcatgggcctcactcccagaatagggccggtcacagcgacttcagggcgcatctactcggcagaatcagctgggttgaagcgctgaaccctgggaggggtccacgccttagagaagaactggagaggattcgttggtga

SEQ ID NO: 12869 - RNA, 1476 nt, unidentified
  source 1..1476: mol_type = other RNA; note = synthetic construct
atgaacgagacgggccccatcccaggggacgatgatccaaccggaccagccacagctagacggaggggaggcaggcatgtgcctagccctaggtcgacacgcggcagtgccactctcggtagagaacccgcacccggtgcaccagggttatccctgttgctcgcatacgcattccttgctgccccggactggaggcaggaggaactgatagccgtaggtgcggtgctccttggagcccgtagacgttggttaggccctctcgctcgcggcgtactaacagggtaccctcgaagaccagtgggagccccgagggagctggctagatggatcgctgcccagccagcctttacggatgcaatcgcccgtgcatcagctcggggcatgcctatttcccctgcccggtacctaaccgccgtgactgaaggtccggctccagctggttctgcacctggctctgccgtggctacacctggcacaagagacttggcctggctggctcgggaactgaggcttacccccggggagctggattggttcgccgacactcgccattggaataggcgtgccgcaagccgtgcactccaccactatcggtatgagtggagggtcagacccggtcgggtacccaggttgctggaagtccccggtatccggctccggacagttcagcgacacgttctggaccacatcttggctcctatccccctgcacgatgccgcccatggctttgcacccggacgatcagctaggaccggtgccgctgttcacactggggctgacgtggtggtcgccttagaccttgtgtccttcttcgctcatattaccccagggcgcgtgtttggggtatttcgacaagccggcttccctgaggccactgcgcatgcactcacgggcctgtgtacccacgaggttcccgacgccgtcctgcaatccatgcccgatggtgggggaagtggcgagcgctttgccctccgtcaggcacttagggcagctcacttgcctcagggagctccgagcagcccagccttagcaaacctggccgtgcgccgcctagacgctagactagccggatgggctgcagcggctggaggaagttatactcgctatgctgacgacctggccttcagctcacccgcacctctggccagacgagctgatgcgttcatccggggggttgagcgcattgtggtcgccgaaggacatgccgtgaatcgccccaagactagagtgtccggagcgtctgtccgccagaccgtgacaggcgtcgtggtcaatgcgaggaccaatgttgccaggaccgattacgacgcactgaaagcaattttgcacaactgcagagtgcatggcccagaatcacagagacgggggcaagccgatttcagggcgcacctagcggggcgaattgcgagagtcgaatctctgaacccacagcgaggccggagacttcgggatgcatttgagcggatacgctggtga

SEQ ID NO: 12870 - RNA, 1479 nt, unidentified
  source 1..1479: mol_type = other RNA; note = synthetic construct
atggatcgcaccgggccgaccacaggagacgatgaccgaatgaggccagccacagctcgtgacggaggaggtagaggcagaccctctccaaggcccactcctgcaagtgctaccctagccagggaaccagcccctggagtacccggactctcccttctgctggctcacgcctttttagccgcgcctcagtggcgacgcgaagaactcatagtcgcaggggcggcacttctaggagctaggcggaggtggttgggtcccctcgttagaggcgtgctgagtgggcaccctagaccccctgatggagcacccagagagctggctcgatggatagcggcgcagcctgctttcacggaagctgttgccagggccagcgctagagggacacccatcggtccagctcaccacttaccagccgtcccagaggaacgcacccccttgagaaccactgcctccgcagatgctgtgagaaccccgggaactagggacctggcatggctggcccgcgaactcagactgacaccgggcgagcttgattggttcgcggatacccggcattggaacagaagagccgcccatcgagccttgcaccactaccggtatgagtggcgagtaaggccaggtcgcgttcctcggctgctcgaaattccgggcatcagacttcgcaccctgcagaggcgcgtgctcgaccatattctggccccactccccttgcacgatgctgcgcacggctttgttccaggacgttccgctaggaccggagccgctgtccatacgggagctgatgtggtgattgcactggacctggtagccttcttcgctcgggttcctccgggacgggtctttggcgtgttccgccaggcaggcttccctgaagccactgcccatgccctgacagggttatgcacccacgcggtcccagacgctgtgttacgtagcatgccagacggaggctcagcaggggagcgttttgcactaggccgggcccttaggacggctcatcttccccagggtgccccctcttcccctgctttggccaacttggccgtgaggcgcctggactctcggttagcaggttgggctgcagcagccggcggtacatatacccgttacgcagacgacctgagcttctctgggcctgccagtctcgcacgaagggcagacgcgtttgtccgcggagttgagcgcatcgtggtcgccgaggggcacactgtgaacagactgaagacacgcgtgggtggagcccccgtacgacagacagtcactggcattgtggtgaacgtgcgtactaatgtggcccggactgattacgatgcactccgagccatcctgcacaattgtcgggtgcatggccccgagtcacaaagacgggggcaagctgacctcagggcccatctagctgggcgcatcagctgggtcgagtcactgaatcctcagcgggggaggagacttcgggatgcctttgagcggatctcgtggtga

SEQ ID NO: 12871 - RNA, 1455 nt, unidentified
  source 1..1455: mol_type = other RNA; note = synthetic construct
atggacggtgcagggccacgtgcagtacgtggaccagctaggccacggcggggaagaggtgcaccagaaggccctacttccgcaagcgccacactggctagagaaccagctcccggagttccgggccttgcgttcctgctggcccatgctttccttgccgcaccagactggcggagggaggatttggtcgctgccggtgccgctttattgggcgctcggaggcgatggctagggccattggtgaggggcgtcttagcaggctaccctcgtagacccgaaggagcccccagagaactggccagatggattgccgctcagccggctctcacagacgcagtcgccagagcggctgcaagaggcgagcctgtacggccagctaggtatctcccacctgcccctgaggaacaggctttcggggatcgctcagcgcctggaggtgtggaggcatctggggcacgcgatcttgcttggctggctcgggaggttcgactaaccccgggggagctcgattggttcgccgataccagacactggaataggcgagccggagcccctgcgcttcatcactaccggtatgtgtggcgtgcgaggcctggaagagctcccagactcctggagatacccggcatcaggctccgcacagtccagcgtagagtgctggatcacctgctggccccgatacctctgcatgaggcagcccacggattcgtgcccggaaggtcagctaggacgggagctgccttgcataccggggctgacgtcgtgattgccctcgacctcgtctctttctttgcgcgagtgccccctggacgagtctttggggtgtttcgccaggccgggtttcctgaagccactgcgcacgccctaaccggactgtgcacacatgaagtgcccgatgccgttctgcgcgccatgccagatggcggttccgcagaggacaggttcgcactcgctcgggccctcagaaccgcacatcttccccaaggtgcaccctcgtcccccgctttggcaaacctagccgtgcgtcgcttggacgcccgcttatcaggatgggctgcagccgcaggtgggagctacactcggtatgccgacgatctggcgttcagtggtcccgctgatcttgcgaggcgagcggatgcatttgttcgcggcgttgagcgcatcgtggtggccgaaggccacactgtgaatcggcgaaaaacccgtgttcggggtgccgccgtaaggcagaccgtgactggcgtcgtggtgaacgcccgcacgaatgtggcccggacagactacgacgccctgaaggcaatcctgcacaactgtagggtccacggcccagagtctcagagacgggggcaagccgactttcgagctcacctggctgggcggatcagctgggtagaaagcctgaaccctcagaggggccgcagactgagagacgcctttgagcgcattagttggtga

SEQ ID NO: 12872 - RNA, 1467 nt, unidentified
  source 1..1467: mol_type = other RNA; note = synthetic construct
atggacgacaccgagtcccttccagacgatggtggatccttccccgctagagggggccctgttagggcatccagagggactgctgcggctcgcacactggcaaggacgccagcaccaggtggtcctgggttggcgtttctgctggctggtgccttcctgacagccccagcatggcaacgtgaggacctcctggatgcaggggccgcagtgttaggaggcaggaggagatggcttgggccgctcgtcagagcggtgctagctggatacccccgtagacccgatggtgccccacgagagttggcgaggtggattcgcgcccagccagtgttcacagacgctatcggcagagctgccgcccgaggagtaccgatcactcccgcacggtatttaaccgccggtgcacccgaggagggacatagaccgagccgcgttgatctgggtactggtgcacctgctgctccaggagccggagatttgggcaggcttgccagggaactgcgactgaccccgggggaacttgattggtttgcggacaccaggtcctggaatcggcgggctcctagtcaggctctgcgacactaccgctacgagtggcgatctcggcctgggagagtgcccagactgctggaagttcccggaatccggctccggaccgtgcagagaagagtcctcgatctcgtcctggcacccatccctctgcatcctgccgcccatggcttcgtccctggcagaagtgccagaacgggcgctgccctacatgcaggcactgacgtggtcattagcctggacctcgtgagcttctttgcccacgtgagtcccggcagaatcttcggcgtcttacgccaagctggctgtcctgaggctaccgcccacgtcctgacaggcctgtgtacccattctgtgccagaagctgttctgcgagccatgccaggtgggggcacacctgaggaacgatttgccttggcacgcgctcttcgtgcagcccacttgcctcagggggcaccatcatctcccgcccttgccaatctcgccgtgaggaggcttgactcacggctggctggatgggcggaagctgcaggaggcacatatacacggtatgccgacgacctcgccttcagcggacctgctgggttagcacggagggcagatgccttcctgaggggggctgagcgcatagttgccgctgaggggcacgaggtaaaccggcacaaaacccgagtacgctcggctgcgacgcgtcagactgtgactggcgtagtggtgaacgcccacccaaacgtggcacgggctgactatgatgcgctgaaggccaccctatacaattgcttggttcacgggcccgaatcacaaaggcggggacaggccgattttcgtgcccatctcggcggccgcataagctgggtggagtctctgaaccccctccggggacgcaagttgagggaagcctttgatcgcattggctggtga

SEQ ID NO: 12873 - RNA, 1680 nt, unidentified
  source 1..1680: mol_type = other RNA; note = synthetic construct
atgctcggctggcaacgcagaataccagcggaggcggaacatgtgcacagggcccgatcatcgcctggacttccccgtgggacccagacagaccaacaccgtgcaccccaagcccctgactgcgcatccaggtcttccgctcctgagcaacgggaacaagtcggtcgtgacccctctccggccgataggcagggaggaaccggagaaggtggtcacgggggcaggcgaagcaatgacgggaggcagcctgatgtctcctcccggaccagaagagcgggacctccaccaacgaccgctggtgcagcccttgcacgtcttccaacaccgggggggccaggtttagccttcttactcgctagcgcctttctcgactccccctcttggcagagagagcacttggtggaagcaggggccgccgtattgggagccagacgaaggtggctgggacccctcgtacgcagtgtcctgagcggctatcccagaagacctgacggagccccacgcgaactggccagatggattgcagctgagccggtgttctcagatgccgtcggtagggccagagctcgacggagtcccatcagacccgcacgcttcctcgttcaggaggactctgaaagagccgacccacctgagcccgttccacctgacgcagcagtggagagcggacggacctcaggcatcaaagatctcgcttggctagcgagagagctgcgcctgactcctggcgagctggattggttcgccgatacccgccattggaacagaagggcagggtcggccctgcagcactaccgatacgtgtggagggtcaggccagggagagttccccgactgctcgaggtgcccgggataagactgcgaacagtgcagcgccgcgtgctcgatctgctcctagctccgatgcccttacacggtgccgcacacgggttcgttcccggaagatccgctcgtactggagcccgggtccactctggcagtgacgtcgttatcagcctcgatctggtcagtttctttgcccgggtgccccctggccgagtatttggagtgttccgccaggagggctttcccgaagccacagcccatgtgctgaccggcttgtgcacccatgctgtgccagaaagggtattgagggacatgcccgatggcggttccggtcaggaacggtttgacctggcccaggcgttaagggcccctcatctgcctcagggagctccttcttcaccagcccttgcgaatctggctgtgcggcgcctggatagcaggcttgcagggttggctgacgctgcagggggtcgttatactcgctacgccgacgacctggcatttagcggtccgggagccctgactcgaagagctgatgctttcattcgcggcgttgaacggattgtggaggcggaggggcacagtgtgaatcggaggaaaactagggtgcggggagcttccacacgccagacagtgacgggggtggttgtgaacgtacggccaggcgtcgcacgccctgattatgacgccctgaaggccactcttcataactgtgtcgtacgcggtccagagtcacagaggcggggcagagctgatttccgggctcatttggctggccgggtgagctgggttgagtcactagacccgccacggggcaggaagctacgtgaagcatttgatcagatcgtctggtga

SEQ ID NO: 12874 - RNA, 1464 nt, unidentified
  source 1..1464: mol_type = other RNA; note = synthetic construct
atggtcagcgacgagcgtggccatcatagagggtcagacggagctcctggtgctccaggacgtccagcactgatctctagagccacagcccccacatcagccgcctccagagctctggctcgcacaccagatcctgggacagcagggttggccctacttctggcggaggcatttctcgaagcttccgcctggcagagagaggagctggttcgggtgggcgccgagttgttaggtgccaggcggagatggttagggccgctgcttcgaggtgtactaggcggctacccacgtagaccgggtggagcaccgagggagctggcaagatggatcgaagcccagcctgtattcgtggaagctgtttcaaccgcccgggcagctgggaggcctattgttcccgtgcgctacttggtcggtgagcgcgatgggcccagaactccagaggaccctgaggcaagcgaagcagagtgtagggacttggcctggctcgcaagggagcttggcttgcccccaggcgaactggagtggttcgccgacactcgccactggaacagacgggcggggcttctcttgcagcactatcgatatgtatggcggtctaggcccggtcgcgtacctcgattactggaggtgcctggcattcggctcagaactgttcagcggcgagtcctggaccggcatctgttaccaatccccctgcatcccgccgcccatggatttgtgcctggaaggagtgcgcgaagcggagcgactcttcacacggggtctgccgttgtgataaccctggacctcgtctctttttttgctcgcgtgaccccaggaagggtgtttggggttttcaggcaagccggttatccggaggcgacagcccacgtgctgacaggactctgcacccacagtgtacccgaggccgtgctcagggcaatgcccgatggaggcaccgctgaagaacgcttcggcctgacgcaagctctacgcgcccctcacttacctcagggagctcccagttcacccgcccttgctaatctggccgtgcgccgactggatgctcgtcttaccggatgggccgaggctgccggaggtgtttataccagatacgccgatgacctggctttctccggacccgccgaattggcaaggcgagctgacgcgttcgtgagaggggctgatcggatcgtgactgccgaaggccacgctgtgaacccacggaagacacgggtgagggggtcctcggtcaggcagtctgtgactggcatagtcgtcaatgcccgcccaaatgtcgcacggaccgaatacgaagtcctgaaagcaattctgcacaactgcacgctccatggccctgaatcccagagtcggggccaaggcgatttcagaagccacctcgcaggccgcatcgcatgggtgtccagcctgaacgcgctgagagggaagaaactccgcgatgcatttgagcgtattagctggtga

SEQ ID NO: 12875 - RNA, 981 nt, unidentified
  source 1..981: mol_type = other RNA; note = synthetic construct
atggcccgggaactacgcttgacccccggagatctcgactggttcgccgacacgcgccagtggaatagacgcgcggtgccagtgctgcagcattatcgctactcatggagacaacggcccggacgagtacctcggctgttggaggtcccaggtcccagactgcgggtggtccagaggaggctcctcgacagaatcctggctcctctgccattacatcccgccgcccatggatttgtacgggggcgatcagcccttacaggagcggcacttcataccggggcagacgtcgtgatttccctggatctcacggcattcttcgcacacgtggttcctggcaggatttttggcgccctgaggcaggccggatatcctgaggccactgcgcatgtcttgacagggctaaccacacactctgttccagacgctgttctgaggtcgatgccggacggaggtggcccagatgagaggttcgctctccgtagagctctgcgaacagcccacctcccgcaaggtgctccttcatcccccgctttagcaaacctggccgttcggcgccttgacgcaagactgacaggctacgccgaagctgccggcggagtgtacactagatacgccgatgaccttgccttcagcggttccgcagatctggctcgcagggctgatgcgtttgtgcggggtgtgggccggatagtcaccgcagaagggcttgccgtgaacgctcgaaaaactcgtgtccgcggcagcagtgtaagacagtctgtcaccgggatcgttgtgaacgctcaccccaacgtggcccgcactgaatatgataccctgaaggccatcctccacaattgcgcattacacggccctgaaagtcagaggcggggaagggcagagtttagcgatcacttggctgggagaatcgcctgggtgtccgccttgaatgcgagccgtggcgagaagctgcgagacgcatttgagaggatttcttggtga

SEQ ID NO: 12876 - RNA, 1284 nt, unidentified
  source 1..1284: mol_type = other RNA; note = synthetic construct
atggcaaggcttctggctcgcgccttcctggatgcaccaacctggcagcgggaggatctactggctgcgggagctgatctgctcggagccagacgcagatggttggggcccctcgttcgcacggttcttagcggacatccgagaaggccagccggagcaccgcgagaattagcagcctggattgaaagggcccccgcattcgaagaggccgttgccagagctgcggcagctggtactcctttagcgccctcacactttttgctggaggatgcacctgccgatacacatgacctgggagagctggcgagggagttacgactgacccccggggagctcgattggttcgccgatactagatcatggaatcagaggacaccacagccggcccttcggcattatcggcatgcttggcaagtcagacccggcagaacccccaggctcctggagattcccgggatccggttgcggactgtacagcgtcgggtcctcgacagaatacttacaccactccctctgcatggagcggctcatggcttcgtgcctggtcgaagcgccagaactcatgccgccgcccacactggaagcgacgttgtcattgccctcgacctggtgagtttctttgcaagtgtcccaccagggagaatcttcggagtactcaggcgggcgggctaccctgaagctgttgctcacaccctaaccgggttgtgcacccacgccgtgcctgaacgggttctacgcgcgatgcctgatggcggtacacccgaggaacgctctcgtctgacccaggctcttcgtgctcctcacctgccacaaggggcaccatcctccccagccctggctaatctgtccttgcgccgtctggacgctcgccttgaaggttgggctgaggcagccggcgccacatacacaaggtatgccgacgacctcgccttttctggccccgcatcgctagccagacgagctcacgcatttgtgaggggcgtggaacgtattgtaactgccgagggccaccgagtgaacccaccgaagacgcggatcaggggagctagcgtgcgccaacaagtcaccggggtcgtggtgaaccgacaccctaacgtgcccagaaaagagtacgacgccctgaaagcaatactgcacaattgtcgggtgcacggtcccgaatcccaacggcgaggtagggtgcgctttctcgagcatttagcagggcgcatcgcatgggtggcctctctggaccctcagaggggcaggaagttgcaggacgcctttgatgctatcggctggtga

SEQ ID NO: 12877 - RNA, 1374 nt, unidentified
  source 1..1374: mol_type = other RNA; note = synthetic construct
atgaccaacgattataaggccgcccaggtgctggcacatacaccacacccaacccctgcaatcgtcgccactgctctgtctcacgctttcttagccgcacccgactggacagtggaagcgttagttagcgctggcgctgaagtcttgggtgccagaaggcgctggctaggacccctagtacgagccgtggtgtgtgcctaccatcggaagccagcggacgccctccgagagttagctgcacacattggggcctcggagccattcgctgccgcagtagacaaggcccacgaccagaggaaacctctgaggcttgctgcatatgccgtggcagagcctgagctcagagagggaacacaccccgtgcccgaagtagccggactcgagcagcttgccgctgttctgggggtcaaactgggagaactggaatggtttgcagataccagacatctgaatcggcttgcttcccggagttgcctgcagcactatcgttacatgtggagggaacgacccggacgaactccgcgcttgctggagattcccggccttcgcttaagaagcattcagcggaaagtcctgcacggactcctcgccccgataccacttcataatgccgcccatggcttcgtgcctggcaggtcagcttcttcaggcgctgcgctgcatacaggcgcagatgttctgatatccatggatctcttgtcatttttcgcaaatgtgacagctgggaaggtgttcggcgctctgaggcaaagcgggtatccggaagcggtcgcccacaggttgactgggctgtgtactcacatcgtgccccctagggtcatctcatccatgccacctggtgggagtgcagcagaacgcttcgccttgacccaggcgctccggcttcctcacctaccacaaggtgctcccacctccccagcgttagcgaacctagccctgcgccgcctcgacagtagactgcaaggttgggctgaggctgccggcgcaaagtacactagatacgccgacgatctggggtttagcggtggacccgctctggctaggagaaccgagagatttctgcgcggcgcaaagcacatcgccgcagacgaaggacataagctcaatgagagaaaaacaagagtgcgtcctcggagtacgcgccaacaggtcacggggatcgtggttaatcagcacctcaacgcaccccggcgtgagtttgatgcccttaaagccattctccacaactgcatgctgttcggccctgagagccagaaccgagccgatcataccgatttccgcgctcatttgctgggccggattacctggatggagtccctgaactctgcccggagcgttcgattgaggcgtgactttgaccggatctcttggtga

SEQ ID NO: 12878 - RNA, 1467 nt, unidentified
  source 1..1467: mol_type = other RNA; note = synthetic construct
atgctgggggctacccagagcgtcttcggagtgaggcatcggtggctgcccgccttagtgcgagaggtgctcgtggtgtttcgcacagcgcccgttgatgcacctcgggaactcgccgccgttatccgtaggtccgccgctttgacaggagccctgagccgtgcaggcgaaagaggcagacccctggccatcgcacactatcccgtgggggaagccgaacaccctgaacccgcaccagctgctgagccagctagagcatccgcctctgctagtgcttctgctcccgaacccgccagggcttctgctagcgcagctgaacctccaccagctccctccgcagccgaaccagcaccagctctgtcaggagcggaacctgcacctgcagcgagtgcgctggtcccagtacccccacctgctttggctctcccgctcgagcctcctttgccacctcctatgccgttaccccgcacgctgcccgctttagcagcacttctggatgtgactgcaggcgagctggactggctcgcggacactggaggttggaatcgaagggccagggagggccccttacatcactacaggtacgaatggagaactagaccaggccgcgttcccagactcctggaggtccctaacgagcggatgcgcacagctcagcgcacactcctcgctgaagtcctggggggacttccgctgcacgatgcagcccatggcttcgttcttggaaggagcgccctgacagccgccggactacacacagggacggatgtggtgattactttggatctggttacgttttttacaagggtcaccgccgggcgggtatatggaaccctaaggcaggaaggcgttccagagcgggtagccctcgctttgaccggcatcgccaccaatcgggtaccccccagagtcattggagccatgccaccgggtggtgacccaggtgagcgtttcgcgttgagacaggcccttgcgactgctcatctgccgcaaggcgctcctacctcccctatgctggcgaacctggccatacgccgcttggactcgaggcttgctgggtttgcacttgccgccgatgcccgctatacccgatacgcagatgacctgaccttctctggtcctctgcctctaagacgccgggccgatgcgtttctgcgaggtgttacccggattgtggtggacgagggccataccgtgaatcgacgcaagacacgggtccgtccagcagccaccagtcaacgggtcactggcatcgtggtgaacgagaggactgccctcccgagagctgagttcgaccgcctgaaggcaattcttcacaactgtgccgagcacggcgccgcctcacagaatagagccgggctggaggactttcgtgcacacctcctagggcggatatcatgggcccgagccttgaaccccgtgaaagccgagagactgcagcgggagttcgacaggatcgtgtggtga

SEQ ID NO: 12879 - RNA, 1599 nt, unidentified
  source 1..1599: mol_type = other RNA; note = synthetic construct
atgcgatggtccgccgacgaagtggacggaagccgaagggatccaccatcacctgggccaccaagggggacccaaaccgattctggaacttctccccaggcatcccatcggacaagtagcggcagaacgcctgcccagacgcataggagctcagccggacataggtctactatccgtgctccaagacctactgccgcggcagccgtccttgctagaaggccaaccgctagcgccggtcaggttgcgacagctctggcactggccctgttagcagccgctgattggacaccggagggtatgcttgccgttctgcagtccgtattcggcaggaggcacaggttccttccggtcctagtccgcgaggtgcgtgcagtgtacagaacagctccacaggatgccccaagggaactcgccgccgtgattagacagtcggctgccctgaccgacgcactggatagagctcgggcggctggcagacccttggctatcgttcatcaccccgtgagccctggatcggaggatcaccgggagagcgcattgccacacgctcctgccgctctgtctgctccagctcccagtactgccgcgcctccacctaggaccttaaccgagctcgcggctctcctggatgtcactcccggagagctagactggctggccgacaccggtgggtggaataggcgtgctcctgccggccctctccatcactaccggtacgaatggcgaagtaggcccgggcgcgtacctagactcctggaagtgcccacagaaaggatgcgcgcagcccagcggatcctccttcacgaggttttcgccctccttcccctgcatggtgccgcacatgggttcgtgcccggaaggagcgcattaactgcagcgcgtctccacacagggcgcgatgtggtcatagcacttgacctggtaaccttttttacccgcgtgaccgctggacgcgtttatggcgcattacggcaagaaggtacccctgaacgcatcgcactggccctgaccggcttagccacaaatcgggtgccggctagagtcattggcgcaatgccgcctggcggtgaccctgatgagcggttcgctctccggcaagcccttgcagcagctcatctaccccagggggccccaacatctcctgcgttggccaacctggccattcgccgcgtggactcccgattggccggatatgcagaagccgcagatgccgtatacacacggtatgccgacgaccttactttcagtgggcccgttgccctgggaagacgagctgacgcttttatacgcggcgtcactcggattgtggaggatgagggccacctggtgaaccgacagaagacgcgcgtcagacccgcagcgacttcccagagagtcaccggaatcgtggtgaatgagcacacggctctccccagagtggaatttgatcggttgaaggccattctacacaactgcgcggagcggggccccgaatcacaaaatcacgacgggcactccgactttcgagcccatctgctgggccgattgtcatgggcccgcgacctgaacccgtctaaaacagagagattggaacgtgagtttgcacggatcagatggtga

SEQ ID NO: 12880 - RNA, 1599 nt, unidentified
  source 1..1599: mol_type = other RNA; note = synthetic construct
ccgacaccagcaagcctggctgccgcaggtgtgccttccccttcatctgcacgagccgctccggtgagcccaggaagtggagtcttagcccgcagacccgtctccacgcccgatacagtagcgaccgccctcgctcttgcattattggccgagggcgagtgggcaggggaaaggatgatagcccgggccgcaactgtctttggcgttcgccaccggtggctacccagactggttagggaactcctggccgtgtatagacaggcacccgaaggatctccaagggaactcgcggctgtaatacgacggaccgcgtcattcacagccgcgctcgaacacgcaacggaagttggaagacctttgaccattgtatcgtatcccgtggctgctgacggcccacccaggttaagtcccgctctgtctcctcctagtgccgccgttgacggcattccccttgtcgccgccagtaacccacgcgatccgaggcacggtactgcaccagccgccttggctacagctgcaggacccgcagcactcgctacagcaactggcccggcagcactcacaccagctgctccaccccgagggctagctggacttcgcaccctggccgacctggctgaactgttgggcgtgacaccaggcgagttggattggctggcggacgtgggggcatggaatcgcagagcaagccccgggcctctgcatcattaccgctacgaatggagagcaagaccagggagggtccctcggcttctggaggtaccttcagcgcgcatgcgttctgctcagcgcacgctgctgcatgacgtgtttgccctgctcccgctgaatgacgctgcccacggctttgttcccggaaggtccgcagttactgcggctcggctgcatactggtgcggctgtggtggtgacgctggacctaaccacctttttcgccacagtgaccgccggcaggatcttcggggccttaagacaagccggggcaggcgaaagggtggctttagccctgaccgggatcgctaccaatcgggtcccccctcgcgtgatcactgccatgcctccagggggtgacccagatgaacgagccgccctacgacgtgccttagcagctgcccatcttccacagggaggccccagctcccctgcacttgctaacctggctctgcgacgcctcgatagcagactggctggatatgccggggctgctggtgccagatacaccaggtacgccgacgacctcactttctcaggcggtacagatctccgaaggcgggcggatgctttcgtcgtggccgtacgtaggattgtggaggaggagaaccacaccgtcaacctgcgcaagactagagttcgtcccgcggccacttcccaacgggtgacaggtatcgtcgtgaacgagcacaccgccctgcctagagcggagttcgatcgtctgaaggccattctccacaattgcgctgagagaggacctgcaagcgagaatcgggccggccacgacgattttcgcgcccatctgcttggccggttgacctgggcccggtctttgaaccctgccaaagccgagaggctccagcgggagtttgatcggatcgcctggtga

SEQ ID NO: 12881 - RNA, 1599 nt, unidentified
  source 1..1599: mol_type = other RNA; note = synthetic construct
atgagatggagcgccgacgaggtggacggctctgatgctgacccctcatcaccggggctaccccgaggtacacagatcgattcagggactaccagtcaggcgcctctgagaacaccctctggacgtgccccagcccttcagcacaggtccagtgcaggccatagaacaccccctccccccacaccagcaacacctgcatctgctgtgctggcaagaagaccgcaaccgagcgctgaggccgtcgcaagtgcgttggcgttggtcctgttggctccaccggctgcaccagactggacaccaacggggatgctgtccgccctgcagggagtgtttggcgctagacatcggtggctgcccgcccttgttcgggaagtgcgcagcgtctacaggactcctcctcaggatgctccgcgcgaacttgccgccattattcggcacagccagccattcctggatgcggttggaagagccgaggcccgtggtagaccattagcagtcctgagatatcctatcacggccgaagcacccgctcaacctccagttgctccagggccaacccctgccactcctggtcctatacccgccactccagctgcgttagctgccttgctcggtgtgactcccggcgagctcgactggttggctgacgtgcgggcctacaatcggcgtgctagacccggtgccctccacctataccgatacgaatggaggttaagacctgggcgctgtcctcgcctgctcgaagtacccacggaaaggatgcgccgagtacaaaggaccctgctgcacgaggttctggccctactccctgtgcatcatgcggcacacggatttgtaactggtaggtccgccctaaccggagcacgggtgcattctggctcagccgtagtgatctccctggatttgacaaccttcttcgcccgagtaaccgcagcgggcgtttatggctccttacggcgggcagggttttctgaggccgtcgcaaccacgattactgggctgaccacaaacagggtgccccctagagttatctccgcaatgcccccaggaggaggaccggatgagagattcgctctccgtcaggccctcgctaccgctcaccttccccaaggagcgccaacttcccctgccctcgccaacggagccattcgacggcttgacgctcggctggagggatatgccgcagcagtcggggctaggtacacaaggtacgccgacgacctggtgtttagtggccccgttgcacttcagcgcagggcagaggcctttgtccgcggtgtcacacgcctggtggacgatgaggggcacgaagtgaaccccaggaagtcgcgggtgtctccagcctccacttcacagcgagtcaccggcattgtggtgaataccggcagtagcttgccccgggaggagttcgaccgactgaaggccctcctccataattgcgctaccctgggcccagcttcgcagaaccgtgctggagtgcctgattttagggcccacctgcttggccgcataagctatagcagcagcgtgaaccctctcaaaaccaggcgcctgatcagagaattcaattctatcgattggggggtcccacgcgaatga

SEQ ID NO: 12882 - RNA, 1686 nt, unidentified
  source 1..1686: mol_type = other RNA; note = synthetic construct
atgcccgctgatgcctcgagacggactgctcacggcaggctgaatcgaagcattgcgccccccaggtgcagaaggtccggatcattcagcagacggattgtgatgggcagacctgccggccatactccagcaccctccttggcagccgtagccgattctctagctgccgcctttttggctgccgcccacccaaaaccagcgagagacagagatcctgctcaaggaagtgatcccacaggtgatcgggaagcagcgagtggtcccgccccaacacagaaccaggacgctccacaggggcaggactccacacagggcacagacctgactggagacagggatcccgcgtttaccatcgcctggacaaggtctgtgctgatcgcggctggggctgatgttctgggagcacgtcgcaggtggttgccaggcctggtgtcagccgtgttggctgcctaccccagagctccatttgaccgtcctcgcgaacttgggcgctggatcgcccaatctgccgagctcactgcagctgcagaacaagcagctgccgctggccggcaccttgtactggtcagacatgccctctatgagattcccgcagcacatggagctggggctgctggagagaggcctgcttcatctggcgcagaggtcttagctcgtgagcctgccagcaggaggccacgaacacctgcagacttggcccggctgcttggtctagacgcaggcgagctggactggtttgctgacctccgcgggtggaatcgcttagccccaggcaccaagctccaccattatcggtatgagtggcgaagtagaccgggacgagtgccacgcctgcttgaggtccctggtcagcgactgatgtacctccagcggcagctgatcgcagaggtgtacacggatctgccagtgcacccggctgcacatgggttcgtttcagggagaagcgctatcacgggagcggccgtacatgcaggcagtcacgtggtgatcggcatggacctcaccacctttttcgcccgggtcacccgcggacagatacatgccggtctgtgcaggcaaggttggggcgaagccctggtccccatcttggcaggcttagggactcatgccgttccgcccgccgtaattcgcgccatgcctccaggaggagatccgggagagcgacaggccttagccgctgctctgcggattccacacctacctcagggggcacctaccagccccctgcttgcaaacctcgcaatgcaccgcctggacgagagattgacaggctgggccaatgccgttggcgcgaggtacaccaggtacgccgatgacttaaccttctccggcgatacccggctggccgctagatctgatgcgttcatacggggggtggaagcaatcgtgacagactccgggcagagaatcaaccctaggaagactcgggtccgccctaggggaactagccaacgggtgacggggattgtggttaacgagcaccctgccatggatcgacacgcctatgaccgactgcgtgctattctccacaactgtgcgcgcaccggtcccgaagcacagaatcgggatcgccatccccacttcagactgcacctcctcggcaggataaattgggccatcgcccttacccccgaaagagccccgggtctttggcgtctatgggacgcgatagaatggactgactga

SEQ ID NO: 12883 - RNA, 1437 nt, unidentified
  source 1..1437: mol_type = other RNA; note = synthetic construct
atgacccccaatccagggcacaccccagcaccctccataagagctgtggcagactctctcgcttccgccttcctggatgcagcacgagtgccccttgacccgggatcaggaggcgaggttttaggccatggagccgccgctcgggaacatggatggaatcgacctgtgctcattgctgccggggcttcagtgcttggggcacgaagaaggtggttgagtcccctagtgcgggcggtcctcgatgcctatcctcgagccccttttgatcgcccccgtgagctggccgcttggattgaggcctccgctgtgcttggagacgcctgtgcggctgctaccgctagaggtcagcacctggttctggtgcggcacgccgtatatgaaccagtaggggcagcaagcccgcttcccgcaacaccagctgaactcgccgggctgttgggcttggacatcggcgaactcgcgtggttcgccgatcagcgcggatggaatagacgggctggttccgcccggctgcaacactaccgttacgagtggcgcgcaagacctggaagggtcccgagattgctggaggttccaggccagcgcctgatgagactgcagcgccagctcgttcacgaggtgctgacggcacttcctatccaccccgccgctcatgggtttgtcccaggcaggtctgcaagaacgggcgctgccgtccatgctggtagtcacgtggtgatcggcatggatctcacaacttttttcgcccgcgtgggcaggtcagaaattaccgcggcattgaggagggcaggatggggagaggcggtagctcctgtcctggcagctctggctactcatgcggtgcccgaggccgtcatcagagccatgccacccggtggcaaccctgaagaacgctttgccttagcccaagcactcagactccctcatcttccccagggggccccaactagccctatgttggccaatctggctatgcgtcgcctcgacgacagactgcttggttgggcagctgccgtgggagctcgttacacccggtatgccgacgatctgacctttagtggagatcagcgcctagcggcccgaagcgatgctttcattcggggcgtgagcgggatcgttgcggattgcggtcagcgggtgaacgaaaggaagacaagggttcggccccgcggtacaagtcagcgagtcacaggaattgtcgtaaacgcccacccagccgtcgaccggaggtcttatgacgccctgagggccccactgcataattgcgcacgcactgggcctgcagcccaaaacagggaaaacctgccatacttcagagagcacctgagggggcgaatagactgggtggtgtcgctgactcccaaaagggagcctgccttacggcggctatgggaggccatcgagtgggaagagccgggctctgcgcccttacgttga

SEQ ID NO: 12884 - RNA, 1326 nt, unidentified
  source 1..1326: mol_type = other RNA; note = synthetic construct
atgatctcgtccgccctcgcccacggattcttggctgcttccacagaagcagactgggctcgggcaccactgattgccgcaggatctgctgtattaggcgcccgtcgacgatggctccccgctttagtagatgacgtgctgcgcgcgtttccacgtccacctttgcgtggcctgcgggagttgcgagagtggattgctagcgctccagggcccatagccgccgttgaagcggcagctgagaggggacgccctcttagacttgcaagacacccagtgtaccacgaacctggggctgcacctggaggaatgcctgccaaccccgctgagctagctgccctgtgcagcatcgctcccggccaattggagtggtttgctgacaccaggctctggaacagacgcctgagtggcgaccaacaccggctggagcattaccgctatcggtggttggaacgacccggtcgggttcctcgcttactcgagattcctggcgagaggctgcgcgcagtgcaacgaagcgtgcttgattgtgtgctggcagagctgccagtacacccagccgcgcacggtttcgttccaggtcgcgatgcaaggagtggagcggccgcacatactggcagggacgtcgtgatagggctggatctgaggacgtttttcgctagggtcggctaccctcagatcctgagagtgctgagagcagccgggcacacggaggcagttgccacacttatcgccgggttatctactcatgcggtgccgcctaggattctccgcgaaatgcccccgggaggatccccagaggaaagattcgctctccgtcgggctttggcagcgaggcatcttccccagggagctccaacttcacccgccctagccaacctggtcagtgccggtctggatcggagactcgcaggctgggcccagaagtttggggcgacctatacacgatatgccgatgatctgaccttctctggggacagagccctacggtcaagggccacccgttttattcgcggcgtcgacctcattatcgccgaggaagggcatgccctgaaccccagaaaaaccagagtgcagccggcagcgatcagccagcgagtgacaggcatcgtcgtgaataggcatccgaatctgccccggcgggaatacgatctgctcagggctatacttcacaattgcgccttgcacgggcccgcatcccagaatagagccggccaccccgactttcgcgctcatctgcggggtagaattggctgggctgccgcacttaaccctgatcgcgaagctgccctcactgccgccttcaataggatcgactgggaccggtga

SEQ ID NO: 12885 - RNA, 1506 nt, unidentified
  source 1..1506: mol_type = other RNA; note = synthetic construct
atgcccgattcatgcacagctggggcttccctgaggagcgctcagcagagaacaagaactgactcacaggtgataggtgagacaattgccgctctgacaacacaacacggcccagagcacgcggaacccactactgccagcgtgacagccgcgtctgcaaccctaaagcgtactcctcgaccttcgtctagtaccattgccagcactctggctcaagccttcctcggatctcccgactggtcaaagcccggattagtagacgcaggggcccacgttcttggagccagacggcgttggctgggccctttggcagcacacgttctgcgcggctacccaagaccaccggtagatgcccctcgggaactcgccgcagttgtgctgcaatgtgaacctttccttgacgccttagcaaaggctgcccagcagcggaaaccaatccgactcgccaattacgtgttagcgtccgccgtcgcgagggagaatttggtgcagggggcgcccagaatcgatacgctcgccgatctggccgccttgttacacgtgaactgcggcgaactcgaatggttcgccgatacaaagcactggaacagacgggcaggtggcactctggctcactatcgctacgaatggcgcaccaggccaggtaggctgccgagattgctagagatacctgccccccgtctgcgcagcattcaacggacggtgctgcgcgagttgctctacccgcttgagctacacgacgcggcacatggcttcgttcctggccgtagtgccgtaaccggtgccgcacagcataccggcagggatgtggtggtcaacctggatcttgtgagtttctttgctaaggtcaccgctgggagggtgtttgggaccctcaggcagtccggcttcaccgaagctgtggcccatagactgacaggtatcgcgacccatgtggtccccccacgcgtactgtctctgatgccaccaggaggtgacccagccgagagatttgctctaaggcaggcactttctctgccccatctgccccagggggctcctacttcacctatgctggcaaacctgagtctccggagactcgatgcacgcttggctggactggtcgagaaatttgatgggggctatacccggtatgccgatgaccttgcattttccggagggagagatatggcccgacgcgctgacgcttttgtccgagcagctaccgtcatcgtcaaggacgaaggacatagcgtgaatcggttgaaaacgagagtgaggccagccggcgttaggcagtccgtaactaatgtggtcgttaatgagcgcacaaatgtgccgcgggtggacttcgataggcttaaagctacgctgcacaactgtcgcgtccacgggcctgagtcccagaactggaacggccatcccgactttcggggacatttactgggaaggatcagctgggttgccgcactcaatcccgctcgaggagcccgactccgtcaagacttcgaccggattcagtggtga

SEQ ID NO: 12886 - RNA, 1365 nt, unidentified
  source 1..1365: mol_type = other RNA; note = synthetic construct
atgacgagggccgctgcgactttgaagagaacaccgaggcctagctcctcagccatcgcccagacactcgcccaggctttcctggcgagccctcagtggactaaagcggagttggtcgctgctggggctcatgcacttggggctcgaagacgttggcttggacccttagccgcacaagtggttcggggataccctaggccacctctcgatgcacccagggaactcggtgccatgatcggctcctgcgatcccttcatcgaagccaccgcaaaagccctgcagcaaagaaagcctatccttattgcaaattacgtgttagcgccctccgtagcccgcgaaaatcgccacgcaggcgtcccacagataggcacactcggtgagctcgccgagcgtctcaagttgtccggaggcgaattggagtggtttgccgatcctaagcactggaaccgaacagcagctcggaagctgcagcactatcgttatgaatggcgaacaaggccaggccgactgccaaggctcttagaaatacccgccccgcgactaagagcactgcagaggaccgtcctgagagagctgctatacccactggagttacacgacgctgcacacggcttcgttcccgggagatcggccgttactggcgctgcacaccatatgggacgcgatgtggtgctgaacctggatttggtgacgttcttcgcaaaagtgaccgccggtagggtctatggaaccttgcgccaggccgggtacactgaagccgtgtcacaccgcctcgtgggcattgccacccatgtggtgccccccagagtgctagcccaaatgccctcaggaggcgacgctactcaacgatttgctcttcggcagtctctgtcagtccctcacctgcctcaaggggctccaaccagcccaacccttgccaatctgagtctgcggaggctggattctagactggccggcctagctgagaagtttgacgggggctacacacggtatgccgatgatctggcattctccggagggcaggaccttgcacagcacgctgacgcgtttctgcgtgccgccaccctgatcattgaggaccaggagcatagcgttaaccagcagaaaacgagagtgaggcggagtggggtaagacagatggtgacttctgtcgttgtgaacgaacgcacaaatgtcccacgccctgacttcgaccggctcaaggcgatcattcataattgtaggatgcatggtccccagtctcagaaccgcgaggctcgcagcgactttagagctcatctgctcggacggatcagttgggtagcggtacttaacccggcccggggtgcaaaactgttgcaagactttcaccggattcagtggtga

SEQ ID NO: 12887 - RNA, 1515 nt, unidentified
  source 1..1515: mol_type = other RNA; note = synthetic construct
atgcctgacccttgtaccgctggcgctgcgttacggtccgctcaactccgcacccgcacagatagccgggtgatcggagaggcaatcgccgcgatgaccgcacaacccagagcaagagcagcaggcagggccgatcctgcagtggctccagtcactgccgcttctgcaactctcaagcgcacacccaggccgagtcctacagccattgcggcaactcttgctcaggcgttcctgtcctctccagactggtctaaacctgccctcatggagtcaggcgcccaagttctgggcgccagacgacgatggcttggcccattggcggcccaagtcctacggtcacaccccaggcctcctgtagacgccccaagagaattggccgccctggtcctggtcagcgaaccatttgttgaagcactggccaagagtgtgcagcagaggaaaccaattcaccttgcgaggtacgttctcgcagccggagctgcacgcgatagccaggtaaggggggcccctaggattgatactgtcggagcactcgccgcacggttagggttaggggtgggcgaactggactggttcgccgacccacggcattggaacaggcgagctgatgcccggctccagcactaccgttataggtggctggttagacccggcagagtgccgaggctgttggagattcctcgccccagattgcgtttcctccagcgcgccgtactccgcgaactgttgcaccctctgcccctgcatgatgccgctcatggattcgttcccggcagatcagctgtgacaggggctgctcagcacacaggtcgtgccgtggtggtgaacctggacctagcctccttctttgcccacgtgaccgctgggcgagtctttggggtgctgcgacaggctggatttaccgaggccgtggcccatcagctaacgggcttgtgcacccacgtcgttccaccccgaatactggtgcagatgccaccgggtggagatcccgcagacaggcttgccctcagacaggcgctttcccttccccatctcccccagggagctcccactagtcccacactggccaatctgtccttaagacgcctagatagccggctggctgggctcgctgagaagtttgatgggggttacacacggtatgctgacgacttagccttcagcggcggtcgggacatgctgagaagagcagatgcgctcgtacgggctgccggcactatcgtggaggacgagggccaccgcctgaataggctgaagagcagggttagaccggcaggaacgcgccaagccgtcacctctgtggtagtgaacgagcggaccaatcttgcccgcgatgattttgaccgtttgaaagccataatccacaattgccgcgtgcatgggccagaatcgcagaaccgagactccgtcccagagttcagatcacatctgctgggtcggatcagctggctgagttctctgaaccctgctaggggagcacgtttgcggcaggctttcgaccttatcacctggtga

SEQ ID NO: 12888 - RNA, 1602 nt, unidentified
  source 1..1602: mol_type = other RNA; note = synthetic construct
atggtagtttcaggggataccgtggtaagtgtcagcatgggtgcatgtgatgggttctccgatgaggccggcagtgtgtttcggaggccttccctaccgggggtcactcctggtcacgcagtgctgcctgacccttgcacttccgacgcatcgctgagatccgctcagctcgggaatcgcaccgattcacaggttattggcgaaacgattgcggtactcaatcccaacatcgcccatattactcctgcctccgcaacactgaaaaggactccacgaccctcgaccctcgccgtgacagagacactcgcccaggctttcctagccgcaccacagtggaataaagccgccctcatggcggcaggcgctcatgttcttggagcccgcaggcggtggttaggcccattagtgtccgatgtgctgcgtgggtaccttcgcgcacctgtagatgcccccagagaactggccgcgcgaatccatcatgccgagcccttcgtggaggcgttggctaaggcagcccaacagagaaaacccattcgactggcgcactatgtcctcgctcccgctgttgccagggagaatgcccctagacagactcctagaataaacaatttgggcgacttagcgcatctcctggaactgacacccggcgaactggagtggttcgcagacacccgtcactggaacaggatggccactcgcaagcttcaacattatcgctacgagtggagggtcagaccagggagattgccacgccttcttgaggtgcccgctcctaggctaagagctatccagcggattatccttcataagctgctgtacctcatcgaactgcacgatgcagctcacggttttgtcccaggacggagcgctgttactggagccgcccagcacaccgggcaagaagtcgtgatgaacctggacctggtgtctttcttcgctaaggttaccgccggaaaagtcttcggagccctgagaaaggctggttttccagaagccgtcgcacatcggctagccggcatatgtacgcaccgagttcccccccgtatcctcgccttaatgcccccaggcggagatccagctgaaagatttgcccttcgccaggccctgtctctgccacacttgccccaaggctcaccgacaagcccgatgctggctaacctgagtgtgaggcggctcgactctcgcctggcaggattgtctgagaagtttgacggagtgtacacccggtatgcagacgatcttgcttttagtggcgggaaagatctcgccagacgcgctgacgcttttgtggctgccgtgaccgcgattgtgcgggacgatggtcacaggatcaaccgcctgaaaacccgtgtccggcctgcaagcgtcaggcagagcgttacgagcgtggtagtgaatcaaaggacaaacccagctaggtcagatgtggaccggttgaaggccatactccacaactgccgaacacgaggccccgagtctcagaattgggacggtcaccctgacttcagaggccatctgctgggaaggattagctgggtggcaaccttgaatccggagcggggggcaaagttactgcgggagttccaccgtatccagtggtga

SEQ ID NO: 12889 - RNA, 1386 nt, unidentified
  source 1..1386: mol_type = other RNA; note = synthetic construct
atgacaggcagtcagaagcccgtgacacctgcttcctcagtcctcagtcgcacccctaggcctacagattcagctgtggcggcaacgttggctcaggcatttctgaacagctcccgctggacctccgccggactgattgaagcgggggcacaagtcttaggcgccagacggcgctggttgggtccagttgtgactctggtgcttcgttcatacccacgccctccagtggatgcaccgcgagaactgggcgccatgatcctgggttgcgaaccctttgcccaagcgcgggccaaagctgccgttcagcggaagccactgaggctggctcattatgtactggaacctatggtagctcgtgagaacgggcagccaagagtcccgcgccttgacactcttgcagacctggctgccatgctggagctgacaggaggtgaactggagtggtttgccgatccccagcagtggaacagactagccgtccccgcacttcagcactatcgatacgtctggaggagacgacctggcagattgcctcggctactcgagatacctgccccacggctcagagggatccagaggactgtgctgagggatctcctgtaccccctggagattcatgacgcagcacacgggttcgtgccaggaaggtctgcagtgacgggtgctacacgccacaccgggcaggatcttgttttgaccctcgacctcgtgaccttttttgcacgcgtgactgctgggaaggtcttcggggtgttacgacgcgcaggctacacagaggccgttgcccacaggttggtgggactgtgtacgcatgtagtgccccctagagtgttgagcgctatgccacccggtggatctcccaccgaacgtttcgctctccgacaagccctgtcacagccccacttaccgcagggagccccttctagtccggtcttagccaatctgagcctcagacgactggatgctagactaaccggcctagcggacagcttcgaagctgtttataccaggtatgccgatgacctggccttcagcggcggcaaaaagttggcccggagatctgcggcttttattcggttcgcgacagtaaccatcggagaggagggccacggcgtgaaccaacccaagagtcgcctgagaaccgccggtgaacggcaacaggtgacatccgtggttgtcaatgagagaactaatgccgtcaggtccgagtttgatcggcttaaagcaactctccataactgctggactcacggcccagatagccagaatagggacaggcatgccgacttccgggcacacctgttgggacggatatcttggatggcctccctcaattcggacaggggggctcgtctccttcgcgacttccagcgtatccagtggtga

SEQ ID NO: 12890 - RNA, 1569 nt, unidentified
  source 1..1569: mol_type = other RNA; note = synthetic construct
atggccccttgcgacgggtttttcgacgaggctggcagtggcttttggagagcgtcccttcccggtgccactccaggctacgcagtgctcccagatcgaagcacctctggggccgcactgagatctgcacaactggggacacgcactgaaagacaggttatcgaggaaaccattgccgccatgactacatcatcgatcccggtgacacccgctagtgccaccctcaagcgcaagccccgaccatcaacttcagccatagcagccacattagctcaggccttcctcaattcccctcagtggagtaaacccgaaattacagtcgccggagcccaggtactcggagcacgtaggagatggctagggccactggctgcccacgtactgctgtcttatcctcgccctccagttgatgcgccaagggaactgacagccacgatccttgcgagcgagccctttatcgaggctgtcgcaaaagcagcctctcagtacaagcccatactgcttgcgtcctacgctctggcacctaccactgctcgagagaaccgtcaggctcgcgttccccggattgacaccctcgctgctttggccgagaagctacatctgacactcggtgaactagagtggttctccgaccctcagcactggaatagaacagccgcccggaaactgcagcattacagatatgtctggaggagcagaccgggccggttaccaaggcttctggagattccgggcctgcgcctgcgaaatatccagaggaccgtgttgactgagctgttataccctttggaattacacgacgctgctcatggattcgtccccggacgaagtgtcgttaccggcgctgcgagacatacagggaaggaggtggtcgtgaacctggacctgactacattctttgcgaaggtgaccgcagggcgggttttcggtaccctgcgtcaagccggcttcacggaatccgtggcccatagactgacgggaatttgcacccacgtggtacctccaaggattttggcccagatgccaccaggaggggatgcagatcaacggttcgccttgcgccgcgccttatcgcaacctcatctcccccagggggcaccctcatctcccgtactcgccaatcttgccttgcggaaactggattcccgcctagctggacttgcggatacatttgacgctggttatactaggtatgctgacgacctgacgttcagcgggggaagggagcttgccagacgggtgaacgcttttatcaggaccgccaccggcatcatcgagaatgaaggccacggcgtgaacaaactcaaaagccgtgtgcgaccggcagcagtgagacaggttgtcaccagcgtcgtggtgaatcagcggaccaatattaaccggctcgacttcgataggctcaaggccactctgcacaactgtcggaggcacggccccgaatctcaaaacagagaagctcacgccgactttcgggcacagcttctgggccgcatcagctgggtgactgctttgaaccctgataggggtgcaaagctcctgcgcgattttcacctgatagcatgggagtga

SEQ ID NO: 12891 - RNA, 1179 nt, unidentified
  source 1..1179: mol_type = other RNA; note = synthetic construct
atgtacccccgtcctccaattgacgctccccgcgaactggctgcaacgattttcctgtcagacccgttcacagaggccgtcgccaaagcagctcaccaacggaaacccctgcgggtggccaactacgctctccttccagccactgcccgggagaatcggcagccaaaaatacccagactggacacactggcctctctggcgggacttctagagttgtcctacggggagctggagtggtttagtgatccacagcactggaataggaaggctgagcgaaaactgcagcactataggtacgaatggagacagcgaccgggacgtttacctagactgctcgagatccctgcacctaggctccgcaatatacagcgcaccgtcctccgggaacttctgtatcccattgagcttcacgacgccgcacatggctttgttcccggtagaagcgctggaacaggcgcggctcaacataccggacaggaggtcgtgattaacctcgacttagtgacttttttcgctaaggtacctgctggtagggttttcgggacattgcggcaggcgggattcaccgagtctgtggcacatcgcctcacagggatctgcacccattccgtaccacctcgagtcttgtctcttatgccaccaggcggcaacttaacggaaaggttcgcactgagacaggctctcgcccgacctcatttaccccaaggggccccgacaagtccaatggtggccaacctgagtctaagaagactggatagccgcctatctggccttgccgaaaagtttgacgcccgttacactcggtatgccgacgatctggcctttagcggagggaatgagctggcccgtaggacctccgcctttattcgcaccgcgatctcaatcatcgaagcagaaggccacgaagccaacaggttgaaaacccgggtgaggcccgcctccgttaggcaattggtgacctcagtcgttgtaaacaagcacactaatgtgactcgatccgacttcgatagattgaaggcaatcctccataattgtctgagcttcgggcccgaatcgcagaacagagaggcgcacgcagattttcgcggctatctgctcggccatgtgagctgggtggctgctctcaatcctgatcggggtgcaaagctgctgcacgatttccaccgcatccagtggtga

SEQ ID NO: 12892 - RNA, 1416 nt, unidentified
  source 1..1416: mol_type = other RNA; note = synthetic construct
atgaccacccccacacccggagctgctgtgcttgcacggacacccaatccgagcccgcggaatgtgagcacagcactggcttatgcttttcttgcagcccccacctggagtgaagctgagctggccgccgcaacaacttacgtcgtaggcaaacgaggaggcacaagaagcgccaagtggcacacccaactcgcaagtagcgttctgcgcgcctaccccaggccaccattacgtgagccgaggcagctcgcagtgttcattgccggcgctaaaccattctatctggccgttgatagggcgacccgactccacgccaccctaaccattgctcattatgtgcttccccccactaacgtcgccgagctgaagtctcctctggaagaaagatccctgatacctcagacactggcagagctcgccggcgtgctcgatctgacagtcggggaactggactggttcgcagaccctctccagtggaataggaccgcccggaataagagactggtccactacaggcatcagtggcgtttgcggcctggacgcactcctaggctactcgaaattccagctccacgcttgcgtgagatccagcggtccgtgttaagagaattgctgtcccccctgcctctgcatgatgccgctcatggctttactcccgggagaagcccagccactaacgcggctcatcacacaggcagaaacgttgtagtgaatgtcgacctcactaccttttttgctcgcgtcacggccggcaaagtcttcgggatacttcgccaagccggatttccagagacagtagcccataggctagcgggactgtgcacccacaccgtgcccttaggagttatcgctgagatgccccagggaggtggcgcttcagggagattcgcctttcgacaggcactggccacaccgcacttacctcagggggcacctaccagtccagccctggcaaacctgtcactgcgcagactggacagcagattggcagggcttgcggcttctttcgatgctgactatactaggtacgcggatgacttggccttctctgggggaccaggtttttctcaccgctcactcgccttcgtgagtttggttcacaaaatcgtggaacaggagggtcatacggtcaatgacgccaagacgcgggtgagaggctcaggggtgcaacagcgggtcactggcgtggtggtgaacgctcacacgaacgtgtcgcgagcagagtttgaccggcttaaggccatcttgcacaactgtgcggttcacggccctgctgggcagaaccgttgtggtcctcaaggatccgaacactccgatttcaggggccatctccagggtcgcattgcctgggtacggcatcttaatccagcgagggcagccaagctggagcgaatcttcgccgcaattatctggtga

SEQ ID NO: 12893 - RNA, 1371 nt, unidentified
  source 1..1371: mol_type = other RNA; note = synthetic construct
atgaagccatcgcagcccactgccgctgccagtgtgttggtgcggattcctcacccctcagcaaacaccgtggctacagccctcgcccacgcattcctcgctgcaggagattggtcaaagcccgcactaacagcggcaggggccgatattttaggcgcccggcggagatggttaggcccacttgcttctcacgtactcagaaactaccatcgaccacccgctgatgctccccgtgagctggcagctgtcgtccttggatgtcctgcttttggcgaggcgcttgcaaaggcggcaacccagaggcgccctatcaaactggcccacttagccgtggcaccagccgtagcacaagccgctagggttccccggctggatactgtggcagacctcgcggggatgttagccttgaccccgggtgagctggaatggttcgccgaccccagacactggaatagaactgccgggccacggctccagcattattgctaccagtggcgtagtcgaccaggtcgcgtgcccagactgctggaaatacctcagcctagactgaggaccctccaacggacgatcctgcgcgagttactggcccccattcctcttcacgacgcggcccacggatttgttcctggtcggagcgctgtttccggagccgctatgcacacaggcgccgatgtcgtggtcagcctggacctcgccgccttctttgcgcatgtctcaccgggaaaggtatttggtgtgctgcgccaggcgggctttacggaagctgtggcgcataggctgacaggcctgtgcactcatgcagtgccggtgggggtactggctgagatgccaccaggaggggaccctgctagcaggttcgccctacgccaggcccttgctgttgcccaccttccacagggggcaccgacctctcccatgctggcaaatctcgcactgagacggttggactcccgactatctgggtgggctggcgctttcgacgccgtgtacagccgctatgccgacgacttggctttctctggtggtgccgaactagccagaagggccgacgcctttatacgcggagcagggcgaatcgtggccgatgaagggcacagcctgaatggcctgaagactagagtccataaagctggcgtccggcagaccgtgaccggagttgtggtcaatgagcgtacaaacattgcccgtgcagagttcgatcaattgaaagccgtcgttcacaactgtgccgcgcatggccctgagggccaaaacaggggcggacatcctgatttccgcgcacacctgctcggcaggatcgcatgggtgtcctccgtgcatcccgctagaggggctaggttgcgagccgcttttgatgaaatcagttggtga

SEQ ID NO: 12894 - RNA, 1380 nt, unidentified
  source 1..1380: mol_type = other RNA; note = synthetic construct
atgatacctgcaggacaagctgtggctccagccgcagcggttttagccaggtcctctcgaccaacaccggatgccctcgcgtcggcactgagtcacgcctttctggccgcggatgattggtccaagcccgccctaatgacggccggaacgggaattctcggagccaggcgaagatggcttggccccttggctactcacgtcctgaggtcataccacagacctcccactgacgcacctcgcgaactcgctgccgtggtactggggtctgaagccttcggggaagccctggagaaagctgccagacagagacggcccatcactctggtgagatacgcagctgaaccagctgtcgcccgagctgcacgcgttcctaggttggacaccttggcagaattggctgaggtgctagacctgagcgtaggggagctcgagtggttctcagatcccggtcagtggaaccgcacagcctccagtcgtcgccttcaacattacagatatcagtggaggagcaggccaggcagagtaccccgattactcgagatcccacttcctcgactgcggggccttcagcggacagttttacgggaactcctgtcccccattccgctgcatgacgccgcccatggcttcgttagtggacgttctgctgtcagcggcgccgctcttcatgcaggtaccgaggttgtcgtcaatctggacctggccgccttcttcgctcacgtgtcacctgggagggtctatggggtcctgcggcaggcaggctttacagaggctgtagcccaccgcctgaccggactctgcacacacgcagtgcccgtgggggtcattgctgagatgcccccaggtggtgaacctggcgaccgcttcgctctgcggaaggcactcgcgactgcacatctaccccagggggctcctacagcgcctatgctggctaatttggcactgagaagactggatagccgtttgtcaggttgggccggcgcctttgacgcggtgtatacccggtacgccgatgacctggcttttagtggcgggactgagcttagccgtcgagccgacgcgtttgtaagaggcgcagcaaggatagtggcggacgagggccacagcttaaaccgcctgaaaaccagggtgcatagagccggcgtgcgccaatctgttaccggagtggtggtgaacaccaggaccaacgtggcccggccagagttcgatcggcttaaggcagtgctccacaactgtctgctcctgggtccggaaggacagaatcgggacggccacgatgattttcgggcccatctcttggggcgcatcgcttgggtcacttccgttaatccagacaggggagccaaacttcgcgctgtgttcgatgccatctcttggtga

SEQ ID NO: 12895 - RNA, 1431 nt, unidentified
  source 1..1431: mol_type = other RNA; note = synthetic construct
atgaagcacactccggattctaccagaccggggcctctcgcggattctacccctggaccaacccccgcatcagccgtcttgggccgaacaccacggccctctcccaagacggtggcaactgcgctggcccacgctttcctagccgctgagtcatggtccaaacccgacctggtagaagctggggccactgtcctcggagctcgaaggagatggttaggccccttggccggacacgtgctagctagctacagaaggcctccggccgacgctcctcgagaacttaccgccgtcgtgctggggagcgcaccatttgctgaggccgtagccaaggccgaccttcagtgtaaacccatccgcatcgcgaggtacgctgtcccaccagcagggatgggagaagcagcaggtgtgcctgccggggtaccacgtctagataccctggcggagctagccgcaatccttggcgttgacgctggacggctggagtggtttgctgaccccaagcactggaatcggacgacgggcaatcccaggctgcagcactatcgctaccagtggcggacccgtcaagggagagttccacggcttctggagattccacaccccagactgcgcgccgtccaaaggaccgtgctgagagagctcctggctggcatacctctccatgcttcagctcacggcttcgtccctggcagaagtgccgtaagtggcgccgcaagacacacaggcagggacgttgtgatcaatctggaccttgcagcctttttcgcgcacgtgacccctggtaaggtctatggcgtcctccgggctgcagggtatcctgagagcgttgcccataggctgactggcctttgcacacatgccgtgcctgtgggagtgattgcagaaatgcctcctggagggagtgccgaagatcgcttcgccttaaggcaggctctcaggaaagcgcacttaccccaaggagccccaacttcccccgccttggctaatctcaccttgcggcggctggattctcggctgcagggttgggcgggtggtttcgatgccgtttatacaaggtacgccgacgatttagcatttagcgggggtcctgtactcgctcgtcgagctgacgcctttttgaagggcgctgcacgaattgtcgcagacgagggacatactttgaacgcgacaaaaacacgcgtgcataaggcaggggtgcgtcagtcggtgactggggtggtggtgaaccgccataccaacgtgtcccgccgcgattttgatcgcctgaaagccgttctgcataattgcgtggtccatggcccggatggccagaaccgagacggacaccccgacttcagagcccagctccgtggcaggatcgcatgggttgcctccgtgaacccaggtcggggagcaagactgctggccgatttcacactgatagactggtga

SEQ ID NO: 12896 - RNA, 1440 nt, unidentified
  source 1..1440: mol_type = other RNA; note = synthetic construct
atgggcgcacccttacgctcagctaagcgcggggcccagactgatagactggtgatcatagaagcggtggctgctatgatcccaactctgtctgccgccgtgttggccaggaatccccgtcctacaccccaggctatcgccactgcccttgctcacgcatttttggcagccgaagattggtccaaaccctctctcatcagtgcagccgccagcgtgttaggagcgaggaggaggtggttggggcccctagctgagcacatcctgggcctctatcatagacggccagccgatgcaccacgcgaggtagtagccgtagttctgcacagcgaagccttcgagacagcagtcgagaaagccgcaaaggcaaggaaacccattattgtggcccattatgtagtccaacctgctgttgcccgcgaggcgcgagttcctcacctagatacacttgcggggttagcggggctgttgggccttagcataggagaacttgagtggtttgccgatcctaggcaatggaatcgtaccgccacatccaagcggcttcagcattaccgctatcagtggcggtcacgcccaggcaaagtgccaaggcttctggagattcctcagcctcgcctccgagctctccagaggaccgttctacacgaactgctggcccccatcccccttcataatgccgcacacggctttgtcccgggaagatcagccgtctctggagcaagggctcacacaggagctgaagtggtggttaacttggacctcgccgccttcttcacccacgtcactccgggtaaagttttcggcgtgctgagacaggcaggcttcaccgaggctgtggcccatagactcacgggactctgtactcatgctgttcctgtgggcgtcttagcagaaatgccgccaggcggggatccaaccgacaggttcgcactccggaaggctctcgcactgccacacttgcctcaaggggcacctacctcacccatgctggctaacctggctctgagacgcctggactcccggctcagtggatgggctggtgcgtttgacgcatgctacactcggtacgcagacgatctggcgtttagcggtggtagcgagctggcccgaagagctgatgccttcgtgagaggggctgccaggattgtcgctgacgagggccacagtctcaaccggctgaagacccgggttcacagagccggagtgcgccagtctgtaacgggggtggtggtcaatcagcacacgaacgtcaccagaggtgactacgacgccttgaaggctgtgctgcataactgcgtctccctgggccccgaagggcaaaaccgtgacggccaggcgaatttccgagcccatctgatgggtcgggtggcctgggtgtcctcggtgaatccaggccggggagccacactgcgtgctctatttgagcgaattgtgtggtga

SEQ ID NO: 12897 - RNA, 1383 nt, unidentified
  source 1..1383: mol_type = other RNA; note = synthetic construct
atggcggtggccaccacgggtgcagccacattagcaaggacacctcgcactagcccggctgatctcgctaccgctttggcgcacgcgttcctaggggctgaatcctggtctaaggccgccttggttgcctcagctgccggtagtctgggagccaggagacggtggctgccacctcttgctggccacgtgctagctgcctatcatcgtccccccgccgacgctccaagggaattagccgcggtcgtggggcagtgtgacgcctttcgcgaggctttagccaaatcggctaggcagcgtaagccaatcaggctggcccatctggtcccagtggctggaaaggccagagacagcgccaccgatatcccacggatagatacccttgcggagctcgccggtaggctggagttgtccactggcgaactcgaatggtttgccgaccctgggcagtggaataggtccgcgagaacccccagactgcagcactaccgatacgagtggcgtagtagacccggccgagtgccgagacttctcgagatccctggaacccgtctgcgcgcgatccagagacgcattctgcgcgatttgctccagcccatcccgcttcatgacgcagcccacggctttgttcctggacggagcgcaattacaggggccgcacggcatacgggcaatgaggtggtcataaacctcgatctcagtacattcttcgcgagggtcactccagggaaaatatttggagttctgcgccaagcagggtacgcagaggcagtggcccatcggcttacaggcctctgcacacacgcagtacctgctcgggtattagcagccatgcctgcaggaggggatcccggagagagatttgccgtccggcaggccctggctagagcacatcttccccagggagctccaactagccccctgctggcaaacctggccctgcgtagactcgactctagactggccggctgggctgcagctgtaggagcatcctatacccgctatgcagacgacctggccttttcaggcggtcctgatttggcccgcggtgctgatgctttcatcagaggcgccgctcgaatcgtggccgacgaaggtcacgacctgaacaggcggaaaacacgggtgcgcggtgctgcaacgcgacaaagcgttaccggcgttgtggtcaacgctcacactaatatttctcgaggcgactacgatcggattaaggcaattttgcatcactgcgtgctcgacgggcccggagagcaaaaccggtcaggccacccagatttccaggcctatctgagggggcgaattgcatggatcgaatctctgaatgccgccaggggcgctcaactaagggcggaattcgatcgcattcagtggcagactgcctga

SEQ ID NO: 12898 - RNA, 1365 nt, unidentified
  source 1..1365: mol_type = other RNA; note = synthetic construct
atgagcaacaacggctcagcagtgttagcacggacacctcacgcccttcccatggccctgtccacagcgctggcagatgcatttctcgcagcggaccaatggacagccccggctttagtacaggctggcaaccatacaataggatcgcagcggagatggatccctaccctggccgcccatatcatcgccacatatccacggcgccctctggacgcgcctagagaactcgccgcagtagtcagacgctccaagcccttcgcacgtgccctagcacgtgccagtcgaactggtaagcccctcccccttgccaattactgcctggaccctgcaagtgcgagggagtccccactgggaattcctgttgtcgacaacctgggagtgctctctcagcatttgggcataactcccggcgaactggaatggtttgctgacccaaaacacttcaaccgctccgctgcccccatcttacagcattacaggtatgagtggcacaccaggcctggcagagtgccgaggttactagaggttcctgccccgaggcttcgcactctccagaggacgatcttggccaatctcttgagtccaatccccttgcacagcgccgctcacggctttgttcccggtcgatctgctgttagtggggctgccgcgcacgctggtaatctggttgtgattaatttggacctggcgaccttcttcgcaaaagtgtctgctggacgggtgttcggcgtccttcgccaagccggatatgctgaggccgtcgcacatcggattactggactgtgtacacatagggtgcccgccagaattctgagcaggatgcctgctgggggtgagccaaccgaccgcttcgcactgaggcaggcccttgccctaccgcacttgccacagggggctcctacttcccccatgctggctaacctggctgtgagacgcatggactcaaggctgagcgggtgggccgggaagtttgatgccggctacacaagatacgcggatgatttggctttctcagcagggacaactctcgcccgggggtctgatgatttcatagccggcgtgtctcgtatcgtaaccgatgagggccacagcctgaatccaagaaaaaccagagtccgaggagcaagcctccggcagacggtgaccggtgtggtagttaatgaacaccccaacgtgaccagggcggattttgaccgactgaaggctattctgcataattgcgccgtccttggaccagaactcgccaatcgccaggctcatgccgattttcggtcccacctgcttggccggatcgcatgggtggcctcagtgaacccacgtcgaggggctcaactccgcgcagactttgctagaattgtctggtga

SEQ ID NO: 12899 - RNA, 1344 nt, unidentified
  source 1..1344: mol_type = other RNA; note = synthetic construct
atgctggctcggaccccacatccctctcccgaagctgtctctacggcccttgcggacgcttttctagccgccgaacagtggaacgccgaggcactcgctcgtgcaggcaatcatacttgtgggtcccctcggagatggattaccaccctggctgcccacatcgttgcttcctatcctcgaccacccgtagacgcgcccagggaactggctgctgtcgtcaggcagtccaagccttttacaagagccttggcaagagcctcgaggactggcaagccactgcccctgaagcactatacactggatccagccgtcgccagacatagccccctcgacgtccccgacattgggaacctctcagagctcgcgcgcttgctcggaattacacctggggagttagagtggttcgctgaccccaagcatctgaacaggaacgccgcacctatcttggcgcactacagatatgtgtggcacactaggccgggtcgtgtaccacgcctactggaggtgcctgctccaaggttgcgggccttgcagagggtggtgctgagccaactgctttgccctatcccaccacatcccgctgcacatgggttcgtgcccggtcgatcagctgtcactggcgcaggcgcacacacgggaaagctggtggtggtgaatctcgatctggctaccttcttcgcaaaagttacagccggccgcgttttcggcgtgatgagacaggcagggtacgcagaagcagttgcccatcgtctgacaggtctgtgcactcaccgcgtgcctgcccgagttctctctcagatgccaccgggcggagatcctgctgacagattcgccctgaggcaagctttggctctaccacacttaccgcagggtgcccctacttcccccatgctcgccaatttagccgtgcggcgcatggatagtcgcctggctggatgggcgcgacgctttgatgccgggtatacccggtacgccgatgacctggcatttagcggaggtcgcgacttagcacgaggcgctgatgcatttatagccggcgtgggccggattgtagcggatgaggggcaccggctcaaccacagaaaaaccagagtcagaggagcctctgcaagacagagtgttacaggagtggtagtgaacgctcaccccaacgtgcgtcggaccgacattgaccgccttaaagcgatcctgcacaattgtgccacctacgggcctagcagtcagaatcttgagggacacgccgaatttcaagcccaactgcttggccggatagcctgggtggcaggcgtcaatccgcatcgaggagcccagcttagggccgtctacaggcggatctcatggtga

SEQ ID NO: 12900 - RNA, 1470 nt, unidentified
  source 1..1470: mol_type = other RNA; note = synthetic construct
atgagtacaaatagcactgctacccgccgagccacaagctcaggacttcccaccccctccccagaagggctcgcaactgctttggcccactccttcctggcagccaagtcatggaccgctcaggacctgaaacagagtgcggcggatatccttggggcacggagacgctggttgggtcccttagtgagaggcacgttagccgcctaccataggaggccggacggagcatccagagagctcgccagcttcatagcaacctctgagccattctttgaggcagtgagccgggcccgtaaacagcggaagccaatacgattagcacactacgcaatcttggggcctttgccgccacgtcatgccattgccaatcagcctcagaagacggggaaaattcctagcgtgtccggcctcgagggtctggctactatgctcgggctcgagatgggcgagctagaatggtttgctgatatagggggctggaatcgacgcgctactgccggttctggaaccgcaggctttaccagagagactggccggaggtatagacacagtaagttccagcactattcttacatctggcgatcccgggaaggacgcgcaccaagactgctggaggcccctctgccccgacttaaaacgatccagagggcagttctggacacctttctagcgccaattccccttcacccagccgcccatggtttcgttcctgggcgcagtgttgtgactggtgccgccaaacacaccggatcggccgttattattagtgctgatctgtccacctttttcgcccgcgtcacagccggcaaaatctacgacgccctgaggcagtccggctattctgaagctgtggctcacaggctgacaggaatctgcacaaacgccattcccgcctcagtgctgaacgcagtgcctcccggaggagctcccgaagagagacacgcactgaggcaagcgctggcaacccctcacctaccacagggtgccccctcatcacccgcgcttgctaatatcgccatacggaggctggatagccgtctcgctggatgggccagcaagatgaacgccacatatactcggtacgctgatgacctcacgttctcgggcgggcctgaacttgctcgaagagccgacgcctttatggcgggcgtcggtaggatcgtcaaggaccaaggacatacactgaaccatagaaaaactagagtgcggagagctggggtacgccaaaccgtcacaggcgtagtagtgaatcaacacgtcaatactacacggcgtagctatgacatcctcaaggctaccctgcataactgtgtgaggtacgggcctgagagccagaacccggattctcagacatctgctgataacgcccattttcgcgaaaggttggcgggccagatcgcgtgggtcgcatctgtgaatccagcacggggcgctaagctgcgcgctaagttccagcaaatttcctggtga

SEQ ID NO: 12901 - RNA, 1386 nt, unidentified
  source 1..1386: mol_type = other RNA; note = synthetic construct
atgatgcacgcacctcggaggatccagtctgaggggactcgggtccttgccagaaccccccaccccacaacttctggggttgccaccgcagtcgcttttgcctttctcgccgctggtgagtggaccaaagccggtttggttcagagcggtaccgaattgctgggagttaggcgaaggtggctccctagtctggctgctcaggtgctgggctggtacccacggcctcctgtcgatgccgtgagagagttagcagcagttgtcgagggctgtccagcctttattaatgccgtcgatagggccgctcgacagcgggtacccattcgtatagcccgctatgttctcgcgccaggccaggctcgtcaaacacccttccccatccctcgaatttcatccgccggcgatttagcagacttgcttgagttgacaagcggggagctggactggttcgcagatgtcaaacactggaacgggcgagcggagccccggttacaacactaccggtacgtgtggagaactagaagcgggcggactccgagactgctcgaaatcccagcaccccgcctgaggtcactacagcggactgtcttgaggagtattctggcccctgtccctctccacgatgccgctcacggcttcgtttcaggacgttccgccgtgacaggcgctaggctgcatacgggcgcccagatggtgatagctctggacctgaccgctttcttcgcacgcgtcacagctggtaaggtcttcggcatcctccggcaggctggatattctgagagtgtggcacatctattgactggactatgcagccacgtggtacccccccgcgtgctttctagaatgccgcctgggggagccgtggatgagaggtttgcgcttaggcaggccctctccctgccacatcttccacaaggagcaccaacctcccccatgctggccaatctggccgtacgacggctcgactccagattaagtgggtgggcgtcagtggcgggagctgtgtacacgaggtatgccgacgacctgacctttagcggcgggaaagagctggcaggacgtgcagacgctttcgtgcgaggggccgctagaatcgtgggcgaagaaggacatgcactgaacccacgcaagtcgagagtaagggccgccggtgttagacaggtggtgaccggcatcgtggtgaacgaaagaacaaatgtggcccgcagcgaattcgaccgcctgaaggcggttcttcataactgcgtggtacatggtcctgcaggccaaaaccgcgatggccacggcgattttcgcgctcaccttctggggcggatcgcttggctggaagccctcaatccgggtcgtggagcgaggctcagagcagactttgcccgcattcggtggtga

SEQ ID NO: 12902 - RNA, 1356 nt, unidentified
  source 1..1356: mol_type = other RNA; note = synthetic construct
atgaccacaacaactcccggtgccagggtgcttgcgcgaacacctcatccgtcccctgtcgctatcgcgactgctctagcccacgcctttttggcgaccgatgactggtcaaagaacggcctgttggctgccggggcagaggtattaggagcccgcagaagatggctgggacccgtcgctgcagaggtgctcagattctacaggcaaccgcccgttgacgcccctcgtgagttagccgccgtggttgtgctgaacgatgcatttcgggcagctgtggcccgggcaaaaaaaaacggggtcccaatcaggatcgctcacttcgccccaactcctgtgcgtgctcctagaggcttgaacgacctcagtgatctcgcacgactccttcggctcccagccggagagctcgactggtttgcggatacacgccactggaataggagagctcacagcaaaagactccagcactacagatatgagtggcgatccaggcctggaaggatgcccaggctgctggaagtcccacggccaaggttgcgggagttgcagcggacagtgcaccgggaaattttggccggcctgcgtgttcatagcgccgcacacgggttcgtttccggaagaagtgccgctaccggagctagatttcacgagggagcgagggtggtaatcaacctggatctggccactttcttcacccgggtacgcgctggccgagtatacggtatttttcgcagagccggctttgcagaaccggtggcacatgccctcaccgggctctgtacgcattctgttccttctggcatagcaaggaacgctcctgcaggagggactgctggggagtggttcgagcttcgacgcgcccttgtcctaccccacttgccacagggcgcaccctcgtctccagccttagcgaacctggccgtgcgcaggctggatttcaggctggaaggctgggcaaccgctgctggtgcagtgtatactcgctatgccgacgacctggctttctcaggaggggaccaacttgctcgtcgcgccgacgcatttgtccggggtgcaacccggatcatagaagccgaggggcacctggtcaatgcgcacaagacacgtgtgagggggagttcagtgcgacagaccgttacgggcatcgtggtcaatgaacgcgctaatgccagccggcccgagtacgagagactgaaggccattctgcataattgcgtgagacacggccccgagtcccagaataggtctggccatcatgattttcgcgcccatctgctgggcagagtggcttggatggaactgcttaatcccgcccggggtctaaagctgcgcgaaagcttcgaccgaattgaatggtga

SEQ ID NO: 12903 - RNA, 1209 nt, unidentified
  source 1..1209: mol_type = other RNA; note = synthetic construct
cggtggctgcctcgggtagtcgctggggttctagggttctaccatcgaccaccacgggatgcacatcgcgagctcgccgctgtcattgagctaagcgatacttttcgggcggctgtcgagcgtagcgtcgaacagaggcggccgatcagaatcgcgcattatgtggtggggccaggacatggtgcgaagcacgccgtgctcccgctcaatgatctggccgaccttactagacttttgggcttgacccctgaccaactcgactggtttagtgacacacgccactggaaccgccgagcatcatcaggctccctccagcactacagatacgaatggcgcgcgagagccggacgagttccaagactcctggaagttcccaggcctaggctgagagaggtacagaggaaggttctgtctttgatactgagtcggctagctgtccatgacgccgcccatggattcgtgcccggaagaagcgccgcaactggtgctaggccccacgaaggcgcaaaagtactgattaatctcgatctgagcaccttcttcaccagagtgactgctggcagggtctacggcgtgctgcgacaagagggatttcctgaggcagtggcccacacaataacagggctgtgcacccactccgttccacctcggcttgtgacggctgccccctctggtggtcgcttagacgaacggttcgttctcaggcaggctctggctgtgccacatcttcctcagggcgccccctcctcacctatgttggccaacttagcggtgcgtcgattggaccggagacttacggggtgggccgaagcagcaggagcagtctataccaggtatgccgatgatctggcttttagtggcggggatgatctgacaaggcgggccggagcttttatccgtggggtgcggagaatcgtcgaggacgagggccactttgtgaatgcacgcaaaacccgcgtgtctggctggtccgtaaggcagtcggtgacaggcatcgtggtgaacgagcatactaatgtcacccgctctgaattcgaccgcttgaaggccgtactgcacaattgtgttctgcacggtcccggaagccagaacagatcagggcaccacgacttccgatcccacctccttggcaggattgcttgggtggcaatgttaaaccccgccagaggagccaaactgcgtgagacattcgataggattctgtggtga

SEQ ID NO: 12904 - RNA, 1389 nt, unidentified
  source 1..1389: mol_type = other RNA; note = synthetic construct
atgttggccgctccagcatggaccgaggctgccttggttgccgcttgtgccgctgctctaggacccgcagcggaactgtccaccaccttccatcacgatgccgacccgggcgatggtgggttaagagatgacggaagccgggacgacggtccacatgacgatggccctccccacccttggctacctggtcttgcgcacgaggccttgcgcgcatttcccagggctccccacgacgagccaagactgctggccgaggtgctccacactagtggtgccctcggacgcggtagagcacgtgctgcagcccagggtgcatctctgaggatagttcgcgtggccgtggtgactactccaacgcgagctgccgatcctcgtctccgcagactagggtccgttgccgacctggccgcattactgcacctgacagtcggcgagctggactggttcgcagacgtccggcattggaatcgacggcacgcctctgggcctcttcagcaccacaggtacgaatggaggaccagacccggcaggacgccaagactcctggaggtccctggccatagactgcgcgacctgcagcgcgtggctttggatgaagttctcgccgccgtccctctgcatgacgcagctcacgggttcgttccggggcgttctgctgtaacaggcgccgctgtgcataccggagcggaagtcgtggtggctctggatctgagaagcttttttgcacgcgtgggagcaggacgcgtgtatggcgctctgcggagggaaggcttgccagaggccgttgcgcatgtcctaactgggctgaccacaacaagcgtacccccggccgtacttagcgccatgccaccaggcggcgatccttcagagagggccgctctcaggagggcacttgcgcttcctcatttggctcaaggagcgcccacaagtccggcactcgccaacgttgcctcacgacggctcgattccaggttagctggatgggcggcagcggcaggtgcaagatacactcgctatgccgacgatctcacattttcggggggacccggagtagccgcaagatcagatgccttcgtcaggggagtaggccgtgtggtggccgacgaagggcacgaactgaatccacacaaaacccgagtgcgaggggctgctacgcggcaaactgtgaccgggatcgtcgtgaacgagcacgtgaccgtcactcggacaagttacgatgcgctgcgggctcttctccacaatgccgaacggaccggccttgaggcccaaaaccgggctggtgtgcccgagttcagagcccatctggagggccggattggctgggttgagcagttacatcccgccaggggggcccgtttgagagaactgctggcacgagtgcctcgctga

SEQ ID NO: 12905 - RNA, 1374 nt, unidentified
  source 1..1374: mol_type = other RNA; note = synthetic construct
atgacaggagctcccgacgctgtggcaagaggtctggcactcgcgctccttgctgtggctgacgccgattggaccgaacccggactcgtcaccgctgcttcggatgccctgggactggagccaggcgatgtggacgctcgatggctgcccggtttggcgcatgaggttctgcggcggttcccaagacctccccgtgacgaggctaggctgcttgctgtggtggtggaccgttcaggcgctcttggcagaggtagggaacgcgcccgcacagaaagacgcgctcttcgggtggtccatcccggtgttgttgcccctggccggacagagactgatgacgcaggagctggtgcccctgatggacgaccagaacttagaggcgttggggatctcgccgccctgttgggtctgaccattggcgaactcgaatggtttgccgacacacggctctggaacagacggcatcccagtggccctctccagcaccaccgctatgagtggagggcacgcccaggcagaacaccacgactgctcgaggtgcccgggttcaggctcagagacttacagagagtcgttttggatcgagtgttagcaggtgccccggtacatgacgccgcgcatggtttcgtcccgggaagatctgctgttacgggggcagctgtgcatcagggcagtgaggtggtggtggcactggacctgcgctctttttttgcgcgcgtgacagctacccaagcctacggagcactgcgaagggaggggctacctgagcctgtcgcccacttactggtcggcttgtgcactaacgccgtgccagccgccgtattgagcgccatgcctcctgggggggaactggatgagagagtggccttacggagggcccttgctgtaccccaccttgcgcagggagccccaacttctccggccctagccaatttggccatgcgccgtctggattcccggttagcaggatgggcagcagcggcaggtgctcgttatactcggtacgcagatgacctttcattctccggcggacaagaagtagcagccagggcggatgccttcgtcaggggagtcgggaggatcgtagccgacgaggggcacgagctgaatcctcacaagacccgggttaggggtgccgcaactaggcagacggtcaccgggatcgtggtgaatagcgggaccaacgtcacccgagcttcctacgatcggttgcgggccatgctccacaacgccgcaagcacaggactagaggctcaggaccgaggcggggaaccagactttcgcgcccacgttctaggccgcatagggtgggtggagcagctgaatcccgctcgtggcgcaaggctgagagaactgctggcgcgcgtgcccaggtga

SEQ ID NO: 12906 - RNA, 1371 nt, unidentified
  source 1..1371: mol_type = other RNA; note = synthetic construct
atgagcgtgcggtcacccgcttcagctgcaggagcccacgaaccagacccaggacccgacgctgtcgccactgttctcgctgacgcattcttaggcgccgaatggtctgtccgcggactcgcagcagcagcaggtgaagctattgacggctctgcccggttttggcgtccactagcgcgggacctggtccatgcccttcctcgagccccccttgacgaccctagaacactggccgcgctgataaggagagatcccgcgttcacggaagcagtggctgaagcacgacggcgcggacgtcctctacggaacgtgcaccacgtgccggtgactcaggaggcaaggtcagcggacccgagattacttagactaggcaccgtcgctgacgtggccaggctgcttcacctgaccgtcggggagctcgattggtttgcagatccaggcaggtggcaccgtagggtggatggtggcccactccaacatcaccgctatgagtggcggagcagacctgggagaacacctaggttgctggaggtgccagggtttagactgcgcgatctgcagcgcgtggtcttggacgaggtgcttgctgcagtacccctgcacgacgctgctcacgggtttgtgcctggcagaagcgctgttactggggcacggcggcatgttggacgagaggtcgtgatcgctctggacctgacatcgttcttcgccagggtgacagccggacaagtgtttggatccctccgccgggaaggccttccagatgctgtcgcccatgtcctgactggcctctgcaccaccagtgtacctcccggcgttctctccaggatgcccccaggtggcagtcccgaacagagattcgccctgagacacgccctggctgtggcacatctagcccagggtgctcccacatccccctccttggccaatgtggcggtccgcaggctggatagtaggttggatggttacgcccgagcagccggggcaacctataccaggtacgccgacgacctcgcctttagcggcgatggaaccttagccgctagggctgatgccttcgtacggggggtgggacgcattgtcggggatgaggggcacttgctgaatcaggccaagacgagggttcgaggagcggccacgcgtcaagtggtgactggagttgttgtaaaccagggcacaaacaccgtgcggtctgagtacgaccagctccgcgctgttctgcataatgctgccactacagggttagaggcccagaaccgcgccggtcatcctgatttcgcggcccaactgtgggggagaatcggctgggtagagcagctgcatccgggtagaggcgcccgtttgcgagctgcattcgcgcgtgtgcctagatga

SEQ ID NO: 12907 - RNA, 1377 nt, unidentified
  source 1..1377: mol_type = other RNA; note = synthetic construct
atggatgaatcaagtggcagccggaggtcacatctggtgacacggccaggtcctcctcctgcaccagacgtagcaaccgccctagcaggcgctttcttggcagcggaggaatggtctgccccatcccttcgtgaagccgcagcagcctgtctcggatctcgcaggcgctttgttgggcctgtcgtgactgccgttctgaccgcccatttacgcgctccaagagatgccccacgcgaattggccgccctgatcctgagggtggatggctttgaggacacagtacgcagagccagtagaaggcggcccgtgagaatcgcccaactgtcacccaccacgacggtcagtcgggttgctgatgagaggaggcctagagtcgacaccgtcgctgacctcgctcgcctgttgggcaccgatgtgggccatctggattggttcgctgacacaaagctatggaacaggagagcaccggccgggcctcttcatcactataggtatgaatggcggcaaagacctggacgagttccgcggctgttggaagttccaggcctgcgcttacgggagatccagcgcaccgtcttagatgagctcctggccccgttgcctctccatgatgccgcacacggatttgtagcgggtagaggagctcggagtggagcggcactgcatactggcagagaggtggtcatagccctggacctcgtcagcttcttcgccagggtggacggcagaagaatttattccgtgctgcgtcaagcagggttacccgagcccgtggctcactcggctactggacttgtaacacacgccgttccccccgctgtcctttcagcgatgcccccaggagggacctccgatgagcggtttgccctcagaagggctcttgcggtaccccacctgccccaaggtgcaccaaccagcccaatgctggctaatctggccgtgcggaggcttgactctagactaggcggttacgctcgagcagccggggctacttatacgagatacgctgatgacctcgcctttagcggggatgctgctttggctggccgagtggacgcctttgtgaggggggtgggtcgcatagtctctgatgagggccaccggctcaatcacgccaaaacacgcgtgcgtcgtcgaggggtgcgacagacagttactggaatcgtggtgaacgagagcacaactattgggcgcagggaatacgacaggctgcgggctatcctgcataactgcgccgcatacggcccctcctcccagaatcgagccggacacgcagacttccgggcacacctcctgggtcgtattggctgggtggaaagcctggaccctgaccgaggacgacgcctcagagccgagttcgctcggattgcgtggtga

SEQ ID NO: 12908 - RNA, 1437 nt, unidentified
  source 1..1437: mol_type = other RNA; note = synthetic construct
atgaacgcccgagacttggacgcctacaccagaacagtcgccactgcgctggctcacgcctttctgatggcagatacatggatgaaaccagccctcttagacgccggcgctagtgttttaggggctcgccgcaggtggttaggacctctggccagagagattttggccacctacaggagtcgaccaaccgatgcgccccgggaattggtggcagttataagatccgcgcccagctttgtgtccgctatagaggtgagtgtggagcggcaggccgcgattagaatcatccaccaccccacatctcctaccgaggcacgaataagggtggatcaagtcagtgccgagctggccctagcttctctcgctaatgctcataccgcatcggccaacccggcatccgctcacaccccttctgcacatacagtgactaggcttgacagcttggtggacctcgctgcactgctggacctcacgcaaggcgagctggattggttcgcagatgtcaggctctggaataggagggcgcgtccagggagactccaccactatcggtatgagtggcgtcaacggccgggtcgcactcctagattgctggaggtccccgggcagagactaagggccatccagcggaccgtccttgatgaggtgctgtcccccatccccttacatccagcggctcatggctttgtggctgccaggtcagccgttactggggctgccgtacataccggagcagcggtggttatcaacctggaccttactagcttcttcgcccgggttactgccggtcggatctacggtgtactgcgacaggccggcctccctgaagcagtagctcacactctggtcggcctagccgtgcatgctgtgcctccacacatcctttctcagatgccaccgggtgggtcacctggcgagagattcgcactgcgcaaggtactggctgtaccccatctgcctcaaggcgccgctacaagccctgccttggccaatctcgccgtgagacggctggacagcagactcgctggttgggccgatgctgccggaggacagtatacccgctacgccgacgatctggcctttagcggaggacccgaacttgctcgcagagccgatacagctattcgtggcatcacccggattgtggaagacgaagggcacacaatcaatccccgcaaaacgcgggttcgcgcggctattgtgaggcaggtggtgactggagttgtcgtcaataagcgtaccaacacaccacggcgcgaatttgaccagcttcgaagcgtcttgcataacgcagcaacgcagggccccgactcacagaaccgtggctcacactccgatttccgagcccaccttctggggcgcatttcttggatggaatcggtgaatccatcccgggggccaagactgagggcagcattcgcaaggattgaatggtga

SEQ ID NO: 12909 - RNA, 1329 nt, unidentified
  source 1..1329: mol_type = other RNA; note = synthetic construct
atgcggcagcgaagcgtggctgtgggcttaagtcacgctatgctggcctgtcctgaatgggctttcgatgcacttgtcgacgcctgtggtcgggctcttggtgtgcgaccaggctggctctggcccttggtggacggtgtgctcggtgcctatagacgccctcctctggatgcccaccgcgaacttgcccggtggatcgaggcctcagatgattttcagagcgcattcgtcgcagccagagaggccgggagggtgattacgctagcgcgcctggagactgtagccgcctctatggcacccacctcgctcgctgttccctcgatcgctggcctgggcgaactggctgatttcctggaggtgagtcccagccagctggactggctgactgataccgtgcattggaaccgccgcacacctagagggaggcttcatcactacggatatgactggttggtgcggccagggagaaccccaaggttactcgaggtcccgaccccccgtatgaggcgagttcagcggttggtgctgagagaaatcttaggcaggctcccactaaatgacgcagctcacggctttgtaccgggaagatctgcggcgacaggagcagcagctcatgtgggcgctcagaccgtgataactttggacctgcgcactttctttgctagagtccccgctaggagagtctttagcgttttcaggcaggcaggctacccggaaggagtagcccatgcgctgacgggcctctgcacacacgccgtacctccatgggttggggctcggatgcctgctgggggatcctcagagaatcgcgcagctctcaggagggctattagcgagtcacatctcccccaagggtcccctacatcccccgcactgagcaatctggcggtgagacgcttggattcacgcctgagtgggtgggctgaagccagtgacgccacctacacccggtatgccgatgatctggcattttccggggttcgacttcgaggtagagccgccgttgctttcatcgccggcgtggaacgtatagtcagggatgagggccacgtgctaaatgagtccaagactcggattgccggaagaggagcgtcccaacgggtgacaggcctggtagtgaacgacgttgtcgccgtcgaccgtgcctacttcaacgaattgaaagcgattctgcacaactgcgcagcccacggaccacgtgggcaaaaccgtgccggtcaccctgactttcgggcccatcttgcaggacgcctcgcatgggtggagtctgtctctccatctcgaggcgccaggctgcggagagattgggacaggatcgactggagctga

SEQ ID NO: 12910 - RNA, 1329 nt, unidentified
  source 1..1329: mol_type = other RNA; note = synthetic construct
atgcggcaacggtctgtcgctgtcgggctcagtcacgcgatgttagcctgcccagagtgggccttcgacgctctggtcgacgcctgtggtagggcccttggagtgaggcctggctggttatggcctctggtcgatggcgtgttaggggcctaccgtcgccctccactggatgctcatcgtgagctcgccctgtggatcgaggcgagcgacgattttcagagtgctttcgtggccgcacgtgaggccggaagggtcatcaccctcgccaggctggagactgtggctgcatccatggcccccacttctctagccgtgccctcaatagctgggctgggggaacttgcggactttctggaagtattgccgtcccagctcgactggctgacagatacagtgcactggaatcggcgcacccctcgtggcaggttgcatcattacggttatgattggcttgtgcgacctggcagaacccctcggttgctggaggtgccaactccccgcatgaggcgcgttcagcggcttgtcctgcgcgagatcttgggccgactgcccttaaatgatgctgcgcatggctttgtcccgggaagaagtgcagccacgggtgctgcagcccacgttggagctcagacagtgatcactctggatctaaggacgttcttcgccagagtgcccgcacgacgagtgttctcggtgttcagacaggcggggtatcccgagggtgttgcgcatgctctgacaggcctgtgcacacacgccgttcccccatgggtaggtgctcggatgcctgcaggcggaagcagcgaaaaccgggctgcccttcgcagagccatttcagcaagccacttgccacagggctctcctacctcaccagcactgtccaatctggcagtacggcggcttgactcacgcctgtctggatgggccgctgcaagcggtgctacttacaccaggtacgcggacgacctcgcttttagcggggatggaatgagaggccgagccgcagctgcctttatagccggggccgaaaggattgttagagatgaggggcacctgctgaatgggtctaaaacatcgattgcaggccgaggagccagacagaccgtgaccggactcgtcgtaaacgactctgttgctgtggatcgcccatatttcgacgaactcaaggccatcctccacaactgtgcagcccatggcccgagaagccaaaaccgcgcaggacaccccgatttccgcgcacacctcctaggacggttggcctgggtggaatccgtgtccccctccagaggcgaacggctcagaagggagtttgacaggattgactggagttga

SEQ ID NO: 12911 - RNA, 1614 nt, unidentified
  source 1..1614: mol_type = other RNA; note = synthetic construct
atggccgccagcattcgtgaagaggccgctatctctcggacctcggttcccgaggaaaataacggcgcaagacgcagacgcaggctgcccttagcttggggcaacgctactgactgtgggcgaggggggtggagtagacagaccaacactttatcaggcgtgacacccgggtataatagccagcctgagcgcactacagcaggaactactcccagattcgcacgttcccgtgcccgaactgatcgcagcgtggctcggggttcatctcatcccttccagggctctgtaaaagagcacagcattgctgtgggcctgagtcacgccatgttggcagcgcccgaatgggcctttgaccctctcgtcgacgcatgcggcagagcattgggcgctaggcctggctggctttggcctttggtcgacggaatcctggatgtctatcgaagaccgcccagagacgcacacagagagctcgcgcggtggatcgaagcgagtacggccttcagaggagccatagaagctgctcgggaggccgggagaagcattgctctggcacacctggagacaattccagcgagcatgggcccaacgccactgaccgtgcccagcatcgctggtcttggggaactggccgacttcctgggagtgagtccgggacagctggactggcttacagacactgcccatttcaaccgcaggaccccacgaggccgactgcatcactactcctacgattggctggttcgccctggtagggctcccaggttactggaggtccccacgcctcgcatgaggagggttcagcggcgtgtacttcgggagatactcaccgccctgccactcaatgatgcggcccacggattcgtgcctggtcggtctgcagttacaggcgccgcagcccatgccggtgctgaaacagttatcaccctcgatctacaaaatttctttgcccgcgtccctgcccagagagtctactctgtgtttaggcaagcagggtatccagaggccgtcgctcacgccttgaccggactctgtacccacgccgttccaccttgggtgggagctaggatgccggtcggagggagtttggaagatcggcttgcattgaagcaggctatctccggctcccatctgccacaagggagcccaacctcacccgcgctttccaatctctcagtgagacgcgtcgatacacggctgaacggatgggccgcagcttctggggcagcgtacacacgatacgctgacgatctggctttttcaggagagggactaaggggtcgggcagccgcaacctttatagccggcgtggcacgcatcgtgttagacgaggggcatctgctcaacgaatccaagactcgcatttccggtcgtggagccagacagagcgtgaccggcctggtagttaatgatggcgtggccgtggaccggctctatttcgatgagctgaaagcgattctacacaattgcgccgtgcacggtccgcacggccaaaacagggcccagcatgctgactttagggcccatcttctcgggcggttggcttgggtggagtccgtgtcgcctagtaggggcgtaagactgcgacgggaatttgaccgcatcgattggtcttga

SEQ ID NO: 12912 - RNA, 1038 nt, unidentified
  source 1..1038: mol_type = other RNA; note = synthetic construct
atggcccccacctctgcagccgttccctctttagacggactgggagaactggcagattttctcgaggtcacgtccccgcaactggactggttgactgacacagcccattttaaccgcaggaccccccggggcagattacatcactatagctatgattggttggtgcgtccaggtagagctccccgccttctcgaggtacctactcctcggatgcgaagagtccagcgccgggtgctcagggatatactggggccactccccttaaacgacgccgcgcacgggtttgtaccgggaaggtcggccatttccggcgcatcggcacacgctggcgctcataccctcatcacacttgatctgagtacgttcttcgcccgagtgcctgccaggcgtgtgtattctgtgttccggcaggctggctaccctgaagctgtcgcccatgccctaaccggcctgtgcactcacgctgtacccccatgggtcggtgcacgcatgccaagcggaggaagcccagaggatagagccgcccttcgtgatgctatatccaggagtcacctgccccagggaagtcctaccagcccagccctctctaatctgactatgcggaggcttgatagccgcctcacaggttgggcagctgcatctggtgcggtttacacaagatacgctgacgacctggccttttccgggagtgatttgaggggccgcgcagcaacatcattcatctccggcgtcgataggattgttagggccgaagggcatgtgctgaaccggagcaagactagaattgctgcgcggggtgcacgacaatccgtgaccggactagtggtgaatgacggcccctcagtggataggcctacctttgacgagctgaaagccctgctgcacaattgtgtggttcacgggcctgcctcacagaatcgagctgggcatccagacttccgggcccaccttctgggcagattgaactggatcgcgtcagtcagccagacccgagggacacgcttgcgcagagacttcgacagaatcgactggtcttga

SEQ ID NO: 12913 - RNA, 1356 nt, unidentified
  source 1..1356: mol_type = other RNA; note = synthetic construct
atgcgccctggagcaacagcccagccatctgccactaccctagccgccgggcttgcacacgctatgctagcttgtccgctgtggacctttgacgtgctcgtcgatggctgcggcagggcacttggaagtcgcccaggatggctctggcccctcgttgagcgcgtcctcagtagttaccatcgccctccccacgatgccactagagagctggcaagatttatcgcccagacgcgtgccttgcacgatgcggtggaagctgcgcgtgctgatgggaggactatagcccttcagcacctggagacaacaccagccaggtcgggggaaaatggcgcccgaggtgtcccaaggatcgatggcctaaatcaattagccgaatttttcgccgtcacaccaggtcagctcgattggctgaccgacacagcccactataatgggagaacgcgtcgggggcgccttcaccattactcttacgactggatgcggagagaagggcgggctcccagactgctcgaagttccctccaggcggatgcgtgaggcacagcgattagtgctggctgagattctgactcctctcccgttacatgacgcagcacacggcttcgtacccagcaggtctgcgattacaggcgctgctgcgcatgtcggtgccgaaaccttgattacactggacctgtccaccttctttgcccgcgttccagcccgaagggtattcggcatccttcggcgagcggcatatcccgaggccgtagctcatgctctgaccggcttgtgtacccacgcagtgcccagctgggtcctggcaagaatgccgcctggagggtcccctgaagaaagggcagcccttcgggagtctttgacgaggtcccacctgcctcaaggctcccctactagccccgccctgtcaaacttgtcagtgcgaggtctggacgggcggttagatggttgggccgctgcttcaggcttcagctacacaaggtatgctgatgacctctgcttcagcggacctcacctcacccatcgagcggctgcttcttttatcgcaggtgctgagcgcatcgttgccgctgagggacaccgggttaatcggcgcaagaccagaatttcaggagcgggcagtagacagagcgtgaccggcatagtggtgaacgagcgcctcaacgccactcgcgagcatgtggacgagctgaaagccattctgcataactgcgcagtgcatggccaggcctcccagaacagattcgggcacccagaatttagagcccacctggaggggagaatcacttgggtggccgcactgaatcccggaaggggagcaaggttgcggcggcaattcgacctgatcgactggggatga

SEQ ID NO: 12914 - RNA, 1188 nt, unidentified
  source 1..1188: mol_type = other RNA; note = synthetic construct
atgctcgccgcctatcataggcctcccggaggtgcaccgagagaactggccaggttcattgcgcaaacgagtgcctttggcgccgctgttgctcgggcagtggagaagggggtccccattcccgtagccaggtacgctgtgggattcgccgctgtgggtactagcgctggcattgcagctgatgtcggcgccctggcggaactgctcgacttaacggtgggcgagctcgagtggtttgctgacaccggacactggaataggcgggctaggcctgggcctcttcgccattacagatacgcatggagaacaagaaccgggcgcgtaccccgactgctggaagttccaggtcccagattgaaagctgtgcagcgcagggtgctgcaccagatgctggggtcgatccctctccacgacgcagcccatggctttgtaccaggacgaagtgtggccactggggcagggagacatcttggcgccgagatgcttataagccttgacttgcgggcttttttcagctccgtgggggccagtcggattcacggaatcttccgacaggcaggcatgcctgaggccgttgcgtacacactgacaggtatatgcaccgccgctgttccacctgcggtcctgtcacggatgccagacggcggttctcccgacgaacggttcgcactgaggcgcgctttggccgcagctcatttgccgcaaggcgcaccatcctctccagcactggcgaacttgtcagtgcggcgcctagacagccgattagccgggtgggccgaagccactggagcagtttatacccgctatgctgacgatctggcattttccggatctgagcctctggccagaagggccgacgcgtttgtcaggggcgtggaaggcatcgttacctcagagggccacctcgtgaatccccggaagaccagggtgaagggtgcctccgtccgccagactgtaacaggagtggtggtgaactccgtcccaaacgtccctcgacccgtcttcgatgagctgaaagccatccttcacaattgtgtggctgatgggcccgaatcacagaacggagcccgtgggccagctcaccgtgatttcagagcccacctactcggccgtattagctgggtcgagtctctcaatccggcacggggacagagattacgcgatgatttcgatagaatccagtggtga

SEQ ID NO: 12915 - RNA, 1299 nt, unidentified
  source 1..1299: mol_type = other RNA; note = synthetic construct
atgcaggggcgtgaggtgctggttgaaacgctggtgcacgcattcctgggcgcagagtggaccgcagatgctcttagcgcagcagccgtagacgctttgggcgcacgaagaagatggcgaggccgggttgttgcgggcgttttagtcgcctttccccacccccccttagatgcccctagggagctagccaggtgcctggacgcactcctgcctgaccgtgctcaacccggggttgcgcatctggctcctgtggctgcgagagcctcagcttcaagctctcctgtcccgcgcatagatggctggggggacttggctaggctgcttgccctgacaccgggcgaacttgaggccttcgccgacgtgcagcactggaaccgaagagcccccgagggacccgtacagcactacgaccacgtgtggcgcgaaagacctgggagggcaccaaggctgttagaggtccctcgtccacgcctgcgggcagttcaacggtcggtgctggatcagctcgtggggttagccccagtgcacccagctgttcacggctttgtccccggccgatccgctatttctggggctgctgtccatgccggagctgccatggtcgtgacccttgatctgcagcggtttttcgcccaggtaaccgctccaagagtcttcggcgtactccgggcagagggtctaccagaaggggtcgcacacgccctaacgggcctgtgtactcatgaggtgcccgtggccgtgctgcgaagaatgccctccggtggaactccagaggaacgcgcggccttgagacgctccctctctctggcacacctccctcaaggagctcccaccagtccggctctcgccaatgtagcgcttaggcggttggtggccaggctagcgggatatgcggaagcggctggagccaggtatacacgctacgctgatgacctcgccttttcagggggtcctgctttcgccaggcgtgcagacgcttttgcacggggagcagctaggcttgccgccgaaagcggttgggccgtcaatcctagaaagacacggctccgcccggccagtaccagacagacagtcactggggtggtcgtgaacgcccatcctaacgtgcggagggcagacgtggatcgcctgcatgctatcttgcataattgcgccgtgcacggcagcgctggtcagaatagggccggcgtgccagattttcgcgcccatctcctgggaagagtggcgtgggtggccgcagttaacccacggagaggagccgccctgcgagcattgttcgactccatcacctggacttga

SEQ ID NO: 12916 - RNA, 1362 nt, unidentified
  source 1..1362: mol_type = other RNA; note = synthetic construct
atgcacggacgcgacgccgttgtggaagcgttggcccacgctttcctgggtgcagagtggacaccagccggcctacgagctgctgcagcagatagcttgggcgcccggaggagatggattggaccactcgtgacggctgtgctggtggcgtttccgcatcccccgctggatgctcccagagaactggcccaggtagtcgccggcctccttcctgaaagggcccaacccgtcgttgcccatctcgcacctgtacccgcacgcgcagttccatcctctagccctgtgcccgcgattgacggacgcgatgacctcgccagactacttggcctggcaccggcacagctggacggttttgcagatcttggccagtggaatcgtagaaccccccatggggcactgaaccccggtgctttgcagaactacgatcacgtgtggaggcagaggccaggtagggctccacgactgctggaggtccctcggtcgcgtctgagagctgtgcagaggtcagtgctggacgagatcgtagggttggcgccagtccatcctgccgcccatggtttcgtgcccgggagatcagccattaccggggctgctgtccatgccggcagtgcaatgctgataacactggacctacagcgcttcttcgctcaggtgactgctgcccgggttttcaggcttctccggggggagggattaactgaggccgtcgcctttgccctcacggggttgtgtacccacgccgtgcctgtcgctgccattcaccgcatgccagcgggtggcgaacctgaagaaagagccgccctgcggcgatctcttgcccttgctcacctaccccaaggggctcctactagccccgcgttagccaatctcgccttgagacggctcgatgcgcgactgactggttacgccgaggccgctggagctcgctatacaaggtacgcagatgacttagcgttttccggcgacgcccgctttgctagacgtgcagaggcctttgccaggggagctgctcggatcgtggaggacgctggctatgctgttaatccaagaaagacacgactgcggccagccagtacccgccaatccgtcaccggcatcgtggttaacgcccaccccgcagtgaggagagccgatgtagaccggctgcgcgcaatcctccacaactgcgcagtccacggacctgccgggcaaaatcgggctggagtgcccgacttgcaggctcatctcctggggcgaatcgcatgggtgtctgcggtgcaccctggtagaggagccaggctgagggccttattcgagcggataccatggcctgaaccgagcggtgcagcaccatccctggatccggcaggacctcgtccctga

SEQ ID NO: 12917 - RNA, 1305 nt, unidentified
  source 1..1305: mol_type = other RNA; note = synthetic construct
atgcaagggcgtgatgtcctggtggagacactgacccacgcgttcctgggcgctgaatggactcgtgatagcctgagagccgcggctgttgattccctgggagcgcgacgcagatggcttggacctctcgccactggcgtcctagtggcctttccacaccctcctctcgacgccccacgggaactagccagatgtattgcaggcctcttaccagagcgagcgcagcccgtcgtagctcatttggcacccgtgccggcacgcgctttaccttcaagctcagccgtgccaagaatcgacggacgagacgacctggctcgcctattggccatcaccccggctcaactggatggctttgcggatctgggccagtggaacaggagagctgcggaaggcgccgttcagcattatgatcacgtgtggagggaaaggcctggcagggttccccggttgctggaaattccacgggccagactgcgcgcagtacagaggacagtgttggaggaggtagttggccttgccgcagtgcacccagccgcacatggcttcgttcccggacggtctgccatatcgggtgcagccgttcacgccgggagtgcaatgctggtcacactcgacctccagcgattcttcgcccaggtgactgctccccgcgtctttgggttactgcgggctgagggattgccagaggcagtggcttacgctctgacaggcttgtgcacacgccccgttccgatcgccgtgttaagacggatgcctacggggggcgatgtcgaagctagagcagccctgcgaagatcccttacgctccctcacctccctcagggagctcccacctctccagcattggccaacctcgccctgaggcggcttgatgcgcgtctcaccggttacgctgaggccgcaggagcacggtatactcggtatgctgacgacctggcattctccggcgatgagcgctttgcacgccgagcagaagcttttgctcggggggccgcgagaattgtcgaggatgccggttacgccgtgaacccccaaaagaccaggctgaggcctgctagcgtcaggcagtctgtcaccggagtggtagtgaatgtgcacccgaacgttcgcagagccgacgtagaccggctgcacgcaatccttcataattgcgtggtgcatgggccaagtgggcagaataggggagctgtgcccgactttggggcccatctgctcggtagaatagcctgggtcgctgccgtgaatcctgccaggggtgccaggctgcgtgctcttttcgacgccatcgtgtggcccggggcctga

SEQ ID NO: 12918 - RNA, 1299 nt, unidentified
  source 1..1299: mol_type = other RNA; note = synthetic construct
atgcgtggtcgggacgcgctcgtagaggcacttgtccacgcttttctcggcgccgagtggacccacgacgcattaagagctgccgccgcagacagtcttggggctagacgcaggtggctaggacctctcgtcacaagagtgctggtcgcttttcctcaccccccagtggatgctcccagagaactgggccggtgcatagccgctctactgcccgataaagcccagccggtggtggcacatttagctccagttgctgcatcagctgccgaatccagcagtcccgtgcctcgcatagacggaatcgccgacttagccgccctgctcggactctcagttgacgccttggacggcctggccgattctggcagctggaatcgtcgggcaccagagggtcgtctgcagcactatgatcacgtctggcgagaaaggcctggtcgcgtggctcgactattggaggtgccaaggggacgactgagggcagttcagcggtccgctctggacgagattgtggggttagccccagtgcatcctgcggcccacggtttcgtgcctggcagatctgccatcactggcgcggccgagcatgtcggatctgctgtcgtggtgaccctggatctccagcgctttttcgctcaggttaccgcccccagagtgtttgggctgttgcggcgcgaaggtctgccagaggcagttgcctacacactgactggactctgtacacacgccgtaccggtcgcagtgctgaggagactgccggagggaggctcacctgaagaacgtgcggggctgcgcagagccctcacacttcctcatttgccccaaggggctcccaccagtccagccttggccaacctggctctgcggcgacttgatgctcgcttgaccggctatgcagaagccgccggggcaagatacacgaggtacgccgacgacctggccttctctggcgacgagagcttcgctaggcgcgcagaagcctttgcaagaggtgcgcaacgggtagttgaggacgccgggtatgctgtgaaccctcgcaagacgcgcattaggagagcatccgtgaggcagagcgtgactggcgttgtggtgaatgtcaggcccaacgtccggagggctgatgtagatcggctgcacgctatcctccataactgcgcagtgcatggccccgcgggtcaaaatcgggcaggagtcggggatttcagggcccacttgcttggacgaatcgcgtgggtagccgcggttaatccagggcgaggcgctgcacttagagccgtcttcgatcggattgagtggggatga

SEQ ID NO: 12919 - RNA, 1434 nt, unidentified
  source 1..1434: mol_type = other RNA; note = synthetic construct
atggctgagccgaccggagtagacggggctcatccctttgctcgcacagccgatgttacaatcgcccgcaccacagatgcaacgacaacgaggcggacagctgtggcatcggctcgtacagcagagatcgccaccgtgcttgccgacgcctttctcgctgctgaagactgggccgttgacgccttacttgcagccggcactgcagccgtaggtccccataggcgcttcgtgcccatgaccgtcctcgcagctctaaggggatatcctcgggcacctcgggacgctcccagagaactggcagcgtttctgcagagtgttgacggtttcgccgaggcggtaaggcgatccgcggaaagagcgcccattaccgtggcaagtcgaagggccactcctacagaggcaccccctaatacaggccacgtgccccgcattgacaccgtcgcagatctggcacgcctgttagacctgactattgggaggctggaatggttcgcggacaccaaacagtggaacagaaggacgcatgacgctgtcctccagcatcacggctatgtttggcgggccagaccaggacgagtccccagattgctggaagtcccaaagccgcggttgcgcgctgtgcagagaactgcactcgacgagatcctgacttttctacccgtacacgatgccgcccatgggtttgtgcccggacgttcagcagtgtctggagcggctcaacatactggccggcaggccgtggtcaccctagatctggcccattttttcgccgccgtgtccgcccctatggtttacggcctgctgcgcagaggcggtcttcctgagcctgtggcccacaccttaacaggcttgtgcatccacgtggtgccacctcgcgtcattgccgccatgccaccaggtggcaccccagaagacagagctgccctccgtagggccttggcaactccgcaccttccgcagggagctccaaccagccctactctggcgaacgcttccgtctggagactggacacacgactcgccggatgggcagcgagtgcagatgccacctacacgcggtacgctgatgacctcgccttcagcggcgatgatcgtttcgccgctagagtggacgcttttgtaaggggcgttgggcgcatagtgaccgatgaggggcacatactgaatgcctctaaaactcgggtgcggcgacggggtgtcaggcaatcagttaccgggatcgtggtgaatgaaagaccaagcgttggaagggcagagttcgatcgcctgaaggctattctgcacaactgtgctgagcacgggcccgacggtcaagatcgtgtgggggtccctgatttccgcgctcacttgcggggaagagtcggctggtttgagcaggtgcatccagagaggggcgcccgacttctcgccgaattccagcggatcacatggtga

SEQ ID NO: 12920 - RNA, 1314 nt, unidentified
  source 1..1314: mol_type = other RNA; note = synthetic construct
atggttgcaggcgccctagccgacgccttcctagctgctgagggctggcaccgagacgagttgaccgctgccgggtatgatgtgctcggcgtggagagaacctatgtaggtgtagctgtcggagtggccctggaggcttatccacgtgcacccgtcgatgccccacgacaattagccgcagtactcgctagtgcccctcggctggttcggctccatgattccagggtacccctcagacccgtccgcgttctgttaaggagggccaccgcagtgagagcacgtccaatcgtcgcatcgcgccttctggtcgatacgctccccgagttggctcgcgaactggacttaacggctgggagattgctatggctggccgacaccaaaggctggaaccggcataggggtcccacatccgcgctgcaccaccatcgtcacgagtgggtgcaacgccctggcagagcaccaagactcctggaaaagccaatggctatgctgaagcggactcagagaacaatcctggacgagcttttagccgctatgcctgttcacgacgcggcccacggattcatcgccggaagaggggtagtgagctctgcggccgaacacgtgggatgccctgttgtgctcagcgccgacctcactgccttctttgctaacgtgagggctgcgacagtctacggcgtgtttcgctctgcaggtttcgcggagccccttgcccatgtgttgaccggcatctgtacgcacagagtgccaccccatgtcttgaccgccatgccccctggaggggatcctgatcagcggactgccttgaggcgggccctgactgaagctcatctgccccagggagcccctacaagccctgctctggcaaatctcgcgctgcgacacctggacgttcggcttgcaggctgggcagcagccgtggatgctacatacacccggtacgccgacgacctgaccttttccggtggcgatgctctggctgcaaggccagatgccttcttgagaggcgtcgaccgtattgtcactgagcagggacacacccttaatgcacgcaaaactcgagttcgaagggccggcgtgcgacagtcagtgactggagtggtcgtgaacgaacgcacatcaccggggcggagggaagtggatcgccttcatgccatacttcataattgcgtggtccacggtccggcaagtcaggatagggacgggcacgctgactttagagcccacctgctcggccgcattggatgggtggggcaagttcatccggtaaggggggcggctctgatgacactgtttgcacagattcggtggtga

SEQ ID NO: 12921 - RNA, 1491 nt, unidentified
  source 1..1491: mol_type = other RNA; note = synthetic construct
atggaattccccggagaggcagacggtgcgagagatgcctctacctcccccggatcacctcgtgggacacagtaccagcaagatgatacaccgagggaagctcggagagctcccagggcactcccacatggcggaactgaccggtcacctggcaatcccacacccacccccctcgacgtcgtagctagggctctggcagacagcttcctggccgctgatagatggaacagggacgacttaactgctgctgggtatgatgtgctgggggtggaacgcacatacgtgggtctggccgtgggaatcgcccttgacgcatggccacgaccacccgtagatgcccccagacagtttgccgcggtgttggccagtgatccgagactgatacggctacatgatagcagagtcccgctgaggccagtgagagtcttacttcgtcgcgccactgcggttagggcggtacctagggtggactctcgcctgctggtggatacccttcctgagctcgctagggaactggatctgacggtcggccggctaatgtggctggccgacacacgtggttggaaccggcgtccgggaccatctagtccacttcatcaccaccgccacgagtgggttcatagagccggtcgtgcccctcgcctactcgagaagcctatggcaatgttaaagcggacacagcggaccattctcgacgaactgttggtcgcaatgccagtgcacgatgctgcccacgggttcgtacctggaagaagcgtcgtctccggtgccgccgaacatgttgggcgatccgtcgtcctatcagccgacctgacgtctttctttgcgagcgttaccgctccctcggtgtacggggtgttcagaagcgctggatttgcggagcccttggcacacgtgctgacaggggtttgtacgcaccgcgtgccacctcatgtgcttaccgccatgcctcctgggggagatgcagacgcacgaggcgctttgaggcgggcattagccgccgcacatctgccacaaggggcacctacatcccccgccttggcgaatctgactttgcggcaccttgatgttaggctcgccggttgggctgcagctatgggaggcacctatactcgctatgcagacgacctcaccttttccggaggagacgctatggccgccagagctgacgcctttctgcgtggcgtagaccgaattgtcagggagcagggccacaccctgaacacccgcaaaactagggttcggcgcagtgctgtgagacagagcgtgaccggcgtggtggtgaatgagcgcacttcacccggccgacgcgaagtggataggctgcatgccgtgctccacaactgcgtcgttcagggtcccgcaagtcaagaccgaggtgggcacccagatttccgcgcccacctcctcggcaggattggatgggtagagcaggtgcatccaggcagagctcggcgactgagagatgagtttgcccggatccggtggtga

SEQ ID NO: 12922 - RNA, 1320 nt, unidentified
  source 1..1320: mol_type = other RNA; note = synthetic construct
atggacgtagttgcaggtgccctcgccgacgctttcttgaccgccgctcgatgggagcgcgatggactcacggccgtgggatatgatgtgcttggggtcgagcggacgtatgttggcgtggccgtcggtgtcgcgttagatgcgtaccctaggccaccagtagatgctccgagacagctggcagcagtactcgctggggcaccacggctggttaggctgcatgaagcccgggagcccttaagaccagtccgcgtgctcttacgcagggctgctcccgtacaagcccatcccacagtggccagtcggctgttagtcgacaccctgcccgagctcgcaagggagctagacctgactgtgggccgtctactgtggctggcagataccagaggctggaatcgcggaccaggccccacttctccgcttcaccatcatcgccatgaatggctgcaaaggcctgggagaactccccgccttctcgaaaaaccttacgcgatgctgaaacggacccagcgcactgtcctggacgatctcctggccgtgcttcctgtgcatgacgcagcccacggcttcgtggctggaagatcggtagtctccggcgccgcggaacacgttggaagaccagtggttctgagtgctgacctgacatcttttttcgctagcgtgaagagccccacagtgttcggggtctttagaagcgcgggatttgccgaaccccttgcccaggtgctgacagggttgtgcacccacagggtgccacctcacgtgcttacagccatgccccccggaggtgatccggatgaaagggcggccttgcgtagggctcttgcagctcctcatctgcctcagggcgccccaacgtctcctgcactggctaatctgtcactccgccacctggacgctagattagcaggttgggccgctgctgtgggcggaacatatacccgatacgcagacgacctgactttctcaggcggtgatgccttggctgctaggccggaggcctttttgcgaggcgttgaccggattgtgaccgagcaaggccacacactgaaccggcgcaagaccagggtccgtagagcaggtgtgcggcagtccgtcactggcgtggtagtgaatgagcgaaccagcccagggcggagggaagttgatcgactccacgccgtcttgcataactgtgtggaacacgggccttcctcccaggacagaggagatcacgcagacttccgagcccacttgctcgggcgtatagggtgggttgagcaggtgaaccctggacgcgccagaaggctatgggccgagtttgcccggatccggtggtga

SEQ ID NO: 12923 - RNA, 1311 nt, unidentified
  source 1..1311: mol_type = other RNA; note = synthetic construct
atggcccaggcgctcgccgatgcctttttggccgctgacgactggtcccgtgacgcactgacggctgcagggtatgatgtgctaggcgtggagcgcacgtacgtgggagtcgcagttgggactgccctcgacgcataccccagaccacctgttgatgcccccaggcagttggccgctgtgcttgctacagccccccggttagtgcgccttcatgattcacgcggaccccggcggccagttagagttcttgcgagacaagccacagcagtccgagcacggcccgttaccgattccccgctcttagtagacaccctccctgagctcgctcgagctctggacctgacggtgggacggctactgtggctggccgatactaggggttggaaccgcagacctggcgcctctagtccactccaccacgttcgccacgagtgggttgcgaggccaggacgtacaccgcgactgctggaaaagcccatggcaatgctgcggcgaactcagaggaccgtcctggacgacttgctcgccgccttgccagtacacgatgccgcccacgggtttgtaccaggacggtctgtggtaaccggcgcagctggtcatgtcggcagaagggtcgtgctgaccgctgacctgaccagcttcttcgcaaccgtacgcgcccctaccgtttatggcgtcttccgagctgctggctacgcggaaccactggctcatgtgctgacagggctctgcacacacagagtccccgtgcacgtccttactgctatgcccccaggcggcagcattgacgagaggagagcgctgcgcgatgccctggtggaagcacatctgcctcaaggggcccccacttcacctgccttagctaatcttgcactccggcatcttgatgctcgccttgcaggatgggccacagctgctggggctacctacaccaggtatgccgacgatctgacattctccggtgacgatagactggctgcgagagccgacgcattcctacgcggcgtggagagaatcgtggccgaccagggtcatacattgaaccctcggaaaactagggtgaggccggcaggcgtaaggcagagtgtcactggggtggtggtgaacgaaaggaccgcgcccggtaggagagaggtcgatagactcaaggcagtcctgcacaattgtgtggtgcacggacctgcaagccaggatcgagctggccatgccgactttcgggcccacttgttaggtcgcatcgggtgggtgggacaggtgcatcctgaccgtgcggccaaattgcgggccctgtttgcccgtatagaatggtga

SEQ ID NO: 12924 - RNA, 1485 nt, unidentified
  source 1..1485: mol_type = other RNA; note = synthetic construct
atggagttcccaggagaagctgctggcgccagagatgctccaacttctcccgggagccctcgaggaacaagataccagcaggatgacactccacgggctggtcgcagagctcctcgagcaacgccccatggagggactgacgggagttcggggaaccctacgcccctggacgttgtagctgtcgcgctcgcagactccttccttactgcagagcaatgggcccacgacgagcttaccgcagccggatatgctgtggtcggagtcgaacgggcctacgtcggcctagcagtagcagccgcattggaggcctatccacgcccccctgttgatgctccgcggcaattggccgcagtactggccagtagcccccgcttagcagagctgcaccgctcaagggaaccacgtagacctgtgcgggtgctcgcaaggcgagccacagctgtaaggagtcgccccgagacagtgtcaagactgctcgtggacaccctaccggagctggcacgggaactggatctcaccgtcggcaggttgctgtggctcgccgatacacgcgggtggaacagacgacccggtccttcctcccctttgcaccatcatcgccacgagtgggtgagacgccctggaagaacaccgcgcctcttggagaagcctatggatatgctccggaggacgcagagaaccatcctggacgagttgctcaccgccctgcctgtccatgacgcagcccatggctttgtggccggtcggtctgtcgttaccggagcagccgcacacaccgggcaacaagttgtggtgtctgccgatttgaccagcttcttcgcctcagtgagcgcccccacagtgtacggcgtgttccgctctgctgggttcgcggaaccactggctcacgtgctgaccggcatctgcacacaccgggttcctccgcatgtgctgaccgctatgcccgacggcggtacacccgaagaaagggcggcccttagacaaatgctcgccgctgctcacctaccacagggtgctccaactagccccgcccttgctaacactgcactgaggcatctggacgccagacttgctggatgggctgccgcggtagatgccgtctacactcggtatgcggacgatctcaccttttccggcggtcaccgtctggctcgtaggacagacgcctttttaaggggcgtggataggattgtcactgagcaggggcatagactgaatccaaggaaaacacgagtgcgtaggcgtggagtgcgccagaccgtaacgggagttgtggtcaacgagcgaactagtcccggccggagggaagttgaccggttacacgcccttctgcataatgccgccgagcacgggcccgcatcccaaaatagggccggccacccagattttcgagcgcatctgctggggcggataggctgggtggaacaggttcacccaggccgtgcgagacgcttacgggaggaatttaccagaattgtgtggtga

SEQ ID NO: 12925 - RNA, 1485 nt, unidentified
  source 1..1485: mol_type = other RNA; note = synthetic construct
atggagttccctggagaagcagacggagcccgggatgcatcaaccagtcccggtagccctaggggaacacaggatcagcaggaccacaccccaagggaggcacggagagcacctagagctcgccctcatggtggcaccgacagatcccccggcaatcccaccccactcgacgttgtggccactgccctggctgacgcgttccttgctgccgatgcttgggacgtggaccacctaactgccgccgggtacgacgtggttggactcgagcgtgcgtacgtcggcttggccgtgagagctgccctggagacttatccacggcctcccgtaggcgcgccaagacaacttgccgctgccttggctggctctccccctttagtgaggctgcacgatgctcgacgcgatcgaaggcctgtcagagtgctccttcggagagcggtcgctgtgcaggcagtgccaaccgtgtcaagccggctcctggtggacacactcccagagctggctagagagctggacgtaactgtggggcgactcctgtggctggcggatacacgcggttggaataggaggccagggcctgcctcacccttgcatcatcataggcacgaatgggtacaccggcctggcaggacacccagacttctggagaagccaatggatctccttcgacggactcaacgcaccgtcctggacgagctcctggccatgctcccggttcacgacgcagcccacggcttcgtacccggaagatctgtggtcacaggcgcccgcgtccacgtaggtcaacaggttgtggtcagtgctgatctgactacctttttcgcatctgtcagagcacccagcgtgtatggcgtgtttcgttccgccggactagctgaaccgctggctcacgtgttgaccgggttatgtacccatcgggtcccggtccacgtgttaaccgctatgcccccagggggagatgctgatgaacgcggggccctaaggcgacttctcgcggattcccatctaccccaaggggcccccacttctcccgctcttgccaatactgttctgcggcacctggatgcacgcctggcaggttgggcagcatcggttggggctgcctacacacggtacgccgacgacttgacgttcagtggcggagcagagttggccaggcgaccagatgcctttctgaggggggtggaaagaattgtgacggatcagggctataggctgaacgcgccgaaaacacgagtcaggcgtgccggagtgcgtcagagcgttacaggggtggtggtgaacgaacggacggctccaggccgtagagaagtggaccgcctgcatgccgtactgcataactgcgttgttcatggtcctgtttcccaggaccgcggcggtcatgctgactttcgggcacacctgttgggcagaataggatgggtcgcacaggtccaccctgcacaagccgtgcgcttacgggccgagtttgatcgcatcgcctggtga

SEQ ID NO: 12926 - RNA, 951 nt, unidentified
  source 1..951: mol_type = other RNA; note = synthetic construct
atgcttgcggacacccgcggctggaatcgaaggccaggttccgcgtctcccctccaccatcaccggcatgagtgggtaaggcgtccaggtcgtacacctcggctgctggagaagccgctggatatgctgagacggacacagcgcaccgtactggacgaactcttggctgtgttgcccgtccatgatgccgcccacggctttgtgcctggccgttcagtcgtgtccggtgccactttgcatgtggggcagagggtcgtgataaccgccgatctgacctctttcttcgctagtgtgcgcgcaaggtccgtgtatggagtgttcagggccgcaggatttgccgagccactggcacacgttctgaccggactgtgtacacatagagttcctacccacgtgttaaccgctatgcccccaggaggcgatgtcgacgaaagggccgctctcagacgcgccttagctgatgcacatttgccgcaaggagcccccactagtcccgccttggctaatacagttctccgccaccttgacgctagacttgcgggatgggcagatgcagctggggccgtttacacacgctacgccgacgatcttacgttttcaggggacgacagactagcccgcagagcggacgcattccttaggggggtagatagaatcgttactgaccaggggctaaggctgaacgctcgcaaaacccgggtgcgacctgcaagcgtgcggcaaagcgtcacaggcgtggtggtaaacgaccgaactgcaccagggcgaagggaggtcgatcgtctgcacgccgtgctgcacaactgcgctgagcacggccccgagagccagaatcggtctggccatcctgactttcgggctcacctcctcggcagaatcggatgggtcgaacagactaaccctggtcgggccgataggctgcggagagaattcgttcgaattacgtggtga

SEQ ID NO: 12927 - RNA, 1485 nt, unidentified
  source 1..1485: mol_type = other RNA; note = synthetic construct
atggagtttccaggggaggctgcagacgccagagacgctagcacctcccccggttcacctaggggaacccaagaccaacaggatgacacacccagggctggaagaagagcaccccgcgcaacccctcacggtggtacagacggctcaccagggaatcccacgcccttaaccgttgtggctggagccctcgccgatgcctttctgacagcggaacactggggcccagatgatctgacagccgccggatgggccgttgttggagtggagcgcgcatatgtggggcttgcagttgcagccgctttggccgctcatccacgccctccagtggatgcccccagacagttagcagccgtgctggaggcttctcctaggctggcggaactgcacagagctagggaagctcgccgccccgtcagagtagtggctagaagggccacagcagttcgagcccggcctgagacagcatctcgactgctggtggacacactcccagagttggccagggaacttgacctcactgtcggacggcttctgtggctggcagacacgcgatcctggaatagacggcctggcccttcttcccctctgcaccaccaccgctgtgagtggattcgtcggcccgggagaacaccgaggttgctggaaaagccaatggacatgctgcgaagaacacagaggactatactggatgagctcctcactgcgctaccggtccatgacgccgctcacggattcgttgggggacgcagcgttgtaaccggtgcggctgctcacacgggtaggcagatcgtggtcaccgcggacctcaccagtttctttgccagcgtcactgccccgactgtgtacggcgtgttcagggctgccggcttcgctgagcctcttgcacatgtgctgactggagtgtgcacccatcgggtccccgtccatgtgttgtccgccatgccagatggcggctcgccagaagaaaggcaggccctacgggcgatgctgagagaggctcacctccctcaaggcgcaccaactagccccgcccttgccaacaccgcattgaggcatctggatgcaaggttggcggggtgggcagcatctgttggcgcagtgtacacccgctatgctgacgaccttaccttctccggagatgagcgattagcggcacggcccgatgcttttctgcggggtgtagaccggatcgtcaccgaacagggcctccggctgaaccccagtaaaactcgtgccaggcgccgtgggacaagacagagcgtcaccggggtggtagtgaacgatcgcacttcaccagggcgccgtgaagtagaccggctccatgctattctacacaacgccgccgaacacggccccgagagtcagaatagagccgggcacccggatttccgcgcacatctgttaggccgaattggctgggtggaacaggtgcatcctggtcgagcccgtcggctacacgaggagtttgcccggatcacgtggtga

SEQ ID NO: 12928 - RNA, 1485 nt, unidentified
  source 1..1485: mol_type = other RNA; note = synthetic construct
atggagtttcctggcgaagccgccggagctagggatgcatccacttcaccaggggcaccaaggggaactcaggaccagcaggatgacactccaagggccggggagagggctcctagagcaacactgcacggcggtacagacagaagttccggaaatcctaccccactgtcagtcgtcactgccgcccttgcggatgcattcctgacagctgaacggtgggaggctgacgagctcaccgccgttggctacgtggtggttggcgtggagcgcgcttatgtcggcctggcagtcgctgccgcattggaagcctatccccgccccccagttgatgcgccaagaaggctggctgcagttctggccgctgctcctcggctagtggcccttcataggtccagagaggaccgtagacccgtgcgggtgttagttcgccgggcaaccgcagtgagagctagaccagagactgccagccgcttactggtcgacacgctcccagagcttgcgagggcactcgatctgactgtcggcagactcctgtggttggccgacacgcgggcatggaaccgacgatccggtccgtcgtctcccttgcaccaccatcgacacgaatggataacacggcctggaagggcccccagacttctggaaaagcccatggacatgctgcgccggactcagaggaccatcttggatgagctgctgaccatgctgcctgtgcacgacgcggctcacggttttgtgccgggcagatccgttgtcacaggtgccgccgtgcacacagggcagcaagtggtagtgaccgctgacctgaccaccttctttgcatctgttagcgcccccacagtgtacggtgtgtttcgcgctgcaggattcgcagagcctctcgcccacgtcttgacggggctgtgcacccatcgggtgcctgtacatgtactcagtgccatgccagctggaggctcaccggaggaaaggcacgccctacggcaagcgttagcgaccgcccatttacctcagggggctcccacaagccctgctctcgctaatacaagcctgcgccacttggatgcgcgattagcaggatgggcgggggccgttgatgccgtatacacgcgctacgccgacgacctcaccttctctggtggtgatcgccttgctgcccggccagatgcctttctccgtggcgtcgatagaattgtcactgagcaggggtataggctcaatccctctaaaaccagagtgagacgccgaggggtccgtcaaagcgtgacaggcgtggtggttaacgagcgtcctagtcccggccgaagggaggtagacaggcttcatgccgtgctgcacaacgctgccgtgcatggaccggcctcacagaaccgtagcggacaccccgaattccgtgcccatctactggggcggatcggctgggtcgaacaggtgaatcccggcagagcaaggcgcctgcgggaagaattcgcacgaattgtatggtga

SEQ ID NO: 12929 - RNA, 1485 nt, unidentified
  source 1..1485: mol_type = other RNA; note = synthetic construct
atggagtttcccggcgaagctgccgatgctcgagatgctagtacctcccctgggtcgccccgggatactcaagaccagcatgatgacacaccacgagccggagaaagggcacctcgggctacaccacatggcgggacggatggtagccccggaaatccaacccctctgagcgtagtggccagtgcactcgccgacgctttcctgaccgccgaccgatgggccgtcgatgagttgaccgctgcaggctatgccgtcgtcggagtagagagggcttatgtgggccgcgctgttagtgcagctctggacgcatacccacgacctcccgcagatgcaccaaggcagttggctggggttctggccgccaatcccagacttgcggccctgcatagaagcagagaggcgcgcagacccgtcagagttttggctcgcagagccacagccgttagggcaaggcccgtgaccgactctcctctgctcgtggacactctgcccgagcttgctcgggccttggacgtcacagtgggacgccttttgtggctggcggatacacgcgcctggaacagacacgctcctgccggatctccgctgcatcacttacgccatgaatgggttgttcgccccggacgagtgccacgcttgcttgagaaaccgatggacctcttacggcgcacccagcggacagtactggatggcctgctgactcggttacctgtccacgatgccgcacatggcttcgtgccaggccgaagcgttgtgactggtgccgccgtgcacactgggcagcaagtcgtgctgaccgccgacctcactaccttctttgcaaccgtatccgcaccaaccgtgtacggcgtgttccggtccgccggatttgctgagccactcgcccatgtgctcacgggcctgtgcacacatagggtgccccctcacgtccttgctcgtatgccagcgggggggacacccgaagaaagagctgcactgagggaggcgctcgccgtagctcacctacctcaaggggctccgacttccccggcacttgcgaacaccgcactacggcacttagacgctcgtctagcgggttgggcatctgccgccggtggaagatatacgcggtacgcagatgaccttactttttcaggagatgatcggctggcggctcggtcagaggcctttctgaggggtgtggagagaatcgtagccgatcaggggcatagattgaacccccacaagacgcgtgtgagacgtcggggcacaaggcagagcgttaccggcgtcgtggtgaacgacctcccctctccaggcaggagggaagtcgaccgactgcacgccgtgctgcacaattgtgtcgtgcacggacctgcatcacaggacagaacagggcaccctgacttccgcgcccatctcctgggtcgcatagggtgggtggaacaggtgcaccctggcagggccagacgtctcagggaggaattcgcccggattcgctggtga

SEQ ID NO: 12930 - RNA, 1314 nt, unidentified
  source 1..1314: mol_type = other RNA; note = synthetic construct
atggtggccaccgccttggccgacgcctttctagctgctgaaggctgggacactgcacacctcactgccgctggccttgatgtcgtgggaccggagcgagcctatgtgggcctagcggtacgcgcagcattagaaacctaccctaggccacccgtaggagctcccagacaactggctgccgtggttgcgagagccccagctttggcccggcttcatcaccgaagggctgacaggcgcccggtgagagttctgcagaggagggctgtgcctgtcagagcggtacctaccgtgagctccagactgcttgtggatactctccccgagttggcaagagagctcgatctgacagtcggtcatttactctggctggcggacacccggggctggaatagacgtcctggtgctagcagtccgctccaccaccatcggcatgagtgggtcagacgccctggtcggacaccacgcttactggagaagcccatggatttgctgcggaggacccagcgcacgctactcgacgaactgctggtccatctgcccgtgcacgatgcagcgcatggctttgtagccggccggtccgttgttactggtgcagccgcccacaccgggcaagaagtggtggtaacggccgacctgacgaccttctttgccagcgtgcgtgccccatccgtctatggcgtgctgaggagtgccggatacgcggagcccttggcacacgttctgactgggctgtgtactcattcagtccctgttcacgtcttgcgagcgatgcccgacgggggatctttggacgatcgcgccgcattaagaagggccctggctgatgctcatctccctcagggagccccaagctctcccgcacttgccaacacagtgctgaggcacctggacgctagacttgctggctgggcagccgcctctggagctgtttatacacgttacgccgacgacctcacattctccggcggaactgctctcgctggcagagtcgatgcattcctgcggggggtagatcggattgtgaccgaccagggacacaggctcaaccccgctaaaacacgtgtgcgcaggcggggggtccgtcaaagtgtgacaggggtggtggttaacgagcggacctcaccagggcgccgagaagtggataggcttcacgcagttctgcacaattgcgtggagcatggaccagcctcgcaagaccgggcagggcatgcagattttcgcgcccatcttctgggtcgcatcggctgggtggaacaggtccaccctggcagagcacggcgactgcacgaagagttcgcccgaatacgctggtga

SEQ ID NO: 12931 - RNA, 1494 nt, unidentified
  source 1..1494: mol_type = other RNA; note = synthetic construct
atggagttccctggcgaagctgatgacgctagaggggcctccagctcaccaggttctccacgggggactcaggatcagcaggacactactcctagagctggacgacgagctcccagggccactcctcatggaggtacagacggatcacccggcaacgccacccccttagatgccatcgccgtggcgctggccgatggatttttggctgccgacgcctgggacctgccaacactccgagctgccggctttgacgtcgtgggcattgagcgggtgatagtcggtgcggccgttgttgctgcactggacgcattcccaagaccacccacggacgctccaggctcgttggctgcagtgctagccaggacaccgcgcctcgtaagcgaacacgggaggcgtactcggcgtcgtccagtgagggtactcgctcgccccgttagccctgtacatgccgccagacacgtggaaggccccttgctggtggataccctgccggagcttgcaagggctctcgacctgacagtgggtagacttctgtggcttgcagataccaagggctggaatagacatgcagatcccgacggccccttacaccactaccggcacacatggactgtacgccccggcaggacgcctaggttacttgaggcccccatgcatcttctgagacgcgcccagagaacagtgctcgatgagttgctgacaaccctcccagtccacgacgctgcgcacggatttgttcccggccgcagcattgtgaccagtgccgctcgtcacgtcgggacggaagtggtggtcacaatggacctgacctccttctttgcgaccgtcagggccccttccgtgtatggggttttccgcaacgcagggttcgcagagcctgtggcacacgttctcaccggtctgtgcgtgcatgaggtgccccctcacgtccttcgagctatgcctgggggaggagggggctctctggatgaacgggtcgcactgcgcagggcactggcagaagcccatttgcctcagggcgcccctacttctccagcgctggcaaatctggccctccgacatctggatgcccgcctcactgggtgggcagtagctgcaggggccacctatacgcggtacgctgacgatctgaccttctcaggaggggccgctctagctgcccgagttgatgccttcatcgcgggagtcgaccggatcgtacgggaccaaggccatgaggtcaatccccacaaaacccgggtgcggagacgaggtgtacggcaagccgtgaccggcgttgtggtgaacgacagattaagtccaggtagggccgaggtggaccgactgcacgcaatcttgcacaactgtgtccggcatggaccagcttcccagaatagggatggccatccggagtttcgcgcgcaccttctcggacgcataggctgggtgggacagacacatccggcaagggcggccagactaagggccgaatttgatagaattgattggagatga

SEQ ID NO: 12932 - RNA, 1491 nt, unidentified
  source 1..1491: mol_type = other RNA; note = synthetic construct
atgggctttcctggtgaagccgacggagtgcgaggcgcatcttcctctccggggcaaccaaggggcacccaagagcagctgacccatccacctcgagaagcccgtagagccccacgggcacttcctcacggctcaaccgaccagtctcccggcaatcctggaccccttgccgaagtagcgcaggcccttgccgatgcgttcctgacagctgatgactggagccgccccgctttgactgctgtgggatacgacgccatcggtgtggagcgggccatagtgggtctggctgttggggctgccctcgatgcctatccaagggcgcctagtgacgctccgcgacaactcgcccgcgttcttgcagctgctccacggctgcagtccgcatatgctgccagggaccccagagtcagacctgtccggatcttggcacgcccggtaggagctgttagggctggacggagcgttgatagccccctcctggtcgatacagtccccgaactggccagggccctggatctgactgtggggcacctgctgtggttagccgatccaggcggttggaataggcgccccgacgcatccagcgcattgcatcactacggatatgcttggatccctcgaggcggtcgtacacctcggctgattgagaagcccaagcctttactccgacgcacccagcgcctcttattggacggactgctcggggcattgccagtgcatgacgcggctcacgggtttgtcgccggtagaagtgcagtaacgggggccgccgaacatgtaggtaggcaggtggtggtgacggttgacctgacagcgttcttcgcttcagtcactgccgggtccgtgttcggcgtgttcagaacagccgggttcgccgaaccagtcgccagagtgctaaccggcttgtgcaccgctcgagtgcccgttcacgctctacgtactatgccagacggcgggtctgtcgagcataggtttgccctgagacaggccctgaggctgcctcacctaccccaaggcgcaccctcaagccctgtgctggctaacctcagcctgcggcacctcgacgcaagacttgcaggacttgctgccgcatccggagccacctacacgcgttacgcagatgatctgactttctcgggcgacgatcattttgccggcagtgtggacgggtttttaagagcggtcggccgtatagtggtagagcagggccacacaattaatcaggccaaaacaagggtcagacggaggggacgcaggcagagtgttaccggcattgtggtgaacgaacgcgttgcgccaggtcgggcagagcacgatagactcaaagccatcctgcacaactgtgcagtgcacggaccacaggggcaaaatcgcgcggggcatccggatttccgcgctcatctcgagggaaggattacttggatgatgcagttgaaccccgagagaggagcacggcttcgggctgtgtttgagagaatcgagtggggctga

SEQ ID NO: 12933 - RNA, 1500 nt, unidentified
  source 1..1500: mol_type = other RNA; note = synthetic construct
atggctcgattcagaggagaggccgatgacgctaggagggcccctagtagcccgggatcacctaggggcacccagaacgaccagcagcatacacctcgagaggctaggcgtgcttcccgggctaggccacatggacggatcgatggttcccctcggaacagaggacacactcccctggcagtagtcgcacaggcccttgccgacgcattccttgctgcgccagaatggactatacccgctctcgatgaagccggttttgccaccgttggcgtggtccgccccttcgttagggtgactgtggtgactgccctggaagcatatccacggccaccccgagatgctcctaggcagctcgccgcagtcatcctacggtcaccccgtgtggtggatctgttcgaggccagggcagccacaaatcctgttagagttgtgtctcgcagcgtcggtcctgtagaagcgagagccgaccacgaaaccgcatcccgccttctggtggatactgtacccgcgctggcaagggaattggacctcaccgtagggcggctactgtggctggccgatactagagggtggaatcgcactgccgcagagggcccattgcaccactatcgctacgagtggctcgcaaggcctgggagaacaccgcggttgctcgaaaaacccctgcatcgtctcaaaacaacccagcggaccatccttgatgacctgctgacggcccttccagtccacgacgctgctcatggcttcgtgacgggcagatccgccgtgacaggagcagctctccatgtgggccaggacgttgtaatttctgctgatttgacgagcttcttcccctccgttagggccggcagcgtctatggggtgtttcgcgacgctggttttgcagagcccctggcgcatctgctgaccggtgtgtgcacacaccgggtgccggttggtattctcagtgcgatgcctcccgggggatcgcctgatgagcgattcgccctgcgccagcggttaagtgccgctcacttaccacagggggctccaacatccgccgcattgggcaatctggtgctcaggcatctggacgcgcgtttagccggctgggcaaagtctgcaggaagtgtgtattctcggtacgcggacgaccttaccttttcaggcggagcgtcattggccagcagagccgatgctttcgctagaggggttgaccgaattgtcgccgatcaagggtacgctctcaacccccagaagaccagagtgaggcgccaaggggtgagacagagcgtcaccggcgtcgtggtcaacgaacgcacctctgccggccgacgtgagtacgacttgctgaaggccacacttcacaactgcctacgggacggaccagcccgccaaaatagagggggccggccagattttagagcccacctggccggtagagtgggctggtttgagcaatgtaatccggagcgaggagcccgcctgaggagcttatttgagcagatcgcatgggcttga

SEQ ID NO: 12934 - RNA, 1539 nt, unidentified
  source 1..1539: mol_type = other RNA; note = synthetic construct
atgaggtggtccccaggagaagctgatggcgctagagccgccgcttcttcacccggtttgcctcgcgggactcggatcgaccaggaacacacacctcaggagcttggaagggcgccacgggcagatgcaccagagagacacgacgaaagctcaggcgatcaccagcatgccgacccaccccctacctcaaggttggtggcacccgagcgaagcgctggactcgtcgagacagccatcgccctggcagacgccttcttagccgctagtgcttggcgcccggccgaactatctgcagcgggtacaacgaccgtgggcaggaggccaggcttagtggaacctgccgtcgccgccgttttggccgtgtatcctagggcaccacgggacgctccaaggcgacttgctggcgtgctggcatccgatcgcagcttcacagccgcatttgctcggctcactgccagacggcccgtacgtttacgcgtgcggaccgtagccccagtagttgccgctcccgttgcggcacatgtgcctgtggttgacgccctccccgatctggcagccttgcttggcgtgaccactgagaggctcctctggtttgctgacacccgtggttggaatcgacgcgtgcctgccggatccccactgcatcattacgagcaccgttgggtgcaaagaccaggcaggactcctcggcttctggaggcacccctgcatcagctgcgcaccatgcagcgggtagtcctggaccaggtcctagcacccctgcccctcagcgatgctgtgcatgggtttgtgaggggaaggagcgcgcttagcggtgccgaagtgcacgttgggcacgatgttgtcgtatctgctgacctggtgtccttcttcgccgcagtgcccgcctctagagtttacggaatttttagaagggtagggtatgccgaaccggtcgctcacgtcctgaccggtctgtgcactcacgtggtgcccgatgctgtgctcagagcgatgccccctggtggggatcttgacgagcggtgggccctgagacaagccttggccacaccccatctgcctcagggtgctccgagttcacctgcactcgctaacctgtcgctgagacggctagacgctcgtctcgctggctgggctcaagcagcagacgcggtgtacacccgatacgccgacgatttggctttcagtggggatggggcaattgctgcccggccagatgcttttctgcggggcgtggacagaatcgtggccgatgagggtcacgcactgaacccgcgtaagacgcgcgtacgcagacagggagtccgacagagtgttacaggagtcgtggtcaatgcggtcccaggggtcggacgacgcgaacttgatagactgagagcggtgctgcacaactgtgtccgctatggtcctgcctcccaagacaggggcgaccacgcagactttcgggcccatttagaaggccgcgtggggtgggttgagcaggttcacccggccaggggagccactttgagagcggagttcgagcgaatagcctggtga

SEQ ID NO: 12935 - RNA, 1521 nt, unidentified
  source 1..1521: mol_type = other RNA; note = synthetic construct
atgcaacgcccaccaggggaggctggaggaacaagagcggtccccccttctcctggtcttcccaggggaaccaaaatcgatgaaaatactacaccacgggaagcggaacgtgcatctcgcgccctgccacctgcacctgcagatgagtccttcgggggtcgcagccagcatgacgccaatgccgacattgctcacgagcccccaggagccaccttagccgaagtggcacgagccctcgcagatgctttccatgccgcgcctgagtggtctgcacccagcttgttggccgctggctccagtgtggtggggtctagaagagcctttgttcgggtcgccgtcggcggcatactggagtcactgcccaggtctttacccgattccccaaggctactcgcccggctcattttggatcttccggggtttgtagccagtttccgcagagggactcggagaaccccagttcgaatccgatctagagcaattgccccaaccagggcagtgggtcctggaccaagagtggacactgtggtagacctggctaggttactgggagtcacggtcggccgcctagagtggttcgctgacacccaggggtggaatcgcctcgccgaggaaggtcctctgcaccactataggtacaagtggagggtacgccctggccgagttcccagattgctggaggtgcctctggaccgtctgcgaaccatgcagcggatcatacttgacgaactgctgaccccgatgcccctgcacgatgctgctcatggcttcgttgccggcagatcggcaattaccggggctgctgagcacactgggcgtgatgtggtcataggcctggatctggtcagttttttcgcgagtgttaccgccaaacaaatttacgggctctttcgccgggccgggttaccagaaacagtagcgcatctgctgacaggtgtgtgtacacatagcgtgccgcctagagtgcttcgtgcaatgcccgcaggcggctcagcttcagctcggtttgccctccggcaggcattgtccacgccgcatcttccgcaaggcgctccaagctcccctgcactcgctaacctgagcctccagcggcttgattcccgccttgcgggatgggcagacgcattcggcgctacttatacacgctacgccgacgacttggcgttcagcggcgatgcctccttggcctcaatggtgagggagttcgtacggggagccaccgctatcgtggttgactcgggacatacgatcaacgcccctaagacaaggatcaggagggctgggacccgccagactgttacaggcattgtcgtgaacgccactactgcccccggaaggagagagtatgaccgtctccgggccgtggtgcacaattgcgtgacacacggccccgaaggtcagaaccgcgagggtcaccccgcttttcgacaacagctgctcggacggatcgcctgggtcagccagctacaccccgaaaggggcgcaagactgcggagagaatttgagctgatccgatggtga

SEQ ID NO: 12936 - RNA, 1422 nt, unidentified
  source 1..1422: mol_type = other RNA; note = synthetic construct
atgacaccccgcgaggcaaagagagcctcccggactttacctcccgcacccgctgacgagtcatcaggcggtagactgcacgctcgcggaggtcaaccttcaggggcctctccttacgaggtcgccgtggtgcttgcagatgccttcgcggccgctccaggttgggatgttcgtagcctctccgcagcaggaaccgccgcttttgggagtggccggcgattcgtaccactggctgttctgggggtactgcaggccctgccaagaccgatcctagactctccccgcaccactgcccgactgatcgttgcgttgcctgggtttgtggaggccgtgaggaggtctgctgaacgagcgcctgtcgtggtcctgtcgcgggaagtggttcccgtagcagcggtaggaccaggaccgcgtgtagatacggttgccgacctcgccaggttactcggggttaccgtcggtcgcctcgagtggttcgcagacacaaagggatggaaccgcagagctcccgcaggtccccttcatcattatagatacgagtgggtttcccgccctggacggacacccagactccttgaggtccctctgggccttctgaaaaccgtccagcggacagtgttagacgaattgttggcccccatgccactgcatgatgccgcccacggtttcgtgcccggtcgatctgctgtgactggggcagcccttcacacaggcagagaagtggtcctggcactggatctagtgtcctttttcgctgcggtgagcgccagacaggtgtacggcctttttcgtcgcgcaggtcttgcagagcccgtcgcacacttgctcgctggcgtctgtactcacgccgtgccagtccacgttctgagcgctatgccggacggcggaagcagcactgagaggtttgaactgcgtcgggccctcgctgctcctcatttgccgcagggagctccatcttccccagccctggcgaatctgagtttggctgggctcgacagaaggctagacggatgggctagggccgccgaagctgtgtacacacggtatgcagatgatctgagcttcagtggggatggcgagttggggggaagggtacctgccttcctgaggggcgtggaacgcattgtgaccgacgagggccataccgtgaatgcccgcaagacgagggttaggagggccggagtccgccaaaccgtgactggcattgtggtgaaccagaccacaagtcctgggcgaacggagcacgaccggctgaaagccattgtgcataactgcgtgagatatggcccagcatcacagaatcgggatgggcacccagcgttcagagagcacctcctgggccggatagcatgggtcgaacagctgcatcccgccaggggagctagactccgagccgaatttgacttaatccggtgggattga

SEQ ID NO: 12937 - RNA, 1374 nt, unidentified
  source 1..1374: mol_type = other RNA; note = synthetic construct
atgaagccccctggcactagaacggccagagcgcttgctgccgccttcctaggttcccccgagtggagcgcaccagccttagtcgaacaggggcgagtggtactcgatcctgcccctgactggcttcctgctgtagccgcagctgccgtcgcagcacatagggagccacccagagatgcccctagagagctggccggctttctcctgggggtgagagaggagttgctggatgcgcgccctcggcttgacgatgatggcgagccactacctaggccagcagagcccagggttcgagcctggttacccaccactccacggatgggaagagctcggtggcccgttcacccgctacacgacctggctgatgtcgccgagatgctgggcactgacctggatcacctgagctggtacgcagatccacagggccgccaacggacagaacccgcaggacacctgcagctgtatcggcgcagatggcttccgaggcctggtagagtgccacggttgctggaagtccccacccctcgcttacgggctgtccagagggtgctcctggatcgggttctcgcacccatccctcctcatcccgcagcccatgggttcgttgctggcaggagtgccctcacgggagcaaggcagcacgtgggtgccgaagagctgttgacactcgacctcgccgccttctttgctaccgtacgcgctggtcgggtgtgggctactctccgatctgctgggtaccccgaaccggtggcctcactgttgacaggcctgtgcacaacctccgccactcgagacgatcttgcaactatgccacccggaggttctgaaggcgcacgagcccatgttcgtgcggccctagccacacctcacttaccacaaggcgcaccgacgtctccccagcttgccaatctggcggcacaccggctcgacagaagactggctggattggctgcggcggcaggtgctgtctatacccgctacgcggacgacctcaccttcagtggaagaaggggcaccgccgctctcaggcatcgagtagcggtcgtggttgcagacgagggctttgcgctgcagccggctaaaacacgggtccgcggacgtggagctagacaagccgtgacaggcgtggtggtgaacgaacgccctagcttacccagggccgaactggacgccttgagggctcgcttgaccaacgccgttaggcgggggccatcagcagctgatctggctgccgtggacggggaccgtcaagctcttcgcagggagcttgccggaagaggggcttgggtgactcaggtccacccagtgcgaggggaacgtctggctgctctactggccgccgtggactttgcagagccagataccgacctgtga

SEQ ID NO: 12938 - RNA, 1455 nt, unidentified
  source 1..1455: mol_type = other RNA; note = synthetic construct
atgagcgtcagatccgcccacgcttacgccggaactaccggtcaggtcgacccgcaccatcggactcctctgttccacgtgaaacagcctccggaacagagaacagcaagggccctcgccactgccttactggctgacggtccgtggaccgtcgagggactaaccgctagaggacggcgtgctcttgatccagcccccgattggctcccagccttagccgcagctactgtcgcagcatggcgcgaacctcctagggatgctcccggagagttcgcccgctatctgtcagccgctcgggaacatccaccagcggagccacctggctacgatgacgaggaggatctccctcctcctgttcccgagccaagagtgcgcgaatggctccccacagctactcgcatgggtagggccaggtggcccgttcacccattgcatgacctctcagacgtggccgagttgctggccaccgacctggatcaactgcgatggtacgctgaccccctggatagacagaggaccgagcccgctggccacttacagctctatcggcggcattggcttgcaagaccaggtagggtgcctcggctcgtggaagtgcccacaccaagactgcgccgcgttcagagagtgctgctcgatgcagtacttgcacctgtccccccccatcccgcagcacatggatttgtggccgggagaagtgcgctaacaggagcccggcaacacgttggcgccgaacaattgctgaccatggacctggctgcgtttttcgccaccgtgagatcgggacgcgtgtttgccacactgcgctccgcaggctatcccgaacccgtagctgccctcatcactggcctgtgcacaactagggccacacgggatgacctggctaccatgccagctggcggtactcccggagctagagatcacgtccgagccgcccttgcactgcctcacttgcctcagggggcccctacaagcccacagctggcaaacctggcagcacacaggcttgatcgcaggctggcaggtctagctgcaagcgcgggtgccgtatacactcggtatgccgacgacctcacgttctctggaaggcgcggcacggctggacttcgtcatcgtgtcgctgcggtggtggctgaagagggcttcacggttcagccgaccaagaccagggtgagaggtcgcggagcccgtcaaacagtgacaggggtggtggttaatgaccgaacctccctcccccgggccgagttagatgcactacgagcccggctgacgaacgcggtcagacgaggtccatctgcagccgacctggcagcgtttgatggggatcggcacgctttgcgtcgacacctggccggaagggttgcctgggtcgctcaggtgcatccggctaggggaggtcgattggcgggattgctggcggccgtagactggagtggaccagacaccgacctttga

SEQ ID NO: 12939 - RNA, 1383 nt, unidentified
  source 1..1383: mol_type = other RNA; note = synthetic construct
atgaatcagcggaccccccctggtacacacactgctcgtgcccttagcgcagccttcctgggggcacctcattggacagtggatgccctggtggcccacggaaggagagctctcgaccctgccccagactggctagcaggagtagcagccgccgccgttgaggcttggcgagaacctccaagagacgctccacgggagttcgctcgctttctgctggctgtccggacccaattagcagccgtccctcccgcctatgacgacgaagaggatcttccccctcgaccggcggaaccacgagtgagagcctggttgccagctgcaactgccatggggagaaccccctggcccgttcatcccctccacgacttagcggatgtcgcggagctgctgggaacggacctagatcacctggcctggtatgctgatccgcagggcaggcaacgacacgagccagcagggcacttgcagctctacagaagacggtggttggcccgacctggcagagttcccaggctgctcgaggttcccacaccacgcctgcgagctgtgcagcgtgtgctccttgacgcggtcttggcccctatcccagcccatccagccgcacatggctttgtgcccggacgcagtgccctgactggagctaggcagcacgtgggggcagacgtggtcctaaccatggacctcgccgccttctttgccaccgtaaccgcgggccgtgtatgggctacccttcggactgccggctacccagaacctgtggctacgctgttgactggactgtgcacgacacgcgctacccgggatgacctggcaacaatgcctggcggcggtactgacgcagctagggatcacgctcgcgctgcactggcaaggcctcatctgccccaaggcgctcccacatctccgcagctggcaaacctcgcagcacaccggctcgacaggcggttagacggcttagctgctgcggctggagccgcttatactcgctacgccgatgatctgtcattttctgggggtagaggaaccgccgccttaagggatcgggtggcagggattgtggtggatgaggggttcgcggtgcaacccgccaagactcgggttagaggccgcggtgcaaggcagacagtaacgggcgtggtcgttaacgagcggacctccctccccagagctgaactggacgcccttagggcccgcctgaccaatgcggtacgtaggggtccgagcgcggctgatttagccgccttcgatggggatgtgcatgcattgcggcgtcacttgacaggacgcgtcgcctgggttgctcaggtgcatccagccaggggggaaagactggccgcactccttgccgacgtcgattggggccgcagagacacatccctgtga

SEQ ID NO: 12940 - RNA, 1638 nt, unidentified
  source 1..1638: mol_type = other RNA; note = synthetic construct
atggcgagaggtaggggacgacgcacagctggcagatccgggtctagtggcgatgcacccgggactgctaggcgtctccaccatgacgcctctggcgctgccctaagatccgctcagcagtcagcaggcccgacaggtcaagtggaccctcgccacaggacacggctgttccacgtgaatccccctaccgcacggacaactgcacgtgccctggcagatgcctttctgggcgccagagagtggcaggtacctgcgctggttgctcgggggagattggtgctggacgcagagccggattggctgactgatctcgcacgcgcagccgttacagcctggcgtgtgactccacatgatgccccagccgagctggctcgcgttcttctggcggtcccaggtgtgttcgagccccctgtgccggagatggtcacctcaggcgaagatggcgaggatgacgacgaagacggctttctcgtctgggcggccgatgaggagcctgaaggatggcaaggtgctcgagcggccgcaccaggtagtcctcgtgtggtgagatggctacccgcccacacacgtatggggcgaacgccttggcgggtagctcctcttgacgacctcgctgacgttgccgaactgctcgccaccgatctggaccatctggcctggtacgctgacagacagggtcggcagcgggctgaaccatccggaagactgcagctctacaggagacactggcgcgtaagaccagggagggttcctcgcctgctggaaacccccaggcctcgattacgaaccgcgcagcgcgtgttgttggaccgggtgttagcacctgtcccgcctcaccctgccgcacatggatttgtgaccggaaggtcagcggtaaccggcgcccaacaacacgtgggcgctgatgtggtgttaacgatggacctcgcagccttttttgccactgtgacaagcggcagggtgtatgccacattgagaactgccggctatccagaacccgtggccgatcttctcacgggactgctgactactcgggccaccagggacgacctcgctaccatgcctccaggaggatctgatgccgctcgggcccatgtgagatctgccctagccgccccacatttaccacaaggggctcccagcagtccccaactcgcgaatctgtgcgctcagcgacttgaccgtcgccttgcggggtatgcagctgcagccggtgcagtctacacgcggtacgccgatgacctgaccttcagcggtggacccgatgtagcccggcgtgttggagctctgagacacggggtggcacgaatcgtcgccgcagaaggcttcgctctgcagccagccaagactcgggttcgtgggaggggcgcaaggcaaacagtaaccggcattgtggtgaacgacagaaccagcctgcctaggcgggagttggacgcactacgcgctaggctgacaaacgccgtcagattagggccctccgtccaggatcttgcggccttcgacggtgacaggggcgctttgagggcacacctcgctggacgagtcgcttgggtcgcccaagttcaccctgtgcgtggggagcggcttgctgctctgttggccgcagtcgattgggatcccgttgatacccatctctga

SEQ ID NO: 12941 - RNA, 1350 nt, unidentified
  source 1..1350: mol_type = other RNA; note = synthetic construct
atgaatcgcgaggtggccagagccctggctgatgctttcctcggggcacctgcttggcgtgtctccgtcctggtggacagaggacgcgccgttctgtccaccgaacccagttggctaggcagagcagccgtcgcagccgtaacgtcatggcccgaaccacctgttgatgccccgggagaactggcgcgctttttgctcggcgtcgacgtcggccctgaagatgaagaggctcgccctgagccccctcccagagttgttcggcgggttccaactcccacccgtatgggtcgtacacggtggcctgtccaccccctgcatgacctggcagatgtggcggagctgttaggtacagatctggagcatctggactggtacgccgaccggcagggaagacaacgcgcagaacccgccggccaccttcagctttatcgacggaggtggttgccaaggccgggtagggttccgcgtctcttggaagtgcctacccctaggctccgcgcggtgcaaagactgctcttggaccgggttctcggaccagtgcccgctcatcctgcggctcatgggtttgttccaggccgatctgcagtcactggggccgctcagcacacaggagctgatgtggtgcttacactcgacctggctgccttctttgctacagtaacaagcgggcgggtgcacgccactttacgcactgccggctatccagagccagtggtggcgctactgaccggcctggtgaccactagagccacgagggacgatctcgctaccatgccgccaggaggaaccgacgctgcacgacaccagctgagaggtgctctcgccgctgcgcatttaccacagggcgcacccacctcacctcacttggccaacctgggagcccagaggcttgaccgtcggttggctgggtatgccgcagtagctggtgccgggtacactcggtacgccgacgatctgaccttcagtgggggccctgacgtagctagacgagtgcgcgccttgcagcacgggatcgagaggatagtggccgacgagggctttgtggtccacccaactaagaccagagtacgaggcaggggtgcccggcaaaccgtgacaggaattgtggtgaaccgcggaacaagccttcccagggcggagctggatgctctcagggcaaggctgacaaatgccgctcgccgagggccatctgcagcagatcttgccgccttcgacgacgatagggtggccctgagagcacatttaactggccgggtcgcgtgggttgcacaagtccaccccgcaaaaggggccagactggcagcactacttgccgccgtagactgggatggccccgatacgagcctgtga

SEQ ID NO: 12942 - RNA, 1362 nt, unidentified
  source 1..1362: mol_type = other RNA; note = synthetic construct
atgagcacagatcgggggcaggaagtggctagggctctggctgatgcctttctgggcgcgcctgtctggctcccttcagcacttctagcgcgggcggagttagtgatcggtgccaggccaccctggttggctgctgttgccgtgaccgccgctactgcctatcaggagccacccagggatgcccctggagagttagctgggtttctggctgcaagcagcgccctggaagcaggcctgttagccggaaaccccactgtgaccgccagaggaagacgtagaagagcccccgttagagtcgttaggcgcctgcctgcctctacagcaatggggaggactaggtggcctgtcgtgcccctcgatgacttgggggacttggcccgcctcctcgacgtagatcccggtcacgtggcatggtatgccgacggacaggggcgccaaagattggacccccccggtaggctgcatctctaccgtcgcgcatggttgcctaggccaggcaggacaccgaggctgctggaagtaccgaccccccgactgcggagagttcacagactcgtgctggatcaggttctagccccagtgccagcccatcctgccgctcatggatttgtgcccggtcgatctgccctaacaggggctcgccaacatgtaggcgcaggggtcgtggtatccatggacctgctttcattcttcgcaactgtgcacgtgcgccgggtgtattgggtgctcaggacagcaggctaccctgaacccgtggcatctgcactggccgggatctgtaccgttgcaactccggtcgccgatcttcgggctatgcctgctggtggcgacgatcaggagcgcagcgctcttagacgagccttggcagctccacacctgccccagggtagtccatccgccccacacctcgcgaatctgtgcgctcagcggctggaccgcagacttgctggctacgctggctcagtcggagctgtttatacccgctacgcggatgatctgaccttttccggtagattccgcgcgggaccactcatatcgggagtgggagctgtcgtacgggaggagggcttccggctaaacgtggacaagacgcgagtccgtgggcgtggcagtaggcagagcgttacaggcattgtggtgaacgagcgccctacggtacctcggccagagtacgacgcactgcgtgcccaactgttcaatgcagcaagaagagggccgagtgcccgggacttagcggaacacccagacctcagggcccatctgaccggaagagtcgcctgggtggcccagttggaccctgaacgaggccgacggcttagggcccttctggatcgggtcgattggtctggccccgcctcctga

SEQ ID NO: 12943 - RNA, 1065 nt, unidentified
  source 1..1065: mol_type = other RNA; note = synthetic construct
atgacaggcagaggcgaacaagctgtcgcctccgccttagccggggcttttcttgccggcgattggaccgcgagcgaactctttgagcgcggtagcacaaccttgggcaggcgtccgcgatggttgagacgagtggttgtggaggtgctgtcactgtatcgagaggcacctgtggatagacctcgcgaactcgctacagtggtgctggcaactgacgggttccagacagcagcgtctcccgcacagcggcatgaaggtcctcccctgagagtcgtgagaattctggtggagcctactcggatggtccgctcaaggtggccagtagcccgggtggacacggttaccgaccttgcggatctcctggaactgggggtcggccacctgacttggtacgccgataccgctggaatgcagaggagaactagggttcaggctctgcagctgtatcggtataggtggttagaccggcccggaagggccccaaggttactggagattcccaaaccgcgcttgcggcgagcccagagattgctgctggacaggatcgttgccagagtcccagctcatgccgctgcccatggcttcgtaccaggacgtagcgcaaggactggcgcaaccccccacgtaggtaccgacgtggtgatcggactggatctcgctggatttttcgcctccgtccccgcgcaaagaatctacgggatccttagagtcgccggttaccccgaggcagtggctcacataattaccgggctgtgcaccactgcaacacctatagctgttttagcggctatgccagccgggggttctgccgatgatcgctacgcattgcgtcggaccctaacgatgcctcacctgccacaaggggccccaacatccccgcagctcgcaaacctctccgcttaccgcctcgactgcaggctagccggacttgtggctgctctaggcgccacctatacgcgctacgccgacgaccttcgctgtcctgccgatcccacatggcgtggtcggcctcgaggatcgagtgctgcaagtggcgggtcaagcgcaactcggggatctggctga

SEQ ID NO: 12944 - RNA, 1038 nt, unidentified
  source 1..1038: mol_type = other RNA; note = synthetic construct
atggcaggatcacgctggcccgttgccactgtagatgatcttgccgacctcgctgggctgctcgatctcagcatgggacacctgggatggtacgccgatcccgcaggcatgcagcgcagaaatcgggtgcccgcattgcagctgtatcgttatcggtggttggataggccaggccgagcgccaagactattggaggtgcttaaacctcgcctgcgtagggcccagaggatgctgctggatcgaatagtcgggcttgtgcctgcccatgccgctgcacatgggtttgttgccggcagaagtgctaggacaggagcagctccacacgtcggaactgatgtggtaattggactggacctcgcagggttcttcggtagcgtgtccgcgcaccgaatttatggcatattacgcgtagccggttacccggaagccgtggctcatatcgtgaccggactgtgtaccaccgcaacgccaatcgcagtgctaggtactatgcctcctggcgggccagtggacgatcgctacgcactgcgccgtgccttgactacgccgcacttaccccagggagcgcctaccagccctcaactcgcgaacctgtctgcatatcggctggactgccggcttgctggtttagctgccgctgtcggtgccacttacacacgctacgccgacgacctgtcactttctggtggccccgaggtcgccagacagacagcaaggattgtcggcggcgtcaggcggatcgttagtgacgaggggtttaggctcaatgaagggaagacaagagtgcagccaagagccggccggcagacagtaaccgggatcgtggtgaacgaaagggccaacgctgccagagctgactacgacaggctgcgagccatcctccacaatgccgctcgcaccggggctcaaggacaaaaccgtggcggccacagagactttcggtcccatttgctgggccggattgcatgggttgaggccctgaatcccgctagaggacgaagattacgggcggatttcgacaggatcgattggacctga

SEQ ID NO: 12945 - RNA, 1332 nt, unidentified
  source 1..1332: mol_type = other RNA; note = synthetic construct
atgacgacagggccagccgtagcccaggctctagcagacgccatgctcgcagaaggagcctgggatgccgctgccttagcaagggcagccgctagagtagttggcccgaggcgcagatggttaccagctctggccgccgaggttttagcgacgtgtcccaggccccccagagatgcaccacgctaccttggcgctgtggtcgctggtgctccttccttcgcccgtgctgaagaaagggctcagcgccgtggacatcctctgccagtgctgtcccgaccagtggtggctaccagagccggtggtagcaggtggccaactgctccactcgacgatgttggcgacctagcagacctgctggggttggacgtcggacacctcgattggatggcagacgtccgaggcctgcagcgtagagctcctgctggcccacttcacctccaccgctatcggtgggttgaaaggcccggccgagtaccccgcttactggaagtgccgagtccaagacttcgccgcgtgcagcgtaccgtcctggatgctgtgctggcgggacttcccgcccatgatgcagctcatgggtttgtcccgggacggggggtgttgtcaggtgcaagggagcacgtggggagggcagtagtcgtgcgagcagacctgactgccttctttgccgccgtcacagccggcagggtgttcagagtactgagagccttgggccagcctgaagctgtggcgcacgtgctcaccggactgtgtaccacacgcgcgcctgttcgagtgctggcagcgatgcctcccggtggacgtgatgccgatcggcacttactccggaggtggctggccgagccccatttagcccagggagctcctacttccccccatcttgcaaatctggccgcgcatagactggacgtccggctgagctcatacgcagccgcatgcggcgccgtttacactcggtatgctgacgatctcgtcctcagcgggggagatgacgttgccagacgagccgggcccttgcttgaaggagtcaggcgagtagtccgcgaggagggctatcgggtgaacgaggccaagacccgggtgcagcctagacacaggcgccaatctgtgaccggagtggtggttaacgacaggcctggggctgggagaagagagacagacgccttgagggcgctcttgcataattgcgtgcgccacggccctgcctctcaagatcgtgacgggcggggtgagggctttagagcccacctggaagggcgggttagttgggtggagcacgtgtctccgagaagaggtgcggcactgcgaggcgagctaggcagaatcgcatggtga

SEQ ID NO: 12946 - RNA, 1326 nt, unidentified
  source 1..1326: mol_type = other RNA; note = synthetic construct
atgtcagccgagacggcccttgccagtgcattggccgaggcaatgctggctgggacatggcatcgcagaggactgattcgtgccatgtctgctacactcaaccgcacatccagacgggtgagatgggtccgccctctcgctgtcgaagttctggcagcgtacccgcaccctccacttgaccgtcccagggaactcgccggatttgtgggcactactccagctgtccaaagggctttaggtcggcggcgccctccaaaagccctggttcgagtagctacccccacaaccaccgtttcccggccctttccaacaccacgtgtagatcacgtagcgcagctcgctgagttcctggcggtggaccccgatgaactggtcttgcttgccgacccgcagtctcgggcacgaagagctcctagtaggcgcatagctcactaccggtatcactggctggacaagccggcaggcgccagattgctcgaagcaccaaaaccccgcttgaaggcactccagaggaaagtgctcgatgggctgttgactcccattcccgtgcatccggccgctcatggcttcgtaccaggcagatccgcagtgactggggccgctcctcacgttggagcagctgtggtggttaccgtagatctggaacacttttttgctgctgttcgagccggcagggtgtggggtgtgttacgggcagctggctatcccgaaccagtggcccatctgctgacagctctcactacccacgcgtctcccgtcgccaccttaagcgcaatgccacccggaccagatcggggaagagatttccgcctgcgacggaggcttgcgacacctcatcttcctcaaggggcccctacctcgccccagttagccaatttggtggccttctcactcgatcgcaggctagacgcatacgcaagagccgccggggtcacgtacacgagatacgcagacgacttgaccttctcaggtggccctgagttatccagggctgcggaggccctacttcatgcggttgacggcattgtgagagccgcaggctatcggctgaaccccgccaagactcgcatcagacgaagccatgagcgccagagcgtgaccggcatcgtcgtgaaccggcacacaactctggctcgtcctgagtatgataggctgcgtgccgtcctgcacgactgcgtgaccaatgggccagaggccgccgatcggaatggacacgacgacttcagggcccacctgctagggcgaatcagctgggtggctgccctgcatcctgcaagaggtgcaaggctgagggcggcctttgatgccgtcgcttggggagactga

SEQ ID NO: 12947 - RNA, 1269 nt, unidentified
  source 1..1269: mol_type = other RNA; note = synthetic construct
atgctagccgggaaatgggctccgaaggccgcaaggaagcgattagggcgcacccttggacaacagcccaagtggttgaaacggctggtccgggaggttctgacagcctaccctagaccccctctggacagacccagagaactggcggcctttgtgcttcgaagcgcagcactggaacgcgcccacaggaagtctgggcccttaccgcgccctgtgagacgtttcagtacaccaacttcaacagtgctccgaccctttcctacgcctgtcctggatcacgctggggcactcgccgatttgctcgacttggatctagatgagctggagctcctagcggacactgctttgcgggcacgcagagcccacgatcccagaatcgctcattataggtatcactggagaatgaggccaggaggaccacggctcatcgaagccccaaaaccgcggctgttgaccgtgcaacgccggatcttggaagagataataggcctgatcccagttcatcctgccgcccacggcttcgtaccaggcagaagtgccgtcacaggagccgcactccacgttggagcgggcactgtggtgaatcttgatttagaacacttctttgctggcattactgctggcagggtgtggggcgtactgagggcagctggtttccccgagccagtggctcatcttctcaccgggctgacaacgcacgcgactcccgttgccgttctgtcggtcatgcccgacaggccaggtgaggctcgcaatttcaggctgaggagaagcctgggaacccctcatttacctcagggagcgcctacctccccacagcttgcaaaccttattctctacagcctggatcgtcgactgcaggcatacgccgatgccgcagggcttcgatacacacgctatgccgacgatctgaccttctcagggccccaggtgagacatccggactctgttgtcgccgctgtcacctccatggcagctgccgaaggctttcgcgtcaacgacgctaaatcccgggtgcgtaggcatcaccaacgtcaggtggtgaccggtattgtagtgaacgagtggactaatctggcccgacccgagtatgaccggctgagagccgtcctccatgactgccgggtgaatgggcctgctgccgcaaaccgggatggccatgacgattttcgcgctcacctccagggccgcgtatcttgggcgggaagcttgaacccaggtcggggtgccaagctggctgcaatgtttgacaggatcgtgtgggactga

SEQ ID NO: 12948 - RNA, 1323 nt, unidentified
  source 1..1323: mol_type = other RNA; note = synthetic construct
atgaccggcccggccgatagacttgctactgccctagcggacgccatgctggcaggatcctgggactaccagtccatcctcgatcggacccgccaagttatcgccagacgccccccctggttagacagcttagcacgggaagtattagccgcgtatcagagggccccggcagacagacctagggaactggccgccttcgtcgtatcttctgctgcgatggctcgcgcaagaaggtccccaccacggctcccaactccagttgtgcggttctcctcacctacccgaatgatccggcggccttttgccacacccgtgctccaccacgcgggagatctagccgatcacctggggatcacacttgaggccctcgacgccttcgctgatacgaggctgcgcgcacgtagagcaagggcagagagaattgcacattacaggtacaggtggatgcatcgccccggtggagctcgattgctcgaagcacccaaacgaaacttgcgtgccctgcaacggaccgtgctggatgatattctggcccctataccaacccacccagccgcgcatggctttgtagctgggcggagcgccataacaggagccgctgaacatgtgggagcagaggtggtgattacactggatctcgagcatttcttcgcttcggtgactcccggcaggatctggggcttacttcgcgccgcaggatatcctgagccggtcgctcacttgttggtcggcctgaccacacacgccactccagtggcaaccctggcttcaatgccagctagcgccgaccccggtagggactttaggctgcgacgtcggcttgctgggcctcatctcccccagggtgctccaacatcacctgccctcgcaaatctggtcgctttcagcctggatcgaagactggactcttacgcgagagctgcggggagtcggtatacgcgttacgccgatgacctcacctttagtggcgacgcagctcttgcacgcagaagtgccgccctgatcgccgctgttaaaaggatgattcgccaggaggggtttacggtccatcctggcaagactcgcgaacaccacagaagccggcgccaggtggtgactggaattgtggtcaacgacaggaccaatataccccgggcagactatgaccgtctgaaggcagttctgcacgattgccgaagaaacggccctctggccgctaatagagatgcgcatcccgacttccgggcccacttgcttgggaggctgagttgggtgtctgccctaaacccggacaggggtgcccgcttgagagctatttttgatgagatccgatggacatcctga

SEQ ID NO: 12949 - RNA, 1530 nt, unidentified
  source 1..1530: mol_type = other RNA; note = synthetic construct
atgagtgatactccggaccctggaccccccccaagaagaagtggggatgatcccggcggattggtgcgaagaggaggtcccccacgtccaccttcaggtggaccccctgcacctcctataagacctagacgcaaacgtccacgggggcgaccaagtccctttcgggaggatcggccagggaggcctgatgcactggtggatgcaatcgccggcgcactgctggctgatgccgatgactggacagcgtctggccttataggccgcgtagcagtcgtcttcgcaggtccgcacgattgggtcccccgactggtggagcaggttcttgaactctaccctagaccacctgccgacagaccacgcgagctacaggccgtggttggcgtgctgctgaatgatcttctcgaccccgcccctgacgacgacggagatgaaccaacaaccgaaattagaccagtaccccgcccggttcactggccagtagctagcactcggactgtgaggcgaccattcgccacccctccattggacgacgcaggggacttggcagccctcttaggggtggacctggtgcaactgacagctctcgccgacaccagacttaggggaaggcgcgctcgctctgaacagatcgcgaactatagatatcagtggctggacaggccgtcaggcccaaggttgctcgaagcgccacgaccccgtctactgtccgcccaaagggtggtgctgcacgaactgctcgatttaattcctacgcacccggccgtccatggtttcgtctccggacggtccgtggtaactggtgccagagagcacgtcggcgctgaaaccgtcctcaccctggacctcgaacactttttcgccgctgtgactgccggcaggatttggggagtgcttaggtccgctgggtaccccgagccagttgcacatctgctcgccggtctgacaacgactgccacgccagtccgcgtgctgacagctatgcctcctggccccgatcctggcagacagtttcgtcttcgccggaggctggcagtcccccatcttcctcagggagctcccacctcaccggccctagctaatctggttgctttcaccctggaccggcgtttagccgcatacgctgccgccgttgggctgaagtatacccgctacgccgacgatttgacattcagcgggccctttaggcaacgcgcccatgtacggagctttgcacgcgctgtgggccggattgtggctgacgagcggttcaggatcaacgaggccaagaccaggtggagaggcaggcacgagcggcagacagtcactggggtggtggtcaacgagcatcccgccatcgcgcgcgatgaggttgaccgattgcgggcggttctccatgattgccgacggtctggacccgcggctgctaatagacatggccaccccgacttccgggcccacttactggggagaatctcgtgggtggcaagcgtgcaccctgcacgaggtgccaggttgcgtgagcagtttgatggaatcgactggaccgcgtga

SEQ ID NO: 12950 - RNA, 1335 nt, unidentified
  source 1..1335: mol_type = other RNA; note = synthetic construct
atgcggagcgagcatgctgtggcgttagctgacgccctattgacgggtccctgggatgccggcagaatggtggcaagggctcggctggtgtttgctcctgtacccgtggagctggcccacgtcgtggacgtagtcctggcagcacaccccaccccacctgtcgatgcaccacgatccctgcagcatctgctgctcgggcttccactgtccgctccggttccggtggtggcagaaggagccccactgttgcccaccccaagaattagggtcgttagaaggctgctatttacaacctccatggtcggctctcgattccccttacctcgggttgatgacgtcgccgctttggccgagagactcgggctgactgtcggcgagctggactggttcggagatcggaggggttggcagcggcgtgaaccacgttctgtgcttcagcactatcgctttaggtggcttagcagaccaggcaggaccccccgattactcgaagctcctcgtcctcgcctgaaagccctacagcggcaagtgctggatgagctcctcgctcctgtagccgtgcatcccgcggttcatgggtttgtggctgggcggtctgtgctgacaggagctgccgtgcacgccggaagagacactgtcatcactttggatttggaacaattcttcgccgggctgacagccagtagagtagctggcgttctccgcagcgcaggctatcccgaagcagtgtcatgggccttgacaacactggtctgttctactgtgccgatggcagtacttcgcgccatgccgggagcagaagcaggaggagagcgcttccgtttgaggcgcaggttagctgctcctcatctccctcagggagcccccactagcccacacttggccaatctggcagccttcggcatggaccgacgcctgacggcacttgccagaaggttcggagcggactacacgcgctacgcggacgacctcactttttccggtgcgccatcgcttggacgagcagctgatcgactcatcggtaccgtggccagaattgccacagccgagggcttctcaataaaccctgcgaagaccagggtgaggcgggcttggcagcgacagagagtaaccggcgtcgtggttaatgatcggcctgcagttgcccgcgacgaggttgatgcgctcagagccaccctgtttaactgcgtgcggtttggccccgtgagtcaaaaccggtcaggtgtccaggatttccgggcccacctcctgggtagaatcgcttgggtggccagtacagatgcacgcaggggagagcgtctgagggcccttgctgaccgcattgactggaattga

SEQ ID NO: 12951 - RNA, 1536 nt, unidentified
  source 1..1536: mol_type = other RNA; note = synthetic construct
atggccggacgcagttttcctcggccccatgcacgacccgctttggttgcggcggcgtcagatgccttgttggctggcccgtggacagcagctgccatgctggctcggctggctgagtctattgaccccgtgggtccctggggtgccgatcttgtaggcgcagttctcgctgctcaccccttccccccagctgatgctcctcgcgagttcatggtcttcatcgacctcgccctgccccctgatgtaggcgtgaccacctggcagagcgttttagtgccagcaggagagccaacaggtgcgggccatcgagcagacgagcaggacgaggacgagcaggacgaagatgacggagaagacgatgatgaagaagatgacgaggaagatggaggaggcgcctttacaggcgcttggcccgcactgttcgaaccagtgccagggccagttgtcgttaggcgcctggctgcctcaaccgcaatgggtcctcgcagatggccagtgcccgctgtcgactacatcgccgccctagccagcagactcgctttaaccaccggggagctgctgtggtttgcagatacccgagggttccaacgcagggacacacggagcgagcttcgccattataggttcgcttgggttgagcggccagggagggtacccagactgctggaagcaccgcgtccacgtctgcggtccatacagcgaaggattctcgacgggctcttggctcccctcccgatgcatcctgccgcacatggggtcacaggaagatctgcgataactggcgcaagggtgcatgaggatgccgccgtggtgctgacgatggacctcgagtccttttttagcgccgtgacagctggcagagtctatggagtgctgcgttccgccgggtaccccgaacctgtagcccacttgctggccggcgtatgcacactgcgcactcctgtggatgtcaggaggagaatgcctactggcgctgctgcaaccacctctgctgcctggcggcttggcagaagactagacgtgccgcacctccctcagggatcgcctacctccccagccttggccaacctggtggcttttactctggaccgacgtctgactgactatgcagcgagagcggggtggagatatacccggtacgccgatgatctcacgttcagtcttcctggtggcggcacaggtggcgctagagcaggacgagcagccttacggctggcggaagccgttacaggcatggtggcgtctgccgggtttagggtgaacgaggcaaagactaggatccgcggtgcccaccaacgtcagttagtcacggggctggtggtgaatgcctcagcagccgtcccacggaccgagtacgacaggcttcgggccgtgcttcaccggtgtggcactgacggaccagcagcccaagccgatgaccacctgaggttccgggaacacctccagggacgcatcgcctacgtcgctgcaagtcaccctggaagaggggctcgccttctagccgccttcgatgccattacttggcccgacgattga

SEQ ID NO: 12952 - RNA, 1329 nt, unidentified
  source 1..1329: mol_type = other RNA; note = synthetic construct
atgactcatgaccccgatgaaggactcgcgagggggttggcttgggcctttctggctgccgagacgtggaccagacctgctctcgtgggcagtgccgcaaccgctctgggaagacggcctcgttggctgggtccggtagtggacgtagtgctgcagcaccatcggtctgctcccaccgacagaccatatgccttatcaaggttcctcgtgagagagactacattactggagcatgcagcaagagctcgccgaggccgtgccctacgaatcgtgaccgtcccaacagtcactgccgcaacaggcaggcggagatggcctgtgccagatgtggctgatctgccatctttggccgggttgctggaactgcctcttgaccagcttgtctggctggccgatgcccgctcccagcaaaggagagcccccgatggtccactccacgcctatcggcatcgatgggttgaacgacccggcgctgtgccgaggttgcttgaggcacctacacccctcctaagggctgtccaacgccgcgtgctagagcgcatcctagtgtgggttccgacacaccccgccgcacatggctttgtccggggtaggagcgcaatatcccacgccaggagtcatgagggagccgacgaagtcgtttgtctggatctgcgggcctttttcgcatctgtccgagtggcccgtgtcgacggcttgtttagaggcgtaggataccctgaagccgtggcctggactttggcgtgcctttgcactcaccagacgcccgtgcgggttcttcacgacatgcccgctgggggagctgatgatgcacgagcctggttacgcgcgggcctacgtgaaaggcatctcgcccagggggcacctacctcaccagctctcgcaaacctcgcttgttttgccctggaccgtcggctggcaggtttggcagctgccactggtcgcgcttacaccaggtacgcggacgacctgacattctcaggagctgctgggggcgccggcagattagtaagcgcagtgagagccattgtgggggatgaaggattcgctctgcaccctgcgaaaacccgcgtgaggtcccgggatcagagacaggtggtcaccggactggttgtgaacgaccgggtgggcgtccccagagagtaccacgagcagctgcgggccgtgcttcacgatgctggtcgtcacggacccgcggttgcaaatcgcgttggctatccagacttccgctcgtatctcaaggggagggtcgggtgggttgagtccgtaagccctcaaaggggtcgccggcttagaagccagctcgacgccattgtgtggccagcgtga

SEQ ID NO: 12953 - RNA, 1332 nt, unidentified
  source 1..1332: mol_type = other RNA; note = synthetic construct
atgtccaggcaccaggacgaagccctcgccagaggacttgcgtgggctttcctggctgcagaagcttggacggtgccagctctggttgacgctggcgcaacagctcttggccggcgttatcggtggctccctcgagtggctgcggcagttgtggctgcacatcgctcgcctccaaccgatggcccctacgcatttaccagattcgtactccagcagacctctctggtcgagcacgcagatagagcctcccgaagagggagcgtagttcgggtggtaagggtcccgaccttaccgggagcaatgggcgtgcgcagatggccagttccggagttgccagaccttcctgccctggcagatgccttggagctgccgctcgatcagctggtgtgggtggctgacactcacggtttgcagcgaagaacgcccgacggccccttccatgtttaccgccatcgatgggtcgagaggcctggtgctgccccaaggttgctcgaggtacctactccactgctgcgtgccgtgcttcgcagggtcctcgataggatcctggtgtgggtgcctgtgcatcccgcggttcacggtttcgtccgcggaaggtctgccgtgacccatgcagccaatcacgtgggcgccgaaagtgttgtgtgcctggacctgcgggccttctttgccagtataacagtcaaccgcgtgaacgggctgttccgtggtctgggataccccgagcctgtggcgtgggctttagcctgtttgtgcacacaccctacccccagagtagccctcgcaggtatgcccggagggggttctgcaagtagcagggcttggctacgtgccggcttgcgatcccgccatctcccacaaggggctcccacttcacctgccctggccaatttagcggggtttaccctggataggaggctagccggtctagccgccgcaactggactgacctattcacggtacgccgacgacctgacattctctggccccagagtcgaccaaggccggtttgtgtccctggtcggagcagtcgtccgggacgaagggtttgccctcaatccaccaaagacacggattcgctcagcgcagcagcggcaagaggtgactggcttagttgtaaacgatagagttaacgtgccccgcgcctatcacgatcagcttcgcgctgtccttcacgacgctacacgaaatgggccagccgcagcaaatagacaagcccaccccgattttcggagccatctggagggcagggtgggatgggtcgaaagcgtgaaccctgtgcggggaaggaggctgagagcgcagctcgaagctgtggtgtggcccgcttga

SEQ ID NO: 12954 - RNA, 1332 nt, unidentified
  source 1..1332: mol_type = other RNA; note = synthetic construct
atgtctcatcgccctgatgaagggctggcaagagggttggcctgggctttccttgcagcagaccgctggaccgctcctgccttggttgatgccgccggcactgctctcggacatcgctataggtggatgtcagccctagtgaggcaggtcctggagaaccaccggttcgcccctacagaccgcccctacgagctgtctcggtttttgctcggcaggactgctctggtcgagcatgccgagcgagcagcacaaaggggacgcgctttacgggtcgtgcgcatatccaccgtagccggcgttatgggggagcgcagatggcctgttccggaggtgccagatctccccgctcttgccgacctcctggagttgcccctggagcagctggattgggttgtggacgcgcgcggcctttccagacgaactcccgatggtccttttcatcttcaccgacacaggtgggtggaacgtccaggtgcggtgcccagactgctggaaagtccaacgccacttttacgcgccgtgctgaggcgggtactagatcgcgtgctggtgtgggtacccgtccatccagcggctcacggcttcgttagagggagaagcgcggtgacgcacgcccgaacacatgtgggcgcagcttctgtggtttgcctcgacctcagaagttttttcacttccatcaccgtgggcagagtgaatggcctgtttagaggattagggtaccccgaggctgtcgcctgggccttagcttgtctttgcactcaccagacccctgtcgccgtgctagggagaatgccccctggtggttcagaagcagcccgtgcttggctgcgatcatccttgagggctagacatctccctcaaggggctcccacatcgccggctctggcaaatctggcctgtttcacactggatcggaggctcgcaggactagcggctacagctgggctgacctactccaggtatgccgacgatttgacgtttagcggcccacgtggctcagcacacagacttgtggcaagcgtcggctctatcgtgcgggacgaaggatttgacctcaacccagccaagacacgggtccgaggtaccggagaacggcaggaggtgactggtctggtggtcaatgaacgtctgaacgtaacccgggcatatcacgaccagttgagggccgtgctgcacgacgccaccaggaatggacctagtgccgccaaccgcgccgatcatcccgacttccggagccacctcgaaggacgggtcggatgggttgagagcgtaaacccagttcggggcaggcgtctgagggcacagctcgatgcgattgtctggccggggtga

SEQ ID NO: 12955 - RNA, 1347 nt, unidentified
  source 1..1347: mol_type = other RNA; note = synthetic construct
atggtaatgcgcatagaccccgacgagggcatcgctaggggtcttgcttgggctcttctcgcagcggccgagtgggataaagccgcactgactagcgccctcggtcatgctttgggcaggaggcacagatggatccccaaggtggtcacagaagtcctggcagcctatcctcgggcccccatcgataggccacatgagctcactgggtttctgaggaccgggacctcattagtccacagcctcgcaagagccagacgccagggaagggcagttcggttgcaacatatacccatggtcaccggtactatgggactgcggcactggcccgtgcctgagattgacgacctcggcgggctggctctgcttctcgagttaccgctcgaacaactgatctgggcagccgatacccaagggcggcagagagcaactaggtcgggacccctgcacctgtatcgacatacatggcgacctcgcccgggagctgctccaagattgctggaatctcctactcccctcctacgggcggtcctgcgaagagtgttagaccgcatccttgtgtgggtgccagttcatcccgcagcccacggattcgttccaggtcgctccgctcccagtaatgcgcgggcacatgtgggggcggatgtagtcatctgtttggacctgcgtacgttttttacgagcattacagccgcgcgagtgaacggccttttccgcgtaatggggtacccagaaccggtggcctggactctggctgcgttatgcacacatcagacgcctgcccacgtacttgcagccatgccagccggtggcgactccacagttcgtcaccggcagcgcgcagagctccgtgttagacatctgcctcagggctccccaacttcacctgccttggctaacctggctgcccacggccttgacaggagactggcagggctggctgatcgcttgggcctcacctacacaaggtatgccgatgacctgaccttctctgggtccctaggcaacggcattggagtccctaggttggtcggagtgattggcgagatcgtgcgtaacgaggggtttgtgctgaataccagcaagacccgggtgagacataccggagagaggcacgaaattaccggactggtgacaaatcagcagctgtctgtcccgcgagcttaccacgaccagttacgcgccgtactacacgatgctgtgatgcacggccccgctgttgccaatagggcaggcctcccaaatttcagagatcacctggccggacgggtgggttgggtggaaagtgtgaacccagttcgggggagacgactacgggcccagttcgacgccatagcctggcctgattga

SEQ ID NO: 12956 - RNA, 1347 nt, unidentified
  source 1..1347: mol_type = other RNA; note = synthetic construct
atgccagtgaagcgccgcgaccctacagcgcatgtagcacgggcactggcctggtcatttctggctgcccctgactggactgaggctgctctccggcggtctgcttgggtgacactgggtcgtagacaccggtgggtgagtgccttagcaggctccgcggtcgctacctatcgaacggcacccctggggaggcctcatgagttagcagggctgttggccgggtcagccgtgcttacaactgcccttcaccgcgctgccaggagagggactcctgttagagtgcgggtactgccaacgactccggccgcaatgggaaggcgacgttggccagtccctgaagtggacgatggcccagccctggctaggttgctgcaggtcccggacgagcaacttagctggctggccgatgttcaaggccgtcagagaaggaccccagctggaccccaccacctgtacaggtatcgctgggtcgccagacccggcactgttccaaggctgctcgaggcccccacccctttgctcaggcacgtgctccgaaggctgcttgatgaagttctcgtctgggtgcctgcacatcccgccgcacatggatttgtgcgcggcaggtccgttctcagccacgctagacgccacgtgggcgcagacttggtgctaggcctcgacttacgccacttcttcgccgcagttacagcagctcgcgtggctggcctttggaccctgttaggctatccggagggggtggttactctgctcaccggtctaacaactcatagaacacccgtccatgtgctgaccgcgatgccgcctggtggagacgtgtctgggcgtcacctgctgagggcgagattgagagcggcacatctgccccagggagcagcaagcagtcctgccctggccaatctggcctgctttaccctggatcaccgacttagcggatacgctgcggccctgggagccacttattcccggtacgccgatgatttgacattcagtgggccaagagacttacccgctgccaggctcgtacgttcggtgaccaccgtcgtagcagaagagggctttgccgtgaacccaacgaaaacccgagtacagcggtcctctgctcggcagcaggtgacaggactcgttgtgaacgctgggctagggatcccccgagaagatgaggatcggctgcgcgccgtcctacacgatgctgtccggagaggtcctcaggcggccaacagagacggcgtgccagacttccgggcccatttggagggcagggtgggttgggtcacctcagtgaatcccgtcagaggagcccgacttcggcgccaactcgaagctgtagtttggccaccccgctga

SEQ ID NO: 12957 - RNA, 1341 nt, unidentified
  source 1..1341: mol_type = other RNA; note = synthetic construct
atgcgcagagcagaccccgtagcccatgtggccagagccttggcctgggcttttttggccgccccggcatggaccgaacccgaattgcgccgttcagcgtggaccactcttggccggaggcaccgttgggtgactccactggtgcggttggcgctcgtggtccataggacagccccgaccggacagcctgcagagttagccaggctcctggcaggaacagacgaactgcccgctgccttgcatcgagcggctagaaggggagctcctgtgcgggttagagtcgtccctgcagtccccgctcggacagcttctccaaggtggcctgttcctgaggttgcgggcgctcctgacttggcacgactcctgggagtgcccctggagcaacttgattggttagcggatgcccagggtaggcagaggcgcactccagcaggaccgctacacctgtataggtacagatgggtggaaagacccggcgccgtcccaaggttgctcgaagcacccacgccactcctacgacacgtcctgcgcaggctgctcgacgaagttctggtgtgggttccagctcaccccgcagctcacgggtttgtacgcggtcggtccgcccttagtcatgcacgcctgcacgttggcgcggctcaggtagtgtccctggacctgcgacacttcttcgctgctgttacagccgccagggttcgcggcttgtggacgttagttggctacccggagggcgtgacagctcttctgaccggcctgaccactcatagaacccccgtacatgtgcttaccgcgatgccaccaggtggggatgctagcgccaggcacttactgcgagctcggctgcgtgcacctcatcttccccaaggtgccgcatcatctcctgccctggccaatctagcctgtgctcgcctcgacagacggctcgcagggtatgcagccgcactcggagccacgtactccagatatgcggacgacctgactatctcagggcctgctgatctggccgcaccacgacttgtacgggctgtgagtgccgtcgtggtggaggaggggttcgctgtcaatcccgcaaagaccagagtgcaacgcagctctgcccgtcagcaggtcactggggtcgtggtgaacgcacgcacaagcgtccctcgcgaggaggaagatcgactccgggctgtgctacacgatgccgtgcggaacggcccagatgctgccaacagagccgccgtgcctgactttagagcccacttagagggacgtgtggggtgggtgagtgccgtgaatccagtcaggggcgctagacttcggcggcagctcgatgccgtggtatggcctggtaggtga

SEQ ID NO: 12958 - RNA, 1407 nt, unidentified
  source 1..1407: mol_type = other RNA; note = synthetic construct
atgccggtccacaccaggagggatggagacgatggcactagaagggagagccatcgccctagaggcgttccagtgacgctggcccctgacgacggtttggcaaggggaatagcctggggactactcgccgcagaagattggacggccgatgcactgcaggctgctgtgacccgtaccctgggaaggccctgtgaatgggcgggtagggtagtaggaccagtgctggccgcctatcgggagccaccaacagatcggccagacgaactggcccgatttctcctgctagcaacacccctgaccgagatagcacatgccgtgcgtcaggaacatgagcctctgcgagtgcgagttctggccccagttcctggcagaatggggcgcagacgctggccagttcccgatctccccgaccttgtcgccctggctcgactgctggaggtgcctctcgatcagttggattggcttgctgacacggcacggttacaaaggcgttcaccaccaggcccctaccaggctttcgagcataggtggagaagcaggcctcatgccgctccacggttacttgaggcgccaggccccctacttagggctgtgcagaggaggatcctcgatcgtattctcgcatgggtgccagtgcaccctgctgcacatggcttcgtcgggggtagatccgcgatcaccaacgcagctcggcatgtaggggctccgaccgtcgtagctctggacctgcggagctttttctctactattacagccgctcgcgtggggggcttgtaccgaactatggggttgcccgaggccgtagtgcgcgtcttgacaggcctttccacccacgctacccccggttgggtgttaagtggcatgcccgcaggaggggatccctctgagagacacagacttcgggcgaccttgagaagccggcacctgcctcagggcagtcccacatctcccgcccttgccaatctcgcatgcttttctctcgaccaccggctgcagcgctatgccgagacagctggtctggtctactcacgttacgctgacgacctcactttcagtggacctgttgccaggccggcagccttgttagccactgtgtccacaattatcgtggcggaaggattcgtcgtccacccgggcaaatcacgcgttcgacggaccggcgaacgccaaacagtgactggtatcgtgactaatcgccggcccggaattgccaggtccgatagagacaggctgagagccgttctgcacgacgctcgaagacacgggcctgaagcggcaaaccgcgaacgccacccgcattttcgggagcacctccacgggagaatcacctgggtggagtcggtgagccctgtccaagggagaagactgcgggcccagtatgaagccatcgtctggcctgagcgctga

SEQ ID NO: 12959 - RNA, 1347 nt, unidentified
  source 1..1347: mol_type = other RNA; note = synthetic construct
atgagtagcaaaacagtgcaagacgatcttgccaggcgcttgggctatagaatgctggctgtggagtgggatagagatcatctgttgattggctgcaggcgggctttgggatctgccccaccctggttggggccagtgattgacgctgtgctgcagcagtaccctgtaaaaccctccggccgtcaccacgagcttacagccctgatagcaagcactgaagaattccaggatgctgtctttgtgtcccgctctgggaggcattggcagattcgctccctccctgttggtgatctggacccggatgagctgcgcatggccacctctagatggccggttccaaccctgggcacagaggctgccctggcagacttgctgcgggtcgacctgcctgtgttgctgtggctggccgaccctaagaggatgcttcggaggcgccccgatggaggacttcaaccatacaggtacaggtggcttgagcgccacgggagaaccccacggttactcgaaatccctggacccctactccgccacgtgcaaaggcggctcttggagagagttatcgacaggattccccctcaccctgcggcgtatggctttgtcagaggggggggccctcataggaatgcagcccagcatgtcggagccgactgggtgatcaactttgatctgcgaagtttcttcgcaggcgtgcgtactggacgtgtggctgggatctttacagctgcaggatatccggcatccgtggtagctctgctagccgggcttgtcagtcgacccactcccgagttcgtgctgcgagggatgcctgatggtggcgaccccagcgacagagccctactgagagcccggcttcgggctgctcatctcccacaggggtcaccatcgtctcccgccattgccaacttagtcgcgttcaacctcgattgtcggctgaatcggctggcaaagaacgccggttttggctacacgcgctatgccgacgacttaacgttttcaggctcaggacctcgtccggcggctggtttcgtcccactcgtgcgaaaaatcattatagatgaaggattcgcacccaatgacaggaagctgagaatccgcggacgaggccagcgacagctcgtaaccggcatcgtagtgaatcagcacactaatttacggcggcgggatcatgaccgtctcagagccgttctgcatgacgcaataagaaacggccccgatgctgcgaaccgcgatcaccaccccgacttcagagcccacctggaaggtagagttgggtgggcagagcagctcaatccaaccaggggtgcccgactccgcaggcaactagaactgatcagctggccaagctga

SEQ ID NO: 12960 - RNA, 1344 nt, unidentified
  source 1..1344: mol_type = other RNA; note = synthetic construct
atgaccccagaagaggacctggctttgaggctggcctatgtcttccttagtaccagctggagaagggccgacctaaccgacgcagcaatagcctcgcttgggggagagccagcttggctgggtgggctagtgagccgactcctgggttcaatccgggagcgccccgctgataggccctatgatctggctcgcgtcatcatgggccagcaggtgtacctagatggcttggatcgggatcaccatcaggataccgtgtggagggttcgatcctttcctgtgggggggttagtcgccgaaaccgagcgtatggcagtgccggattggcccgtgccacgtcttggaactgaaagggctctggccgacctgttgcgggtggacttacctgtgctgctgtggctggcggatcctcgaggatacctaaggcgtgcagacgacggcctccagccatacaggtacaggtggataaggcgacctggtaggacacctaggctgattgaagctcctggccctttacttagatacgtgcagcggcgcttgctggaccgcgttctcgttgggattcccgtccatcccgccgcatatgggttcgctcggggaaggaacgcagttagagctgctagacggcacgtcggttctgactgggtgattaattttgacctggtaagcttcttcaacggcatcagagaaagtagagtcagaggcattgtgcgggtagccggatatcccgagccagtcgccagactgatggcagccatcatgacgacagccacccccgtgcgcactcttcaacgcatgcccgacgacggccctgacgatgacagagccgttttgcggtcagtgctcagaacggcccacttgccccaaggagccccgacatccccagcaattgctaatctggcttgctacaggctggacgtgcgtctggcgggattagccgaatccctgggcctccgctatacacggtacgcagatgatttggcgttttctggacacggaactcgccccggtcgtcgcttctttcgcctcgtaaccgaaatagtcaccgatgatggctactgtctcaacgaccacaagcagcggcttcaaactcggagagggcgacagacagtgactgggatcgtggttaatgatcgagctaatctgaggcggtctgagtatgaccgactgcgcgcagtcctccatgatgccatgatcaacggcccggagcacgccaatagaaacgggtatcctgcgttccgggaacatctcgacggccgcatcggctgggtagagcagcttaacccagcgcgaggtgccagactcagacggcagtttgagctgattacatggccagaggataggtga

SEQ ID NO: 12961 - RNA, 1332 nt, unidentified
  source 1..1332: mol_type = other RNA; note = synthetic construct
atgaggctgtccgatagcactctcgctcgggctctcgctatggccttcctggacggggactgggagttcgatcccctcctggatcgagccgcccaggttttgggcggcagacgacgatgggtgagaaggttggtgaaggacctgctagccgcatttcccaggacccccagagatgcaccatcagcgcttgcagggtggatcggggcccatccatccctgattgaggcagctgcaagggccagggacgcagctaggccacttcgtgttgcggcgatccatcctgggcacaccgagatgggtcgccgaagatggcctgtcgccactctggacgacctggctgatctggccgagctcctggatctcgaccaggcccaccttgcttggttcgctgatcaacagcacagagctagacgtgccccggacggtcctctccaccactacaggcggcgctggatatcacgcagtggccggaccccgcggttgttagaagtccctttgcccagactgcgcgcccttcaacgcaccctcacacatgaggtgttggcccatattcccactcacccggcggcgcatggatttgtgcgagggagaggcgctgtgacaggagctcagcagcacgttggccgggatgccgtgttgtccctcgatctgagcgcatttttcgcatccgtatcagcagcacgggtgcgcgcgatttggagagctgccggataccccgaacccgttgccgatgcgttaaccggagtagtgaccacccttgcccccgtgcggatgttaaccgccatgcctcctggaggccctccagaagcaagagcccttctgagagcctggctgcgagcctctcatctaccacagggcgcccctactagtccagccctggctaatctggccgcacatcgtctcgacgcaaggctcgccgggtatgctgctgcagcaggttggtgctacacacgttatgctgacgacttgacaataagtgggggtcccgagatggttcggcgtacggatgctgtggtcgctgcccttagccgcattgtcactgaagaaggctttcgcgtgaatccaacaaaaacgcgcctacggacagcgtctcagaggcagctggtcacgggcatcgtcgtcaaccggaggccaggacctggcaggagcgagtatgaccaactgaaggctctgctgcacaacgcctctcggacaggcggacaagcccagaacagagatggtcacccagccttcgcagcacacgtaaggggaaggatcgcttgggtggctcagctgcatcccgaaagaggggcccgcttactggccacttggcacgaggtggactggtcttga

SEQ ID NO: 12962 - RNA, 1449 nt, unidentified
  source 1..1449: mol_type = other RNA; note = synthetic construct
atgcccagatctgctccaaggtgctacgcgagagccctccatgaccgcagtcatccggacgcaaccgtcatgacttccgaccgcgtgagaactttggcccggggcttggggaatgccttcttgggggctgaagcatgggcaacccggccaatggcagaagcggctgtgtcagtcgttggggttggagggaggaggaggtggccaaggaaactggcccgggaggttctggctgcttatccaagacctcccgccgatcggcctagagagttagcccggtttattgaaaattccccggtgttgtgggcggccttaaatcgttccgcaccccccggaagggctccagttctacgtgctcggcgaatcccccccacgccagtaaggatggccgataggcgaccgtggcctgtcccagagctgcatgatcttgccgacctggccgcactgctggatctggatcccgcccatctggactggttcgccgacgtcaaagggcttcaacgtcgcgccgcaccaggtcctctacaccactaccggtatagatggactactcctggcagcggcagacctcgcctgttagaggcacctcgcccccgtctgaggtcagtccagcgaacccttctggacgaggtcctcgccttaattccggtgcaccccgcggcacatggattcgtgcctggaagaagcgcagtaacaggagcaagacgccacactggcgccgcagttgtgatctcgcttgatctggcggcctttttcgcccacctcaacggtggcagagtctacggcgtgtttagaacggccggatacgcccagcccgtagctcatgctctcacaggcctctgtgtgcatcgcacacccgtggcggtgatagcggctatgcccccagcacgaccaggtagcacaccagaagctgtctctgcgcgccctggactccggagattgcttgctggtgcccacttaccgcaaggggcccctacgagtcctgctctagccaacctgtgcgtgatggcactcgataggagactgagcggccttgccgctgctaccggcttgacctatacacgttatgctgacgatctgacattttcaggggacttagagcccagggcagcccaacgcgtaaccgaagccgtgggtcggatcgtgagatccgaggggctggctctgcagccagccaagactagggtgcgggagcgctctaggcgacaagaggttacaggcattgtcgtgaacgaacacagtaatctgcccaggaccgagtacgatcgactccgcgccatactccacaacgctgcacggtctgacccagccgtgcagaaccgcgaacagcacgctgacttcagagctcacctgctcggtcggatcgcatgggccacccaacttaatcccgcccgaggccaaaagctgcgggctcaatttgaaaggatcgtgtggcctggagagcagccttga

SEQ ID NO: 12963 - RNA, 1344 nt, unidentified
  source 1..1344: mol_type = other RNA; note = synthetic construct
atgtcagaccctcgcaccagagtccttgcacgggctctcgggaacgcctttctgacggctccagaatgggcgttgcggcctctgacggacaatgccgccacagtacttgggggacgtcgccgatggacaagacgcctggcacgggaagtgttggatgcgtatccgcgacctcccgctgacagaccaagggagctggccgcttttattcaggcttcccctatactgttcactgcagtgctgcgttccgtggagacaggtaggcctcttagggtgatcagaatgccacctgcccccgtccaaatgaacacacgacggccgtggcctgtgcccaaaattgattccattcaggatctggctagactgctggacttggagacagcacagttggactggttcgccgatgtcaaaggccttcaaaggcgagccgctccaggccctctccatcactacaggtacgcctgggcctctaccgcgtctaagaggcccaggctcctggaggcaccattacctagactgagatctagacagcgcactctgcttgagcagatcttagctcggatccccactcatcccgccgcccatggatttgtgcctggacgcagtgccgtgacaggcgcagaaccccatgcaggagccgctgtagtcataggcctcgacctcgccgcattctttgcttcaattcaagtgggtcaggtttatggcatttttcgtgctgctggatatgccgagcccgttgctcacgtgctgaccggtctgtgcactaccaggaccccagtacgggttataagtaatatgccggccacctcagacgtagagagccgcgtgcgactacgcaggctgctagcaggaggccacttaccacagggcgcaccaaccagtccggcacttgccaacctgtgtgcgctcggcctggataggcgcctaaacggtttagccgcggccgtggggatgacttatacccggtacgctgacgacctgaccttctccgcgggggaggaagttaatgccagacggctcatcaccgccgtcgacgagatcgtgagaagcgagggcttcgccttgcagagcgcaaaaacgcggatcaggcgtgatttccagcgacaggaagtcacagggatcgtcgtgaatgcccaccccaacctgaatagacgtgaatacgatgagctcaaggcaatcctgcacaatgctttgcgccatgggcccgaaggtcaaaaccgggccggacaccgcgattttagagcacacctcctcgggcgcattgcttgggttgcccagttgaacccagaacggggcaggaagctgcgggagactttcgaagcgattacttggcccagcctttcgtga

SEQ ID NO: 12964 - RNA, 1362 nt, unidentified
  source 1..1362: mol_type = other RNA; note = synthetic construct
atgtccaggaggactaccagggaggctggcctggctaatgccctcgccttgtcctttctggctggggcatggtcagtggacggcctggaacaaagggggacaaccgtgttgggcgaccggcctagatggctgcgacgcttggttcggctggtgaccgacgcttacccacgtcccccggtggacagacctagggagcttgccgcgtatgtgttagctgcaccccccctccgacgtgcagcttactcggctgctcgccgaggacaccgacttccagctcccagagcctggctcgccgtaccaacagccatggccccaaccaggatggctccgtctcggtggcaggtgcctgcaatcgacgatgtgggcgcactggccgacctgctggatctcgagatgggacagctggaatggctggcagatgcccggggattactgcggagagcgcctcaggggcctttgcatcactatcgctatcgctggcaaccaaaagctgggggcgcgaggcttcttgaagcgcctttacctcggctgcgtcgcctgcagcggactcttctggataccgttctcgccagagtcccagttcaccccgccgctcacggttacgttccaggtcggagcgcggttactaatgcagccgcccatgtaggtgccgccgtggtagtgtccctcgatctggaagccttttttagctctctgagtgccggaagagcttacggcgtgttgcgcactgctgggtaccccgaaccagtggcccatctcctgactgctctctgtacaaacgccgtacctgtacatgtgctaagggggctcccagactctgtgcccgtcgatgtccgcttccgtctccgtcgggccttagccactccccacttgccgcaaggagccccaacgagtcctacactggcgaacctgtgcgcgcacgctctagaccgacgccttgcagggtatgctgcagcagcgggcgtgacatacacaaggtacgccgacgatctgacgttctcaggaggccccgggttattgagagctgctcccgcccttgtgaccgcagtccgaagaattgccgcagcagagggacacagagttaacgtggccaagaccagagtcaggagctccgcccagcggcaagtcgttaccggattggtggtcaacgagcgcctgaatctcccccgcggcgagtatgaccggctaaaggccgtcgtccacgatgcagtcagacatggcccggctgccgcgaatcgacatggtcacagggatttcagagcccacctagagggcagggttgcctggctcgaggcagtgcatcccgaacggggtgcacgcctgagagctcagctggcaagggtggcatggcctgtgagctga

SEQ ID NO: 12965 - RNA, 1332 nt, unidentified
  source 1..1332: mol_type = other RNA; note = synthetic construct
atgcgggcccgagacagactagccgcagctctggccgacggaatgttagcgggggattgggccggtgcacctatgcgagctcaaggtgcattagtcctcggcgagcggcacgcttggatcagaagactggttcgggaggtgcttgaattctaccctgaaccacctgccgatcgtccccgagaactagcacggctgataggacgcacaagaactatggaggagttggagcggagagccagaagacgcagacggcgcttgccaattccccaacatcgggtgactacacctaccacaacagtgaggaggccgttcccggttgtgagcattaatgacgctaccgcgctggcagagtgcctagggctgtcagtccctgacctcctgtggttcgctgatactaaaggccttcagcgcagggccgcatctgtagggctgcatcactataggagcacatgggtcgggacacggtcaggttcgcggttactggaagcaccaaggccacggctcaaggaagttcagcgtcagatcctgcagcaattgctcgcccccattcccgttcacgaggctgcccatgggttcgttgccggtcgctccgctgtgactggagctcgaccccatgtggatgccgccactgtgataagtctggacctggagagcttctttagctctgtatcaggcaggcgtatctacggcctgttccggatggccggctttcccgaaccagtggcgcacctcttgaccgggctgtgcacacaggcaacccctgtggacgtcctcaggcgcatgccatctgggcacccagctgcctttagactgcgtcgtaaattagcagagccgcatttgcctcagggcgctcccaccagtccccacttggcaaacctcgcagcttttggacttgaccgccgactggccgcctatgctagtcggattggagcccgctacacccgctatgccgacgatcttacgttctctggacctgacctgcgcaggagatccaggggagtagtcgccgcggtagctcgaatcgttgcggaggagggctttgccctgaacaccactaagactagagtgaggggacaggatgaccgtcaaaccgtgacaggcgtcgtggtgaatcgccaccctaccgtcagcagggcggaatacgatacgctcagagccatcctccacaactgtgtgcgattcggccccgaaagccagaataggctgctgcacacggactttcggtcccatctcagaggtagggtcgcttgggtggctgccctggatccagagagaggcaggcgccttcttgcaacctatagtcagatcgatttttccccctccgggacctga

SEQ ID NO: 12966 - RNA, 1326 nt, unidentified
  source 1..1326: mol_type = other RNA; note = synthetic construct
atgccagacgggagggctcgacttgcgattgccctggctgatgcttttctcgcaggcgcctggacaagtgacggattaaggacacaaggccagcttgtcctgggcgctcgtcatgcctggcttcgaagactcgcaagagaagtgattaaagcttatcctgagccgccatctgatcgacctcgggagctgttcgcgtttgttctgcagacacaggcaatggcccaagtagaaagacgcgctgcacggcctggcggaggatttccactgcccctgcaccggcttaccgcacctactagcatgattaggcaccccttccccgtgactagcctcgaccatgccggtgaccttgctgcactcctcggggtcagcatggaggagttgctgtggttcggcgataccaacggactgcaaaggagggcccgaagcgaccgtctacagcactacaggtccacatgggtcccaagcgtgagtggggggcgactacttgaggcccctctcagccggctgaaggcaatccagagacagattctggcccagatcttaacccccattcctatacacgatgccgcacatggcttcgtggtaggacgatccgctagaaccggagccgccccacatgtgggtacaggcttactcatctccctagatttggaatctttctttgcctccattaccgggtcacggatctatggggtgcttagggcggcgggttatcctgaacccgtagcccacctgttgacgggcctgtgcgctaccgccactcctgtcagggtgttggctgaaatgccaggtaccgcagcgccgtcggcctttagactgagaagacggctcgctgagccccatctgccccaaggagcaccgacctcaccccagctggctaatctctgtgcattcgccatagatcgtcgcctgtctgcctacgcctctgccattggcgcagtgtatactcgctacgccgatgacctgaccttttccggcgacaccctcgttgtcagacagcgcggggttgtggctgctgttgcacggatcgtcgctgaggagggcttccgcttgcacatcgataagactcgtaccagaggtcgcgacgcccgccaacaggtgacaggagtagttgtgaatgccagtacgactgtgccccgccgggactacgatactttgagggccatcctgcacaactgcgtcacacacggcccaagtactcagaatagggtggagcacaacgattttagggctcatttaagagggcggatatcatgggtggcctcattggacgcaggacgcggtcggaaactgctggcgacgttcgaacagatcgactggacatga

SEQ ID NO: 12967 - RNA, 1326 nt, unidentified
  source 1..1326: mol_type = other RNA; note = synthetic construct
atgagcgaagctctcgtcgccagtgctttagccgcagccctcctagatgggccttgggacgcagccgcactcacaacccgagccacagctgcactgggtggaaggaggcgcgcttgggttgctggtgttgtggcggacgttttggcagcccatccccgtcctcctttggacgctccacgaagcttcactacagagctggctcggcaccctgctttagcacgcgccgtgcacgctgcagaaaggaggggaaggcctctaagacccgcccatctggaacctgtcccctcatcaatgggcagaagaaggtggccggtgcccgtgcttgatggggttgcagatctggccgctctgctggaccttgacctcgcggagttggattggtttgcggacccccggggtttgcagcgaagagctagtgggacagccctgcaccactatacctcccgatgggtcgcaaaacggggaacccctcggctcattgaagcacccaagcccaggctccggcatctgcagagaattgtcctccacgcggtgctcgatgtggtggacgtccacgatctcgcccacggctttgtaccagggcggtcagccgtcactggagctcgaagacatactggcgccgacgtggtcgtaaggatggacctatccgccttttttgcctccgtgggtgctgcacgcgtgtacggagagttccggaggctgggctatccggaagctgtggcacacctgctgaccggcctttgcacgcatcggactccactgactgtacttcgcaccttgccagccggcggaagagccgaagatcggttccgtctgcgccaatggctgtctgccgcccacttgccacaaggggctccaactagcccggccctggctaacttagtggccggaccattagataggaggctggccggacttgccgactctatggggcttaggtgcacgagatacgctgatgacgttaccttctccggcggtcctcagcttcgttcgggtgcaggccgcctcgtgagatgtgtcacggcaatcgccgccgaggaggggttcgtagtgaatggggataagaccagagtccggggcgctgagcaacggcaagtcgtgaccgggatcgttgtgaacgagcgtacaagtgtgcccagagacgagttcgatcgcctgaaggcgctgctgcacaacgcggtgagaagcggacctgcattgcagaatcgccggggccatccagactttcgcgcccatctggcaggccgtgtttcttgggtggaggccgtatctcccgcgaaaggccgaaggctgcgcgctacatacgatagaatagcctggggctga

SEQ ID NO: 12968 - RNA, 1320 nt, unidentified
  source 1..1320: mol_type = other RNA; note = synthetic construct
atgagtgctgctgttgctgccgccttggctgctgccttcctggatgccccttgggaggccccacaactagcggcagctggacgctgggctttgggactcaggagagccgcctggttagatcggctggccgcagacgttgtggcacagcaccctaggcccccatgtgacgccccaagagcgctgacggctctcctcgtggcacacccagaacttgcctccgcacaggcagtggcccgaagacgaggtcgtcccctcagagtacggcacctggtggcagtacccgctgcaatgggtcgggctagatggcccgtaccaccacttggtggtgcagcggatctcgcagccctgctggaagtcagccctggggagctggattggttcgccgacgttcgtgggtggcagagaagggccgagggcacagctctccaccactaccgggctagctgggtggcaaagaggggagctccacgcctgctggaagctccaaaaccacggctcagggctctgcagaggagattgctacgggaggtccttggggcagtacccgcacctcctgtggtacacggatttgttcctggcaggagcgcagtcactggggctcgagaacattgcggcgctgccgtcgtggtccgcgttgatttgaccgccttctttgcgagcgtggatgcggcgcgtacctatcgggcctttcggtctttgggttaccctgaggccgtggcccacctgctaacaggcctcaccactcatgctaccccggcacgggatttacgagggatgccccctggcggagatgctgacgagcgtttcgcccttagacacaggctggctgctgcccatttaccgcagggggcaccgacatctcccgctttagccaacctttgcgcccgctcgttagaccgcagactggcaggcctggcagcagctctcggagcaagagtgacccggtatgcggatgacgtgactttttctggcggggaagaattagccgccggagcgcaaaggctagtgaggtgcgttacacgagtcgccgccgacgagggctttacggtgaatcccgccaagactaccgtgagaggacggggggagagacagctcgtgacaggcgtcgtggtcaacgaacggcctaatcccgtgcgctccgagttcgaccgcctgaaagcggtgctgcatcgatgtgccgtccatggccccgctagtgttgaagcaccgggaggggtggacttgcgctcccatcttgccggtcgcgttggctgggtcgaggcactttcaccttccaggggccgccgtttgagggagtcattcgacgccatcgcctggtga

SEQ ID NO: 12969 - RNA, 1320 nt, unidentified
  source 1..1320: mol_type = other RNA; note = synthetic construct
atggccgaaccagatgccgtagcagcggcactcgctgccgcttttctcgacgggccatggacggccgatgctctaactgctcgggcccgagaagctgttggcgtacccagagccagatgggtagcccggctggcaggagaggtaactggcaggttcggaaccccgccattagacgccccccgtgaactccgagctgcagttgccgggtcaccagcatatgccggagcaagagatgccgccaggagagccggacggcctttgagagtcgcacatcttgctaccgggacaacaaggatggggcgcaacaggttttccgttccccccctcgataccgtcgacgacctggctgctttttgcggcctggatccagcacagctcgactggtttgctgacgtccatcgctttcaggtgagggcgggcggatctgctctgcatcactacagggcgaggtgggttgctaaaaggggcgcccctagactgttggaggccccaaaacctcggctgaaggcagtgcagaggaaggtgttacacgaggtgcttgaccgcttccctgtccatgatgccgcccatggctttgttcccggtcgaagtccagtgacgggcgcatgggatcacgttctggcccgaacagtggtgcggtttgatctggaggggtttttcgcaagcgtgccagccgcgcgtgtacatggcacattccgcagcaccgggtatccagaacctgtcgcccaccttctgacaggcttggtgacccacgttacccccctgcgggatcttcgtgccatgcctgatgggggatcggccgaggctagacaccgtctgcgcaggaatctttcccacgcccacttgccccagggagctcctacttccccggcacttgctaatctgtgcgcgcgggggctagacgccagattggatggcctggcacgggtcctcggtgcaacattcacccgctacgctgacgacctgaccttctctagtacaactggtctggaccccgtgcgcctccatagagctgtgagggcagtggtcgccgatgagggcttcactctcaaccccgccaagaccagggtaagaggagccggtagccgtcaagtggtgacgggactcgtcgtgaacgaacgccctaatgtgccccgggaggagttcgaccggctaaaagcggtgctgcataattgtgtgcgccacggtcctactagccaagaccgagaggggcacagagacttccgagcccacttgctggctcgcgttgctcgggtcgaatctgtcaacccggcgaagggcaggcgcttaagacggtcattcgaacagatcgcatggtga

SEQ ID NO: 12970 - RNA, 1347 nt, unidentified
  source 1..1347: mol_type = other RNA; note = synthetic construct
atgtatgacgctagagggcgcgctttcttaggccggtgccttgccgacgcttttctcgcaggcgtttggaatgagcgggcattagttgaccgtgctggccgcgcactcgacagaagaccacgctgggtaagagccgtagccagggaggtgctggctgcctatcccagaccccccagcgatcgtcccagggaactagcgaggctcatcgaactagcgttgagggaacgccccgcacctgagggagatagcgaacctcccagggttaggcgctggcttgtacctgagccggctatgggcagacgcagatggccagtcccagagatcgcttcactgggagcgctcgcggggttcctgcaagtgtcggatggcgagttagcctggctggccgatgctaggggcttggaacgcaccgtggagaacgagagactgcgacattacagatacggtgctttgccccgtcctggacgccctgtgagggtcatcgaacggccaaagcaccgactgaaatctatccagagaagggtgcttcacgagctcctcgactggatacctgttcatgaggccgctcacggattcacaaggggccgatcagtacgaacacacgcacgggctcatacagggcggtttgtggtcgtgcgctttgacctggaggattttttcgcaagtgtgcgcgccgccagggtgtatggaatattccggactgccggttacccagaatcagtggcttacgccctgaccgtgctaactaccaacgtggtcccagccaccgtctggcacgagcttccacgccctgttgcccctcgtttgctgggcgctcaccatcatcttggccgcagactggcaaccccacacttgccgcagggtgcaccaactagccctgcattggccaatctcgcagcgtttagactggacaggcggctggatggcttggcgaagagtctggaaattagttactcccggtacgccgacgatctgaccttctctggagatgcccgtctcgtgcgagctgccgctacagtgcgtagagccgtcactcaaattgcccgggaagaggggtttaccgtcaacgagtccaagagcatgctggctacgagagcagggcggcagagggtctgtggagtggtggttaatgagcatctgaatacaccccggcgagagtatgacgtgctgcgggcaattctgcacaactcctctaggtatgggccccagactcagaaccgcgcagccattcccaatttcagggcccacctgcttggtcgaatcagctggatcgaatccgtcaacccgcgacggggggataaactcagacggcatttcgcctctattacgtggcaggaagactcctga

SEQ ID NO: 12971 - RNA, 1347 nt, unidentified
  source 1..1347: mol_type = other RNA; note = synthetic construct
atgtacgacgtacgcgcaagggcctacctagcccggtgtttggcggacgcctttctcgccggagtctggactgagcgagcaatggttgatagagctggacgggcactagacccgaggcctcgatgggtgagggcagttgcccgtgaggtgctggctgtctaccatagacctcctgccgatcgtccccgcgagctagcaagattcatcgggcttgtgctggcagacaggtctgcccctgaagacgcgcccaaccctccacaggtcagacgttggttgataccggaaccagctatgggacgacgccgatggccagtgcccgaaattgcctctgtgggagatctggcctcctttctgggggtgagtgatggagagctcgcctggctcgctgatgctcggggattagagagaatggtgaaggatgaacgactgaggcactatcggtatgcgaccttaccacgtgctggccgccctgtacgcgtaatcgagcgacccaaacaccggctcaaggctatccagcggcggctgctgcacgaggtccttgattggattcccgcacatgaggcttcccacggcttcacaagaggccgcagcgtaagaacccatgcggggggtcacacagggcggtttgttgtggtgcgacttgatctcgccgacttcttcgcctctattaccgccgggagagtctacggtatctttagaacagccggctatccggaatcagttgctcatgccctcactgcactgatgacgaacgttatccccgccgtgttgtggcacacacttccccgcccagctatcccaaggcagatcgctgcccatcaccacttgggcagacagcttgcgacgcctcacctgcctcagggtgcaccaaccagccctgcattagccaacttggctgcatttcgcctggacagaaggctgaccggcttggcaggctccctggagattagttactcgagatacgcggacgacctcactttcagcggacccacccaactggttcgcagggctggcaccttaaggcgtgctgtggcccagattgcccgggaagagggtttcactgtgaacgatgacaagtccatgcttgccacacgggctgggagacaaagggtttgcggagtggtggtgaatcaacatctgaatgtgccacggagggaatatgatctgctcaaggccgtcctgcacaactcagccattcatgggccacagacccagaatcgcgagggcgtggtcaattttgaagctcatctgctgggcaggataacttgggtcgagagcctcaatcccacacggggtgacaaactgaggcgccagttcgcaaaaatagtctggcacgacgatccctga

SEQ ID NO: 12972 - RNA, 1350 nt, unidentified
  source 1..1350: mol_type = other RNA; note = synthetic construct
atgctctctgcacccatgtacgaccacctgactcgcgcttccctctccaggtgcttggccgacgccttcctggctggtgcgtggaatgagaatcggttagccgggcgagcagggcaagccttagctcctcggagggggtggataggccctcttgtccgggaggttctggccgtataccacagacctcccgccgatcgcccaagagagctgaccagatttatagcacttcagctggaacagatgccgcctagtgaccttgacccgccacgtgtcaggcggtggtttgttgccgaactggcaatgggcagaaggcgatggcccgtgcctgatcttgcatctgccggtgctttagccggctggctggaggttgcaccaggacatctcgattggttggcggatgcccgcggattggagcgcacaaccgcaacagagaggctgcgaaactatcgctatagttggttaccacgcgctgcaggcccacctcgtctaattgaaaggccaaaggctcggttgaaagccatccaacgcagactgctgcacgagattctcgattggatccccgctcatgagagcgctcacgggttcactcggggcaggtctgtgaggtcccatgcagcggctcatacaggacggtacgtcgtggtcggcctcgatctaaaggactttttcgctagcgtggtcgccgggagagttttcggcatcttccgcacagccggttaccccgaaccagtagcccatgtgttgaccgctttgaccacaaacgccgtccctgtcgaggagtgggcatcagtgcccagaccgagagatcccgggcttgtaggtgcccatcaccgcctcggtagacgcctggcaacacctcacctgccacagggagcaccaactagccccgcgcttgccaacctagtggcatttgccctcgaccgtcgactggctgctctcgctagggccactggcgtgacctatacccggtatgctgacgacctgacgtttagtgggcccgcttcattactcagaggcgccgatcgcttccgaagctccgttgcggacattgcccgagaagagggattcagggtgaatgaaagaaaatcgaccctgatgactagagcgggacgtcagagggtgtgtggcgtggtggtgaaccagcgactgaatgttgcccggacggaatacgatgagctgaaggcaatcctgcacaatgcggcccggtccggtccttcttcacagaaccggcacgccgtggcagactttcgtgcccatctgctcggacggattgcctgggtagaaagcctgcaccccgggaggggagaaagattgagggctaggttcgaggtgatcgattgggacagatga

SEQ ID NO: 12973 - RNA, 1353 nt, unidentified
  source 1..1353: mol_type = other RNA; note = synthetic construct
atggatagacgcactagagcctatcggtccctctctccttgcctcgctgacgcctttttagccggcccctgggacccagctgcattagctacgcgggcaggtttagtgctcgagcctcggccaccctggatcggattgttggtccgcaacgtccttgccgcttacgaacggaggccggctgatcggccacgtgagctagctaggtacattgccttgcagctggagagggtggacgcagataccgcagggcccagacctagagtgcgccgatggctgctcgcagaactggccatggttagaaggccatggcctgtgcccgaactggcaagcgtcggagctgttgccaatcacctggaagtctctgatcggcatctggcgtggctggccgacgttcgaggccttgaaagaacagggtccgatgagaagctgcgccactacaggtacggatggttacctcggcatggtgggccccctagagtgattgagaggcctaaggcgaggctcaaaagtatccagcggagagttctgcacgagatcttggactggataccagcccacgacgccgctcacggttttacacgcggcaggagtgctcgctccaatgcagcagcccatacccgccgtccagtggtcatggcgttggacctggaggattttttcgccagcgttagagcccccagggtgtacggaattttccgcaccgcaggttatccagaacccgtggctcacactctgacgggcctatgcactaatgctgtgcccatcgaggagtgggcagctgtgccacatcctactgcgtcgccgctagcccaggcccatcacagactgggccgtcgtcttgccacacctcacctgccccaaggagcacctactagcccggcacttgcgaacctggccgccttcactctggatcgcagactcaccgggctggcactcgctttggacgccacctatacgcgctacgccgatgatctcaccttctctggctcaagccgccttctggacaggggtgggcagatccgggcaacaatagccaccatagcccgggaggaagggttcgccgtcaacacccgtaagtccgtagtcacaacaagggccgcgcgacaacaggtgtgtggcattgtagtgaatgacagacttaatgtgaccaggcacgagtatgacgaactgaaagcgatcattcacaacgcagcccgacggggcccatcaggagaaaaccgggctggactgtctgattttcgggctcatctcctgggcaggatcgcctggattgagagtctccatcccgctcgcggggctcgacttcgatcacagtttacaagaatcgtatgggaccgacagggcgctgcctga

SEQ ID NO: 12974 - RNA, 1431 nt, unidentified
  source 1..1431: mol_type = other RNA; note = synthetic construct
atgaggagaggacctgcaccattgggtacccccccaggcgacttagcacaagccgctgctgcagcattgctcgcaggtgcctggaccgaacgggctatgctacggcggctgcaacaggctgtacggcctctgggtcctagattgcccgcacgcctggttgcgagtgttctggccctccatcggacacctcctgccgatgctcctagggcactcgctcaggagatcgatgacctggtccgcggacatgcaccaagaggaggctggccaccgaacgcacgtgtcagacggaggtacgcccctcctaccgccatgagaggtgctaggtggccggtagcccctcttcccactgttgccgctctgggtcgactggtcggggaaagggatccaggggctctggcctggttggctgacgttcgcggcctggaaagagaggttccagatgagcgcctcagggcatatcggtatactcatcacccccggacaggtggaccaccgcgtgtactggaacgccccaaggcacgcttgaaggaagtccagaggaccctgctgcgggaggtccttgctccaattcccccccatgacgccgcctgtgggtttgtcgcagggagatccgtgcttgaccacgccgccaggcacgtaggcagaacggtggtggtgcagctcgacctggaggacttctttgcccaggtgactgccggccgagtgttcggaatcctgcgagccgccggatatcctgaacccgtggcgcacgccatagtgggcctaacgacaaacgtggtgccatacggcttctgggctcgaattccccgccccgatggtccacgggagatagagagacaccaccggttagggagaaggctcgccactccccatttaccccagggcgctccgacttcaccagctttagccaatttggcggcctttaggctggacaggagactggatggcctcgcgcgctcactcggactcacctattcccgctacgcagacgatctggccctaagcggaggccgacatctagctcggcgcgcttacgaacttgagcgcacaatcgcggctattgccgcggatgaggggtttagagtgaacccgcagaaaacaagggtgagggcccgggaaggacggcaaacagtctgcgggatcgtcgtgaatgagcgcccagctgtagcaagacgggacgtggaccgtctgcgagcccttctccatgaggccgaagtggccggaccaagagccgctgatcgtggagggatgggacctgccttcgaggctcacgtccgaggtcgtgtggcctgggtggcacaggttcaccctgcaagaggggcgcgtctgcgagagcagctgaggagagttgactggtcggcacttcgcgataccggggatgctggcgtgcacaggtcttctccccctggcgacaggcccttcaccagctga

SEQ ID NO: 12975 - RNA, 1371 nt, unidentified
  source 1..1371: mol_type = other RNA; note = synthetic construct
atgcccccacctccagaccaaccgcaaccccttcgttctgacgcagctgctgcactggccgacgcgtttctggcaggagcgtggacgaggcccggtatgattcagagagggcacgacgccctcggcgttgaagcagtgccaggcctgcgatggttaaggcgtgaggtcgatcgcgttctggcagcctacgctcaccccccacgagacaggcctagagagttggccgcattcgtagcggccacaatcgatgcacgaagagccgctccgtttccccccaaacatcggctggtagctccgggagccatggcaggtagacggccttggcctgcaattcccgagctggataccgccggcgatttagccgactggctcgctctcagccacggagagctggcttggttcgccgacgttcaatcacgcgagaggcgcgctgacgaccgaagactgcgccactacacttacgcttggagtgctagacccggtgccccagtccgcttcttggagcagcctaaagctcgccttaaggcaatccagagacgcattctccacaagctgcttgtccatgtccccgcgcatgatgccgcgtacgggtttgtgccggggcgagatgtactgcaacatgctcgacgccacgctggagctgccgcagttctgagattcgacgtgcgggacttctttgtgagcttgcccgcaggcagagtctacgggatctttaggctggcagggtatcccgaagctgtggcacacgcattaaccggcctaaccacgaatgccgtcccacctggcgcttgggctgacgttccagcccctgctgaccctgctctgcatcgccagcatgtgctgcttggaagacggctcgccgctcctcacctcccacaaggagctccaacttctccactactggccaacttgtgcgcctttactttagatcgccggatggccgcacttgccgtgaagctgggtgccacatataccaggtatgccgatgacttggtgctgtccggggatagggcacttgccagacatgcccagcggactactcagaccgtacgggccatcgttaggggccagggtctaaggctgaacgaaaccaagacaacaatcatggtggcggcacagaggcagagggtgacaggcattgtcgtgaacgatcaccccaatatagcccgagatgagtatgatcggctccgtgccatcctccacaatgcagccagggccgcggatccccatgctgaaaatcgggcgcacgtgcctgacttccgtgctcatctccggggccgtatagcctgggtggagcacgtgaacccacaacggggagcgaaattgcgcgcccggttcgaacagattgcctggccagcctcccctagatga

SEQ ID NO: 12976 - RNA, 1335 nt, unidentified
  source 1..1335: mol_type = other RNA; note = synthetic construct
atgacttcagacctacagaccgttgcaggcgctctggcctccgctttcctgcgtggagtgtggaacgaacggcgattagtagcccggggggaaagaatgattggccagaggccggtgtggctgactccattggtgcgccgagtgctcgagggctatcacagaccccccgccgacagaccaagagagctgcaagcctttattcgcgtgagtctccgcgacattacaggaagggctcgcttggccaaaagagtcgagatgcgccactggagcccgacacccaccgtcatggtggatcgcaggtggcgggtcccaatcctgcacaccgtgggagacttgggggcccttttaggtctggaccccggtgcgctgatgtggttagcagacgccaggggcctcgagaggtttgcacctgaggagcggctgaggaactatcgctacacctgggtacctcggacaacgggagcgccgaggttgctcgaagcgccaaaagcgcgtctgaaggtggctcagagagacgttctgagacgaattctgtgctgggtgccacctcatgatgcagcttacggcttcataaggggtcgatccgctcgggaccatgctgcacggcataccggacgggaggtggtgctctcatttgatctgatggacttcttcgcaggcgtaccagccagaagggtgtacggcatataccggctggcaggttaccccgaacctgtcgctcactgtcttacagctctctgcactaaccagattcctcgaaccgtttctaatgatatcctgggccgtcctgacccagcttacgccctgctgaggagaagactcggcacccctcatttgccccaaggcgcacccaccagtccagcattggccaacctggtcgcccacgcccttgacaggaggcttacgggcctagccgccgcacttggtggaacgtatacaagatatgctgacgacctcgtcattagcggggatgcccagttagcgcgcagaatcggggttgcccagcgagcagtagccgagatagcagctgatgaagggtttgttatccgccccgccaagacaagacgcatgagccgcgccgatcgtcaagctgtgtgtggaatcgtggttaatgcccggactaatatcccaaggagggattatgatcgtctaaaggccatcctgcacgatgccgtgcggcatggacccgatgcagctaatcgggacgggattgcggatttccgcgcccaccttgcagggagagtggcttgggtcacttctctgaaccctgatcgtggggccaaactccgaactacctttgacgctatcgtctgggaccctcggccccagacatga

SEQ ID NO: 12977 - RNA, 1260 nt, unidentified
  source 1..1260: mol_type = other RNA; note = synthetic construct
atgctcacccggcgcgaagtttccgaggttctcgccgtggcattcctgagtggagaatggcactttgaggagcttcagcgcagggctcggagggcacttggtagacgcgcctggctaaggccactggcaattgaggttgtagatgcgtaccggcgacctcctctcgacagaagacgggaactggttgcgtatattgaacacgctatccctagacgcgtgaggcttcccccgcgaatcctgaggcagcccacattccaccccgccatgggatttgcgagatggcccgtgcccaggatcgacacagtaggggatctggctgcctttctggggctggaagtgggggagctggaatggtttgccgacgtaaggggcctggagcgtgtggtcgacgatgagcgcctcaggcattatcggtatacgagattacctcgcgcctcaggacctccccgagtgttggaagcacccaagcctcgtctcaaagcgctgcagcgccgtctactgcgggaggttctcgcctttgtccctgtccatccggctgcacatggcttcgtcggcggcagatctgcacggacacacgctgcaacccatgtgggccgtagggtagttgtgagagtggacctggaggatttcttcgctggcgtgactgccgctagggtgttcggcatcttccgcgcctgcggttacccagaaggagtggcccacgtgctgaccgggctctgtaccaatgcggtgccagctggtgaaagcgtcgccggtcactggcgattgagtcgcagactcgcggctcctcatctaccacagggagccccaactagcccggctttggccaatctggcagcctttgccctggaccgacgtctttcagggctagcagcagctgtcggcgcaaggtactcccggtatgctgacgatctggtattttcttccgacacccacctgagaaccccagtcgctgccatagggggcattgcccgggatgagggcttccaagtgaacgccggcaagactagagtcatgggacgcggtcggcggcaaactgttacgggagttgtggtcaatgcacatcccaacgtccctcgagtggaatacgagagattaaaggcaactttacatcgggctgcccacgatgggccagctggacttgacccaacagtgctgctcggcaggatagcctgggtggagagcttgaaccccgcccgaggagccaaattgcgcacagctttcgggcacatcgcctggaccccccttgagaacgggtga

SEQ ID NO: 12978 - RNA, 1212 nt, unidentified
  source 1..1212: mol_type = other RNA; note = synthetic construct
atggcaagcagcctgtctcggcgcgagacagccagagtccttgcagggagttttctgggcggagagtgggaacttgaggccatggccaagcgagccggaagagcactaggtcggcgcgtatggcacaggagagtcgccgaacgaactctgagggcatatcgccacccacccagagatcgccccagagagctggcagacttcgtcttcacgctgctcgatgacgtgaggctcccacccaggctcttacgggaacctgtttttcacacggaaatggccccaggcaggtggcctgtaccgagaatcgacacacttggggacctggccgaccggcttgagctggaacctgggcagttgggatggctggctgatgtgcgaggactggagaggacatccactggaaagctgaggaactatacctatgtgcgtgtgcctaggagaagcggaccaccgcgggtgcttgagaggcctaaagcccgcctcaaagagattcagcgatggatactgagagaactcctggcttggattcccactcacgacgcggcccacggatttgtaaagggcagatcggcacatacccatgccgccctgcacgtggggcgaaaagttgtggtcaggctcgacctggaggactttttcgccgccgttagtgcagcacgcgtttacggggtatttagaactgctggctatccagaagcggtggctcatactctcacgggcctgtgcaccaacgtggtgcctgcagacgaaagcgtgccaggccacttcaggttggcccgtcgtttagcaactccccatcttcctcagggtgcccccacctctcctgctctcgctaacctggccgcccacgcattggataggcggctgaccggcctggctagagagattggtgctacatactcacggtacgccgacgatttggtcttgtcagctgatcaccatctccgaacaccacatgcagctgtgacagagttggcgcgggatgaaggcttcaccgtgaatcgggggaagaccagaaccatggggcggggttcccgccaagttgtcacaggcatcgttgtgaatgcccatccgaatgtcccccgcgctgagtacgatcggctaaaggcgatcatccaccggggcgactacgatcgcgagcatgtgttaggtcgcattgcctggatagcggccatcaaccccgctcgtgctgctaaactacgttcctctatgtga

SEQ ID NO: 12979 - RNA, 1386 nt, unidentified
  source 1..1386: mol_type = other RNA; note = synthetic construct
atgaatcgggatgcggctggccatagggcaaccgctgcagacgtaagggctctgataccggtcctgcgtccatcccttagatcagtcgccggctccctcgccgatgctttacttgacggtgagtgggaagccgacgctatggtttctcgcgtgacagctgccctcgatcggcctggaagatgggtcagacagctggtgcggatcacccgtctgtcatttcccgtggcgccccatgacagtcccgaaagtcttcggcgagtgatcctggcaggccctccacttccccaggttgctgctgccgatgcccttgcaggcaggccactccctaccctggctagacgccccttaccagccagggtagtcgccctgcaagccggattgccacgatgggacggcgtaggggacttggcggcatacctgggcttgactgtgggagaactggcatggtttgcggatacgaggggctatgaggctcgagtgcgagcggagacactgcggcactaccgctaccgcctgctccagaagaggattggggggtgccgcctgattgagagccctaaatggcagctgagagagattcagcggagaatcctgcacgaggttctggaccagctgccggtgcacgatgctgcccatgggttcaggcctggcaggtcggttattgggtatgtggaaccgcatgccggccgcagagtggtcatccatctcgacctccgggactttttcgccagagttggagccggtcgagtgtggagcgtgtttcggtgggctggctatcctgatgcggtggcacacgtcctcacaggactgtgtaccaatgtttctccaactgccgttaggtctgacgtccgacgcactggggccttgagactagcagccgcatgtgggacagtgcacttgcctgctggtgcacctaccagccccgccttagcgaacctatgcgcctacgctctcgatcgccgccttgctggattagctcgtcgggtgagcatgcggtacacgaggtatgctgacgatcttgctttttccggaggacggtccttactgtggggcaccgacgccctcatcgaccgtattgcagcaatagccgcagccgagggattcccagtgaactcccaaaaaactgctgtgttgacagcatcaagacgtcagcgcctcgccggcgtagtggtcaacgatcaccccaacctggatcggcgcgagttcgacgccctaagggcaaccttgcacaattgtgtacacagcgggcccagttcacaaaacagggggagccaccaggatttcagagcccatctgactggtagagtctcttgggcctgcctgctcaatcccgccaagggtgccagattggaacgactactggaacagatcgactgggcaaggtga

SEQ ID NO: 12980 - RNA, 1365 nt, unidentified
  source 1..1365: mol_type = other RNA; note = synthetic construct
atgaccagagaatctgcagcggtaactgtggctagggggctcgctcatgcgttcttggccggagactgggatccaccagccatggcctccaggggtcgtgaagccgtcgaaacaagacgggtgtgggtaagacacctcgccgatgcagctcggcacgcctatcctgacgctcccagagatcgaccccgagagctggctaccttcctgtctgtgtgcccacctctgacaaaagcaatagccgctgcaagaaggcgtagtgaggagccgccaacgatacgcaactggctggttgcagagacagccatgggacccgcaccttggccagtcgctaatctccacacgctgcgtgacctgcaggatctaatcggcatgagcaccgcaactctgaactggttcgccgacacgagaggtctggaacgcacagtggctgatgagcggctccggcactacagataccactgggctcctaagaggaacggcggcgccagactgatcgaagcgcctaagcctgtgctgaaacacttgcagcgggtgctcctgcgagaaattctggagccagttccggtacaccccgctgctcacgggtttaggcgcgatcgctcagccctgagccacgcaaatggccatatccagcgcaatgtggttatccgcgtcgatctggaggacttctttgcctctgtccgagccggtagggtgtacggcatttttaggggctgtggatatcctgagcccgtcgcccacgtgttgactgcgctgacaaccaatgctgtccccagggcagttagcgcccagacaggagctccatctgtggtggagagtaccgccgctttccgtcggttagccgggcatttagctcacccccatcttccgcagggcgctcctacaagtcccgctttggcgaacctcgcagcgttcgggcttgaccgcagacttgcaggcttggcatcggccgctgggcttacctacacccgctatgccgacgaccttgcattttcctcaattgacccccgtagcgaaggacagaatcggcgcctcgtggaatggatcactgggattgccgaggatgagggatttcgggttaacgtggccaaaacttccgtcagacacgcaggccagcggcaacgactagccggagtggtggtcaacgaacgagcaaatgtagagcgcagacaatatgacctgcttaaggccaccctccataacgccgctaggcatggtcctgcaggccagaataggactggacatccagccttcagggaccatctacgggggcggatctcatgggttaatcaactcaacccagcgcggggtgagagattactggccacctttgcccagattgactgggattccgccgataggtga

SEQ ID NO: 12981 - RNA, 975 nt, unidentified
  source 1..975: mol_type = other RNA; note = synthetic construct
atgcctgcatggaacgtcgccgctatcgacagcttgcccgagctcgccgagcgattagagctgagtctggaacagcttcagtggctagccgatgtacggggtctggaacggtccgttaacagtgagcgactgcgtaatgatagatataggctgctgcctagagcttctggggtgccgcgggtgctcgagataccaaaggggcgcctcaaagaagtgcagcgctgggtccttcgggagatccttaaccaaattcctactcaccctgccgcgcatggcttcgttaggggctccagcgtcagaacgcatgcagaggtccacagcggccaggccatggtgttgggcctcgacttaaaagatttctttgctagcgtcaggcgcgcccaggtgaaggcaattttcagggctgctggtttcgagacagaggttgcacggaccctcgctggactctgcacaaacaccacacccagacacgtgggagcatcgcgcttgcttgccactcctcatctgccccaaggcgccccatcttcacccgctctggccaatttagcggccttcgcactcgatagacgcctgtccggtctagcatacgcccacgatctgctgtattctcggtatgcagacgaccttacctttagtggacccatgccaggtagagggaggcgacgatttctggtggccctggccaccgaaatcgcgagagatgaagggtttgcgattaatgaaaggaagactgctatgcatcctgccggaggccgccagcaggtttgtggagtggtggtgaatgcacgtccaaacgtgcccaggagagactacgaccggctcaaagcaacactgcacaatctggctgccgccgggccagtagacaggtcagaagctgccgcattagccgggcgtatcgcgtgggtagcttcattgaacccggcccggggcgctaaattgcgcgagaagtacgctaagatagagtggtccgaatga

SEQ ID NO: 12982 - RNA, 1323 nt, unidentified
  source 1..1323: mol_type = other RNA; note = synthetic construct
atgcgcatcattgtggccgccttcctggacggatcttgggagccaactgcaatggctgcacgggcgcatcacgatctggggctcctgaccgtgaggcgggaaatcgactttggcgggaccgagccttacgtgtggctacatagagccgctgatctggttgccgatacctttgtagccccaccccggagtgagttgcgggcaatgcgggttctggtagctgagcacgctgccccagctattttacctctactcgaccaccctattgcggggccccatacagggactgcccttgtctcctccgctatgtcagaaccccggtggccggttgtgcatctggatacggttggagacgtcgccgctgcactggggttactgccgacacagctgtcgtggtttgccgacgttgcgagcctggagcagtcagtcacggacgaaagactgcgacactacaggtatcggtgggtagccaaaagcggatcaggccagcgcttagtcgaggcccccaagcagacacttcgcagagtccagcgatgggtcctccgccgtgtactgcacaacatccccgtgcaccctgcaacccatggcttcgtgcctgggagatctgtgcacacttatgtgggcccccatgtgggccggagagtcgtagtgagcttggatctccgaaacttctttaccagcgtggccgctggacgcgtcttcggtatatttcgggtcgccggatacgcagactctgtggcgcatactctcaccggattgatgacaaacgccgtgcccgcagacattcttcggggtcatccagatgcccccagggcgttgcgtttcccacaccttcctcaaggagcgccaaccagtccggccctcgcaaacctggccgctttttctctcgacaggagactgagcggtctagccacagcgatggatttgaggtatactcgctatgccgatgacctggctttctccagtgctggcggcttgagtcgaagggcaaggcgcagacttgtggtgacagttgaggaaatcgccagggctgaaggttttgacgtgaatcgtgctaagactagagcagctaccgccgggcgacagcaaaggctggcaggtagggttgtgaacgccgtggataatgctcctcgccgcgactacgacagactcagagccgttctgcacgacgcaagcatcaatggcccagtggcagccaatagggaaggccaccctgccttcgaggcacaccttcggggacgtatccactgggtcgcttccgattcacccgctcgccaaagacgactctggcagctgttcgatcagatagattggtccgagggctga

SEQ ID NO: 12983 - RNA, 1311 nt, unidentified
  source 1..1311: mol_type = other RNA; note = synthetic construct
atgcggccggaattagcacgcgcccttgcagccggctttcttgctggcgagtggacaagagctggtctgaccgcctctggcgcagtggtgctcggaagacggcctagatggcttgcgccactcgtgcggcagactttggacctgtacccaagacctccaggcgatcggcccagggaactggctacaaacctggcgaggctcccagctgcagagaaagctgctctggccggtccacaggttcatcccgtggctgaaactcacatgattgccaatcgctggcggcttcccgagttagaccggctcgcagatctggcttcctatctgagagtgacagacggggagctcgattggttcgccgatcctcggcacctcgctaggctaacggtgcagccgcctctgcagcactatcgtgtgagtcacagggttgccgcctccggcggaatacgcgtcttggaggccccaaagccccgcttgagggccatccagagacgcctgctggatgagcttgcttcccgcattccccctcatgacgcagccagagggttcagacccggagggtctgtaagggcgtacgctgcacctcacgctggaaggtcagttgttctccgcatggacctcgaagctttctttgcgagcgtcaccgtgtcacgcgtttacgggatctggagaacagcaggctaccctgaacccgtagcccacgccctagctggcctggtaaccagcgtgctgccactagcctcctggcgagccatacccactcctgtcgacgaaggcttgctggatgctcactggcgcctcggcagacgattagccaggcctcatttaccccagggagcacctacatcacccgcaatggcaaacctggctgcctaccacctggacgtcagactttctgctttggcccgtagctggggcgggaggtatactcggtatgccgatgacctggccttttcgggtgcgacgggatggggaaccggtaccagtcggctgctcgacgcggtagagcgtatcgtcgtggatgaggggttccgcttgaacccgcgtaagaccggcgtgatgccacgagccggtagacaatccctggggggactggtggttaatgaaaggccacgagtgagccgagcagacgtcgatcggctgaaagccattctgcataactgccgagtgcatggaccgtctagtcagaatcgggatgatcatcccgcctttgaggaacacctcagggggagagtcgcatgggtggcccaacatgaccggcttcgtggcgccaggctattggcgatgcacgcagagatcgactggagccgctga

SEQ ID NO: 12984 - RNA, 1311 nt, unidentified
  source 1..1311: mol_type = other RNA; note = synthetic construct
atgaggcctgagctcgctcgcgctttagcagccgggtttgttgcaggcgaatggacgaggccaggccttgaagcctcaggtgccgtggtcttaggtagacgtccgcggtggttggcaccccttgttcggcaggtgctggaactctatcctcgcgctcccgtagataggccccgagagctggccaccaacatcgcctctagaccagccgccgcaaaagcactgagggcacgggctgtggtactgccaatagctgagactcggatgctggctaacaggtggaggttgcccgtcctggatgatctcggcgacttagccgcattcctcggtaccagccccgctgaattggattggttcgcggatccccggcgtctggcacgtttgacaaagcaggcccccctacagcactaccgcgtaagccacttggtcgccgccagtggaggaatccgcgtgcttgaagccccgaaaccacgtctcaaggccatacagagacgtctactgcacgaagtcgcgtcactggtgccgccacatgatgccgcacgagggttcagaccagggggttcagtccggtcttacgccgcccctcatgcagggaggtctgtcgttctacatctggacctggaggctttctttgcctccgtgacagtaagcagagtctatggaatttggagatcggccggttacccagagcctgtggctcacgctctggcaggcctggtgactgcagtgttaccgctggccgcttggagagcaatccctgcacctgctgacgatggcctcctggacgctcactggagacttggccgacgactcgcggctccacatctgcctcaaggagcccccacttcccccgctatggccaatcttgccgcttttggactcgacgtccgcctgacagcccttgcaaggtcatggggggggcggtacactcgctatgcagacgaccttgccttttctggagagaggggatggggcaccgggaccagtagactgatcgacgcggttgaacggattgtggtggacgaggggttcagactgaacccccggaagacaggcgtcatgccaagggctggtaggcaagctctcgccggcctagtggtgaacgagcgacctcgggtgtccaggcgcgatgtggatctgctgcgggcgatcctgcacaattgcctggtgcatggacctagttcccagaatcgcgacgatctccctgcttttgaggaacatcttcgcggccgcattgcgtgggttgcgcaacacgacaccttgagaggcgcccggctcttggccgttcacagagagattgactggagccgatga

SEQ ID NO: 12985 - RNA, 1050 nt, unidentified
  source 1..1050: mol_type = other RNA; note = synthetic construct
atgcttaccaatcgctggagactccctgaactgcatgaccccgctgatctggcggaactggtcggcatcacaacaagcgagctggattggtttgcggatcctcgccgcttagcccggagtgctggcgatgtgccactgcagcactaccgagtcgggcatcgtaccgcagcaagcggtggcattcgggtactcgaggctcccaaaccccggcttcggcgaatccagcggcagatcctcgatgaggtggcctctctgatacctccacatgacgcggcaagaggatttcggcccggcggatcagttcgctcctatgcagctccgcatgctgggaggcctgttgtaatcaggctggaccttgaggccttcttcgcttccgttaccgtggctagggtttatgggatttggcgctctgctgggtacccagagcccgttgcccacctgttagccggactcgtcacctccgtgctacctaggagtgcctggaggggggtaccaagacccgcagacgaacgtctgctcgatgcccactggcgacttgggaggcgcttagcagccagccatctgccacagggtgcacccacatctccggctatggccaaccttgctgccttcggtctagatgtgagactgacagcacttgcccgttcctgggggggtagatacacgagatatgccgacgacctcgccttttctggcgcagcgggatggggatcaggcacttccagattgttggacgccgtggaaacgatcgtgcgcgacgagggcttcactttgaacgctcgcaagactggcgtcatgccacgaggaggtaggcaaaccctggggggactggtcgtgaatgaacgacctagagtgagtaggcacgacgtggacttgttgagggccattctgcataattgccaccggcatggaccttcgtcacagaaccggcacgacgtccccgcctttgaggaacacctgcggggcagaatagcttgggtggcccaacacgatccagtcaggggcgcacgtctcttggcggtgcacgagagcgtggattggagcagatga

SEQ ID NO: 12986 - RNA, 1311 nt, unidentified
  source 1..1311: mol_type = other RNA; note = synthetic construct
atgagagctgacttagccagggcccttgcagcgggatttctcgctggggaatggacacgccccggccttgtggagtcaggttccgttgttcttgggcggcggcccaggtggttagcacctttggctaggcagacaattgatctgtaccctcgtcctccacatgataggccccgcgagctcgcagcgtcaattagtgctcgtccggctgccgccaaagcagcaggtgtacggcccctcgtccaacccgttagcccgacacggatgatgactaatcgctggaggctgccagtgcttgatggcctgggagacttggccgacctgttagggctgacttcctctgaactcgactggtttgccgatccaaggcatctggccagaaccgctgcagacggccgactacagcactatcttgtgagccatagagtggccgcctccggcggaatccgcgttttagaggcgccgaagcgccgccttaagggcatccagcgggtgctactggatgaagtcgcttccctaattcctccacatgacgccgctagaggcttccgtcccggaggtagtgtacggtcctatgccgcacctcatgccggaaggcccgtggtagtgagactggacctggaggctttcttcgcctcagtgactgtgagccggatctatggcctgtggagatctgcagggtaccctgagccggtggctcactgtctggcagggctgaccacgaccgtgctgccacacgcagcttggcgagcagttcccaggccagcagacgatgatctgttagacgcccactggcggttggggaggcgtttagctgctcctcacttgccacagggtgctcccacttcgccagctatggcgaacctggcagccttcggactggacgttcggttaaccgccctcgctgaaagttggggcggtcgctacacacgatacgcggacgatctggccttttctggagccaggtcttggggcaccgggacaagcaggttgctcgaggtgatcgaagagattgtccgagatgaggggtttcggctcaacacacgaaaaactggtgtcatgccccgggccggaagacaagccttaggaggcctggtggtgaatgaacaacctagagtcgcccgaagggaggtcgacttactccgcgcgatcctccacaactgccgcagacacgggcctagcacccagaatcgcgacggagtccctgcctatgaacagcacctgagaggccgtatagcgtgggtggcccagcacgatccagtaagaggcgcccggctgctgaccgaacatgaggcaatagattggacgagatga

SEQ ID NO: 12987 - RNA, 1311 nt, unidentified
  source 1..1311: mol_type = other RNA; note = synthetic construct
atgcgcagtgatctagcacgcgcactcgccgctgcttttcttgccggggagtggacccaaccaggactggtcgcctccggcactactgtgcttggtagacgggccagatggctccctcccctggtaagacagaccctggctctgtatccacgggctcccgttgatcgtccccgggaattagcagctaatctggcttctcgccctgctgcagccaaagctttgagggccgttcccttggtacgccctgtggtcgcgacccagatgcttaccaaccgatggaggctcccggtgttagacgatttggccgacgtggccagcttcctgcatctgtctgcctccgacctagactggttcgccgacccacgtcaccttgcaaggagtgcgtcagatgtgcccctacagcattaccgggtcagtcatagggtggcttcttcaggggcgattcgcgtccttgaagccccaaagccacgcctgaaagccgtgcagcgcagactgctgcacgagctcgcagccctgattcccccacacgatgcggcacggggctttcgtccaggaggttctgtgagatcgtacgccgcacctcacgctgatcgatccgtggtgttgagactggatctggaggccttcttcgcatccgtgactgtcagcagggtgtatggcatttggcgaacggcaggataccccgagcctgtcgctcactgtctggctgggctggtgacaagcgtgctacccctttctgcatggagagctgttccgacgccggcggatgacggtatgcttgacgctcactggcgcttaggcagaaggctcgcagctcctcatctcccgcaaggtgccccaacttcacctgcgatggccaatctcgccgcctttaggctggacgtgaggctcactgcactcgccagatcatgggggggacgatacacacgatatgctgatgacctcgccttcagtggggaacggggatggggaaccggaacaagccggttgatagacgccataggctccatcgtcgccgacgagggctttaggctgaacgcacggaagaccggcgttatgcctagagccgggcgccaaacattagggggcctggtcgtgaacgaaagaccaaaggttgcgcgtcatcaggtagacctgttgcgggctatcctgcacaattgccataggcacggccccagcacacagaaccacgacgatgtccctgcctttgaggaacacctgaggggccggatcgcttgggtggcacagcatgatcccgtacgcggacgacggttgcaggccgttcatgataccatcgactggagcagatga

SEQ ID NO: 12988 - RNA, 1311 nt, unidentified
  source 1..1311: mol_type = other RNA; note = synthetic construct
atgagggtggacttggctcgcgcgttggcagcaggctttctggacggagagtggacacagcaaggcctgctagccagcgggaccgctgtcttaggtagacgcccccaatggctggctcctctagcccgacagacccttgccctgtatcctcgtgcacctgtcgaccgccctagggagcttgcgaccaacataagtagtaggcccgcagcagcaagagcaagatcggcagccccccaggtgcaacctgtggtagctaccaggatgctggggaacaggtggcggctgccagtacttgacggactgggcgacgtggccgattttttgggtgtcagcgcatcagagttagactggttcgccgatcctcggcacttagcacgtgggactgctggggtgccgttgcagcattaccgcgtgagccatagagtggccgctagcggcgcgattcgagtgctcgaggctccaaaggccaggctgaaagtaatccagcgacggcttctgcgggagattgcgagtatgatcccaccacacgacgctgcatgtgggttcagacccggcggttctgtacgagcttacgccgcaccccacgccgataggtccgttgttctgcgcctcgacctggaagccttttttgcctccgtcaccgtctcccgggtgtatggcatttggagaacagcgggatacccagaacccgtggcccattgtctggccggattggttacctccgtgcttccgcggtcaacatggcgcgctgtcccacaacccagggacgatcggctcctcgacgcccattggcgcttgggaaggcgacttgccgcaccacacctccctcaaggagcaccgacgtctcccgctatggccaatctggccgctttccggctggatgtccgtctcactgctctcgccaggagctggggaggcaggtatacacgctacgccgatgacctcgcattctctggcgctgctgggtggggaagtggaacgtcccggctgatcgatgccgtcgagacagtggtgcgggatgaaggttttcggctgaatcccagaaagactggcgtgatgcctagagccggccgtcagtcacttggcggtctagtggttaacgactctccaagagttgcccgccaccaggtggaccttctgagagccatcctgcacaattgccaccggttcgggcctagcactcagaacagagacgatgttcccgccttcgaagatcacctgcgaggccgcatagcctgggttgctcagcatgacccagtgagaggggcgaggctccaggctgtccatgatgcgatcgattggtcacgttga

SEQ ID NO: 12989 - RNA, 1311 nt, unidentified
  source 1..1311: mol_type = other RNA; note = synthetic construct
atgcgcgatgatctcgcccgtgccctcgctagcggcttcttagcaggagaatggacccaggacgcactggttgcctcaggcaccgtcgtgctagggagacggcacccttggcttcctcctctggtccggcgcgtgctgacagcttatccgcgaccccctgccgatcgaccaagagagttggccgcagtgatagctgcactgccagcagcagcaagagccaggaatgccgccccagtggtgcacccagttgctgagacgcggatgctgaccaatcgttggcgtctgcccgtattagatgggctggacgacgtggccgcttttctacgcctggagcctagcgaactcgactggttcgccgacccacggaggttggcaagatccgcctccgacgtgcccctgcagcactatagggttagtcatcgggtaactccttctggcgccattcgcgtcctggaggctcccaagccaaggctgaaggctctgcagcgccgggtgctaacagaagtcgccagccttattccccctcacgatgccgctacaggatttcggccaggtggctcaatcagacgttacaccgccccccacgcaggcaggtctattgtgctccgcttggatttggaggctttctttgcaaccgtttctgtgtcccgagtctacgggatctggcggactgccggctaccctgaacccgtagcgcactgtctggcgggactcgtgacttgcgtcctacccaggtctgcttggagggccgtaccaagaccggctgatgagagattgctcgacgctcattggcgacttggtcgcaggcttgctgcaccccatttaccccaaggcgcccccacaagccctgcaatggcgaaccttgccgctttccgactggatgtgagactgtcagcgctggcaagaagctggggtggcgggtacacccggtatgctgacgacctggcgttttccggtgacgccggttggggcactgggactagtcggctgctggatgcagttgaagccatcgtcagggacgagggatttcggttgaatcagagaaaaacgggagtcatgccgcgcgctggaagacaggtactcggaggccttgtggtgaacgagcaccctagggtggcacgccatcaggtggatctcttacgggccatactccataactgcaggcgcttcgggccaagttcccagaaccgtgatgatgtgccggcgttcgaagaccacctgagggggagaatcgcctgggttgcgcaacacgacccagttcgaggagcccgcctccaagccgtgcatgacgctgtcgactggtcgaggtga

SEQ ID NO: 12990 - RNA, 1311 nt, unidentified
  source 1..1311: mol_type = other RNA; note = synthetic construct
atgagtccagatctggccagagcccttgccgctgcattcctagggggcgaatggaccgaaccagggttggtggcctcaggggcaggtcttctgggtagacgtccggcatggttgcgcccactggctaggcagaccttagccctgtaccctcgacctccccttgataggccccgcgaactggcgacgaacgtggctagtcgccctgctgcagctagagccggagctgctgctcccttagcccagcctgtcgctcagacacgcatggtggcgaaccggtggagactcccagaactggacactctcgccgaccttgccggattcctggggctcaccgcgactgagctcgactggttctctgatccccggcggttagcacgagacgcttccgcagtccccctgcagcactaccggattagccacaggccagccccatccggagccataagagtcctggaggcccccaagcccaggcttaaagcgttgcaacggcggttactgcgagaactcgctgggcgcattcccccccatgatgctgcacgtggctttcgacccggcggttccgttcgcagttacgcagcccctcatgccggcagatccgtggtgctacggctggacctcgaagctttcttcgcctcggtcacggtgtctagagtctatggcatctggaggtcagccggctacccggaaccggtagcacacgcactggctgggttggtcacaacagtgttgcctagagctgcttggcgctctgtgccacgtccagccgatgacagcctgctcgacgcgcattggaggctgggcagacgactggcagcacctcacttgccgcaaggagcccctaccagccctgccatggccaatcttgccgcattcgggctggacgtgcggcttaccgctctagccaggtcatggggaggccggtatacacggtatgcggatgacctcgcatttagcggcgagaggggctggggaacagggacttcccgcttgctcgacgccgtggaggtcgttgtgcgggatgagggctttcgcctgaaccccagaaagactggagtgatgccaagagctggcagacagcgtctagcgggtctggttgttaatgatgccccaagggtagctcgggaggaggtggatctgctgagggcgatcctgcacaactgcgccaggtttggaccttctacccagaatcgcgcaggggttgtagcctttgaggaccatctgcgcggtaggatcgtgtgggtggcccagcacgatcccgttcgaggagccaggctcctcgaggcacatcgtgccgtagactggagcagatga

SEQ ID NO: 12991 - RNA, 1311 nt, unidentified
  source 1..1311: mol_type = other RNA; note = synthetic construct
atgaggcccgaccttgcgcgtgccttgagcagtgccttcctcgctggcgagtggacacgagccggcatggtggaatctggcgctgttgttgtcggccgaagggcccgttggcttggtccacttgccaggcaggtcctggaactatatcctagagcccctttggatcgcccccgggagttagccactaatctggctcggtgtcccgcagcaacaagggccctggcatcaggcccaatggtccacccagtggccgtgactcggatgatgaccaaccgctggaggttgcctgtgctccacgatctagatgatctggctaccctgctggacttggaccaagctgccctggcctggtttgccgatccacgccatctggcacgaggggcaacagaagcacccctgcagcattaccgtgtgtcacaccgaccagccccatccggagccattcgagtcctggaagctccgaagccgcggctgaagagaatccagcgccgtttgcttgacgagctggcaggtagaatacctccccacgaggctgcccggggatttaggcctggagggtccgtagccagctatgcggctcctcacgccggacgaccagtagtgctccgcctggatctcgaggcattctttgcctccgtgactgtgagccgcgtctacggcacctggagatctgccggctacccggaacccgtagctcatgccctggcagggttggtgactactgtgttacccgcttccgcctggcgggcagttccaacaccctctgcggaccatctcctggatgctcactggcgcctcggacggagactcgctcttccacatcttcctcagggggcacctacatctcccgctgttgccaacctcgccgctttcggcctggacgtcagactgaccgcattagctgctagctgggggggcaggtacacgaggtatgcggacgacctcgccttttccggggataggggttggggacggggaaccagtcggctgatcgatgctattgagacggtagtgcgggatgagggcttccgcctaaatgcgagaaaaaccggggtgatgcccagagcaggcaggcagagattggcaggacttgtggtgaatgaccgaccgcgcgtcgcaaggagcgaggttgatctgctcagggctattctgcataactgcaggcggcacggtcctagttcacagaacagagatgacttacaggcatgggaagcgcacctacgcgggagaatcgcctgggtggcccaacatgaccctgctagaggtgcgcggctgcaagaggttcacgacgccatcgactggtcgcgttga

SEQ ID NO: 12992 - RNA, 1311 nt, unidentified
  source 1..1311: mol_type = other RNA; note = synthetic construct
atgcgcgccgatcttgcccgggcattagcctccggcttcttggccgatgagtggacacagcccgccttagtggcttctggccgtactgttttggggaggcgtcccgcctggttaacccccttggtcagacaggtgctcgaactgtaccccagagctccagctgacaggccaagagagctggccgctaatatcgcggcttgtccagcagcaactcgcgctgggcaggcaggtcctgtagtgcatccggtggcacggacacagatggtagcgaacagatggcgcctgccggtgctagaccgcttggatgatgtggccacgtttctggacgtcagccacaccgacctggactggtttgccgatccgcgacgccttgcaaggtctgcttcagacgctcctctgcagcattaccgggtttcacaccgtcccgctccttctggcgccgtacgagtgctggaagctcctaaaccccggctgaaggtgatccaacggcggctgctcgatgaggtggcaggccttatcccacctcatgaagccgctagggggttccgcagcggaggtagtgtgagatcgtatgcagccccacacgccggtcgacctcttgtgctccggctggacctggaggccttttttgctagcgtcacagtgagcagagtgtacggaatatggcgcacagcaggctatcccgagcctgtcgcacattgtctcgccggcctggtcacatgcgtgctccctaggagtgcatggagggcagttcctgccccaactgacgacgggctacttgatgcccactggcggctgggaagaagactcgctgcaccacacttaccccaaggagctcccacctccccagccatggcaaatctggccgctttccggctcgacgtccgtttgactgcccttgcgcaaagctggggggggaggtataccaggtacgccgacgacctggccttcagtggtgatgccgggtggggaagaggcacgtccagactcattgatgctataggactgattgtgcgagacgaagggttcggcctgaacgccagaaagaccggagtaatgccaagggccggtcgccagaggttagctggcctagttgtcaacgatgagccccgcgtcgcgagaggagaggttgatctcctgcgcgcgatcttgcacaattgccggacccatggaccttcctcacagaaccgagatgacgtgcccgcatgggaagagcatctgcggggcaggattgcgtgggtggctcagcacgacccagtccgaggtgctcgtctacgggccgttcacgacgcggttgattggtctaggtga

SEQ ID NO: 12993 - RNA, 1311 nt, unidentified
  source 1..1311: mol_type = other RNA; note = synthetic construct
atgcgagccgacctggccagagctttggctgctgggtttctcgctggcgaatggactaggaatgggctcgtggcctctggggcagttgttctcgggcgacggactgcctggctgaggacattggccacccaggccttggagctttacccacggccccctcatgatagaccgcgagaactcgccgtcatcctgaggagccttcctgccgccgagaaggccgttgctgtgggtccagtgacccaacccgtcgctcctacccgcatggtcaccaacagatgggctctgccccagctcgacgaccttgccagcgtagctgcattcttggatgtgacggcggccgaactggactggtttgcagacccaagaaggtgggccagagctgccgaagaaccccggttgcagcattatcgggtaagccaccgcacagcaccatccggcgcaatcagagtgctggaggcacccaaaccacgcctacgggcaattcagaggttactgctggatcaggtcgtctcaagaatccctccacacgatgcagcacgtggatttaggccaggcggcagtgtgcggtcatatgctgtgccccacgccggacggcctatagtgttacggctcgacctggaagcgttctttgcctcggtttccgtctcccgcgtctatggcatctggaggaccgccggctatcctgagccagtggcacactgcttagctggcctaacaacctgtgtcctgccgcgtagtgcgtggagagctgtaccaaggccgggtgaggatgaactcctggacgcccactggcgattgggaaggcgcttggcggctcctcatcttccccaaggagcgcctacttctcctgcactggctaacctcactgcctacgggttagatgtgcggctcacagctctggcaagaagctggggcggacgttacaccaggtacgccgatgacctggccttctctggagaggcaggttgggggcatgggacatctcgcctgctggatgcaattgaggagattgtgcgtgacgagggcttccgcctgaatccaaggaagacgggcgtgatgcccagaggtggtaggcaacgccttgccggactggtggtaaatgagcggccccgagttccgcgcgaagaggttgacctcctgagagcgatactgcacaactgcagacggcacgggccctccactcagaaccgagatcaggtgcccgctttcgaggagcacctgcgtggacgcgtgtcatgggtggctcagcatgatcctgtcaggggcgcccggcttctagcggaacttgacgccatcgactggagtcgctga

SEQ ID NO: 12994 - RNA, 1311 nt, unidentified
  source 1..1311: mol_type = other RNA; note = synthetic construct
atgagagacgaccttgctcgtgcactagcggccggctttctggccggagattggactgctaccgggctacgagcatcaggtgctggtgttctcggcagacgccctcgctggttagcccctctcgtgcagcagacactcgacttgtatccccgccctccacacgatcgtcctagggaactcgccaccaatttggcagggcttcccgcggcggctaaagccttgagaaccaggcccgtggcacaacccgtggcacctacacggatgttagccaaccggtggcggctcccagttctggatgacctcggcgacctggccgatctcttgggagtcaccgctacggagcttgattggttcgcagatccgcgacatcttgctcggagcgctgcagacgtaccgctgcagcactaccgggtgagccatcgcattgcacccagcggagccgtaagggtgcttgaagcgccgaagccacgcctcaaggcggttcagagactcttgctggatgaggtcttgtccagggtgccaccacacgatgctgccaggggctttaggcccggagggtcagttgcttcttatgccgctccccatgcaggccggccagtagtagtgaggctggatctggaggccttctttgcgtctgttaccgtctcccgagtgtacgggatttggcggacagcaggctatccagagccggtcgcccataggttggccggtctggtgacagccgtgctgccaagaagcgcctggagggctgtccctagacctgctggtgacgggctgctggatgcccactggcgtttaggtcggcgactggcggcacctcatctgcctcaaggcgctcccacaagtcccgctgtcgcaaatcttgcagccttccggctggatgtgcgcctcagtgccttagcccgctcttgggggggaaggtacacccgttacgccgacgatctggcattctcgggtgctaccggttggggcactggcacttctagactgctggacgccatcgaggagatagtccgcgacgagggctttcggctcaacgccagaaaaacgggagtgatgcccagagccgggcggcaaactctaggagggctggtggtcaacgaccggcctagagtcgcccgagcagaagttgaccgccttcgtgccatccttcacaactgcaggcgaagtggagcttcctcccagaatagagacggcgttcccgcttgggaacagcatctgcgcggtcgaatcgcctgggtggcacagcacgacccagtgaggggagccagactgctggctgaacacgacgctgtggattggtcacgctga

SEQ ID NO: 12995 - RNA, 1305 nt, unidentified
  source 1..1305: mol_type = other RNA; note = synthetic construct
atgcgagatgacctcgcccacgcactcgctgcaggattactcgcaggcagctggactcaacgcggcctcgtggcttccggtgctgaggttcttggaagccgccgccggtggttagacaggctcgctaggcacactctggaactgtaccccaggccccccttggaccgtccaagagagctggccagaatcgtcgcggcttttgttgacgcagatgcagccgcacggcctgctaccagacctgtagtgggtacaaggatgctgacaaaccggtggggcctgccaactctgcacgacctgaatgatctcgccgggtggctcggactgacctcttccgaactagaatggtacgctgatccccgtaggctagctcgcaccacaagccaggggagactgcagcactatcgcgtgtctcacagggtcgcctccagcggagcgattcgggtgttagaggcccctaagctggaactgaagggcattcagcgacgactgctggatgaggttctcagtagcgtgccaccccatgaggcagctagggggttcaggccaggtggcagtgtgcgcacttacgccttgcctcacgcgggacgtcccgttgtgcttcggctcgatcttgagtcattctttgcctcagtgaccgtagcccgagtgtatgggatatggaggtccgccggatacccagagccagtcgcacatagactgtctgggctggtgacctctgtcctgcctctctcattgtggcggagcgtaccaaggcccgccgatgatgccctgcttgacgcacattggagactgggacgaaggttggcggctccacatttgcctcagggtgccccgacaagccccgcattagccaatctagccgcctttcgactagacgtcaggctttccgctcttgctgcctcatggggagggcggtatacccgctatgctgacgacctggcctttagtgggggccggagttgggggacaggaacttcgcgcctgcttgatgccatcgaaggcgtcgttcgggacgagggcttccggttaaatcagagaaaaacaggagtgatgccacggggcggcagacaggtattaggcggcctggttgtgaacgaacgtccgcgtgtgtcccgggcagaagtggatagactgcgcgccatcctccataactgcctgacgcatggtccttcaacccaaaacagagagaggcaccctgccttcgcccagcacttgcgaggtcgcattacgtgggtggctcagcatgaccctgtcagaggggcacgcttgctcgcgcaacacgatgcggtcgactggtctagatga

SEQ ID NO: 12996 - RNA, 1311 nt, unidentified
  source 1..1311: mol_type = other RNA; note = synthetic construct
atgagagcggatttagccagagccctcgcggccgcatttttggccggagaatggacacagagcgccatggtacagggcggggcagttgtcctaggcagccgaagaagatggcttacgcccttggcccgccaagtcctggacctgtatccgcggcctcctcttgacagaccccgagaactggcaacactgattagtactcgccctgcagtggctcggaccggtaatgccaggcccgttgtgcagccagttgtagcgacacgcatggtgagaaacccatggcgtcttcccgcactcgacgatcttggcgatctggctcaccacctgggtgtcgaaggctccgagctcgcctggtttgctgacccccgtcgatgggcgagaggaacatccgaagggagactccagcattaccgtgtgagccatagggttgcaccttccggagcaatccgcgtgttggaggccccaaagcccagggtccgcaggatacagagaagcctgctggacgacctagtgtcgcgggttcccctccatgatgctgcgaggggctttaggaccggcggcagtgtgcggagttatgctgctccacacgcgggtcgaccagtcgtgctgcgacttgatctggaggctttcttcgcatcagtgactgtcgccagggtgtatggcatttggcgttctgctggctacccggagcctgtcgctcactgcttagccggtctgaccacctctgttctcccgcgcagcgtatggcaagctgtgcctggacccgccgacgatggactgagagaagcacactggagactagggcgcaggttagccgcccctcatttacctcagggggcacccacttctccagccctcgctaatctcgcagcctaccggctcgacgtgagacttgccgctttagctcggtcttgggggggacgttatacccggtacgccgatgacctggctttctcaggggagcgggattggggagatggtacggcccgcctgatcgctgccattgatgtcgtagcaagggatgagggcttccgcctgaatccacggaaaacagccgtgatgcggaggggagatcgccaacggcttggagggttggtcgtgaaccgacggccccatgtagggcgaactgaggtggacctgttgcgcgctatcctgcacaactgtcggcgccacggcccatcatcccagaacagagagggccacccagcgtttgaagagcacctaagggggagggtggcatgggtggcccatcatgaccctgccagaggtgccaggttgagggctgccctggacgcagttgactggacccgttga

SEQ ID NO: 12997 - RNA, 1050 nt, unidentified
  source 1..1050: mol_type = other RNA; note = synthetic construct
atgctgactaaccgctggaggctgcccgttctgcacgacttagccgatctggccgctttgctggagctagacgccggggagctcgattggtttgcggatcccaagcattgggccaggactgctggcgaagcacccttgcagcactatcgagtctctcacagggtggccgccagtggtggcatacgcgttctggaagcaccaaaaccgcgtctgcgccgcttgcaaaggcggttgttggacgaggccctcggtctggtgccacctcacgatgctgcaagggggtttcgagctgggggcagcgttggaagccatgccgctccacacgctggacgacctgttgtgctgcgcctggacctcgagtctttttttgcctccgtgacagtaggccgggtgcatgggatctggagaaccgcgggctaccctgaacctgttgcccatgccctggccggcttaactaccgccgtacttccccttgccgcttggcgtggagtaccccgacctgcagacccaggcctcctcgatgcccattggcggttagggagacgactagctgccccgcacttacctcagggcgcaccaaccagtccagccacagcaaacctggctgcgttcgggctggatgtccgccttacagcgcttgctgcggcatggggtggacgttacacacggtatgccgacgacctggccttctccggagatgctggttggggcagaggaacgagcagactgctcgacgcagtggaagagattgtgcgcgacgagggcttcagactcaacccccgcaagacggcagtcatgccaagagctggacggcagtcactggccgggctagtggtcaatgacaggcccagggtggctaggcatgaggtggacctgctcagagctattctccacaattgccggcggcacggaccctcaacccagaatagagatcaggtccctgccttcgcagagcacctacggggtcggatcgcatgggtggcgcaacatgatccggcacgtggggccaggcttctggcagaacacggtgctatcgattggaccagatga

SEQ ID NO: 12998 - RNA, 1311 nt, unidentified
  source 1..1311: mol_type = other RNA; note = synthetic construct
atgagagaggatctggctagagccctggcagcgggattcctcgcaggtgcatgggaccgggatgggttactggcatcaggacggggggttctgggtagaaggcctgcctggcttcgccctcttgttcgcgatgtgctcctgcactacccacgccccccacacgatcgtccaagagaactggccaccgtgatcggcgcctttctggctgccgatcggagctacgctgacgcacccgctcatcgaccgttggcccctaccagaatgctcgctaaccggtggggtgtacccgcccttcacgaccttgccgacctcgcagacttgcttgatctcgacaccggcgagctggattggttcgccgatcctaaaagatgggcccggcggaccagtgaaccaaggctacagcactacagggtgtctcaccgtgtggtggcgacaggagccgtgcgagtccttgaagcccccaaacaccggctcaaggtgttgcagcgcagactcctggacgaagtcctcgctgtcgtaccgccgcatgacgctgctcgcggatttcgcccaggtggctcagttaggaggcacgccgccccacatgcggatcgatctgtggtcgtcaggttggacctggagagcttctttgcgagtgtgactgtgggcagggtgttcgggacttggaggacagtcgggtaccccgaacccgttgctcacgcattggccggccttactactacggttctgcctcatgctgcatggagggccgtgcccagacctgctcctgaacacttgctggacgcacactggcgattaggtcgccggttagccgcgccacatttgccccaaggagcaccaacatcccccgccctcgccaatctggccgcatatagactggacgtacgcctgtccgctctagctcgtgcttggggaggccgatatacgcgctatgcggacgatctggccttttccggggatagaggctggggccgcggaacaagcagactgctggacgccattgaggaggtggtcgtggacgagggattccgggttcaccctaggaagaccgcagttatgcctagggcaggtaggcaggtcttaggggggctcgtagtgaacgaccgtcccagagtgccaagggcagaggtagatcgtttacgggccatactgcacaattgccgcctgcatggcccggcctctcaagacagggacgggcatcccgcgtttgccgctcatctgcgaggccgaatcgcatgggtcgctcagcatgatcctgctcggggcgagagactcctagccgcatgggagtcggtggattggacccggtga

SEQ ID NO: 12999 - RNA, 1311 nt, unidentified
  source 1..1311: mol_type = other RNA; note = synthetic construct
atgaggccagaagttgcagcggcgttaggcgctggcttcctcggaggagagtggaccgaggacgggctcctagcaagcggagctagggtgattgggcgcagacctcagtggcttagacagctggcagcccaggtcgttgctgcctacccagacgcaccccgagataggcctcgggagcttgccgctgcagtagcctcactaccagccgctgcaaaagcccggcgtacaagggcccttcgctggactccaacacccacagccatgggtcgtaaccgctgggcactccccgttttggacgggctagatgacctggctgccctgctggacgtgacccaagcggagctggattggttcgccgatcctaaacgatgggctcgagaggctgccgtagcccctttgcagcactacagggtggcacatcgggtggcgagttccggagccataagagtcctcgaagcccccaagcctcggctgaagcggatccagaggctgctgttggacgaggtcctcgatcggatcccccctcacgacgctgctagaggctttcgccccggtggctctgtagccagatatgcagccccacacgcaggtagggctaccgtgttgcacctggacctggaggcatttttcgcctctgtgacggtgggccgtgtttatggggtctggcggactgcaggctacccggaacctgtcgcccatctgctcgctgggctaactaccaccgtgctcccacgtgcggcctggagaacactgcctcgcccagcagaccccggattacacgacgcccactggcggcttggtagaaggctggctgcaccccatcttccacagggagccccaacttcccccgccttagccaacctggccgcctatcgtctggatctgcgcctgacagcgttggccgaagcttggggcggtcgctatactagatacgctgacgacctcgctcttagtagcgatcgaggctggggagctgggacctcacggttggtcaccgccgtgaccgaagtagtccgggatgagggctttagattgaatccgctgaagacagctgttatgcgacgaggagagcgccagcaccttgctggcctggtggtgaatgaacacccccgcgttgctagagccgaggtggatcggctcagggcaattctccacaattgcagggtgcatgggccgagcacgcaaaaccgagccgcagtgccggccttcgcagaacatctgaggggccgcgtggcttgggtggctcaacatgatcctgcgcggggggagaggctgttagaagcgtggagagccgtcgattgggagagatga

SEQ ID NO: 13000 - RNA, 1311 nt, unidentified
  source 1..1311: mol_type = other RNA; note = synthetic construct
atgcgtccagatctggctagggccctagccgcaggactactcgcaggagaatggactcctgccggcttagtcgagtcgggctcaacagttcttgggagaaggagacgatggcttacccccctggcccgtcaagcgttagagctgtatcctagacccccccatgatcggcctcgagaactggccgcagtgctggctggtcttcctgcagcaggtcgtgccgctgccgatcgacctgtttcacgacctttgagtgggacccggatgttggccaatccctggaggctccccgcgttagatggcctcgacgacctggctcgccatctcgacttgactccaggggagctcgactggttcgctgacccgagacggctggcacgcagaacctctgaaccccgactgcagcactaccgggtcagccatagggtcgctccatccggggccattcgggtgttagaggcccccaagccaagaacgaaggctctgcagcgcctgctgctcgatgacgtagtgagcagaattgccccgcatgacgccgccagaggatttcgcagggggggaagcgttggcagttacgccgctcctcatgctggcaggccagtggtgttgcgcctcgatttggaatccttctttgccagcgtgactgtggcacgggtttacggcatctggcgctctgctggttaccctgagcccgtcgcgcatgcactagcaggccttaccactactgtgctcccacacgcagcttggagagccattcccaggcccgcatccccaaggctgcttgatgcccactggaggttgggtaggcgtctcgctgctccccacttacctcaaggggccccaaccagtccggctcttgcgaacctggcagcctatcggttggatgtgcgcttaacggctctagcacggacctggggaggacggtatacacggtatgcagacgacctcgcgttgtctggagatcggggctggggcacaggcacatcaaggctgctggacgcggtggagacagtagttagagacgaaggctttcgcctgaatccaagaaaaacagctgtgatgcctcgaggggggcgacagaccttaggagggctggtcgtcaaccagcagcctcgggtgagcagagcggaggtggatactctccgcgccgtcgtacacaactgcagacgccacggcccgtctacgcagaatagagaagagaggcccgctttcgccgagcacctaaggggtcgcatcgcctgggtagcccaacatgacccagcccgtggagcacggcttcttgccgactacgataccatagattggtcccgctga

SEQ ID NO: 13001 - RNA, 1311 nt, unidentified
  source 1..1311: mol_type = other RNA; note = synthetic construct
atgaggaaggacctggctacagctttagccggcgcttttctatccggggaatggaccagcagcgggctgtttgacagtgccgtgcccgttgtgcagggcccaacaccatggctgcctgccctgattcggcagatcctggccgtttatccagcagcgccgcttgatcgaagccgggaacttgcagtggtaattggctctaggcctgccgctgggggtgccaaaagtgcaagaccaatagcatggcctgccgcgaccacacagatgacctccaacccctggcacttgccagcattgcatggactgggggacttagccgaaatgctcgatctgggcgccacagaactcgcctggtttactgacccccgccattgggcccgtagcactacggaccggcgtctgagacactacagagtgaccaccaaagtcgccgcttcaggggctgtcagagtcctggaggctccaaagtatagactcaagagtcaccagagacgcttcctgactgagatccttgatcgcatccccgctcatgatgctgcccacggtttcagagcgggccgctcagtcgcatcctatgcagcccctcacggaggccagccagtagtcgtgcgtatggacctcgaaggattcttcgcctcgatcacggcaggacgggtctacggcattttgcggtccgctggctaccctgagcctgttgcccacgctctgactggtcttgccacaaccgtgctaccgcgggcagagtggaatgccatatctcctcccgcgaaccccgacttgagagaggcccattggaggctcggtcggaggcttgctggtcctcatctgccgcagggagcacccacaagtcctgctctcgctaatttggcggcgcaccgtttggacgtgcgccttagcgcactggcatcatcctggggtggccgctataccaggtacgcagatgatctggctctctctgggggaattggctggcggggggacgtttcaaggttggtggccctagtgggggacattgtaagggatgagggctttcggctgaacgaccgcaaaactgctgtgctgccagctcactcccgccaggttctcggaggcttagtggtgaatgagcgaccccacgtgtctcgggccgaagtagatctgcttcgagccgtgctgcataactgccgacgcgatggcccatctacccaaaatagggccggagtccccgacttcgagggacatctcaggggaagaatcgcctgggttgcacaacacgaccccgcaaggggggccagattacgagcgctgttcgatgccatcgattggagcttttga

SEQ ID NO: 13002 - RNA, 1311 nt, unidentified
  source 1..1311: mol_type = other RNA; note = synthetic construct
atgagggctgatttggcgagggctctagccggggggtttctagctgcggaatggactcgaccaggcttggttgatggcggtgccgtagttcttgggaggcgggtccgatggatgcctgctctcacccgacaagtcctggccctctaccccagaccgccattagacagaccacgcgagctcgccgccatcatctccacaagaccagccgctgcccaagccggaagagcaaggccaatggcacatcctcttgcccccgtccgcatggtcagcaacccatggagacttgtggttctacatgatctggctgaggtcggctccctccttggactgagccagcccgagttagcatggttctctgaccctcgccattggtcacggacagctcagcaggtgcctctgcagcactaccggatatcctctcgcaccgccccttcaggagctataagggtgctcgaagcccccaaacgccacttgaaggctatccagcggcagctgctgcaggagattgttggcagaattcccccccacgaagctactcacggcttccgcgtggggagatcggtgggaagttacgcagcccctcacgctgggcgtgctgttgtcatcaggagtgacctggagggcttcttcgcatcagttaccgtggggagggtgtatggtgtgcttagaaccgcagggtaccctgagccggtggctcactgtctggctggcctcatgactaccgtgctcccactcagcgcatggaggaagatcccccgaccgacagaccccgtattgctggatgcccattggcgtctgggtcgcagattggcagcgccacatctcccacaaggtgcgcccacatctcctgcactggcaaatctggccgcttatcgtatggacattcggttagacgcactggccctttcttggggaggtcagtacacacggtatgcagacgacatcgcgatgagtggggacaggggatggggacctgcagcagaccggatactgggcatcgtagcggaaattgcccgcacagagggctttcgcttaaatgcccgcaaaactggagtcctgccgcaggctggacgtcaagtgctgggtggcctggtagtgaacgacagaccccatgtgtcccgggccgaggtggatgtcttgagggccacgctgcacaactgcattcggcacggccctagcacgcagaacagacagaataggaccgcctttgaacagtatcttcaaggccgaatcgcctgggtggcccagcacgatagggatcgaggggccagactgcggacccagtttgatgccattgattggactcggtga

SEQ ID NO: 13003 - RNA, 1317 nt, unidentified
  source 1..1317: mol_type = other RNA; note = synthetic construct
atgcggtccgagttggccagcgcctttgcaggtgcttttctcagcggtgagtggaccgagtccggactgtggggtagcggagccagggtactgggcagagatgccgtgtggcttcctgccctggtgcgagaggtccttgggctgtatgcttgcgcaccacatgaccgcccccgagaactcgctgccgtgattgcaatgcaggaagccgcacaggggcgtgatgccgagcatgcagtgccgtgtagatggcccgtgtctcctacaaggatgttgcggaatccttggcacctgcccgtcctccactcactggaagaccttgcgggcctgttagggctgaccaccgccgaactagcctggttcagcgaccctaagcgcttagcgaggacagctgccgacccacgcttacgccactatcgggtgaccactagacgagcgccgtcaggcgctatacgcgtcctggaggcgcccaaataccagcttaaggctcttcagcgtcgcctgttggctgacctcctaggggcaattcccccccatgccgctgcacatggctttcgggcaggcagatctgtcgcaacattcgccgggccccacgctggtaaagcactggtgctgcggtgcgacttggaggggttctttgccagtgtgacggttgggcgtgtatacgggctgtttcgcactgccggctatcctgaacctgtggcccacgctttggcaggcctgactacgacagttctgccagcgtctgtgtggaggaaagtgccccggcctgccgatccaggactgcttgacgctcactggcgtttgggcaggagactggctcaagcccatttaccgcagggcgcgccaactagccctatgttggctaatctggtcgctcacaggctagacgcaaggtgtgcaggcctcgcggaagcttggggatggaattacacccgctacgccgatgatctggctttcagttgcgctggcggaagaagagcaggtgcggctgctctgctgcggatggtggagagaatcgtcggtgaagaagggttccggctcaacgcacgaaagaccgccgttcagggctcatccgccaggcaatctctcggaggactcgtcgttaatgagcatgtacgcgtaccaagagtggagctcgataggctcagagccatccttcacaactgtgcccgatatggaccctccacacagaaccgaagtggacacgcagatttcgccgcccatctctccggaaggattgcctgggtggccaaccacgacccagttaggggggccagacttcgggcaggctttgaggccctggattggtcgcggtga

SEQ ID NO: 13004 - RNA, 1353 nt, unidentified
  source 1..1353: mol_type = other RNA; note = synthetic construct
atgaccactccaaggcaagcagcggcgaccgcttcaggtatagccactgcgttgttagccggaccctggcggaggcgagaagctgtacgacgagtggcagtggctcttggtcatgccagggcccccagatgggttggcgctttggtgggcgaggtgctggatgcctatcgagacgcacccgctgatcgcccacgtgagctagcggcatttctggcctcaacaagggggtgggcgcaagggcaagctggagatgtggccccacgtgtggtgaggagagagcccgtccctactcgggtggttcgtcctcgccccgaccttaccgaagtaccagacctcgcggcgcttgcccggcttttggatgtggatcagggcgaactggcatggttcgctgatacacgcggccttgagagaacggcacccgaggaagctctccggcactatcgatggagagtggtagagcgacccgggggagttcgccttttagccgccccaaagccccgcctcagggagattcaacgccggctgttgcgccatttagttgccccagtgccgcctcaccctgctgcacatggctgcgtgccaggccactccgtcagaactgcagctgctccccacgctggagctgacacagtcctggccctggacctggagtcgttttttgcctctgtgccagcaggacgggtttggggggtcctacagggcgtcgctggtctgactgagcctgtcgcccatgccgtgacaggcctcgtcaccaccgtagtccctctggctgtctggcggagagtgccggttcctgaggacggagcggctcgtgataggcacgccagattagggagacgcctggctgtccctcacttgccacaaggggctcccacttcccctgccctcgcaaacttggtgtgcgccagactggacaggcgccttgctggtctagccgcaagtgccggggccgtttacacacggtacgtggacgacttgttcctcagcggccccccagcattaagacgaccggccttcgcagcaagggtagcagcgatcgccgccgatgaaggattccgcgtgcaccccgggaaaacgaggtctgctgggagaggtcggcgtcagaccgttctcggcgctgtggtgaatgtgcggcctaccttgccgagggcagaacgcgatgccctcagagctctgctccataactgtgccgtcagtggctgggcctcccaggtaagggacagggatcccgccacatttcgggaacacgtgctaggacgcgttgcctgggccagcagcatggaccctgtcctgggagccagactgcgggtgctggcagaacggatcgattgggacgcaccaggcaccgcctga

SEQ ID NO: 13005 - RNA, 1347 nt, unidentified
  source 1..1347: mol_type = other RNA; note = synthetic construct
atgactgccagcagacgcacagcagcgaccgcttccggagtagccactgcccttctggccggtccttggcgaagacgcgatgccgtgaggagagtggcggtggcattagggtacgctcgggctccgagatgggtaggcaccttggtcggcgaagtgctgctgacataccgcgaagcccctgcagataggcccagggagctggcagcgttccttacaacgacggctgggtgggagaggggttggtctgcaggcgaagtacggcctagggtacaccggcgggaaccagtacctacacgcgttgtcaggcgccgccctggagttcgtgaagtgtccgatctggccgcccttgcccgactgttggacgtggaccaaggggagctggcttggtttgccgacgtgaggggcttagagaggaccgccccagacgaggccctcagacactaccgttggcgggttcttgagcgacctgggggagtgcgtcttgttgccgctcccaaaccccggctcagagaggctcagcgacgcctattgagacacctcctggctccgctgccagttcacgacgcagcccacggatgtgtgccaggtcgctctgtgaggactgctgcagcaccacatgctggcgctgccgtggtcctcagcatggatctggagtcattctttgcgggtgtaccagctgggcgtgtgtggggagtcctgcaaggagtggcgggactcaccgaacccgtggctcatgccgtaactggcctagccactacagtcgtcccagctgccgtatggcggagggtacccgtgggtacagatcctgaccgccatgctcggttgggacgacggttggcagctccccatctcccagttggcgctcccaccagtccagcactcgccaatctcgtgtgcgcccgattagatcgccggttggccggattggccgcttcagcaggggcagtgtatacccgctatgtggacgatctgaccttctctggggggcctgggctaagacgcgacaggtttgcagccagagtggcagccgttgcggctgacgagggtctacgtgtgaatcccgctaagactcggactatgggcaccggacatagacagcaggtcctgggcgccgtggtcaacgtcagaccgacccttccccgacccgaaagggatgcccttcgggcactgctgcacaactgcgccgtccacggctggagaagtcaggtcagggacagagatccggccacattccgggatcacgtgctgggcagggttgcatgggccgcaagcgttgaccctgtcctgggagcgcgattaagagagctcgcggctcggatcgactgggatgtcccaggcacggcctga

SEQ ID NO: 13006 - RNA, 1350 nt, unidentified
  source 1..1350: mol_type = other RNA; note = synthetic construct
atgactcggcctcgccaagctgccgctacagccagtgggatcgcgaccgcactacttgccggtccctggagacgccgtgacgcagttcggcgagtggctgttgccctgggtcaagctagggctgcgcgatgggtggggacattggtcgccgaggtcttagccgcctatcgggatgcacctgccgacagacctcgcgagttggccgcattcgtgcggacaactgaaggctgggcacggggacaagccgctgatgtgcgaccgagggtggttcgccgtcagccagtcccaaccagaacggtacgggttagggcccccgttgcggatctccctgatctggcagcactggccaggctcctggatgtggaccagggcgagctcgcctggcttactgacgtccggtcatgggagaggaccgctgatgcaccacttcgccattacaggtggagaaccgttccgcgacccgctggaggagttaggctcctggccgctccaaaaccccgattgcgggaggcccagagaagggtgctgaggcacgtgttagccccactgcccgtgcaccctgcagcacatggctgcgtcaggggacggagtgtcagaacagccgcattgccacacgccggcgcagatgttgtgctcgggatggacctcgagggcttctttgcaggaattcccgccggcagagtgtgggggttactgcagggcgtcgccggtctgactgaacctgtggcgcacgcgctgactggcttggctaccacagtagtgcccgtcgctgtgtggagaagggtgccagttcctgctgaccctgcaggcagagataggcaccacagattgggacgccggcttgccgtgccacacttacctcaaggggcccccacatctcccgcgcttgctaacttggtgtgcgcccggctagaccgacggttagcagggttggctgccgcttccggtgctgtctacacgcgctatgtggatgacctgaccttctccggcggagccgcacttaggcgtgacaggtttgccgacagagtaaccgcggtggccgccgatgaaggattccgtgtccatccagggaagacgcgtactgcaggtagcggtcgccgtcagcaagttctgggggctgtggtcaatgtcagaccaacacttccgcgacccgaacgcgacgcattacgcgctctgctgcacaactgtgctgtgcatggctgggctagccaggtgcgcgatgcagaccctgccacctttagagacgcggtgttgggaagagtcgcctgggcctccagcgtagatcccgtactcggcgctcggctgcatgccctagctgaacgcgtagactggtcagcggccccgtcttga

SEQ ID NO: 13007 - RNA, 1335 nt, unidentified
  source 1..1335: mol_type = other RNA; note = synthetic construct
atgacaacacatcgccaggacgcagtaactgcggcaggcgtggctacggcattgctcgctggacgatggcgccgaagggagatggtccggcgagttgctgtcgccctggatagagctcgggcgcctaggtgggtgggtacactggtgggagaggtgctggtggcctatcgggaagcgcctgcagatcgccctagggagctggcagccttcgtgccaaccaccgagggctggtctaggggaagaaccgccctgccgcgacctagagtcgccagatggcagcctgttgccgtgagcgttctgaggcgcccgtttccagtggccgaacttccggacgctgcagccttagctcggctcctcgatctggacctgggggagctgctgtggttcgccgatcccagaggactggagagaacgtcaggcgagcccctgcgccactatagatggcacgctgtcccacacggctccggtatgcggctccttgctgcacccaagcctcgcttgagggagatccagaggaggctgctgcggcatgtgttagcccccgtccctctccacgctgctgctcatgggtgcgttcccggacggagtgtcagaactgcggctgcccctcatgctggtgccgatgtggtcttagggatggacctggaagccttctttccctcagtagctgcagcacgggtgtggggccttctgcaagggacagtcgggctcacagaaccggttgcccacctagttactggacttgtgaccactgtgcttccagcggcagtctggaggagggtgccagttccaccaggtgccggctctgccgataggcaccgacgactcggccgaagactcgctgtgccccatctgccacaaggcgcacccacatctcccgccttggccaacttggtctgttttcgcttggaccggcgtttggcaggtcttgctgcagccgcaggagggaggtacactagatacgtcgacgacctgacctttggaggggggcgtgctttagcggccgatcgtttcgccgctagagtggccgcgattgccgcagacgagggctttcgggtgaatgacgcgaaaacccgtgcagtaggcgccgctcgtagacaggaagtgctaggagcagtagtgaacgcacgtcctactctgccacggcccgaacgggacgctttgagagccctcctccacaattgcacgaccaggggctggcggacccaagtgagagatcgcgatcctgccacattccgcgatcacgttctgggccgcgtagcgtgggcctcttccgtagaccccgccctaggtgctcgccttcaagccatggccgccagggtggactggagttga

SEQ ID NO: 13008 - RNA, 1302 nt, unidentified
  source 1..1302: mol_type = other RNA; note = synthetic construct
atgactgcctcgggaattgcaaccgctttgctggccgggccatggtcccgaagaacaatggtgcgcagagttagcgttgccctcggctttgccagggctcctaggtgggtcggcgcgttagtagacgaggtcctagctgcctacgtctcagcccccgctgatcgcccaagggagttggcagcctttgttaccactacccaggcatggcagagaatgggggcactgcgaagagtggtgcatagacgaccagtcgcgacctctgtcgttcgccaccgcttcggagtgccccctttgcctgacgcagcagctctggcaaggctgctcgatctggaccagggggagttggcctggttcgctgacgtgcggggccttgaacgaacagccggtgagcccctcagacattacagatggcacgccgttgaaaggcggggaggcttaagactgctcgcagagcctaagccgcgtctgaaggagatccagcggaggcttctccgtcacgtcctggtgcccgtacccgtacacgatgccgcccatggatgtgtgcccggacggtcagtgagaaccgctgctgccccacatgctggaagtgccgtcgtgctcgggatggacctggaagccttttttgcctccgtgacggcacctcgaatctgggggctgttgcagggcacggtgggcttaactgagcctgtggcacatctggtcaccgggctggtcacgacctctgtgcccacctctgtttggcgggccttgccgcttcccgatggtacagatgccagggagagacaccgacggttgggtcaacgattggcggcgccgcatcttccacaaggagcacccacctcccccgctctagccaacctggtgtgctatcgccttgaccgtcggttagccggcctggctagtgcatttggcgccaggtacacacgttatgtagatgacctgacattcagcggggacagacgcattgagacaggccgcctggctgcactggtgactgggatcgcagctgaggaaggcttccgcataaacccagctaaaactcgcgtggccggtgctggtagcaggcaaagggtgctcggcgcggttgtcaatactcgtccaactctgccacggcctgaacgggatgcccttagggctctcctccataattgcgccagacacggttgggcgagccagacacgggaacacgaccctgccaccttccgggaacacgtgctaggacgcgttgcctgggccgcttccttggaccctgtattcggagctcgcttgcacgcgttggcacggagggtggattggtcatga

SEQ ID NO: 13009 - RNA, 1044 nt, unidentified
  source 1..1044: mol_type = other RNA; note = synthetic construct
atggtggctgccgatgacggtcctcctggtaggggacgcccaaggttaagaactcgccccgcattggcccgattgctggacctggaccaggccgacctggcatggttcgccgatgtgcgggtcctcgagaggacggtggatgagcccctgcgacactatcgctggcacgccgttgaacggagaggtcggctccgtctgctggcagagccaaagcccagattgaaagaggcacagcgccgactactcaggcacgtgctcgctcccattccagtccacgacgccgctcacggatgcgtgcttggtcgcagcgttaggacagccgctgccccacaagcaggacgagcactggtgttaggcatggacctggaagccttttttgcgtcggtaagcgctcctcgtgtctggggcctactgcagggcacagcaggcctcacggagcctgttgcccacctggttaccgcccttggcactaccacagcgcctgtgtctgtctggcgcgcacttcctctccctggaggcgtagaggccagagaacggcatcggaggctcgcagctccccatttaccacaaggggcccccacctcccctgctttggcaaacctggtatgtttcagactcgaccgtcgacttgctgggctggctgcttcctgcggagctaggtacaccagatacgtggatgacctgaccttctctggcgatagacgtattagaggggaccggctggctgccttggtgacagaggtcgcggccgaggaagggttcagagtcgatccggccaagactagggtcgcaggtgccggatcacggcaaagggttctcggggccgtggtgaacgctaggccaactctgccgaggcccgaaagagatgcgttacgcgcgctgctgcataattgtgcgcggcatgggtgggccacacaaactcgaggccacgaccccgcaacctttcgggagcacgtactaggacgcgtggcttgggccgctgccttggatccagtgcttggagaacgccttcatgccctggccgcacggatcgattggagttga

SEQ ID NO: 13010 - RNA, 1173 nt, unidentified
  source 1..1173: mol_type = other RNA; note = synthetic construct
atgctcgcggcctatgcagcagcacccgttgaccgcccacgggaactgacactgttcgtgcagaggacccaggggtgggaaagaatgggcagtccccctcgggtagtgcacaggcagcctcgtgctacagctgtggctcgcgaccgtttcggggttgccccactcgctgatgctgctgcccttgcgcgccttctggacctggaccatggagaacttgcctggttcgctgatgttcgcggcctggagaggacagtgggtgagcctctgcggcactaccggtggcacgcagttgagagacggggaggggtgcgactcctggcagaaccaaaagcccgtttagaggaggtccagcggcctctgctaaggcacgtgcttgcccgcgtccccgttcatgacgctgcacacgggtgtgtccccggtagaagcgtacgaaccgccgcagcgccgcatacatcaagagcagtggtgctggggatggatttagaggccttttttgcgtctgtgacggctccccgggtttggggacttttgcaggggaccgtcgggttgaccgaaccggttgcccacttgctgaccggcctagtcacgactactgctcccgctggagtatggcgtgcccttccagtaccttcaggcgccggtgcccgagaacgccatagaaggttgggtgagagactgacgactctccacctcccacaaggcgcgcctacaagtcctgccctggccaacctggtgtgctttcggctggataggagactcgctggactcgcagcaactgtaggggcgcggtacacaaggtatgtggatgacctgaccttcagcggcgacaggagactgagagccgatcagtgtgccagcttggtgacagaggtcgctgccgaggaaggctttcgggtgaatcctgccaagacccgagtggcaggagccgattccaggcagcaagtgctgggcgccgtcgtgaatactcgccccaccctaccaaggccagaacgagacgcactccgcgccctcttacataactgcgccaggcacggatggactggccaaacccgcggtcatgatcccgctactttctccgagcatgtcctgggcagagtggcttgggccggatccttggacccggtctttggcgagagattacacgcactggctgcccgaatcgactggtcttga

SEQ ID NO: 13011 - RNA, 1422 nt, unidentified
  source 1..1422: mol_type = other RNA; note = synthetic construct
atgacagccccctccgaaaggagggcagctgggactgctgcaggcatcgccactgcacttttggccggtagatggcggcgccccgaaatggtcaggaggactgccgtagccctaggccgcgatagagccccacgatgggtagggacgttggtcggtgaggtgctggacgcctaccgagatcctccagtggatcgtccacgcgaactggccggctttgtgagaaccacagccggatgggcaaggggttggaccgtcgttccgcagccgaggataacccggtggcagccagcacggaccgatgtagtccaccgtccttatggtgtcgcagccctgcctgacctgactgccttagctcggctgctggacgtggatgctggcgaactggcttggtttgccgacacacacaggctggagaggaccgtcgccgagcctctcaggcactaccggtggaccacagatggcgatagattgctggccgctcccaagagccggctgaaagagattcagcgaagattgctgagatatgtgataggccccctccgagttcatggggcagcgcatggctgtgttcctggacggagtgtgcggaccgctgttacaccccataccggcgcagcccaagtcctgcagatggacctcgagtctttctttgctagtattgccgctgagcgcgtccacgggctacttcgatctgtgggcgggctgccagaaccagtggcacttgcggtgaccggcctcgtgacaactgtggtccccagatccacatggagacgcgtgcctgttccagacgacgtggaccgccatcatcgcttagggcggcgattggcggggcctcatttaccccaaggagcccccacttctcccgcactcgcgaatctggtgtgcttccgcctcgatcggcgattaggcggactcgccgccagctttggagctgcttatacgcggtacgtcgacgatctgacattttcgggtgggcgcggaatcgaccagggaccattcgaacgtctcgcgggcgagatcgtggtggaagaggggttccgtttgaacagatccaagactcggtccacgtcatcagctggacggcagtctgtgttgggaactgtagttaacgtgaggcccactctaccccgcaccgagagggatgcccttagagcccttctgcacaattgcgctacacgcggctgggccagccaggttagagacagggaccctgcaacgttccgggaccatgtactcgggcgcgtggcttgggctagcagtatcgatccagctttcggcgcgagactgagagctagggcagccctgattgactggagccgaccagacgagggtgcatgtgggaggacccctgccgatcgtccgtcagatggaacccttccgcctcccgacgatgacggaggtgcacgttgcggcgaaagatga

SEQ ID NO: 13012 - RNA, 1356 nt, unidentified
  source 1..1356: mol_type = other RNA; note = synthetic construct
atgactgccccaggaggcagaagagctgctggaaccgctgccggtattgcaacagccctcctggctgggagatggcagcgaagagagatggtgcggcgtacagcagtcgcccttggactgccaagggccccacgatgggtaggaaccctcgtcggcgaagtgctggctgcgtatcgcgaccctcccgttgaccggccaagagaactcgccggctttgtcagagcaacagctggttgggctcgaggttgggcagccgttccccaacctaggatcgtacgctggcagccagtccccacagctttggtcaggaggcgccatggcgtcgcgggtttacctgacctggctgcccttgccagactgctggatgtggacgcaggggagttggcctggttcgccgacactcaccgactggaaaggaccgtgggcgaacggttgcgccactaccgctggaccacagctggagatcggctgctggctgtgcctaagcccagactgaaggaggtgcagcgccgcctcctcagacatgttgtcggcccccttggggttcatgacgcagcgcacggatgcgttcccggcagatcagtgaggaccgctgtatcgcctcatgcgggcgcagatcagctcctgcagttggatctggagtcattctttgccggtattgccgcagagcgggttcacggccttctgcgaagcgttggagggttaccggagcccgtagccaggacagtgactggcctcgtgaccacagtggtaccgcgatccgtgtggcggcaactacccgtgcctgatgatgctggcaggcatgagagattggggaggaggctagccgtgccccacttaccacagggagcgcctacctctcccgccttagccaatctcgtgtgcttcaggcttgaccggcgtctggatggccttgcagcctcctttggggctgtgtacactcgctatgtcgatgacctgactttcagcggtgaccgcgggattgaccgaggacggtttgagcaactggccggggaaatcgtccgggaggagggattccggcccaatcgtgccaaaacgcgcagcacgacgtccgcaggtcgtcagtctgtgctggggaccgtggtaaacgttcggccgaccctcccacgcccagaaagggatgccctgagagccttgctgcataactgtgccacacacgggtggagaacccaggtgagagatcacgacccggccacttttcgtgaccacgttctgggccgggtcgcttgggcaagtagcatagaccctgtgctcggtgcgaggctaagggcgcaggctgaacggatcgattggagttctggccctgatggaactgcagccccagcacctgcatga

SEQ ID NO: 13013 - RNA, 1371 nt, unidentified
  source 1..1371: mol_type = other RNA; note = synthetic construct
atgacagcaccaagtggtaggcgcgccgcaactacagcggctggtatcgctgtggccttattggggagcagatggcggcggagagaaatggtacgagcgaccgctgtcgctctggggtacgcaagagcgcctcggtgggttggcacccttgtaggggaggttctcgtggcctatcgagatgccccagtggacaggccccgggaactagctgccttcgtgagaacgactgctggctggcaacggggatggacacgcgtaccccagcctagagtggcacggtggcagccaacggtgacggaggtggcattccggcgacacggggtcactgaattgcctgatctggccgcgcttgccaggctgcttgatctggacaccggggagctcgcttggtttgcagacgcccacaggctggagcgcactgtacgggaacccttacgccactaccgttggcggactgtgggaagcagactggtggccgcacccaaaccccgtctcaaagaggcccagcggcgcctactgcgtcacgtagtcggtcccttgcctgttcatggcgccgcgcatggctgtgttcctggaaggtccgtccgaaccgcagtagctccacatgccggagccgcagtcgtgctccagctggatctggaggccttctttccctcaatagcagcggagagagtgcaggccctgctgcagacagttgggggattgcctgaacccgtcgcgcacgctgtgacaggcttagtgacaaccgtcgtgccacgttctgtgtgggctgcagttcccgttccagcaggccctgatagggacagggacaggcaccatagagtgggtaggcgcctcgccgttccacatctcccgcaaggcgcacctacttctccggccctggctaacctcgttgcctttcgcttggataggaggctcgccggactggcagcctctttcggagcccagtacacacggtatgtggatgacctaaccttttccggcgacagagcactcgacaggggtcgctttgcctccttggtcggggctgtggtcgctgaggagggattccgtctgaacgctgccaagactagaagtaccacctcagcagggaggcaaagcgtcctgggagccgtggtgaatgtgcaccccactctgccaagaaccgatagggacgcccttcgcgcccttctgcataattgcgctgtgcatggctggcggtcccaagtccgcgatcatgacccagccaccttcagggatcacgtccttggcagagtggcctgggcggcttcgattgacccggcttttggcgtgagagctcgacgcctggccgatcgaatcgactggacagctcacccggtacgaagcccagaaggccctgggcacgactga

SEQ ID NO: 13014 - RNA, 1350 nt, unidentified
  source 1..1350: mol_type = other RNA; note = synthetic construct
atgactgccgagagacaagccgcagccacagctgccgctattgcaaccgcattgctggctggtccatggcggcgtcgcgaaatggtgaggagggttgcagtggccctggggcaagcaagggctaggacgtgggtgggtacattggtcggcgaggtccagaccgtgtatcctactgctcctgtcgaccgacctcgcgagcttgccagagtcgtgcgcacgactcaaggctgggagcgtggccaaagccatcgaccgctcgccagggctgtacgttgggaacccgtgcccactgcgcttgcatggcgcagatggccagtggccgatctcccagaccaagctgccgtcgctaggcttctggacgtcgatgccggagaactcgcctggttcgccgacgctagaagactggagcggacagccggcgaagcccttagacactatcggtggcgtgttgttcaacgcccggcaggagtgcggcttttggcagcacccaagcctcggctaaaggaggcacagcgccgcctcctgaggcatgttctggacagagtacctgctcacgacgccgcccatggatgtgttcccggcagaagtgtacggacagcagtggccccacatgccggtagcgcagtggtgctgaggatggatctggaggcttttttcgccagtgtcgcggctgggagagtgcatggcttgttgttgggggttgcgggtctgcctgaacccgttgctcacgtcctgacaggactgatgaccaccgtactcccaacggaggtatggaggcgcataccccccccagatggcatcgaagcacgcgagagacacagacggctggaacagcggctgaccgtgccacatttaccgcagggggcgcctacatcacccgcgttagcaaacctggtgtgccacaggctggaccgcaggttagccggactagctgcggcatccgggggaacttacacccgatacgtggacgatctgacgttctccggcgacagacgtattgcccgcgaccggtttgccgacctcgtaaccgatgtggtcaccgatgaaggatttcgagtgaatgccgccaaaaccagcgctacatctgcagccaggcggcaagcggtgctgggaacagttgtgaatgatcacccaactcttccccgacccgagagggatgcgttacgcgctctcctgcacaactgcgctgtccacggctggactactcagacccggggcagagatcctgggacattccgggatcatgtgctcggtcgagtggcctgggccgcttctgtcgacccagcatttggggcccggctacacaggctcgctgatcgaatcgactggaccgctcctgcccactcatga

SEQ ID NO: 13015 - RNA, 1335 nt, unidentified
  source 1..1335: mol_type = other RNA; note = synthetic construct
atggctgccgtcacagcgtcaggcctcgctactgcattactggctggcccctggcggagacgggatatggttcgccgggtggcagtggctctaggtcaagcccgcgcagccacatgggttggcacaatggtcggggaggtccagactggatatccacaggctcccgtagatcggccgcgtgagttggcacgctttctcaggacaaccaggggctgggcgaggggacaagacaccactcctccaccccccgtgctaaggtgggaacctcagccaactcggctggcatggagccgagcacctgtcgcagatcttccagaccaagccgccgtggcgagactgctggatgtggacccaggcgagcttgcttggttcgctgacgcacgagggctcgagcgtaccgtaggcgaaccactcaggcactaccgctggcaagttgttccacggccccacggggttcgcctattagcggcacctaaacctaggttgaaggaagcccagcgcaggctgctgcgacatgtgctggcacgggtgcctgtacatgacgccgctcacgggtgcgttcctggacgatctgtgcggacagcagttgctccccatgcgggtagccccgtggttctgagaatggacctggaggccttcttcgctagcatcgccgcagagcgagtgcacgggttactgttaggaccggcaggtttgccggagccagtggcacacgtactcgcctctctggttacgaccgtagcccccgcacaagtatggcgccaggtgtctcttcccaccggcattgaggcccgtgaacgccatcggcgtcttggtagacagctggccgtaccccatcttccacaaggcgcccctacatccccagcgttggccaatctcgtctgctttaggctggacagaagactggcagggttggccgcctcatgtggagctcgctacacgcggtatgtcgacgatctgaccttctcggggggaacggctttaggccgggacaggtttgctgatcttgtgactagagtggtcgccgacgaaggcttcagagtgaatgccgcaaagactgcagccacctccgccgcaagacggcagtcagtcctaggggcggtcgtgaacactagaccgaccttgcccagaagggagagggatgccctcagggctctgctccacaactgtgctaccagtggatggcctggacagacacgaggccgcgaacctgctaccagcagagatcacgtcttgggacgcgtagcctgggctgcgagtctcgatcccgcctttggcgcccgtcttcacgctctggccgaaagaatagactggtccgctgagcctgctggttga

SEQ ID NO: 13016 - RNA, 1203 nt, unidentified
  source 1..1203: mol_type = other RNA; note = synthetic construct
atggtgggagaggtgcagactgttcacccaagaccgccggtcgacagacccagggaactcagccgggtagtgagggccacacaggggttcgcaagaggccacgcttcattaccactgccacgagtggtccgaaggaacccagtgcccactgcacttgcgtgggaacgctatcccgtgaccgatctgcctgaccaggcagccgtcgctcgtctcctggatctcgatgccggcgagcttgcctggttcgcggacactagagggctggaacgcaccgcaggggaagctctccgccactaccgctggcatgccgttgacaggccacacggggtaaggctgctggcagctccaaagcctcggctgaaggaggcccaaagacggttgctgcgacatgtgttggcgcccgtgcctgtccatgaagcggcacatggttgtgtgcctggcagaagcgttcgcacggctgtagctccgcacaccggatctgccgtggttctgaggatggaccttgaggccttctttgcaggaatccccgcaggcagggtgcatggcttgcttctaggtcccgccggcctgccagaacctgtagctcatgtcgtgacagggctcgtcacaaccgttgtgccggcccaagtgtggagagccctacccgtgcctcccgacgtagatgctcgggaccggcaccatcgcttgggacgaaggttagccgtagctcacctgccacagggcgctcctacctcaccagctctcgccaacctggtgtgctttagactggatcgcaggcttagcgcactcgccgcctctagtggtgcccgttacacacggtatgttgatgacctcaccttttccggaggacgtagtgtcggaggcgatcgcttcgctgcactggtggctgaggtggtcgctgacgagggcttccgagtgaacgccgccaaaacatccgctgttggggccggtagaaggcagtccgtgttgggcgcggtggtcaatgtgcatcctgcgctgcctcgcagggagagagatgcactgcgggccttgctccacaattgcgcaactcacggctgggctggacagacgcgtggtagagatcccgacacctttcgggaccacgtcttagggcgagttgcctgggccggttctctggaccccgtctttggggcacggcttactgcactagccgagcggattgattgggccgccgcggattga

SEQ ID NO: 13017 - RNA, 1353 nt, unidentified
  source 1..1353: mol_type = other RNA; note = synthetic construct
atgacagcggggagaagagcggaggtgaccgctaacggcattgcgactgctctgttagccggtgcgtggcggaggccacaaatggttcggcgcgttgccgtggccctcggatatgctagagcaccccgatgggtgggcacccttgtgactgaggtgctggcagcctactggcacccacctgccgacaggccaagagaactagccctgtttgtaagaacgactgctagctgggctaggggaacagcatccggtcccccacctggagtcgttagatgggagccggtccccactagtgttgtgaggccgcggttaccaggcgtcgaactctctgatctcggggcgctggctaggctcttggatctggaccagggggagctggcatggtttgccgacgcacgaagactggaacgcaccgcccccgagccacttcgacactaccgctggaggatcgtggatagacctaccggggtccgccttctagccgcacctaaaccccgcctgaaggaaatccagcgccgtctgcttcgacacgtgctggacccagtacccgtgcacggagcagcgcatggctgtgtgagaggccgatctgtgcggacggcagccacaccacatgcaggagctgccgtcgtcctgcgcatggatcttgaacatttcttcgcctcagtgcctgcccctagggtccatggcctcctactgggtcaagccgggttgcccgaacccgtagctcatgccgtgacaggcttggtgacgacagttctgcccgctgctgtgtggcggagaatcccgctgcctgacgatgtcagggcgagggagcggcataggcgattaggggcaagactggcagtcccacacttgccccaaggcgctccgtctagccctgccatggccaatctggtctgctttcggcttgaccgcaggctcgccgctttggctgacgcattcggcgcaacatatactcggtacgtggacgacctgacctttagtggtggagctcgcgttggacgtggacgcttggctgggttggtcggtgagattgcccgggacgaggggtttcgcgtgaacaccgccaagacccgtgccatatcctcagcccggcggcaagatgtactcggcgtggtggttaatgatcacccagccctccctcgtagagagcgcgatgctctccgggcactcctgcacaactgcgccacccacggttgggcaactcagctgcgtggcagggctcctgcttcgttccgagatcatgttcttgggagggtggcatgggcggctgccgtagatcctggcttcggagccagactgcacgccttagccgaccggattgactggagcagacccctgggctccgcttga

SEQ ID NO: 13018 - RNA, 1329 nt, unidentified
  source 1..1329: mol_type = other RNA; note = synthetic construct
atgaatccgagggaacaagtggccaacggactggcaacagccatgctgggcggtgcttggtccagggaaccaatgcgggcccgcattgcacgagcactaggacgcccgagagctcctaggtgggcaggtgcactggtaggccaggtgctgggtgcttatcgggatgcccccgccgatcgaccacgtgaattggccgcctacgtgcaaactacacccgcttggcagcttgcttgggagcataggcggccccctcgaatcgtaaggtgggctcccactcccactgtcatggttgcacggccctggccggtgatagaactggacgacctcggcgcgcttgcgagactactggccattgatcaaggcgagctcgcctggttcgccgatgtcagatctatagagcgtcgttctgggcagcccctccggcattatcggtggagggcgcttccaaaacgcggaggggttcgcttggtggctgcaccaaagccacgcctgaaggagattcagcgacgcctcctccggcacgtgctgacacagattccagtgcacccagctgcccacgggtgtgttcctggacgctcagtgaggacagcagttgacccccacgcgggagctgccatagtgatcagagctgacgtcgaggggtttttcagcagcatttccgccggcagaatctggggcctgttacgcatggccggactgcctgagcctgttgcacacactatcaccggactggtcaccaccgtcgtccctacccaggtgtggagagccgtacctagaccgaccggcgcactgctgctagacgcacatctcagaatgggtgagcgactggccactccacaccttcctcagggggctccaaccagccccgtcttagctaatctggccgcattctcgctcgacaggcgcctgacaggtcttgccggagcttttgggggccagtacaccagatacgtggacgacttgactttctccggcgggccttcacttagaaacgcacgcagcagatttgtggaattggtggatgacatcgtgcggagtgataggctgcgactgaacgaaaggaaaacggttgtactcggcgctgctggacggcagcagctcttaggagccgtgatcaacgatcaccctacggtggcccggcatgaaagagatgcgttgcgggctctgttgcataattgcgccacacggggctggcaaacacagacgcgcggcttagaggccgacgagtttagggcgaccctcctggggcgtatctcctggattggcgggctagatcccagtttcggtgccaggttgcgtcgatcttttgacgccgtcgattggtcatga

SEQ ID NO: 13019 - RNA, 1278 nt, unidentified
  source 1..1278: mol_type = other RNA; note = synthetic construct
atgaccacacgtagcgaccaacagcgccaggtggcagacggtttggctacggctcttctcgcgggtccctggaccgttccactcatgacccgtcgcgtgagaacagcacttggcctcagggggaggcagccttgggtggtaggtctggtcgccgaggtagcggacgcctaccgagatccacctgtggatcgccccagggaattggccgcctatctacgagctaccggatcatggcgactggctccagtgccccgtgtcgttgcctggactccggttccgacttcaatgggccccatgccttggccagtgactgccctaccggatctgggggcactggctagactgctcgatatcgaccagggggaactggcctggtttgccgatgtgcggggattagagcgcagatgcgcccctcccctgaggcattatcgctggcgagagattcccggcaggtctggccccagattagtggcggcgccaaagcctcggctcaaagaaattcaaagacggctgctgaggcatgtcctggagcctatccctgtccacgacgctgcacacggagccgtggctacacggagcgtcagaaccgccgtcgcacctcacgcaggtgctacagtcgtgcttcgggccgacctggtagcgtttttcccttccatacccgcagaacgcgcctggggactccttaggactgctgggctgcccgaagctgttgcccatactgtgactggtttgttgacaaccgtggcacccattgaggtgagcaccgatccaaggctccggcacccacatgtaccacagggagctccctccagtccacgcctggcaaatgtggttgcatttagcctggataggcggctagccgggcttgcagctcgtttcggcgccagatacacgcggtacgtcgacgacctcacattctctgggggcgcctcgctgagaacagccaggagtcgcttcgtcgcccttgtggaggaaatcgtgcgggatgagggcttcgaggtgaacgagcgaaagaccgtcgtgctgggggagtctggacgtcagcaggtccttggcgccgtggtaaatgctcatcctgcgttacccaggccggaacgggacgctttgcgagcaacgctgcacaactgtgttgttcatggatgggcctcccaagctcgcggcagaccaagagacgagtttagggcccacctgctcggaagagttgcatgggtggggagtttgcaccctggccacggcagacggttacgcgaactagccgatcggatcgactggaactga

SEQ ID NO: 13020 - RNA, 1278 nt, unidentified
  source 1..1278: mol_type = other RNA; note = synthetic construct
atgactggagcagggcctgctgggccacttgcagacggtctggctaccgcactgctagcagggccttggacacggcccgcaatgcgaactaggggtcgggacgcactaggagccgccagaacaccagtgtggttaggccggaccgtggatgccgtcctaacagcgtacccccaaccgcccgctgatagaccccgtgagttggccgccttcctgttagcaaccgcagagtttgccaaactggctaggcgccgccctcctccacgagtagttagttggtcgcctgtcccaacggacgtgatggttcgcccatggccagtggagctgctcccagaccatgctgctttggcgggcctgctggatgtggatcagggtgagctggcgtggttcgccgacgtgaggggtctggaacgctcatccccagaaccccttaggcattatcgctggaggaccgtggctaaaccgggaggcgtaagagttcttgcggccccaaagcctagactcaaggagatacagcgccgcctgctgaggcacgtgtttgatgctgttcccgtgcatcccgctgcacatggcggggtacgacgtaggagcgtgctcaccgcctctgcaccacacgcagcccaacctgtcgtggttcgggtcgacctggtcagtttcttcgctagcgtaagagccggtcgggtgtggcgattactccggacagccggagttccggaaggtgtcgcgcacacggtcactggcctcgtgaccactgtcgctccactgcccttccgggctcttgaccctagactccgcacacctcaccttccccaaggagcccctacttcccccgcccttgccaatctcatcgcctttagcctcgatcggcggctgaccggattggcagctcgcttcgacgcctcctacacccggtacgcagatgacctggtgttttctgggggtaggggcttgggagcggctagatttttggatcgggtcggcgagattgtgagagacgaaggcttccgtgtccatgatggcaagacggccgtactgggaaggtcaggccgacagcaggtgctgggggttgtgttaaaccaccaccctgccgtgccccgaagagaaagggatgccctcagagccctcctgcacaactgcgctactacaggatggagggcccaagcccgcgatcgtgatgactttcccgcccacgttttgggcagaatcgcgtgggtccaaagcctggacccggtgcatggtaggagactgcgtgccgcttatgacgcagtggactggtcttga

SEQ ID NO: 13021 - RNA, 1335 nt, unidentified
  source 1..1335: mol_type = other RNA; note = synthetic construct
atgactacaacagctcatagacgaagggcagcagccctaagggccggaaggagacgtcacgatcgggatagctctggccatgcagccgctggcactgtcgctgatgccctgctcacaacggactggcagaccggtaagatgcaaattgcagtccgccgagtaacggcagggcgaaaagggtgggccagacagttcgtccaatttgtcagacgcgcttatcctcgggccccctatgacaggcctcgggaacttcgactcttcctgcaggcgaggggaggaatcccacgggacgtggtagccaggcaccggttagttagtgctactcgggtggtacgaatgcgctggaataccccgggcttgggagatcttgctgacctcgcagccttcctggatctggatggagatgccctggactggtttgccgataggagggaaataaatcgacacgctcgcgacgagcgtctgcgccattaccgctacgtctggctccctcatcgtctcatcgaggcccctaagccaagattaagggatctgcagagactggtgcttgatcgcattctagcgcgggtgccagtacacgacggtgtgcacggcttcgttcccggtcgaggggtgcacacttttgctcggacccacacaggaagagacgtgttggtgagcatggacttacgggctttctttacctcagtcaccgccgctcggatctacgggttgttccggggtattggctatcctgagcccgtggctcatacactgaccgccctgaccaccacacgaacacccgttgccgtgctgagatctgcaccggaccctcatctcgcagccttgcttcgcagaccccacctaccacaaggagccccaacctcccctgccctggcaaacctgtgcgcataccgcttagacagacgcctctccgggcttgctggcaggtttggagtgacatacgggcgttacgccgatgacctggctttttccgggactttgagcgctccacatgtgacccggctcactgcgcttacagggagaatagcggacgaagaaggcttcaggctgcacccccacaaaacgcgcgtgagaaccaggagtcagaggcaggcgctgactggtctggttgtgaacactcgccccgcggttccacgggaggactatgaccgtctgagggccatcctgcacaatgccgctacgcacggccttgcagaggccaaccgtgatggccatgccgacttcgctgcacacttggccggcagagtcgcgtggatgtcacatcaccatcctgcccgggctgcaaagctgcaccatctcttggcccaggcactcagagatcagcccaggtga

SEQ ID NO: 13022 - RNA, 1230 nt, unidentified
  source 1..1230: mol_type = other RNA; note = synthetic construct
atggtcgctggggccgtggctgacgcgcttttgaccaccacatggcacaaggaccagatgctggcagccgtcaggactgttactgctgcccgacctccgtgggctagacgactggtggctgttgtcctgcacgcatatcctcagcccccagccgataggcctcgggaactgagaaggttcctgctccatctgaccagaagggcccatgtccgtcggcggttagtcacgcctgcgaggaccgtgcacatgaggtggggcgcaccagctattgactccctcgcagacttcctgggactcgatggagatgaacttgattggttcgccgatcgcagagagatcaacagacacgcccgagatgaacggctgcgccattacagatatgcctggttgacacaccggctcattgaggcacctaagccccgcctccgagacttgcagcggagagtgctagacgatattcttagcgcagtgcccgtgcatgagggcgtacacgggttcgtacgtggacgcggagtgcactccttcgctcgtgcccatgccggatgcgacgttcttatcagtctggacttgcgggcgttttttagctctataactgcagcccggatctacgggctatttaggggcataggctaccctgagccagtggcacatacactgaccgcgttgacaactacgcgcacccccgcacatgttctacgtgccgcacccgatccacacttagccgctctcctgcgccagccacatctgccacaaggtgctccgacaagtccggcgttagccaacctttgtgcttataggctcgacaggagattggctgcactggccacccggtttggcgtgacatacgggagatatgccgacgatcttgccttttcaggccgcctcggtcgtactgaaactgaccaccttatcgccctggtggatggtatcgcagccgaagaggggttcagagtccacccaggtaaaacagaggttagacgccgctctcaaaggcaggctctgacgggcctggtcgtgaatgagaggcccgctgtgccccgagaggattacgacagactgcgagcaattctgcacaatgccgccactcacggcatggccgaagctaaccgggacgggcatgcggattttgccgctcatctcaccggaagggtagcctggatgtcacatcaccaccctagccgcgctgccaagctcaaaaccttactggaccgggcactggcgaccccctga

SEQ ID NO: 13023 - RNA, 1332 nt, unidentified
  source 1..1332: mol_type = other RNA; note = synthetic construct
atgtctacggcggcccatcgacgcagggatgcagctttgagggcagcgctgcggcggcatgacagagagtcctcaggacatgctgcgccgccacaggtggcaggagcactagctgatgctctgttgaccactgattggcggcccgctcagatgcaggctgtcgttcgggcagttgtggccggtagagcaccatgggctaggcggctcgtggttgccgtatggagggcctatccccgggctcctgtagacagacctcgtgagttgcggcagtttctgatcaaccgagcactggccaggcgcgctgttatacgtcggcggatagtggctcccactagggtcgtgaggatgcgctggggtgctcctgccctaggagacttggcggagcttgctgcctttttgggactggatggcgatgcccttgactggttcgcggatcgcagagaactcaaccgccacgcaagggatgagcgactgcgccactatcgctacgtctggaggcctcatcggctcatcgaggcacccaaaccaaggatgcgtgacctccagcgcagattactggacagaattctcagcgtggtgccagtgcacgacagtgctcacggcttcgttcccggcagggggactcacacgtttgctcgcgcccacactggcgccgatgtactggtgcgcttagacctgagagcgttctttccatccatcacggccgcccgaatttacggcctgttccgcggacttggatatccggagcccgtggcccatactctgacagccctgaccacaacccggactccagctcacgtcctgagagaggcccccgatcctcatctggccgccttattgagacaaccccaccttccacaaggggccccaacaagccctgctctagctaacctctgcgccttccgacttgacaggaggctcagtgctctagccgggagatttggggtcacctacggtcgatacgccgatgacctcgccttcagcgggaccttaacaaacgcccgtgccgaccgtttggtggaactgaccggccgcattgccgctgaagagggctttagggtgcacccgggcaagacacgaatcaggagacggtcacagagacaggaactgaccggactggtcgtcaatgaaagacctgcagtgcccagaaaagaatatgatcgacttcgggcagtgctccataatgcagcaaggcacgggctggccgaggctaatcgtgacggccacgcagacttcgcagcacacctcgcaggtagagtagcctggatgtctcatcggcatcctacacgcgcggccaagctgcacgaacttctggcccgggcgctgacctga

SEQ ID NO: 13024 - RNA, 1413 nt, unidentified
  source 1..1413: mol_type = other RNA; note = synthetic construct
atgactactgcagctcatagacgccgggcatctgctttacgcgctgccaggaggcgccatgatcgcgaatcatccggccatgctgctgcccggacacctaagggagcacataggcagtcaccttggcaggtggctggtgcactggccgatgctctgctgacaaccagctggcgccctgaagatatggttgctacagtcgggagtgtcgttgcaggcagacctgcctgggccaggagactggtcggagcagtgctcctggcatatccccgggctcctgccgatcgtcctagagagctgcggcatttccttgccggcctcgagggtagaccccgagttgctgtgagacgagccgtggtaagacacaggcccgtcgtgcccgtaagagtggttcgtatgcggtggggagccccaggagtggacggattggcaggactggcggcgttcctggaccttgatggcgacgcccttgactggtttgctgaccggagggaaatcaaccgccatgccagagacgaacggctgcgccactacagatacacctggctgacgcaccggctgatagaggcgccaaaaccacgcatgcgggcactccaacggcagcttttggaccagatcttgtcacgtgtgcctgtccatccctccgtccacgggttcgttccagggcgagacgcccacacctttgctcgtgcccacgctggggccagtgtattggtgtcaatggatctccgagccttctttagctcgatcacggccgcaagaatccatggcctcttcctggggataggttatccggagcccgttgcccacgcacttacagccttgactacaacccggactcccgcacggattctcagggcagcctctgatccatacctggctgcgttactgcggcaaccccacttgcctcagggagcacccacatccccggcactggctaacctctgcgccttccgcctggaccgaagacttagcgggttagccggccgcttcggtctgacctatggccgttatgcggacgacttagctttttctggaactctcgccgacggtagagtggctaggctagtggcgttggccggccagattgccagggaggagggctttcgcgctcacccaggcaaaacccgagtcaggaggaggtcccagcgccaagagctaaccggccttgtggtcaacgataggcccgccgtgccaagggaggattacgaccgcctgagagccattctgcataatgctgccacccaggggctagctgccgccaatcgagatggacatcctgactttgcggcacacctggcaggcagagttgcgtggatgagccaccaccacccaagtcgagccgctaagctcaaggatctcctggatcgggtaaggtccagcgggccggaagtgagcgtggaaaggcgttcttga

SEQ ID NO: 13025 - RNA, 1257 nt, unidentified
  source 1..1257: mol_type = other RNA; note = synthetic construct
atgctgaccgtcgactggcagccagagcgcatgaccgctgtggtcagaacggttgttcgggggagggctaggtgggctcgaaggttggtcgatgctgtcctccgcgcatatccaagagcgcccgctgatcgacctcgtgaactgtgccgcttcctcaccaaccgtggcggtattccccggacacgggtaaggcggagacttatgactcctaccagggtggtgagaatgcgttggggcgcacctcctatcaatgacttagcggagctagctgccttcctgggggtagacggcgatgccttagactggtttgctgataggagggagattaaccggcaggcgagggatgagaagctcagacactttcggtacgcctggttgccgcaccggctgatcgaagccccaaaaccgcggttgagaactatgcagaggaggctcttagatcgaattttgtctcgggtgccagtgcacgactccgtgcacggttttgttcccggccgcggtacacacactttcgcccgagctcacgcaggtcaagccgtgttgataagcctggacctgcgcgcattcttttcgagcatcactgccgcacgaatctacggactcttccggggcattggatatcccgaacccgtcgcgcacgcattaacagcgctgacaaccactcgaacgccagcgcgcgtgcttagagcagctcctgacccccatctggcagccctgctgcgtcaacctcatctcccgcagggagccccaacatctcccgctttggccaatctctgtgcctttaggcttgaccgcagactaagcggactggccggcaggttcggcctaacatacgggagatatgccgatgatctggcattcagtgggaccctggacagtaccggaattgccagacttgtgaccctggccggccagataaccggtgaagaggggtttcgcatccaccctggaaaaacaagagtgcgccggcagtcacagcgccaatcactgacgggcctggtggtcaatgcccatccagcagcttcccgcaaggactacgacactcttagggccatcctccataacgccgccgttcacggccttgccgctgcaaatcgtgataaccatcccgatttcgccgcacacctggccggaagagtagcctggatgagtcatcaccatccctccagagctgcaaagctgcatcagctgctcgctaggactgctggggaccagccaagagggccttcctcagtgagcaacagccggtcttcttga

SEQ ID NO: 13026 - RNA, 1386 nt, unidentified
  source 1..1386: mol_type = other RNA; note = synthetic construct
atgactacagctgcgcataggagaagagccagtgcattgcgagccgccagaagacgccacgatcgcgatagctcgggacacgccgcgacttctacatggtacgggccccatagacagcggccatttagggtggcaggcgcactggctgacgcattacttaccaccgattggaggcccgaacagatgacagctgcagtacggtctgtagcagcaggacgggccgtgtgggctgttcgtctggtaaaagccgtgttactcgcatatccccgactgccagccgacaggcctagagagctccggcagttcctcgctaatctgcctcctaccccacgcactacggtgcggcaagccgtgatccgccatcgacttgcggtgccaacccgtgtggtccgcatgaggtggggtgcacctggcataggggacctcgctgaactcgccgcattcctggggttggatgatgatgccctggattggttcgctgacagacgagagattaacagacacgctcgggacgaaaagctcaggcattaccgatacgcgtggaggccacaccggctcatcgaagcccccaaacccaggctgcgcgccttgcaacgtcagttactggaccagattctgtccgccgttcccgttcatgaccatgtccatggctttgtgcctggtcggggaccgcacacatttgcaagagcccacgcaggcaatgccgtcctagtgtcaatggatctcagagcttttttctcatccattacagctgcccgcatatacggcctctttcgtggaattggttatcctgagcccgtcgctcatgcactaaccgcgcttactacgacccggacaccagcccccgtgttaagagacgcgccagatccgtatcttgcagccctgctcaggcaaccccacttgcctcagggagcccctacaagccccgcactggctaatctgtgcgcgtttcgactggaccggaggctgagcggacttgcaggaaggtttgggcttaactatgctcggtacgccgacgacctggctttctccggcaccctgaatacgtccggggtggacaagttcagcactctggccggcaggatcgtccacgaggagggtttcagaatccacccacgtaagacccggatccgcaggcgatcacaacgccaggcactgactggcctggttgtcaacaccctacctgccgcccctcgcgaagactacgatcgcttgagggctatcctgcacgatgccgccactcacgggctagctgaggccaacagagatgggcacccggagttcgccgctcatttggcgggcagagttgcttggatgtctcaccgtcatccgagtcgcgctgccaaactgcaccggctcttggaccaggctcttgccaagccatga

SEQ ID NO: 13027 - RNA, 1377 nt, unidentified
  source 1..1377: mol_type = other RNA; note = synthetic construct
atgacaaccgctccccatcgccgtagaacaagtgccctgcgtgcagcaagaagaaggcatgatcgggagtccagcggccatgctgctcctgctgcacaagtcgccggcgctttggctgacgccctactgactaccagctggcagcccgacgatatggtggctgtggtgcgttctgtcgcaggaggacgccctatcagagctcggcgcctggtagaagccgtgcttcaggcgtatccacgagcccctgctgatcggcccagagaactccgcagattccttgccgctctgcctactaaaccccggaccacggtgaggagagctgtcatacgtcacagactggcagtcccaacccaagtcgtccatcttcggtggaacgccccggcattgtccgatctggccgatctggccgatttctttggacttgacggcgacgcactcgattggttcgccgataggcgggaaattaatcgcaaagctaatgaccagaaactgaggcactatcgatacggctggctgcctcatcgactgattgaggcgccaaagccgaggctgcgagcgcttcagagacgattgctggacaggatattgagcgccgttccggttcatgatcgggtacacggctttgttccgggacgggggacccacacttttgcccaactccacgccggagcccccgtattggtgtctatggacctccgggcattctttagctcgatcaccgcagccaggatctatggtctgtttcggggtatcggttaccccgagccagcagcccacgctttaacggcgctgacaaccaccagaacccccgctagagtgcttcgtgcagcacccgatccttacttggcggccctcctacgccgccctcatttaccacagggggctcccacttcccctgctctggcaaacctctgcgccttcagacttgacaggcggctgacagggctggcagataggttcgggctgacatacgcaaggtacgccgatgacctggctttctcaggcactctctcccgaacacggattgaccgcctcgtgacactggccacccagatcgtgcacgaagagggttttaggacccaccctggcaagacgagagtgcgcacttcaagtcagcgccagagtctcacagggctcgttgtgaatgccaacccagccgttccccgggaagactatgaccggctgcgagccattctgcacaacgcggccactcacggcttagccgacgccaatagggacggacaccccgacttcgccgctcatctagcgggcagggtcgcatggatgtctcaggcacacccttcaagggcggccaagttaaacgccctcttggagcgcgctctagggccagaggtgccaagaccaggacgacgctga

SEQ ID NO: 13028 - RNA, 1395 nt, unidentified
  source 1..1395: mol_type = other RNA; note = synthetic construct
atgagtactgcggcccacagaagaagggcctctgccctgcgggcagtgagaaggagacacgatagagaatcaagcgggcatgcagccatcagaacttggaaccgtaagagactagctccggccaggagatggtattctcccaggaggcagccatcctcttccgtcgccagcgccttggcagacgcattgctcactacaaactggaggcggccccatatgttgtcagcagttcgggttgtagctcctgcaagagcgcgccgccttgtggacgcagtgctacaagcgtatccacgcgctcctgttgatcgtcctcgcgaattgagcaggttcctggccggatttggcgtccctcgtgctgtgatccgacgtaggctagtggcccccgctagggtcgtgagaatgcgatggaaggctccaaggatagatgatctggctgggcttgctgcatttctcgagctggacggtggcgcgctggattggttcgccgacagacgagagcttaatcgtcaggcgcgagacgagcggttacggcactaccgctacgcatggctgagccatcgcctgatcgaggcccccaaaccacggctcagggccttacagcgacgagtgctggatgagatcctggccactatcccagtgcacgacgctgtacacggctttgttcccggccggggcactcatactttcgctgaacgacatgccggacaagacgtgctgctcaccatggaccttagggcctttttctccagtattacggccgcacgcatttatggtctttttttgggcgctgggtaccctgaaacggttgcacacgcactgaccgccctcacaaccaccagaaccccggctcgcgtcttaagaagcgccccagatccggacttggctgctgtgctccgaaggcctcatttaccccagggagcgcccacatctccagcactcgccaatttgtgcgcctttcggctggaccgccgcttaacagggctggctgaaaggttcggcctgacctatgctcggtacgccgacgacctcgctttcagtgggacagggcctgtggatcggctgacacctctggtggcccacattgcaacagaggagggcttcagagttcgcccagacaaaaccaaggtgcggcatcggagccaacgccagtccctgaccggtctggtcgtaaacgagaggcctgccgtcgctagagccgattacgaccggctccgcgcgattcttcacgatgccgcaacccacggactggatgccgctaaccgtgatggacaccccgacttccttgcccatctcactggtcgcgtagcctgggcttcgcatgatcacccctcacgggcaacgaaactgaggcggctgctcaatcaggtgcagtcctcacacatagtcggaagatga

SEQ ID NO: 13029 - RNA, 1233 nt, unidentified
  source 1..1233: mol_type = other RNA; note = synthetic construct
atggttgccggcgctcttgccgatgcattgctgaccaccacctggcagcctgaggaaatggaagccgcagtcaggagtgtggcagctgtgcccgaagcatgggctcgtaggctggtccgcactgtcttaagcgcctatcctcgaaaccccgccgatagacctagggaactgcgccggttcctcacggctcggagagcttacatcaggcaccgactcgtgactccaacccacgctgttcggatgcgctggaatgctccacccatcaatgatttggctgagctggccgcattcctagaactggacggagatgctcttgattggtatgctgacagaagggagattaaccgtcacgctcgagacgagaggctcaggcattaccgctacgcttggcttccccatcgcctgattgaagcgcctaaaccactgctgcgggacttgcagcggcgtttgctcgatgacgtgctggccaccgctccagttcacgaacacgcccacgggtttgtgcccggaaggggtacacacactttcgcccgagttcatgccggccgtgacgtgctggtgtcaatggacttgcgcgcctttttttcctctattacggcggcgcggatatatgggctgtttcgcggtatcggctatcctgagccggtggcccacgccttaactgcccttaccactacacggacgcccgcacacgtcttgagagccgcaccagaccctcacctcgcagctctgcttagaaggccccatctccctcaaggcgccccaacatccccagccttagcaaacctgtgcgcttacagactggatcggaggttaacaggcctcgcagaccgattcggtctaacttatgccagatacgccgacgatctggccttttccggaacccttacacacgcccaagtggagcgcctggttgcgctgactaccagcatagcagccgaggaggggttcagggtgcatccccataagacacgctttagaacccaggcccagagacagagtgtaaccggcctggtcgtaaacgatcgccccgctgtaccgcgggaggagtacgataggctccgggcaatcctgcacaatgcggctacacatgggctcgcagaagcgaatagagacgggcatgctgatttcgccgcacacctaacaggaagagtcgcgtggatgtctcatcatcacccgagccgggccgctaagttgcaggacctccttgtgcgagcactgtcagccccttga

SEQ ID NO: 13030 - RNA, 1281 nt, unidentified
  source 1..1281: mol_type = other RNA; note = synthetic construct
atggccaccgccctggcagatgcccttctgacaacgtcttggaggagaaaggctatgatcggtgcgggaagggcattattgggcaggccgactagatgggttccccgcgttgtcgacgccgttgctgcagcttatagagatgcccctgcagaccgacctcgcgagttggctcgctttgtggccgagattattcgcacaactcccggtgcgaggaggcagtccagacggacagtaatcagacatcgccttgttgcccctacccggactgtccggatgcgatggaaaaccccccgcatcgacgacctagctgctctcgccgacttcctggctgtcgacggcgatctcctcgattggttcgctgaccgaagagaaattaaccggcatgcccgggacgaaccactcaggcactatcgctatcagtggctgccacaccggctcatcgaggctccaaaaccgcgcctccgggcaattcagcgacgtctactggaccacgtgctggcggcaattccagtgcatgagcgagcccatggtttcgtggccgggagaggcgtccacacgtttgctggatcacacgccggacgtgcggtgctggtgagcatggatctccgcgccttctttagctcaatcactgctccccgggtgtacgcgatgtttaggcaagccggataccctgaacccgtggcacacgctctgaccgctcttaccaccacccgcaccccagccagggtattacgaggggctcccgacacaacaagggctgccatgttgagacagccccacctgcctcaaggagcacctaccagcccagcactggccaatctttgcgccttccgcctggatagacgactgactggactcgcggaccggttcggtctgcactacagtaggtacgcggatgatctcgctttctccggaacactaggcgaacggaggactctggacttgataagttatgtgaggggcatagcagcagaggaggggtttcgggcccatcctgataagaccagagtacggcggagagccgaccgtcagcttttggccgggctggtggtcaactctagacccgccgtgcctagggaagagtacgatggcctgcgtgctatcctgcataatgccgggagacatggcttggccgcggcaaacagggatgggcacccagattttgccgctcacttagccggccgtgttgcatggatggcccaccagcatcccgctagagcagcaaagctgcacaatctgcttcgcgccgcattaacagccccgacgactgcaggctcctga

SEQ ID NO: 13031 - RNA, 1182 nt, unidentified
  source 1..1182: mol_type = other RNA; note = synthetic construct
atggtgttcggacgcagggcaagatgggtccgtcctgctgttgacgcggtgctcagggcttatcgcgaagcaccaggtgatcgacctagagagctggccggctttctggctgcatccgggagactgggggctcacaggactgtggtgcgacaccgtcttgttgccccgacgcgcaccacaagaatgcggtggccagcaccggcaatcgatgacctgggcgcactggccgatttccttagcctggatggggacatgatggactggttcgcagaccgacgcgaaatcaacagatacgcaagggacgaacggctccgccattataggtacacatggctgccccatcgacttatcgaggcccccaagcctatgctgcgcgatctgcagaggcgcctgttagccgaggtactcgctggaatgcccgttcacgagcgggtgcacggctttgtgcctggacgaggcgtacatacatttgcagcgtcccacaccggccaggaagtcctggtatctctcgacttgcgggccttcttcagtagtattacagcagctcgtgtgtacgccgtgtttaggcaagccggatatccagagcccgtggcccataccttgacagcactgaccaccactcgcactccagcccatgtccttagagacgccccagacgctactcgtgccgccttgctaagacggccgcaccttcctcaaggcgcccctacatctccagccctcgctaatttgtgcgccttccgccttgatagaagactcaccgggctggccgacaggtttgggctacactacagcagatacgcagacgatctcgcgttctcaggtacggtaggagatcggcgcgtcggcgacctgatatcatacgtgcgggcgattgtgaccgaggaaggtttccggacccaccccggaaagactcgtgttcgacggcagggggatcggcagctgttagctggcctagtcgtcaacgcgaggcccgctgtggctagggaggattatgatcggctccgagccgttctgcacaacgccggaagacacgggttggctgcagcaaatcgcgagggccatcctgactttgctgcgcatctcgctggtagggtcgcctggatggcccacaggcatcccactagagccgccaaattacacagcttgctgcggtccgctgtggctgccgataggcagtga

SEQ ID NO: 13032 - RNA, 1329 nt, unidentified
  source 1..1329: mol_type = other RNA; note = synthetic construct
atgactactgcggcccacaggcggaggttagctgctctcagagctcggacccggcgccatgaccgagttagctccggtcatgccgctgccgctgcaccaagagtggcaacagcactggccgatgcctttctgtcgacgcggtggcggcgaaaagccatggtgaaagccggagctgcagtactagggagagagagaaggtgggtggatcgagcagttgtaaaggtcctgagagcttatcggatcgccccagccgataggccaagggagctagcgggctttctggaaggcattacccggccggccgtgatacgtagaagacgcgttactcctgtgcaggtggtaaggatgcggtggcacgcaccccctattaatgatttaggagaactggctgccttccttgatgtcgatggggaccttctcgattggttcgccgatcgcagggagatcaatcgccatgcccgggatgaacgtctgagacactacagataccgctggcttccccaccgcctcattgaggccccaaagccccacttgctggccctccagcgacgtctgctggacgaagttcttgcccgtgtacccgtgcacgagcgagcccatggcttcgtgcctggcagaggcgtgcatacattcgctgcttcccatgcagggcaagcggtggtcgttcgcctggacctgagggctttttttagtaccgtcacagccgccaggatctatggtatctttcggagcgcaggatatcccgagcctgtcgcccatgccctgactgctttgacaacaacccgcacccccgcaagggtgctgagagatgcgccagaccctcgcctcgctgctttgttgcggcgacctcacttaccacaaggcgcaccaacctccccggcattggccaacctctgcgctttccgcttggacaggcgacttacgggcctcgctgggaggttcggcctgcattattctagatacgccgacgacttagccttctctggaccggaccatccccataacctgatcccctacgtgcactcaattgctgtcgacgaaggtttcgagataaaccctgccaagacacgagtgcgcgggcaagctgatcggcagctcctagccggtctggttgtcaattctagtcccgcagtccctcgcgaggactacgatcggcttcgggcgaccctgcacaatgcggctactcacggactcgcagaggccaacagggacgggcacgcagactttgcagcacagctggccggaagagtggcttgggtgagccacagacacccagcacgtgccaggaaactccaggaactgctttcagcggccctggcgaagccttga

SEQ ID NO: 13033 - RNA, 1284 nt, unidentified
  source 1..1284: mol_type = other RNA; note = synthetic construct
atgtccgccgcactggcagatgccctgttaacgtctcgctggaggcctgggccccttcaacggactggaaccgccgttcttggaggcagacccccctggttgcgtattgcagtcgtcgctgttctgcgggcttacagacacgcaccggctgataggccccgggaattagcggcgttcctctcttgcctggagcggtcaggtagaccattggtgcgccggcatcccatcaggctaagacgagcgacgcctgtgagaatcgtccggatgaggtgggacactccacgcatcgacgatctagccgccctggccgatttcctgggtgtggatggggatcatctggactggtatgctgatcggcgacatctgaatagacacgcgcgggacgaacggcttcgccactacagatacgcatggctgccacataggttgatagaagccccgaagccacggttgagagccttgcagcgtcgtctcctcgacgacctcttaggccgcctacctgtgcaccctcacgctcacggctttgtgcctgggcgcggagtgcatacatttgccgcaccacacgctggccagaaacttgtgattggtctggacctcacagcattcttcagtagcattactgctgcacgcatccatggcctctttcgcaccgccggctatcccgaaccagttgcgcataccctgaccgccctgacaacaactgccactccagcagccgtactgagaggacgtaccgacccacatcgcgctgccctgctgagacgtccacatcttccccagggtgctccgaccagtcctgctctcgcaaacctggtggcgtaccgacttgaccgaaggctaaccgggctcgccgataggttcgggcttcactatacccgctacgctgacgacttggctttcagcggaactctgggcagaggagagcctgcccacctgatcgccgctgtgcacacaatagccgccgatgagggctttcgagtgcacccccgaaagaccagggtccgcggtagaggcgatagacagcggctggccgggttagttgtcaacgagaggcccgccgcctcacgtgaggactacgatcggctccgggccgtactccatgatgccgcaaggaggggacctctggtggcaaatcgagagggccacgacgactttcccgcttatctgagggggagggtagcgtgggtttcccatcgccaccctgccagagcagcaaaactgcacaggatgctcgcagtcgccttggctggacctgctgctccacccacggtgacaacaccgtga

SEQ ID NO: 13034 - RNA, 1344 nt, unidentified
  source 1..1344: mol_type = other RNA; note = synthetic construct
atgttttgccctcctggaacaggaggcagcctcgatagatcactcacatttgccgggcatgccaacttgggcgcggtgagacaggcagtgaacagtgccctagctgaggcgtttcttgcctgtggctggcgtgatgggcccgcaagacctgctctggacagactgacccgcgccggtgctgaggttcttggaggtcggccatggtggctgaggccgttggctgcagaggttcttcgggcccacaggaacccaccattagatcggccccgcgagctggccgcttttttaggccggagggtggctggttcccgtccaattatggtcaggcgcgcagtcccagttcgcactgtccggatgcggtggccgactcctaggatcgatgacctggctgcgttggccgacttcctggggctcaccggtgaagaactggattggttcgccgaccgccgagaaattaatcgccacgcgagagcagagcagctgaggcattaccgctacagatggctgccacaccggcttatcgaagcccccaaacccagactgcgcgcccttcacaggcggcttctcgacgatctgctgggacggttgcctgtgcatgacgccgcccatgggtttgtgcccgggagatctgtgcatacgttcgcagcacctcatgccggccgggctttggtgatcagggctgatctcgccaccttcttctcttcaataactgcaccccgtatctttggcctgttccgcacagccggctatccggagcctgttgcccacgctcttacgggactcacaactacgaggacccccgctgcagtattaagggggcacgggtacgataccgctcgtatgctccggcagccacatctacctcaaggagcccctacatcccccgcactggctaacctcgtagcattcagattagatcgcagactggcaggcctggctgcacgattcgacttgacttatactcgatacgcggacgatctagcgttttcgggcccccggaccgatccaaggaggtttctcgacgctctcagaacagtggtcgccgacgagggcttccgactgcatccagccaagaccagggttcgaggacgcgccgatcgacaaagcctggccggactggtcgtgaatgaacaccccgctgtgccaagaactgactatgaccgcctccgtgctatattacacgacgctgccagacacggtttggccaccgccaatagagacggccaccccgacttcgcggcctatctgaccgggagggtagcgtggattgcacaccatcacccgacacgagcagccaagctacaccggatgctggcagccgctctgaatcctcccccaccttga

SEQ ID NO: 13035 - RNA, 1182 nt, unidentified
  source 1..1182: mol_type = other RNA; note = synthetic construct
atggttgtggcaggtttggtgcgggctggcgccgaagtacttggtgcacgaccatggtggctaagaccggtcgtggcgcgggtattgcgcgcttatccccatccgcccctcgatcgtcctagggaactagcggcctttctggacagacgcgtgcagccccacccagttgttgttcggagggccgctcctgctagggtagtgcgaatgcgttgggatacccctcagctgaacgatttgggggccctcgcagattttctcgaggtgtctggcgacgagttggactggttcgctgaccgcaaagaaataaataggcatgcccgcgacgagagactgagacactaccgctacgtctggctgccacaccggcttatcgaggcaccaaagccaaggctacgggcgctgcaacgtagactgctcgatgagctgctggggaggatccctgttcatcccgcagctcacggattcgtcccaggaagatctgtgcatacctacgccgccccccatgcaggacagcgaatggtcgtgcgtgccgatttggctgcctttttctccagcattacagcacagcgcagctacggactgtttcgcctggccggctatccagagcctgtcgcacacgcccttaccgcacttactaccactagaaccccgattgatgtgttgcggggcagacccggctcaactaggacactcctgagagagggacatctcccacaaggcgcaccctgcagtcctgctctggcgaatctggtcgccttccgactggacaggcggcttacaggtttagctgcccgcttcgggctgacgtatacgcggtacgccgacgacctcgctttttccggccctagggccctcaatttagacgcgctcgctgctgtggtgaaggatgaagggtttagactccaccctgccaaaacaaggatcagaggtcggggggatcagcagcgccttgcaggactggtggtgaacgaacatcccgccgttccccgcggggaatatgaccacctgcgagctattttgcacgacgccgccaggagaggcttagaggctgctaacagagagggcaaagcggacttccgggcctaccttatgggacgggtcgcctgggtaagtcaccgtcaccctggccgagccgcaaagctggataggttactgaaggacgcactgaggcggggggattga

SEQ ID NO: 13036 - RNA, 1182 nt, unidentified
  source 1..1182: mol_type = other RNA; note = synthetic construct
atgctcggcagactggtgcgggctggaggtgaagtcctaggaggacgaccttggtggctccggcctgtagtagcaggggtgctgagagcctatcgggacgctcccgctgacaggccaagggaactggctggctttctgagtggccgcgtgcagtcacaccccgttgtggtacggcgcgcagttcctgtgcgcgtagttaggatgcggtgggatacacctagaattgacgacttgggcgtgctggccggattcctaggtttagcgggggatgagttggattggttcgccgacagaaaggagatcaaccgccacgcacgcgatcagcggcttagacactatcgttaccgctggctgcctcatcgtctgattgaagcccctaagccgagactgcgagccgttcagcgcagactcctggatggcgtgctcggaaggatccccgtgcaccctgcagcccatgggttcgttccaggccgtggtgtccatacctttgctgtgccacactccgggcagcccatggtggttagggtggacctcgcaagcttcttttccagcgtcacagccccccggatatacggactctttaggaccgctggatatccagagcccgtggcccatgcattaacagctctgaccacaacgaggacccctgcggatatcttgggaggcaaataccttcccctgctccgacacgcccaccttccacaaggcgctccgtcgagtcccgcgcttgctaacctggtcgcctatagattggatcggcgcctgtctggcttagcagcccgttttgggatgacttatactcgatacgctgatgatctcgccttctcagggcccagggtatctgcgccaaggctcctggccgctttagaggcagtggtcaaggatgaagggttccagctccgacacgcaaaaacccgggtcagaggccagggtgacaggcaagttttggcggggttggtggtgaatgagcgcccagcagtggcccgtgtcgaatacgacagactgcgcgccgtccttcatgacgctgccagacgaggactggacgaggccaatagggacggccacgccgattttagcgcttacctgaaggggtgggtcgcctgggtgtcccatagacatccgggcagggctgcaaaacttgaccggctgctagcagccactctgggtgaggaccgggcttga

SEQ ID NO: 13037 - RNA, 1383 nt, unidentified
  source 1..1383: mol_type = other RNA; note = synthetic construct
atgtccacagctgcccaccgtaggcgggcttcagctctcagggctggtcggagacgtcacgacggtgccagttctggccacgctgctactcgccggcaagctccaaggagagtggcctctgccctggccgacgcattcctgactgtggcgtggcgacgggctgagctcttagccgtgggacgcaccgtccttgctgctcgaccgagatggctgggcccagtagtgactgccgtcctgcgagcttatcgcgacccgcctgtcgatcgtcccagggaactagcggcctttgtggccggagccactggaccagcaggccaaagggttggagcggcggttgtgagggaacggaggatggttcccacccgcacacagcggatgaggtggggtacgccagctatagacgacctggccgccttggccgattttctcgacctggatggggatcatcttgactggtttgccgacagaagggagctgaaccgccacgcccgtgacgaaagactccgccattatcgctatacctggctcccccacagactgatcgaggcaccgaagcctagattgcgagccgtccagcggcacctcttggataccgtggtaggcctgcttcctgtgcacggaagcgttcatggctttgtccctggcagaggcgtgcacacttttgccgccgcccatgccggaaaacccacggttgtgcggctagacctccgggcattcttcaccactgtgacagcagggcgggtgtacggcgtctttcgaaccgctgggtaccctgagcctgtggcacacaccctgacagccctgactacgaccaggaccccagccgcagtgctgagaacagcccctgatagagccgcagcaggtgcacgagctgctctgctgagacagccacaccttcctcaaggtgcacccacatcccccgcgctggctaatctgtgcgcctacaggcttgatagacgattagccggtctagccgttcggttcggggtgggatacactcggtacgcggacgatctggcattcagcggagacttgactgccagacaggctggccatctggtgacacacgtgacagcggtagccacagctgaggggttcgggaccaatccagctaaaaccagagtcaggggccgcgcagataggcagcagttagccgggttagtcgtaaacgcagcaccagccgttcctcgcgcggaatatgacctgctccgcgccattttgcatgatgctgcccgtaacggccttgcagccgccaatcgcgatgggcatcccgacttcgcagctcacctcgcgggtagggtggcttgggtcggacataggcatcccgctcgggcagcaaagttgcgccgactcctggctgatgtaggcgcaccccggacctga

SEQ ID NO: 13038 - RNA, 1224 nt, unidentified
  source 1..1224: mol_type = other RNA; note = synthetic construct
atgttgtggcagaggagcgagcttttggctgtaggacacaccgtgttgggtgcaagaccacggtggctcggacccgttgttaccgccgttctccgggcttaccgtcaaccgccagctgatcgaccacgggagcttgcggcctttgtagccgctgtgactgggcccgccggaacaagagtccaggcagcagtgatccgcgaaaggcgttttgtggccaccagagttggcaggatgcgctgggcaactcccgccgtagatgatctaggcgctctggccgattttctcgacgtggatggggataggctggattggttcgcggatcggcgcgagctgaataggcatgcccgggatcaacagcttcgacactatcggtatctatggcggcctcataggctgatcgaagcacctaaaccccgcttgcgagcattacagcggcacctcctggacacgatcgtggggctgctgcccgtgcacgaatctgttcacggcttcgtggctggcaggggggtgcatacatttgccgctgcccatgccgggaaacctaccgtgctccgcctggacttgagagcattcttcacaagtgtgactgccgcacgtgtgtatggcctcctgaggaccgctgggtatccagagccagtggctcatgccttgacggcattaaccacaactagaacaccagtggacattctgcgcgacgctccgaatagggctcatgctgccctcctgcgacaacctcaccttccccagggagcgcctacatctcctgcgcttgccaatctctgcacgtttcgtttagatcgcaggttagcaggactggccggcagattcggtgccgactacaccagatacgccgacgacctagcgttctccggggatctcggtggcagacaggctcagcacctgatcacacaggtcactgccatagccaccgccgagggctttggcgtcaacactgccaagaccagagtccgcggacaagcggatcagcagcggcttgctggactggtcgtcaacgctgctccggctgtccccagagccgaatacgacaggctgcgagcaatactgcacgacgctgcacagcacggaattgacgccgccaacagagacggccatcctgacttcgccgctcatctggccggtcggattgcatgggtagcccaccgacaccctactcgcgcaagcaagctgcagcggttgctgtcagcagcggttcccgcaccatga

SEQ ID NO: 13039 - RNA, 987 nt, unidentified
  source 1..987: mol_type = other RNA; note = synthetic construct
atgagatgggataccccgcggatagacgacctagccgcccttgccggctttctggggttcgacgcagacgaactggactggtacgccgaccgaaaggaattaaaccggcacgcgcgtgatgagaggttgcgccattatcgatatacctggttggggcgccgcctgatagaggcaccaaaaccaagattacgggcagttcagaggcgtcttctggatgatgtgttgggaaggctacccgtgcacccagccgctcacggattcgtgccaggacgcggacctcacacatttgctgctgctcatgcagggcagcctgtcgtggttcggctcgatctggctgccttctttagcaccattacagccggccgagtctacggcctgttgcgaacagcaggctatccggagcctgtggctcatacactgacagccctggtcaccacgaggactcctgcagccgtgctcaggaacgccccagattggcgtactgccgccctccttagacacccccacttacctcaaggagcccccacgtcaccagctctcgcgaacctgctcgcttacaggctggatagacggctcagcggcctggcagcgagatttgacgctacctacacaaggtacgcagacgacctcgcgttctctggccccctcactggtggcgtagctggtaggctggttgccgcagccactaccgtagtcgccgccgaaggtttcagggtccatcctgggaaaacccgcattagaggccgcgcagacaggcagcttctgactgggctggtggtgaatgatcgccccgcggtaccccgagctgagtatgatcacttgcgggccgtgttgcatgacgcagcgcggaatggacttgcagccgccgatcgcgatggtagagccgactttgctgcttacctgcgggggagagtggcttgggttgcacacgcccatccctccagagctgctaagctgcaccggctgctagccgcagccttgagttga

SEQ ID NO: 13040 - RNA, 1317 nt, unidentified
  source 1..1317: mol_type = other RNA; note = synthetic construct
atgagcactgctgctcataggcgtcgcgcatccgcgctgagggcaacattacgtcgccacgatcgagactccagcggccatgctgctcgggctgtagctggagccctggctgatgcttttctgaccgtggattgggcacgcggaccccttttggaggtgggcagggaggtactgggacgcagaccacggtggttggggcctgttgttaccgctgtgctgagggcctatagagaggcccctgcggacagaccacgggaacttgccgaactgataagcgcgcctggtcggcagccaattcgggtgaggcgtgcaacggccactcgcactgttcggcaacggtgggactctccgagagtggacgacttggccgcccttgccgagtttctcgcagtgacgcctgatgaactggactggtttgccgaccggaggggactcaataggagacatcccgatcctcgcgtaagacactatgcctacacgtggattggggatcggctcattgaagcccccaagtctcgcctgaaggctctccagaggagagtgctggacgaactcctaggaccccttcccgtccacccgttcgcccatggattcgttccggggagatctgtccatacattcgctgcgccacacgccggacaggtcactgtggtcaggatcgacctgcgcggctacttttccagtgtgaccgccgggagagtgtacggcttatggcgaaccgccggatatcctgagcctgtcgcgcacgccctaaccgcactctgcacaaccgctacaccacacgccgtctcaagaagagtcgagcaccgtacccctcacttaccccaaggcgcgcccacatcacccgctttagcaaatctggtgacttttcgactggatcgacggctggcgggtttagccgccagattcggtgccacctacagtcgatacgctgacgacctggcgttctcgggccctcttcgacaaccagctcgcctggtggccgcagtaacagccgttgccgctgaggagggtttccgggtgaacccagccaaaaccagggttcgggggcgtggtgaccaacagaggctggctgggttggtggtcaacgatcggcccgcagtgcccagagcagactatgatagattacgcgcagtgctccaccatgccgcacgcgatggcttagatgccgcaaatagggacggccacccggattttgctgctcacctcacaggcctagtcgcatgggccgcacatgggcatccaactcgtgccgcacgattacacgggttgctccgcgccgcaggcatcaacaggaggactgctacacctccatga

SEQ ID NO: 13041 - RNA, 1062 nt, unidentified
  source 1..1062: mol_type = other RNA; note = synthetic construct
atggagttggccgaattcatcgccgctcaccttcctgctaggctgccagttcgaatagtagtcagacgggctgtccccacccggacagtaaggatgaggtgggatactcctgttcttgacgacctcgcggccctggccgaactactcgaactcgatggcgatcgattggactggcttgccgaccgtagggagatgaaccgcaagactctgcgcgaacccctgcggcactatagatacacctggatgggacgcaggctgatcgaggcaccaaaacccttgctgcgaggacttcagagacggttactggacgaagtgctggggcgcattcccgtacacccagcagcacatgggttcgtgccgggacggtccgtccatacatttgccgcccctcataccggaagggacgtggtggttcgtatcgacctcgcccatttctttgcctctattagcgtgcagagagtctacggcctctttagatctgtcgggtatcccgagccggtcgctcatgctttagcggccctgtgtacgacaagcaccccaagtgacatcgctaggggtagtatcgctcttcgcaccccccacttaccacaaggcgcccctacttcccctgcactagctaatctgtgcaccttcaggctggatagacggctaacgggcctggccctctcctttggtgcgacatacacacgatatgctgacgatctcgcattctcaggctcattcaacgcagaccacgtgatagccgcggtgcgccaaattgtggctggggaggggtttcgcgtgaacccagcaaagactagagtgcgggggcgaggcgatcgtcagagattggcaggcctggtggtgaatgagcgtcccggtgtcgctcgcgaagagtacgaccgccttagggctatcctgcacgcagccgccagagatggactggatgccgcaaatcgggatgatcatccggacttcaggaaccacctgctgggaaggattgcctgggttggtcacggcagccctgccagagctgcgaaattgcgggagctctttggattggttgcagccactggcctctga

SEQ ID NO: 13042 - RNA, 1305 nt, unidentified
  source 1..1305: mol_type = other RNA; note = synthetic construct
atgtccacggctcagcacagacgccctgatgcagctcttcgagccggacagggaaggcacgacagagtctcctcaggacacgctgcactggccgatgcattcctggctacacccgcctgggaaagagccgcacttcttggcgccgggtacgaagtgcttggacgtcggccgaggtggttaggcccagttgtgaccgcagtgctgggagcctatcgcgaacctccagctgaccgtcccagggagttagctgcctttgttgccgcactcggccgcgtgccttttcgtgctcgggtagctgttcgtagggcggtaccgaccagggttgtgcggatgagatgggatactccccggttggacgacctcgcagcgttggctgagttcctcgaggttgatggggaccatctcgactggtacgcggaccggagagagatcaacagactagcagcggacggcgccctgcgacactatagatacacttggctggccactcgcctgatcgaggcccctaaaccccgactccggaccctacagcgccgattgctggatgaggtgctgggaaggatccctgtgcatccagcagctcatgggtttgtcccaggcagggacgtacgcacattcaccgctgtgcaccttggcaaaagcacagtggtgcgcctcgatctgagcgcgttcttcgcttcaatgacagttagccgtgtgtacggacttttcagaggtgcaggttatccagaaccggtcgctcacacgttggctgccctgtgcacaacccggactcctccagatgtcgtgcgcgacgcccctagttttttgctcgctgcccagctgaggcagccccatttaccccaaggcgccccctcttcgccagctctagccaatctgattgccttccgcctggataggaggctggccggtttggcagacaggtttggcgcggactactccagatacgcagacgatctcgccttctctggggcctttgacgcaccccgactagtggccgcagctaccgatgtggtagtcgacgagggttttcgggtccatcctatgaagacacggattcgggggcgggcagatcgacagcaacttgccggactggtggtcaacgagcacgcagccgtccccaggaccgaatatgatctcctgcgagccatgctacacaccgccgctagggacgggttagctgctgccaatagagccggccatccagatttccgcgcctatctggctggcagaatagcctgggttgggcgggatcaccccagtagagcggcgaagctggcacgcctctttactgccctgccttga

SEQ ID NO: 13043 - RNA, 933 nt, unidentified
  source 1..933: mol_type = other RNA; note = synthetic construct
atggtcaggcggcctacacggcatgagcctcctcgacatcgtccaccaccggcaccccttcctctgccagtggataggggcagacccgccgatagggggacagaagtaccagccgcccgacctgctactcctgcacctcacagaggtcctcgaccacatcccggtccaccagccgcacacggatttgtgccgggacggagcgctcatacctttgccgggatccacacagctcagcccgtggttgtcaggatcgacctgcttgccttttttacacacatacccgctactcgggttcatggcctgttccgcaccgcgggataccctgagtctgtggcgcacaccttgacaggcctatgcacgaatcggaccccacaccccgtactcagacgtgccccaaccgaactaccccacagggccgctcgattagccgctcttagaactggccatctgccacagggcgctcccacttcacccgctctggctaacctgtgtgcatatcgcctggaccggagactgaccggcttagccgacgccttcgcaatcacctactccaggtacgccgacgacctcgccttcagcggagacttgactacgcgccgcatagacgacctgattgccgatgtgacagacatcgcgcgcgatgaaggtttccaggtgcacccggcaaagactcgggtgcgtggcagagctgataggcaactcctcgctgggttggtcgtcaaccagcaccctgcaacgccacgggatgagtatgatcagctgagggccatcctgcacaatgcagccagaaccgggctcgccgctcaaaaccgcacaggacatcccgatttcgcgcagtatctgattgggagagttacctggattagtcaccatcaccctgcacgcgccgcaaaattggcggccctccttgctcatgcattggcggccccctga

SEQ ID NO: 13044 - RNA, 1329 nt, unidentified
  source 1..1329: mol_type = other RNA; note = synthetic construct
atgctctggcctgcagtggtgagggttacgggcgtgccccaacaagcacgacgtgaccctcggaggcatcgtcccgacactggcacagcatatcgaccaatcaatagtgcggtccagtcacggggaactccagctgggacacctgtggtgcccaggcagagagatccagctctgcatggttctctgcaccgcgccacaagaactggggataccgatgacggactgcgcagcctgagatgctcccatggaggcgtcagcagggctgaccaagcaggcttaccctgtggtgtcaggagccgaagcttgcgcggcaattctggaaaggaccatagccctcgtcaccacaccaccggggccaagtcaagactgcgagccctgcaacgccggctactggctgaggttcttggacgcataccagtccacttagcagcccacggctttgtgccggggagaagcgctcacacctttgctgccgcccatgcagctcaaccggtggtggtaagaattgatccactaggtttctttactcacattcccgccactcgggtccacgggcttttccgaacggcaggctacccagaacctgttgcccacacactcacgggcttgtgcaccacaagaacaccacatcccgtactgcggcgcgcccctactggtcttccccatagggctactcgcctggcggcactcggaactggacatctcccccaaggggcccccacatctcctgctttggctaacctttgtgcctataggctggatcgcagattgaccgggctcgccgatgccttcgagacaacttacactaggtacgccgacgatcttgccttctccggtaacctgacaacccgccgcatccacacgagatctccgccatcccctacttcacccgctaaacgggcatccgaatcgactcagccacggccagcgtcagtgggagcacctaccggaaactctagtcctgacagcagttctactaccacacccccgcatcacgccacgaacaccacctccagtgccccttccagtacaaccccccctgcgccagcttcaccaccctcaaccggcccaacaacaccgactagcctgcataccagtagcgacgagttttcagaatctgccatcaccacccggcacgcccagcctaattcccccaggtgctggcccaagctgttaagacaccgtcggctcacaaggcggggctctttcgcagggtccagacagggccacgttggcaggcctaaaagagggttgagcaggacatatacctgctcggcggatctgcgacaagcttccacggccacccggctgtgtgacccactcacctga

SEQ ID NO: 13045 - RNA, 1614 nt, unidentified
  source 1..1614: mol_type = other RNA; note = synthetic construct
atgccgggcgctgctccattcataggtcgcgggcttactccacggattcatcgtcacgccacctgcattgccgatactcacggcggccctaggtcactgcgttgtagccatggaggggtcagcagagctgatcaagcggccccacctcgaggagtcagatcaaggagtctacgaggcaacccgggcgacgccatcctcacatctgcaccacaccaccggtgtgtaggcacgctgagggagccagtgcacccctacgatcgcgcctctagtggccatgcagctacaccaaccggactgccagtgaacaccattcacgcactcgcgaccgccctggctgatgcattcctcgcaggagccggatggagaaggggcgacctggtcgatcagggtggcttggtactaggcgtgcgccggagatggctttggcccgttgccgatgcagccctggtggcataccttcatccccccacagataggccacgggaattggctacttttctctcgacactggaccctttacgggccgcggttactgcagctaggcagcatcggcgcccaatcgtgattcgagcccgacccgtgacgcctacacgtaccgttcggcggccttggcacacacctgtaatcgacactgtcggcgatctcgccgctatgctcgatctctcaattgagcatctggactggtatgccgatcggagggctatgaatagacgggccccggcccaccgcttacaccattatcataacagatggaccgacagagggcgactgatcgaagcacccaagtcccgcctacgggctttacagcgtcgtctgctggcggaggtccttggacccatcccagtccacccgactgctcacgggtttgtgcctggaaggagcgcacacacattcgccgctactcacgctgcccagcccgttgtggttcggatagacctcctggctttttttactcacatccctgctacccgcgtctatggtctgttccgaaccgcggggtaccctgaaccagtggctcataccttgaccggactctgcacaaccagaacgccccaccccgtgctacggagagctcctaccgacttggcgcatagggctgctcgattggcggctctgagaacggggcatctgcctcaaggtgcccctacttcccccgccttggccaatcgctgcgcatacagactcgacaggagattaacagggcttgcagacgcattcgagatcacctatacccgctatgcagacgatctcgccttttccggtgacctgacgacccgccggatagatgacctgatcgccgcagtgactgatatcgccagaggcgaagggtttcaggtgcatcccgccaaaacacgcgtgagagggcaggccgaccgacagttactcgcgggtctggttgtgaatcaccaccccgccacaccccgtgacgagtacgaccaactgcgcgcaattcttcacaatgccgcgaggacaggcctggcagcacaaaacaggacaggacatccagatttcgcccagtacctgattgggagggtgacctgggtaggacaccaccatcctgccagggctgccaagctggccactctgttggctcaggcccttgcagccccgtga

SEQ ID NO: 13046 - RNA, 1380 nt, unidentified
  source 1..1380: mol_type = other RNA; note = synthetic construct
atgacaactgtacgcgctctgacaaccgcactcgctgatgccttcctggctgacggcgactggcacaggccagacctcgttaaccggggtgggcttgtcctaggggttcgacgccggtggttatggcccatagccgatgctgtgctggtggcctacccccatccgccaagagacaggccacgggacttagccgccttccttgcgaccctcgagcctctgagaggggcagtaacagccgcacggcaacacggacgccctattgtgattcgggctaggccagtagctcccatccggaccgtcaggcacccttggcacactccggtgattgacgacatcggtgcccttgctgccatgctggatctcagtatcgagcacctggattggtacgctgatcgcagagctatgaatcggcgggccacagatcagcgcctgcatcactacggatataggtggacgaatcgtggcagactgattgaagctcccaaaccgagattgcgcgccctgcagagacagctgttggctgaggtgctggggccaatcccagtgcacccagcagcccacggcttcgttcctgggagatccgcccatacctttgccgcagcgcatgctggtcagccagtggtggtcaggatagacctactcgcttttttcactcacatacccgcctcacgcgtttacgggctgcttcgaattgccggctatccagagcccgtcgcccatacgctcaccggactgtgcacaacgcgtactccccacaccgttttacgccaggcccctgccgatttgcctcacaggagcgcaagattggcagcactgagagccggacatttacctcagggagcacctactagccccgccttggcaaacctctgtgcgtatagattggatcgacgcctaactggcctcgcagatgcttttgccctgacctacacaagatacgctgacgacctcgctttttctggggatctcacgaaccagaggacctccgatctgacagccgctgtcactactatcgcccgcgacgagggcttcaggatccatcccgataagatccgggtgaggggacaggcggaccaacagctgcttgcaggcctggtggtgaatcaccgtcccgctgcgccgagggacgaatatgaccgtctcagggccattcttcacaacgctgcacgaaccggactggatgcgcagaaccacacaggccatcctgcctttgcggaacatctgacaggccgggtcgcttggatcgcccatcaccatccaacccgagccgccaatcttgcaagactgctagaccaggccctgaatcctcccgatggccggtctacaaccgcgacccgacaagcacccgcacaattggacgtgggtgaagccgcaacttga

SEQ ID NO: 13047 - RNA, 1602 nt, unidentified
  source 1..1602: mol_type = other RNA; note = synthetic construct
atggctgccgaggacatcccggttgcagccaatggctcggcttcacgccccgcaactgctgaacgggccgctacaggagtgagactcggctggctggggtgtacggacgggagtgtatccagggctgatcaagctgctccacctggtggagctcgctcccgtagcttgagagggaatccgggagacgccacactgacccaggctccacatcaccgctgtgtcggcaccctgagagagcctgtgcatccccatggtagagcctcctcaggtagagccgcacccattaggtgggcggcagtgaccactgttcacgcactggccacggccctcgctgatgcttttttggctgaagatagttggcgacgtcccgacttggtgcatcggggtggcctagtgttaggcgtcagacgaagatggctgtggcccgtagccgacgccgttttagtggcttaccccaggcctcctcgggatagacctagggagctagccgcctttctcacaaccctcgacccgctgcgagacgccatatcagcggctcgttggcagggacggccaatcgtcatccggactcgcccagttgcggcgaccagaacagttagacgcccatggcacacccccctcatagacgacgtgggcgctttggctgcacttctgcggctgagcgtggagcacctggattggtacgccgaccgaagagcgatgaatcggcgcgccagcgatcagcgtctgcaccattacaggtgccgctggacggacaggggcaggttaatcgaggcccctaagccgcgacttggagcgctgcagaggcgcttgcttgccgaggtgttgggccctattcctgtccatcctgcagcccacggattcgtccccggtaggagtgcacacaccttcgctgccgcacatgcgggacagccagtggtcgtgcgggtggatctgctggccttcttctcctctgtcccagccactcgggtctacgggctctttaggaccgccggtcatcctgaagccgtggctcacgcactaacaggcctgtgcactactcggacaccaagctccgtcctgagacaagctcccagcgatctcccacataggtctgctcggcttgctgccctgcgagcaggacatttgcctcaaggggccccaacaagtcccgctctggccaacctgtgcgcatatcggcttgataggcgattagctggcctcgcggacgcttatggcgcaacttatactcgctatgccgacgatctcgcattctctggggatctctcagccagctctctgatcacagccgtgtctgaaatcgtgcgggatgagggatttcgcattcaccccgataaaaccagagtgcgaggccagggagatcgccagctgcttgcagggctggttgtaaacgggaggcccgcaacccccagagatgactacgaccgtctgcgcgccctcttgcacaatgccgcacggacaggcctcgacgcccagaataggaccgggcaccctgcatttgcagaccacctagccggcagggtagcctggattgggcaccagcacccagcaagagccgcgaagctggcagctctgcttgctgaagcccttgcggcccgttga

SEQ ID NO: 13048 - RNA, 1335 nt, unidentified
  source 1..1335: mol_type = other RNA; note = synthetic construct
atgaccagtgccagatccctggctgtagccctggctgatgcgttcctggccgatggtgagtggagacgtccagctttggcagatcggggcggcctggttctgggtgtgaggagacgctggcttgtgccagtggccgatgccgttctgactgcttaccctaggaggccctccgaccgcccaagagagttggcagctttcgtagccggactggagcctctccgtgaagccgttcggcgtcccatactgatctcatcccgacaggttgtcgccactcggacgattactcaccgctggcatacccccgtgctcgaccatctcggagacttggccgcccagctcgggcttagcatagagcacctagactggtacgccgaccgcagagctatgaaccggcgagcggcggatccccgattacaccattaccgatataggtgggcaggcacccggctgattgaggcaccgaagcccagactgagggacttacagaggcgcctacttacggacgtatttggaagaatacctgtgcacgatgcagctcacggatttgtacctagccggagcgcatctacatttgcaactgctcacagtggccagcctatcgttgtgcgggtcgatctgcttgccttcttcgcgactgtgacagctgcccgcgtgtatgggctactccgaaccgcaggctatcctgagccggtggcgcatgcattaaccggcatctgtaccatccgaacccctgccaacgtgttgcgtatggccccaccccatctgattgaacggcccgcccgaattgcggctttgagggctggccatcttcctcaaggggcccctacatctcccgtgctcgccaacctctgcgctttcaggttggatcgcagactcacagggctggcaggggcatttggggtgtcctacagaagatacgctgatgatctcgcctttagcggaggcatctctgggcagaggctggatgacctgctggttgctgtcgctgacgtggtcagggatgagggcttccgggtccaccccacaaaaactcgcattcgcggacgcggtgacaggcagttgctggctggacttgtggtcaacgaaagaccggccgtgccccgcgacgaatatgacaggctcagggctatcctgcataatgcagcacggaccgggctggccgcgcaaaatagaggtggacacccagcctttgccgaacacctagccggccgtgtcgcttgggtcggtagagcatcaccacaccgggccgcaaagctggcatcgctgttagacgccgcgcttgccacagctgccaatccagcccatccacaccagcgggacatcgtggacatgtga

SEQ ID NO: 13049 - RNA, 1308 nt, unidentified
  source 1..1308: mol_type = other RNA; note = synthetic construct
atgacagacgccagaggccttgcggtagctctcgcggatgcattcctcgctgatggcgaatggcgcaggcctgctctggctgataggggtggacaggtcctcggcgtaagacgccggtggttggttcccgttgcagacgccgtagtgaccgcataccctaggcgcccaagtgaccgtccccgagagttagctgcctttgtgtctggtcttggccccttgcgggaggctgttagaagggccgcgacaccaattgtggtccggtcccggcctgtagtagccactcgaaccgtcagtcaccgttggtcgacgcctgtcgtagacgacctcgggggactagcagccgtgcttgggttgaccatcgagcagctggattggtatgccgaccgcagactgctaaatcgaagggccgccgacgatcggctgaggcattacagatcacgctgggtggggggccgactgattgaggcaccgaagcccaggttaagagccctgcagcggcggttgttaacggaagtgctgggccccgttccagtgcatggagcagcccacggattcgttccggcacggtcagcagccacatttgctgctgcccatgccggcaggccagtagtggtgagggtcgatctcctcgctttctttgcgactatcggcgctggtagagtctatggcctgttgcgaaccgccggatacccagaacctgtagcacacgcactgaccggcctctgcactattcgaacaccagcctccgtattgagactcgccccccatgacctcgtcgatagaccggtgaggctggccgccctaagagctggtcaccttcctcaaggggcccccacaagcccagcccttgcaaacctgtgtgctttcagactcgataggaggcttagcgggctggctggcgcctttggactgacctatgggagatatgctgacgacctggccttctccggtgaattacccggacggcgcctggatgaccttctggtcgcagttgcggaagtggtgcgggctgagggattccgtgtccaccctgctaagactcgcgtgcgtcgtaggggagatcgccaggttctggcagggctggtcgtaaacgagcggcccctggtaccccgggaggaatacgatcgcctgagagctatcttgcataatgccgccctgaccggtctagccgcgcagaatcgaacagggcaccctgcctttgcagagcacctcgcaggcaggatagcgtgggttgggcaaggctctcctcaccgcgctgctaaactggccgccttactcgacgcagcgctgagcactgacccacgctga

SEQ ID NO: 13050 - RNA, 1320 nt, unidentified
  source 1..1320: mol_type = other RNA; note = synthetic construct
atgactaccgtcggcagtttggccgttgccctggcagacgcctttcttgcagccgatcgctggctccgaggggatctcgttgcgtccggtggcagggtcttaggcgttcgacggagatggctgtggcccgtagctgatgcagccctcgcagcatatccacgagctccccgcgataggcctcgagaactggccgctttcctcgcaaatctggcacttcttgctgaggtggtgggggccgctaggcagagaggacacacagtcgccgttcgagccagacccgtcacacctacccggaccgtgcgcagaccatggtctaccccggtcctggatgacctggcagacctcgccaggctgctagacgtgacccccgaccagctggattggtacgcagaccggcgtgcaatgaaccgcagggccgatgaccagaggctgcaccactataggtaccgctggaccgtggctggtcggctgatcgaagccccaaagccacgcttatgcgcccttcaccggcgcttgcttgcagaggtgctgggacccttacctgtccacccagctgcacacggctttgtacctgggagaagcgcacacacatttgctgctgcgcatgctgggagggcagtcgtagtcaggattgatctcgccgcattcttcggttccgtgcccgcacggcgtgtatacggcctttttcggactgctggctacccggaacccgtggctcatactctgacggccatctgtacaactagaacacctgcagccgtgttgcgggctgctccagttgacctcccggacagagtctggagactcgctgcgcttagagggggccacttgcctcagggagcgccaacaagccccgccttagccaacctgtgcgcatttaggctcgatcgtcggctgaccggactagctgccgccttcgacgtggactatcagaggtacgcggacgatctggctttctctggagagttgcctccccgacgcgtcgcagatttgttggccgcggtgacagaggtggtacgggacgaaggattccgagtgcacacgcgcaagactagagtgcgtggacgtgccgaccggcaactattggccggcctggttgtgaacgagaggccagccgtgccaagagtggagtatgatagactgcgggctatactccataatgctgcccgcaccggcttggccgcccaaaatcacgctgggcatcccgcctttgcggaacatctagctgggcgcgtggcctgggttggtcatacgcatcctggcagggccgcaaaactcgctgccctattagccgccgcgcttgcgtcacctcagacttga

SEQ ID NO: 13051 - RNA, 1377 nt, unidentified
  source 1..1377: mol_type = other RNA; note = synthetic construct
atgctgtcaggggtagggggcgaggaacctccaggtcgacctggagagagggttgccgccgcactagccgatgcctttttggctggcgattggggcagagatggcctactggggagaggcgctcttgttgtgggggtgcgtgcacggtggttgagacgcgttgcggccgaagtgctgggagcgtaccccagagtcccagccgataggcctagagagctggcaggcttcgtggccgcaagcccagtgtatagagcggcatggcattctgctagacgcagaggtcggcggcttagagttagggcccgccctgtcacagcaactagaactgtccggaggccgtggccaacaccagtagtggacgatctcgccgctttagccgccctcctgggtctgacgcccgaagaactggactggtacgcagaccggcggtccattaatcggcatgcgcgtgatgagcgactgcgccactaccggtatacctggctcggcggccgcttaatcgaagcccctaaacccagactccgcgccctgcagcgaagattgctcgcggaagtgcttggtcccgtgcccgtacacccagctgtccatgggttcgtgtctggtcgcagcgcccacacattcgcagccgctcatgctggtcgcccgactgtcgttcgggtcgacctggtgagtttttttgcaactgtgagcgccccgcgcattttcggcttgctgcgtctcgccggctatcctgagccagtcgcgcacacgctcaccgctctgtgtgtgaccaggaccccagccggagttcttcgagcagctcccgctgggttaccggataggccctaccggttggccctgctgagaggaccccaccttcctcaaggtgcccccacctcaccagcccttgccaatctctgcggctttcggcttgacaggcgcttggctgggttggccgctgctttcggggcaacctacacaaggtacgccgacgatctggctttcagtggagacttacctccacgaagggccgccgccttggtcgatagggtcacagctgtggtggcgggtgagggctttagggtgaggcccgacaagactaggatccgaggaagagcggaccggcagctgctagccggtttagtggttaacacagcccccggggtgccaagggacgagtatgaccgactccgcgcactgctccataacgctgcacggaccggactggccgctcaaaaccgtgccggacaccccgatttcgaggctcacctcgcgggtagaatagggtgggtaggacgtgaccgtcctgcacgcgctgctaagctgagggccctgtttgaggctgcacgactgcggcctgacgatggatcccctggtgcacacgcagcagctccctga

SEQ ID NO: 13052 - RNA, 1233 nt, unidentified
  source 1..1233: mol_type = other RNA; note = synthetic construct
atgttagggtacgccccgcagtggaccgatggagtggtagacgaggtgctcacctatccccgaccacccgctgatcgtccacgcgaactggccagattcatcgcacggctcagagcctttcgaagtcacgttgccggagcacctggggccagtcctgaagcagctccggtgagagtggtccaccgggttgtgactccaaccgtgacagtcaggcagccattccacacgccaaggttggacagcgtggcagatgtcgcagattggctgggtctgtctattgtggagctcgagtggtttgcagacgtgcgggagattaatcgccaggctactgaccggaggctgcggcattacacctataggtggctgaatggcagactgattgaagcgcctaagccgagactcagaagcctgcaacggaaagtcctggacgagcttctgggccccatccctgttcaccccgccgtacatggtttcgtcagcggccgctcacctcataccttcgcggcacctcacgctgggcagcgaatggtcatcagactggatgtaatgtctttctttgcctcggtcacagctgcccgggtatacgggctgttacgtgctgcgggcttccctgaacccgtggcacacgttttgaccggcctgtgtactacaaggaccccacccgatgttttgcgtcgagcccccgccagagtgccaaatagggacctccgactggccctattgagggccccacatttaccgcaaggggctcccacgagccctgccttagctaatttgtgcggatttagattagaccggcgcctcgctggattggcccaatccaacggattgcgctacaccaggtatgctgacgacctggccttctccggcttcacttcccagccccagaggtttattgacatagttcggtcaatcgtcgcggacgagggatttcgcctaaacgaggcgaagacaagacttaggggggccgctgataggcagctgctagctgggcttgtggtgaacgccgcacctgccgcacccagagatgaatatgatgccctccgggctctgcttcacaacgccatctacacaggcctggacgaacagaaccgcgatggtcatcccgattttgtggcacacctcgccggccgtatagcatgggtgggtcatcgacaccctacacgcgccgctaaactccatgcacttttccagcgcgctctttctggcccaccacctgaggcgactgcctga

SEQ ID NO: 13053 - RNA, 1341 nt, unidentified
  source 1..1341: mol_type = other RNA; note = synthetic construct
atgactcgtggacggaccctagctgtggacgctgccgatgccttagcaggcgccttcttggccggagaatgggacccacctgcaatggccaggcgtgctcagcgcgctttaggagatagacgggggtggactctggagctggcgagagtggttcgggcagggtttccagaacggcccgccgataggcctcgcgaattggctggcttcatcgggagatgtgaagtatttcaccgcgctgttcaagacccagaccgccccatgcgcgtaagggtctggatggctcccccaaccgaaatgggtcccgcgaggtggcctgttgctcctcttcctgacgtggctgctctggccacttggctcggcgtcacagtcgatcacctcgcctggttcgccgatcgccgatcgctcgaacggcacgtcgacgatgagcggctgcgacactacagacggagatggctggccaaacccgacggaacagcacgactgctggaggccccaaaagaggagctgaaggacctccagaggcaggtgttgcaccagattctggacaggatcccggcccatgatgcagctcacggcttcagacccaaccgatcagtgaggacctctgccgccgtgcacagaggccaagaggtcgtcgtgaggctggatcttgaagctttttttacgagcgtagacgtggggcgcgtttatggcattttccgactggccgggtaccctgaaccagtggcacatacactcgcagccttatgcgtgaccgtgactcccggtgccgttttacgatccgcgcctcctgtcccagattctctggttgacgcgagacgccgtctgctacaccggcttaggtccccgcaccttgcacaaggcagtcccacgtcaccggccctcgctaacctggtcgcttttagacttgacagacggttggccggtcttgcagctgcactcgatgcccgttataccaggtacgccgacgacctcgtcctgtccggtggaagaaatctcgtgcgcagtgcagggcccatcctgcatctcgtagagcgcatagcccgtagcgaggggttcacagtgcatgatcggaagactagagtgctgaccagcgcacagaggcagcggatcacaggcctagtggtaaacgggggcgtgaatgttgcccgccccgactatgatagactgcgggccgtgctgcatgacgccgctttgcacggtccagaggcagcgaatcgagagggccatccagactttcaggcacatctacagggaagggtcgcttgggtgggcgcaggaaaccctggaagggcacataagttggcgcgggcgttcgctgccattgattgggatgcctga

SEQ ID NO: 13054 - RNA, 1362 nt, unidentified
  source 1..1362: mol_type = other RNA; note = synthetic construct
atgtccacgtccagggcatcagttgccaacgctttagctgccgccctgctggacggagaatggaagagcgtcactacgcttgcaggcaggggagctagggcgttgggtgtgtctcaaagaagacttggcgccgtcgctggagatgtcctggctgcataccgcgaaccgcccctcgacagaagacgcgaactgtcgtcttatttgctcgagcttccgagctttcacgtgttatgggaagggccaggtcgccctccgatcgtacagaggcacagactgcccttggcggatatgggcagggccagatggcctgttccaacaatcgccacttccctcgaactggcatcctgggccgaggaagacctgtccgtgctcgactggtacgccgatgttcggagcttggaacgctctgccgcacccaagctgaggcattatgaccgggaatggagatacaacaggcgaggaggtgtacggctcttagagcggccccgatccaggatcaaaggtctgcaaaggcgcgtgctgcgtgagatgttggatgttgtgcctgctcacggcgccgcacacggatttgtagccggtcggtcagtcgtgagctttgtgacaccacatgtggggcgagacgtcgttgtgcgcttggatctgactgcctgcttcgcatccattactgccccaagagtcttcggagtgttccggatgctgggctacccagaagccgttgcccacacccttaccgggctgagcacaaccgtggttcctcgggacgttttgcgaagtgccccccaggctctacgcaacgaggacctggacgcgcggagatggctgctgacacggcttgctgagccccacctcccacaaggcagtcccacatcgcctgccctggctaatctggtgctcttccacctcgatgcccgtctctccggattggctgccgctgctggagccagttatagtaggtatgctgacgacctggcattttctctggatggcactgatgccgtccggcgagctaaacgcctagtggcgagcgccagaagcgtcgttgcggacgagaggctccgtctaaatgatgccaaaacctctatcacccgtagatcacagcggcaggtgctgtgtggcgtcgtggtgaatgataagcctgcagtagagaggcgccgccgagagtcactaagggctgcactccataacatacgacagcatgggcctgagtcacagaaccgtgcagggcatgaggattttagagcacatctgttaggggagattgcgtgggtgtctgcagtgaatccagaccacggcgagcgccttcggagtgaattcgcacagattacctggtctgagcttggccctggggcaagccagccctga

SEQ ID NO: 13055 - RNA, 1011 nt, unidentified
  source 1..1011: mol_type = other RNA; note = synthetic construct
atgcctgtctggaggtggcaggttgcccggtggactacctttgacgagtgcgcagccgctttagatctgacgcccggtgaactctcctggttcgccgacgagagagggtggcacagacgatcagggcccgtgttgcgtcattactcttatcggtggatacccacagccaccggaggagctcggctgatcgagcgacccaagccacggctggcagaagtgcagaggcgcatccggcgtcaggtgttagatgcccttcctgtgcacgaagccgcacacggcttcaggagaggcagatccattcacacgtgtgcacggccacacgcaggacaggatgtggtggttcgtctggatcttgcaggcttttttccaactgtcagcgcttcccgagtacgatcactcttggatctggctgggtaccctaaagccgtcgctgctgcaattgccgggatactgacaacaagaacacccgtggatgttttgcgcagtgcgcctgccaggtccgctatgctaagccatctggctggtacccatttaccgcaaggggccccctctagcccatctgtcgccaatgcggttactcaccacctcgaccggagactgtcagggctcgctgcagtcctgggagcgaactatacccggtacgccgacgacctggcattttctggcgacgccagcctgccattgcatcgcctcctgccgggtgtacgccggattgtcactgatgagggcttcaggctcagggacgataagacttcggtgaagcctgcttatcgacagcagcgcgtggccggccttgtggtaaacgctgccccagcagtggccagggctgagtacgacgaactgcgcgccgtgctgcataattgcgcaaggaccggtcctgcgcaacagaacagagcgggccaccccgacttcagagcccatcttatgggaaggatcgcttggatcagtgccacaaatgcagcccgcggaaccaaactacgcggcctcttcgatagaatcgactggagttga

SEQ ID NO: 13056 - RNA, 1053 nt, unidentified
  source 1..1053: mol_type = other RNA; note = synthetic construct
atgaacggagagagggtcacatcagcctccttgctgggcccaatgcccgtctggagatggcccgtagcacggtggacaaccttcgatgaatgtgccgctgcgttggatctaccgcccggagaactgtcttggtttgcggatacacgtgggtggaatcgcagagcccctgcgcgactccgtcatcactgccatcactggattccaacagccagcggcggagcaaggctaatcgaacggcctaaaccgcgccttgccgagcttcaacggcgcgttaggcggcacgtgctcgatgcactgcctgtgcatgaggctgctcacggctttcgtgggggcaggagcatccacacttgcgctcagccacacgccggtcaggaaatggttgtgcgcatggggctggaagggttttttcccgcagtgtcagccactcgcgtacgagcgctactggagctggccggatatcccccagctgtcagagccgccttagcaggcatcctgaccaccagaacacctgtcgacgtacttcgggcagccccagtgcgagctaggtctttagggcgcctcgccggaactcacttgccccaaggcgctccaagcagtccctccgtggctaatgccgtgacccatcatctggacagaagactgtccgggctggcagcaagccttggtgtcaactacacgcgctacgccgacgatctcgctttctctggagacgctgggctccccctccataggctgttgcccggtgtgagacgcatcgtgaccgatgagggcttcaggctgagagacgacaagacctcggttacacctgcatatcggcagcagcgagttgctggcctggtagttaacgccaccccagctgccgccagggcacaatacgacgagctcagagcagtgcttcacaattgtgccaaaactggacctgctcctcagaatcgtgcaggccatcctgatttccgagcgcacttgcggggcaggatagcctggattagtgccactaacccggctcggggtgccaagttaacggacctgttccaccggattgagtgggactga

SEQ ID NO: 13057 - RNA, 1110 nt, unidentified
  source 1..1110: mol_type = other RNA; note = synthetic construct
atgaacggggaaagggttactccggccagtcctaccaatcccgcaaatcccgcggaacatacaaaaccatttggcccccaagaaccgagcctgttggaccccctcccccctatctggaggtggcaggtgcctcattggcctacattcgagagctgcgccgctgctctggatctcactcccggtgagttgtcatggttcagtgatcctaggcactggaatgaccgtgccaatcacacactgcgacactaccaccaccgctggatcccaacttccacgggaggcctgagactcatagagcgcccaaaaccccggctggctgaactccagcgccggattcggagacacgtgctgacagcgttgccagtgcacgatgccgcccatggctttcaccctggacgatcgatcctaacctgcgcacagccgcatgcaggccaggataaggtcattaggatggaccttgagcacttcttccccacagtctcagctcggcgcattaggtccctgttagagcttgctgggtatccaccagccgtcgcccaagctcttgccggaattctaacaaccactactccacccgtggttctcaagaacgcaccgcggaaggtgagagatcaattaaagaaacctcatctgccccagggagcccctagctcaccagctgtggcaaacgcagtcacaaatagattggaccgaaggctctctgggctggctcagaaattgggcgccaactacacgaggtatgcggacgacctggctttctccggtgaggccaccctgccactgcatcgactgtttcccggagttagacgcatcgtagaggatgaaggatttagactgcgcgacgataagacctctgtggctgccaaacatcagcggcaacgtgtggccggtctggtggtcaataccaaaccagcggcccagagaacgtattacgacgatttacgtgccacccttcacaactgtgcaaccaccgggccccaggctcagaaccatgcaggtcaccctgactttcaggcacacttaaggggccgcatcgcctggatatccgcaacttctgcccctcggggcgtaaagctcaaggagcttttcgacagaatcgattggagctga

SEQ ID NO: 13058 - RNA, 1089 nt, unidentified
  source 1..1089: mol_type = other RNA; note = synthetic construct
atgaacggggaatccgtgacatcagcctcactgctccagccatggcctgtgtggcgatggcccgtctccagatgggccagtttcgatgagtgtgcgggggcccttgatttgatgcccggcgagcttggatggttcgccgatgcgcggtcttggaatcgcagggccaatccggtgctacgtcactattcttaccgctggatcccgaccgctagtggcggcattcgcctgatcgaacgcccgaaacctcggctggccgaactccaacgccgggtaagacggcacgtgctggacgcactccccgttcacgaggcagcccatggttttaggacaggccggagcattctgacttgcgctcaaccccatgccggccagcagttggtggtgagaatggatttagaagcctttttccctactgtgtctgcccgcagaatccgagcactccttgagcttgcaggttaccccgctgccgtctccgcagcattagctggcatactgactaccgctacccccgcggatgtcctacgagaggctcctgctggtagaaggggtcctgttcgggcccgtctcctcaatagtctggcagctactcacctgccacagggagccccctcctcaccaagcgttgccaacgctgtgacccatcatctggacaggcgattggctggactggctcgtacccttggggcgaggtacaccaggtatgccgacgacctggcattcagcggggatgcaggcctgccactgcacagactgttgccaggcgtccggctcattgtaacaggagagggatttaggttgcgcgaggacaagacaagcgtagccgcagcccaccagcagcaacgtgttgccgggctcgtcgtgaactctgctccagctgcaacaagggcctcgtatgacgaacttcgggcggtgctgcacaactgcgctaggacgggccctgcagctcagaatagagctggccatcctgacttccgcgcgcatttactgggacggataggatggattgcagccacgagccgagccagaggggaaaaacttaaggccctatttgacagaatcgattggcacgccgagactgccggggactga

SEQ ID NO: 13059 - RNA, 1068 nt, unidentified
  source 1..1068: mol_type = other RNA; note = synthetic construct
atgaccggggagagagtgacgccagcttctctgctaggacccatgccagtatggaggtttcaagtcgccaggtggaccacctttgacgagtgtgcagccgccctcgacctgactccaggagagctgagttggtttgccgatgctaagggatggaatcgccgtgcagcggaaccagtgcgccattatacataccgctggatccccactgccagtggaggcgtcagactgattgaaagacccaaacctcgtcttgccgagctccaacgccggatagtacgccacgttgtggacgcccttcccgtgcacgaggctgctcatgggttccggaggggtcgctcacccttaagttgcgccgctccccacgctggtcgagaaacagttgtgaggatggatctggagggcttcttccctacagtgagcgctcggcgtatctccgccctccttgcattggctggctatcctccagccgttgcagaggcactggcaggcgttctgaccactgctgtgccgcctgccgtcctagcaacagtgccagggggaagaagggaccctgcacggacgagactgttgagcaacctcgcggccacacatcttccccagggtgcaccgtcaagcccttctgtcgccaacgctgtgacccaccatttggataggcggctgggtggactagcgcgagcgttaggagccacgtacacaagatatgctgatgacttagccttctcaggggattccctgcctctgcatcgacttctccccggcgtgcggagaatcgtgaccgatgagggctttcggctgcgcgacgacaaaaccagcatagccggagcgcaccagcgacagagggtagcagggctggtcgtcaattccgctcctgcagctactcgggccgactacgatgccttgagggccttgctgcacaattgcgccaggaccgggcccgaaactcagaaccgatccgggcacccagactttcgcgcacacctcctcggccggattggttggattgctgcgtcttcggaaagaagagctgccaagctcagggatctgttcggcggcatcacttggccgtga

SEQ ID NO: 13060 - RNA, 1074 nt, unidentified
  source 1..1074: mol_type = other RNA; note = synthetic construct
atgaatggggagaaagtgaccagcgcctctccccttggtcccttacccgtttggagatggcccgtggctcggtggacgacctttgatgagtgcgcggctgcactggatctcacgccagacgaactctcctggttcgccgatgctaagagctggaacagaagggctgccggacctctgaggcattataggtacagatggatccctaccgcctcgggcgggattcgtctgattgagcagccaaagccacggctagccgagctgcaacggaggctacgtcgccacgtcctggacgctctgcctgtccacgaagctgcgcacgggttcagacccggtcgctctgctatgacatgcgcagctccgcatgccggccgagacttagtggttcgcatggacttagagggcttctttccgacagtgtccgcccgcaggttgcgcagtctgctactccttgctggatatcctgaggccgtagccggtgcacttgctggcatgttgaccaccgcagctcccgtcgacgtgctcacagcagcccctgatggcaggagagatagtgcccgaactcgactcctgaacaatttggcggccactcatctcccacaaggggcaccatcatcccctgctgtggccaatgcagtgactcaccacctggatcgacggcttgcaggtctggccaacgtcttgggcgccaggtatactagatacgcagacgatctcgtgtttagcggcgacaccggacttcccctgcataggctcctgccaggagtgagagccatcgcccgcgatgagggttttcgcatcagggacagcaagacctcagttacagctgcgcatcagcggcaaagggtagcggggttggtggttaactccagtccagccatagccagagccgaatacgacgaactgcgcgccttgctgcacaactgtgcacggactgggcccggagtccagaatcggcatggccaccctgatttcagagcgcaccttctgggccggatcggatgggctggagcctcttctcctgcacgggcagctaaactgcgtgaaatgttcgaccgaatttcatggacagggtga

SEQ ID NO: 13061 - RNA, 1050 nt, unidentified
  source 1..1050: mol_type = other RNA; note = synthetic construct
atgctggatcccgtctggagatggccagtcgctcgatgggagacattcaccgactgcgccagagctcttgatctgactgaaggagaactgagttggtttgcagacgccaggacctggaatcgcagggcagacgctccgctgaggcactatacttacaggtggatacctacggccagcggaggcatcaggctgctcgaacgcccaaagccgcgtctagctgaactccagcgtagggtcgttcggcacgttgtaaatgctctcccagtgcatgatgccgcacacggcttccgggctggtagatctgccttaacatgcgcagcgccccacgccggacaagcattagtggtcagaatggatctggagggtttttttccatccgtgtcagccaggcgtgtgcgatctctactcttgctggctggctaccctgaggctgtggccttagcactcgctggtgttctgaccaccgctgcaccagttgacgtgattactggggcccctgatggaacacgggacgcttccagagtaaggctgctgaacaatcttgctcgaacccatctgcctcagggagcccctagttctcccagcgtcgccaacgccgtcacccatcacctcgaccgcagactggcaggtctagcccgggttcttggggctacttacacccggtatgccgacgatcttgcctttagcggacccgcggagctccctctccacagattgctgcccggggtgcgcgaaattgtacgcgccgaggggttccgcttgcgcgataacaaaacgtcagtggctgccgcgcaacatcggcaaagggtggctggcctggtggtgaactccgcacctgcggcagccagagcggactatgatgatctgagggcactgctccacaactgtgcccgcacatgtcccgcggcacagaatcgatatggccacccagacttccgggcatacctgttgggccggatcggctggattgggacagggcatccagcccgtgctgccagacttcgggcccttttcgaccgagtggagtggcccgacactttgcccggctga

SEQ ID NO: 13062 - RNA, 1074 nt, unidentified
  source 1..1074: mol_type = other RNA; note = synthetic construct
atgaacggcgagaaggttaccagcgtgtctccactgggaccacgacccgtttggaggtcgccagtccccagatggaccactttcgacgactgtgcagccgcccttgaccttactccaggagagctagcctggttcgcggacgcgcgatcttggaaccgtagagctgggactgccctgaggcactaccgctaccgctggttagccaccgctggtgccggaattcggttgctcgagcagcccaaacccaggctggcagaactgcagaggcgagtgtgcaggcatgtggtgggcgctcttcccgtccatgaggctgcccacggctttcgcagaggcagatcagccatcacctgtgcagcaccccatgcaggacgagccctggtggtgcgtatggatctagaaggtttcttcccggccgttagtgcccgccgggtaagaagcctgctcgaactcgccgggtatcctgccgcagttgcagctgctctcgctgggattctgaccacggctgcacctgtcgatgtgttagccgccgccccggatggaaggagagatcctgcgcgcacacgcctgttgaataacctcgcttcaacacacctaccccaaggatctccttcagcaccagccgtggcgaatgcagtgacccatcacctggacagacggcttgccggcttagcacgcaccctcggagttcggtatactcggtacgccgacgatctcgccttttccggtgacgctactctgccactgcacaggcttctgcctggcgtgaggttgatagtcagggatgaaggctttaggctccgggagtccaagacaagcgtcacggggacacaccagagacagaggattgctgggctggtagtgaattccagcccagcggcggccagaccggattatgacgctctgaaagcattgctgcataatcgggtacgcacaggccctcagccccaaaaccgcctttgccaccctgattttcgagcctacctgctcgggcgtatcgggtggatcgctgctagtcaccctagacggggcgagaagctgcgtgctttgttcgaccggatctcctggcagggttga

SEQ ID NO: 13063 - RNA, 1863 nt, unidentified
  source 1..1863: mol_type = other RNA; note = synthetic construct
atgaatggctctgggcccgacggtgccagagacgatgtccctagagacttcgtgtcacgcgactgcgccccacgcgatgaagtgagcggaggtgaagtgtctggcggagaggcatctggaggagcagcctcgggaacgctacccgcagctactgatgccgcaccagatgccgcaacagctgcggctgatgctgccgctgctgatgccgacgctgacgctgacgccgatgcagcaacggatgcagccgctgcaacagcggcagcagctacggacgcagctgctgctgctactgcagccgcagccactgatgcggatgcagccaccgctgcagccgctgatgcagacgtcgcagccgacgatgaaccagggcacgacatggacgagcttgcaccaggaccggcccatgccgaacatcctgggggtgcaccagaaccagccgagccagttgaaccggccgagctgatcgaacgcggcgattggcctgcactcatccagcggagcagggatcgagcccggacaaggtggagaagcaacgcagggcgttccgtggcagctgctttggctgggccatggcaacgcgatgctctggccgaccggttaactgaagaggcggggcattccgctgatgcggctgctgagctggccaatcgccttgtggagctcaatccttctcccccctttgggggagagaggcacttggccagattaatagccgatctaccccctctgcctgccccagcacctgttgcaccctttcgcattaccggtgggactgcagaaccccaagccggcttgtccgtagccgcaagggagtggcgatgggacgtccctcgttggaacaccgtaggcgagtgtgccgaggctctggacctgacagttggggagctggactggttcgccgatcggggaacttggaacaggagagctgcctgtccgctccggcattaccgatataggtggattcctacatcctcgggcggcgtgagactgctagagcagcccaagcctcgcttggcggaactccagcgaaggatcactagacacgtcctgagcaggctgcccgtacacgaggctgcccatggcttcagacctggcagaagtgccttcacctgcgccgcgcctcatgctggatctgctcgattggtcaggttcgacctagagggcttctttgctgcagtcgctccgggccggattcggtcattactgggtagagccgggtatccccgggcagttgctggagcattggctggggttctgactaccgcagcacccgtggatgtgcttagcgcggctcccagggcatcagatgatgccgtccggcacaggttacttcggggcttagctgccgcacatctccctcaaggcgcgccatcctcaccagcagtggcgaacgctgtgaccgcgggactggacgttcgactcgaagccctcgcacgagctttggacgcccggtatacaaggtacgccgacgacctggccttctctggcgacagcaccctgccactccatcgccttcttcccggcgtgagacgtatcgtgatggatgaaggctttctgctgcgtaaagggaagacaagtgtcacattcgctcatcagaggcagcgcgtggcgggactggtggtaaatagtgctccggccgtacctcgggaggagtacgacgcacttagagcgctcctgcacaactgcctgagaaccggtccagccgcccagaatgttcacggccaccacgactttcgcgcccacgtgctcggacgcataagctgggtgggagcgacacaccccggtagagctggtcgtcttcggaccgtgtttgacaggatctcctggcacgaaaccgacgtcaccgggagtcgccacggctga

SEQ ID NO: 13064 - RNA, 1305 nt, unidentified
  source 1..1305: mol_type = other RNA; note = synthetic construct
atgagtgccgtggagcgacgcgtagctgcgagacgtcgacaggcagaagagctcgccgctatcgccctggcaggtctgtgggagcagacagaattggcatctaggttggagggccactcccgcctagatggcgacgatgccagactgctcgcccagcgtctgctggagacattccctggaggtagtcccagcgttgccggctttgtggacgcgctcaggaggtaccctccccttccggtcagaaccctacctggctccgctgtcgtaccagtcgagccctggcctgtttggcgctgggacgtaccccgttggagaaccgtgagggaatgtgcccaggcgctggatctgaccgagggagaactctactggtttgcagacgcccgtggttggaatcggagagcccgagcctcactccgccattatcggtataggtgggtgcctactagatctggcggcgtgaggttgctagagcagcccaagccacgccttgccgagctccaacgcagagtggttcgtcacgtcctggccgcactgcccgttcatgatgccgcacacgggttccggaaaggccgatccgctgccacatgtgctggtccccatgcgcgcagggatcttgtggtcagactggacctggaagggttcttcgctgccgtgccagcaactaggctgcaggggctgctcgccttagctgggtatcctgccggcgtcgcccaactgttagcagggctgttggccaccgaaaccccagctgatgtgctttccgctgcgccacgggctggtgatgctttggtgcgcagaagactcctggagcatctcgcccggccacatcttccacagggagcaccgtcttcacctagcgcggccaacgccgtggcttgtcacttagacgtccgactggcgggccttgctcgggttcttggcgctacctatacacggtacgccgacgacctggcattcagcggcgatgcacggctggctttgcatcggcttctgcccggagtgcgccggattgcatcggacgaaggatttaggttgcgggatacaaagacgagcgtagctggggcacaccagcgccaacgagttgccggactagtcgtgaacacggctcctgccgcacctcgcgaagactacgacgcactcagagccaccctgcacaattgcgtgaggacagggcccgctgcccagaacagacatgggcacccggactttaggactcacctgctgggaagaatcgcttgggtgggatcaactcacccaggtcgggccgcgaaactcagggcattatacgataggataacttggtga

SEQ ID NO: 13065 - RNA, 1068 nt, unidentified
  source 1..1068: mol_type = other RNA; note = synthetic construct
atgagaacactgcccgattcacgcgccgtacccgtagagcctgaaccggtgtggcgttgggatgtggcacggtggcgtacggtggaagagtgtgcccacgccctggacctcaccgaaggtgaactatattggttcgctgatgcaagggggtggaatcgccgcgctggaacagccttgaggcactatcggtacagatgggtacctacccggtccggaggcgtcagactgttggagcagcctaagcccagactggcagagctccaacgaagggcagttcgccacgtgctgggggctttacctgtgcatgatgccgcccacggtttcaggagaggccggagtgcggctacctgtgctgctccacacgcgtccaaagatctggtggtgcggctggacctggaggggttctttgcggctgtatctgcagctcgcctccgcggacttttaaggctggccgggtatcccgacggcgtagcaacgctactggccggtctactgactacttctactccagttgacgtcctggctgccgcaccgcgaagtagggacgatgccgtgaggcggcgcttactgcataggctcgcagctcctcatctgccccaaggtgccccaagctcacctagcgcagccaacgccgttgcctaccacctggacgtccgactcgcaggcttggctggggttttaggggccgcctataccaggtacgccgacgacttggcgttttcgggggatgcgagattgcccctgcaccgacttttgcctggcgtccgtcttatagcgcgggaggaaggattcagactcagagactccaagacaagcattgcggccgcccaccaaaggcaacgagtcgctggactggtggttaacgctgccccagccgctccaagggcagagtacgacgcccttagagccattctgcataactgcgcacgcaccggaccccaggcacagaatcgtcatggccacccggattttcgggcccaactcctcggccggattgcttggatcggctcaacacatccaggccgagcagctagacttcgggccctctttgagcgcatcacttggtga

SEQ ID NO: 13066 - RNA, 1374 nt, unidentified
  source 1..1374: mol_type = other RNA; note = synthetic construct
atgcctagagtctccgaacctggcgacgatgaggccgctgacgttggcgactggagacagcgcggacgagcgagaaggcgtaggcgaactgtagagagacgacgccaagcccatcagctggccctactcgcgcttgaggggccttgggacagagccgatctgacagcccgcttggttaggggctctcggctcgatgatgatgacgcccggcacttgacggcgaggttgcacgagcgattcccggatgccccaccagatgatccaggtcgggtggccgcggctattcttgcactgccccctctgcccgtgaggacactacctggctctgttgaggccccagtggaacccatgccagtgtggcggtggccagttccccactggaggacactgggggattgtgcggaagccctggacgtggatgtcggcgagctccagtggttcgccgataccagaggttggaatcgaagagcaggcgccgccttgcgccattatcggtaccgctgggtgcctactcgatcgggaggagtcaggctgttggaacagccaaaaccgagactggctgagttgcagcgccgggtgacacgtcacgtcttagctgccctgcccgtccatgacgccgcacatggattccgcccaggcaggtcagctgctacatgcgcagagccccatgctgggcggagctttgtcgttcggctcgatttagaagggttttttgcagcagtgagcgccgctcgcgtcagagctttgctgcgactggccggatacccacccgcagtagcagctgctgtagccggactactgaccactacggcacccgctgacgtcctctcagctgcacctaacaccagggacagggaaagtcggcgcagacttctccggaggttagcagcaccgcaccttccccaaggagccccttcctctcctgccgtggcaaacaccgttgcccagcggctggaccttaggctcgcaggtttagcagctgctctgggcgcccgctatacccgttatgccgacgatctggtgtttagcggggatgctgatctgcctcttcaccgactcctgcctggcgtccggctcattactggggacgaaggcttcccgctcagggactccaagaccagtgtggccgcggcacatcaaagacagcgggtggccggactggtagtgaatgcctcacccgccgtgccaagggaggactacgacgctcttagagccatcctgcacaactgcgtgcgtactgggcccgctgcacaaaatcgggacgggcacccagacttcagggcccatctgctcggtcgcatcgcttgggtgggtgctacccatcccagacgtgctgcccgtctgagagcgctttttgcgcgcataagctggtga

SEQ ID NO: 13067 - RNA, 1248 nt, unidentified
  source 1..1248: mol_type = other RNA; note = synthetic construct
atggccctgcatcgagccaccgtggctttggacggaccctgggaaccagccgcagttgccgataggttggctacaaccagcatcgatttcgaagccgcacaggaactcgccgcccgactgtttgctctgtgcccatcccgaccgttcggccctagacaactggccaacctcctgcgctcactccccgaacctgcaccagcagagccaagcgcccctgatctgccaagtgaagccgcccctagagaatggcgctggggcgtacccagatgggagacacccgctgaggttgcccgggcattggatctaaccgtgggggagttggagtggtttgcagacctcgggggctggaaccgtcgtgcacctttacccgttcgccactatcgctgtcggtggcttcctggtggccgcagacttgtggaggcaccgaagccacgtctggccgagcttcagcggcggattagacggcacgtccttgaccgcatacccgtgcacgatgcagcccatgggtttcgccccggaagaagcccgcttacctgtgctaggcctcatgccggtcgggcactggtagtccggatggatctcgagggattcttcgcggccgtgagtgggtatcgggtgcgaaggatgctgtgccattcgggctaccccgatcaggtcgctgcagtcgtcgcaggtctactgacaactcgggcccctgtggatgtgctcggagagcctgacagaggcgatcccgctaggtggaggttagcgcgcaatctggcggcggaacacctgccacaaggagctccatcttcacctgccgtcgctaatgccctggcgtacggcttggacaggcgacttgccgggttagctggcactctgggtgctacgtatacgcgatatgccgacgacctcgccttttccggggacgcagacctcccactccatcgtctgctacccggggtgagaagaatcgctcgcgaggagggcttcagggttagagaggacaaaactggtgttgctgccgcccaccagaggcagagaattgctggactggtggtgaactccgcaccggctgtagctcgggctgagtacgacgaactgagggcactcctgcacaattgcgccagaaccggaccagccgcccagaatagggatgggaggcccgactttgctgcttacttgttaggtcggatcggatgggcgtctacaggcaaccctgcaagggccgcgaaactgaaggaaatgttcggccgcattccctggtga

SEQ ID NO: 13068 - RNA, 1077 nt, unidentified
  source 1..1077: mol_type = other RNA; note = synthetic construct
atgccggagcacgccagattaagaccagcgccaccaccagaacccccagcacctagaccctggaggtggggagtgccacgttgggctacaccggcagagtgtgcccgggctttagatctgacgcccggcgagctcgattggtttgcggacctcggcgggtggaatagaagagcggggcgacccctccgccattatagatatcgctgggtacccactaggaccggaggtgccagactcctcgagagtcccaaacctcggctcgcagaactccagcggagggtggttaggcacgtggtggccagatttcccctgcacgaagcagtccacgggttccgaactggccgctctcccgtgacttgtgctgcccagcactcaggcagagacgttgtggttcggatggatctggaagggttcttcacgacagtgagcggccgacgcgtaagggcattgttggccgccgctggataccctccacgtgtagctgccgttctggccggcttactgaccaccgcaactcccgctgacgtactggcagatgctccagcaggtcgtgacccggccctaaggtggcgacaggtcagaggacttgcgggtccgcatttgccccagggagcacctagctcccctgctgtggccaatgctgctgcacacaggctggacgtgcgattagcggggctggccagggttttaggagtggcctacacccggtacgctgatgaccttgccttctcaggggatgctgcggtccctgtccacaggcttgtccctggcgtgaggaggatagcccgggaggagggatttcggattcgcgaggccaagaccagtgtgaccggcgctcatcaacggcagcgagttgccggtctggtcgtgaactctgccccagccgtgtcccgtcgcgaatatgacgccctgcgcgcacttcttcataactgcgtcaggacaggtcctcgcgcccaaaaccgggatgggcaccctgacttcagagcccatctattggggcggatcggctgggcaggcacaggaaatcctcgtcgggctgctcgcctgagagcactgtttgaccgcatcgcctggtga

SEQ ID NO: 13069 - RNA, 1230 nt, unidentified
  source 1..1230: mol_type = other RNA; note = synthetic construct
atgacctctgctgatctgctgcatctggctcggaccgccttggatggagcttggaccaggcccgcccttgcgacaaggttagccggcatcagtttacacgccgccccgaaccccgaccctgaagatctggctgccagactcctggacctgagcccttctccttttttcgggccccctgaggccctagccagattgctggccgatctgcccaggcaggtggaacctgctgcagcaccacgacctcgctggagggctgatgtacctagatgggagactcccgctgacctcgcagcggcattgcgacttacaccaggtgaactggattggttcgctgatgcccgcacctggaatagaagagccgcgactcccctgcggcattatcgtcaccattggctcgggcacagaccccttgagattccgaagcccagactggctgagattcagcgtcgcctcaacaggctgctcttggctcgcctgccccttcatgaggcagcacacggcttcaggccaggcagaagtgctgccacattcgctgccccgcatgccggacagcctcttgtggcacggtttgacctcgccggctttttcacgtccataacagctgcacgcttgagggcctattttcggcatctgggctaccccggtaatcttgcagtggcgctgactggcctgctgaccacagccactccaccagaggtcctccgagctgccccacctggtgcacaacgccaccgtttagcaaccccacatctgcctcagggagctccttcctcgcccgctatagcgaatgccctagccgctaggctggaccggagacttgcaggcttggccgaacgcatcggggccaattacacccggtacgccgacgatctcgcgttcagcggggatctccctgtcgaccgcttgagggcaggcgttcgacgaatcgctgccgacgaaggatttagactgcacccaggaaaaactcgcattgcggccgcccaccagcggcaaaagttagccgggctggttgttaacgtgcggcccgctgtgtcacgggcagatcacgacaggctgcgtgccgtcctccacaactgcgcacggaccggaccagacgcccaaaaccatgtggggcacccagacttcagggcacacctccttgggaggatcggctgggtaggagcaacacacccggctcgagccgctagactaagagccatttttgacacgatccattggggtcaggcgtga

SEQ ID NO: 13070 - RNA, 1209 nt, unidentified
  source 1..1209: mol_type = other RNA; note = synthetic construct
atgctcacagaagcgcaggctgccgcagttcttgacggtccctgggatcggggaggtttagcggagcggctcgccgatgttatcggaccagtgcccgccgaagacctcgcagtgagattgctgggcctttctcctacagccccacctggcggggcacctagtttagtgagactggtcggggatctcgcactggagacacccccagaagaaccccgatggcggggtgaagtgcctcgatgggagactactggcgacttggccagggccttgggactcgacgtaggcgagttagcctggttcgcagatgcccgcgcttggaaccgtagggctggagagcccttgaggcactacagaacatggtgggttccctcgcggtcacatggccgtcgattgatcgagtcaccaaagcccagacttgcggagctgcagcgccgattagtgagacacctgctcgacaggtttgacgtgcatgacgccgctcacggttttcggaaagggcggagcaccacaactttcgctgccccacacgccggtaagcctctggttgttagactcgatctggagggcttttttacctctgtgactggcgcgcgtctgaggggacttctaacggcccacggctacccaatcaccgtcgctaccgcactcaccgggctgcttacaactcgcactccgcctgaggcgctgcatcctgctgactggccccagagacgcagattggctgcaccacacctgccacaaggggctccgtcctctccagccaccgctaatgtaattgcacgcgcactagaccgtcggcttgctgggctggccagaaccctgggagcaacctacacgaggtatgccgatgatctggccttcagcggcgacgatgatctcccgctacatcggctgttgccgggggtgaggggagtggtagaggatgaagggttcaggctcaaccccaggaaaactcgaatagccgcagctcaccaacggcagcggcttgcagggctggtcgtgaatgatacccctgctgccagccgcgcggaatatgacgacctgaaggccgtcctccacaattgcgctcggcatggcctggagtcccagaaccgccatcaccaccccgatttccgcgcccatttgcgcggcagagtcgaatgggtgagtgccggaaggcctgctagaagggcccgactgacagcactgctggacgccatttccggctga

SEQ ID NO: 13071 - RNA, 1236 nt, unidentified
  source 1..1236: mol_type = other RNA; note = synthetic construct
atgtacgttagagcccgtgggcaccgggagaacgaatccctgagagtggcagcaagcgccttggacggcccttggacccaagctgaaatcgctacccggttaatgcccctgtacgtggatcccgccgctgctgaggtcatggccgacagacttgtgagtcatagccccagggcgccattcggcggtattgcagacctcgcccgcctaatcgcagccttccctcccattactcaggcgccagcaccccccccaaaacctaaacgttccctggatatcgccgggctccttgacgttacaccttctgagctggactggctcgccgacgcaaggggatggaataagcgggccggaaagccgctatggcattaccggtcttggtggactggcacttccactggaggtttgagactcatagaggccccaaaaccgaggttggcagaggcgcagagacgcctagtgcgacacctgggccttccggtgcatgaggcagcccatgggtttcggaaagggaggagcggcctcacgtatgcagcaccccacagcgggaaacctgtggtggtccgcatggacctggaaggatttttcgcctctgtaaccggtgctcgagtcagagcgcttctgcacgagtatgctcaggctaccacgctggctggcctgctgacaacaagagctcctctggccgtgttaagagatgcgccaaagacatccggagatccagatgtgcgacgccgactgctcgctcacctcgctcaccagcacttgccgcaaggagctccatcatcgcccgccgttgcaaacgccgtggcctatcgcctcgatctgcggctgtcaggcttagctagggccttgggcgcccactacacccgatacgccgatgacctggcatttagtgggccccaaaccctgcccttataccggctcttgccaggtgtggctaagattgcgcgggaagaggggttcagggtcaggcctgataaaacttcagtaaccggccagcaccagaggcaaaagctggcgggcctcgtcgttaatgccagtcctgcagccccaagggccgcctatgacgaacttaaggcacttctgcataactgccgccgcacaggtccccaggctcagaatcgcgcaggccaccctgactttcaggcccatgtccgtggaaggattgactgggtagctgccggtcatcctgccagaggggctaagctgcgggctctgttcggacagatcgattggtga

SEQ ID NO: 13072 - RNA, 1206 nt, unidentified
  source 1..1206: mol_type = other RNA; note = synthetic construct
atggaaagtctccgggtggcagctagcgctcttgacggtccatggacgcgctccgcgattgccaccaggctgatctccttctatgcggaccctgctgccgctgagacaatggccgggcaattactggatcattgcccgaggccacctttaggtgacgccgctgacctggcaaggatgatcgcagcttttcccccaatgcctggttacgctccaccgccccctaagcccaagcgtagcctggacattgccgcgctgttggacgttactccctcagagttggattggctggctgatgcacgcggctggaacaggagggcaggtcagccactgtggcactatcgtagtcgatgggctgggacttctaccggcggccttagactcatcgaagctccaaagcctcggctcgccgaagctcaacgccggattgtgcggcacctggatttacccgtccacggagccgctcacgggttcagaaagggccgaagcgcggttacatatgcagccccacatgcaggcaaacccctggtggtgagaatggacctggagggattctttgcgtgtgtgacaggcgctagggtcagggccctagtgcatgagtaccagcaggcgtcagctcttgctgggctgctcaccacgcggacccctcttgaggttctgagatcggcccctccttcatccggcgatccagatgtgagacggcggttgctcgcccgactcgcttaccagcaccttccacagggagccccttcttccccggcggtagcaaatgccgtagcctaccgcttagatctgcgactggcaggcctcgctagggcactaggagccgactatacaagatatgccgacgatttggcctttagtggaccccagaccttgcccctgcacagattgctaccgggcgttagggcaatcgccagagacgaagggttccgtgtccgcccagacaagactagcgtgaccgggcggcatcaacgccagaaactggccggtctggtcgtgaatgcagcacccgccgtacctcgcgccgaatacgatgctcttaaagcactcctccacaattgccgcactacaggacccgacgcccagaaccatgtcggccgaaacgattttgctgcccacgtgagagggaggatagagtgggttgccgcaggacatcccgccagaggagccaagctgcggaaactgtactctcagataacttggtga

SEQ ID NO: 13073 - RNA, 1239 nt, unidentified
  source 1..1239: mol_type = other RNA; note = synthetic construct
atgtatgcgtgggcaagagggtaccgggaaaaccgctcactcagagtcgccgcatccgctttggacggaccatggacacagactgatatcgcaacacggctgagtgcactttatgccgatcccgcagcagctgaggtgatggccgatttgcttgtgagtcactcgccccgacagccatttggctccctcgacgaactggcccgacagatagccgccttccctccgcttccgaaaccacctgctcctgagcccccaaagccaaagaagagtctcgacctgcaagccctgctggacgtgaccgcaagcgagcttgactggctggccgatgccaggggctggaataagagagccggtcagcctctctggcactaccgtagcaggtgggtgggcacctctacaggaggactgcgcctgatcgaagctccaaagccacgcttagccgaggcccaacgccgcattgtccgccatgtggacttgcccgtacatgaggccgctcacgggtttaggaaagggcggtcagccctaacttatgccgctccccatgctggcaaacctctggtggtgcgaatggacctcgaggggttctttgcatccgtgacaggtgccagggtacgggccttactgcacgagtacgaacaggccgccacactggccggccttctaacgacccggactcctcttaaagtcctgcgcgcagctcccaccacatccggagatcccgatatccggagacgactgctggcccacttggcccaccagcatctcccgcaaggtgcacctagcagccccgcagtggctaatgcggttgcatatcggctcgattgcagactggctgggttagcgaaagccctgggggccgaatacaccaggtacgcggacgacctcgctttttctgggccgcagactctgccagtacatagattactgcccggagttgttatgattgcgagggatgaaggcttcagagtcaggcccgacaaaacttcagtggctcgtcagcaccaaagacagaagctcgcaggcttggtcgtgaacacggcacctgctgtccctcgggtcgaatacgatgcgctgaaggctttgctacacaattgcgttaagaccggtccacaggcacagaacagagcgggccattctgacttccaggcccacgtgcgtggaaggattgagtgggttgctgctggacatcctgcccgaggcgctaagctgagggagctcttctgtcaagtgacctggtga

SEQ ID NO: 13074 - RNA, 1254 nt, unidentified
  source 1..1254: mol_type = other RNA; note = synthetic construct
atgtctgtgaggcacctcgatctgccggtgcacgaagctgcacacggctttcgcaaaggccgatctgccctgacctacgcagcccctcatgccggaaagcccgtggttgtccggatggaccttgaggggttctttgccgccgtgacaggggctcgagtgagagctctgctgttcgaatacgaacaggccgtggtccttgcaggcctcctgacaacgcgcactcctcaggaagtgcttcgggccgctccagggacaaggggagatccagacgtgaggcgcaggttgttgtcacgcctcgcccaccagcatctgcctcaaggggcacccagcagtcccacgatcgcgaacgccgtcgcgtatcgccttgactgcagactaactggcctcgcgcgggctttaggcgccgattacacacggtacgcggatgacctcgcctttagcggaccccacaccttaccccttcaccgcctacttccaggcgtgcggaccatagcgcgtgacgagggattccgagtgaggccagacaagacctccgccgcaggtcagcatcaaagacagaagctggggggtctggtggtcaacgtcgcacctgccgctcccagagccgaatatgacgcagtcaaggctctgctgcataattgcctggcgaccggacctggtgcagagcctagatggccccaaaggttacgccgtgctagggcatggcctggtcgggttggtggaggtcgcactcgtggacagggatccgaggtagctcgggctctgcagccagataggctggtggtaccttatgacccgggagttgctgacggagccgccgattttgagatcggcaaagatgggctgaccgtaattattgtgggcgtggatggcagccccccaagtctccatgctgccgcttgggcaggcggtctagccagaagggaacgggcccagctggtcttggtctatgtagagcccatcgcctccccagcctactggactgcaatggggatggctggggcaacagaggctgcaactgctttcgtcgacgagataagagtggaggcagcggcctacctcgatcacgctggcatcccctgggagttggtgcactatcggggtgatcctgcccacgggttggaagccatcgccgaggaaagacgagcagactgtattgtggtaggaaggtcaagacatggggggggtctggtgggctcggttccaaaaatgctcgttaagggcgccaaacgaccggtggtcgttgttccatga

SEQ ID NO: 13075 - RNA, 1137 nt, unidentified
  source 1..1137: mol_type = other RNA; note = synthetic construct
atggccgacagactgttggctcattgccctcggcccccccttggtaacgctagagatctctctcggctgatcctcgaattccctccagaaccagtcctagtgatgccaccggtgccaagaatttggaggtggggggttccgcagtgggagtatacggccgacgtcgccgctctgttggatgtgactctgtcagaactcgactggcttgcagatgccggcggatggaatcgtcgcgctggcgaacctctgcgacactacaggccaaagtgggtagcgactagtacaggcggcataaggttgatcgaggctccgaaacctcgtttagctgaggcccagagacggatagctcggcacttgtctctccccgtgcatgaggccgctcacgggtttaggcccggacgttcccccctcacatatgcgcagccacacgccggaaaagcacttgtggtccgcatggatttagagggattctttgctgctatcacgggggcacgggtgagggcattacttcgaactgccggctatccgcaccaggtggccatcaaactcgcagggctcctgacaacccggactcccctggatgttctccgggacacacctcccacccaaggggatcctgatgttcggcgacggttgctggcaaggctgcctggacagcatctgccccaaggagcgccctccagtcctcagctggccaacgcaattgcctaccgactggactgtagactggcaggtctggccaacgtcctgggcgcagagtacacccgctacgccgacgacctagccttctccggcccacagaccctcccactgcatcgacttctgcccggggtgagagccattgctcacgacgaaggattccgtgtcagacccgacaagagcagggtgagcgcggctcatcaacgccagaagttagccggcctggtggtgaattcggcgccagcagtacctcgcgctgagtatgacgccctacgcgctctccttcacaattgcgttcgcaccggccctgaagcccagaatagggccggtcatcaggattttcaaagccacgtcagaggcaggattgagtgggtagcggccggtcacccagggagatcagcaaagctgcgcgccttgtacaggaacatcgcatggtga

SEQ ID NO: 13076 - RNA, 1299 nt, unidentified
  source 1..1299: mol_type = other RNA; note = synthetic construct
atgatttggcaagacgtcgctttgcgggcccttgccgagacagcagtcaacgcagacgcctgggaacaatccgagttggccgccgctctactgaggcacttccgcagggatgggggtgcaagcgatgctttcgcatggactctgctggcacacgtgccagaaccccctgaaagtgccgaggagctactagctctcctggtcgcagttccagagctgaccgctgcgcttccaaaagcccccaggcctgccctcgaggtcgaattatccccagggtggagatggccagtagccagatggcacacagctgagcagctcgcccatgggcttgatttggatgtgggggagctgatgtggttcgcagaccgggggggatggttacgccatgcccatcctccgctgaggcactaccggtgcagatggatgcgcacacgctccgggggaatccgtctgatcgagcagcccaaagcccgtctcgccgagcttcagcggaggatcactcgaagggtggtggacgccatgccagtccatgaggctgcccacggattccgcagaggacggagtgccgcaacttgtgcggccgaacacgcgggtcggcattttctggtgagggttgatgtagagggattttttgcctctctcacattcacccgcatttctagggcaatgcgtgccgctggttatcccggcgcagtagctggcgctataggtggccttctcacaactgccacccctcgagatgtgttagccgctgcgcctcgagtgcgggaatcggaagttgacgctaggcgacgcttgcttggaagactcgccgccgcacacgttccacaaggagcaccgtcatcacctgcgctggccaacgctctgatgcacagactggaccggcgtatagacgcttatgcagggaccttgggcgcaacctacacgcggtatgcggacgatctggccttcagcggcgatcgtcgcttacctgttgccgctctgctcagaggcgtcacggctattgtgagagcagaagggctgagactccgccagtctaagacccgcgtcttggcgccgcatcagagacagcggattgccggcctggtggtgaatgatggcagagctgtggcccccagagcggaatacgacgcactgagggcccttctccacaattgcgctaggactggcccccaggcacagaaccacgaagctcatcccgactttcgaagccacctgctgggtcggatcgcttgggtgggtatcaaccatcccggcagggcccgaaagttgggagagctgtttgaccggatcaattggtga

SEQ ID NO: 13077 - RNA, 951 nt, unidentified
  source 1..951: mol_type = other RNA; note = synthetic construct
atggatgactggctgcgcctgctgcgcattgacagtggcgagttcgcgtggtttgcagacgatcggggctggaaccgaagggctgccgaacctctcagacattatcgttatcgatggatgcgtacacgcagcggtgggttgcggctcatagaggccccaaaacccaggttagcagaggtccagcgcacactgctcagacacctggagctgcccgttcatgaagcagcccatggcttccgacgcggtcgtagcgtgcacacttttgcagccccacacgccgggcgggatttagtgctcaggatggacctcgagggcttctttgccagcgtcacggccaccagggtaagggcactggttggtgacttggctgggctggttactaccgccgcccctgtggctgtcttacgagctgctccccccgctcctgatgtggaggtgaggagaagactgctggacagactagctcgaccccatcttccgcagggcgcaccttcatcacctgctctcgcaaatgcggtcgcccatcggcttgacagaaggatcactgccttggctgatgttcttggcgccacctacacgcggtacgcggatgacctcgctttctctggcgatgccggactgccattgcataatttgctgaggggagtgagacgaattgccgcggatgaagggtttcaggtccgcccagacaagacccgcatcactcccgcccaccacagacagaggcttacagggctggtggtaaatgattccccggctgcgtctcgggctgaatacgacgagctgcgtgcagtgctccacaactgcgtgcacagtggaccatccacccaaaaccgcggaggccacgcagactttagggcacaccttctgggacggatcgggtgggtgggagaaaacagacctgcccgggccgcaaagctaagagccttgttcgatcggattacatggtga

SEQ ID NO: 13078 - RNA, 1278 nt, unidentified
  source 1..1278: mol_type = other RNA; note = synthetic construct
atggctccagatccgcacacagtcgctgcagccgctcttgccggaccttggcagctggagccactgaccgaacgactcgccgagcacggaaagtggaggtcgcctgaggagattggcgatgtcgttgctatcttgctcggaagatggcgtgctcggcctcgaaggccctttgaacgggtggtcactgaggtggaaggcttattggccgcaaggcctggaactaggccgcctgatctggagcccgacgtccctatatggcggtggccggtgcagcagtggacagatctggacgcgctagccctggggcttgatctcagggacggcgagcttgagtggttcgctgatcctggcgggtggttgaggaggactcccgctggaccactgcatcactatcgacgaagatgggtgactgccagatctggcacacctcgtctgctcgaaagcccaggaccccggctgcaggaactccagagacgcgtgggccggcatgtattggcgcggattccggtgcatgacgctgcccatggctatgtccgaggccgctcacctgcaaccctagctgccctgcatgccgggagagccatggtggtgaaagtggacttggaggggttctttggtcacgtaacgggagagcgtctggccggcctcatgaggatcgctgggtacccacctgctgtggcagctgcattggccgggctgttagttaccgccaccccagaacccgtactgaggtctgcaccagccgcagaaggcgcatgggaagcgagaaggagattgctcgaccggttagcagccccacacctccctcaaggagcacccacctccccagcagctgccaatctgctggcgttccgcctggatagacgcttagcggggcttgcagctgcactcggtgccacatatgggcgctacgccgacgacctggtgttctccgctgcgacactccccgcttcaggccttatcacgcggatcgggcgcatagctgaggaggagggttttaggttgcacgccaccaagacccgcgtccttcccagtcaccaccgccaaagagttactggactggttgtgaacgccgagcccggtgcagctcgtcgagagtacgacgcactgcgggccctgcttcacaattgcgcccggacaggtccagatgaacagaacaccgcggaacatcccgcctttcgggaacatctcctgggcaggatcgcctgggttagcactggtcgtcccagaagagccgatcgcctgagagccctattcgacgccattcgctggccctga

SEQ ID NO: 13079 - RNA, 1353 nt, unidentified
  source 1..1353: mol_type = other RNA; note = synthetic construct
atggatggcccttggcggcgggatgacctagctgaacgcctagcccctctgcgcggatggttaggccctgacgaggtgggtagaaccgtcgctgtcctgcttgcacgctggccaaggccacctacagcagcacctgcccaggtagcggccgaattggcacggctgctggctgcattgccaagacgcgggccgattgttcccgaccctcctcctcggccacaatggcgatggcctgtggccccatggactgatctggctgcgctgtcccacgctctgaatctgcgcgacgacgagctcaactggttcgccgatccaggaggctggttgcgtcgagctccagagggtcccctgcaccattaccgcagaaggtggactgcgagccgctctggagtccccaggttgctcgaaacaccagggccccggcttcaggagctacaaaggcgggtcgctaggcacgtgttggccagaatccccgtgcacgacgctgcccacgggtatgtgcgtgggaggagcccacacacacttgctgccgaacacgccggacgggccatggttctgaggttagatctcgagggttttttcgggcatgttacgggtgcccgagtggcaggcctccttagaaccgccggatatcctcccgcagtagccgcagcgttagccggacttctcgttacggcgacaccggcccatgtcctcagacatgcgccagcgggagaaccccatgcctgggaacccaggagaagactgctcgacaggctagccggtccccatttgccacagggcgcacctacatcacccgctgtggccaacctgctggctcatcgcctggaccgccgattggcaggcctgtctaccgccgtaggcgctaggtacggaagatacgccgacgacctcgttttttccggcgagctgcccgtgcatgggttagcagccagagtcaccgctattgcacgggaggagggcttcagagctcggactgacaagaccagagtgatgccgagccaccaccgccagagggttactggcctcgtggtaaacgcacgacccgccgctccacgtgctgagtatgatgccctgcgtgctctgctgcacaattgcgcaagaaccgggcctcaagcacagaaccgggatgggcacccggcctttcgcgatcatcttcttggcaggatcagttgggtggccgccggctctcccaatcgtgaagctcgactgcgagccctgttctccgagatagactggtcgtgcaggagtggttcacgggcactcatggtcggggtggacgtgctgctagtacggcagccacgggatggagtgcacgatctcgtgggatgtggccccgctgatcacccgtga

SEQ ID NO: 13080 - RNA, 1062 nt, unidentified
  source 1..1062: mol_type = other RNA; note = synthetic construct
atgcggcccgaggaacctgctgttcccgtctggaggtggcccgtgactccatggagctcactggatgccctgacgggaggattggatctgcgggcgggggaattggactggttcgccgaccggggagggtggttgcataggaggccagagggcccactgcaccactaccgcacaaggtggaccgcttcccgatctggagtgccacgcctccttgagacaccagcccccagactacaggagctacagaggcgcataggcagacgcgtgttggccagaatccctgtgcacgtcgccgctcacggttatgtacgcggccgtagtccgctgactttagcagcggcgcacgccggtcgagcaatggtagtcaggctagatctcgaaggcttcttttcccatgtgactggggatcgcatcgctggccttatgagagcagcaggttatcccccggccgttgcctcagcgttagctggattactggtgaccagcactcctgtgcacgtgctgagaggagcaccaccggctcctccagacgtcctggacagccgaaggaggttgctggaccgtcttgctaccccccacctgcctcaaggcgctcctacatctcctgccacagctaacctgctggcccatcggctcgatcgcaggcttgcagggctcgcagcagctgttggcgctgaatacggcagatacgcagacgacctcgtgttctccggtggagccagactgcccgcacatggcattgcagctcgggttaccgagattgccgcggaggaggggtttcgggtaagggcagataagaccagagtcctccccgctcaccacagacagcaaatcacggggctggttgtgaatgctcggcctgccaccccccgacgtgaatatgacgccctccgggccctccttcacaactgtgcccgaacagggcccgacgcccagaatagatcggatcatccagccttccgggagcatctgctgggacggattagttgggtagaagccgcgcatcctgctcgcggtgccagattgagggcccgttttgccgagatccgctggccagattga

SEQ ID NO: 13081 - RNA, 1275 nt, unidentified
  source 1..1275: mol_type = other RNA; note = synthetic construct
atggcaccagagcctcacgtgctggccgctctgttgccaggaccctggaccgttgacgctctcaccactcggattgctggctgccgaggttggggaggacctgacgaagttggggatgtggttgccgccctgttagctcggtggtcacgggctccaaccggcagacctgacagagtcggagcacaggttgcggcactgcttgccgctcgaagccgtcgtcgacacgtcgttccagagtccccgcctgccgatttagcatggcggtggccggtggaaccatggacaggactggacgctctggctaggggcctcgacttgaggcctggagagctggattggtttgctgaccgcggcggctggctccatcgaacacctgacggccctctccatcactaccgaaggaggtggactaccagccgctcaggcacgcccagactgcttgagacaccggctcctcgcctttctgaactgcagagaagggtgggccgcagagtgttagcccgcattccagtgcacgacgctgcccacgggtttgtacgcggtcgcagcccacataccctggctgcagaacatactggcgccgccactgtggtgcgccttgatctggagggcttcttcgcccacgtgagtggtgctcgggtagctgggctactaagggcggcaggctaccccgatgctgtagcctccgccttggcagggttactggtcacaagtacaccagcccccgtgcgtagagcagcacctgcaggaggtgatgtcggcgcccgtaggagactgctcgatcgcctcgcacacccccatctgccccaaggagcacccacatctcccgccgtggcgaaccttttggcccacgtcctagaccggagactccatggtctggcgggtgccttgggagctcggtatggtcggtacgccgatgacctcgtcttttctggggacagactccccgcccacggacttgtggccagagtcaccgctatagcagccgaagaggggttccgggtgcgtccagataagaccaggatcgcacccgcacaccaccggcagagagttactgggctggtagtgaacgctcatcccgcggtggcccgcgtagactatgatgccctgagggcgctcctgcacaattgtgcgcggacggggccagacgctcagaatagggatgggcatccggccttccgggaccatctgctggggagaatcgcgtgggccggatcaggacaccctgcaagggctgcccgactaagggccttgtttgatgccatttcctggtga

SEQ ID NO: 13082 - RNA, 1278 nt, unidentified
  source 1..1278: mol_type = other RNA; note = synthetic construct
atggctccaggtgcccaggtagtcgctgccttggccagacagggcaggtgggacactgtctcactgactgaccgactggctgtagccagtggctggtccggacccgaagagattgcgggagtggtcggccatttggtgggacggtggagacgggagccaacagtgccagacgatctgtttgccgcccaagttgcagagctgctagccctcccgaggcgccatctgagagtgggtgcaccccctgaacccgtttggcggtggcctgtcgccagatggaccgatgtagccatggtggcgaggggcttacacctcgacgagggcgaactggcgtggtttgccgacacaggcggctggttacgtcacgtgcccgatggaccgctaggccattaccggcggagatggacagcaagcaggccagggactcccaggctcatcgaagccccagctcctcgactcgcagagctccagaggcgtctgcttcgccgggtgctggatcgtatccccgttcaccctgccgcgcacggttacgtccctggaaggggtccacgcacgttggcccttctgcatgccgccagacccatggtgctgaggctggatttagaggggttcttctcccacgttaccggggcacgaatcgctgggcttctgcgcacagctggctatcccgaggctgttgccaccaccctagcagggctcctggtcacggctactcctcctgccgtgttaagagcttgcccccctgcagccgatcctcagccaagacgccggctgttggatcgcctcgcagctccacacttgccacagggagcccctaccagtccagcggtggcaaacctgctgacacaccgcctggaccggcgactttctggattggctgcggcagttggcgccaggtatgggaggtatgctgacgatctcgtgctcagcggagccgcaaatctgcctgtccacgggcttgcagcacgagtggccgctattgcccgggaggaaggatttcgcgtccgtccgggtaaaactcgcattgccccggctcaccatagacagcgcgtgaccggtctggtggtgaactccggctcacccgcagcctctagacgtgactacgacgatctccgggctttgcttcacaacgctgcccgaaccgggccagctgctcaaaatcgagccgggcatcccgcgttcagggagcatctggccggcagaatagcatgggtaggtggaggcaggcccagaagggctgaagtgctgcggagccttttcgacgcaatctgttgggactga

SEQ ID NO: 13083 - RNA, 1272 nt, unidentified
  source 1..1272: mol_type = other RNA; note = synthetic construct
atggcgccccatccagcagcagtagcagcagcagcctgcgctggaccttggggtactgatcccttaaccgaacgacttgcgggcttgggtggatggagtggccctgaggaactggcgggtgtggttggtgcactcgttgctagacgccggcgtgccccaagggacagttctgcaggggtcgaagccgaggtggtagctctgctggctggtccccgcagacatcgacgcgtcgagcagccagatcccgtctggaggctccctgtgcccagatgggctgatctgtcggctctggctacagccctccacctggatgacggcgagctggcatggtttgcggatcccggtggatggcttcgccacgcacctgaggggcctttgacccactatcggcggcactggaccccctctagatcagggacaccgagactgatagaagcccccgcaccacggttagccgagctccaaaggcggattcgcaggcgggtgctggacagaatccctgtgcacccagccgcgcatgggcatgtgagaggtcgcagcccacatacgctggctgctgaacaccgcgcccgacctatggtgctgcgtctggacttagagggcttctatagccatgtgacaggtggtcgagtggccggcctgttgcgtgtggctggttaccctcccgctgtagccgcaaccattgccggccttttggtcactgcaacacccccgggtgtactgcgtgcctgtccacacagaggcgatcctgctgcccgacggcgaatgcttgatcgcctcgctgcaccacatctacctcagggggccccgtcttccccaacggttgcaaatctactgacttacggcttggacaggcggcttagcggactagccactgccgttggagcggcctacggacgatatgccgacgatctggtgttttccggtgatgctgccctccccgtgcacggattgacacgccgtgtggctgccattgccgctgaggaggggtttcgcgtcaggccagacaagaccagaatcatgccagcccaccacaggcagagggttgtcggcctcgtcgtgaatggagacgcccctgctgcctccagacgcgatcatgacgaactgcgggccatattacacaacgctgctaggaccggtcccgacgcccaaaacagggcaggacacccggttttccgggagcaccttctcggacggatcgcgtgggtgggtcatggaagacctgcaagggccgcccggctgagagaactcttcgacaggatctcatggtga

SEQ ID NO: 13084 - RNA, 1218 nt, unidentified
  source 1..1218: mol_type = other RNA; note = synthetic construct
atgaccgaccccgaggccgtgctggtggctattctgcgggtgccatggcgcgaaagagcagtcgccgcagcggtaagagagattgtgggcgcccaaagagcacctgaactcgccgccagactgctggaaaggtggccagacgccccccgagtaacgcatgctgagatactggcgggcatcaccactgcccttggtaggaggatcgtgttggatccgttaccccctccaaggtggcggtggcctgtacagagatgggaggatgtggacgccttggctgctggcctggacctacgtgacggggaactcgactggttcgcagacacccgcgggtggttagctgatgggcgccttggccattatcgcaggcggtggcacgatcgccggctaatagaggcccccaagccaagactggccgaattacagcgccgcgtgggtcgtcgagtgttagcccatattcccgtccacgacgctgcgcacggttacgtacggggcagaagccctcttacactggctcgggttcacgccggccaagctctggtgctccgactggacgtggaggggttctttacccgcattggaccggcacggatcgcaggtttgctggccacggcaggttatccggctgcagtcgctcggacactcgctggattgctggtcactgcaacacccccaggcgttcttagggcagcaccagcccatgtggacgccgctacccgtgatagactacgcgctccacacctgcctcaaggagcccctacttcccctgccgtcgcgaacgtgttagcccacggactggatcgacggctcacagctttagcggccgccgctggagctagatacggaaggtacgccgacgatttggtgttcagcggggacaccactcttcctgtccagggacttctgcgtcgggcacgagatgttgccgcggatgagggcttcgccgttagacccgccaaaaccagggtcatgcctgcacatcatcggcagagggtggtggggctcgtcgtgaacgagacacccgcggtttctcggcgcgaatttgatgcactgagagctttgctccacaattgcgcccgaacagggcccgcagctcaaaatcgcgacggccacccagactttagagcccacctgctcggcaggatcggatgggttgccactggtagtccagcaagggctgagaggctgcgtgccctctttggcgggatctcatgggattga

SEQ ID NO: 13085 - RNA, 1191 nt, unidentified
  source 1..1191: mol_type = other RNA; note = synthetic construct
atgcgccctgatccggaagtggtgctcgcagcagtgctgcgcgtcccttggagggaggaagcactcgccgctgcggtgacaccggaagtcgctagaaggctcgtggaactgtggcctcaaccgccacgcgatactcacgccgccatcctggctggcattaccagatgcctcggccggcggatagtgttggatcccctgccaccaccacgttggagatggcccgtcgaacggtgggaggacgtcgatgctcttgccgccgggttggatctccgggatggagagctggactggtttgccgacgttagagggcgcctcggtgatgatgctcgcgctcactatcggaggcggtggcatgagcgtcgccttatcgagagccctaaaccaaggctggcagagctgcaacgcagggtgggacgcaaggtcctggcccatatccccgtgcatgacgcggcacacggcttcgtagctggcaggagtcccctgactttagccagggttcatgccggccgtgagatggtcctgagacttgacgtggagggctttttcacacgaattggcccagctcggatcgccgggcttcttgcaacagctggttaccctgccgccgtggcgagactattagccggcctcctggtgacctccacacctcctggagttctcagagccgcgcctgcagggacggcagttgaaaggctgagggcaccccatctcccccaaggagcaccgacatctcctgctgtggctaacgttttggcccacggacttgaccgacggctgtcagcgttagctgccgcagtcggagcgcgttacggtaggtatgcagacgacttggtgttttccggagacggcgccttgccagttcagggtctactgcgacgagccagaggggtagcggcagatgagggttttgccgtacgggcctctaagactcgcgtaatgccagcccaccatcggcaaagagtcgtggggctggtcgtgaatgctagccccgccgtgccaaggagggaatacgacgctctaagagcactgctgcacaattgtgctcgaaccggacccgccgctcagaacagagatggccaccccgacttccgggcccacttattggggcgcataggctgggtggcaaccggtcaccccactcgagctgcaagactgaccgccctgttcgacgccatttcgtggaacgggtga

SEQ ID NO: 13086 - RNA, 1239 nt, unidentified
  source 1..1239: mol_type = other RNA; note = synthetic construct
atgcgcaggaggcgaccagaccctgaagccgttttggtagcagtgttgcgcgtcccatggcgtgccgatgctttaaccgccgcagtggctggtgaagttggagccgacgcagcccctgaacttgtggcacgccttctggaaagatggccagttgcgcctcgcgacactcatgccgccattgtcgcaggaatcggcgcaagtctggggcagcgaatagtgctcgatcccctgcctccccctaggagacgatggccagtccagccctgggaggacgtggatgctctggctgccggcttggatctgcgagccggagagttggactggttcgccgatccgggcggatggttggataggtccgcgtctcccagactggctcattaccggaggcggtggcacgggcaacggttaatcgagacaccggccccacgcctggctgaactccaaagacgcgtgggcagacgtgttctggcccacattcccgtgcacgacgccgctcacggctttgttgccgggagaagccccctcaccttagccagggagcactcaggcaggcagtgggtgctgcgcctggatgtggaggggtttttcagccgcatcggacctgccaggatagccggtcttctgggagctgccgggtatcccgcagctgtagcaggcgctctcgctggactgctcgtgacgtctactcctgccgccgtgctgagaagagcacccgaacggcccgcagacgctgtcagagatcggttgagggcgccacatctacctcagggcgcaccaacaagcccagctgtcgccaacgtacttgcccatgggctggaccggcggctatctgcacttgcagcggctgctggcgctcggtacggtagatacgctgacgacctcgtcctgagtggcgatggcccactgcctgtccaagggctgttgcgccgtgccagagagattgctgcggatgagggtttcgacgtccgcccagccaaaacccgggtaatgcccgcgcatcatcggcagcgtgtggttgggctggtggtgaattcagccccgagggtgcctagacacgagtatgatgcacttcgagcactccttcacaactgcgccaggacaggcccagcccgacagaatcgcgacggtcaccccgacttcagggcccatctactcggacggatcgggtgggtggctactggatccccagcacgagcccagcggttacgtgcactctttgacgcgatcgattgggcgtga

SEQ ID NO: 13087 - RNA, 1266 nt, unidentified
  source 1..1266: mol_type = other RNA; note = synthetic construct
atgaccgaggaggctgagggggttctcagggacgttctgggcgtccggtgggaggtagctccactagctgccgccctggcagatagaattggggaaagggccgccggtgccgcagaaagactggttgaaaggtggccacaagcgccaaggggtacacacgccgatctggtcgaagagattgcagtgctactggccgtgcgcagacgactggtgcctgcagaaccccagccttcttggcggtggggtgttgccgagtgggagtcagtggacgcattaagtcgtgggcttgatctgcgcgatggagagacagagtggttcgctgatcccggtgggtggcttcgaagggcacctgaaggccccctccaccactatcggggcacttggcgcgtgtctccatcaggagcgccacgactgctcgagactccggctccacggattgccgagttgcagcgcagaatcgggaggagagtgctgatgcggatccccgtgcatcccgcagctcatggctacgtgagaggccgatcccccgccacttttgcagcggtacacgcgggtgctgcaatggtcctccgcgtggacgtggagggcttttttagccggataggcccagctcgtatcgccggtctactccgcaccgcaggatatcccgcagccgttgctgccgtgttagcagggatgctcgtgaccagcaccccgagagccgtactcaggagagcccctggcgctcctggagaagcacgaaggcgcttgatagaccgactcgccctgccgcatttgcctcaaggagcccctactagtcccgccgtcgccaatgtcttggctcacggcctggacagacggcttgatgggctggcgggagccgttggagccagatacgctcggtacgccgatgacctggtgttttccggcgaagcagatctgccggtccacggtcttcttcgcagagcgggcgaaattgccgctgacgaagggttcgacgtacgccccgacaagaccagggtgatgcctgctcaccataggcagcgagtcacaggcctggtggtcaatgccggccctgctgtgagccgtcgcgactatgatgacctccgggccctgcttcataactgcgctagaacggggccagacgctcagaacacggcaggacaccccgccttccgtgagtacttgttgggccggatcgcttgggcaggaacaggaaggccagcccgtagggatcggttagctgcgctgttcgcccggatcgacttcgggcaggatcgctcctga

SEQ ID NO: 13088 - RNA, 1203 nt, unidentified
  source 1..1203: mol_type = other RNA; note = synthetic construct
atgacagatcctgaagcagtcctcagggcactactgggcgtaccctggcgtctcggggcactaacccatacactcggggaggtcctgggtgaacgagcccctgaagtggccgctcgtctggttgaccagtggcccgaagctcctagagcggcacatgctgagctcctggccggcattaggggcgcattggggagacgcatagtggtggaggaaccagcccccgtttggcgttggcccgtagctaggtgggcttcggtggacgagttagccgccggactggatctaagagcgggcgagcctgaatggttcgccgaccctggtggatggttacggcgagctccggagggcccacttcaccattaccgcgcggtctggcgaggagatcgactgatcgagacacccggcccccggcttgcagaattgcaacggagaattgggcggcgcgtcctcggtagaatcccggtacacccggccgcccatggatatgtgagaggccgaagtcctttcactttagcagccgagcacgccggcagggctatggttgtgcgcctggacgtggaggggttttttaccaggattggcccagcccgcattgctggactactgcgggcagccggatatccagctgctgtggccagagtgttggccggcatgctcgtcgccagtaccccaagagctgtgcttcggaggggtccatccagccaacggcaacggctcgcacttccccatctgccccaaggcgctccatctagccccgctgtcgccaacctccttgcacacgggcttgaccgcaggttggggggtttagcggctgccgttggggctagatatggccgctacgccgatgacctggtgttctccggagatgagctccctgtgcacgggcttgtacggcgcgtttcagcgatcgccgctgcggaaggattcacgctcagaccggataagactcgcatcatgccagcgcaccaccgtcaaagggtgaccggcctggtcgtgaacgctactcccgcagcctctcgcagggactacgatgacctgcgtgccctgctgcataattgcgtgcagcacggacctgacggacagaatagggaagcacaccctgcctttcgggagcatttgttagggcggatagcctgggttggtgctggccgaccagcaagaagggcaagattgcgggagttgtttgataggatcgccttctga

SEQ ID NO: 13089 - RNA, 1305 nt, unidentified
  source 1..1305: mol_type = other RNA; note = synthetic construct
atgaattggctctctctcgcacagcgagctctggacgggccttggctacaagggcccctagccgaaaggttaggagatgaactggaccccgccgccgctgagaggttagcttcagccgtcctcgcacatcggcctagaatgccctggacagagcaggccagattcgccagggaactcgccgaaattccagacgtggtggcagctttggcaccagggaacggtaggggacctcgcgttctggtcagcccagaatggaggcctgtttggcggtggcctgtgccagaatggacgactaccgagcatctggctcacgcgctggatctcaccccgggtgagttggcctggtttgccgactctcgaggctggttgcgaagacaccggggagggcctttacctcactaccgccacagatggctgagaactcggggtggagtgcctcggttgctcgaggctcccaagccgcttctggctgagcgccagaggcgactgctgagacacctgctgcgagctatccccacccatcccgctgcgcacggttttgcgaggggacgtagtgtactgacttttgcaaggccacacgcagggaaagatcttgtcctgaggttcgatttagagggcttcttttcgtgtatcggagcagcccgtgtggcaggccttatgcggtgggctgggtacccaggacctgtagccaccgccctgacagggctaatggttactgccactcccccgccagtgctgagagaagccccacctcctgcagggccaggtcaggttgacgctcgcagacggcttctgacacgtctcgccggcacacatctcgcacaaggagcacccagcagccccgcactggctaacctggtggcctattccctcgatcgccggcttagtgcgcttgcgagggaacgcggccttgcctacacacgctatgcggacgacattgctttgtccggcgaccatgctacaagcgtgccggccttgcgcagagcagtctcaagaattgcccgagatgagggcttccgcatacgggccgacaaaacccgagtgatgccctctcacaggcggcagagactgaccggcctggtcgtcaatgccgagccagctgtagcccgggatgagtatgacacactccgcgccctattgcacaactgcgcaagaaccggccccactgagcagaatcgcacgggtcaccccgatttcgccgcccatgtgaggggacgtatcgcttgggtggctgcaacgcatccaggtcggggtgagaagctgctcgcccagtaccgtgcgatcaggtggcccaccccttcctga

SEQ ID NO: 13090 - RNA, 1443 nt, unidentified
  source 1..1443: mol_type = other RNA; note = synthetic construct
atgtcagtgaggctctttgccgaaaggaagcacatgctgagcgcctccgatacacctccccctccaaaagatgccgccccacttgctggactgagccgatctatcgcggacttcttgctctactccctagaacaaggattcgctctgaacgccaaagccctgagggagcgtgcaagggcccactttttcgatgccagcgagatcctcgaggctgtttatgtagaactggaatcagatgagtggccttggagaggccagaccgcagatgtgctggcgcagagaattctggtcagtgaggcgttattggatctgcaggccccgatagatgaagatgagctgtggtacctggacgacgaaacccttgcctcttataagacacagcacgaatcttacctcttcagcctgtcgacaatgcctgtttggaaaccaccatctgtcaggggtcacgcctggctacattcagcccgaagtagcgtaccatccctggagtccgtttctgacattgcaacctggttgaatgtctcacgcgacgagtgggacggcgctactaacgcgagtaagtaccgtcttcgcgtgcaccgcaagcctagtgggaaactacgcctcctggagatccctccggaaccgaaacgggtgctgcagagaagactcctgcaccgcttattagaccatgtcgcacctcacgaagccgcacacggattcgttgccggacggtccgtgcatactcacgcctccctgcatatccagcaacaggtggtgattcggctggacctcgctgacttcttcgcaaacacactcgctgctagagtgtttctgctgttccgggctctcggctttgtcgcacacgtggccaacgccctgaccgcactttgcacgaccagtcaaagccgggtcagcctcaggggtgcattgggtgcagagtacttgaatgggaatcggtatgacatctattctgttaaccatctcccccaaggtgcccccagctcaccagctcttgccaatctgtgtgcgcatagtcttgacgtgcgcttaactgctatcgccggccagtttggagccatatacacgagatatgctgatgacattgtgatttccgggtccggcgaaattgcagctaggcccagaaagtttataactctggcccgggagattatcgctgatgagggctggaggcttaaccccgataaaacccggatcatgcgtaatactggcaggcagagcttcaccgggctggtggtgaatgaacgggtcaacgtggctagagacgagtttgaccgcatcaaggctgcagtacatcgcgccaccagggacgacgttccccatgtacttgggctcttgtcatggctgaagcagtcctctcccgagagagccgctaagttacgacagaaattgctagcacgaaatgatttgacagatgtgcgatctgcgtcgaagacacgttga

SEQ ID NO: 13091 - RNA, 1416 nt, unidentified
  source 1..1416: mol_type = other RNA; note = synthetic construct
atgagcgccaacgaagatacatcccccgatgactcacgcactccccttctggcattcgaaagattcgcgaggtccattgctgagtttctgttgtacagtcatcgagagggctttcagctctccgtgtctgctttacgtgcaagggccacgagacatttcggaggacacgactacctggtgtgcgcgataatcagggaggtgatcgatgacgtcgccggctggtgtgatttgccccccacaactctcgcccagagaatcctcgatagctcagcactggaggaactggtggcgccgtttgtggaggacgactactggttcctcgatgacgacgctctgttggatcttcggtcggcccaggccaggcgtgttgctgatgctgcaagtctcgccgcatggcttccaccccctcaaaatggggctgaatggctaagggaggcccgtttgataagcccttcatttgcaacagtggtggatttagcaaggtggcttgacgttagtccagaggaattcgatgcggccatggccaaccgccggtataggctgcgcgtccacgcaaaaccctctggagggactagactgatcgaaattccgcccgaaagtctgcgcgtcttgcagagacgcgtgcttcaccgactgctggatcgcatttccccccacgcagctgcccatgcctatgtgagaacccgctctgctcacactcatgcagcccagcacgtcggtcgagaaatggttgttcgtctggacctccgcgacttctttccttctatcaagggagcccgggtctttctgctttttaggagcctgggtttcgcagctaatattgctaacgttctaaccgccctctgtgtagcgagccaaagcagagcttcactgcgaagagccttgggcgccgcacacgttgctttcttcgagaggttcagcgccaatcacctccctcaaggcgctccaacatccccagcactcgctaatctctgcgcccattccctggacgtccggctgaatgcacttgcagagtcctttaacgctacctatactcggtacgccgatgacctggtctttagtggtgacgagggcatagcctctgagccacgagaattcgtgtgcttagcgcgggccatcgtgagcgacgaaggctttcagctaaatacagagaaaacgcgcattatgaggaagtccgctcggcaagccttcgccgggttggtagtaaatgaaaagatcaacctgccacggtgtgattatgaccagctgaaggctgccgtgcacagggctacccttcggagtacctcagaggaggtgtcaaaactcctggggagaatcgcatggctgcggcagaactctcctcatagagccgacaagctgcgatctaaactaatttcgagcttaccaaaccagtccgcgtctcctaccgccccttga

SEQ ID NO: 13092 - RNA, 1470 nt, unidentified
  source 1..1470: mol_type = other RNA; note = synthetic construct
atggttatcgacgctgctccaccttctcccgaatggcttgccgcccagcttgctgccctttttagccacgcggtggcccacggctacagcttgaagcctgccactctcgcacggcgatctagtaggcactttgccggagcttcaggcatcgttcgacatgtcgccagagatctccagaagcgcggtcagaccgggaacgattggactaagtggcctacagaggtcttggctgacttcatactcaagtcaaatgcgtttgtgccactcgtggatggctacgctgttgttaccggcgaagtcgagtccccaaaatacgagactgagccggacgcggagatcatggcccttctggcagagaatcctgaagcgctggctgcatggctggagcgggacgaagccgacgacgtacctctgtatgccccgtttgtagccacaaggcccctgcctgaggtgatgcccaacttcgccgccacgttacccgcactgaacggggtcagtgatattgcccggctccttgacgtatcccgagaagaatgggacgacgcattagctcggtctaggtatcgcctgcgctgcgtgagaaagtctagtggaggcgtgcgtctgatcgaaatcccgtcagaggctttgagggtcctccagcggagaacattgcatagactgctcgggcgcgtgtccgtccatgatgctgcacacggctttgtgcgaggtcgctccgtgcacacccatgctgccgctcacgttggtcgcgatattgtgattcggctcgatctcaaggacttcttccccagcatctcaggagcaagagtgttcctgtttttccggtccttgggctataacgtacgtgccgccaacgcccttactgccttgtgcgtggcctggcagacgaggagatctctgcgagatgggttgaaaacattggcgaccaccacagatattaacgctctcctacccaggtacagtgttgcacacgttccacagggcgcaccaacctccccagctctggctaatctgtgtgcccggtcattagacttaagacttgacgcatgggcaaagtcgtttggagcaacctacactagatacgcagacgatctggtattcagcggcgacgcagccctggctaagtcttggcgcgccttcatcgctaccgcacgtgtgattataggggaggagggatgggagctgaatgttcaaaaaacaagggtgatgaggcgttctgtcagacaagtctttaccgggctggtggtgaatagccgcgtcaacgtggcccgggatgaattcgatgccctcaaagctagcgtccacagattctgtaaacccgacgcgacagccaatgcggatgagctgcgagtgctgctagggcgggtggcatggctaggacagagccatcctgccagggccgaaaagctgaggaataaactgtatgcctccactgacagtcgcgcagatacgaacggtgacgcggcttga

SEQ ID NO: 13093 - RNA, 1461 nt, unidentified
  source 1..1461: mol_type = other RNA; note = synthetic construct
atgccggctaccgtgccctccgagactacacctcctccagaagttgacgcgatcgcagacgctctggcagccttcatgctggccgaacatacagctgggcgctcactaactgcccgagcgctcactgcacgtgctagcgcacgcttcgtcggctgcagtgcccttcttggagctgccagacgagacttggccctgcacgcggagctagcttggccacactggtccgccgcacaattggccgctcgaatccgtaagcttcccgcctttgaacgcctcgtgacccagagtgtgctcctgaccgccgctatcgaggacattaccgctactctggctcacgcggcagatgagaaggaacggggcgaacacgccgattgggtggctggtttgcaagcaaggcgggcacgtttacaggctgacctcccaaggatttggccagtggcagctaccgctgggtctgacccacccagggttgagagcgggcttcagcctctcgccgatctggcaaggcggatcgaaatctcggaagacgagctggatgccgcccttagaacctccagaactcctcacgccttccgccttctcgtgatgcgcaaacagtccggcggcttacgggtgatagagcaaccccaggacgcgctgagggtgttacaaagaagagtgttgcgggaggtactggcgaccgctgatttgcacccggcggcacacggttttgtcaggggacggtccgctttaactcacgccgccctgcatagcggtagacggttagtactgcgactggacatcgccgacttttttacatcaattaccgctgggagagtacatagtgcattcttgcgcctgggaatgccccctagggtggcaactgctctcacggccctgtgtacatctgtccagcgggctggagcattgagggccgcattgcggcgacatgatgccttcgcaagccagacacgcattgtcggccacgtacgcgattggcaacagaccctgtgcgtcccccatctacctcagggagcccccacatcacctgccctagccaactggattgcttaccgcctcgacagacgtcttagtgggctcgcagcggcctgggatatgcggtattcaaggtatgccgacgatctgactttttctaccgacgcctctgattgcaatagcctgcgcttcgtcgatcaggtgagaacaatagtggctaccgagggctggctgctgaacgaacggaaaacgctggttatgccgcagtctaaccgacagagggtgacgggtatagtggtcaaccagacaatgaatctgtgtagacaagactacgacgcactgaaagcagccgttcacagacatgttaatgccccaccagatgacgctcagcgcagccagctccttggcaggatcgcctggctcgcccagtttaggcctgagagggccgatcggctgctccataagctgcgttccgcgcccagatga

SEQ ID NO: 13094 - RNA, 1362 nt, unidentified
  source 1..1362: mol_type = other RNA; note = synthetic construct
atggccgctgttcacgccctcgcccatgccatcgcatcagcattccttgatggaccatgggtcccaagagagatggcacagcgggctacatatgctgtccgcggggtgcgtaccgaaaccagagtggggctgcatctcgtgattccacacgaagccgtccggactcggacttggctgccagcactggctagggccaccgtcatgagatttccagagcccccccatgccaccctcgatgcattggccgtatggattggggaccaagattctctggcccgccacgcccatatcactgtggtacgggctattgctctgcctgccccagcgatgagtacaatgaggggagcgttagctgacctgggcgtgccttcgatcaccacactgcccgagctggcagcgcaaatcggcacttccgtggctgccctggatttcctcagcagagcccggccacgggaaattgtgcgaccgcaacaccgcactacactgctaaggaaacagagtggtggccttcgggttctcgagataccctctccgcctcttgcaagagcccagcgtgcaatccttgacgcaatcgttgcccacgtgcctatccacgacgcagctcacggattcgtcaggggaaggtcccctagaagcgcagcggtccgtcatatgcaccgcgaggtggtggttaggctcgacctcgcagatttctttttgagcattactgcggctcgtgtgcgcggcgtgttcagcagaatggggtaccccgacgtaatagccgctagattaacacggttgacaacgaccgcgacacggcccgatgtgatcgcctctcttaggacccacgtcgatcatgcttccacgcatgccctggcgcagcgactaagaaccccacacctcccgcagggcgctccttcatctcctgccctggccaatttggtggcctaccatctagacgcccgcctggctggtctggcacgaagatttggggctacatacacccggtatgctgacgatctaacgttttcaggtgatgctagcctctcccaccacgtccgcgggttagtgcgaagtgtcgtggccatatgtcgagacgagtcctttggcgtgagacatgacaagactcgggtattacgccgacacagacgccaggacgtcctgggtgttgtggttaatgataggcctaacctggcaagggaccgttatgacctgctccgcgctgtactgcatagggttgccagggaaggctgggaacgggcagagattgacggacagcccattggcccctcagcccttgcgggacatgttgcccacgcttgcaccttggtgaacgatgcccgagccaggaagttgcgcgcaatgctggccaggctgccctga

SEQ ID NO: 13095 - RNA, 1227 nt, unidentified
  source 1..1227: mol_type = other RNA; note = synthetic construct
atgcttctccggagcccgtgggaactgtacgctctctgggcagcgctggacgaggcatttggaagaagaatgccgtttaccagacagctcgcaatggaagcactccgggttggtcgggtcggggaggaacgtttggctcgcggtctgagggaagggagggcatttagaggcctgttgcgagacgaggaaccactcaggctggtactgtgggatctgcctgtgacccagatgcagccacccagggtgcctctacattgggagcctcccgagctgcccacagatgacgcgctggctgcctggctgggattagaactcgggcccttgcgagcattcgcggatctacaagatagagccagacatcaccctccagcctggcgtaactatcagcaccgctggatcggccgaaggcttatcgaggcccctaaggcccggctcaaacacgttcagcgtcgcgtcctgcacggcatactcgacgccctggtagtccatccagccgcccatggattcgtgagaggcagagatcgcagatcacatgccgccccacacgtcgggcatgaggtggtagctcgcgtggacctggccaggttcttcccgagtatccaccgacggcgcgtgactggcctttttgaggccatgggctatcctagacgggtggcaaggctgttggctgggttgtgcgccgctaggactccacctgacgtggtcgaggctggtccagcagatgcacctgtgaggtatgacgccccacatctgccccaaggagcacccacctctccagccgtggccaatgctttgtgctggcggctcgaccagcgactttccgctcgtgcaaccgcgtccggacacgtctacagcaggtacgccgacgatctgactatttctgggccccggcggggtatgagagccttagttgctgccgtgcaggtgatcgccgcggatgaagacttcgtggttgcagccgacaaaacgagggtgatgcaccagtcggagcagcaacgcgtcacaggcattgtcgtgaatgcacagcccggagttccccgacgcgaaagggaacggctggaggctattcttgtgaactgtggccgcacagatcctgctgcacaaaaccgggacgggcaccccgattttgcggctcacctgagaggacgtgtcgccgctgttggcgccgtgaatgctcgccatggcgagaagcttctagccttatggcaggctgtagattggggatga

SEQ ID NO: 13096 - RNA, 1314 nt, unidentified
  source 1..1314: mol_type = other RNA; note = synthetic construct
atgcacgccgctacgttttgtgctctccttgccgaagcattcctggccggcgactggcaacccgcagatatggcgaggcggggatcagccatgattgacgcagcagggtcccagaggaggtggatgcgcagactggctggtagagtggccgaaagcctaccacggggagagcatctgactccagcccgcgtggcgtcgtttgttgaacgggatctgggatttcgacgcgtctggagtacttggttgagttcctgtaggattcggcagaggttttgggtccaccccactatggggcctagccagctcccactggaagcagcgttaccccaggtcgcaacagcggggcaactagcagactggttgggcgtgggagtgagcgaactggccgggttcgcagacctccagggaaggcacttaagagccagtgcccgcagccggcgacattatcgacgtcgctggcgagagccaagaagcgtagccggcagtcctcggcttctggaggctcctaaggaccgcctgcggcgattgcagaggcgcatactgagggggatcctgtctcaggtccaggtccatgacgctgctcacgggtttgtgcccggaaggtctgttcactcttgtgctgcacggcacgcttgcaggccggttctagtccggatggatctctcagccttcttcaccggcatcgatggccgtagggtggctggtctgtttgaggcaatgggcatcccgaggactgtagccagagtgctggccggtctgtgcacaaccgctactcccgccgatgagctcgctgcgttagcccacacctggtggctccgggtcttgtatgcccgaccgcatttaccccagggcgctccaacaagccctgcccttgctaacctgtgcgcattcagacttgacgcgcgcctggatgcattcgcccgttcaaagggctggagatacaccagatacgcagacgacctgtacctctccgggcccgatcgacctcatcggctcgttagaatggtgcatagaattgcccgccaagagtccttcacagtgaatgcccggaaaacctccatcatgcggcctggtcgcgctcatagatgtttgggcctttctgtggaccgtcaaccagctgtaccacggcagctgagagagcgccttgaagccatattgacgaattgcgtgcgtcacgggcctaacggacagaaccgagaaggccaccccgattttaggcgccatctggagggaagagttgcctgggtgaccgctgcctgcccaagacacggtgaaaggttcgccaggctcctggaggagatccagtggccttga

SEQ ID NO: 13097 - RNA, 1353 nt, unidentified
  source 1..1353: mol_type = other RNA; note = synthetic construct
atgattagccatcttccccgcggcataccaggggtgccaactagcatgcacgaccaccggcaagctgcagatcccgccgttcgcagagccggatctcagggaacagaatccgaggtcagcctgcatcaccctctgatcgacgctctcgcggacgctttgctggccgttccgtgggatagggaagcccttcagcgggggtttagagaggtgctgggcggttacgaccccttagcagccggtttagccgcacggctgtggacggatgctaggccagacaggggtgaggcagtgaggctgctcgtcgaagacgtagagctgcggcgccttctccaagggccagttgtagcccggagaagggcgtggcatttcccagaggaggacccggcacctcttcgattcgagggactgccggagctgcctgatgtagcggcactggcccgctggttaggctggtcagtgcccgtcttgctaggccacgccgatctgcgacatgaccatcggcgccgagccgaatacagggattatgtctacagatggcatggagctagacttatcgaggcaccgaaagaccggttggctggtggtcagagacgtatactgcgggagctgctggttcacgtccctttgcacgacgccgctcacggctttgtgagaggcaggtccccaagaacacacgctcggctccatgtcggctgtgctgtggtggtacgggtggatctagagcgcttctttgcttctatcaccgccccccgagttagggggatgtttcgggcactcggatatcctcgcagggtggcgtctcttctagccggcctgacaacatcatggcccccacctgatgttgtgcccggaggatccccatggagtgcccctcacttgccacagggagcccccacttcacctgccttggccaacattgtctcccacgggctggacagacgtctccaagggcttgctcgacatcacggcgcggcttactctagatatgcagacgatctgaccttctccgggcgtgcattgccttcgtcactcgtgcccaccatcgagcagatcgctgtgagcgaaggctttcgggtgcgcagatgcaagacgaggcgtatgggagaaggggctgcccaacgcgtaactggcctcatcgtcaatcgacacgtggccgtgagccgcagagaacgcgatcacctgagggccctgctgcacttagcactcacccgcggtcccgccagtgttcgtgtcgaaggcgtggacgatgtgaggagttggctccgggggagaattgcttgggtggcacatgcccgacctgcacatgcggaaaggatgctggaggtcttccatcagattgcctggaccgcatga

SEQ ID NO: 13098 - RNA, 1365 nt, unidentified
  source 1..1365: mol_type = other RNA; note = synthetic construct
atgcttgacgtcctcaggcagggtcgaccagggccatctcctttttgggtgggacttgtggcccgggtgagagacgcattcggacccacttccccccccccaaccctagacgcattaactaggatgctggcggaggacccaatcttcgatgaggactaccgggcagagatggccctgctcacagaggccgacgggtggaagaccccaccctacgtggatcgactgatttttcgccctgtgggatctaggttcaggccaggggcagcagctgcagaatggccagtccccagactggaaagtgtgcccgaattggccgcccatctcgaggtacccgaggctactctggaaggatgggctgacgttggcgggtggttgggcaggtatccatcagatcggcgccagcactacgtgagaaggtggatacctggggtgcctggtagaagatctcgcccaacccccctacgtagagctgcccctgggtgtgccccctgtctcagatcaagcggtggctcaggtccgcgcctcattgaggctccaaagacacagctggccaaaatgcagagaaggatccttcgcagcatcctggacctggtgcctgtacatccggcggctcacggatttgttcgggggcgaagcattcgcacgcacgctgcacgacacgtgcacatgcaggtcgtgctccggttcgatctgaggcgcttctttccttcagttcaggcaccgcgtgtccagggcctatttcgctacctggggtacccagaagaggttgcccgtttgctcgccggactgtgcacaacaatcacccctcatgacgtttttcccccccggactgcggctgatgtccgtcaactgtatcgccagagacacttgcctcaaggcgcgccaacctcccctgccttagccaacctgctctgcctgggactggacagaaggatgatgggcctggcaagggccttcgacgctggctattcccgctatgccgatgacttggtattcagcggaggcgctgcccttgctgcacgatcgagaaggtttggaggattcgtggcccgcgtcgtggaagaggagggctttctgcttaaccatgataagacgcggcggatgccccggtctggtagacaagaagttaccggcttagtggtgaatcaggggcctgcttacccgagagatgagttcgatcggttaaaagccatactccaccagtgcgcactggatggccctgaaaggcacaatcgcgagggccatcccgattttcgtgcccatctgcttgggcgggtcagtttcgtggaatccgtagacccgagaaggggcgcgaaattgagggtccggttcgagcgaatccggtggggtagcagtcaacgatga

SEQ ID NO: 13099 - RNA, 1242 nt, unidentified
  source 1..1242: mol_type = other RNA; note = synthetic construct
atgagccacgctgtggctgcagccatcgctctagccctgctagagccagagcggtggcgatccggagttagggcaagtttggaatcttttgaaggcctggacgccgaatctcggaccgccattgggagactcgtaaagtccctttacgtccgacctgaagtggacgagctcgctgccctcatcgcaagagatcccaaggtgacccttcggggcgtcattccccgtaggtgggccttaccccctttgaggatgactcgtcctccctatggcgcaccacctttgccaacgccagccgacctggctgcttttctggatgtcgaggtcggcgagctctcgttcttggcggacccgaaaggctggaacactgatgcgcgcagacagcactaccgaacccgctgggttcccaaaaggcgcggtggtaggcggctgatagaggcacctaaggctcggctgaaaagggtacagcgcaaggtgttaagaggtattctcgacccggtacccctgggagcagcagctacagggtttgcgccaggcgccagcccaagtaagcacgcagctcgtcattcaggcaagcgctgggtgttgaaaatggatctggccgactttttcgcacacgtggggtctggtcgggtgagagccatctttgagacgttgggatatccgctcgcggttcgccgactactcgtgggactatgcaccacacgggcccctgctgaactgcttctcgacgccgatcctgtggagagagcgctgcatggtcgccgccgattaccccagggagcaccaacaagccccacccttgccaacttagctgccgcccccctggaccatagactttggaaccttgctgcccgtctggggctgacttattcccgctacgccgacgatctggcattctccggggacaggatgccagagagtctgatacccagaatcgccgcgatcggcattgaagaagggttccctctgcagctccggaagactaggaggatgggccgagctgtcaggcaggagctgacagggttggtggtgaatgccgatcctgcgccacgcagggaaagctatgaccggctcagagccatccttcaccaagccgctctggatggacctgcagccgccaatagagaggccagggaagacttccgggcttacctgcggggcagaattgagtgggttgcaggaggacgaccgcaacgtcgggcaaaactggatgctctgttcgcaagaatcgattggtcatga

SEQ ID NO: 13100 - RNA, 1056 nt, unidentified
  source 1..1056: mol_type = other RNA; note = synthetic construct
atggggctgataatctatgcaatcctgtcaagaggcaagatcgacgccgtggccattaggaggagtcggaaagactacagatccccgtttttatttcgccgggctggaaggcctgatgcaggcaaactggcctctcgtggcttacccgtgctagggaacgttaacgaagtggcagcgcttctgggcgtcagtcccaaacagttgcgctggttaagcgtggccgacttcggccactatcattccttcctcttggagaaaaaatcgggagctgccaggcttatcgacgcccccaagccacagttgaaggctgcccaaaggaagatttacgagctcctcctgaagaagcagccactccaccctgccgcacatggcttctgtccgggtaaaaatgtacgtgatcacgcagcccggcattgcgggaagcaaactgtcctggggatggatgtcgctaacttctgcccctccgtgagtgcacggagagtttgtggactctttaagtcctggggctatggagaggatgttgcccttctgctgactacactgaccacgtacaatgggcatttgccccaaggcgcccctacatctccagctctggccaatctggtgttcactcatgctgatgcacgtctggcaggtctagcgcgacgcttcggtgcggagtatagcagatacgctgacgacatgacattcagcgggggccaggccttccagaggaagctttctgcattttcaaaagctgtgcagggaattgtaaaggaggaaggttttgcgctcaatcacaacaaaacacggcagatgcggcatggaaggcgacaggtggtcaccggccttgtggtcaatgaaaccccacacgtttcacgacgaatgcggcgccgcatgagagctatcctgcacaacgcccaacgcaagggactcgaagcccagaacagatttaagcaccctcggtttgcggaacacctcagggggcgaattgcttggataaccagcctgcaccctaggttgggtggcagactgcttgaggggtggaaagctgcccgcgccagattcgcaggatga

SEQ ID NO: 13101 - RNA, 1389 nt, unidentified
  source 1..1389: mol_type = other RNA; note = synthetic construct
atgggactgtttgatttcattaaggggctgtttggcgggtccgcccaggttcaatctggtccgactcatgccgacgtcaaccctgcgcatgatcaggccggaagggaccagacagaaacttcatacgcagagtccattcacgctgatgctggggaggcagtaccgcacgagcattcctcaccgcagaattcttcctcgaacaaggtgttcagggaacgcaaggctagcaagaacatagttcttagaaaattctcctaccggccttccactgtcgctacaccccaggagcaagagattgtgcgccaccgcccctacaagtttgccgtgccaggaccacataccggtgagtttctcgatctcagccaggatgctgacgagagatggctggagtattatggactgcctaccctggcgacacccgacgaccttgccgactggtttggcatatcgataggtaagttggcttggcttacccaccggatgcgtgacggaaacagaccaaaagacgtgaaagatgctcactaccacttccagtggaaaaagaagagaagcgggtcatggcggctgatcgaggcacccaaagaagagttaaaaggcgttcagaccaaaattcttcgagagatcctggaccttgtcccagcacatccagccgcccacggatttgtgcctgggaggagcatcctgagcaacgccgtaccccatgtgggaagtaagttcctcctgaagctagacctggaaaacttttatccaacagtgcgttacagcagggtcgttgcaattttcaggtccctaggcttctctcgggaagtttccatctggttggcgcgacttacggtgagtgcccccccttggtctttggatgcaccaaaaaagaattgggaattctggcaactgatgcccccgcatttacctcagggtgctcctactagccccgccttggccaatctgagtgcatttgcgctggatgtgcgcttaagcggcatggctaaagcttacaacctcaagtatacccgatacgcagacgatctgaccttctcaggccccgggctctcaatcccagccctgaacgaatttatcccactgactagtaagattattgccgccgagagattcttcgtgaacaaaaagaagcgtaagatcatccggaattctcagcggcaatgtgtcacgggcgtggtcgtgaatgaaaagattaacgtctctaggcaggattatgaccagctcaaagccatactccacaattgcgtaaaaacaggccctcagcaacagaatagaaatcaacaccctgattttgctagtcacctccgcggccgcatcgcccatatgatgcagttgaatccctctaggggggcaaaactactggaaatctatcagaagatcagatggtga

SEQ ID NO: 13102 - RNA, 1077 nt, unidentified
  source 1..1077: mol_type = other RNA; note = synthetic construct
atgggactctttgactttatccgtggattgttcggcagttctcctaatcaccaggtcgagcagtcaggcgagcaaagggatacaacccctgggagatctgatccaggggtgagcgaaactgctagccctacacctcaggtggaaccacgccagagtgtaagcaagagaacgcaaactcatctgccttgcagtaagcgctcacctgtcaagctacaacagctggagtatcgcccagggatcgtgagaaccccctcggaacaggaagtttccaaacagaagccctaccgattcgctagcattgggcccaggacaggcgaatacttgaatctatccagggacatggatgagcggtggttggaatacttcggactgccccaactagctaccccagacgacctggcccagtggcttaatctcagtatagggaaactcgcctggcttacccatcacaccagggagggctacagaccgaagaatgaatccgattctcactatcacttccagtggaagcgcaagcgatcggggggactgagattgattgaagctccaaagcaagagttgaaaaatgctcagcaccagatcctgcatcagatcctcgactcagtccctacccatcaggccgcacatggcttcgttcgaggacgcagcatcctctccaacgccagcagacacgttggatcaaagtttatcctgaagctggatctcgagaacttttatccttccgtgaaatattcacggattgtggctattttcaggtctatgggcttctcacgtgaggtaagcctgtggttagcccggcttactacgtctgccccctattggggtctgaaagcaccggagaagaactgggagtactggcagctcatgcagaggcaccttccccaaggtgcgccgacatccccagcgttagccaatctgagcgccttcagtcttgacgtgcggctgtctggcctggcaaaagcctataacctcaaatactcccggtacgcagacgacttaacttttagcggcccaggtatgtccattcccgcactgaacgagtttatccccctgacaaacaaaataatatctgattga

SEQ ID NO: 13103 - RNA, 1380 nt, unidentified
  source 1..1380: mol_type = other RNA; note = synthetic construct
atgggctggttcgacttcctacgtaaaatctttggcttcggccgggcagagtcttctcagggttcacagaccgtcgccgatgcaccactagcagaggcccctgtaaccgaatcatcagccgctgagtcccctagttccgatgttagcgactccgaggtgtcagagccagcggagaaacggaaagctgagcctaggcccaattctacagtcccccgccccgatgttcaccttcgcccattggactacgttccctcaacggtgccgattcctcccgacagagagattgtgtccgaaaagccttatagattcgccgtgcctgctccacggacaggagaatttctcgatctgagccgagattcagacgaacggtggttagaatactacgggctgccgcggcttaagactccagatgatctagcggactggctgggtgtgaccaccgggactttggcctggttgactcaccgttttagggaagggcatcgacctagcgatgaaagagatagccattaccactatcggtggatagctaagcgaagtgagggttggaggctgatcgaggcccccaagagcaagctcaaggacgtccaaaccaagatcctgcgcggcatccttgactccgtgcctgcccatagtgcagcccatggattcgtgccaggccgctctatcgtctctaatgctacaccccacagcggctcgaaattcatcctgaaaatggacctcgaagacttctatcctacagtgagatacagtagagtcgtagctatttacagatccctcggatttagcagggaagttagtctctggctggcaaggctgtctgtgtcagccttaccgtggtccctgaagtcccccgtaagcgctcacgagtacgtggtttataccgcacaccatctcccacagggagctcccacatcgcccgctctggctaatctgtctgcttacggtcttgacattagactggccggcatggccaacgcataccgcattaggtatactcggtatgccgatgatctcactttcagcggacctgggcttagtatcccagcattaaacgagtttattcccctggccaaaaagataatccgtgaggaacgatttacgatgaaccggcgaaaactgaaagtcatccgcaacagccagaggcagattgtcacaggcgtggtggtgaatgaaaagaccaacgtatctaggaaggagttcgaccaattgaaggccattttgtataactgcataaagcacggcccacagtcccagaatcgcgccgagattgcgaactttgcggagcatctgagggggcgcatagcccacatctcccaactgaatccgagaagaggagcaaaactcatgcggatgtacagtcagatcgggtggacctga

SEQ ID NO: 13104 - RNA, 1101 nt, unidentified
  source 1..1101: mol_type = other RNA; note = synthetic construct
gataggccatatcactttgcttggccgggaccgagaacaggggaatacctggatctaagtactgacgctgacgagaggtggttgcaatactacggcctgcctaccctgcggacaccagaggaccttgcagactggttgcatataccaattggtaagctggcttggctgacactcagaacgaatgatggtcacaggcccgtgtccactgaggcctcacactatagataccaatggatcccaaagaggtctggaggatggagactaatcgaggcccccaaagaacagctccgactcgtccagacccaaattttacgggaaatactggatcgcatccctcctcactcgtccagccatggtttcattgctgggcggagcattattaccaatgccgaaccccatttgggccagaagtttatactcaaactcgatctgcaggatttctacgcctctgtccgttatgcacggatagtagctatttatcgatcattcggcttcagcagggaagttagcatctggctggcccgcctctcaaccactgccgtaccctggtctttgcagttccctacgcgcgacgcaaggtcctggacattccacgcctactacgcattccatctgccgcagggagcaccaacctccccagcacttgcgaacttgtctgcgtatggtctggacgtcaggttagctggcatggccgcagcgtacgggttaaattacacacggtacgctgacgaccttacctttagtggccccgggagggcttttcctagtctgcgcgaggtgatcccttttgccaatcgtattatccgaagtgagagattccgccccaaccagaaaaaggccaaggttatccgtagatcacagagacaaactgtgactggagtggtggtcaacgagcacctgaacgtgagccgccaggagtatgatcggctgaaggccattctacataactgcgttaaaatgggcccctcctctcagaaccgcggagaactggccgactttcctgcccacctgagagggaagatcgctcacgtgatgcttctcaatgaggatcggggcctcaaacttctggaaatctatcatcgaatcgactggagccggtga

SEQ ID NO: 13105 - RNA, 1359 nt, unidentified
  source 1..1359: mol_type = other RNA; note = synthetic construct
atgggcctgtttgatatacttaaaaggttactggggttcgggccccgacctgatacaggaccagctgcaccaccaggccaacctgcaccaccaccggaaagtctccctggacccgcctcagccactattgctgagcccagtcctcagaaacgagcatccgcacgggaggcccatgaacagccagccaggagggttcgtgttgtcctgaaacctcttagatatcagtccaacctgatcccgacaagctccagccaggagatagtgagcggcaaaccttaccgcttcgccggtattgggccacagcaggggcagttccgcgatttaagccgcgatattgatcaacggtggctggattacttcggactgcctgtcttggctacccccgacgacttggcggcgtggttgaatatacctatcggccagctggcttggcttacacataggacatccagaggccatcgagccgaatccgtcaaacaatcacattacgtctatagttggatagcaaagcgctctggcgggcatagactcattgaatcaccgaaatcggacctgaagcacgcccaagagcagattctccggggattactggaccacgtccctccacacacggcagctcacggttttgtgcccggaaggtctatcctcactaatgcctccccccacgttgggcagcgctttgtgctcaaatttgacctccgggacttctacgtaactgtgcggtattctagagttgtagctatctttcgcagtctaggttattctcgagaggtggccatttggctggccaggctgacgacctcctcagtgccctggggcatcaaggcccctgtgaaggaatgggagctggccaagtatgcttctcgtcacctgcctcaaggagcaccaaccagccccgccctcgctaacttatccgccttcggtctggacgtgcgactagatggcttggcgggggcatacggactggagtacactaggtacgctgacgatctgaccttctctggccccggtaccgcaatcccagcccttcacgaactaatccccctcattcagaagattatcagagctgagaggttcagcagtaattggcagaagagaagagtgctcagaaatggtcagcgccagacagttgccggcgtagtggtgaacgaaaaactgaatgtgtcgagacgggattatgactctctcaaagctaccctgcacaactgccggaagctggggccgtcaactcagaaccataagagccatcccgagtttgcaagccaccttaggggccggattgcgcacgtccgccaacttaaccccgcgcgtggagagaagttgttggccatctaccagcagatcgactggagcaagtga

SEQ ID NO: 13106 - RNA, 1368 nt, unidentified
  source 1..1368: mol_type = other RNA; note = synthetic construct
atgggcctcttcgattttctttcacgcctcattttcgggtcgcctgcttcccatgactccgcagccgatgtgccaccaacagctccggagccatcacgagccgatgctgcacctaaacacaacagcccgcctcccaagaggccatcccggattaagaatcggacgtccagtacccgtccggttagactcgtacctttgagatacgtgggttctctcgtccgtacgccccagcagcaagagctgacagccgagaagccctacccattcgcttcccgcaacctaaacccgcggactggagaagatcttgggtggctggatctgtcgaccgatggggatgaaaggtggttgcagtactattctctacccatactcaagacaccaaccgaccttgctcagtttctaggcatccctctgggacggctggcatggttaactcagcgcagacactctaattatcgccccgcaaccattcgggagagccattaccactatcgatggattactaagcgcagcggtggacatagactgatcgaagctccaaagcagcagctgaaacaggtgcaacagaagatcctgagtggcattctggaccgcgttcccgcacatcctagtgctcacggcttcgtcgcaggtagaagcatcttgaccaatgcccaggcccacgtggggaaacgattcctgctgaaactggacctcgaagacttctacactaccgtgaggtaccgcagggtagtcgccatctttagatctcttgggtacagtagggaagtggccttatggctctctaggcttacaacaagcgcggtccccagagaatttgtgggaccagacagcagacctggttggcaccacagtctgagcaggtatgcccttctgcatctgccccaaggcgcccctacctcacctgcactggctaatttgtccgcctacgctctggatgttcggttggccggcattgctggagcatatgacatggactattcaaggtatgcagacgacctgactttcagcggggaaggaagatctattccagcccttcaggagtttgttcctctggtccagcaaataatacgcgcggagcgatttcggcccaacaggtccaaacggagggtggtgcgggattctcagcgtcagatcgtggccggcgtggttgtcaatgagagaaccaatgtggcccgaaaggactacgatctgctgaaagccatcttgcacaactgtatgagggagggcccctcctcacagaatcggtacaatttggaaaacttcgcggagcacttacgtgggcgcatcgcgcatgtaacacaactcaaccccgagcggggcgcccgattactcgagatgtatctcagaatcgactggaactgctga

SEQ ID NO: 13107 - RNA, 1341 nt, unidentified
  source 1..1341: mol_type = other RNA; note = synthetic construct
atggggctgtttgagttctttaagcgcctcttttttggcagccccgcacccgacgtgacgtcttctgctggctcggcatctgcccctcattcttcaccaactccggccgcccctgctaagtcaacgccaagacgccgccgaaaacgagtgcccggacagtcctcaaggccaccagtgcagcttcgttccctgcgctaccgaagtactttggtccagactccaaggcagcaggaacaagttcccactaagccctatgcatttgccgtcagggatttcgatgcctatcttgacctgagccaagatgccgacccccggtggttggagtattatgggttacctgccttaagaacccctcaggacctcgccaattggctgggcatccccgttggtagactggcatggctgacccagcagcatctgccggatagaagacctgcatccccaaaagaggcacactatcattaccaatggaaacagaaacggtctggcggataccgtctgatcgaagctccgaaagagctgctgaagaccgtgcaaacccagattctccgagaaattctggatagggtacccccccatcctgcagctcacggttttgttgaggggcgtagtatagtaacaaacgcgaggccgcatctcggccagaggttcattcttaagttcgacctggagaacttctatcctagcgtgcggtacagccgggtggttggaatcttccggagcctcgggttttcccgcgaagtcgccatatggcttgctcggctaacgacaaccgccgtgccacaggaattcagatcacctgacagcaggcccggttggcactggtccatgagtacctacaggtcccaccacttgccacagggggctcctacttcacccgccttagccaacctgagcgcctacgccctagatgtgagactgagcggccttgccaaggcgtaccatgtgacttataccaggtacgccgatgacctcacattcagtggcgcgccaaggacagttccagcgttaggagaggtgatccagctgacagaaaagatcgtgcgctccgagagattcagacttcaccctcgaaagcggaaagtcctgcggaataatcaaaggcaggtggtgacaggagtcgtagtcaatgatagattgaacattagtcgcaaagagtttgaccagctgaaagctaccttgcacaattgcattaagctcggccctgcttctcagaatcgcgcggaacatcccgagttcgcagctcacctccggggacgaatcgctcacgtccggcaactcaacgcactacgtggggacaagctgatggctttgtttcagagaatcaactggaaccgctga

SEQ ID NO: 13108 - RNA, 1401 nt, unidentified
  source 1..1401: mol_type = other RNA; note = synthetic construct
atggggctgtttgagttcatcaagagactcctgtttggatccccagcgccaaccacagccacacagtctggcgatgatagccccctagagcgcccagccgagtctggttctgcatctgctgcgacgtccgctatgactccagccgagcaacaccggcaacggatgcgctaccaaagtcgccagcgaaacgccggccggagggaaagagtcagggtgtccttgaggcccctgcgttacgaatcgagcctggtgcccacatcggcatcccgagaacaggtcgccgaaaagccctacttgttcgccacttgctctgtggatccgcgacagggtccacgccatggctacctggacctaagtcaagacgccgatccacgctggctcgaatattatggacttcctgtgcttagaactccacaggatttggccgattggctccagatccccgtgggcagactggcttggctcacccagcggcaacatcgggagaggaggccacccaccgttagagaggcacactatcactatcagtggatccgtaagagaactgacggacacaggctgatcgaagcccctaaagagaagttgcgagccgtgcagacgcagattctggaggggatccttaaccacgtccctccccatcctgcagctcatggtttcgtggaaggcagaagcattgtcactaatgcaagaccgcacgttgggcagcggttcgtcctgaagttcgaccttgagaatttttacacgacagttcgctatagccgggtcgtcggcatatttcgcagcctgggcttctctcgtgaggtgtccctgtggctagccaggcttaccactaccgcactgcccgagcaggtgaaaaaccctgaaggcctccccgggtggcattggagtctcgcaccctatagggcagctcatctgccacaaggagcccctaccagccctgccttggctaatctgtcagcctacggtctggacgtgagattacagggactggcgaaaacataccacgtgaactacacccggtacgcggacgatctaaccttctccggggaggctcgtgtacttccggctctctcagaatttattcctttatgccagaggatagtgagaagcgaacgatttgtattgaacctgcgtaagcggaggctggtgcggagtaatcaaaggcaggtggtaactggggttgtcgtaaatcagcgcaccaacgtttcaaggagagagtatgacaggttaaaagccaccctgcacaactgtctccggcagggacctcaatcacagaaccgcgaggacgttgagaattttgctgcccacctccgcggacgaatcgcacatgtgacacagctcaatccggctagaggcgctaaactgttagaaatgttccagcggattcactggacagggtga

SEQ ID NO: 13109 - RNA, 1317 nt, unidentified
  source 1..1317: mol_type = other RNA; note = synthetic construct
atgggtctgatcacactgctgaagaggatcctctttggaagcgcaccatcaatcccgcatgcaggagggcaacctgagcctgccgcggaaagcacaggagatcataccgctagagtgggcgctgtgagccaaagaccctccggtccagtgagattagcccccttgcggtaccagagtagcctggtccggacaccacctgacagggaacatgctgacggggccggcaaaccataccggtgcgcacacatagatccgagacggggcggctaccttgacctctcgaccgacggggatgctcgctggctggagtattacggactgccccacatagctactccagagcaacttgctgtttggctccagctgcccttagggaaggtaggatggctgacggatcgattctgtcagaaccatcgcccccagaacactcgtgaagcgcactatcattaccactggcttgccaaaaggtctgggggccataggctgatcgaggcccctaaaagccagctgaagcaggtacagcagcagatcctccgtgagatcctctgcagagttccccctcacactgccgcgcatggctttacagcgggacggtcaatcagaaccaatgctcgcccacatgtcggtcagcgggtcctgataaaatttgacctggaggatttctacccctcctgcagatacgccagagtggtggcaatctaccgctcccttggctattgtcgggaagtcgccctctggctggctcgcttaacaacctctgccgccccggctaacctaaggttccccgacgggaacctgcggtccctaatgccttatctccctcgccatctgccacagggcgcaccaacttctcctgctctggcaaatctcagtgcctattccttggatgtgagactcgccggtttggcagcccgctatcacctgaagtacacccggtacgcagatgacttgaccttctcaggggacgggcactctattcccgccctacgagagattcttccactgattacccgtatcgtgcgcgacgaacgctttagggtgaaccgtaaaaaaaggaaggtgattcgaaacaatcagcggcagactgtcacgggcgttgtggtaaaccaacacctgaatattcgaagggacgagttcgaccggttgaaggctattcttcataattgtcgaaagcacggtcccgcaagtcagaatagggatgatcaccctgattttgcagcccacctgagaggcaggatcgcccacgttatgcaattgaataggcaccgaggagaaaagttactcgcgatgtatgaccagattgattgggccagatga

SEQ ID NO: 13110 - RNA, 1287 nt, unidentified
  source 1..1287: mol_type = other RNA; note = synthetic construct
atgggccttctgcgcttgctgcagaggttgtttttcggaagttctgcgaccgctgaagaacctcggcaagacgtcagacccagtagccaatccaaaccttccgcctccgccgagaggcagagagaacggttggcacctctgcggtaccagagctcccttgtcgcaacgcctcgaagccgcgaggtggtggaagggtcctcaccaccgtatcggtttgcgcatcgtgatgctgtggggggcgcgtatctcgatctcagtcaagacgtggatcccaggtggcttgactactacggcctgccacatctgagcacgcccgaggacctagcaggctggctgagattgcccatcgggaaggtggcatggctcacctaccggttttgcgaaaacaggaggccgcaatctgccaaggaggcacactatcacttcagatggatccgtaaacggtctggcggacatcgactgattgaggcccccaagaagactctccgcctcgtccagatacagatcctgcgcgaaatcctggaccggattccaccacatcctgctgctcacggtttcgtaaggggaaggagcttaacaacaaacgccgccccacatgtggggaaacgcgttgtcgtgaagttcgatttggataatttctacggcagcgtaagacagtcacgcattgtcgccatctttagatccctggggtacagtcgagaggtagccctgtggctcgcccgacttaccacatcagctgctcccggatcgttaaaactgccactcggcgagtcaacttccatttggaaatatatgcctcgtcatctccctcagggtgcaagcacaagtccggccctggctaatctgagcgcattcggactagatattcggttagccggtctggctagagcctggcacgttgactatactagatatgccgatgatctcaccttttctggcgaccccaaatttgtcgccgcagtgggagacttcatcccattagtgcagcagatcatacgggacgaggggtttcagtctaagaggtcaaaaaggcgcgtcctgaggaccaaccagcgccaaactgttacaggtgtggttgttaatcagcacatcaatgtgtctcgggcaaagtacgatagactcaaggccaccctgcacaactgtgtgaagcacgggcccgcttcgcagaaccacgacctgcatgccgacttcgctgcccaccttcgaggacgcattgcacacatgcacagacttaatcctcatcgtggccagaagctactggcgttgttcgctaaaataaagtggtga

SEQ ID NO: 13111 - RNA, 1260 nt, unidentified
  source 1..1260: mol_type = other RNA; note = synthetic construct
atggggctgtttgattttcttaggcagctgtttctgcccagctcccgggatgtcgcctcacctagccaccgcagaagggagagagctcctagacgccgcgttaagctcaccccccttaggagaaggcatggacagcggccctggtccgagccaatagaggaagaaaccccgccctatcggtttgcccaatacggaatcagagatggcaggttcctggacctaagcagagacggagatgagagcctgctcgacagcttcgatcttcctgttatccatactccggagcagctcgccgagtggttgcaaatgccactgggtcaggtggcatggttgacacagcgcttcagcgacgggtatcgcccagagaatgagcagcaggcgcactatcatttcagatgggtcaagaagcgatccgggggctggcgcttgatcgaagccccaaagcagaaactgaaacaggtccagacacaaatcctccgggaaatcttggacagggttcctccccataattgcgcgcacgggttcgtacgacgtcggtccatcgtgacaaacgctcgacgccacgtgggccaaagagccattttaaaactcgacctggaagacttctacgctaacgtggggttttctcgggtggtcgggatttttcgtggactcggatactcgcgggaggccgctctgtggttaggtaggctgactacctccaaggtgcccagtaacctgaggtacccagaacggttctcaagtgccttctttcccttccttaagagacatctaccccaaggcgcaccttcttctccagctctggcgaatctgtcagcttacggcctcgacgtccgcctttctggccttgccaggagttattctgtcgaatacacccgatatgccgatgacttaaccttttccggcccccagtcttttattagggcactccctgtattcatccctttgacgtcacagataatacgagacgagcgatttcgtgtgaatagaaacaaacgtaaggttgtgagaaacaatcagcaacaggtggtggcaggtgtggtcgtaaacgctcacacaaacatgccgcgtcgggaattcgatcggctcaaagcaattctgactaattgtgtgcggcacggtcctgcaagccagaatcgcgagcaccatgcagatttcagtgcccacctaaggggacgggttgcccacgctgtgcagctgaacccacacaggggcaataaactgagagagctgtaccatgccattgattggaagcgctga

SEQ ID NO: 13112 - RNA, 1296 nt, unidentified
  source 1..1296: mol_type = other RNA; note = synthetic construct
atgggcctgttggactttctgcgcagattacttggcggtcagccagcgtcgcccaatgatcaaccctcagccccagacacaagcactttagtacgcgatccccggaccggaggtgttacaccggcagcaccaaaactcttagctcctctgcggtaccgatccagtctgaatagaacagccactgctgctgagagagttgccgaactgccttaccggttcgcaaacctcagcgtggatggcgacggctacttggacttgtccaccgacgcggatgaacgatggttggaacattttgacctgccacacttgagaacgcccgaagacctagcaaatttccttcagctgcctttgggtaagctcgcttggctgacacaccggttcgaagagggaggcagacctgcgggggaaaaggagagccactaccaccatcattgggtcaaaaaaaagctcggggggcaccgtctgatcgaagcacctaagcagaccctgaagatggtccaacgccgtattctgcgcgacattctagatcacgttcccccccatcccgccgctcatggatttgttactggcaggtctatccggaccaatgctgagccccacgtgggaaaatccgtgcttctgaagttcgatttgcagaacttctatccctctgtgaggtattccagggtggtggccattttcaggtctgtgggcttctcaagagaggtggctatctggctgggaaggctgacaacaagcgccatcccagcaagcctgaaatacccacaggatgaccctagtgcactttggatgtattatccacgccacctccctcaaggcgcatgcacctcaccggcccttgccaacctgagcgccttcgctctcgatgtgaggcttaccgggctcgcgcgcaagtatgatgtgcactacactagatatgctgatgatttaacgttttccggtaccggccgatttgggggcgcccttagcgagtttatccctctggtcacccatatagccaagtccgagaggttttacattcacaggcaaaaacgccgggtactaagaggatctcagagacagactgtcgccggagtggtcgtaaatgagaaacctaacgtgtcacgacgcgacttcgaccgtctgaaaagtatactccacaactgtgcaaagcatgggccatctactcagaaccatgacgaccatccggattttgccgcccacctcgccggaaggattggtcacgtcctgcacctcaatccccatcggggggctaagctgcgagagctgtacaaccagatcgactggagtcggtga

SEQ ID NO: 13113 - RNA, 903 nt, unidentified
  source 1..903: mol_type = other RNA; note = synthetic construct
aggccagcgggcgttagggaagcccactaccattaccattgggtgaagaagaagacagccgggcacagactcatcgaggctcccaaacagaccctgcgtgcggtacagcagaggatcctgcgcgacatcctggacaaagtgccaccgcaccccgctgcacatggattcgtctctggccggtccattcgaactaacgcagagcctcatgtgggtcagaggattctgctgaaattcgatctgcagaacttctaccccagtgttaggtatagtcgagtggtgtcaattttcagatccgtgggttatagtcgggaagtggcaatatggttagcccgccttaccacttcagccatcccggcctccctcagctttccaaagggcgaccccagcgctttgtggacatattaccctagacatctgcctcaaggggccgctacgtcgccagctttggcaaacctttccgcttttgctctagatgtacgcctggctggtctggcccgaaaatacgacgtacggtacacacggtacgcagacgatctcacctttagcggctcacaccgcttcggcggagccttatctgagttcattcctctggtggtgcacatcgcaaaatctgagcgttttgttcttcatcgtcagaagcgcaaagtcctgaggagctcccagaggcaatctgtggcgggagtcgtcgtcaatcaaaaggccaatatcgctagacacgagtttgatagactcaaggcagtcttgtataactgcgtgaagcacgggccctcaacccagaaccacgatgctcatcctgactttgccgcccacctcgcaggcagaatagggcatgttttacacctcaatccagcccggggagccaagcttagagaactatataatcggattgattggagccgctga

SEQ ID NO: 13114 - RNA, 1338 nt, unidentified
  source 1..1338: mol_type = other RNA; note = synthetic construct
atggggcttttcgactggctaaagggcatgctaggtggggctcccccatcaccaacccctgcagctccttcaccacccgcagctggcgtacgcatcaatccatttacacaagaagtggtccagctggggatcgatagacggacatcggctccttccttgcatgctttcaggtacagaagctctttggtgagaactccccctagtcgcgaattcgccgctaaaaggccatacccctccgcgcagcgccaagtttataagggctggctggacttgacaactgacagcgacccgcgatggcttgagcactttgggctcccccctcttaaatcacctgatgatctggccaagtggctcaacgtccccttaggccgcctcaattggcttagcggtaggtatcgagatggcggtcacccgggaaccgcaaaagaggcacactatcacttccaggtgatcccgaaacgttctggaggagcgcgcctgttagaagccccgaagccacagctgaaggccatacagcagcggatcctccgggacattctggataggataccagtacattcccaggcacatggtttctccaaaggccgttctattgtgactaatgccgaaccccatgtggggaagcgaatcattctgaagtacgatctcgagaatttttatccttccgttcggtataacagagtggtggccatttttaggtccatcggatttagccgcgaggtcggaatttggctggcccgactaacgacaagcgccctgccctggaacaccagtgacattcctagactcggcgagttgagcgggctggagactaggggccgatactgggagctctatggtagtcgtcaccttccccaaggcgctgccacttctccagccctggcaaacctgtctgcttatagtttggacgtacgcctgtcaggactggcgcggaagttcgatgcggattacacccggtacgcagacgacataacattctctggcaccaaaaggtttgcaggagccctgtccgattttatacctttagtcgaacgggtggttcgcgccgagaagtttgtggtgcacaagggaaagagaagggtgctgagaaacaaccagagacagagcatcacgggcgttgtggtcaatagcaaacccaacattcggcgcgaagagttcgacagactgaaggccatcctgcacaactgcctcaaatacggtcctagtacccaaaatcgggacaggcacccaagattcgctgaccatctcagagggcgagttgccttcgtctcacagcttaatgctgataggggggaaaaattgcgtgagatgtacgataggatcgactggcggaagtga

SEQ ID NO: 13115 - RNA, 1305 nt, unidentified
  source 1..1305: mol_type = other RNA; note = synthetic construct
atgggtctattcaactggctgagaaccgtgttgtttggcgctcccccacaacccacaggggacttcacacccgatcaacctcctcctgctggacgcgacgtgcacccagtgacgggagaaagagtctcccacagccgcgcacgcttagacaggctcgagtaccgaagcagcctgattcgtactccatccagaagagaatcagccgggtcagatcccccctatcagtttgcccataggaatccacgaacggggcgatggctggacctcaccactgatgctgatcccaggtggctggactattacggactgccgcacctgaaaacacccgctgacctggcagattggcttgagatgcccatcgggcgcctgggttggttaacccatagattctgcgacgataggcgcccgccatctgcacagacagcccactaccacttccagtggctgaacaaaaagaccggcgggcataggttgattgagagcccaaaaacatcactgaagggggctcagcggaagatcctctccggcattattgagcgcatccctccacacaggaatgctcacggattcgtggccggacggagtattttgtcgaacgcccgtcctcacgtgggcgcgtatgctgtcctcaagctggatctggagaatttttatccctcagtgcggtacagtcgggtggtggccatctttcgctctgttggcttcagtagggacgtcgcgatatggcttgctagacttaccacgagtgccgttcctcatgatattcctagaccagctggcggccatgcagcagtctggccttatttcagccgacatctcccacaaggcgcgcctacttcccccgcactcgcaaacctctctgcctactcgctggacgtaaggctaactgggatggcccgtgcctatgatgtaacctacacacggtacgccgatgaccttacctttagcggaagctatcgcttcgctgccgctattcgggactttgcaccgctggtcaccaggatcgtgagggatgagcgatttaaggccaatcggtctaaacagagaataatccgtcggaacaagcgacagactgttacaggtgtggtggtaaacgaaaaacctaatatatcccgggatgcctacgacaccttaaaagccatcctgactaactgtgccaagcggggcccctccacccaaaacagaggagcccacgaaaatttcgcggcacacctccggggtagaatcgctcatgttgcccatcttaatccgcgcagaggcgcaaagttgttgcagctatacgcgactatcgactggtctaggtga

SEQ ID NO: 13116 - RNA, 1317 nt, unidentified
  source 1..1317: mol_type = other RNA; note = synthetic construct
atgggcctattcgaccttctgcggagactgctctttggagcgccagcatcgccaaccgacactgctggctctagccctgctcctcgagccagccagatgcctgttgctcccaagtccttgcccgtagccacacctgcaggtaaaagaggtcccgcaaggaagttgcccccatttcgctatcagagcaagccacgcagaactagccccaaggctgagagagttgcccggaggccgtacactttcgcagcgccaactgctctgggggaatatctggatctgtctacagacgctgaccttggccttttggatcacctgggattaccgagactgcagacacccgcagatatcgcagagtggctggaaatcccactaggtcggcttgcatggctaagcgggcgattcttcgaaaatcacaaaccacaaagtgagcgatccgcgcactataatttcagatggttgaaaaagcgcagtggagggcataggcttatcgagtcccctaaaaaacagcttaaggcagtgcaggagaagatcctgcgggaaatcctggacaaagccgatgcccaccccagagccttcggattcattgctggacggagcgccattctcaacgccagggaacatgttgcaccttatgtgctgctgaagttcgacctggaaaacttttacccctctgtacggtattcccgcgtggtggccatttaccgtacattagggttttcaagagccgctgcgatttggctggccaggctcacaacaagtgcggtcccgagcagcatgagttttccaggcggcgatccttacgggctgaacccctacctctcacgccatctgcctcagggagcacctacgtcaccggcactcgctaacatgagtgcctacggcttagacgtgagactaaccggactggcccggtcttttggggtcacttacacccgctacgccgatgatctgaccttctctggcgatcaaaaatttgccggcgccctccgagacttcatcccattgaccgagacgataatcaggaaggagaggttctttctgaatgtctccaagcgtcggatcatacgcaggtctggccggcaaaccgtgaccggtgtggtcgtcaatcagcatccaaatctcgccagggctgagtttgaccgcctgaaagccatactctttaactgcgtgcgtctcgggccctcaacccaaaaccgtactaatcaccctcagttcgctgcccacctccagggcaggattgcccatgcagcttccattaacccctcccgcgccgctagattgcgagctttatatgaccggattgattggtcaaagtga

SEQ ID NO: 13117 - RNA, 1290 nt, unidentified
  source 1..1290: mol_type = other RNA; note = synthetic construct
atggggctgttcgctttccttcgtcgtatcctcttcggagcacctgaggatgcggccgatgatggaggctcaaccgcaccccgccaatcaccgccaccacaatctcccgctacagcccggcgacgaagaactccactgccacctctccggtatggctccaaacaccccaggacacctgccgcccttgaacaagtagcagagcgcccttatcagtttgcgaatctgggacccgcaggcagattcctggatctgtccacagacgccgacttaagtcggctggagcagctggaactgccacgcctcctgacacctgcggatgtggcacattggttgaacatgccgcctggacgcttggcctggcttagtggccggtttgagccacagcagagggcagcatccgagaaagccgcccactaccactacaggtggatcaggaaacgctctggtgggatgcggctgatcgaggcccccaaggtacggctcagacaggtgcagacccgcattctacgagaaatactcgatcatgtggctgcccatgaccatgcgcacgggttcgttagggatagatctgccctgaccaacgctaagcctcacgtcggcagctacgtagtccttaagctggacctggagaacttttacgctagtgtgagatactctcgcgtcgtcgcaatctttcgcgccttaggcttttcacgggccgctgcactctggcttgcaagattgaccactagcgcagcccccgcttccctaagtttccctgacagatcccctctcggcctcctgccgtatcttccccggcatttgccccagggggctccaacatctcccgctctggccaacttgtccgcctggagcctggacgtgagactgactgggctggctaaaaagtatcacgctacctatactagatacgcggatgacctgacgttcagcgggtcgcacagatttgctgccgcattatcagaattcataccactcgccgaaaagattatcaggtcggaaaggtttaaggtgaatagggctaaacgcaaagttttgcgaaggagcggaagacagactgtcacgggagtggtgaccaatgcccgtccgaacattgctcgggaggactatgataggcttaaggccattctccataattgcgtgcgcagaggcccaagcacccagaatcacgacagccgaaaggacttccaagcacacctacggggtcgggtggcgcacgttaggtctgttcatcccgcccgtggtgctaaattattggccctgtaccagaggatcgactggaagcgatga

SEQ ID NO: 13118 - RNA, 1047 nt, unidentified
  source 1..1047: mol_type = other RNA; note = synthetic construct
atgggcttctttacgtggctctttaggtggctgggctggggcgctgattccagagacttccccagtgacaccgagcgtaccagcgatttaggagtgcgaaccagctctggatctcttaatcgctcaagtttcgacgactctgatgccccgcgacggaactcagacctcacagagactgccattcactcgaactccgagcggtccgtgactactagacccgtcaccagtcgccctaagttgacattgtcacgaagggaggaggaacgcatacggaatccgcctgaaaggtccccctgtgtggaagtggttggggagacaccatatcggtacgcacggtttggcagtaccactgggcgacacctggacctgagccaggatggtgacgactcccagttaaacgcccgctgcctgccaatcttccacacaccagaagaactcgcaggttggcttcagatcccccttaatcaactggtgtggctcgtgcatcggtttagcgctggcaggcctccagcatctgacgctgctcactacgtgtttcaatggttgaagaaaaaatctggcggctggcgtctaatcgagagcccaaaacccattctaaagagggcgcaggtaaagattctgcgtgagatcctggacaggatccccgctcacagaagcgcccatggattcgtcgcaggaaggtccatcgtaactaacgcagaacctcatgttgggcaggatgtcgttgtggccttcgatctgtctaacttctacacaaccgtgggatttagtcgggttgtcgccattttcagatccctcggttactcaagagaagccgctatatggcttgggctgctcaccacttccgccattcctggtaatatggcctttcccgagagaaatccatatgcctttgatccctatttgaagagacatctgcctcagggggctcctacatcgccagccctggcaaacctgagcgcgttcggactggatgtcaggttgaccgggttagcgcgcagcttcggcgcaacgtatacgcgctacgctgatgacatctcactctga

SEQ ID NO: 13119 - RNA, 945 nt, unidentified
  source 1..945: mol_type = other RNA; note = synthetic construct
atggccttcttcgcctggttattcagatggcttggctggtctaccgacccccgcgactcttgggatgcacctgctcctcctcaggctgccgatagaagtgccgtgcggacagccactttagaggccccgccaagagctccatccagacctcccagcgagccacttcctcggccaaggctgacacccaccaggagggacaccacacgccacgatgctcgcaagtcccacgcaaccttcgtcgaagtaactggggccgtgccgtacaagtacgctagatttgggagcggtacgggtcgccatctggatctttctcaggatggagacgaggccagactgcagcagaggggactcccggttttccgcacccctgagcagctggcagactggctcggtgtgccactaaaaaaggtggcttggcttgtacaccggttcagtgctgggcggcctgccagtgtcgaacaggcacactaccactttcgatggctgaagaagaagtccggcggctggcgtctcatcgaatcaccaaaacaaactctcaagcaagcgcaagtcaaaatattgagagagatcctggaccgcgttcctacacacagcgcggcccatggatttgtgacggggaggagcattctgactaatgccaaaccccatgtcggacatgcgatgctggttaaactggacttaagtaacttctatgccacagtggggttttctcgggtggtggcactatttagggcgctgggctattcacgtgaggctgcaatttggctgggcctcctgaccactagcgccatcccaggaaatatggcatttcccgcccgggatccctatgccttcgaaccctatctccgacgtcatttgccacagggcgcacccacctcccctgcattggctaacctctcagcctacaggctggacctgcgacttgctggcttgtccaaatcgtga

SEQ ID NO: 13120 - RNA, 1356 nt, unidentified
  source 1..1356: mol_type = other RNA; note = synthetic construct
atgttcagttggctcgggggaggtgaaccgtccagccctagccaaccgaccactgacagaggccaacagccagacccccaacattcccccacacccccagcagatcatgggccagacaggacttctcggagtaccacaccccctcgtcagcgacctcggattcgacggttcccaccaaagcgcaatcccaggctgaacgtgagatcccatgatcagcagcatcggcggaaccgaaaaaaagcaagttttctggaagtgacgggtgcaagcccttacaggtttgcccggttcgggagccaaacaggacggtacctggatttttctcgcgacggtgatgacgcgcgtttgcgagacagaggcctccccgtgtttcatacccccgaagagttggctgagtggctcggcctaacacttaataagctggcttggttggtgcacaggttttcaaatgggaggccagacagtgtagaccacgctcactatcacttcacttggcgcaagaagaggtcgggtggggtgcgtctgattgagtccccgaagcagaccttgaaggaagcacaggttaaaattctgagagagattctggatcgggttcctactcacccggcagctcacggcttcgtagcagggaggtctgtgctcactaatgctaagtctcatgtgggacagggcatcgtcgtgaaattcgatttgaccaatttctacaccaccgtctcatattctcgagtcgtcgccattttccgaacactgggctacgcgagagaagctgcgatatggcttggtctgctgacaacgaatgccgtgcctggaaacatgccattcgaccgccagaagctgtacagcatcctcccctattggagaagacaccttcctcagggcgcgcctacttcacctgcattagctaacctgtctgcctatcacctcgacgctaggttaaccggcatggcccgtgcctttggcgccgattacacccgctatgccgatgatctgactataagcggaccagagacattatcctacgccctgagaacactcatccccctagtcgagcagatcatcagaagagagaggtttcagagcaatcggtccaagagacaggtgctgcgggctcaccagcggcaagtgatagccggcgttgttgtaaacgtcaaacctaacgtgtcaagagctaaccttgataggctcaaagcaaccctgaccaactgcgtgcgcatgggaccatcgacgcagaaccgcgaccaggttgaagactttcaggcccacctacgtgggcgcatcgcccatgtcctccaattgaatcccgcccgcggagagcagctgcttgccattttccataggatcgattggaggcgctga

SEQ ID NO: 13121 - RNA, 1506 nt, unidentified
  source 1..1506: mol_type = other RNA; note = synthetic construct
atgggcctgattcgatggctgttgcatcggctgggatggcggccagcaccacttacgcggtcgttgcccacagcaggtccggtttctccagccccagcaacacctgctccgctggatacgccccctttagacactccccccctagcccaggcttcacttacccctgcctggccggtagtagcttcccctgtggtggctccacccgctcaagcgtccccaattgtggcctcacccaatcccgatagtgtgcctccaagcattctgtttgaccctcccgcggtggctccagccaatagtcgcaagaggccaagaatttggagccggacaagcaggatccgactcgtccctacgcggcggaagcaacagaggcaggcagcacgtagaccagctatgctggtggaggaaacacagggtgcggcaccctaccgatacgcccgttatggatcaaggaccggtcactacctggacctatcaagggatggagatgtcgtgcgacttcagaggttcggccttcctgagtttcacaccccagagcagctgagccactggatcggacttcctctgaaccgcgttgcttggctcgtgcaccgctttagtggagggaggcccgagatggaggaactagcacactaccatttcagatggatcaagaaacggctcgggggttggcgtttaatcgagtctcccaaaactaccctgaaattggtccaaaccaagatattgcgggagctgctggacaaggttcctgtgcatgcagccagtcatggatttgttaagggccgctccattctgacaaacgctagagcccatgtcggccagagcgtcgtactcaaattcgatctcaccaacttctatacaacagtgtctttcgcccgcgtcgttgccatattcaggtccctcggctatagccgggaggtggctatttggctcggtctgctcactacatccgcagtccctgggaacctgagattccaggaccagggaccttacgccctggtcccatatttgcgcaggcatttaccgcaaggcgcgcccacttctccagcccttgctaacctctcagccttcggcctggatctgcgcttgactgggctggcccggagttttggagcacactacacccgttacgccgatgacctgaccctttccgggcccgaagaactggggaaggccttgagaaccttaatcccgctcacacaacaaatcatacgacaggaaagatttgttctcaatcccgaaaagagaagggttctgagatcccaccagcgccagactgtgactggcgtggtagtgaaccagaagaccaatgtgtctcgcggcgactttgaccgacttaaggccattttgaccaattgcgtgaaacagggccctagcacccagaatcagaaaatggtcgaggatttctatcaccacctccaagggaggatcgctcatgtgtctatgctgaaccccctgagagggcagaaattaacgctgctatttcaggcgatcgactggactagatga

SEQ ID NO: 13122 - RNA, 1332 nt, unidentified
  source 1..1332: mol_type = other RNA; note = synthetic construct
atgggcttgattcgctggttgatgcagaggcttgggtggggttcctcacgcggaccagtgccaactgagagcaacagcagacccgccagtgaacaggcctctgcaaagtcagaaaatcttacccctacaagtctgcgcacgacacggcgctcatatccaccaggaagagcacggcttgtcgccagcacacgcgtcgagtccgacattacacgaccctcgatggcgtacgtagagacggaaggcgaaccctataattatgcacgctacggatctcaaaccggaagatacctagacctgtctagggacgccaatgaggctcgcctggctcagtttggcctgcctgtactgaggacccccgacgatctcgcaaattggatcggcctgcctctcaacaaagttgcctggctggtgcaccgtttctctgctggtagaccagccactgttaaggacgcgcattatcacttccattggcttaaaaaacggcaaggtggatggcgtctaatagaggccccaaaagccatgttaaagctggtgcagactaagattctccgcgaactgctcgatccaatacctgtccatagaagtgcacatgggtttaccgtgggacgaagtatcgttacaaacgctctcccccacgtgggccagcatgtggtcctcaagctggacctgtctaacttctacacaaccgttagcttcgcgcgggtagttgcaatcttccggggtctgggctattccagagaagtcgccatctggctcgggcttttgaccacttccgctgtgcctggcaacctgggcttccaggaacaggggccgtatgctttggtagcgtacttaaggagacaccttccgcaaggtgcccctacaagccccggcctagctaacctgtcagcttttggactcgatgcccgaataactgggctcgccaagtcattcggggcaacctacactaggtatgctgacgatctgaccattagtggcagcaaagagctgactcgagggctgagagccattatccctttggtgcagcagatcgtgaggcaggagcgtttttttgtgaatcacaagaagaggcggatcctgcggagccaccagcgacaatctgtgacgggcgtggtggtcaacgagaaacccaacattagccgtggggattacgaccggctgaaggcaatgttaaccaactgtcagaggcatggcccctcctcccagaatagagatggagtcgtggatttttacaatcacttgagggggtgcattgctcacgtgtccatgctgaatccggttcggggacagaaactcaccgagttattccaagtcatcgactgggccaggtga

SEQ ID NO: 13123 - RNA, 1338 nt, unidentified
  source 1..1338: mol_type = other RNA; note = synthetic construct
atgggactcctggcattcctccagcggctgttttggggagctcctccgagggagtcatctatggtggggagaggaacagccggagctccttttggcgacccgctgagccgggataactctctgagcggtcctgccaccagcggccaagtcctgtataagtcccggcgtggtgtgttccagaatcccgcttcaaacaggtacgcacctcacggagacaggacaggtagggggcaggtggtggaacagtccccctatagatttgccaggcgtgacctgcccagcggaggtttcatcgatctgaccggagatcaccggccagatgtgctgaatcagtacgggctccctcttcttcgcacccctgatgatctggcacggtggctatcaatccccctgccacggctagcgtggttgattggacgattcgacgataatcacaggcctcagtccgagtctgagtcccactaccactttcactggattaaaaagaagtcaggggggttccggctgatagaggcacctaaaagtcaactcaagcagattcagcttcagattctacgaggcatcttggacagactcgtgccacaccccgcggttcatggattcgtccccggtagaagtattcgttctaatgccgcccctcatgtgggccaggcatgggttcttaagttagacctaaccaacttttacccatccgtatcgtttaaccgggtggtggcaatcttcaggtcactgggctattgccgtgaagtggccatatggttgggccgcttgacgacaagcgccattcccagcagtttgaacagtccagatagacgcatggcaactgtctggccatacctcagacgacacctgccccaaggtgccccaacttctccagctctcgccaatctgtccgctttcgggttagacgtgagactgcaggggttagccggcgcatatggccttcgctataccagatacgctgacgatttgacactgagtggaccccagcgagccgtagcagctcttcgcgagatcataccatttgccgggtggattgtgaggcaggaaaggttccaccttaacaaagctaaaagacgcgtcctgcggcgctatcaacagcagtccgttacgggcctcgttgtcaacgaccaactgggcgtaccgcgcgcggaattcgaccgactcaaagccatcctgactaactgtctgcgacatgggcctgccagccagaatagggaggcccatccggcctttgctgcgcatctgttgggccggatcgggcatctcgctagcgttaatcccggccgcggcgtcaagctcaggtctttataccaacagatcgactggaatagatga

SEQ ID NO: 13124 - RNA, 1311 nt, unidentified
  source 1..1311: mol_type = other RNA; note = synthetic construct
atggggctgatagcctttctgaaacggctgttctgggggacccctactcccagttctgtgccttccgccgagagtgccgactcgtcaaggctggccgcggatagcacctccagctcagcaaaaatcatcgtcaggcgcaagtttcgaggcccagatctgctgcgattcagtgccaccgtacgtagacagggccggaccgtacaagtggttcgggggcagccatacagatttgcccggccgttcgtgatcagctctgtggattacggggacctgtccactgacacaaatcccgccgccttgggcagattcgacttgcctgtgttacggactcccgaggatttggcgcattggctgggcattcccctcggaagagtggcgtggcttaccggccgattcttcgaaaatgagcggccccagtcagatgacgttgcgcattaccactttcattgggtaaaaaagaagtctggggggtatcgcctgatcgaagcaccaaaagcccttctgaagttcgcccagactcaaatccttagaggcatactcgatagggtgcccgctcaccctgcagctcatggttttgtcaagcagagatctattaggtcaaacgccgctccccacgtaaagtcagcatgggtcatgaaactcgacctatccaacttttacccttctgtgactttcagccgtgttgtcgcaatcttccggtctttaggatatagccgcgaggtcagtatatggctcggccgcctgacaacctcgactatcccatccaacctgagcgcacccgacagacgagagaatacagtgtggccatatcgcttaagacacctgcctcagggagcaccgacaagtcctgctattgccaacttgagcgcctttagcctggatgtgaggctaaatggactagcagctaagtaccacgcccgctacacacgctatgctgatgatcttacgctgtctggtaagggcaaatccatcccagctctcagagagattattccaatggcagaatggatcgtgcgtaacgaacgcttccacctgaataggtccaagaggcgagtccttaagcagcatcaacgccagtcagttaccggaattgtcgtgaatcaaaagctcggagttggtcgggccgagtttgaccagctcaaagctatcctcaccaactgcattcgtcagggaccggtgagccagaacaggaatcaacacaacgactttgcttcccatcttaggggtaggatagggcacttcaaaagtgtgaatgctgaacggggcacaaaactcttgaagctgtattaccagattgactggacgagatga

SEQ ID NO: 13125 - RNA, 1311 nt, unidentified
  source 1..1311: mol_type = other RNA; note = synthetic construct
atgggcttgctgtccttcttaaaaaggctgctgtttggagccccagcctctaacgacgctccagctcggcctaagccatcaaatgatcctgcttcaagaccagcaactccacccgcatcccccccatctactgacgggacagctacaaaaaagcgggtccgcttgacccctatgcgaaggcagggaccaagggagcgtggccaacctgcacgggaaaccgccaggccaccctatccgtacgcttttcccacttacggaggcaagttcctggacttatccgacggaaccgatttcgagagactccgacagtttggactcccggagctggtgtatccagggcagctggcagagtggcttcagctccccctgggccatgtcgcttggctgacctaccggttctgcgatggtaacaggccccagactgcagggcaggctcattatcacttccattgggtgcgcaaaaagtctggggggcaccggctgatcgaagcaccgaagagtcgcttgcggcgggtgcaagaccagattctgcgcgaaatactcgatagggtgccctcacatcccgctgcccatgggtttgtgagaggccgcagcattgttacaaacgccgaaccacatgtgggccacaagttcgtctttaagctcgatctggagaacttctacccttccgtaagatatagccgagttgttgccacattcagatctttgggatacagcagagagattgccatatggctcgcacgcctcaccacatcactcattcccaccgaccttcctacgcctggccaaaggcccggtatgctgtacgcgtactttggaagacacttgccacagggagcgagcaccagccctgcgatagccaacctgagtgcactcggtctggacattcgtttatcgggtcttgccaatgcgtatggctgtacgtatacgcgatacgccgatgaccttacattgagcggccccggaaaagcagccggtgctcttagggaactaatccctctgtccgaacagatcgtcaggagtgagaggtttcacctgcaccccgtgaaaagacgaattctacgccgtggtcagcggatgagggtgactggggtcgtagtgaatgacaaggttaacatcgcacgtggcgattttgaccgcctgaaagccatccttaccaattgcatcagaactggccccgaggctcagaacagagaggggttaccggccttcagtgatcacctgcgggggagaatcgcccacattacacagctcaatcctaatcgaggcgctaagctgcaagccctattcgcccggatccgctggccttga

SEQ ID NO: 13126 - RNA, 1392 nt, unidentified
  source 1..1392: mol_type = other RNA; note = synthetic construct
atgggcctcctggatttcttacggcgtcttttctttccccaaccgtcgccccctcctaataaaactgcctttgatggagtaccttccccacggcctccagtaagagcgccaagtgacaacgggcggcatccgagcgataactcacactcagcggcaacctctactgctgagccggaagtcgagtctagggacaggcggcctaagaggcccagaaggaccggacctcgaccacgagccaaactcacccctcttcgccatgcccccccagagtttattgcagatcgatctacagaggtgacccccattccctatcgtttcgctagatttggagtgcgaagtggtggtttcctcgatctggcaagcgacggggacgacgcgagattgcgcgagaggcaattgcccgtgttacacacccccgaggatctcgccgcttggcttggcatccctctggggaaactcgcatggcttatccaccgcttcacagctaacagccggccactgagcgaacgcgaggcacattaccacttccgctgggagaggaaaaggtcaggggggtggaggctcatcgaagctcctaaagccacgctgaaggatgtgcagtgtaggatcctagaagagatcctctcccgcgtacccgcacatccagctgcccatggcttcgtccccggcagaagtatagtgacaaacgccgccgagcacgttgggaagcccattgtggtgcgcctcgacttgactaacttttacccaaccgttactctcgcacgcgtcgccgcgatttttagaagtgtgggttactcaagagaggcctccgtctggatggccagactttgcacttctagcctgccgcagacggctggctttcccgaaggtaatgcctctgccatcaggccatatctgcctgcacatctgccacagggcgcctgcactagcccagctctggctaatctgagcgccttctccctggatgtgcggctatccggactggcacgggctttcggcggtgtgtatacccggtacgctgacgacctaacattttctggaccagacggatttaggcgcgccctgcccaatttcttgcctttggtcgaacaggtgatacgcgaggaaagattccgtataaataaggctaagagacgcattattcggtcaaacgcccgacagatggttacaggagtcgttgtaaacgataggaccaatgtgagacgagtcgactttgaccggctgaaggcgctgctgacaaactgtttacgacacggcgccagatcccagaaccacgaagggagggataatttcgccgcatgggttcgtggccggatcgcacacgtgcaaagtctgaatgctgctcggggctccaagcttttggccctgtatcagcagatcgactggcgttga

SEQ ID NO: 13127 - RNA, 1158 nt, unidentified
  source 1..1158: mol_type = other RNA; note = synthetic construct
atgcctttgagatacgacggacaccgtagtggaaagaggcagaagaacgccgaggaggtggatcggctgccttaccgttttgcccaacagggggttaggtatggaggctatctggatctttccgatgacgctgacgtgggtaggctcgagcagctgggtcttccaatactgcacacaccagagcagatagccgtgtggctcgatagacccctgggccaggtggcctggctgattcacagattcagctctggctatcggccagaaaatgaaggggaagcccactaccattacaggtggcaacgaaaaaagtcaggcggctggagactgatcgaggctccaaaacctattctaaagacagtgcagcagcagattctcaccgatatccttagccaggtgcccgttcatcctgctgcgcacgggttcactgcaggcaggagcatcgttacaaatgcagccccccatgctggacagcaggtcctcgtgcagtttgatctcgcaaacttctacgcaaccgtaagcctctcacgcgtggtcgccgtatttaggagcctgggttactgccgggaggccgctatctggctggcaagactgacaacttccgcaattccgcagactgccacatttccggaccaggacacccatgcactgaccccattccttccaaggcacctgcctcagggagctcccacgtctcctgccttggcgaatttgtccgcctattctctggatgttcgactcaccggattcgctgctagttgggggggtacgtatacacggtacgccgacgacattaccatctctggctccaaatcactaatccgggccttgcccaaatttatccccctggcggagagaattattgggcaagaacgattcgtcttccatcgtcaaaagcgaagagtcgtgcgcgattgtagtcgccaggttgtcaccggcgtggtggtgaactcgcaccctaacttatcccgcccccaatatgaccgcctaaaagccatcttgactaattgcatacggcatgggccatcaactcaaaacagagaaaaccatgccgactttgcggcttggttacgcgggcacgtcgctcacgcacggaatcttaatccccaaaggggcctgaagttacaggcactctacgatcaggtagactggcagcgctga

SEQ ID NO: 13128 - RNA, 1302 nt, unidentified
  source 1..1302: mol_type = other RNA; note = synthetic construct
atgggtctgctgaggtggctccttgggctctttggtgccaatagtggaaccgctgtggccaaggcatggacagatcaggctctgaggtccactgctggaagaccatggcgcaggccgcgcttgtcctcaattagaaggaacgccgtatctcctccacttcgccgaactcccgcgcccactacaccacaaccggcctataggttcgccagacagggagtagctggtatgcttgaatctctgcggggccggagttcttatttgaatctcgcaaccgacctggaccgcacccgcctagatagatggaacctgccccctttggccactccggacgagttagcagactggctggagatcccagtaggtaaattagcttggttgtcaggccgtctcgttagcgggaataggcccccctcaacacgcgaggctcactacgtgtttcggtggaaggctaaaagaagcggcggcgcaagattgattgaaagccctaaaccactcctgcgacaggtgcagaccaagatcctgagagaaattttagataaggtgccccctcacgcggcagctcatggtttcgtggccggacggtccattctgaccaacgcgaaaccacactgcgaccgggtggtggtggtgaagtgggacctgacggacttctacgcctctgtcaggtacagtcgcgtggtggccattttccggtccctggggttttctagggaggtcgcactgtggctcgctagcttaacgacatctgccatcgccgctgatctgccattccctgaaagcggcccccaagctctacgcccttacttggggcgacatctgcctcagggagcagcaacctcgcccgctcttgccaatctgtcagcctttagtcttgacgtaaggctgtccggactcgctagagcatttggcggcgcctatactcgttatgcagatgacctaacaataagcggggatgacgccttcgcccggcaactgaaaaatgttatccctcttgttgagaaggtcattcgtcaggaacgatttcatgtgcacgcaaaaaagcgaaaggtgatacggcgcgggcaaaggcaagttgttgcgggggtcgtcgtcaaccagcaccccaatatccgtcgggatgattttgataggttgaaagccatcctctacaattcggcgaagcacggacctgcctcccagaacccaaacggccatcccgacttcgccgcacatctcagaggacggatagcccacgccgcgatgctcaacagcgtcagaggcgagaagctgatgcgactgtacgaggctatcgatttcggctga

SEQ ID NO: 13129 - RNA, 1350 nt, unidentified
  source 1..1350: mol_type = other RNA; note = synthetic construct
atgtggagattgttctcaagtctctggcgattgtttacggggcactccggacggcaggcgaaaaatccatatgctacattcggcacaacggacgaaagcaccgctaatgagacatttgatgatgcaatggtaagtccacccgaaccccctagacaccagaggaaacctaaggctgatcagcgctacccccgccttaccaagttcaggtaccagcctgggagagtgagtgacagagagcatgccccccagattgtgaccggcacaccataccgctacgctaaccctttcgtcgtgagccccggcatgttcttagatatgtccaacgatcttaggtctgagagactcgaccgttgggagcttccccaactgaaaacacctcaggacctggccgattggctgcaactgcccctgggcaagatagcctggctgactgacagatttacggaagccaatagaccagttgacgcatcaaaaagccactatcattattgctggaagcaaaagaagtccgggggctatcggctaattgaggccccgctgcctctgctgaggcaagttcaggaacagattctggatgaaatcttagcatctgtgccggttcacgccgctgcacacggattctgctcgggacgttcagtcgtcactaacgccaggccacacgtagggcagcagctcgttatcaaaatggatcttgacaacttctacactcgggtgcgatacgcccgcgtagtagcgctttttaggtcattaggctacagtcgggaggttgctctgtggttagcgagactcaccacttccgcagtgccatccaatctcccctttccaggtggggaaccaaagcagctccggttgtttctagcccgacatctacctcagggtgcccccacctctcctgctatcgccaatctggtggcttataacctggatgtgcgcctggcgggactggctagatcttttcaggtgcagtataccaggtacgcagacgatctgaccttcagcggaggcgaagacctgcagtattgtagcagggtgttcctgccgttggtgtctcagattgtccgcgacgagcggttccagatgcacgccaccaagcgtaaatttcttctcccaagctgccggcagcaagtcactggagtcgtggtcaacgagaagacaaatatatcccgcaaggagtttgaccgactcaaagcaactttgtataattgtgtgaagacagggcctgccgcccagaaccataatgcacacgccgacttccaagcacatttgcgcggccggatcgcttacgtgcagcaactcaaccccgcccgaggtgctaaactgctcgatctgtaccagcaaatcaggtggtga

SEQ ID NO: 13130 - RNA, 1335 nt, unidentified
  source 1..1335: mol_type = other RNA; note = synthetic construct
atgtggcggcttttcagtttcctgtggcagctacttggcgggcgatcccccgacagcagggtttctgagcctattagccctggcggcaccgtgtctgagagaacagcaagttcaagtgcggctctttctcccgctcctgggcggaagaagtctaaggcagaccagaaaaggcccgttctggtcccactcacctatagaagaccacgcttatccgaccgcgagcacgcccctgaaattgtgagcgaatccccgtataggtacgcgctgccttacgttgtatcacagggaaagtacctggatctgagccaggacattcgaccagagctgctccaacggtgggatttacctctgttgaaaacacctcaggacctggctgattggctccatctgcccgtgggccaagtcgcctggctttcagggcgttttggagagggaggacgccccgcagatgcttcgaaggcacactacaggtattcatggaagaagaaaagaagcggcggctacaggctcatcgaatccccactgcccctccttagacaggtgcaagagcagattttggatgagatcttgagccgcgttccagtccaccaagcggctcacgggttttgcgccggtcggtctgtagtgaccaacgccgcgcctcatgtcgggcagcatgtggtgatccgcctggacctcgataatttctactccagagtccgccatagtcgagtcgtggccgtcttccggggaatgggtttctcgcgagaggtgtctctgtggctcgctaaattagtgacttccgccatcccgagcaacctagagtttcccggagatcagccaggcttgctgcgcctgtttctgccccggcaccttccacaaggtgcacccacatctcccgcagtggccaatctggtggcctattccctggatgttcgcctggcagggcttgccagagccttcagtgccaattatacacggtatggcgacgacttaaccttttcaggaagtgccgaattgtctcaaggtagccgtcttttcctcccactcgctcaggctattataagagaggaacggtttagggtcaactcccgaaagcgtcggttcatgagacagtcaacgaggcaggaagtaactgggctggttgtaaacgaaaaagtgaattactcccgtcaggaatacgacagactcaaggccaccttgcataactgtgtgaaaactggttgggagagccagaatagggccgggcaccctgactttctggcccacttgcgcggcaggatcgcatatgtgcagcagatcagcccgctcaggggcgctaaactgctggctctattcacgcgaatagtgcggtga

SEQ ID NO: 13131 - RNA, 1116 nt, unidentified
  source 1..1116: mol_type = other RNA; note = synthetic construct
aaccgctcatccagcatcgtgagccaacagccataccgcatggccctgccttccgtcagaagcccgggtacattcttggacctcacaaccgactatagtcccgataaactcaatcaacgcgacctgcctcttctgaaaactcctgaggacctggcaaattggctgcagaagccactaggtaccgtagcatggttgacagactattacaatgaggccaggcggccgatagacattcggaaagcccactacagatactcttggaaacagaagcggagtggcggctaccgtttaatcgaggcaccactgccaatgctgaaggaagtccaggagcagattttagatgagattctcgatagaatcccagtgcattcgtgcgcacacggattctgtaccggcaggtcaattctgacaaatgctcgcccccatgtggggcaagatgtggtggttaagctcgaccttgataacttttacaccagggtccgatattcccgagtagtcgccatcttcaggagcatcggttatagcagagaggttgccctgtggctggctaagctcaccacctccgctatccccagtaacctggaatttccaggaaacgaacccaaactgatgcggctttttcttcccagacatctccctcagggggcccctacttctcccgctatcgcgaacctggtcgcttattctttggacatacggctgtccggcctaacacagtctttcggcggcaattacacgcgttacggagatgatatgactttcagtggggactggcagtttattaaagcgatgcggctcttccttcctctgacccagcaaataattaggcaggagagatttgttgtgaacgggaggaaacgcaaggtgctgcgtaggagcaaacagcagagcgttactggagtggtggtgaacgataagacgaacatctctcggaagtcatatgacaatctaaaagccactttgcacaattgcatcaagtccgggcccgactctcagaaccgcgaggaacaccctaattttcatgctcacttgagaggacgagtggcattcgtacagcagttaaaccgagccaagggcgataagctgctcaggatgttcgaacaaatttcatggtga

SEQ ID NO: 13132 - RNA, 1335 nt, unidentified
  source 1..1335: mol_type = other RNA; note = synthetic construct
atgggcttaatccagtttttgcgaagcctgttcttcggcagcggacctcagagtgctggaacagctagccgacagtactcagaccagtggaatgccggcagctcttcggcgaatcagaatagttctactcccacagccaccgcaccagagacagtcaggacccgacccaagctggtgccgctgagaaggcacaagaaaggcagaaaccgtcaactgattagcggggagcgcggcctaaagactgcgccttatcaactggccgtcccagacgttacctcccccggtactttcctggacttgtctagagatggcgactcagctaggcgcgccgattgggagctccctgagttgacgacaccccaggatctcgcagactggctcgaaattcccttggggcacctgggatggctaacgggtagatacctcgatggtaaaaggcccctggacgccagtaaagcccactatcattacacctggaaacagaaacggaaagggggcttcagactcattgaggcaccttatccactcctgagacaggtccaggaacaaatcctggacgaaattttgtgctgcgttcctacccatgtctccgcccatggcttcaagacaggatgctctgtactgacaaatgcccagccacacctgggcaaagacgtggtggtaaagctggatctggataacttttataccagagtgagatattcacgagtggttgcactcttcagggggattggttacaatagggaaattgccatatggcttgcgcggctgactacttctgctatccccggtaacttgcgatttccaggggggcaacctaagctgatgagcctgtttcttccccgccatttaccacagggagctcctaccagcccggccttagccaatctggtagcatactccctggacatcagacttaacggcatcgctgaatcttttggcgcacagtatacccgctacggggacgatctaactttctccggagatcacaagttccgtgcctcgcttcggttattccttcctctggtccgccagattatacggcatgagaggtttgtgctcaacccaaagaagatgcaagtggtgaggccgtgttcccggcagctcgtgacaggagtcgtggttaatcagaagcctaatatctcacgcaaagagttcgatcggcttaaagctacgctccacaactgtgtgcggctggggccagagtcccagaaccgtaccaatcacgaaaactttcgggcacacttgcgcggacggatagcttttgtgcaacagctcaaccccgctagggccgagaagcttctaatgatctacaaccgcatcaagtggagttga

SEQ ID NO: 13133 - RNA, 1338 nt, unidentified
  source 1..1338: mol_type = other RNA; note = synthetic construct
atgcgcttcctcgaattcttgaagcgcctttttttcggagggtcagcacagtccacagccgataaatactccaggacccctgacgacactcgattccagtctaccctcgctccgaccgagcccgaaacccatcctgagagccagataagtgaccacgtcaaacgcgagcagcattggcctgtcctagtgcctctgcgtcggaagaggatccgccagactactcacaacggggaggaaaccgccggccctaagaagtacgccctcgctttaccatatattatgtcacccgattcttatctggaccttacacaggatgtgcaacccgagctcctcaacaactgggaccttccacacatcgtcacgcccgccgatctggccgattggcttcagatctccttagggcagctggggtggctgacggaccgctttagcgaaggcaagaggccgatcgatgctaggaaggcacattacaggtattcctggaaagaaaaaagaagcggtggctaccgactgattgagtcaccactgcccatgctgaggcaagcacaggaacagatccttgacgaaattctggaacagattcctccgcacgctgccgctcacggattcaggacagggagatctatcgtcactaatgccgaaccacatgttggtcaggccgtgctggtaaagcttgacctcgacaacttctatacacgggtgagatttagtcgggtggtagctatcttcaggagcctgggttactcccgagagatttctttgtggctagctcgcctcacgaccagcgcgattcctggcaatttacagtttcccggcggacagccaaaactatttagcctctttttgcctcgccacctgccacaaggagcgtctacaagtccagcactggcaaatctggtggccttttccttggacgttcggctgagtggcctggccaagtcttttaacgcgaattacacccggtatggagatgatctcactatctcgggcgatgagcgattccggcattcactgagattgttcattcccctggcaagacagataattaggcaagagcgcttcgtgttgaacgcaaaaaaaaagaagatcatacggccaatgtcccaacaacgtgttacaggggtggtcgtgaatgagaaaactaacatcccccgaaaagagtatgacagactcaaggctacccttcataattgcgtgagatttggacccgagagccagaaccacgatcagcatgaacactaccaagcccacctgcggggcagaatagcgttcgttcagcagttgaatcctcacagaggtgagaagttactggccatttaccgtaagatcaattggtga

SEQ ID NO: 13134 - RNA, 1338 nt, unidentified
  source 1..1338: mol_type = other RNA; note = synthetic construct
atgctgttgctcgaactgttaaagcgccttctctttggctcttcagcggtatcctcaaagaaaagggtagtcgagactgctagttcgcgcagcgatgggagattttctccccccgctgaagcttccgtggccgtagcagataagcccaggaagaagcctcgcgaagagcaaacttggccgattcttagaccactgagacgcaaaaaagtgcgtcctgaacgggatgctgccgcaaacgccgggagcaaacagtatcccttcgcttatccttacgttgtgagcgacggctcctacctggacctgactaaggatacagaccgtgagcggctggaccggtgggatcttccctacttcgagacgcctacacagctagcagaatggtttaatttgccccttggccagctcgcctggttgaccgataggttcagcgatggaaaaagaccagtggacaagtctaaggctcattatcgttatcagtggcggaccaaacggtctggcggctaccgtctgatagaagccccacttccgctgatgaggcaggtgcaggagcagatcttggacgagattctagacagggttccaacccatgacgctgcacatggcttttgtgccgggcggtcagtagtgacaaacgccgaaccgcacgtgggtcaagcagtggtggttaagttcgacctggacaacttctataccagagtgaggtacagtagggtcgtcgcagttttcagaagtttcgggtactccagagaagtcgctatctggctcgcccgactgagcacctccgctattcctgcgaacctcgactttcccggccgccagccaaaacggttacggctgtttctgccacgccatttgccccaaggggcccctacttctccctgcatggcgaatctcgtggcgtttagcctggatgtccggcttagcgggttggcaaagtcattcggtgccacctatacacgatatggagacgatctcacgttctcaggagatgagagttacctgaggagcttgcgcgtctttatccctttagcccaccagattataagacaggagcgcttcgttctgaacggaaaaaagaagcaaatccggcgaagggtgtctcagcagaaggtcaccggcgtggttgtgaatgacaaaacaaacatcccacgaaaagagttcgaccgcctcaaggccactctgcacaactgcgtccagcacggacctgattcccagaatcacgatcaacacccaaactttagagcccacctaaggggtcgaatcgcatacgtgcagcagctgaatgagcatagaggaaataaactgctctccctgtaccaagccattaattggagttga

SEQ ID NO: 13135 - RNA, 1113 nt, unidentified
  source 1..1113: mol_type = other RNA; note = synthetic construct
atggacttatctcttgatggcgatgattcgttgctggccagctaccacctacccgtatttcacactccacaacggctcgccgactggctgggtattcgggtgggggaattggcatggctggtgcacaggtcaacgtccgatagacgacccgcagacgagcagcgcagccattatgtataccggtgggtcaaaaaaagaagcgcgagtctggaggctggatctcccaactcacggccagttcagacacagtggcgacttattgaggcccctaaacagaccttgaaggctgcccagcggaaaatcttaagcgaaatcctggagaagatccctgcccatcacgccgctcacgggttcgttcgaggcaggtccatagtttccaacgcaagaccacatgtgggccaggcggtggtcataaaactggacctgcaaaacttctatgccaatgttacctactcgcgggtcgtggcaattttcagatctatgggatattgccgggaagctgcaatctggctcgggaggctcactactagcgctgtgccatggtcactcgcagtgcctgacggcgacgaggcaatgaagtccctctacgttcgccgccatctccctcagggagctcctacatctcccgcgctggctaatcttagtgccttcggccttgacgtccgcctgagtggactgcttaagaagttcggagggaactacacaaggtacgccgacgatttgaccttatctggcagtgatgattttcgtttttcactcagatgtgtgatcccgctaaccgagcagattgtacggtccgaacgcttccgactcaaccaccgaaaacgtaaggtggtcagaagagggcacagacaactggtgacaggtgtggtcgtgaatgccaagcctaacatccgccgcgatgagttcgatcgcctgaaggctattctgtataattgcgtgaagctgggtcccagctctcagaacagggacgcccatgccgacttcagcgcacacctgagaggcaggatcgcctttgtcaggcagctgaatccggcgcgggctgaaaaactatggaggttgtttgagaatatacgttgggacgggtttcccccaacccaaggttccaggtga

SEQ ID NO: 13136 - RNA, 1320 nt, unidentified
  source 1..1320: mol_type = other RNA; note = synthetic construct
atgaagctcctcttagatttcctgaggtggctactaggggacagaggcgggaccagtcgtacagggagccagcagccaacaggcactcagtcacggcggctgaaacgacgcccagtgaaactgacaaaacgccgccgcctgtctggtaatgccctcctgatgcaaaggcctaagccaatcaaatctctggccccgccctaccaattttcggcctacgcatctgaccacaggcagttccttgaccttagccaggatggcgatgatagcctcctggcctcctatcaccttccagtatttcataccccacagcatctggcgcagtggctcggtgtcagggtaggggagctggcttggctggttcaccgcagcacctccgaccgaagaccggcagacgagcagcgctctcattatgtctacaggtgggttgaaaagagattagcctccgtggagtccggaatgcccaatacgaggcctgtgtccacacagtggaggcttattgaggctcccaagcagactttgaagtgtgcacagcggaagattctcacagaaatcttagagaagattccgactcaccaggccgcacacggatttgtgagaggaagatcaattgtcagcaatgcgaggccccatgtcgggcaggcagttgttataaagctcgaccttcagaatttctatgctaacgtcacctattcaagggtggtggcaatctttcgatccatggggtactgccgtgaagccgccatttggctcgctaggcttactactagtgccgccccttggagcttggctgtccctaacggcgacgaggccaccaaaagcttgtacgtgcggagacatctgccccaaggtgcgccaacatctcctgctctggctaacctgagtgcctttggtctggatgttaggctgagtggattgctcaagaagtttggaggaaattacacgcgatacgctgatgacctgactttgtcgggcgatgacgatttccggtatgcgttaagatgtgtgatccctctgaccgaacagatagtccgctcagagcgattcagactgaaccaccggaaacgtaaggtagtgcgacaaggccatagacagctggtgaccggagtggtagtgaataccaaacctaacatccggcgcgatgaattcgaccggcttaaggcaatactccacaactgcgtgaaactgggccccgcactgcaaaaccgtgacgggcacggcgattttgctgcccacctacgcggccggatcgctttcgtgggccaattgaatcccgcccgggccgaaaaatgccagagattgttcgagcagatcagatggtga

SEQ ID NO: 13137 - RNA, 1341 nt, unidentified
  source 1..1341: mol_type = other RNA; note = synthetic construct
atgggtttattcgactgggtgcgaggtcttctggggtttggcaatcctgctccaaaccccgtggaatcccctgtggaaacgaaaaacgcccccttgcctactccagcttccggggtcgcctcaccaccttctggtcctgccagttccagacgcgaccgtggagtcactaggtcaagggagttcaggcggtcacgatccgctatacagctgcggaccctgaggtttcagctgcgcccaaggtccgacttgcggacgaccgttcaggatcgagcgcattacagattcgccagaccatccgtggaaggaggctttctggacctgacacaatcaggcgatacgggaaatctggagcaactatctttgcccgtattcagaacccccgaggagatcgccgggtggttgcaaattcccctgggacagctggcgtggcttgtgcatcggttcgatgaagaccagaaagcaggtgacgagaagacaagccactactggtatagacttatccccaagcgaagtggcggacagcggctcatcgaagctcccaaggcgaaactcaagagggcccagtggcagatcctcgatggcattctatctaaagtcccggcccacagggctgcacacggattcgtcgccagtcgcagtatcctgacaaacgccaccccacatgtgggccaacgcgtgattgtaaaactggatctggagaatttctatccgagcgtgacctttaaccgcgttgtcgccatattcagaagcctgggctactgtagagaggcagctatctggcttggtcgtctgaccactacaacattgccacgccgtatttcccctgaactcagccgatgcgccgatctcaacgattataggggacggagactgcctcagggggcacctactagcccggctctagcgaatctttcagcttttgcactggacctgcgcctctctgggttagcacggtcttttcatgccaattattcgagatatgccgatgatataaccttttctggcgacgacagattcctccggagcctcgctgttttcatccccctcgttaagacaattttaaagtccgagcgttttcgagccaaccggcggaagtggagagtgattcgcaataaccagcgccagaccgtgaccggggttgtcgtgaatgcaaggcccaacgtgactcgcagaaactacgacaggctgaaggcaatcttaactaactgcattcggaggggcgccagcacacaaaatcactcgcagcacaaacagtttgctgcccatctgttggggaggatcgcgcaggtaagtcacctcaatgctgagcgtggccagaagctttacgcactgtacagctga

SEQ ID NO: 13138 - RNA, 1311 nt, unidentified
  source 1..1311: mol_type = other RNA; note = synthetic construct
atggggctgttccagtggcttcgtggcctctttggattcggggatgcagccccagagtcctctgcccagcctcatagtcccagttctagcagggctagtgacagcaatcgcgctacaccagccgctcgaccaccaagaaaaaggcgcagaccagcccgcctgaagcctttgagattcaaacccccacggaaggtcggaggacgaacgactttgcctaaagaccggggttatagattcgcccgccctagtgtaacgggaggctggctagacctctcccagggaggcgacgcatctagactggagcgctactcactgcctgtctttaagattcctgagcagctcgctaagtggctggagatccccctgggtcaactgggttggcttgttcacaggttcgatgacgagcacagagctgcagatgaaaagtcagcccactacttttatcgctggattgacaaacgggccggcggcaaacggctaatcgaagctcccaaggtgaaactgaagggggtgcagtggaaaatcttagatggcatcctccgcaaagtacctgcacaccctgccgcacacggtttcgtaaccggtaggtccatatcgaccaatgcggtgccacacgtgggccaacgtgtggttctgcagctggatctggagaatttttatccctccgtgtcccttaatcgcgttgtggccatatttaggtcactcggctactgccgagaggccgcaatttggcttgggaggctgacaaccaccactctgccagcctccatgaccgcgacatttggcagaggacccgaaatccatccgtaccgagggaggagattaccgcagggggctcccacttctccggctcttgcgaacctcagcgccttcgtattggacctgcggctttctggcctggctcggactttcggcgcaaactatactaggtacgcagacgacctaacatttagcggggatgcagtcttcttgaagagcttggctgtttttattcccctcgtcaagcagatcgtgagggatgaacggttcttaattaaccgcaggaagtggcgagtgctgcggaacaatcagcggcaaactgtggccggtgtcgtggtcaacacacgaaccaacgtggccaggaaggattacgatcgcttgaaggccacactgaccaactgtgttcgtagaggagctagcacccagaaccatgacagacatgagcggtacgcctcacacctgctggggagaatagcccacgtggcacatcttaatcccgcgcggggagaaaagctccgtgtcctctatgatcaaatcgactggaataaatga

SEQ ID NO: 13139 - RNA, 1350 nt, unidentified
  source 1..1350: mol_type = other RNA; note = synthetic construct
atgggcttcttcgactgggtgttcgggtggctcggtttaggccttcggtcacccgcaaagacagcaggcagtgctcccccaggatctccgggtgatagcctggggcaaccaggggaaaccgaaacccaatttcggactaggaatagaaactacgccaaggtggcgctaactccccgaacattcagagctaccagggcaggtggtgaacacccggaagagcgccgtgcaacaggagattggccatacaaatttgcaagaagggcccccgatccagctcgctggttggatctgagtcgcgatgctgaccgcgtaagactcgcccagttcggcctgcccgtactcgaaacgcccgaagaccttgcgcgttggttgcaggtcgagctgggggagcttgcttggctcagcggtcattttcacttcggaggccggccagacagcgttgcgagatcccactatcactatagttggatcgagaagcgatctggagggcggcgcttaattgaggcacccaaggctaggctgaaacatttacagacacagatccttcgatgcatcctggacagggtgcctcctcatagggccgcacatggcttcgtcgcaggacggtcgattttgagcaacgccgccccccacgtaggacagagagtgctcgttcagttcgatctaagcgacttctacccctcagtgtcctactcccgcgtcgtggccattttccggagtctgggcttttctagagaggtgggttgctggttagcccggctgacgacttctgctgtgcctcacgagctgctcaccggcccttcctcaacccgcttcgggtccaggtttgattctgatcacgagctgtatctgcgtcgccatctgccacagggagcccctacctcaccagcccttgccaacctctccgccttcgtgttggacctgagactcgctgggctggctagggctttccaggcacattacaccaggtatgccgacgacctgacctttagtggcgggactaggtttcagcgaagcctggctgtttttatccctctggctagacaaattatccggggcgagcgctttagcatacacccattgaagtttcgagtcaggcggagggggcagcgccaaacagttactggcgtcgtggtcaacgatcatcttaatgtgtctcgggcggatttcgacagactgaaagccatcctacataattgtgcccgtcacggccctgcatcccagaaccgttcacaattgccggactttgccggccacctgagaggacggattgcccacgttcagatgataaatcctcggagagcagccaaactcgtggcgctctttggacagatcgactggacacgatga

SEQ ID NO: 13140 - RNA, 1293 nt, unidentified
  source 1..1293: mol_type = other RNA; note = synthetic construct
atggggtggctggactggttgtggcggctgtttacaggcagcggtgctgacagatcacctcaggagctgacctcggccagaggcacagcagcagacccagcctcaaaggcaagacgacgtcctggacgcagacgccgactggttccactgcgctatcgccgtaatccctctagatcccctcctgctttggcagcgcagctcccatatcgcttcgccaggagaagcgcagacctgcgacactggaacgatctcaggcaagatgggcagccacgtcggcttgaacaactaggccttcccgtgcttgctgggccggatgacattgcttgttggctttcattaagcgccggagaagtggcttggctcaccggacgcttttgggaagggaggtctgcccctagagtggcagcaagccactatcactacagatggatcgctaagcggaggggaggaaggcggttgatagaggcccccaagtctcggctcaagcgagtgcagcagcagatattagcagagattctgggacgcatcccacctcacgttgcagcccatgggttcgttacaggacggtctatccagaccaatgcccagccccatgttggccagcgggtgttgcttaaactggacctcgagaacttttacccatcagtcacctaccccagagtcaccgccattttcaggtccttaggctacagtagggaggccgccatctggctggctaggttagtgacaacagccgtcccgcccaatctctgggaggctggtagaccgtccgatgtagcggaaaccagatatctgcgacggcatttgccccaaggtgcgccaactagtcccgctctcgctaatctaagcgcatttgtactggatctgaggctggccggtctagccaggtccttcaacgcacagtatactaggtacgcggatgacctcactttcagcgggggcgaagtattccagcggtccctcgccgtctttttgccccttgtgcgtcagattgtggcccaggagcagttccgcctgaacagtaggaaaacggccgtgcagagggcttcgcaacggcagagagtgactggcgtggtcgtgaattctaaactcaacatccgccgtgaagactacgatcggctgaaggccacgctgaaaaactgcattcaatacgggcctactagtcagaatcgcgaacgccaccctgagtttgcctcccatctgagaggccgaatagcatttgtcacctctctgaacagccaacggggcgcgaagctactggctctgttcgagcagatcgactggaatcgatga

SEQ ID NO: 13141 - RNA, 1290 nt, unidentified
  source 1..1290: mol_type = other RNA; note = synthetic construct
atgtcctttttcgacagcatcctccgctggctcggactcaagaatacgccgccaaccggtagagatcacgcccaacagaggaggggcaaactacggagacgacggggcaggctggggcatatctatatggtacctctgcgtcgccgacagggacagagatctgcagatcccaccgaggacgcgggcgaagaatcagctgagtccccctacaggtttgctcgctttggcggctacggcgaatatcgtgacctgagtaaagacagcacgccagagcggctgtatcagttcggacttcctcagctgtgtacccccagtcacatcgctgaatggctggaagtgccttgcgggaggttggcatggctcattcaccggtttgatgatggtgggcgcgccgcccatgttgcacaagcacattatcattactcatggctgaagaaaagagggggagggtatagactcgtggaagccccgaagcctatcctgaaggcaatccagcagaaaattttaagggagatcctggatcgcattccccttcacggagccgcccatggcttcgttgctggtcggtccatctgtactaacgctcagccccacgtgggccaaagggtggtcctcaagttcgacttagagaacttctatgcaaacgtcagcttctctcgggtggtggctatttttagatccgtgggtttttcaagagaggccgcgatctggctggggcggttaacaacagcattgccacctgagggacttcctgccccaggtggagacagaaatgtcgtgcgaccttacctgagcagacacttgccacaaggggctcccacctcaccagccctcgctaatttgtcttgctacgccctagacctgaggctagccggaatggccagagcctttggcgctacctacactcgatacgcggatgacctcacattttctggcgatcagcacctgattgattcgctgaacgtcttcataccgttggttaccaaaatagtgcggagtgaacgtttcactgtccacgcggggaagcggaaagtagttagaaataatcagcagcagcgcgtcactggggtggttgtaaatgagagacttaacatttgccgcaaggattacgaccgcctgaaggccatcctgacaaactgtgtgaggcacggagctgcaacacagaaccgtgagcaacgggccgacttcgccgcacatcttcgcggtcggatcggccatgtgcagtccattcaccccggccgaagcaggaagctgcaggctatattcgatcgaattgactggaggagctga

SEQ ID NO: 13142 - RNA, 1299 nt, unidentified
  source 1..1299: mol_type = other RNA; note = synthetic construct
atggggctgctgaattttttttggcggctcatttttggtgatcccccgagtcggccggagagcagttcttcagcttctcgtgatagtagcgtatccagaaaccctagcacacctcggacacggactcgaaaactgcgcgctaggctgatccccgatcgcgtcaagagaagccgccaggacttcccccagaatatagtgtcttccctgccctacaggtttgcaaggctgaacgtgacgggcggttatctcgacctttcgcaggatttggacgagccccaattacagcagttgggactgcccctgctcgctactcctgagcagcttgctaattggctcggcattccgctggggaaactggcctggcttacacacagatgtgatgaagggcagcggccacgcgacgtcagacatagccattaccattaccgttgggttaagaaaaaacagggcggctacaggctcatcgaagcccccaagcaccaattgcgcagactacaagacaaaatcctcttagaaatactgtgcaagattcccgtgcatccagctgctcatgggttcgtagccggacgatcaataaggtcaaatgcagaaccccatgttggtcagcgcgtggtggttaagatggatctcgcgaacttttatcctacggtgaggttcagtcgggtcgtgtccatcttccgagccatcgggtttagccgggaggtggcaatttggctagcgcggatcaccacttccgctgtccctttggccttcgagggcccacctggtgagttgaatcggtgggccctgacaccttattatagtagacacctaccacagggagcaccaacctcccctgcccttgcgaacctgtctgcatatctgttagacaggcggttggctggcttagcgcgcaggttcagggccaattacacccgttacgccgatgacctgaccttttctggggacgcaaagttcctgtcaggacttcgaaactttgtgccactggttcataccgtaattcgcagagagagattccagcttcactacaagaaaactaaagtgcacaggtctaatcagcaccagcgagttactggagtggtcgtcaatgagaagccaaacatgtccagagccgatttcgaccgactgaaagccatcctgaccaactgcatcaggcgcggcgtgagcacacaaaaccactcacagatcccagacttcgaagcacacttgcgtggaaagatttcccacgctaagtttctcaaccctgccagaggcgcaaagctcctggcccttctcagaaaaattgattggcaaagctga

SEQ ID NO: 13143 - RNA, 1290 nt, unidentified
  source 1..1290: mol_type = other RNA; note = synthetic construct
atggggctgtggtcttggcttagaaggcttctgtttggccaaccgaaacgctcagcagcctcccgcagtgatgatcgagaacaaaaaagacggcggccaagggctcgacttactcccctcagacaccgccagaggagaacggacagatggaggcagagggatgccgccgggtccattaacaaaatcacagtcaagagccagccctacaggtttgcatggagctcagtgttcggcggcttcttggacctaaaccgcgatggtgaccctgctcgccttaaacaggctgggctgcctgtatttcaaaccccccaggaactggccgattggctgcagatgccaatcggacgtctcgcatggctcgtccaccgcttccacgaccaccaacggccagccactgtgaaactgagtcattaccactaccaatggatagcgaagaggtccggagatcgacggttgctcgagatccctaagccacagctcaaagcagcccaggagaagattctccgcgagattttggacctcgtaccgacccattcagccgctcacgggttcgtcaccggacgaagcattaagaccaatgccgaaccccacgtgggccagcgagttgtgatgaagtttgacctggaaaacttttacccttccgtaaagtatagtagagtcgttgcgatatatcggtccttgggatatagcagagaagccgccatctggctgggccggttaacaacgtctataacacctccactgggaacattaaaggacctagctaccgaagcggagtggataccatatgcaacccgtcatcttcctcagggagcacccacaagtcccgccttggcaaatttgagcgccttcgctctggatctgagactggcgggcctggctcggactttccatgccaactacacccgatacgcagatgacctgactttctctggtccggatcagttcctgaggagcctcagggtctttattccactggtgatgcagttaatcagacaggagcgctttcgtgtgaaattatctaaacggaaggtgatccggaactcccagcagcagcggatctgtggggtggtggttaacgagcagatcggtattcccaggagagagttcgacaggctgaaggctattctcacaaattgcgttcgcagagggcccgctactcagaatcacgagagacatcctgactttgctgcccatctgcgcggcaggatcgcccatgtgtcacaccttcactcggagcgtggcgcacggctactggatctcttcgaacaaatcgactggaattcttga

SEQ ID NO: 13144 - RNA, 1299 nt, unidentified
  source 1..1299: mol_type = other RNA; note = synthetic construct
atgggactcttcaactggctcagatgttggttcctcggcaaaagaccacctgcaaccaatgacgttgtttctgaccaaggcgctgcccctcaacgacgaaaacgccggcggaagcactctcgtgcaaggctcgtcccactgcgtgcagctgccgctagggatgctcgtaggaggttcccagggttgaccactgcagagcggacaggggcagctccatatcgcttcgcgcgaccttgtgttcttggtggctggctagacttttcattggatggccagacagaacaactgggcagcgccggcctacccgtgtttgagacgccacagggactggccgactggcttgaattaccccttgggaggttggcgtggctgattcataggttcgagatcgagcagcaacctccagaccaggccaaggcccattaccatttctgttggctacctaagagaagggggggaaagaggctgatcgagagccctaaacccatcctcaaacgcatccagcatcgtattctgcgcgagatcctggacaaggttccgcttcaccccgccgctcacggatttgctgccaagcgctctatccggactaatgccgctccgcacgtgggtcagagggtgattctcaaaatggatctggaaaacttctacccctccgtcagatttagtagagtggtagcgatcttcagatccttaggctatagcagagaagccgcgctgtggctttctcggcttactacgtcttcacttccagccaacgccgcccagtggagtttatggtcccccgaactggaagcatatctctgccgacatttgccacagggtgcaccgacctcacccgctttggccaatctcagtgcatttagcctcgacctgcgcctggcagggttagctcgcacttttggagcccgatacaccaggtacgctgatgatctcacatttagcggggacgaacacttctccagatcgctggccgtgtttatacccctggcagagcagattattcgggccgagcgctttagaaccaacaaatccaagcggcatgtcgtgagagatcaccagcggcagcaggtaacaggtgtcgtcgtgaacaggcaccctaatgtggcccgccctgactatgaccggctgaaggctgtgctgacaaattgcatacggcgaggcccctccacccaaaaccactcaagggaggatgattacgcggcccacctgagaggctgcattgctcatgtggcattcctgaatcctagccggggagagaagctgctggacttgttcagtcagatagattggaaccgctga

SEQ ID NO: 13145 - RNA, 1293 nt, unidentified
  source 1..1293: mol_type = other RNA; note = synthetic construct
atggggattttccaatttatacgtcgcctattgtttggctctagcccttcccgccctatcgctccagctgacacccacagcgctctgaagcagattaagccgtctaggcctagaagaaaaccgcgactccaaccactccgctttaacaaaaaaaagaaccgcgactcccccgacatggtcgatgtctccccacttccctacaagctggcaaggccatacgagctccttagataccgaagccagagtgaccactatctagacatgacccaggatgtagatcaccaaaagcttaggcagtaccatttgcctgcttttagtactcctgaagaaatagccaattggctcgaatatcccctgggcaaactggcatggctaacacacagattcaatcaggctgatcgccccgacgacgtaaatgaaagccactatacttatcattggctgcctaagcggaacggatataggctgatcgagagccccaagccctttatgaaaatggctcaacagcagatcctgcaggatattttgaacaaaatccccgcccatccaacagcccatgggtttgtgactggtcactctcaagtgacaaacgccgtccctcacacaggcaaaagggtagtcgtgaagtttgacctcgagaatttctacgcctcggttaagttctcaagggttatctcaatttaccggtccgtggggtactgcagagaagccgccatatggcttgctcgcttgactaccacggcgattcccatgtctatgcctttcccagatggatcactccggccgctgtatccatacctgagccggcatttaccacagggagcccctacctctcccgcactggcaaatctttcagccttcagtctggatgtgcgactgtccggcctcgcacggtcattcgatgcggagtacacgcgctacgcggacgacttgaccttttctggctccgatcaattccttaggtccttgcgggtgttcatacccttagttgagcagattatcagaagtgagagatttcaggtcaaccagagcaaacggcgtatcctgcgcaacaaccaacagcaaaaggttaccggcgtggtcgtgaatgagcatactaacgtgcctagaaaagaattcgatctgctgaaggccatcctcacaaactgtatccggaagggtcccgccagtcagaatcgagagggacacccggacttcgcaagccacctgaggggtagagtggcttatgtgcagcagctcaatccaaatcgagggcagcgtctgctgcagttatatcagcagattaggtggtga

SEQ ID NO: 13146 - RNA, 1269 nt, unidentified
  source 1..1269: mol_type = other RNA; note = synthetic construct
atggggctgtttcagttcatcagacgtctgctatttggatcatccagcgggaggccagtgactcccaccgattcctatagtaaacagaacaagacacagcgagcttaccgcaagcccagactcaaaccttttagataccggcagaatcggcgcacagacacgaccgagctcgaagaggtgtcaagtcctccatacgagttagcaaggtacgccagccggacagggcactatttcgacatggcacaagacaccgattttgaaaagctggatcagtacaatcttccacggttctgcaccccacttgaactgagccagtggttggaattccctttgggaaagctcgcctggttgactcaccggttcaatcagttcgacagacctgacgacgtgaaggagagccactacgtgtatcattggctacccaagaggaacggcttccgtcttatcgaagcacctaggccgtttatcaagatcgcgcaggagcagatcctcaaagacctgctaaatcgaattcctgtacatccggcggctcacggatttgtggctggccacagctccgtgaccaacgctctgcctcataccggcaaacgcgtcgtcgtgaagttcgacctcgagaacttctatacctcagttaaattttctcgcgtggtttctatataccggagcattggctattgtcgcgaggtgtctctgtggctcgccaggctcaccacttccgctatccccatgagtatgccctttcccgatggtagcctgcgaccactgtatccatatctgtccaggcatttacctcagggggccccaacttcaccagccctggcaaacttgtcggccttttctctggacgtccggctgagtggattagccagatcttttgatgccgagtacacacgctacgctgatgatttaacttttagtgggtctgatcaattcctgcgagcattgcgcgtctttattccgctcgttgagcagatcatacgaagcgagagattccaggtgaatcagtccaaacggcgggtattgaggaacaatcaacaacaaaaagtcacaggcgtagtcgtgaacgaacacacaaacgtgcctcgtaaggaattcgacctgctcaaggctattcttacgaattgcattagaaaaggtcccgcctcacagaacagaaagggtcatcccgatttcgcgtcccacctgagaggcagggttgcctacgttcaacaactgaaccccaataggggacagcgccttctgcagctttatcagcagataaggtggtga

SEQ ID NO: 13147 - RNA, 1293 nt, unidentified
  source 1..1293: mol_type = other RNA; note = synthetic construct
atggggttctttgattttatacgacagctgttcttcggaccagcacctgatcggtctgtggcaagaccggaaacctcagccaacgttaaaccttcaaaagctccccggatcttcagaaaacctagactgagccccctcaggtacaataaaaaaaagaggttcactccacccgagaacgccgacgtcggatcactcccgtacaagctcgctcgcccgtatgaattgttacgctaccgttcggaaaccgatcactatcttgatatgacccaggacggagacgccgccaagctatcccgcttcgaccttccagtgttttctactcctgaggacatcgctcactggttgaacctcccacttgggaagctggcttggctcacacatcgcttcaatcagtccgatagacccgacgacgtgaaagagtcgcattatacgtatcattggctccctaagcggaacgggtttaggctgatcgaagcgcccagaccatttattaagatggcacagcagcagattctgcaggaaatattgaatcagatccctgtgcacgatgcagcccacggctttgtcacggggcacagtccagtgacaaacgcgattccccacaccggtaaacgtgtcgtagtcaaattcgatctggaaaacttctatgcctctgttaatttcgcccgagtcgtcagcattttccgctccgtaggatactgccgggaggctgctctgtggttagccaggctaagtacaactgctatcccgatgaacatgcccttccctgacggctcacttcggcctctgctcccatatctgtccagacatctgccccaaggcgcaagcactagtcccgccctggcaaatttgagcgcattttccttagacgtgagactgagcggactagctcgaagcttcgatgccgactacactcggtacgctgatgacctgacatttagtggtagcgaccagtttttgcgatccctgagagtgttcatccctctcgttaatcagatcattcggtctgagcgctttcaggtgaatcagtctaagcgcagggttctgaggaataaccagcaacagaaggtgacaggggttgtagtcaacgagcacaccaacgtgcccaggaaggagtttgatcttcttaaggcgattttaaccaactgtatccgacaaggcccagtgggccaaaatagggagcaacatcctgattttgcctctcacctgcgcggccgtatagcctacgtgcagcagctcaacccaaataggggtcaacggctgttgcagctgtacgagcagattagatggtga

SEQ ID NO: 13148 - RNA, 1275 nt, unidentified
  source 1..1275: mol_type = other RNA; note = synthetic construct
atgggcctctttgatttcctccggagaatttttttcggatctcctccgagccaaacagtttcccctgtggagagcgcaccagttcccgaggagacgagctcccgaaagcctcggcgcaaaaccactctggagcctctccgctacagttccagccactctagcagggtagagaacattgaggaagtagccgcccctccctacgagttggcgagatatggcgccaggacaggccattattacgacatgactcgggatggggacaccgagaaattggccagatatgagctcccactgttttcaacccccgttgaactagctgaatggctaaacataccactcggtaagttagcatggctgacacacaggtttacccagttcgatcgccctgatgacgcccaggactctcactacatctaccactggaaacccaaaaggagcgggtttagactgattgaatccccacggcccttccttaagatggcccaacaacagatcctgcatgaaatcctgaatcagatccccgtgcacacggcagcccacggtttcgttaggggcaggtccagtgtgactaatgccacacctcataccggaaagcgggtggtggtcaagttcgatctggagaacttctacacttcagtgaaattctcccgtgtggtcgctatatttcgcaatctaggttattgtcgcgaagcctcgctttacttagcgaggctgactaccagtgtgatcccaatgtcattgcctttcccagatggatcactgcgcccgctggtgccatatctgtcacgacaccttccacagggggcctctacctctcccgctttagcaaaccttagtgcatactccctcgacgttcgcttgagcggactcgctcgagctttcgatgctgattatacgagatacgctgacgacttgaccttctcgggctctgaacagtttttacgaagcctgcaggtgtttttgccactcgtcaaccagattattagatccgaacgatttcaggtcaaccacatgaagaggcggatacttagagagaaccagcaacagaaggtaacaggcgtcgtggtcaatgaacaccccaacgtgccccgtaaggaatttgacctgctcaaagcaatcctgacaaattgcattcggcaggggccgcggactcaaaatcgcgagaatcatcctgacttcgccagtcatcttcgtgggagagtggcgtacgtccagcagctgaatcccaagcggggacaaagactgctgcatctgtatgagcagatcaggtggtga

SEQ ID NO: 13149 - RNA, 1278 nt, unidentified
  source 1..1278: mol_type = other RNA; note = synthetic construct
atggggttgttcgactttattaggcagcttttcggaagccctcctgatcggagtgggcaagctgccgccccagatcctgtgccagaaccagcacctcacgagcctccccagaagagacgccccgtgaggcttcatcccttgcgatatcctaagcgccgtccgcgaaccgaatacaatatagaggaggtgccagcaccaccatacgagcttgcacgctatggcgccatgactggacactactttgatatgacgcaggacacagatgcagcacagctcagccggcatgagctaccgcaatttgccacccctctggaactggctcagtggctggaaatcccattaggtaaactggcttggctgactcacaggtataatcactcagatggccccgaagacgtgaaggagtcccactatacctaccactggctacccaagcgcaacgggttccgcctgatcgaagcccctagacctttcatcaagatggcacagcagcaaatccagcaagaaattctctctcggatccccatgcaccattcggctcatggctttgtgagtgggcattcccccgtcacaaatgcccgtccccatgctggcaaaagggtggtgctgaaattcgacttagaaaacttctacgccaatgtcaagttctctagagtcgtatcaatttttagatcacttggctattgcagagaggcggctctttggctggctcgcctcacaacctccgccattcccgccaacctgccattccctgacggtacgctgcggccgttgcttccctacttatctaggcacttgccacaaggagctccgacctctccagcgctggcaaacctcagcgcgtattccctagatgttagactgagtggcctcgcccgaagcttcggagctgactacaccagatatgccgatgacctgacattttctggtagcgaggcattcctgcggtccctgaaagtttttatacctctcgtgcaacaggtaatccgtagtgagaggtttcaggtgaacctcagcaaacgcagggtcatcaggaacaatcagaggcagacagttactggggtcgtggtgaacgaccacactaatgtatcacgaaaagagttcgaccggctgaaggcgatactgaccaactgtatccgccagggaccagaaactcagaatcgggagcaacatcccgattttgccaatcacctccggggcaagattgcccatgttcagcagctgaaccccaacagaggtcagcgactcttgcacttgtacgagcagattagatggtga

SEQ ID NO: 13150 - RNA, 1278 nt, unidentified
  source 1..1278: mol_type = other RNA; note = synthetic construct
atgttcattcctatcacaggaccactcccgtcaagcatcaagattcgcaggcccatctctatagtgacccccttgctgaaaccctcctcttcccaccggaccgagctggagggaaagcctcggctgaccccgttacgctatcgcccagttgaatcgcgtgcagaagcggccctgccagttgaccacctcccttatcgattcgctcgactcgccactaggcccggccagtactgggatctcagcagagacggtgaccccgatcagctacgaacccttgggctgcccgagttccacacgcctgaacagcttgctgactggctgcagatgccggtggggcgattggcctggctcactaggaggtgtgcagagactcaacggccagaaacagagcgggatggccattattactgcagatggatggaaaaacggagcggaggatggagactcattgaagctcctaagcccatcctgaaaagtgtgcagcagagaatcgctcgtgagattctgcagaacatccctccacacgaggccgcacacggatttgtgagaggaaggagcattgtcaccaacgcacaaccacatgtgggtcgcagagtcgtcttaaagctagacctggagaacttttacgcttctgtgcggttcgctagggtagtagccatcttcaggcgagttggttacagtagggaagcggccatatggctcgcccgcttaaccacatctgccgcgccttggtcattgtcagcccctgatgggagtgacgatacgctccggccctacactgcgtggcatctcccacagggcgctccgacttcaccagctttggcaaatttgagcgccttttctctggacgtccggctgacaggcatggcacggtgttttggggccgcctacacgcgctatgccgacgatctgacctttagtgggtcccagagactgataagggctcttcctaccttcctgcccttgataacacagatcattcaatccgagcgctttcgggtcaaaaaggagaagcgcaaggtgcttaggaataatcagcgacagactattgctggcgttgtggtgaacgcacatcccaacgtaacacgctccgatttcgatcgtctgaaagcaatcctgacaaattgcattagacatggccccagcgaccaaaatagagaacaggtgccagatttcgctgcccaccttaggggtcgtatcgcccatgtgatgcaactaaaccctcacagaggcgccaaactgctggcactttatgagcagatcgactggaatcactga

SEQ ID NO: 13151 - RNA, 996 nt, unidentified
  source 1..996: mol_type = other RNA; note = synthetic construct
atgggcctgtggcagtggctgaaacagcttctcttcggaagcacaagtgtggaggtcgaaatccctactgaggaggagcgtcaggaacgtcgaccaacccccaaactgactcctctgcgttatcacgtttcttcatgggagaaccatctgccttggaaacgagagtttgtgagccagcgcccctatagatttgcatgcaatacggatgtctgggggatgtacaacgatggctatgttgacctaagccttgatgcaaactttggtcagctggaacgctgggggctccccaagttcagcaatccagaggaattggctgaatggctgggtcttccggtcggccgggttgcatggttggctgacagagtgcgcagaggcgactggcgaggagatagggccaccgaccactactaccggaaatttgtcagtaagcgaagaggtgggtggcggttgctcgaggcaccaaagcctgccactaaggctgtgcagtaccgcatcctttccgagattttggagagggtaccacctcatcctgccgcgcacggcttcgtaaggggaaggagtattgtgacaaatgcaagaccgcacgcgggccaagccgttctggtcaagttagaccttgaaaacttctacacttccgtgtcgtatgctagggtggtggctatattccggagactcgggtattcacgggaagccgcgatttggttagccaggttgaccaccacgcaagcacccgagaacctccaaccgccccatgggaaggctaggctggattggcgctataccctacggcacttaccccagggagccccaacatctcctgccctagcaaatctcgccgctttctctctcgatgtgagactgtccggaatggctcggtcatttggcgcccagtacacaaggtacgccgacgacctgaccttctccggtcccaaacgctttctgcaatctctggacacattcctgccactggtgatccagataatccagagcgaatga

SEQ ID NO: 13152 - RNA, 1281 nt, unidentified
  source 1..1281: mol_type = other RNA; note = synthetic construct
atgttccgttggctactgcgactgctttttggggaggacgaaagtgttacacaaaggtcccaacccgaaaaaatcgcccccgtagagactgatgaagcccctaaggttcgggtgaggccaaggctggcacggtttgagttccgccgacgcagggggcatcattcgacctccgctgccactcggactaccgagaagccgtaccggttcgcactcccgaatggtgtgtctggtgaaacaatagacaggagccaggatcagaattttgagcgactgacccgttgggagttgccagctctgaccactcctgaggacctcgccgattggatggaggtgagtattggagagctggcctggttaactcaccgcactgagtccgcctatcgccctccctctctagaggccgcccactaccatttcaggtgggtgcataaaaagagcggaggctcaagactgattgaatcaccaaagcgcaggttgaagcacgttcagcagctcctgctgcggggcctgttagatagagtacccgcccatccagcagcgcatggcttcgtgcgtggccgaagcatagtcagtaatgcccagcctcacgtgggaaaagcagtcgtgctctcctacgacctggaaaacttttaccctgccgtgcggtataaccgggtggtagctgtctttagagggctcggctattcccgcgaagccgccatctggcttacacgactgacgaccagcgctttgcctccaagaatgcccttacccgaggggagaggggctaatcttatccgggcttatgctgcgcgacacttgccacagggagctccgacaagccccgcacttgcgaacctgtccgcattctcacttgatgtgagactaaacggcctcgcaaattctttcgaggccaactacacaagatatgctgacgatctcacctttagtggagacgaccgcttccgccgctcactggcaacgtttattcctctggtcaaccaaatcgttagaagcgaacagttcgtggtccacagggagaaaagaaaggtggtaaaacacggtcaacggcaactggtcacaggtgtggtggttaatgatagacccaacgtctctagggccgcgtacgacaggttgaaggctaccctgcacaactgcgttcggcagggccctgcaagccagaatagggatgaacacctcaatttcgaagcgcatttgcagggaaaaatctctcacgtgagacagctcaacccagcccgcgctgaaaagcttcagcggctgtttgaccgtattgagtggtga

SEQ ID NO: 13153 - RNA, 1275 nt, unidentified
  source 1..1275: mol_type = other RNA; note = synthetic construct
atgctcaggtggctgttcagccttctgtttggatccagggacgatggaggtcgtcctgctccagcgcagagaagaaaaaggcccaagtattggaggatcggcaagattaagctgtccagatttcagtatggcagacgaaatcgaaagctccaacgggacgagttggttagggagaagccctacgcctttgctttcaggtatcctcttcacagcaaatacatagatcgctcaggctcaggagactccgagaaactggccaggttcgaactgccggatctcaggacacctgatgacatagctcagtggctagggatgcccctgggaagggttgcatggctgacacacattacagagagacagtttcgaccacagtctttgagcgaggcccactacacctttcattggatgccaaaaaagttcggcggtgcacgcctgattgaggcacctaagcccctcatgagaaaggtccagcatcagattctgcgcgggattctcgaccatgttccagcacatgatgccgcacatggcttcgtgaaacacagatctgtgctgactaacgccgctccgcacgtggggcaaagagtggtactccgcatggatctcgagaacttttatgccaatatccggttttcaagggttgccgcgatattcagagaactgggatacagtagagaagccgctctgtggctggcccggttgtgtacctctgggcttcccccacgtatgccactccctgaaggtcggggtgccaatttagtccgtaattacaccgcccgccaccttcctcaaggagctccgacttctcccgccctggcgaatttcagcgcatattcgttggacgtgcggctgactgggctcgcaaatagtttccatgcaaactacacacgctacgccgacgatttgaccttttcagggggcgaccgttttttaaggagtttacgcgtctttatccccttggtcaaccagattatcacccaggaacggtttatcgctcagcctgctaaacgccgcgtgatccgggacaaccagcggcaaaaggtaacgggcgtggtcgtgaatcagaaacccaactgcgatcgacgggaattcgacgaactaaaggctatcctgcacaacagcgtgcgcttcggacccgcctcccagaacagacacgaccacgaggatttctatgcgcacctgaacggccggatcgcacatattgcccagctaaatccacagcggggcgagaaacttcgatccatgttccgacaaatcaattgggctaacagcccttga

SEQ ID NO: 13154 - RNA, 1323 nt, unidentified
  source 1..1323: mol_type = other RNA; note = synthetic construct
atgggcctgattgattttctgttccggatgttgggtctaaagagagaatcaaggggggaattacccacgagtgtaccgaccaaaccccgccctgccgctaaaacccaaaccaaaacctcctatccacgcctgcacccactgagattcaaacgggaaagatggtccaaagttaagaagtcatcccagaaactgtctgcttctacccgccctttcagtgtcccagatgccaaaacagagcgaccctatcccctggctaatcaggacgtcaggtatggaggatatcttgatctgagccaggacagcgacccagtgcagttgcgagaattggagctgccccagtttactaatcctcccgagctggcagagtggttaggaattccagtggggcagcttggctggctgacataccagtttgacgagggacaccggcctctcactcagagagccggtcactaccacctccgttggcagccgaagcgtaactattcggtgcggctaattgagtccccgaaacctctgctgaagcaagtgcagcgtaagatcttgcgcgagatcctggaccatgtccccgcgcattctgcagcccacggatttgtctcaggcgaaagcattctgacaaacgccaaacctcactgtagacagagggtcatcgtgaagttcgaccttgagaatttttaccctaggatcaggttcagaaaggttaccgccatatttcgggccatgggttatagccgagaggcagctatatggcttgcgcgcctctgcacttctaacatcccagttgacaccaagctgccttcaatggatcccgaagtaatctttttgtacacgccccagcatctcccacaaggcgctccaaccagccctgctctcgcaaacctggcggcttatggcctggatgtgcggctcgagggacttgccaggagtttcggcgcaaattacacacgatacgctgacgatctgacattcagcggggatgacaagttcctccggtcccttaagattttcattccgttagtggaacaaatcataagagagactggctttagtgtcaacaaagagaagaggaaggttatccgggataaccagagacaggcagtaactggggtggtggtgaaccagcatcccaatatgaacaggaaagactacgataggctcaaagccattctaaacaattgcgtgcgccacggggccgaatctcaaaatcgagatcagcatcctgactaccaagcccacttacgggggcgcgtggcacatctgctgcaactcaatccaaagaagggcacaaagctccagagattgttcgaacgcatccagtggtga

SEQ ID NO: 13155 - RNA, 1317 nt, unidentified
  source 1..1317: mol_type = other RNA; note = synthetic construct
atggggttctttgacttcctgctcaggttgctcggcctgaagtccaagccgcaggctacaatggcaccagctgcggggacccagttcaagaagaccacttcacctaagcggaccgaccggaagttggaccccttacgctttcagcgcgagcgctggagtaaagtagcaaaatctccccagcagcaaaccaccacatctcgaccgttcagcgtacccgctgtgaaggtcgagcaaccataccccttcgcccatttcagcccaatgggtgacggatatctggacctgtcccaagacggtgattctgtccagctccaagaactggagcttccagaattctcgaatccgcagcagatggcagattggctgcagatgcctgtcgggcagttagcatggctgacttgccaatttgaggaaggctacgctcatgcaacggaaaaagcggcccattaccacttcaggtggcttcctaaacgtaattttggctgtcgtctgatcgagagtcctaagcctctcctaaaacaggctcaacggaaagtgctgagagagatcctcgacaacgtccctacccaccaagccgcacacgggtttgtccagggaagttcaatcctaacaaatgcgcagccacattgcggtaaaagagtggtgctcaaatttgatcttgagaacttttacccacacgtgagattctcaaaggtggtagccatattccgttccatgggatatagcagagaggccagcatttggctcagtcggctatgtatgtctagactgcctttggattgcaagcctcccacagcaaatcccgaagctctgtggatttatcaaccaacacatcttccccaaggagcccccacgtcgcctacccttgccaatctcgccgcctacgtgctggatgttcggctggatggcctggcgcgaagcttcggtgccgactacagcaggtatgccgatgacctgacattctctggcgatgctcagtttctgaggtccctcaaatccttcatcccatttgttgagaagataattagagagactggctttaaagtgaataagaacaagcgcaaagtgatccgcaataaccagaggcagtcagttaccggagtgactgttaacgaacaccccaacattaaccggaaggagtttgaccgactgaaggctatcttacacaactgtgtgaggtacggctccgaaagccagaatagggatcagttgcccgactttcaggcacaccttcgggggcgagtcgcttatttccagcagttgaacccaactcgcgccgccaagttgaaacaggtgttcgaacagattagatggtga

SEQ ID NO: 13156 - RNA, 1263 nt, unidentified
  source 1..1263: mol_type = other RNA; note = synthetic construct
atgtcactctggcagctgcttaagaatttactctttggagggactgctgcgtcctcaaatcccgccgtccgcaatacagagcatgagcgacgcagggggaggcctaggcttcaacccctgaattatagccagcattcccgcaaccgacagccctcccggcaggttagcgagaagccgtatctgtacgcccgaaaagatacctacagacaggacgggtggtacgatctgcgggagggtggcgacgcagagtttctgcagcaagaggggctgcctctgattgagagccctgccgagctagcagattggttagaccttaagcctggtcagttagcgtggctcactcactttttctcacctggcagtcgcgccgagagtgtggaacaatcccactaccactatcactgggtaagcaaacgttctgggggagagcggctgatcgaatctccgaagcccatgctcaagcaagtccaaagcaagatccttcagggcatcttgaaccaagtgccggtgcataggtcgtgtcacggcttcacgagggggagatctatactctccaacgccgaaccacactgtggtcagcgactactcctgaagtttgatctgcagaacttctacccatcagtgagcctcaatagagtgatagctatcttccggtcgcttggctacaacagggaagtggccatatggctgggtcggttgaccaccaccgcaatcccctccagtattccattccctgaagaaggccccaaaggcctgcgtgattatctcgcagaccatttgccacagggcgccccaactagccctgctctggcaaacctgtccgcctttagcttggatctgagattgcatggattggcaaatagtttcggcgctaactacacaagatatgctgacgacattacatttagtggacccgagactctgctgaaatctctaaaaaccctgattcctctggtggaagccgttatccgcgatgagcgcttcacggtcaacaaggccaaacgcaaagtaattcggaataaccagagacagacagtctgcggggtcgtggtgaatgaacaccccaattattccagaaaagaatttgacaggcttaaggctatgctgttcaattgcatcaggttcggaccagactcacagaaccgtgagggacatccaaactttcgggagcacttatggggccggatttctttcgttaagcagctcaatcccgcgagaggagccaagcttgaagctctctggaaccagatctcttggtcttga

SEQ ID NO: 13157 - RNA, 1296 nt, unidentified
  source 1..1296: mol_type = other RNA; note = synthetic construct
atggaccaacgctggctggggattctgatagtggtcgcagcttggatcgtcgtaaggacattatttggaaagaggagaacccagccacggagctctcgcagcattcacaaagaacgatatgagcagcaaagggttaggcccgcaattcgggagaagcgccctctgattgtcgggcgcaacaaatcgccactgctggccgttgcaagtcctcctcactctttcgcccatcgcggacttaaacccggtacatggtacgatttgtcccaggacggccgcaatgatgagctcgtgagacgtggcctgcctgttttccagacccccgatgaactcgccgcgtggctgaatgtcccggtgaatagactggcctggctagcgtacagatgtacacgggggaaccttccaggcgtgtcacagagtcattatgtgtatacatggaagcccaagcgcacctatggctatagactcatcgaatctcccaaagcaagcctcaaaaccgtccagcgacagattctgaccgagatactagatcaccttcttgtgtcagaggcggcccacggcttccggaaagagcactcaatccttacgaacgcccagttgcacgtgaatgctgcagttgtggttaagttcgatctgagcgacttttacttgacagtacgcagtggccgaatcactaatttgttacgtagggtgggctacagccgcgaagtggcgatctggctgaccagattgactacgtcaactattcctggaaacctcccaccgccccccaccaaccctatcgtgatgtggaactaccggcaacggcacctgcctcaaggtgcaccaagctccccagcactggccaatttagtggcttacaggctcgaccagcgtctcttgggtcttgcaaagtccttcggggccaactacactaggtatgccgatgacctaacattctccggtgatgaatctttcgccgcagctctcagggcctttatcccgcttgttgaggctatcatcaggcgcgaacggtttcagtccaataatgccaaaagacagatactgaggagacaccagagacagatcgtggctggggtcgtagtcaacgaaaagccaaacttttgccgaaaggactttgaccggctgaaggctatactgcatcgatgcgtgactcagggacctgctgcccagaacagagatcagattgaggacttcgctgctcatctgcggggacggattgcccatgtacgacagctcaatccccaaagagccctgaagttagagagtctgtttcaacgtatcgactggcggaggtga

SEQ ID NO: 13158 - RNA, 1266 nt, unidentified
  source 1..1266: mol_type = other RNA; note = synthetic construct
atgatgtggtatctgattttgatcgccgtcgtaactggcattggtgtcatggttgccagatccagagtgaggggagctagtaggtcacgaccacccggagattctcggtggcgtcgacttagacggcccttccagcatccacccaccccaaggacatctggggaagtggtccggcaacccccttacgctttcagctatggtgcaggggggaaagggcgtttttgcgacctgtcacaggatctcaatctagaccgcctgaccacgtggaagctcccggtgctgcgcactcctgacgacatagcccagtggcttggactgcccgtgaatcgtcttgcctggctcgcacataggtgcaggagaggccgcccagaaggtgttcagcagtcccactatcactaccgctggctccctaaagcctcaggcggcatgcggttaatagagagtcctaagcgtgaactgaaagccatacagcggcggattctgaaggagattctgcaagccgtgccagttccagcggcggctcatggtttcgtgcgcggaaggtccatcaagacccatgccgtattgcacgagcggatgcatgtattagtgcggatcgatctcagggatttctatgcaagcgtaggcttcaaccgggtggtggcaattttcaggacgattgggtacccacgcgaggccgctctttggctggcaaggcttactaccgccgctttgcctacaaacttagctgggccccctgaagaccccggagctgtttggagatacagaagaaggcaccttccacagggagcgccgacaagccctgctctagccaatctcagtgcctactggctcgacaagcgtctgactgggctcgcccgagcatttggcgccaattactcgcgatatgctgacgacctgaccttttctggagatgacgcgttggaccccaagctccgggttctgatccaactgatcgaacaggtggtcagagatgagcgatttcactcccatagaaagaaaagacgcgtgctgcgaaggcaccagaggcaggtcgttacaggcgtcgtggtgaacgacaaacctaacgtgagccggagagattttgatcagctaaaggctgtgctgcacaactgtgtgcaatttggcccggcttctcagaatcgcgagggccatgcacacttcgctgcacacttgcgcggtcggatcgcccacgtccagcaattgaaccccagcagaggagcaaaactgctggccgtctacgggcagatcgattggggccgctga

SEQ ID NO: 13159 - RNA, 1452 nt, unidentified
  source 1..1452: mol_type = other RNA; note = synthetic construct
atgatagcgccaatccttaattggaacccagtctacggaggctctactgtcgacagaataaggaaccgtcactggctgtgtgacccagctgtcgacacgctaggcaattcaatgcagactatgcattgccagggaaaggacgtgtttatgggactgtggtcctggttttggtcatggtggaggcccacagggagtaaccacgcactcccaagctctccgccagctaatagagcgtccgggcagaagcggcaatggattggcagtacgaccaccccgaaattgcctaggctgcgttaccgctcacctgaaatggtccgccaatggagaatcgagggccgaggaacccaggttgatcagttgccctacgtttatgctcgttatgcacgtactcgccgacggaaacagttcctgaatctcctgacagatacccgcgtagatctgttacagcagcacaggttgccagtgctcacaactctggatgagctgagccagtttctcgggctgcctataggccggttagcagggcttatccacctggcagaccacggacggcctccaaccgagaagaagtcccattactggctgaaatggattcgaaaaaagagatccgggcacagactcatcgaggctccaaagcccgctttgaaaaaagtccaggagattattctgcgccagattcttgatctagtgccagcacaccccgctgcacacggattcgtgcccaactgcgacattcttagcaacgcccagctgcacgcaggtagggctgtggtagtaaagttcgaccttaaagacttttatccctccgtgacattcagcaaagtcgttgccatcttccggagcctcgggtatagcagggaaatggccctctggctggcccgactgacaaccagtgccctacccatcggtatggctttccctgataagaatccttactccatcatgcagtttacgcggcgccatcttcctcaaggtgcgcccacatctcccgcgctggctaacttggcagcctattcgttggacgtgagactgactgggcttgccaggcgctttggagccatctacactcggtacgccgatgacttaaccttctcgggcgaccatcgattcctgaagcagttgaagcgattcgtgccgctgaccgaccaggtgattgtgcaatgcaggtttcatagccagcctgccaagaggcggattctcaggcagtctaaccgccaaactgttacaggtgttgtggtcaaccagtctcccaactgttcacggagagattatgatcagctcaaagccatcctgcataattgtgtaagacacggccaccaaacccagaatagagatcaacaagtggattttagggcccacttacagggcagagtggcccatatacggcatctcaatcctgacagaggcgtgcgcctgcagaagatcttcgaaaagatcaactggaatagttga

SEQ ID NO: 13160 - RNA, 1293 nt, unidentified
  source 1..1293: mol_type = other RNA; note = synthetic construct
atggggttgctgaattggtttttctctttgctatttggatccccaaggagggctgccagtcctccgactgctatgagtcagactagcggggctcgctcaagcgcccaaactcacgggcgcgtgcgcttaaaaaaggaccgtccccggcagtggagcaacaggttccggtccacacgggttgtggtgcctaagaagccctatccatttgccaggaagtcaattaccggcagaggctacctcgacatgtccaccgacggtgatgaccaagccttgatagccgccggcctccccgtatttcaccatccccaagagctggcagactggttgaggctgcccctgaaggaacttgcgtggctgacaaaccacttcagacacggccggcccatagatcctcagcgtgcgcattaccactttagatggatagagaaaagaagaggcggatggcgactaatcgagagcccaaagcgcctgctgaaagctcttcagtcaaggattcttgacgaaatcctctccaggatcgccacacacagtgcggtgcacggcttcgttcttggccgttcgattctgaccaatgccgaaccacatgtcgggcaatgcgtcgtcgtgaaacttgacttagagtctttttacccttctatcaggctggctagaattgcccgtctcttccgaggactggggtatagccgagaggcagctatctggttaggacggctggtcacgtctcggttacctctcaaccagccgttcccaaccggaaaatccggcacatctagtctgacgctgtggccatacttccctgctcatctccctcagggagctccgacatctcccgcactgtccaacttggtgctttcgcgactggacgccagacttgccggtctggctcgcaagttcggggctacttacaccagatatgcagatgatctcacattctccggcccagagaggttcgcagcaagcctggctgtgtttatcccactagccaagcagatcattaggcgggagggtctgagagtgaaccgcggaaaaactcgcgtcctcaggcaggccggaagacagatcgtaaccggtgttgtggttaacgagcggcctaatatcgatcggcgggcatatgataccctcaaggcgattctgaccaattgtcatcggcatgggcccactagccagaaccgcgacaatcacccccagtttgcactgcatttgcgagggcgaattggccacgtgtcattgctcaatcctgcacgcggtgccaaactgctagccatatttgaacagatcgattgggaaagatga

SEQ ID NO: 13161 - RNA, 1281 nt, unidentified
  source 1..1281: mol_type = other RNA; note = synthetic construct
atgggcttcttcgatcgcattaggagagcattgtccggagagcccccccccacttcaaaagcgggcgaaactggcgagcggcctcaagagtaccgcagttttcccagagtgaaacctgttcgaactgttgcccggcatctgcccgtgtgtcaaccagacgctttggtgcgcgtcgagaagccctacgcctttgcccgtaggtcgccgctcacaggtgagtatctcgacaggcgggtgggaggaaaggtcgaaagattgaggaagttccggcttccagagttcggcaccccggaggaactggcgacatggatggggcttcccgtgaagacaattgcttggctagctgattttcacaaccgcaacgccggcgaaaaaaccgccaaaaagcagcactatagatacacatggcgacgaaagcgtggcgggagagggtggaggctgatcgagagcccaaaacctgtgcttaagctggtccagcaacgtatcctacatgaaatactggatagagttccagcgcacggggccgcacatggttttgtcaaaggcaggagtattctcaccaatgctgcatcccatgccggaaagtatgtggtagtccgttgtgatcttgccaacttttatccgtccatcagcttcaaaagagtgcgggccgtttttgcggggctggggtataattctgagatcgcgtggtggttggctaggctatgtaccaattgcaccccagacacgctggaaggcccttctggaggagcactgggcaggtttgcagccggtagacatttgcctcagggcgcacctacttcaccagctctcgctaacctcagtgcatgggcattagatgtgcggctgagcggtttggcccgacgctttaatgtggcctacacacgatacgctgacgacctgacgttctccggtgatgagaagtgcttaaatgggctgaccatggcacaccttctggcctacatcagggggatcattcgcgacgaaagattcgttttccaccctactaagcgcaaactcgtcagacgcgggggaaggcagatcgtaacaggcttaaccgtgaaccggaaacctaacgtccctcggccatacttcgacaagctcaaggccaccctccacaactgcgccagacatggaccctcactgcacaatcgagagaacctgcccgatttccgcgctcacctggaaggccagatagctttcgtaaggagcgtgaatccacagaaggccgctcggctgcagcggatttttgaccggatagtgtgggagggttctggatga

SEQ ID NO: 13162 - RNA, 1287 nt, unidentified
  source 1..1287: mol_type = other RNA; note = synthetic construct
atgggactggggttcttgcggcggctgtttgggggtggctctgacaagccgccgtcaggacggaagacaaaccctaaaagacgtgcactcaaacccactgtggtacctggcgctcatgctccagcgccaaccgctcatccgcttcccgtctttgagaagccttacgccttccccctgttcgcgccagatacacaaaaggagtctcgggcacgctttctggacgggcgcgttggtggaaagcctgaccgccagaagggttggaacctgccccgtctggagactcccgaggacttggctaagctgtgcggcgtgccacttaaaacccttgcttggctctgcgactaccacaggaggaacgcggatgaaaaggttaagaaaaagcagcattaccactacgtgtggaagcagaaaaaagccggaggctggcgattgattgaggccccaaaacctctgctcaaacactgtcagcagcgcgtgctcagagagatcctagatagggttccccctcatggcgccgcccatgcttttcgtgccggaagatccattaagaccaatgcagcagcccacgccggtaagtatgccatcgtgaaggctgacctgagttattttttcccatcgataaggttcaaaagggttgtgagtgtgttccgaggactggggtacaatctggaattagcacgatggctcgcccggttgtgtactaacagacttcctcccgatctctccatccccggaacaaacaatacctgggctttatactctgtgctaggccacctggcaacgagccttggacggcatgtcccacaaggggccccaacttcccctgctttggccaatctgtgtgcctgggcaatggatgtgagactcaatgggcttgcgaggaagttcggcgctgtctatacccgctatagcgacgatctgacgttttcaggatccgcagaactcatgggtaagcgaaggatcaattatttcgtgagatacgtgcgcggcattgtgaggaatgaacggttcaaatggcaccctaaaaaagtcagagtagtaagacggggcagccgccagatagtcacaggcctaacagttaacgagaagcccaacgtggggagggccgatttcgaaaccttaaaggcgatcctccacaactgcgtaaagcaggggcccgctagccagaatcgatcaggccacgcagactttcgcgcctatctgtctggcaaactggcctttgtcaagagtgtcaacccacaaaaagcagctagactggagcgggactttgccaagattaaatggtga

SEQ ID NO: 13163 - RNA, 1257 nt, unidentified
  source 1..1257: mol_type = other RNA; note = synthetic construct
atgggtttgagctttctcaaaaagctatttggcggctctgaatccgagaggccttccgggaaaaaaggcaagccaagtcaacggcttcctaagactacactggcccggtacaagccaaaaccttacgttccaagcctgagggtgaaaggggctaagccatatcccttcgctcagcctgcgtgtcctggattccttgacgggcgcgtcggagaagatgcagcacgactgcagcgttacggcctgcagaggctccaaacacccgaggagctggccgcgtggcttaaaatccctctgaaaaccttggcttggatggccgactatcaccgtaccaactacctggaggacgttaagaagaagcagcactaccattacaaatgggtcaagaagaggtcctctgctggataccgactcattgaagctcccaaaccgatgctgaagatgatccagcggcgcattcatgaggaaattttgtccaaggtgcccccacatccagcagcccatgggttcgtggccggcagatctataatctccaatgccagccagcacgccggaaagtacgtcatactcaagattgatttacaggacttctatccgagcatcaaaagaaggagagtgttggcggtttttcgcggcctggggtacggagtggaggcttcacattggttaatgaggctttgcgttaactgcatcccctcgaattgtgacgcccccgatgattcttcaaaggcttttcactggatcattagaggtatgtacgtgccacgccacctgccacaaggtgcaccgacttctcccgccctggctaatttcgcggcatgggccttagatgtcagattggccgggctggcaaagaagtttggagtgacctatacacggtatgccgacgatctaacgttcagcagtgatagtaagctcatgaagggaaaaagcatgaccatgctgatccggtatgtccgcggcatcgtaaaagacgaaggcttcaggtggaatgcatcaaagaaagctgtggtgcgacgggggagtcgacaggtcgtgactggcctcacagtgaacgcaaaacctaacgttgcccggaaagagtttgacgcccttaaagctattctccacaattgcgccaaaaaagggcccgcatcccagaacagatcaggcgtcgcggacttcagggcacacctgcagggtcgcataggttttgtacgtagcgtgaacccccctaaggccgccagactgcaaaaggtatatgagaagattgcttggtga

SEQ ID NO: 13164 - RNA, 1299 nt, unidentified
  source 1..1299: mol_type = other RNA; note = synthetic construct
atgggcattttcgactggctgtttgggaagaaaaagaaagccgcgtatggagcagactgggacactactcagtctgctccctcatatcagggtcctgcaaatcagcctgcgcccgagcagagagagccgtttataaatgcacccgctagaaggacgaaacgcacccgtacatggggcctcaagtggcggcagcaacgatccaagcaccctctagaaagcgtcccgaacgaagaggagcccttctcgctatggagcaatccattcaaacatcacgccctttatgggggcaccgaagccaaaccatccaaaggtggatccgccgccaggattgaggcactgggcttacctaatttggagaatctggatgaactggcagccctcctcggcgagacgagaaacaacctcctgcattacatcatccgtgatcgacctggcgataggcattatgtggcccgagacttacccaagaaatcaggagggacaagaatgcttctcgtccccaagccaagactcaaagctatacagcgcaagctcaatgcaaagcttatcaggcgactgcctttgaacccggcagcacacggcttcaggagaagccacgacgttctgagtggcgcttctgtgcatgtggctcggtccgtggtaatttccgtagacattgaagcctttttcccatctcttacatttcgcagggtcagtggctttctgcgatctatcggttacagcaggggaatcgctaccgccctggctaacctgatgacaatccggccttgtaatgtggctggcatcgggaggacagctgacactaggtacccacaactgccccaaggtgctcccaccagcccaggaatcgctaacgccatctgctggagaatggacaagcggttgtcagccctagcccgcaaattcggcggggattacactaggtacgccgatgatctgaccttctcagggttcgatgagatggccaaaggagcggggcggctgttacagttggtgcggaagattgttaaaactgaaggactggccctgaacgagaagaaaacacgcattatgcggaaggggagacaacagcgtgtcaccggtgtggttgtcaatcagcagaccaacgtgagtcgccgtgaatttgataagcttaaggcgattttgcacaactgcatcaaacatgggcctggcggacagaaccgggaaagcgtgccagacttcaaggagcacctgcgcggacgcatagcacacataagtcacattggccccgagagaggtagaaagctcaaggccatgtttgaccagatccggtggtga

SEQ ID NO: 13165 - RNA, 1212 nt, unidentified
  source 1..1212: mol_type = other RNA; note = synthetic construct
atgggaattctggactggctgttcggtaggaaacggagactgcccgctgaaccagaagtttttgtccctaggcctgtggaggtgcccgattctcccaacgctcgggaaccctttctgaaccatcccatgccccggagcaagcgcagatggtattatgagcgcaccgctaatctgttctggagaaatggacgaagtaaagagccaaagtattctacttcaatcgaacctagcccaagtaggatcgaagccctcggcctgcctgacctccgagagttaagggacctggcagccctgcttggtgtagcgttgaaagacctgaagcagtactccgcccgtcctaaccacgccaatgggcattaccttcccctgtacattacaaaaaagaacggcaccaagcggctacttctggcgccaaaaccacggctcaaagctatccagagggccctacaccagaagctcgtcagaaagttgccgttgaacgaggctgtgcatggttttcggcgtggacgagactccctctcctcagcctctgcccacgtgggaagggacgtggttatctgcatggatatagaggagttctttccgtcgttcgatttccggagagttagcggatttttcagggcagtgggctattctagggaagtagccgtgatgctggccaacctgacaaccgtggcaccagatgacgtccctaatgcagagagcagatactgtcgagatatcccacaactgcctcagggcgcacctacaagtccggggttagccaatgctatttgttggagaatggacaagaggctggcagcacttgcgcaccggtttggagccgagtacacacgatacgccgatgacctcacgttttccggtcacgatgatttagctgatggggctaacaagttcgtcagaatggtgcgcgagattttgctctcagaggggttgtatgtcaatgaagataagactcgtatcatgagaaaatccagacagcaacgtgtgaccggcgtagtcgtgaacgagcggactaacgttagccgccgggaattcgaccgcctgaaggctatactgcacaattgcgcgaaacatggacccggcggccagaatcacgaacgccatgaggactttgcaggccacctacgcgggaggattgcctacttctgccatatagggcccgagaggggccgcaaacttatgcgcatgttcgaactcatcaactggtga

SEQ ID NO: 13166 - RNA, 1203 nt, unidentified
  source 1..1203: mol_type = other RNA; note = synthetic construct
atgtgtgtcgcaaacaaacccaatccaaaggaaccgttcctgtcctcccccgaacacaccctcgaccgaaggcacaggaaaagatgggctgggcttgcctataggcgaaaacgatccaaatggcggatttcacctgtggctgatcagtcaatcgaaggctgtgactggcgcgataagctgggcaatgtcagcgcggacagagtgccgcaaggagttgccggaagagtagcaaccctcggattgcctgctataaattccgtggaagaccttgctgcactgatcgggatcacgcctaaccagttagctggttttgctctccggggggatgggcaaaggagccattacgtgggcagacccatcccaaaaaagtccggtggtgagagacggttgctcgtgccactgcctcgtctgaaagccgctcagcaagccctgcacaggaagctgatctcgctgctacccctacagccttgcgtgcacggctttcggctgaaacacgacgtcctcacaggaagtagcgttcatgttggaaggcaaatcgtaattggcatggatattgcagagttcttcccttcatttacatttcgccgcgtcagtggctatttccgtgccttagggtacagtagagggattgcaatcgcccttgcaagtcttaccattacatcttgcatggacgttcccgactataccccagaggcctactctaaccactcttacaccgagctgccacaaggtgcgcccacttctcccgggatagccaatgcgatctgttggaggatggataagcgactaagcgccctggcgcggaagtttggcggcgattacactagatatgctgacgatctcactttctcaggctttcaggacatggccgataacacaggccggttgctgcggattgtccgccagatcattgaaacagaggggttcgtggtaaacgagaataagactcggatcatgaggcgtggaagccagcagcgagtcacgggtgtggtggtgaacgagaagaccaacttgcctaggcgcgagttcgacaaaatcaaggccataatacacaactgcattaaacacggcccagctactcagaatcatgcccagcatgaaaattttaaggaacatctgcgcggtagagtggcacatgcacagcacattggaccggagcgcggacagaagttaaaggccatgttcgatagcatcgtgtggtga

SEQ ID NO: 13167 - RNA, 1380 nt, unidentified
  source 1..1380: mol_type = other RNA; note = synthetic construct
atgggatttctggattggctgttcggcagaaagcggttcctgccaccgcacacacctccttcacccgtcggacccaggaatcccaatatccccaccatctccgaatccgggactgctcccgtaagaccgccagctgggggacaatcccagtcaggtcagcacagcctggggagtcgatacaatccccgcatcctgcgtccccgcagaaggagatctagccggcctagagagattgatgccgggaaatccgagcatctggaccggtggccacacgatgaattagacaggcctgaccctgccagtttaaccctgccagcacctcgagcggactgggttccgttgggcgatcagagcgccctcgctgctctcctgggaatccagcccactgacctcaagtactggctagtaggccatcatctggatgaaaactatatactccgcgaaatccctaaaaagagcggtggaacccgattgctgatggcacctatgccaaggttgaaggcactccagagacaactccaacaggcactggtgtctcggctcccactgtcaccgtcggtgcatggcttcaggcgacgccatgacgtccttaccaatgcagcggtgcatgtggggaaacgggtcgtggtttgcatggatatagcagacttcttcccaagcttcgacctgagaagggtgtgcgggtattttcgctggcttggctatagtcggagtgtcgccctgtccttggctagtctcacaaccgctgactcattcaacgcacgactggccaaaggacgcggcaggacaggcctttcctctgattggacagagcggaacgaggtcgaaaatcggtgtcaaagcgtgaacaagatccatcggactagcccacttcgttaccgcggatatagactaccacagggcgcccccacttctcctgggattgcgaatgccattgtatggagaatggataagcgtctgtctgctttggcgcggcggttcggaggtgattacacgcgctacgccgatgacctcacattttcggggtttgagaaattagccaagcacactcgtatgtttattaaacttgtggagaagatcgtgcacacggaaggcctagctataaacagaaagaagactcgcatcatgcgttccggcagacggcagagggttaccggtgtcgtggtgaaccgccagaccaacttagctaggagagactttgacttgcttaaagccatcctgcacaactgtattaccaaaggcccctctacacagaatcgaagcaatcaccccaacttcagggagcacctgagagggagggttgcccacgccctccacattggtcctgagaggggcgccaagctgcagcaactgtttaaccagattgattggtcaaggtga

SEQ ID NO: 13168 - RNA, 1164 nt, unidentified
  source 1..1164: mol_type = other RNA; note = synthetic construct
atgagaatgcttaagccccgttataggcggtcaaaagatccaaaaagcatcgaagggaagcaaaacgaaccgattggctactggcatgaacagatgggcgggacagttaaggacccggtgaaaggtggaaatccatcacgaaccgctcagctgggcttgccctctatcccccatgccgacgcactcgcgtctctgcttggtatatcgacaagagccctggaggggtggattggcgggctacttaatgagcaaaactacgtagtgcgcggtatagccaaaaaatcaggcggaacgaggtacctcatggcccctatgcctaagctgaaggctttgcagcgaacactgagaaccagcttggttgataaactaccactgaacgcctgcgtacacggcttccggcgcgatcacgacatcctgtccaacgggacagtgcacgtgaacaagagggtggttatttgtatggatgtgttgcaattcttcccttccttcgatctgcgcagagtttgcggatatttccggtggttaggctacagtcgcgggatcgctctgtccctggccaagtttactacggccgacagttttaatggtcagttagtctccgcatccggacgggaggggtttgctcagagcaccccagcctacgtagccctgaaaaatcagtacaggcagcctcaattgccccagggagcccctacttcacccggcatcgcaaatgctattgtctggagaatggacaagagactcaccgcacttgctcgtaagtttggcggcgattatacacgctatgccgacgacctgactttctctgggttcgagaagatggctaaacatgccaaattaatcgtggctctggtggagaagattgtccacactgaaggacttgcaataaataagaagaagaccaggatcatgcgtaaaggtcgccagcagagggtgaccggagtcgtggtgaataaacaaactaatgccagccgggagcagttcgatctcctcaaggcaattctccataactgtgcgaaaaagggccccagcacccagaaccgatctaaccacccaaactttaaagaacacctgcggggacgagtcgcgcatattgctcacatcggccctgagaggggggcgaaactgaagaagctctttgacgcaatcgactggagtagatga

SEQ ID NO: 13169 - RNA, 1401 nt, unidentified
  source 1..1401: mol_type = other RNA; note = synthetic construct
atgggcctatttgactggttgtttgggcgcaaaaagaaagacccccctacctataggaatccatacccccccaaagtgcactcattcagcgagttctctgccgactctaccttgcccgcgcctaggcagcaggctcgtaggaacaagcccactcgtcgcaaactgcagccatttgctccgcagtcctacaagggccatagaacactcggcctgtcctggagaagagaacgcagtaaggaaccagttgatcgagttcctaatagctacctgagtgtggcccattttcagcacttcggagggaccccatcaagcataccagagggcggcgatgccgcaaaattgctcaatgtcggtctacctgtcctgcgccattttaacgaacttgccgctctactggaaattgattctactagtctttacaaactcgtcgtgaggactagcgcccagcattatctttttcatgagatcgctaagaagtcgggcggaatccgtctcttaatggcgcccttgccacgcatgaaagctgcccaaaggcgacttctccaggcattagtaagcaaggtcccgttgcacctggctgcccacgggtttcgagaaggacaggatgtactgacgaacgccggccctcacgtaggaaagccaattgtcatatgtatggacattagtgacttcttcccttcttttacattccggagagtctccggcttcttcaggcacctggggtatccacgtgggatcgcggttgcgctggcaaatctgactacttggtcaccaagaggccagttccagctgccgcaaacaaccgggcggaacctgcgatccgtggactacaaagaacgcaaggtgcagcttgctcgggccgagtggctggattcaggcggaaacgagatcccttcccggatgtggccccagttacctcaaggtgcccccactagccccgggttagccaacgctatcgtgtggaggatggacaaacgactttctgcactggcccgcaagttcgggggagactacaccagatatgccgacgacctcacgttctctggttttgagaaaatggctgagcatagcagaaccctgattagcttggtggagaaaatagtgaagaccgaaggactcaccattaacgtgaataaaacaagggtgatgcggaagggcagaagacaaaaggtgacaggtgttgtggtcaacaagcagaccaacgcctcacgggaacagtttgatctgctgaaggcaatcctccacaattgcgcaaaaaaagggccgagtacacagaatcggtccaaccatcccaatttcaaggagcacctgaggggacgggttgcacacattgctcacatcggccctgagcgcggtgcaaagctgaagaagctctttgatcaaatcgattggtcccggtga

SEQ ID NO: 13170 - RNA, 1188 nt, unidentified
  source 1..1188: mol_type = other RNA; note = synthetic construct
atgagttttcggctgcgtcgcagcaaagagcatataggacctgtgaaggacctgacactctctggtagccgtaatcctatgaccggggaagcaagttccgtgggagcaattggcaatatcggaggtagcgcaaggcacccagatatcgggtttgactccgctaccatccgctcactggggcttcctgagattgaacacctcgatcagctggcccaagtgctgcagatcgaccggaaccagctagtttggttggccgcaagacctgccttctctgaaaatactgatgcccactatacgctgaaagcgatccccaagaaagccggcggcaggagattgctcatggtcccgctgccactcctgaagcgggcacagcagagactcctcgcggaactggttagaaaactgccagtgcatgaggccgctcacggatttagggttcagagaaacacacttacaggagcttccattcacgtgggtaaggacgtggtgatagggctggatattgccgatttctttccctcattcacatttagaagagtgtcggggtacttccgctcacgaggctacggccgagggatctctgtagccttagctaatctgactactaacaggctgcttgacactatcaccaaggacggaaaaaggtggaagtatcctaaacggaatgcgtttcccgagctttttgaacatccccctcacccaatattaccccaaggcgcccccacgtctcccggtattgccaacgctatctgttggaggatggacaaacgcttggcagccctggctctaaagtttggcggcgactatacccgctacgccgacgacttgaccttcagcggattcggggacatggctaggggcgctgagaggctgattaagctcgtacggaaaattgtcgagactgagggtctagctcttaacgaaaagaagacacgcgtaatgcgccagggacggcaacaacgggttaccggcgtcgtcgtgaatgatcagaccaatgtgagtcgacgagatttcgatcgactgaaggccatcttacataactgcatcaaacacggcccacacgggcagaacagagagaacgtcccagatttcgagcagcatttgcgggggcggatcgcacatgtgtcccacattggaccggaacgcggcaggaagctcatgagaatgttcgagcagatacgttggtga

SEQ ID NO: 13171 - RNA, 1371 nt, unidentified
  source 1..1371: mol_type = other RNA; note = synthetic construct
atgggctttttcgactggttgttcgggaagaagaaagacccttatgggggcaaattgcaaaagggctattcatccccacgagcacagccacagccggccaaaacctaccaacaccagcctcagggctacgggggacctgtaccaccacctacaccccagcagcaacgtgccgtaggtgtgaggttcaggtttctcaagtggcgcagagcaagatctaaagatccactcccccctctgcccgaccaaaccattagcggtggcatagaccccatgaccggagcctataccgagccgggtgccatcgctggattgggagggactgcgcaacatccagacccacactttaagcctgatcgggtgagagccgctgggttgcccgagattccccatttggacgcgcttgctgctttagtcggagtcggtcgtaatactctggtgtggcttgctgggaaacctctggctagtgagggctgtgattcccactataccgtcaaagccatcgataaaccgagcggaggccaacggctgctgatggttccgctgcctaaactcaaggccgttcagcgcgcacttgtggaccgcctgattaataagctcccagttcatgatgccgcgcatggctttcggaagggaagagacgtgctgagcggtgcaagtgtccacgtgggcaaggacgtcgtgatctctctcgacatccgcgatttctttccaagcttcaccttccgacgggtgtcgggctactttcgcagtttggggtacggaaggggaactgccgtagctctcgcaaatctgacaaccgcgagacttaacgacgcccaggtcaaacagggcaaaaggtgggtgtacgctgctcaggtacacaagttacggacatactcccacccagaactcccccagggagctcccacatcacctggaatctctaacgcaatctgccgacggatggacaagagactggccggtctggccagaaagttcggcgccgactatacgcgatatgccgatgacatgacgttttccgggtccgatgacctggccttccacgcacccaaatttataggccttgtgacaaagattgttcagtcagaggggctagcactaaatgataagaagactcgcgtgatgaggcagggcagacagcagagggtgacaggggtcgttgtgaatcataagactaatgtgtcaaggcgcgattacgatcgtctgaaggcaatcctgaacaactgcatcaagaggggcccccacggtgaaaacagggagaaccatcctgatttccggggatggttacaggggaaaattgcccacgttagccatattgggcccgaacggggccgaaaactccaggctctgttctctcagattagatggtga

SEQ ID NO: 13172 - RNA, 1338 nt, unidentified
  source 1..1338: mol_type = other RNA; note = synthetic construct
atgggcttcttcgactggctatttggcaaaaagaaggacccatattcaggcaacgtccagaaggactataccagtccaaggcaaagaccccagacggcccagacatatccacagcaaccccacggctacggttcacctgtaccgcccccgaccgtgcagcaacagcagagtctgggcatccgtgatcgctacctgagctggcgccggaatagaagtcgagctcacgtaccacctgtggctgatcagacccttggcggcaacgaacatctagggcacttgggaggtacttccagacaccctgacaggcaccagaatgccgcggctttgcaagcggctggacttcccctcctgccccaccttgacgctctggcagcaatggtgggggtggagctgaagacactggtgtggctcgcctcgaaacccgtcgcttccgatgaatgtgaatcccactataccatcaaagcaatcgataagccttccggcggcaagcgtctgctgatggtccctttacccaaactgaaggccgttcagcgagccctcgtcgagaaactcgttaacaaacttcccgtgcatgaggccgcacatggcttcaggaaaggaagagatgtgctgacgggagccagcgtacacgtgggtaaggatgtagtcatttgcgctgacattcgggacttttttccatcattcacttttcggcgcgtcgcagggtatttccgctctttggggtacggacgcggaacagcagtggccctcgccaatttgactactgcccgaattaatgacgccctggttcggcagggagacacatggacctacgcggcagaagtttacaaggtccacctctgggggcatccagaattgcctcaaggcgccccgacttctcccgggatagccaacgctatctgcagacgtatggataagagactgaccggccttgcccgcaagttcggggcagattataccaggtacgcggacgacctgactttttctggtggggatgacctggccttccacgcaagcaagttcctcgggctggtgcgccagattgtgcagacagagggactaaccttgaatgacaagaaaacaaggataatgcggcagggaaggcagcagcgagttacaggtgtggttgtgaatgataagacgaacgtgtctcgaagagactacgacaggttaaaagccatcctgcacaattgtgtgaagaggggccctcatggtgagaaccgggataaccatcctgattttagaggatggctccagggcaaaatcgctcatatcagccatattggtccagagcgggggaggaaactgatggctttatttcaacagatacggtggtga

SEQ ID NO: 13173 - RNA, 1335 nt, unidentified
  source 1..1335: mol_type = other RNA; note = synthetic construct
atgggctttttcgactggctgtttggcaaaaaaaaggacccatacggtcccaggcgggatccctatcagcagcaacccaaagcctatgggggacccgtgcccccaccaactgctcaacaggcttctgcaattggcctgaggaacatcttccttagctggcgaagacggcgttccaaaggccctgtcccagcccaaccggaccaaaccattcgcggtggattgaaccctcagacaggagcttgggtggaccctggagccatcagctccatcggcggcacacgtcagcatcccgatccatactacgatagtgcaaaggtcagggccgctggattgcccgacttaccccatatagatgctatggcggaggtgcttcgcgtcgataggcggaccctggtgtggctagccgcgaaacctgttccgggcgacagcctggatagtcactacacacttaaggaaatgcctaagtcgagtggcggtacccggctgctgatggtcccactgcctaagctgaaggctgtgcagcgggccttggtggaaaaactagtcaacaaactacctatccacgaggcagcacatgggttccgcaaaggtcgcgacgttctgagcggggcctctgagcacgtcggaaaggacgtggtaatctgcgctgacattagagattttttccccagcttcacctttcggcgggtttccggatattttcgctcattagggtacgggcggggcacagcggtggcattagccaatttgaccaccggtagactgatggatgccagagtccagatgaacggaaggtggcagtacgccgctaagctcaagcatccagaaacgcacgcacgatatcacccggaactgcctcaaggggccccaacctctcctggaattgcaaatgccatctgcaggcgcatggacaaaaggctcaccgggctggctcgaaaattcggcgccgactacactcgttatgcagacgatctgacattctcagggggcgatgaccttgcctttcacgcgtcaaagttcctcggtctggttaggcagatagtgcagactgagggccttactctcaacgacaagaagactaggatcatgcgacaaggacgccagcagcgcgttacgggggtggtagtgaatgataagacaaatgtgtctcggagagattatgacagactcaaggcaattctgcacaattgtgtaaagagaggaccgcatggcgagaatcgtgataaccacccagacttcagggggtggttgcagggcaaaatagctcatgtgtcccacattggtcccgagagagggcgaaagctcatggccctctttaaacagatcagatggtga

SEQ ID NO: 13174 - RNA, 1335 nt, unidentified
  source 1..1335: mol_type = other RNA; note = synthetic construct
atgggaattttcgactggctgtttgggaagaaaaagaaagatccttatggtgggggcggcctgagcaaggattatggtgctcctaagccatacagtgatatgcccaggcagtaccagcggccatcagaccctgctccaccacgtaccttcgaaccggacaatcgcgagataaatctgtcgtttcggctgggacgatccaaacaacccgtgaccccactgagggaccagacagtagggaggaatgctaagccgggtacaaccaacttagaccatctgggcggcaccagggataaccccgatccttatacagacgtcatgaaactccgcagtaacggcctcccagagatcgacagcctggatgctcttgccgaactggtgggatccactcgcgagtcactgctctttctggcagccaggtctggatgggataggcccgcccattactccctcaggcagattccaaagaagagcggaggcacccggttactaatggcgcctatgcccaagctgaaggcagtgcagagagcactacatggcaaactggtgcagctccttcctgttcacgaagctgcgcatggcttcaggaaggggcgagacgctcttagcgcagcaacccctcacgttgggaaggacgtagtcatatctgtcgacatcgagaacttcttcccctcttttactttccgtagggtggctgggtacttgcgaacactgggatacggtcggggcgtcgcagtagccattgccaacttgacaactgccagactcgccgacggcaaatacaaagagggctcaagatgggttcctggacacaacctccgccaccccgatatggccggacgctaccaccccgaattacctcagggagcccccacatcccccggtctagcaaatgccatctgcctccgcatggataagagattggacgctcttgccagaaaatttggcgcgacctatacgcgatatgccgacgacttgactttttctggctatgatgacctggctaagagtgccgggaacctgttgcagctgatcagacaaatagttcggacagagggtcttcgcctcaatgaacagaaaaccagaatcatgaggggaggtcggcagcaacgagtcactggcgtggtggtgaaccagaaaacgaatgtgccaagacgcgaatacgggactttgaaggccatccttcataactgtattaaacacggaccagcggggcagaatcgggataatcacgcagatttcaaggagcacctgcgggggagaattgctcatgtgagccacatcggtccggagcgtgggagaaaactgatgcgtatgttcgagcaaattcggtggtga

SEQ ID NO: 13175 - RNA, 1356 nt, unidentified
  source 1..1356: mol_type = other RNA; note = synthetic construct
atgggcctgttcgattggttgtttggcaagaagaaggacccctatgggactaagccaggccaggactatggagacaaggatcacgcccccaaaccctacaatgaccagcctaaacagtaccagtcagcacagaagccctaccaagctcctccaaagtcatacggtgctccaccaccgaaacctggcgagaggacggagaagctttcattccgacaggcccgttccaacaaacccgtcgatccgctcgccgatcagaccatcaagacacctcggagagggcccaacttggcccaccttggcgggactagggaaagtcccgaccctcatacagatgttattaagctgcgcaacaacggaatgccagaaatcgcccacctggacgatctggctgacttagtgggcgcaacaagaaatgagataattttcctggcctctcgcccaggatggggagaaccttcccattataccctgaaagagcttcgcaaaaagagcggcgctacacgcatgctcatggtgcctatgcccagaatgaaagccgtccaaagggctctaaatgctaaactcatctccaggctgcctgtacacgaagcagcccatggcttccggaaaggacgtgacgtcctcaccagcgcaagcccgcatgtggggaaggatgtggttatatccgtggatatcgaggacttcttcccatcctttaccttccggcgggtcagtggctactttcggaatctgggttatggcagaggtgtgagtgtggctcttgccaatctgatgactgcacgcctgagagacggtgcaaccaaacagggaaacaagtggaaaccggtcgcgtatggaagccatcccgatattggaaagcggtaccaccctgagatcccccaaggggctccaacctctccaggactggcaaatgccatcagccgccggatggataagcgactgcacgcgttggcccagaaattcgcagccgactacacacgatatgccgacgatttgactttttctggcaatgatgaactggcgaaatcggttgggaacctactccaaattgtgagacaaattgtgcgaaccgaagggctccgtttaaacgagaaaaaaacaaggattatgcggaagggtaagcagcagcgcgttacgggggtggtagtaaacaagcagactaatgtgtcaagacgggaatacgacaaactcaaggctatactgcacaactgcattaagcacggcccaaccggccagaacagggagaatgtgcctgactttagggaacaccttagagggaggatcgcgcatgtctctcatatcggtcccgagcgcgggcgaaagttaatgagaatgtttgagcagatcaggtggtga

SEQ ID NO: 13176 - RNA, 1359 nt, unidentified
  source 1..1359: mol_type = other RNA; note = synthetic construct
atgggcctctttgactggttgtttggcaaaaagaaaaaggatccttatgggggctctttcagacaggattatgatagcggacgctcgtataatgaccaaccagtcgagcggtaccagagcaaagctaccagaaggcctccagccgtcgaatcccccagacagaaacataggactgggaaattaagctttcggcgcctgcggtctaaccaggcccttgatccgctacccgaccagaccttagacggccgcaacccgaacaccggccaactgacaggttccccactgtcacaccttggaggcacaaggcaagctcctgaccctcacacggacgctcagcgactgaggaatcacgggctgccagtagtggagcacctggatgacctggcagaactgctgggtaccgctcgggatgaactggtgtacttgagtgcacgacccactgttgaggaacctacccattacacgttgaaggaactcccaaagaagagcggagggactcgtctcctgatggtgcctatgcccagacttaagtcactccagcgaactttgaatgcaaagctgatttcactcctgcccgtgcacgactgcgtacatgggtttcgtactggacgcgacgttttgtcgtccgccagcgctcacgtctccaaagatgtgctagtatccatggacattgaagatttcttcccctcatttacattcaggagggtggcaggatatttccgcagtcttggctacggccgagggacatgcgtggcactcgcgaacctgacaaccttccgtctcgctgacgcaagtgtgaaaagaagtaacaggaacgcctggaagcttgcgtccgtccatcatcacccagacgcaatgaggagatggcatccagaacttcctcagggggccccgacatctcccggaatagctaatgctatcgcccggagaatggataagcggctgcacgccctcgccctcaaattcggtgccgattacactagatacgccgacgatttgaccttttctggcggcgaggagttagccaagggcgttgggcgacttctgatgctagcgagaaagatcgtgaagacagaaggcctcgccctgaatgagaacaaaacccgcataatgcgcaaaggacggcagcaacgcgtcacgggagttgtggtcaatcaacagaccaatgtgagccgcagggacttcgataagttaaaggctatcctgcacaactgtatcaaacacggtcctgggggtcagaatcgggagagcgtgcccgacttcaaagagcatctgagaggcaggatcgcgcacatttctcatattggacccgagcgtggtcggaagctgaaggccatgtttgagcagatccggtggtga

SEQ ID NO: 13177 - RNA, 1008 nt, unidentified
  source 1..1008: mol_type = other RNA; note = synthetic construct
atgcccgcccttccgcatctggatgccatggcagagctgttgggcacccctagaagcgaactacagtggctagcgcaccggcccgtgcaggaaatagcaaaatctcatgtgcactataggctctttgaagtgcgcaaaaagtcaggcggcacacgccttttggcagcacctctcccacgccttaaggctgtccagcaccagttgttagacaagctgatctcccgattacccgttcatggggccgcccatggtttccgacggggaagaggaattctgagtggggcaaacgtgcacgtagggaaggatgtgctcgtatgctttgacatcaaggatttcttcccaaccttctccttcaggcgtgtctcagggtattttagatggctcggctacggcaggggcattgcaaatgccatcgctctgctgaccactgcggcacttcacgaggccacaaccgggggaaaggggcagtggactcccgcttacaacacaaggcaccccgacctggtgagacggcatcacccagaattgccgcaaggcgctccaactagccctggccttgccaatgccatttgctggcgaatggataagcgcctgagcgcgctggcttctaaattcggaggtgattatactaggtacgctgacgacctgacctttagtggtggtcaagatctcgctcgccatgccgataacctgatcaagctggttcgcaaaatcgtgcggaccgaggggctggagttgaatgagcagaaaacgcgtgtcatgagaaaaggacggcagcagagagtcacgggagttgtggttaacgaaaagacaaacttatccaggcgggattttgacaagctgaaggccattctgcacaattgtgccaaacacggtccagctgggcagaatagagcagaccatcctgacttcaagggacacctccaaggacgtgtcgcccacgcgatgcatatcggccctgagaggggcgccaagctcaaagctatgtttgacaaaatagtgtggtga

SEQ ID NO: 13178 - RNA, 1350 nt, unidentified
  source 1..1350: mol_type = other RNA; note = synthetic construct
atgggcctgttcgactggctattcggaaagaaacgggacgaatatggcgcaggcctcaatcgcagctatccaccttcacagccccagcaagtacgcccagtccccagtcaagggggccctgttccttcagccgggactccacagaatggcaagagaacatcctaccttagctggagacgaagacgctcgcgggagagcgtagtatctgtgcgcgatcagacactggggggatctgttgatccacaaactgggcgacattcagaggctggcgccataggcaatttaggtggaagtcctagacacccagacccctatttcgacgctggtcgagttgcctcccatgagctgcccgctttgcctcatctggactcccttgcagccctcgtggaaactccactcccggaactcaaatggttgagcgtgatgccacccttcggggataagatgtggggccactattgccttttcgaggtcaagaagaagtctggaggcacgcgacttttggccgcgccattacccaggctgaaggccgtccagcgcagaatcctagataagctggtgagtaggctgccggtgcatggtgctgcacacggcttccgccgaggtaggggaatcttgagcggcgcgaccgtacatgttggaaaagacgtccttgtctgctttgatattaaagactttttcccctcctttaccttcaggagagtctctggcttctttcggtggttggggtacggaaggggtattgcgaacgccatcgccgctttgactacagtgcgtctgaccgacaccaaccgccgtcgcgaagggaagtgggaacaccctgggctggcaaagcatcctgacatgctcaaaagaagacagccggaattaccccaaggcgcccccacttcccctggattagcaaatgccatctgttggaggatggacaaacgtcttagtgcactggcacggaagttcgggggagattacacaagatacgccgatgatctgacatttagcggcggggaggactttgctaggcacgctgccaacctcattaaactggtgcggaagatcgtgcggacggagggactggccctcaatgagaagaaaacccgcgtgatgcggaaagctcggcagcagagggtgaccggtgtggtcgtgaacgaaaagaccaatctatgccgtcgggattttgacaagctgaaagcaattctgcacaactgtgcaaagcacgggcccgctggacagaacctggagaaccaccctgattttaaggggcatctgcagggtagggttgcccacgccctccacataggcccagagagaggcgcgaggctcaaagctctgtttgataaaatcgtgtggtga

SEQ ID NO: 13179 - RNA, 1143 nt, unidentified
  source 1..1143: mol_type = other RNA; note = synthetic construct
atgcgcgaccagacgttgggtggcgcccgtaacccgcaaacaggagctccatccgttgccggggcaattagcggggtagggggaactccaggacatcccgacccctacttcgatgcaggcagggtcgcatctcacgaactcccagctttgacccacctggatgcactggccgaacttatcgaaactcccagaaacgagctcctgtggctggcagtcaagccccctttttctaataagctctggggacactatcacctattcgaggtgaggaagaagagcggtggcactagattgttagctgcgcctatgcctagactgaaagcagttcagcggaagctactggacaaacttgtgtcaagactgccggtgcacggagccgcccatggtttcaggagaggccgagggattctcagtggcgctaatgtgcacgtcggcaaggacgtcctcgtgtgtttggatatcaaggattttttcccctcgtttaccttcaggcgtgtatccggttactttcggtggctgggatatggccggggcatagcgaatgctatcgctgccctcactactgcccggctcacagagacaaaccagaggcaaggaaccacatgggctgctgcccatacgggaatgcatccagatatgaaccatcgccgacacccagaacttccccaaggggctcctacctcaccagggctggctaatgcaatttgctggcgcatggacaaacgactgtccgcgctggcccggaaattcggaggtgattataccaggtacgccgatgacttaaccttcagtggggggcaggacatggcaagacacacagacaacctgataaaacttgttcggaagattgtgcgtagcgagggcttgcagcttaacgatcctaaaactagagtgatgcagaaaggtcggcagcaacgagtgaccggggtggtggtaaatgaaaagaccaacttatctaggcgcgagtttgaccgcctaaaagcgatcctgcacaattgcgtcaagcacggccccgccggccaaaacagggagaatcatacagatttcaagggacatctgcagggccgcgttgcccatgccatgcacatcgggcctgagagaggcgccaagctgaaggccatctttgacaaaattgtgtggtga

SEQ ID NO: 13180 - RNA, 1386 nt, unidentified
  source 1..1386: mol_type = other RNA; note = synthetic construct
atgggctttttcgattggctgttccgtaggaaaaaagacgattattccaaagggctacagcggggataccagcgaccctcatctcatcctcaaccgttgccacctcagccggcgacaccacctcagagagctggaacccccccagaacccgcaggatggggatctccacctcccccaccaccgtggaagaatagaacccaccgcagctggatcaaccggcgatctaggactcctccagagccccagaggagtgagccgattccaaagggacggcctggtgaacttcgccacctgggcggtacagccaaacatcccgaccctcattttaagcccggcagagttcaagagctggggttaccagccataccccacctggatgctttggctacactgctcggaacaaccatttcgaaggtggccggctttgcagtgcgacctcccagcaccgctatgaattgggtgcattacttcctccaccctgtgcccaaaaagtccgggggcactagactcctcatggttccttgccccgagcttaagcggttgcagagacgactccatgaagtcctcgtgagaaagcttcctctacacgaggctgcccacggttttcgggctaggcgtgatagcctgtccaacgccaccgcgcatgctggcaaagcagtcgttatatgtatggatatcgcggattttttccctagcttcgactttagaagggtgtgtggctatctgaggtgggcagggtacggaagaggagtggccattgctttggctaatttgacgaccaactcccggaatgaatgcaagatgcgccgcaaacccgacgtccagaaaggggccggaacactgctgtcagcctggaaatgcgtcccgaagcaccccgacttactcgcaggctcactgccagaattaccccaggggagtcctaccagtccaggccttgcaaacgccatctgtaggcgcatggacaagcgcctcgcagcgttggccagaaagtttggcggtgcatatacccggtacgctgatgacctgactttctcagggggcgaagaaatgtcccgcagggccggtcgtcttatgcaactggcccgaaaagtaatcactagcgaagggctagcagttaatgagaaaaagacacgtgtgatgcggcgcggtcgccaccaaagagtaacgggcgtcgtggtgaatgagaagccaaacctgcctcgagccgagttcgacaggctgaaagcgatcctgactaattgtatccggcatggacccgcctctcagaacagggagcagcacgccgacttcagagcccacctccacgggtgcgtagcttatgccgcacatattgctccagccagggggggcaagctggtgaagctgttcaacgagattcggtggtga

SEQ ID NO: 13181 - RNA, 1092 nt, unidentified
  source 1..1092: mol_type = other RNA; note = synthetic construct
atgggcctgggaaacttcttcagaaaactgttcggggggggagatgactatcagcgacggcccgggggtggtgattatcgcaagccatcagttggcgcaacgcacgcttcacctgccgcccatggtggaccacctccaccacctcctgccgcatcgcgtgtacatgccggcgatccggcttacagaagtcctcaatccggccaggccataaacgacagggaaatcactgatgccctgaagcacccctaccgaaggaaaaggcgcagcaagcaccccctgcaggggcatattcacgaaactggcagcagcaactggttttctccagatagaactaccaaccctgtgagacttaatgccctgggcctaccagtgctgtctactcctgtcgagctggttcccctgctcggcgaagagctcaaaaggctttatgattttgcttacgcaaatgatagggattccgaggacagccactacgcgtatcgacttgtgccaaagaaacgcggggggtggcggtttatagaagcccccaagccccgccttaaggctgttcagaagcgcattaaggagattttcgttgacaagctgcccgtctctaatcatgctcacggctttctccggaagagggatatggtgtctaatgcaaccccccacgtgggaaaagcctgcgtgatctgtgcggacatctccgacttcttccccacaatcggattcaaccgggtagccggctttttacgcagttgtggctacggtagaatggtggctgcagctctggctatgctcacgacaaatgcccattgggccagtgcggacgtgttgattggtgatgaggtcgtgaaaaacaaagacgcaaggaagcgggcccctgaggtattcaaatataccggggcgtacagacgtaccccacaaggagcaccgacatccccgggattggcaaacgccatctgctggcgtatggacaagcggctcgccggcttggccaagaaatttaatgccgtgtatacccgatacgcagacgacctgacattttcagggggggtcgaactagctggaagagcaggcgctttcttaaggtacgtggctcggatcgtctga

SEQ ID NO: 13182 - RNA, 1146 nt, unidentified
  source 1..1146: mol_type = other RNA; note = synthetic construct
atgggattcttcagctggctgagggggatgctctttccacctgccacacccttaccgcctggaatgacgagagccgaagcacgtaggcgacgccaacccgattttttaccaaggccacgccgacgaagaccaagaaggcaccgttacggcagaccagaggccactttcagaccagctgaactggctcggtttgacctccccgcgcttgctactgtggaagatcttgcagcagcactgggtgtcacaacgggcaagcttcgatggctgacatggccctgccgcgatcggacctgtgaccattatgtgcggcgtcgggtgcccaaaaagagtgggggtgagcggttgctctgtgcacctaaagcagaaacccgcagggctcaggactggatctttcacgaaatcttggcccgtgtcccggtatcatcagccgcgcatggctttatccggggtcggtctatagtgtcaaacgcctccgcacatgtcggaaaacgggtggtggtgtccatggatctagaagattttttcccctccgtcagtatggccaccgtcgttggcctcttcgagtggctcggatacagcaaggaggttgcctggcacctctctatgctgtgtacctgcgcctatgggagacgcagagccttacctcaaggttcgcccactagtcccgctatttctaacctgatatgctggaaaatggaccggcgcctggctgggctggctagaaaattcggcgccacttatactcgatacggggacgacctgacctttagcggacacttccagcgccctgacaggcctggtaggctgatcggaattgcccgagcgattattagcgaggagggcttcgaggttgcccgccacaagaccagaatcatgaggcacaacaggcggcagtctgttacaggcttggtagtaaatgagaggaccggaatcggccgcgatgaagttagaaggctgcgcgccatcttgcacaattgcaaggtgcatggggtggagagccagaatagagagggcgacgagctattcaaggagcggcttagggggaagattgccctggtgaaaatggcgaaccctgaccagggagctaagctgctcgctgcatttcatgaagtggattggggcgcaacagcttccccaaaggggtga

SEQ ID NO: 13183 - RNA, 1152 nt, unidentified
  source 1..1152: mol_type = other RNA; note = synthetic construct
atgtcttggatgtactttctgctggctggggctgccgtgctgctactcttggcactctccattccgcgagccgagcaacctgccgttgcagagcccaaatccagaagggggccacgcagaccccttccaggatcacgctggaggacccagcaccctggcgattctgaccgtttacgatctctcgggttgcctgaattaagagatacaagagatctgctgcggtggctgagactgtccttgcgggagctggtgccacttgctgaccacgccaatcgtgccacgagagacagaaacaactatatagagtggaccgtgcctaaaagacgcggtggcaagcgcgtgatcgcagctccaaagaagcgcttaaaggctatacagaccagaattcttcgcgagattctggacagggtccctcctagcgcagccgctcatggctttgttcgggggaggaacatcgtgagcaatgccgcccctcatgtgggtagggccatcgtggtaaacttcgacctcgtggatttcttcgaacacgtccattttccccgagtaatgggcgtgttccgccgcctgggctatagcaaagaagtggctcgctggttggcctacctgtgtacacataggccccttctagttgcgggagatggacacgggccactagcggctgcaaggcatgctgtccagggtgcccccactagtccagcggttagcaacctggccgtacataggcttgatgccagactcgcaggcctggctaggcgttttggctgcacttacacaaggtatgccgatgacttgactttctcaggcgacgaaccgtttaagagatctctcaagcgtttcgtccccctggttaggcgcatcgtatccagcgaacggttccgacttcacgaaggaaaaatgcggttcctgcgggcaggaaggcggcaagaagtgaccggggtcgtggtcaatagaaagatcaacgcacgacgcgaggagtatgaccggttgaaagcgattatccacaatgctcgtaggtccggaagtctggagtcgcagaatcgggagggtcggccccactttagggcctacctcctcggacgggccagtcacatcgcaatgctgtcaccggagcgaggccagcgactcatgagagaaattcggcggctgacatga

SEQ ID NO: 13184 - RNA, 1131 nt, unidentified
  source 1..1131: mol_type = other RNA; note = synthetic construct
atgacagtgctggtcagcattggcctggcggcaatcgtcatcgcctttaccgccttgataatggctttaagtgcacttgatcggtctggggcccctcggtcacgtcctttgccaggagcccgggtgttcccacaagctggcggaaacatcgcgaagctaagagatcttaatctacccgagctcgactcgacacacgacttgctgcgttggctcaggcttgaactggtgcagctgcttcccctggcaaatcatgctaaccggactgagagatcaaattacgtggagtgggccgtgccgaaaaaatctggcggtcttagggtcatcgccgcccccaaaaagcggctgaaggctatccagctgcgcattctgagagaaatcctcgataatgtgccacctagctcagccgcccacgggtttgttaggggtcgcgacgtgctttccaacgccactcctcacgtgggcaaaacactggtggtgaatttcgatctcgtagacttcttcggacacattgcgtacccccgggtagtcggcgtcttcaggcgaattgggtacgggaaagaggtaagtcgctggctagcctgtctctgcacccatcaacctaagccccccagaggtcggggccatgatagagagggaaggcgccggcacgctgttcaaggagcgccatctagcccagccattgctaatttggcagcctggcgcctggacgcacgtttatgcgggttggctaggcgctttcagtgtacctatactagatatgccgatgacctgacgttttccggcgacgagcccttcaagaggtccctgagacgttttctgcctctcgttcgaaggatagttgctgcagagcggtttgccctgcatcgcagaaagatgcgattcgcaagagctagcagacgccaggaagtgacaggagtggtcgtcaaccgaaaaaccaacatccgccgggctgattttgacagactcaaggcaatactgcacaacgcaaggcgagccgggtccctggagagtcagaacagagaacagaggccacacttcagggcctatctgctcggcctggcagctcacgttgcgcatttaaatccgcagcgcggtgaaaggttgcggcgagaaattctcgctttagagtga

SEQ ID NO: 13185 - RNA, 1251 nt, unidentified
  source 1..1251: mol_type = other RNA; note = synthetic construct
atgctcgcgttggctcctacgacctgggcctgctacgggattcctctcggcgtattcctctcggtcgccattttcctccggtatgcctatcgacgggctgggagcgagtccgagaaatgggacagcctcggtggccgtagatggaggtgcgaaagaaagggggatggagttggtgagctcagggaacgggtcacgcgcgagagagtgtggctgccaggatcaaagaggttaccccaaaaaccctccaacgcccagaaactaggagacttgggcataccagtgctgaaggataccgcagacatcctcaggtggcttggcgtcgacctgaagagcctgctgcctctggccaatccggaacgaagggttagacctgggaaatctaactacgtggagtggaccgtcaaaaagaggagagcaggccttcgggtcatctgctcaccgaaaccaaggctgaaggccatccagaggaaaatcaaggctgagattcttgaccgagctccagtgcacatggcagcgcacggattcgtgagaactcggtctattgctaccaatgcagccggacatgtgggaagaaagcttgtggttaacctggacctgcgcaatttctttgagcatatacgcatccaacaggtttacggcgtatttcgtcacctgggatatggttcagaagtctctcgttggctggcacgcttgtgtacacacgcaccacagttgggcgaagcgagtcgcgggctagacggacagtgggagatgcagaggatacgtagacatgccgttcaaggcgctcccacatcccccgctttagccaacctggcttgtctgcgcctggatcgtaggctcactggcctggccaagaaatttgatgccgaatataccagatacgccgatgatttgacattctccggtgacgagagatttaagcgcgggatgaagcggttcctcgatcacctgcacatgattatccggctggaaggttttagtgagaactacgtgaaacgacgctttatgagaagtggccagagacaacaggtgacaggggtggtcgtaaaccagcgggtaaatgtggcacgggacgagtacgatcgacttaaagctatcattcataatgccaggaagactgggctagacgcccagaaccgggatcaccggcctgacttccgcgcgtatcttttaggcagggccgcacatgtggcacagctgaatcccgaacgcggtcggaagttggtggaggctatccgagccgtgagctga

SEQ ID NO: 13186 - RNA, 1248 nt, unidentified
  source 1..1248: mol_type = other RNA; note = synthetic construct
atgtcttactgggcatgggggatacttgttgtggttgccatagtcgttatttttattgcacgggtcactcagaggaagctacctagcggtttttggcggcccggatacagttgcggatttgccccgggcgcttggaaacgatgtgacaaacgagagggagccgacgcgggcttcccaagagctaaagatgctgagagactgaagcctctgcccggttttaaaaaacatcgacaggcaccagccgaccgtggcagattagtggctagcgggcttcccgtgctggagtccactgacgatgtgctggcctggctcggcctggacttacgcagcttcctcgcgctggctgatccaggggatcgaatccgtcctggcaaaacgaattacgtcgagtggacagtgccgaagaaaaggcatggggtaagaatcatctgttcgcccaagccaagattgaaggccgtgcagcaccgaatcaaagacgaaatactcgaccacattgtgccgcacgaagccgcacacgggttcgtgatcggccggtctattgtgaccaacgcagagcaacacgttggccgggccctcatcgtgaacctggacctgcgcaatttcttcgactatgttaggtatcaccgagtaatcggcgtgtttaggtggctaggatactctcttcaggccagtagatccttggctctgctatgcactcaccggcctaacctctccgctctccacgaggacccccctgaagcctatgtccggcatgtcttccgccatgcggtccaaggggcaccaacctcacccgcactggctaacctcacagtataccggctggataggagggtagctggcctcgcaagaaccttcgatgcgcggtatacacgctatgccgacgatttaacatttagcggagatgagcctttcaagcgtgggatgatcaggttcttgtcactggccaagcaaattattgccgaagagggctttaggcttaatatgcgcaagatgcgcttcatgaggccaagtcagcgccagcaggtgaccggagtgatagtgaataagaaggttaatgtccggagagaggattacgaccagctgaaggccatcgtgcataacgcccgcaaaattggttcattggaatcccaaaaccgtgaaaatcaccccgattttcgggctcacctgcttggaagggccgctcatatcagacagttgaacgcggcaagaggtcagtctctgatcgatcgcattcatgccattgcatga

SEQ ID NO: 13187 - RNA, 1323 nt, unidentified
  source 1..1323: mol_type = other RNA; note = synthetic construct
atgatgcccgccttgcagattggggccgtggccataatcggactgctggtcgcagtgtttgctattgttgtagtgctgattattgttgtcaatatcgtgaaccaggcaaggagaggaggaccaggtggcgcacggttagaattgggcaccgatggtcttagagttagcgtggggggaaggtcacgagggaaaatcctgggctctagagcacccatcgtcctcggcaattcccctacatcctcatatcgagagagagacgacaaaatgcggcagctgcaccctcaatctatagacaggcagcggtccctgagactcccggttctggagaaacccgacgacattgtcgccttcttacagctgagggatttccgcgagcttgtgcacctgtgcgacactggcaggatgcagggcctacgcaacggaccaggcaagctgcggaactacaccatgcgcacgattcccaagcgtggcgggggacagaggtttctctttatccctaagccccggttgaaggcagcgcaacgcagaatcttgcacgaaatcctggataaggttccggtgcatgaagccgccaaaggatttgtgaggggtagggacgccaccgatcatgctcgccctcacattggcaaaccgataattgtggctcatgatattgccgacttttttccgagcatccgatatcgaagggtgtgttcttttttcatgtggttagggtacccccactcagtggcccggattctgtccctgctttgtactaccgcctctcttgcgagtctcgcacgcgtccttccacaaggggctcccacttcccccgccctagcaaatgctctttgctatcgtctcgactgtcggttggctgggctggccaagaaattcggagctacatacacacggtacgcggatgacctggcatttagcggtggagaggatttcaagagaggtctgaatcgcttcgtgccattggtagagacaatactcaaaagcgaacgtttccatcctaagaaagccaaacgcaggttcatgcgccggggaagacagcagaacctcgtcggcttaaacgtgaacgacagactctcagtcggccgggctgaaatcgatagactgtgcgccatcctgcataacgctagtaaggccgggtcgctcgagagtcagaatcgagatagaatccagaatttcgctgaccacctggggggccgtatcgcttgggtagagaggttccaccccggcaagggggccaagctacgaagccagtggcggcaactgatcggtgcaccaccagcccctccacctcctgatctcccagcagcgcctcccccagagtga

SEQ ID NO: 13188 - RNA, 1311 nt, unidentified
  source 1..1311: mol_type = other RNA; note = synthetic construct
atgctgctactcgtggggatcttggtgctcgccgtggttgccgcgattctgattgccgccgccgccgttaaatctgggggtagccctcagacgcctcatccagctcaggctggaggacgggcaccaggtgcagtaccggaggcttccggaaatagattcgcagcaccacccggcgccaacttcacagggcctttcgacaagaagaagtggcttatcaaccctgactggagagaggctgacccaaaggcagcttcccgctatccacgggccgaggatcgtcggaggcaatggtctttgcctattctggacaatccagaggacgtggtgcgatttctagatttggggggcttcggcgtgcttgtcaatctttgtgatcccaatctgtggtcgtcagccgctggccattcagttcccaacccggccgccaactacaggtttagaagcattccaaagaggggaggtggggtgcgtttcatcgccgctcctaaaccgcgcctgaaagccgctcagcgccggatattgagagagatcctggataaggtgcccgtacacgatgcagccactgccttcagacccaggcggtcagttgcggatcacgctaggccgcacgttggccgacagctgattctggcttacgacttacaggactttttcccccgcatcagacacggaagggtcgctggactgtttaggtggttggggtaccccgcttccgtcgcaaggtgcctcgcactgctctgcacatgcagcgattccatggccgtctctacccaagcccgccatctcccacaaggtgcgcctaccagtcccgcaattgcgaacctgttatgtttccgcctggattgtcgtcttactggcctcgccaagaagttcggcgcgtcatataccagatatgcagatgacctggcatttagcggagacaatgagttcaaaaggggaatcactcggtttatacctctcgcagaaaaaattatccggaacgagggcttcgtcctcaacaagcagaagcgtcggtttatgcgccatgggagatgccagcggctgacagggctgaaggtgaatgacagcctcagtgtgggcagagaagaaagcgatctagtgaaagccatcctgcataacgctaaaaaggcgggctctcttgaaagtcagaataggcagcagcgaggcgactttgaggcacaccttcgaggcagaatctcctggatcagtcagtttcaccccgcccgaggagccaaactgttggctgaattagacaaagtaaccgggtttcaacgccgcgctggtccacctgccataacacctcccgattga

SEQ ID NO: 13189 - RNA, 1530 nt, unidentified
  source 1..1530: mol_type = other RNA; note = synthetic construct
atgagcgaaaagctctctagacagcaaatttacgaccggattagagccacgtccaaggatagctatgtcttggaggaaatgcagaggctaggattctgggaatcgagtgatacgcctagtctgtcagaggtgctgataaagagggaagtcgcagctaatcaggagctgaataatttgcttgcacaggataggaagtatcagaatcaggaagccatgctcaaggagatgaggaaggcgcgtatgaagttagccaaggagaagagagaacaaaccaagcagaaaaataagcagaaaaaagacgacaaagcagaggcgtggaaggacactcagcagcagcagatcgtgtacctgggggagggtgtgtcaggcggcttgaatgagatcgaatccgccatagagtctttacagcgctttaacttgccagtatttgaaaacctgagtgatttcgccagcgctctgggaacagacctgtccgcgctccggtacctgttataccagcgtaaggtgagccggatcaaccactaccacgcattccaaatcccaaaaaaaagcggcggtaaacggaccatcactgctccgaaacaaaagctcaagaggctccagctgtgggtgttggagaatgtactgaaccgaattcagattaatcaccacgtccacgggttcattaaggaaagatctattgtctcaaacgcccgacctcacctccaaaaagatattgtcatcaatgtggacctgaaagattttttccccagcatttcatacaaacgcgtgaagggcttttttcataagctaggttatagtgagcagctctccacaattttcgctctgatttgcacctacgccgaaaccgagaaagttgagatggatggtgtgaactattatgttcagaagggaaaccgctttctacctcagggaagccccgcttcacccgctatctctaaccttatcgcctacaagcttgacaagaagatccaggggcttgctgcaaaattcaattttacctatacacggtatgcagacgatctcacattcagtacatccaaagagaatgagaaaaacatcgcctctctgctgtttttcctgaaaaagatcatagaggtggagggatttgctattcatccagccaagacccacatcatgagaaaagggaatctccagaaagttaccggcatcgtggtaaaccaaaagctgaatgtgcagcgagtccagctgcgcaaatttcgcgccctgttacatcagatagagaaagagggctggaaagatcaaaagtggggcaacgcgaaatatctcatcaacgcaatagagggatacatcaacttcgttaagatggtgaacgaatccaaggccatggtattcaaggcacaacttacttccattttggccaaacatgggcatcctccagtcgagcaagccgttgttgaagaagaatctaagataatcgctgaagaaaaggccacagaggtgaagattgaaactcccctgaaaactgacaccgaggctaaacagtacgactggtggaacgtgctttga

SEQ ID NO: 13190 - RNA, 1530 nt, unidentified
  source 1..1530: mol_type = other RNA; note = synthetic construct
atgtcagagaagcttagtagacagcagatctacgataggattcgtgccacctcaaaagagtcttacatcttggaagaaatgcagagactggggttttgggaaagtagcgacacccccgggctccctgaagtgctaatccatagggagcttgtggcgaaccaggaattaaacaacctacttgcacaagaccgcaaataccagaatcaggaggctatgctaaaggagatgcggaaggcccggatgaaactggcgaaggagaagcgggagaagacacgccagaagaacaaacagaagaaggaggatcaagcagccaattgggcaaatatacagcagcagcagatcatctatttaggcgacggggttagtggcggactcaatcagaccgagagtgacgtggaaactcttcagaagttcaacttgcctgtttttaaccagatagttgacttcgcttctgccatcggagtcgatctctccacactgcgatatctcctgtaccaacgcaaagtttcaagaataaaccattaccacacattcgagatcccaaagaagaccggcggtaaacggttgatatctgcccctaaatctcgactgaaggccctgcaactgtgggtactcgagaatatcctgaaccacatagaaattaacgaccacgttcacggattcattaaggagaggagcattattagcaacgctcagccacatctggagaaggatatcgtgatcaacgtggatctgaaagacttttttccaagtatctcctacaagagggtaaagggacttttcaataagctcggctacagcgaacaattagcaacagtgtttggtctgatttgcacatatgccgagactgagcacgtcgagatggatggggtgagctattacgtacagaaaggcaatcgagtactccctcaggggtcacccgcttcacctgctatttccaatcttatagcctttaagctggataagaagattaaaggactggcttccaaattcaatttcatttatacccggtatgcagacgatttgtctttttccacgtcgaaagaaaatgaaaagaatatcgcatccctgttgttctttctgaagaagatcatcgaagcggagggtttcactatgcaccccgagaaaactcatattatgcgcaaaggaaacttgcaaaaggtcactggcattgtggtgaatgaaaaactgaacgtgcaacgtgacaggctgagaaagttcagagctttactgcataatatcgagagcaacgggtggaaagaccaaaaatggggcaacgccaagaatctgatcaacgcagtggaaggctacattaatttcgtgaaaatggtcaacaagtctaaagctgccgcctttaaagcgcagctcgagaacatcgtcgctaagcacggttacccagtgatcgtggaagaagtcgtggaggtcaaaacggaaaccatcgtggccgaaattgttccggaggtcaaactcgagaaccccataaagcccagctccgatgccaaacagtatgactggtggaatattctctga

SEQ ID NO: 13191 - RNA, 1527 nt, unidentified
  source 1..1527: mol_type = other RNA; note = synthetic construct
atggaggagaagctgagccggcaacaaatttacgatcggatacggagtacgtctaaagagtcttacatcctcgaggagatgcagcgcttagggttctgggaatcgagtgaaaccccatcattatccgaactgctcataaagcaggaaaccacggccacccaggagttgacaaagctgttggagcaggacaaaaagtacaacgatagggaggccatggttaaagaaatgcgcaaagctagaatgaaactagccaaggagaagcgttctgaaaccaagaataggaataaggagaagtcaattgacaaagcacagaagtggaaggagactcaggaacgacagatcatttacctgggcgagggcgtcagcgcgggtcttaatcacactgagtccgacaaattgaatctgcagaaactcaacttacccgccttcgatcaggtgacggacctggcctcagccatagggctgagcctcgcggaacttcgctatctgctgtaccaaagaaaggtgagcaagatcaaccactatcataccttcgaaatccctaaaaaaagcgggggaaaacgggtaatatccgctcctaaatcgcgcctgaaggcacttcaattgtgggttttagaacacgtgctgaacaatatatccatcaatgacgtggctcacggcttcatcaaaaaccgttctatcgtcacaaatgcaaccccacatctggccactgacattgtgatcaatgttgacctgaaggactttttcccgactattaactacaagagggtcaagggtttgtttcataagtttggctatagcgagcaactcgctaccctgtttgccctcatttgcacatacgccgagacagaggtagtcgagatggatggagtgtcttactacgtgcaaaagggcaacagattccttccccagggatcccctgcaagtccggcaatttccaatctcattgcatatagactcgataagaaaattcagggactggcgtccaagtttaacttcacttatacaaggtatgccgatgatcttagcttttccaccagcaacgaaaacgagaagaacatcgcgtcactcctgttctttgtcaaaaagctgattgaggcagagggctttaccctacaccccgagaaaacacatatcatgcgaaaaggtgccttgcagaaagttaccgggattgtagtgaacgaaaaactgaacatccaaagaagtcagctgcagaagttcagggcccttctacacaatattgaaactaatggctggaagaaccagaagtgggggaaggcaaaaaacctgatcaatgctatcgagggatacatcaatttcatctcaatggtgaatgctgaaaaaggagccaaatttaagttgcagcttaaggatatcgtggccaaatttggttatccaatcgtggaacaggagacagctgaggtcaaaattgaaaccgctaagcaggaaatagttgagcctcccaagagtaagctcgagactccagaaacagcttctaaacagttcgactggtggaacatcctgtga

SEQ ID NO: 13192 - RNA, 1563 nt, unidentified
  source 1..1563: mol_type = other RNA; note = synthetic construct
atgtcagagaagtctacacgtcaacagatctacgatcgcattaggatgacctcgaaggattcctacattctggaggaaatgaagagactggggttctgggattcttcagacgtgccctccctgagcgaaaccttaattaaacgggagtcagaggtgaataaagagctcacgagtctgttagagaaggatagaaagtatcgcaatcaagaggctcttctgcgggagatgaggaaagaacgcatgaagaaagctaaggagaaacgcgaagagacaaaactacgcaacaaaaaaaaacgactggacaaagccgctaagtggaaatctatgcaggaacatcaagtaatctacttagggaaggacgtgagcgcgggactgaataacaccgagactaatgaggcattgctaaacaagaataacctgcccgtgttcaagtctctaactgatctcggccagtccatgcagctcgaattgtcaaatctgcgatatcttctctttcagcgtaaggttagtcggcagactcactattataacttcgagatccctaagaagtccggtggcaaacggaaaatcagcgcacccaagaggaggatgaaagccctccagctgtgggtgcttaataacatactggacagaatagctattggtgaacaggcccacgggtttattaagcagaggtccattgtaaccaatgctggacctcacactgggaaagacatcgtcattaatatcgaccttaaagactttttcccctccattgattataaaagggtgaagggcctgtttcataagctcggctatagcgaacagatggcgaccatattcgccttaatctgtacacaagcagaaaccgagacggtggctatggatggagtgacctactacgttcagaagggtaagaggattcttcctcaggggagcccagccagtcccgcaatttctaacctgatagcctataagcttgacaagaaggtcaagggcctcgccgacaagctgggctttcgctacactcggtacgccgacgatttgtcttttagtaccgataaggggaatgaaaaaaacatagcgagtctcctccatttcgttggaaaaattatcaagtcagagggtctgaccatcaatcctgagaaaacacacatcatgcggtccggcgcacagcagaaagtgacagggatagtcgtaaatgagaaattgaacgtcgagagaaagcagttgcacaacttcagagccctgctgcataacatcgaaactaacggatggaatggccagaaatggggaagagccgataacgttatgcactctatcgaaggctacattcatttcattaagatggttaacccagagaaaagcatcagatttggtgagcagcttacgcgaatcgtcgaaaaacacggcttgcccctggtcgaagagaagacatgcacaaaacaagacatcgctccgaagcaggtggtgcaagtggaggaacctctgaagccagaaccaactatccagccgggacagaagcaagaggatagcaacaagaagacctccagcacagacgactggtggaatatcttctcgtga

SEQ ID NO: 13193 - RNA, 1539 nt, unidentified
  source 1..1539: mol_type = other RNA; note = synthetic construct
atgtctgagaggagcactcgacagcaaatttatgatcgaattcgggcggctttcaccaaagatagttacattttagaggagatgaagcgcttggggttttgggactcgaatgttgacgcccccacactgcctgagagactgatccagcgagaggccgagattaatcaggagctgaacaaattgctcgctcaggatcgtaagttcagaaaccaggaagcaatgttagccgagatgaggaaagcccgcatgaagcaggcacgggaaaagcgggtactgaccctggagaaaaacaagcagaagaggttagacagagcagccaggtggcggtccctgcaacaggaacagattatctatctgggaaagggggttagcgccgggctcaataatacggatactaatgtccagtctttgcagaagtacaatttgccagtattctccagcctcacagagctcgccaactctatgaacctcgacctggcgaagctgagatacctgatctttcaaagacaggtgagcagacatacacactaccacacattcgagattccaaagaaatcaggagggaagcgtaaaatcagcgcccctaagcgacaaatgaaagctctccagcgctggatactcgacaccattctgagtcccatatcaatggatgagcacgcacatggctttattaagaacaggtccatcctaaccaatgcccagcctcatacaggcaaagagatcgtcatcaacgttgacctgaaggattttttcccttcaatcgacttcaaacgcgtgaagggcctttttcacaaactaggctattctgagcagatggccatcatctttgcgctaatttgtacccaggctgagactgaaacagtggaaatggatggcgtaaggtattatgtgcaacgaggtaaacgcattctgcctcaaggctctccggcttctcccgcaataagtaacctcgtcgcttacaagttagataagaaggttaacggactggctgagaaactgggtttcacctacactcggtacgccgatgatttgagcttctcaacctttaggaggaacgaaaaaaacgtggcaagacttcttcactttcttgggaagatcatcgaatccgaggggctggtcatgcaccccgacaaaacgcaagtgatgcgcaacgggggtctgcagaaagttactggaatcgtcgtgaatgaaaagctcaatgtgcagcgggaacagttgcggaaatttagagccctgcttcataatatcgaggtgaatggttggaaggaccaacgctggggacatgctcacaatcttatacactccatcgagggatatatccagttcgtgaagatggtgaatccccgtaagggcgacaaatttcggaagcagctggatcagataataaaaaagcacggctgcccgccaattgacgaaaccacattctacaaaaagactgtcgaaacgagtcagccttcccaacccattactagccagaccattgaaccagaaaaacatgcaaccccaaagggcaacgactggtggaacatcttctcctga

SEQ ID NO: 13194 - RNA, 1521 nt, unidentified
  source 1..1521: mol_type = other RNA; note = synthetic construct
atgtcagagaaactgactaaacagcagatctatgatcggatccgagctacgtccaaagatagttacattctggaagagatgcaacgccttggattttgggagaaagcagactctccccagataccggagattttcatagagaacgaaactagactgctccaagagttgaatcagctactggataagaacaagcagtactctgaccaactctccatgctcaagagtatgagaaaagtgcgtatgaaaaacgccaaggagaaaagagaggttaccaggcagaataacaagctcaaagcgctcgaaaaagcagagcggtggttgaagctgcagcaggaacaggtgttatttctcggcaaggaagtcagcaaaggattaaataataccgagcccaatgttaactcgctgaagaagtttaacttgccagtgttccactccgttgtggagttcgctggctatatggagacagatctcccgtcgctgcggtatcttttgtatcaacggaaggtgtcaactattaaccactaccatacctttgaacttcctaaaaaatccgggggcaagcgaaagataagcgcccctaagtcaaggattaaagccctgcaactgcaggtactggacaaaatcctgaagaatatcccagtcaacgattacgtacacgggttcattcagggaaaatctatcgtctccaatgcccagccacatgtgaataaagacatcgttatcaacatggacctcaaggacttttttccttctattgagtacaaacgtgtcaaaggtctgttctataagcttggctattccgaacagattagtacgatgcttgcactggtgtgcacccagtccgacacctacgaggtgaatatggatggtgtaacctaccacgtgcaaaagggagcaaggttcttacctcagggctctcccgcttcacccgccatcagcaacctgatcgcatacaaactggacaagcgcattaagggcctagccgaacgcctgaacttcacctacactcgatatgccgatgatttgagctttagcacaacaaacgagaaccagaagaatatccgccagttattgtttttcgtcaatcagatcgttgtggaggaggggttcaaggtgcacccagaaaagactcatatcatgaggaaagggaacctgcagatggtgacggggatcgtggtaaatagaaagctcaatatcgagcgcaagaaactgagaaattttagggctctgctgcataaccttaatctcaatggatggaaggaccagaagtggggaaacgccgtgcatctaatacacgccgttgaaggttatattcggttcgtcaaaatggtcaaccctgaaaaaggtaaggaattcgcggagaaacttgctactattattaagaagcaaggctacccagaaatcagctgtcaaaaatacaacagcaacgatacaaccgaaaagacaacagctagtattaccaagcccgagacaaaccagaaggaggaaaatgactctcaggattggtgggacatattttga

SEQ ID NO: 13195 - RNA, 1515 nt, unidentified
  source 1..1515: mol_type = other RNA; note = synthetic construct
atgtcagagaagttatctaagcagcagatctacgatcgtataaaagcaactagcaaggattcatacatccttgaggaaatgcagcggctggggttttggcagtcgggtggtcagccaacactgtcagaaatcctaatcaaacaggaagccgctattgagaaagaactgaatgagctactggcccaggatcgcaaattttctaatagggaggcaatggtgctggaaatgcggaaggcaagaatgaaggctgccaaggaaaagagggtagagactaagctgaagagagagcagaagcgactcgataaggctgagaactggaagctgcttcaggagaaacagattctttatcttggtgaagaggtgtccaagggactgcactacaaagaggccgccgtcaatctcctcgaaaaatataaccttcctgtgttcgaagacgcactcgcgttggcaaaatctatgaatatcgacctgaaagccttacagtacttggcttacaatcgtaaggtcagtaagataaaccattatcacacgttcgaattggagaaaaagtctggaggcaagagaaagatcagcgcccctaaacccaaactgaaagaaatccagacctggattcttgagaatatcctgcatcagattccgtacactattgaggctcatggctttgtcaaagagcgcagcatcgtgaccaacgcccaacctcacgtgaataaggatatagtcgtgaacgttgatctgaaagatttcttccccactattacatacaaacgggtgaagggtctgttctgcaaattgggctacagtgaagaggtggctacgatcctctccctcctttgcacttatagcgagattaacgaaacgactctggacggggtcacctattatgttcaatctggcgagcggaagctcccacaagggtcccctgctagtcccgcaataagtaatctcattgtgtataagctggacaagaagattaacggcttagcgcagaaattgaattgtagctatacaaggtacgccgacgacatgtcatttagcaccacccaagagaactcctccaacataagcaagctcctgtacttcaccaagaagattattgcttctgaaggcttcattgtgcacccggagaagatccacgttatgaggaagggcatgcaacagaaagtaacagggatcgtggttaacaacaaattgaatatagaccgaaaccagctaagaaaatttcgcgccttgttacacaatatcgaaaagaatggatggaaagaccagaagtgggggaaggccgtgcatgtcattaatgcaatcgagggatatatcaattacgtaaacatggtcaaccccgaaaaggggaccctgtttaaggagaacctgaagaacatcatcaaactgcatggactccctcacattgagaaaatcattatcccagagaaagtaacacccatcgcggtgtcgctgccagaagaaaaagaagagacaaccgttaaacagcaatccgagaactggtggaatatattctga

SEQ ID NO: 13196 - RNA, 1515 nt, unidentified
  source 1..1515: mol_type = other RNA; note = synthetic construct
atgtccgagcagcttagtaaacagcaaatttacgataggatccgggctacatcgaaggattcttatatcctggaagaaatgcagaggctaggattctggcagtcaggagccgagcctacgctatctgagattttgatcaagcaggaagcgaagatcgaaaaggaattgaatgacctgctcgcgcaggatcgaaaatactccaacagagagagtatgattttggagatgcggaaggctcgaatgaaggctgcaaaagaaaaaagagccgagactaagctgaacaatgaaaagaagagacgtgagaaagccgaaaactggcagctgcttcaacagcaacaaatcctgtacctgggtgaggaggtcagcaaaggtttgtattataaggagtcaaacctcacgttgttagagaaatacaaactgcccttctacaaggacgctctggccctggccaagtcaatgcaaatagatttaaaagccctgcagtaccttgcctacaatcggaaagtgtctaaaatcaatcactatcacacctttgagttagaaaagaaaagcggaggtaagagaaagatcagtgcacccaaaccaaagctcaaagaaatccagaattggatcctcgagaatatactgcaaaaaattccgtacactaccgaagcccatggtttcatcaaagagcggtctatcgttactaatgcacagcctcatatcaacaaggacatagtggtgaatatagatctcaaggatttttttcccacagtcacctataagcgggtaaaagggctgttccataaaatgggctacagcgaggaagtggcggtgattctgggcctactctgcactcatagcgaaattaatgagactatcctggacggcgttacatattacgtgcagtccggagagaggaagctcccgcaaggcagtcctgctagccctgctatttctaatctgatcgtctacaagatggataagaagatcaacggactggcaaaaaagctcaacttcaactatacccgttatgctgacgacatgtcattcagcacaacacaggagaactccaagaacgtgtcccgccttctttacttcaccaagaagatcattgaaaccgaggggttcgttattcacccagacaaaattcacgtgatgaggaaagggatccagcagaaagtaacaggaatcgtggtgaacaagaagcccaatatagaccgcaaccagcttagaaaatttagggccctgctccacaatattgaaaaaaacggctggaaagaccagaagtggggcaaagccatacacgttattaacgcaattgaggggtatatcaattatgtacgcatggtcaaccccgagaaggggatcgtgtttcgccagaatttgaaggacattattaagcagcatggcctgccatacgttgagaagatatccatccccgagaaaatcacccctatcgtcattcctgtcccagatgaaaccaaggaaattccaattgagaagaaaccagaaaactggtgggatatattttga

SEQ ID NO: 13197 - RNA, 1518 nt, unidentified
  source 1..1518: mol_type = other RNA; note = synthetic construct
atgagcgaacaactttctaagcagcagatctatgatcggattcgggccacctctaaggactcatacattctcgaagaaatgcaaagactgggcttttggcagagcgcaacagagcctactttgtcagagatcctcattaatcaggaagccaaaatcgaacaggaattgaacgagctactcgcaagggaccgaaagttctccaacagagaagccatggtcctggaaatgaggaaggcacgcatgaaagcggccaaagaaaagaggggggaaaccaaattaaatcaagaaaagaagcgtctggagaaggcagagaattggaagcagctacaagagaaacagattctgtatctaggtgagacggtgtccaaagggttgaatagcaaggagacagatagcaaaattctggaaaagtacaatctgcctgtatttgaggaccttttggcattggccaaatctatgcagcttgacttaaaagccttgcaatatctggcttacaaccggaaagttagtaaaattagccattatcacaccttcgaggttgagaaaaagtccggcggaaagcgcaagataagtgctccaaagagcaagctcaaagagattcaaacatggatcctggaaaacatcctccataagattccacataccatcgaggcccacggtttcataaaagagcgctctattgtcacaaacgcccagcctcacatcaataaggatattgtggtgaacattgacctcaaagattttttccccactgtgacctacaaaagagtgaaagggctgttccacaaaatcggctacagcgagcagatagctacggtgttatcgctgctttgcacttattctgagatgaacgaaacctccctggatggaattacatactatgtgcagtcaggagagcggaagctgccacagggatccccagctagtcccgctattagcaacatgatcgtttataagctcgacaagaagatcaatggtctggccaagaaactcaacttttcctacacccgttacgctgatgatatgacttttagtgcgaacgagaaaaattctaagaacgtatcaagactgctgtactacaccaagaagatcattgaatcagagggctttgtgatccatcccaacaaaatccacatcatgagaaaggggatgcagcagaaagtgacaggcgtcgtggtcaataagaagcttaatatagaccgcaatgagttaaggaagttcagggcgctgcttcataacatcgagaagaatggctggcaggaccagaagtgggggaaagcaatccgagtcataaatgctatcgagggttacattaactatgtctatatggtgaacccggagaaaggaactacgctgaaacaaaatctcaaaaacatcatcaccaagcacggccagcccactataaccaagctgtccattccggaacagactgtacctatcccagccagtgtgcccgaaaagaagaaagaaacaatagttcccgacgagaaacctgggaattggtggaacatcttctga

SEQ ID NO: 13198 - RNA, 1515 nt, unidentified
  source 1..1515: mol_type = other RNA; note = synthetic construct
atgtctgagaaactgtcaaaacagcagatctacgatcggatcaaggctaccagcaaggattcgtacattctcgaagagatgcagaggttgggattctggcagtccggtgccgaaccgtcccttagcgaaatactgatccagcaggagactactatacagaaggaactgaacgccctgcttgcccaggacaaaaaatttcagaacaaagaggccatgctggtggaaatgcgaaaagctcggatgaaggcggcaaaggaacggagagtggagacattacaaaagcgggagcagttaaaaatcgaaaaggcgcagaaatggaagttgacacaggaaaaggagattatatacttgggcgatcaggtttctaagggcctcaatatccaagaaactaacgcggccctcctggacaactacaatctgccggtgttcgaagatgttctcgcactcgcacagagtatgcagattgatctgaaggctttacaatatctggcataccaccgctctgtttccaagatccatcactatcatacctttgaagtcagcaaaaagtcaggtggcaagcgtaaaatctctacgcctaaacctaaactgaaggagttgcaaaattggattctagagaatatcctccataaaataccacataccgacgaagcccacggcttcataaagaagagaagcattgtgacaaatgccaaaccccacctcgagaaggacattgtgattaatattgacctcaaggatttctttcccaccataacacataaacgcgtcaaaggtctttttcacaagatggggtacagtgagcagatagccacgatcctgagtctgctttgcacttactcagaggttgacgagatcgatctggacggagtaacatattatgtgcagtcgggcgagagaaagcttccccaaggagctcccacaagccccgccatcagtaacatgattgtgtacaagatggacaagaagatctccggactggctaaaaagctgaactttacttatacccgctatgcagatgatatgacattcagcacctcaaacgagaatgctctgaacgtctccaggctcttgtacttcatcaagaagatcattacgtccgaagggtttatcatacatccagacaagatccacatcatgaggaatggcatgcagaagaaagtcaccggggtagttgtcaataagaagcttaatgtagaccgactgcaactgagaaaattcagggccgtcttacacaacattaaccaaaacggatggaaggatcaacagtggggcaaagctatccacctgatcaacgcagtggaagggtacatcaattatgtggcaatggtgaatcccgagaaaggggcccagttcaagaaaagcctagtcgctatcatttctaagcacggtaaacctgagattgaaaaacctactccaattgagaaggagaaattgatcgtgcctcctgtgctagaggagccaaaaaccattgtggaagaccagaaaccagggaactggtggaacattttttga

SEQ ID NO: 13199 - RNA, 1014 nt, unidentified
  source 1..1014: mol_type = other RNA; note = synthetic construct
atgtccggcaacctaaccagacaacagatctacgaccgaatcagggctgccagcaaggattcctatatcctggaagagatgcagaggttgggcttctgggataattccgacgtccccaccctgtctgagacattaatcaggcgtgaggttgaagttaataaggaactcaatgaacttctggccaaggaccgaaaattcagaaatcaagaggctatgctttcggagatgagacgcgagcggatgaagaaggcaaaggagaagcgagagcagactaagcagaagaacaaacagatacggctcgataaagcagcccggtggaagaaagcacagctcgaacagattctatatcttgggaaaggcgtctctgagggactgaacaatacagactacgatgcagaactgttgcagaaatataacctcccagtatttgatagtgtgaaggcgctggccgagaacatgggagtggaattggcctctctcaggtacctgttgtatcagcgtagggtgagcaagaatactcattactacaccttcgagatacccaaaaaatccggtggtaaacgcaaaatctcagctcctaagcatcgcatgaaagaactgcagatgtgggttctgcaaaatgtgctggataatattcctcactgcgacaccagtcacggcttcataagagaaaagagcattctgacaaacgccgagccacacgtagggaaagacatcgtcattaacgtggacctgaaggatttttttccgaccatctcttataaacgggtgaagggactcttcagaaactttgggtactcagagcagacggcaatcatttttgctctcatatgtacacaagccgaaacagaaactgtcgagatggacggcgtgacttattacgtgcagaaaggggagcgcttccttccacaaggaagccccgcttcacctgcgattagtaacatcattgcctacaaactggacaagaaggtccagggcttagctaagaagttcggttttacgtatacccggtga

SEQ ID NO: 13200 - RNA, 1392 nt, unidentified
  source 1..1392: mol_type = other RNA; note = synthetic construct
atgatcaaaaaggaggcgagcctcagccaggaactgaacactctggtggctaaagataggaaattttctaatcaggaggcgatgcttaaggagatgagaaaagcgagaatgaagctggccaaagaaaagcgcgaacagaccaagcaaaagaataagcagaaaaaacttgacaaggccacatcatggcagcaaacacagctggaaaacataatatacctgggtcccggcgtgagtgccggactgaacaacaccgttagtgactcaaccattctgcagcaattcggactcccagttttccctaacatccccagcttggccaacgccatgcaagtcgatctagccacactccggtatcttctgtatcaacggaaggtgtcaaggactaatcactatcacgtgttcgaggtgccaaaaaaatccggaggcaaacgacgcatctccgctcctaagaagcagcttaaaaagctccagctctgggtgctgaacaacgttctctgccatctgccaaatgaaacagtcgctcatgggtttatccgacaacgttctattgtcacgaatgcagcacctcacgttggaaaggacatcattgttaacgttgatttgaaggatttcttcccaaccataacttatgcacgggtgaagggcgtatttaaaaaactggggtattctgagcagcaggctattattttcgcacttatctgtactcaggcagaaacggaggaagttgagatggacggcgtgaagtactacgtgcagaatgggaaaaggtgcttgccgcaaggatctcccgcaagccctgctattagtaacataatcgcctacaagctagacaagaagatccaggggttagcagccaaattgaatttcgcctacaccagatatgctgatgacctcactttttccaccactaatgacaatgcgaaacagattaccaagctactctatctgatcaagaaaatcgtcacagccgagggtttcgaggtacacccaggtaagacacacatcatgagaaaggggggccagcagaaggtgactggcatagtggtcaataagcaattaaatgtggagaggagccagctgcgcaagtttcgggcactgttacacaacctccagatgaacggatggaaggaccagcagtggggcaacgctaaacatctggtcaatgccgtagaggggtacatcaactttgtcaatatggtaaatcccgtgaaggccaaactgtacaaaacccagttggaaaagattgtggccacacatggctaccccctggtggacaacacaatgcccaagcctactgtaaccaccgtggtggccgaggtcaaagaaacgcttattccgaccgtggctaaagagaaatccgctgataagacagattggtggtcggtcttttga

SEQ ID NO: 13201 - RNA, 1533 nt, unidentified
  source 1..1533: mol_type = other RNA; note = synthetic construct
atgacgttgaaactgaccaggcagcaaatctacctgagaatcaagtccagctccaaagactcatacgtcctcgaagaaatgaaaaggcttggtttctgggacaaggagcagcctactttgcccgagaatctgatcaaaagggaaaccgagattaataaggagcttaccgagcttcagaagctggacaagaagttcaagaatcaggaggcgctcctcgccgagatgcgaaaggaccggatgaagaaagcaaaagagaaacggctgcagactaaggaggctaataagaaaaagaggctggaaaaggccgctaactggaaactgctgcaagaaaaccagatcatatacctcggaaaggacgtcagttacgggctcgataacacgaaaagcgacgtggagagtctaaccaaatacaagctcccaatctataagaacatactacatctggcacagagcatggaaatctctctatctgagatccggtatctcttgtaccatagaaaggtcagtaaaaagacccactatcatacttttagcatcccaaagaagtcaggtggaactcgaattatatctgcccctaaaagcaaactgaagcgactccagtattgggttttgcacaacatattagaagttattcccccaggcgagcatgcccacggctttatcgccgggaaatccattcaaactaacgccctgccccacgtcgggaaagatgtggttattaacatagacctgcagaattttttccccacgatcacatttaagcgcataaagggactgttctctaaacttggatacagcgagcagctggcaacaatcttcgcgcttatttgcactgaaacaccttgtgacaaagtgcagatggacggcgtagattactacgttcaaaactccgagcgcgtcttaccccagggatctccagcctcgcctgctatttctaacctgattgcttggcgcctggataagaaaatccaaggtttagcttccaagtacgactttacctataccagatatgccgatgatctcacattctcagccgcggcaaaggctgaaaaaaatatcgccgggctgctgtacttcctcgagaagattattagaagcgagggcttgactattaatccagaaaagacatccatcatgagaaaggggcgccagcagcgggtaacaggtatcgtggtgaatgaaaaattgaacattccccgtgataattatcggcgctttcgtgctcttttacataacatcgaggcaaacggctggaaggatcaacactggagccactccaaaaatctgccgctgtcggtgaaagggtatattagtttcgtgaagatgattaaccccgataagggcctaaaattcgaagagcagctgaccaggatcatctccaagcacggctttccggaaatggaggtgaaaaagaccatcagctcaatccaggaacaaaaccagagtattgaacttgagaagcctattcaggaggtgaaatcttcaaaggaagacaaacagacagaggataataattggtggaatatattgtga

SEQ ID NO: 13202 - RNA, 1515 nt, unidentified
  source 1..1515: mol_type = other RNA; note = synthetic construct
atgtctcagaacctgtctaggcaacagatttacgaccggatcaaagagtcctctaaagacagttacattcttgaagagatgaagcgtctgggtttttggcaggagacatctacaccatccctcccagagcagctcattaaaagggaggccgtgctgcagcaagaactccaagagctgctggccaaggacagaaagtatggaaatcaggaggccatgctgcgcgaaatgaggaagcagaggatgcaggaggcgaaggctaaacgggaaatcacaaagcagaagtcagaaaagaaacagcaggagaaggctgactactggaagaatctacagcagcagcagattatctacttgggcgaaaacgtgtctaagggcctccacaagagtgattctgacacagccaaactgctgcaatttagtctgcctgtctttgagaatgtcttagattttagccagaagtcaggatttagcctaagcgtgatcaaatacctggccttccatagaaacgtgagcaaaaagtcccattatcatgtgtttgagatccccaagaaaagtgggggcaaaagaaaaattagtgctcccaagcctcaactgcggtacctgcagcactggatccttgagaacattttgaataagatcccagtcggcgagatggttcacggcttcgctatcgaaaaaagcattgtgaccaacgcagaaccccaccttaagaaagacattgtcataaacatcgatctccaggattttttcccaagcatctcctataagcgcgttaaggggttgttctcaaagctgggttacagcgaacagctgtccacaatatttgcattagtctgcacgcaggcccacaccgaggaagttctcctggacaatgtcaaatacttcgtacataaaggagaacgcttcttaccgcaagggtcacctgcgagcccggccatatcgaacatcatcacttataagcttgataaacgacttcagggactctcaaagaaatatggcttcacctatactagatacgccgacgacttgaccttttccgctgcccaagataatgagcacaacattaacacactactgtactttgtgaagcaggtgattaaccatgaagactttaccatccatcccgataaacttcacatcatgaaacggaagcaccagcagaaggtaaccggcatagttgtaaatgagaaactcaatgtcgagcgaaagaagttgaggaaattccgtgcattactgcataatatcgaggtgaatggatggcagaaccaaacttgggggaaagcattccacttgataaatgccatagaggggtatatcaatttcgtgaacatggtgaacccccctaaagcactggcgttcaaagaaaagctcaatacgataattgcaaagcacggtaagccagtggttgagatccgcaaaactgctcccgagatcgctgaaactattaaggtgtccgaagatcaagaggaaattattacccctgccgaagagaagaccgattggtggaacatcttctga

SEQ ID NO: 13203 - RNA, 1515 nt, unidentified
  source 1..1515: mol_type = other RNA; note = synthetic construct
atgagtcagaacttgtctaggcagcaaatttacgaccgcatcaaagcgtccagcaaggactcatatattcttgaggaaatgaagcgactgggcttttggcaggaaacctctacccccagcctccccgagcagctgatacagaaagaggtcgtgctgcagaaggagctgcaggaactccttgcaaaggatcggaaatacgggaaccaggaggctatgctgagagaaatgaggaaaaaacgcatgcaagaggccaaagctaagcgagaggtaactaaacagaagaatgagcagaagcgcaaagacaaagctgatcactggaaaaagctgcagcaggaacagataatctacgtcggtgaagatgtgagtaaagggctgcattgcaccgattccgacgtcgaaaagttactggaattctcgttgcctgcctttgaaagcatcagtgatttctctcagaaatcaggattcggcctcccgcttatcaaatacctcgcatttcacagaaaagtgtctaataagacgcactaccacatctttgagataccaaagaagtctggaggaaaacggaggatcagtgctccaaaacctcaactccgatattttcagcagtggatcctggaaaatattctgaacaagatctcagttggcgaggtcgtgcatgggtttacagcgaaaaagtcaattgttacaaacgcagagctgcacttgggtaaggacatcattatcaacatagatctgcaggacttctttccctcgattagctatcgtagagtgaagggactgttctccaagtttggctactccgaacaattaagcactattttcgccttagtgtgtacacaagcccacaccgaggagattttactggatgacgtgaagtatttcgtccataagggcgagcggtttcttccccaaggatcccctgcctccccggcaatcagcaatataatcgcgtataagttggacaaacgtctaaaaggcctggcccagaagctagggtttacttataccagatatgctgacgatctcactttcagcgcaaaccaagacaaggagcagaatattaacaaactcctgtacttcgtgaaacaaatcattaacgacgagaacttcacaattcacccagataaactccatatcatgcggggaaggcatcagcaaaaggttaccggcattgtggtaaacgaaaagttgaatgtggagcgcaagaagctgaggaagttccgggcccttttgcacaatattgaggtgaatgggtggcagaatcagacatggggtaaggctttccatcttatcaatgccgtagaaggctacatcaactttgtgaacatggttaatcctgtgaaggctctcgtcttcagagaaaagctgaacacaatcatcgccaaacacgggaaacccatagtggaggtcaaggaagttgtgcaggaaattgtcgagacggtagcagttaccgagatacaggaggagatgctagccccaaaggaggaaaaaactgattggtggaatatcttttga

SEQ ID NO: 13204 - RNA, 1515 nt, unidentified
  source 1..1515: mol_type = other RNA; note = synthetic construct
atgtctcagaacctgtcccgacaacaaatctacgaccgtattaaggctagctctaaggactcatacatattagaggaaatgaagcggctcggattctggcaggagacttccactccctccctgccagagcagcttattcagaaagaagtggttctgcaaaaagagctccaggagcttcttgcaaaggacaggaagtacggaaatcaagaggctatgctgagggagatgaggaaaaaacggatgcaggaagccaaggcgaagcgcgaagttacgcgccaaaagaacgagaaaaaaagacaggaaaaggccgatcactggaaagaattgcaacaggagcaaatcatctacttgggtgagaatgtctcgaaaggcttacaccagatgcagtctgacacagaaaagctggatcagttttcactaccggtgttcgagaatatactggatttctcacagaagtctgggttctcactcagtcaaatccggtacctggcgttcaatcgcaacgtcagtgagaagagccactatcacacatttgaggtttctaaaaagagcggaggcaaaagaaaaatcagtgcccccaagccaaaactcaaactgttccagcagtggatattggaaaacattctcaataggatttccgtgggggaggtggtccatggcttcacacctaacaaaagcatcgtcactaacgctgcccctcacctaggcaaagatatcgtgatcaacattgatctgcaggactttttccccagtataagttacaaacgtgtgaaagggctgttttccaaatttgggtattccgaacagctatcgaccatttttgcattgatttgcacacaggcgaacaccgaagaggtgcttctggacggggtaaagtattttgtccacaagggagaacgctttctcccacagggctcaccggcctctcctgctattagcaatagcatcgcctataagctggacaaacgactccaggggctggccaagaagtttggctttgcatataccagatatgctgatgatttaacctttagcgccggacagaattccgagcaaaacataaaccggctcctgtacttcgtcaagaagataattaaggatgagaacttcaccatccacccagacaaactgcatattatgaggcggaagcatcagcagaaggtgactggcatcgtggtgaatgaaaagttgaatgtagagagaacaaagctgcgaaagttcagagccctgctgcacaacatcgaggttaacggttggcagaatcagacctggggaaaagcataccatttgatcaatgcaatcgagggttatatcaacttcgtaaatatggtgaaccccagcaaggcctccgttttcaaagaaaaactcaagaccatcgttgctaaacatggcgtccccttcgtggaagtgcagaaggtgattcctgatgtggtggaacttcccgaagtccttgagccagagcaggacgctgtaacgcctaaggaggaaaagactgactggtggaatattttttga

SEQ ID NO: 13205 - RNA, 1515 nt, unidentified
  source 1..1515: mol_type = other RNA; note = synthetic construct
atgtctcagaatctcagccgccagcagatctatgacaggattaaggccagctcaaaggactcttatatcctggatgaaatgaagagattgggattctggcaggagacatctactccttccgtgcccgaacagttgattcagagagaagctgttctgcagcaggagctccaggaactcctggccaaggatcggaagtacgggaaccaagaagctatgctgcgcgaaatgcgtaagaagcgcatgaatgatgcaaaagccaagagggagattaccaagcaaaaaagcgagcagaagagacaggacaaggctgactattggaaaaatttgcaacagcagcagatcatctatctaggagagaacgtgtccaaaggcttacacaagtcggactccgacaccgagaagcttttacagtttagtctgccggtgttcgaaaatgtcctggacttcagccagaagtcaggctttggcctttctgtgatcaagtaccttgcatttcacagatcggtgagcaagaaaagccattatcacgtgttcgagataccaaagaaatccgggggtaagaggaaaatctcagcacctaaaccccagttacggcacttccaacattggattcttgaaaacatactgaacaagatacctgtgggcgaggtcgttcacgggtttacgatcaaaaaaagtattgtcacgaacgccgagagccacctaaagaaggacatcattattaacatcgacctccaagattttttcccttccatcagttataaacgtgtgaaggggctgttttctaagctggggtactcagagcagctgagcaccatctttgccctggtatgcactcaggctcacaccgaggaagtgctgttggatgatgtaaagtacttcgtgcacaaaggtgaaaggtttttgccgcaaggaagtcccgcttccccagccatctccaatatcatcgcttacaagcttgacaaacggctgcagggcctggccgccaaatacggtttcacttacactcggtatgccgatgacctaaccttctcagccggacaagataacgaacagaacataaataagctcctgtactttgtgaagcaagtaatcaatgctgaagactttacaattcatcccgataagttgcacattatgcgacggaaacatcagcagaaggttaccggtatcgtcgtgaacgaaaaactcaacgtcgaaagaaagaagctgcgaaaattcagggcactcctccataatattgaggtaaacggatggcaaaatcagacctggggcaaagccttccatcttataaacgcggttgagggctacattaacttcgttaatatggtcaatccaagtaaagcactggtgtttaaagagaagctctctgctatcatcgcgaaacatggaaaaccaattgtggaggttcgcacaactattcccgagatagcagagacaattaaagtctccgaggataaggaggagattatagcgcctaaagaggaaaaaacagattggtggaatatcttctga

SEQ ID NO: 13206 - RNA, 1515 nt, unidentified
  source 1..1515: mol_type = other RNA; note = synthetic construct
atgtccgagcagctgacacggcagcagctctatgaccggatcaaaagctctagcaaggacagttacatactggaagagatgaagcgcctgggcttctggaagtcaaagggacagcctactctggaagagacactgatagagaaggaggcgagcttgcaacaggaactttcaactcttgtggccaaagaacggaaattccagaaccaggagctcctactgaaagaaattcataagcaacgcatgcagaaggcaaaggcaaaacgggaggaaactaaggagaaaagagcaaaagaaaaacaagagaaagctgcgcgctgggaggcccttaggacaaccgaaataatttatcttggcgagggggtttctaaaggcctgcagcctactgcctccaacgggaccctgttggcccagtacaacttgccgtactttgataccgtggcacaactggccgatgctatggggattagtacaaagatgctcacctactgggcgtaccacaggcctgtgtctcttaccagccactactatactttcgagattgccaaaaaaagcggtgggaagaggaagatcgcagcaccaaagaaaggactgaagaaactccagaactggatcttaactagtatcctgtctaaaatcgcccttcaggacgaagtccacggctttacgtccaaaagatcaatcgtgtcaaatgcccaaccacacatcggcaaggctgtagtggtgaatatcgatttgaaagacttctttccatccgttcactataagcgagtcaagggtttgttctcgactctaggatacagcgaacagatcgctagtatcctggcattattatgcacacaggcagagacaaagcaggtgactctggataacgtgttatactacgtgcagcagggtaatcgggtcctgccccagggatccccagcttctccagccatttccaacctcatcgcctacaagctcgacaaacgtatgaagggactggccaagcgatatggcttcacatacaccaggtatgcagacgatctcacattcagctcacatacggccaccgataaagatattgctgccttgctgcactttgctaagaagatttccaccagcgaggatttcactgtacatcctgacaaagtccatgtgatgaaacagtcgagacaacagaaggtgacgggagtagtggtgaatgaaaagcccaacattgaccgtaatagactcaggcaatttagagccctgctgcaccaaattaagaataaggggtggcaggacaaacagtggggcaaatctaacaatgtctatgcggccattgagggctatatcctattcgtccacatggttgctcccgagaaggctctcgtctttcgcaagcagctggaagatatagttgctatccatgggaccccaccccctacggaggtacaacccgtgccccagccggttaccgaagagaagacaatagttcctgagaataacagtaaggccaacgaagaggacacaaccaattggtggaccaccttttga

SEQ ID NO: 13207 - RNA, 1506 nt, unidentified
  source 1..1506: mol_type = other RNA; note = synthetic construct
atgtctgagcaactgaccaggcagcagttgtatgatcggatcaaggagtcctctaaagatgggtacattctggaagagatgaagcggcttggcttttggaagtcacaaggagagcctactctcgaggaaaccctgatccagcgcgaagctaacttgaacaaggaactgactgctctggttgccaaagagcggaaatttcagaaccaggaaatgttgctgaaagaaatacataagcagcgaatgcaaaaagcgaaagctaaacgtgaggagactaaacagaagagggagcagaagaagcaagatcaggccgctagatggcaggagattcaagagaaagagataatttacctgggagatgacgtgtccaagggactgcagcagacggagagcaacaaagatctgcttctgcagaacaatctacccttttttgagaacgtgctccacctggctgaatccattggtacgagcactaagaagctgacttattggtgctaccatcgcaaggtgtcaacgaacagccactactataccttcgaaattccaaagaagagcggtgggaaaagaaagatctcagcacccaaaaccggactcaagaacctgcaaaagtggttactggacaccctactcagcaaaattacaatggcagaggaagtccacggattcaccgccaataggagcatcgtttctaacgccaagtcccatatcgggaaggaagtggtgatcaatatcgaccttaaggatttcttccccagtatacatttcaagagagtgaaaggcctcttcaaggccctcgggtactctgagcagattgcctccatcttcgccctgatcagtactcaggcagaaaccaaagaggttttgctcgatggcgtcaaatattacgtccagtccggcaatagaatcttacctcagggctcccctgcttcgccggccattagcaatctgattgcctacaaacttgacaagcgcttaaaaggactagcacagcggtatggctttacctacacaagatatgcagacgacctgaccttcagtagcgaggagaataatgctaaaaattcggcagctcttctctactttgccaagaagatcattacctccgaagactttacagtccaccccgacaaaatacaccttatgaaaaagtctaggcaacaaaaagtgacagggatagttgtgaacgagaaaccaaacatcgaccgcaatcggctgaggcagtttcgagcgttgctgcataatattagttgcaatgggtggaaagatcagaagtggggcaaagccaagaacatctacaatgcgattgacggttatatcttgttcatccacatggtacagcccgaaaaggcaattgtattccgtaagaagttagaggaaatagtcgtgaagcacggcaagccaatcacaaaatgttcaactccgctcccagtggaaacacagaagaaggaagagacactctcagagaaagaaaattcatcttctcctagtaactggtggagcaacttttga

SEQ ID NO: 13208 - RNA, 1512 nt, unidentified
  source 1..1512: mol_type = other RNA; note = synthetic construct
atgagtaaggtgcttagccggcaggaaatctatgatcggataagaaactccagcaaagactactatattctggaagagatgaaacgtctggggttttggaaggaatcaagcgtgccaactgtggccgaatctttgattcagagagaggccttgcttaacaaagagctgcaggagctaattgctaaggacaagaagtatcaaaatcaggagctgatgctgcgtgaaatgcgaaagaaacggatgaaggaggcaaaggaaaagcgcgaagagacaaaacagaagaatgaacgagcacgcatcgagaggagtgagaaatggaagaaaattcatgcagcacagatcatttatctcggggacgattattctgcgggcctgaacaattcagcgccgattaacagcatcaatgccctgctgcccaccttctctgatgtccaggatctggccgccaagatgggcatcgatctctccactctaagattcctgtcattccaccgaaaagtctccaagaattgccattaccactcctacgagatcaaaaagaagagcggtggaaccagaaacatatccgtccccaaggggaagttgaaaaaggctcaacactgggtgctccagaacatccttaacaaaatcgaaatcaacgattcggcccacgggtttatcaaagggaagtctattgttaccaatgcccagcagcacgttaacaaggccgtgatcataaatctcgacctgaaggatttctttcctacgatccactataagcgcgtgaaggggctgtttattaagctgggctaccctgaacaactggcaattatattctccctcctctgtacccatgcccacacagaagaagtattcttggacggcatacgctactacgtacaaaatggcgaaaggttcctgcctcaaggatcgccagcctcacccgctatcagcaacttaatatgctacaagttagacaagaggttggatggcctcgcaaaaaaatacggagccgtctattctaggtatgccgatgacattacttttagtctcgacgacaatgagaacatcagcaagctgctcttttacgctcacaaaattatcgagggtgaggatttacagatcaacaaggctaaaacgcacattatgcgcaaaaatgctcagcagaaagtgacaggaatcgtggttaatcagcagccaaccgtagagcggaggattcttagaaaattccgggcacttttacataacattcttaagaatggctggcaggagcagaaatggggcaatggatctaatctgctgcatagcatcgagggatacattaattacatccatatggtgcacccaacaaaagctcaatcatatagggtgtccctaaaaactattttggagaagcatggtactcccgagatcaaggttaacatacccataaacatcgtccctcctccgcagatcgctagtaccgaggaagacccaaaagacagtgcgcccgaacaaaagaaagaggagacagactggtggaacctgttttga

SEQ ID NO: 13209 - RNA, 1512 nt, unidentified
  source 1..1512: mol_type = other RNA; note = synthetic construct
atggcactcacgaggcagcagatttacgatcgaattaagagctcttccaaagatagctatatcctagaagagatgaagagaattggcttttgggagaattccgagatcccgagcgttccagagcagctgatcgccgaagaaaccgcattacagaaaacactcaaccagcttttggctcaggacaaaaaatattcagaccaagaggccatgttgagagccatgaggaagcagcgaatgcaggagagcaaacagaaacgcgatatcaataaacagaaaagagctcagaagatcatagagaagtctgagaaatggcagcaggtcaatcaaaaacagatgatctacctgggcgagtcagtgtcaaaggggctgcagaacgagcagcaaaatccgatccttctatccaagttcaacctggattttttcgaaaactcttacgacttcagtgtccaaagtggattcgacttgcccacgcttaagtacctggcctacaatcggaaagtgtctaaaagcacccattatcatgtattcgagataccaaagaagagcggcggaacccgcaagattactgcacccaaaacaaaactgaaggccttccaactctggatcctcgaacacatccttaacaagatcgtcgtagcacctatggtgcacggattcgtgcagaataggagtattgtgtccaatgcgaaccagcacgtacagaagaacgtggttctgaacttggatttaaaggacttctttccttctattagctataaaagggtcaaaggactgtttcggatctttggatattcggaatccatggctacacttttagcgctggcatgcacaacttgtgacatcgaaaagattcaaattgacggcgagacatactacgtgcagaaggggcctagatacctgccacaagggtcccctgcttcacccgctattagcaacctgatcgcctataaactcgacaaacgtctccatggcctggcctctaaatatgggtttacatacactcgctacgctgacgatctgactttttccggcaacgaggaagccgcacaatacatgggtaaattcctctgctttgtgaagaagacgattaagagtgaggacttcgaagtgaacaatgataagacttccattatgaggccttcgaatcagcagaaggttacaggtatagtcgtcaataagaagttgaacatcgaccgcaagcggctgagacagtttcgtgctcttctccacaatattgatcagaacgggtggcagaaccaaacttggggtaaggctatacacctaataaacgccgtggaaggctatattcagttcgtgaagatggttgatgccgccaaaggtgccaagttccatcaaaccctgctgaatatcatcgccaaacacgggcggcccatcatcgagagtaaaattatgcaggtgtcaaaggctgcgatccccgaagcgccaatagttgagaagaccatatctaaagcaaccaccgacaagcagaccgattggtggaatctgttttga

SEQ ID NO: 13210 - RNA, 1464 nt, unidentified
  source 1..1464: mol_type = other RNA; note = synthetic construct
atgggtgaacgtgccacaagggagaacacccctggacgaagcgtgccagtggagaagcagcccttggaggaaatgaagaggcttggtttttgggagcagcctctgccagccttccctgaagagctcaaccagcgggaggatgacctggcccgggaactgaatgaactcttggccaaaactgggaaggagaataaagagaagggagaaatgttattgcgccagcgcgctagacagaaaaaactcgaaaaagctgcacggcgaaagttggcgcgacccgagacaatcccttatctgggcgaggaggtttctaccgggctcagagaaaccgagacgaacacggcactcctacaaaagtataatctccccgtttgtacttctttcagggaactcggagagcagatgaactgcgacttacctaccttgcagtatctgctttacaatcgaaaagttacctcttccacccattactacacattcaagtttcccaagaaaagcggtgaaatgagaacaatctccgctcccaaacagaagctgaagaggctgcagtactgggtaacggagaacatcctgaatagactgccagtctgtgatcaggtacacgggtttgccaaagaaaggagcatattgactaatgcctccccgcaccttggcaaagacattgtggtgaacctggacctgaaggactttttcccctcaatcagctacaaaagggtgaagggcctatttagaaaattcggctattctgaacagcttagtatcctgttggcgctgatctgcacagaagcccaaacccggcaagtcgagctcaatggccaaacttggtacgtgcagacgaatcgccggagtcttccacagggctcacctgctagtcctgcgatttccaatctgattgcatataccctggacaagagattagaaggagttgccaagaagtacaactttacttatactcgctatgcagatgatctgacattctcagcttataaagagcaggaaaggaatatcacaaagcttctctactttattcgcaaggtcataagagaggagcggttcacagtacatcctgaaaaaacccagatcatgaggaagaacaggcaacagcgtgtcaccggcattgtggtcaaccagcggcccaacatagatcgtcagcagctccggcgatttagagccctgttacatcatattgaggtgaacggctggcagcaacaacaatggggacacccatccgggtacctgccccacagcatcgaaggctacattaactttattcgcatggtgcacccgcataaggccaaaaagttcgaggagcagctgatgaagatcgtgttcaagcacggatacccggcaggtccagcttccagtcccgagacacgcatagataagtcaggggaaaaaaaagagccagacagccctagcacttcgtctttcgaggtggactggtgggggctaccactgaccacttga

SEQ ID NO: 13211 - RNA, 1500 nt, unidentified
  source 1..1500: mol_type = other RNA; note = synthetic construct
atggccgagcagctaaccagacagcaattgtatgacaggattagagaaacctcgaaggacgcttatatccttgaggagatgaaacggctgggattttgggagaactctagccagcctactttgtctgaggctctcatacagcgcgaggcaactttgcagaaggagctgaatgagttgttggataagcagaggaagtacaactctagggaacagctgcttcgagacatgaggaaacagaaactgaaactttccaaagaaaagcaggcggagacgaagaaacgccaggaagagaagcgccaactgaaggctcagaagtgggtggaaagcaaacagaaagagatagtctacctcggggagtcagtatccggtggacttaatgagaagaccagcaatcaggcattgcttgccaagtatcagctttccgatttcgcctccgtgctcggcctggctgaagccatgaaggtgtcgctggcccagctgcgtttcttggcttttcaccgggcagtaagtaagacctctcactatcacttttacagtgtacctaagaaaagcggaggcaaaagactgatttctgctcccaaaccattactcaagaagtgccagcactggatcctggaaagcattctgtacaagatcaccccctctgaacatgttcacggtttcgtccctaaaaaaagtatcgtgactaacgcaaaaccccatttacagaaggacatcgtggtcaatctcgacctgaaagacttctttcccagcatttcctacaagcgggtgaaagggctatttgttaacctcggctattcagagcagctggcgacagtgctggccctgattagtacacactacgaaatggataaggtgaacgtcgatggagacgtttactatgtgcaaaaaggggagagagttttacctcagggctcaccagccagcccagccattacaaccctcatcgcctatacaatggatcgacggctgcaaggcctggcgaagaagcttgggttcacttacactcgatacgcagatgatctcaccttttccacagatgctagcaacgaaggcaatatagcaaccctcttatacttcaccaaacaagtagtggaagacgaaggtttcacggtccatccagacaagactcatgtgatgcgtaaagggagtcagcagaaagtgaccggggtcgtggtgaatgacaagctaggcgttgacaggacgattctccgcaaattccgggcctttctgcatcaagtttcccagttcggctggggaaagaataagtggggtaacggcgataacccgagacaatcagctctggctttcgccagctttgtcatgatggtggacaaggaaaagggaactaagctgatgaaccagatcaaggccatcgcagactcctctgtggtcaccgagaaaaagaaaacagtctcacaagagccccagaaacaagtgccggaggagaagacaaatactagtacacctgcctcacaggattggtgggatatcttttga

SEQ ID NO: 13212 - RNA, 1599 nt, unidentified
  source 1..1599: mol_type = other RNA; note = synthetic construct
atgagcatgacgcggcaggagctgtacgatcggattcgaacaactagcaaggaagcatatatactcgaggagatgaagcgcctcggcttttggggcgatagtgaaaagcccactctcgcggaggagctgataaacaaacaagcccgtttgcagaaagagctctccgaactgaatcagaaacagcgccagtacaactcacgtgaggcaatgcttaaggaagttagacttgagagaatgaaggccagcaaagaaaagcaaaaggaaactaaggctagaaatgaagagaaagtaagacttaaagctgaaaagtgggctgagacgcagaagactaatatcatttatctaggtcaggaggtgagcgagggcctgaacaataccacttctgataaggagaaactggaaaaactgaagctaccttatttcgagaacatcgtggaattctctgagaagattaacaagccaattagtgaactcaggtttctcgccttccaacggagcgtctcgaaggtcaaccagtaccataactactacgttcctaaaaagtccggaggtaagaggttaatttccgcgcccaagccaaaattgaaacacacacagaactggatcaagacaaacgtcttggacaaaatcgaaatcaatgagaacgtccacgggttcgtgaaagaacggtctattctgacgaacgcagagccacaccaaaataaaaatctggtgatctctttagacctgaaagattttttcccgtctatcagttacaaacgcgtgaaagggctgttcctgaagtttggatattccgaacaacttagcaccttgttcggccttctgaccacacacaatgagactgataagctgaatgtcgatggagagatatattacgcccaaaaagtggataaagagacaggaaagactaataggtttttacctcagggctcaccggcctccccagctataaccaccctgatcgcctacaagatggacaaacggctcgagggactggccaaaaagatgggtttcacgtatacccgctatgcagatgacttgacctttagcagtgacctggacctgaaaaaggacaccaaagctacaaataagatcatcggaagcctgctctactttgtgaagaaggtggttactagtgagggtttcgaaatccatcctgacaagactcatattatgaggaaggggaaccagcagaaggtaaccgggatcatcgtgaaccaaaacaccgaaaataagctaggcattgacagacagactttacgaaagtttagggccttcctccaccagacagctaaaacagggtggaaagtggacaaaaatgcaaaggacaaaaagtggggcattcatcccgatcccaagcaggccgcccttggcttcgcttcatttattaagatggttgatgcggagaaaggggagaagttcatccagaaaatcaagtccatacccaccgcagaggactacctccagaccgacgatacaacattggtatcccagaagaccgaggagaagaccctgaaacaggtggaaacaaagtcaaaagagtcagaacaggaaattgaaaaacaatcggatgaatctgactggtgggacattttttga

SEQ ID NO: 13213 - RNA, 1536 nt, unidentified
  source 1..1536: mol_type = other RNA; note = synthetic construct
atgagtcagcacccgaccaggcaacagctttatgatagaattagggcctcctccaaagacagcgtgatcttggctgaaatgaaacggttaggcttctgggaagatagccctcagcccactctccccgagactcttatcgcccgggaagccacactccagaaggagctcaacgatctccttacgacagagaggagattccagaactcagagcaggtcctggtagacatgcggaaagaccgcatgcgcaagagcaaagaaaagcaagcagagaacaaggctcgaagactcgaggagaggcgacagaaggcagagcagtggcagcagacgaagacccaggatattatctacctcggagagggtgtctctgccggcttacaggcagcgccctcagacctggagcgtctacaaagcttgggactgccaatattcgagaatgtattggacttagcccagcagatggggatccctcttcctaagctgagatttctggccttcgagaggaaaatagctaaggtgtgtcactacagctactttcagctgccgaagaaatcaggtggactgcggagaattgcggcaccaaagccactgctgaaacaagctcagcagtggattatgacacacatcctctatcagatccccaataaggattgcgtacatggcttcgtgcccgagcgctctatactgagcaacgcacagccccatctgggccaggaagtggttattaatcttgacctgaaggacttcttcccatcaatcagttatgcccgcgtgaaaggactgttcgtgaaactgggatatagtgagcagttggccactatccttgcactactgtgcacacatgctgaaaccaaggccgttaccgtggatggtgagcagtttttcgtgcaggaaggcgaacggcggcttgtccaaggatcccccgcttctcccgcgctctctaatctgatcgcccacaagttagataagcgactggaggggctggcggccaaatatgggtttacatacacacgctacgcagatgacttgactttttccgcccctaaagctgacgagcctgctattagcgccctgcttgcttatgtaaagcgcgtggtcagggaggaaggcttcgccctccacccggacaaaactcacctaatgaggaaaggggcacaacacaaagtcaccggggtcgtggttaatgaaaagccttcggtcgacagaaaacagttgcacaagtttagagccctcctccaccaaattgatcaaaccggctgggagggcaagcagtgggggaacacgccaaacatcgttcattcggtgcaaggttacgccaattttgttgcaatggtgaaccccgaaaaaggccagaagtttgtggcgatggtgaaggcactgatagctaaacatcccgcccctccactggttttgcgttacaccccggccccagaacaaccccctgctgatgaaactcattccacccagccagccgcaccaacatctccagctagtcctcagaagcctgaatccgactggtgggacgtgctggatctatga

SEQ ID NO: 13214 - RNA, 1515 nt, unidentified
  source 1..1515: mol_type = other RNA; note = synthetic construct
atgagcactcagcttaccaggcaacagctttatgaccggatccgcacaacctccaaagatcagttcgtactcgaagaaatgcagcgcctagggttctgggagaagaaagagcaacctacactgtcagaaacattgatcaagcgagaagctgatctgcagaaagagctgaatgagctgctgaccaagcagaacaaatacaataaacgcgaggccatgcttctcgaaatgagaaaggccaagatgaaggcctctaaagaaaagcaggcggctacgaaactgcggaatgagcagaagaggaaagacaaagccaagaaatggcaggaatcacaacagaacgacatagtctatttaggcgagggagtgtctgcagccctgatccaaaaggagaacaatctggaaaacttgcagaaatacgaattgcctctctttgagaatatgcttcagctggctgaggctatgcagatcccgttatcaaaactgcgctttctggcttaccaccggaaggtgagcaaaatcacacactacaatcacttcacaattcccaagaagtctggagggctcaggaccatatcagcaccaatgccagatctgaagaaagttcagcagtggatccttgagcacatcctgtacaagattaagccaaaggctcaagttcatgggtttgtccccgagaggtcgatcttaagcaacgccacccctcacatcggtaaggatatcgtgattaacctcgacttaaaagatttcttcccctccatctcttataagagggtcaaaggcctgttcgtcaaactcggctattccgagcaaatagcactcacgttggcacttttgtgcacatatcacgagactgaaaagttgaatgtggataacgagatctactacctacataaaggagagcggtatctgccacaaggcagtcctgctagtccggctataacaaccctcatcgctcacaagatggacagcagactgcagggcttggccaccaagtatggtttcacctatactcgatacgcagacgacctgactttttccgccaataaagacgccgaggaaaacatcaataagatgctgcttttcgtgaagaaagttattgaaagtgaggatttcgaactacatcccgacaaaactaaaattatgagaaagggaagccagcagaaggtgaccggaattgtagtgaaccagaaacccaatgtagatcgtcagcagtttcgtaaattcagagccctgctccatcagatcgagcagacagggtgggagaacaagaaatggggcaacaaggacgcccatattgtgtacgcagttaagggttttgccgaatttgtgcacatgattaatcccacaaagggggagcagctcaagaagaagattgcggagatactgactaaataccctgcaaccgtgcctgccaagccccaaaaagaggtcgcgtcccagacgaaggaggaaaccccaaacattcaaactaatactaacattcagccaaccgaatggtgggatatttttgaaaactga

SEQ ID NO: 13215 - RNA, 1380 nt, unidentified
  source 1..1380: mol_type = other RNA; note = synthetic construct
atggccaatcagcccagcagagaggacatcagaaagagggtcgctgaatctactaaggacgccgtaatactggaagagatgaaacgtttcggcttttggaaagaggagttttcacccgaactcgaggatatccttcaaaaacaaaaagaaaccgagactgagctgaacaccctcgtgcgaaagcagacgcgttacaggaatccagaaactctgcggaaagagatgcttaaagaacgtatgaaggcgagcaaacaaaaacggcaggaggccaaggagcgcaaagaacaaaagcggctcgctcgcgcagaaacctggaaaaagaggaaggagacagaggtactgtacctaggcgaagacgtgagttccaggctgtccgagacagaacccaacctggaattccttgccaagtggaacctgcccaatattgagaatcctttggctttagcaaacgccctttcattagagctgtcccagctccggttcttgacttacaacagaaaagtaagtttggtgaaccattataagcgcttctacataccaaaaaagatggggggcaagagacttatcagcgctcccatgccgcttattaaatcagcacaactgtggatactcaacaatattttgtatctgatcccacacaccgaccaggcccatggatttattcctcagcgctcaatcgtttctaatgcagcacagcacgtgggtaaggagttagtgctgaacctagatttgaaggacttctttcctagcatcagcttctctagagttaaaggactgtttcagagctttggctatagcggacagatctccacacttctggctctcttgtgcacagaagccgaggttgaacaggttgctatagacggcaagaaatattttgtgtccattggtgaaaggaccctgcctcaaggatcgccttgctcaccagccatttccaacttaattgcctacaagctcgataggcgcctacagggaatagcgaataagtggggcttcgtgtatacgagatacgcagacgatctctcttttagttgtgggtctgacaacctcgataactttcagcagctcctgtggagtgtccaggaggtcgtgaagtccgaaggctttactgtccatcccgaaaaaatccacatcatgcgcaaagggagccgacaggaggtcaccgggctgatcgtgaatagacagattgggatcgagcgaaaagagctgcacaggttccgggccttgctgcagcagattgaaaagaacggtccagctggtaagacatggaacggcaatccgaatctggagaattctatgcgggggtacgcgagtttcgtgatgatggtgaagcctgagctgggaattcgattcatgaagaagatcgattcgatcttctga

SEQ ID NO: 13216 - RNA, 1521 nt, unidentified
  source 1..1521: mol_type = other RNA; note = synthetic construct
atgacacgccaagaaatctacaatcgcatccaggagctgggcagtaaacagtcctacatcgctgccgagatgactcgcctaggcttctggaaccaaggtggagagcccaccattccagctgaactgacccagcaggccaccgctctgcagactgaactgaatcagttgatggaacggcaaaggaggtatcagagtagacaggcaatgctgcaggaaatgcgtcaagctaggatggctgcagccaaacagagacgattggagacaaaggtacgtagggaagcggcacgcttagcaagggcagaaacttggaaaaacaaactcgctactactgtgccttatctgggtgatgaggtatctgccggactcaaaaataccaccagcgaccctgccagactcgcctactttgggctcccacatttcgacagtcctcttgccctggcacaggctatgagcctccctcttagcgagctgagatttttagcctacaatcgggccgtttccactgtaagccattataagagattctatctggcgaagaaatctggaggaaagcgtctgatctctgcccccatgcccagactcaagaaggctcagctgtgggttctggagcatattctgcacaaagttcaaccgactgagttcgcgcacggttttgtgaccgatcgaagcattctgacaaacgccacacctcacgtggggcaagacgtggtgatcaacgtggatctcaagaacttctttcccaccataggatatccccgagttaaagggctactcacaaagcttgggtactccgaggccatcgccacaatacttgctctactgtgcacagagccagacaccgaggctgtgcagatggatggcaagacatatcacgtcggtaatggggagaggacgttgccacagggagcccctacgtctccagctatcacgaacctgctagcctaccggttagaccggcgcctccaaggcatggcagcgagattcggatacgcctataccagatacgcagacgaccttaccttcagtgctaccggcgcagccgcaggtaaggctaaccaggtcttgtgggccgtggaacagatagtgcaatcagaaggctttactgtccatccagataaggtcactgtaatgcggaaaggcgatcagcagagggtgacagggatcgtcgtgaaccagaaaccgtcgatcgatcgcgcgaccttgaggcagtttcgagcgttgcttcaccagattgggcagtcgggctgggagtccaaaacctggggcaaccccaatccgacggcagatatccaaaatgtcgtcatagggtacgctaatttcgtgatgatggtgaagcctgacttaggacggcagctgcgggcaacaattgctggcctcattagcaagcctccgaccagctcctccgcctcatctatgcccactattgccgatgacctgtctcccgtgtcagcccccattaccacaccactggttcctccaacggcacccccagcctcaaaggactggtgggacgttctgtga

SEQ ID NO: 13217 - RNA, 1500 nt, unidentified
  source 1..1500: mol_type = other RNA; note = synthetic construct
atgacaagacaggagatacaaaagcgcatcgaagagctgggtagcaaacagcagtttatcattgccgagatgactcgactggggttctggacccagcatggagaacccatcccagcagagctcgttgcgcaggatgccgccctccaaaaggaactttcccagctgctggaccgccagagacggtttcagtccagggatgccatgctgaaggagatgagacaagcccggatggctgccgctaaacagcggaggatcgaaacaaaacagcggcgagaagctgcgcgtaaagcacgcgcggacgcttggcaggcaactcttgcaacagatgtaccctacttaggtgaaggcacgcctgccgcactggccaatcacacagctgacccagaccggttgagacaggtcggtctgccccagtttgaaagcccattggccttggctagagcgatgggtctaagcctcagcgagcttaggttccttgcctataatcgggccgtttctacggtgtcacactataagcgattccacttaattaagaagtccggtgggaaacgcctgatttcagcacccatgccccgcctaaagaaggcccagctgtgggtactagagaatatacttagcaaggtccaaccaaccgaacaggcacacgggttcagggccgaacgcagcatactgaccaacgctcaacctcatgtgggaaaagatgtggtgatcaacatagatctcaagaacttctttccaaccgtgtcttatgggcgagtgaagggccttctggcaaaactcggctatagtgaggctctggccactgtcctcgccctgctttgcaccgagcccgatacacaggctctccaggtagacggaaaaacatactatgttggaaacggatccagatacttaccacaaggcgcccctacctcacccgcactgactaatttgctcgcctaccgtctcgacaggcgtctgaacgggctggcgcaagcatttgggtacgtgtatacccgatacgccgacgatctcacgttctctgccagtggcagcggggctggcaaagcgaaccaactgatttgggccgttgaacagatcgtgcagggagagggtttcgtcgttcaccctgataaaatctccgtgaggagaaagggccagcagcagagagtgaccggaatcgtcgtgaaccagaaagccagtatcgacagggctaccttgcggaggttccgcgctctgctgcatcagattggccagaccggatgggagggcaagacatgggggaatccggcgccggaggcagatatccagcaggtggttttaggctacgcacattttgtgcaaatggtcaagccagagttgggccggagtctggtggcctctattagggcactaattcagtcacgccctgacgcagccttggctcaaccggtggaacctgtgccagctactgtctcttcgactgctactaattccgctcctgtcgccagacccgtcaaggagtggtgggacgtactgtga

SEQ ID NO: 13218 - RNA, 1050 nt, unidentified
  source 1..1050: mol_type = other RNA; note = synthetic construct
catcgaccagtaagcactgtgaatcactacaagtcattctacctgccaaagaaaagtggggggaaaagattgatatcagctcccatgcctcgtctgaagaaagcgcagttatggatcctggagcacctgctgcagaagatcacccccaccgaacaggcccacggtttcacgaccggacgctcgattgtgtccaacgcccaaccccatgtggggcaggaggtggtcataaacgtggatctcaaggatttctttcctaccatctccttcccgagggtcaaggggctgttcatggcccttggatttagtgagcaactcgcaactctgctggccctcctgtgcaccgagttgcctacctatgcagtgtctttggacggcagaacatactatgtggccacagatgagaggcggttaccccagggagctcctacgtctcccgctatttcaaatctgatcgcgtaccgccttgacaggaggctgcagggaatggccacccgttttgggtatgcatatacaaggtacgcagacgatcttactttttcagcaagcgatactgctgtgaaacaagtcgagcaggtgttgtggagcgttaaccagattgtagagagtgagggattcactgtccaccccgacaagatctccgttatgcggaaaggcagccagcagcgcgtaacaggtgtggttgtgaatgacaaaccgggagttgaccgggccacacttagacgatttagagccctcctgcaccaaatctctctcacagggtgggctggcaagtcttggggtggcaccgccactaatcatcaagctgatctgcgcaacgtggtcatgggctacgccaattttgtggccatggtcaagcctgaacagggccaggcgctccgggaacaaattaacaagctcattggcggtacgaacttatccgtgaatccattgctgagcgaacagccagctcccgataacgcaccagtcgtaacaggcgaatccactctaggaaccctaagtcagaaaccacctatcctgagccagaataaagactggtgggacgttctttga

SEQ ID NO: 13219 - RNA, 1488 nt, unidentified
  source 1..1488: mol_type = other RNA; note = synthetic construct
atgacgaggcaagagatatacgacagaatccggggcctcggatccaaggattccttcgtcttggccgagatgaaacgcctcggattctgggaacccaccaccgacatgcccggactgcccgaacagctcattgagagacaaggtcagctgcagcgcgagctaaatgagctcctggagaaacagcgtaggtatgaaaacaggaaagctatgttggcagagatgcgcaagacccgcatggcagagtcgaagcggaagcaacaagaaactaagcagagaaatgagcagaaacgccaagagcgagccgctcagtggaaaaggcagcaagaacagacgattgtgtatttgggcgagaatgtttctggaggtctgcagagcgggaccgccaacaatgatcagctgcgacgatttggattgcctgatttcgattctcccttggccctggctcaggcagtcggagttaccctgtcccggcttagattcctcgcctatgacaggccggtgagtaccgtctcacattataagcgattctacctgctgaaaaagtcaggaggcaagcggctgatttcagcacctatgccttaccttaagacagtgcagtattggatcctggaacacatacttcgcaagatccagcctactgagcacgctcatgggtttacaatagatcggtctatcgttacaaatgcacagccccatactggtaaggacgtggtggtgaacctcgatctaaagaactttttcccttccattagctaccgaagagtaaagggccttttcgtcatgatcggttacgccgaaacaatcgccactatcctggcgcttctatgcactgagccagattctgatatgattgagttggatggcaaaacctactacgtggccaaaggaagcagagtgttaccccagggcgctccaacctcaccagcgttgacaaacatgattgcctaccggcttgaccacagactgcgcggtgtcgccaacaagtttggatacatttatacccgttacgctgatgacctcactttcagcgcatccgacgaagcggcagggcgtgtaggacagctcctctggtctatcaggcaggtgatcgatggggaaggctttgtcctgcaccccgacaaattacaagttatgagaaaggggagtcagcagcgggtaactggcctagtggttaatgaccagctgggtattgacaggaccactctgagaaagtttagggccctcctgcaccagatcgaacaaagcggctggcaagggaaaacatggggcaaaggccaaatacagaacaccgtgctgggctatgctaactttgtcgccatggtgaagccggagcaggggaaacggcttgttgagacggtaaagaggctgatgctgccagctgtggaaagcgcgggggaattaccgcgccaggagccaagtacaaatgggcagatcaatcagcctccaaaagacacaaacctgagtacagactggtgggacgtgttatga

SEQ ID NO: 13220 - RNA, 1566 nt, unidentified
  source 1..1566: mol_type = other RNA; note = synthetic construct
atgtctctgacccgtcagcagctatacgatcagattagagcatcatccaaggaggagtacattcttgaagaaatgactagacttgggttttggccaaacaatgtggggcagcctgcacccgcggtgacacttattagaaaggagggcgaattaaaccggcagctgaatgagctgctggccgaaaagcagaagtatcgaaataagagaaagatgcttgaagacatgagaaaggatagaatggcaaaagccaaactcaaaagggctgaaactaaaaaaaggcgggaagaggagcgggtaaagagggccgctgagtgggcagctaccaagaatctccagattgtttacctgggggaggacgtatcagccggcctgaacaaagtgacccccgataccgcccaactcacccgctttggcctgccagtgctgagcgatgcggtagccctggcaaacgccatgaacatcaccatcggcaagctgcggtatttaagcttctccagaaagatcggccatcatacccactaccagcgatttcaggtgcccaagaagtccgggggtacaagggttataagcgcccctatgccacaactcaaagccgcacaacactggatcctggagaacatactctataagatcaagaacaacgatgccgctcacggtttcgtgccgggcaagtccatcgtcacaaatgcgactccgcacatcgggcaggacatcgtcattaatctcgaccttaaagacttctttccctcagtggcctacaaacgtgtgaaaggcctcttctgcaaactaggatacgccgaacaagtggccaccatcctgggactgatttgcacggagcccgaagtggatgaagttttgctggacggtcgcaagtactatgttgcgaaaacagaaaggcatctgccccaaggagctcccactagtccagcaatcaccaatcttatctgttacaagttggatcagcggtttgcaggcctggccaacaagtatggatatgcctatacgcgttacgctgacgatatgacattctctgccaagggtgacgcagcagacaaggctggccagttgctgcgggctatcaagatgttcgtcaaagaggagggcttcacactgcaccctgagaagttgaaagtcatgaggcgaggggacaagcaggaggtcactggaattgtggtgaatgagaaactgtcattggaccgcacaacacttcgcaagtttcgcgcgttattgcaccagatcggacataccggactatccggcaaatcttgggggaaggggaaaaacattatttcgagcatggaaggatatgctaatttcgtgtacatggttaagcccgatctcggagccaaactgaaaagcagcttgacggccctcctccaacgcgaggatataaaagctgaggccaggagtatttgggcaggcgagcaggctcctacaaccccaagtgtcgcaggtgtccatataaacactactccgcaggctacgcctgctgccgaagttccacctgtgaatccctctactgacaaacctgccgctcctgacaagccatggtgggatgtattatga

SEQ ID NO: 13221 - RNA, 1593 nt, unidentified
  source 1..1593: mol_type = other RNA; note = synthetic construct
atgtcccttactcgacagcagctgtatgatcagattagagcctcgtcaaaagaggaatatatcctagaggaaatgacacggcttgggttttggcccaagtctgtgggccagccaacaccagcagtgactttgatccggaaagaaggggaactgcgacgcagccttaacgaattgatagccgaaaaacagcgctacagaaataaacgcgcaatgctcgaagatatgcgaaaagctcggatggccaaggcaaagcagaagcgcgccgaaacaaagaagcgtcgcgaggaggagagggtaaaaagagccgcggagtgggccgccgagaagaatctgcatatcgtgtatctgggagagggcgtgtcagccgggctcaataaggtaaatcctgatacggcccagctggagaaatttgggctcccagtctgggctgacgctattgcgctcgccaacgccatgggaatcactatcggtaaattacgttacctaagcttcaaccggaaggtcggccaccacactcactatcagcgcttccagatccccaagaagtctggcggcaccagagttatctctgctcctatgcctcagctgaaggccgcacaacactggatactagagaacatcctgtacaagataaagaacaacgaggcagctcacgggtttgtgcctggcaaaagcattgtgacaaatgccgcgccccatattggccaagacatcgtgattaatattgatttgagggacttcttcccatctattgaatacaaacgcgtgaaggggcttttttgtaaactgggttacgccgagcaggtggccacaattctggctttaatttgcacggagcctgaagtggacgagctgctgctggacggcaggaaatattacgttacaaagactgcacggcatttgccccagggggctccaaccagtcctgcgattacaaaccttatctgctataaactggacaggaggttcgccggactggccacgaagtacggatatgcatataccagatacgctgacgatatgacattctccgccaagggacctgcagcaggcaaagcagggcaactgctgagggctgtgaagatgtttgtcaaagaggaaggatttactatacatcccgacaagctcaagatcatgagaaggggggatcggcgagaggtaaccggtatcgtcgttaatgagaaactgtcattagatcgtacgaccctccggaagttcagggcattacttcaccaagtcggacaaactggcctcgcgaacaaaacctggggcaagggtaagaacattatatcctccatggaaggttacgccaacttcgtgtacatggttaaaccggagttgggggcgaaactcaaagctacactcgcagctctgctgcagcgggcagacattaaggcagaggctagaagtatctggacaggagaagccctcccgcagaaggagtccaacaccgccatcagcggaaacaccgaaaccatcactacccccgttagcaccgctaccaatggcaatggagccgccagtgccgctagaggtaataccggcactgataagcccgctgcggctgataaaccatggtgggacgtcttgtga

SEQ ID NO: 13222 - RNA, 1530 nt, unidentified
  source 1..1530: mol_type = other RNA; note = synthetic construct
atgagcttaaccaggcaactactctacgacagaatcagggctagcagtaaggaagaacttatcctccaggaaatgactagattagggttctgggcggaaaacctcgcccaacccagtcctgcggcctccttaattcagcaagagacagaagtccgccggcaactgaacgacctgattaacgaacgacagaagtatcgcaacaaacggatgatgttggaggacatgagaaaagcccggatggctaaagcaaagctgaagagagaggagacaaaacagcggagggaaacggctcgaaaagagagggcagccgcctgggctattaccaaagaccagcagatcgtttatcttggcgaggaggtttccgcggggctgaacaaggtagtgcccgatctcgtgcagctgcagaagttcggtctgcctgtgtttgcagacgctaatgctctggccaccgcaatgggaatcactcttggtaagctacgatacctgtcatttaacagaaaggtgggccatcacacccactaccagaggttccagatcccaaaaaagagcggcggcagccgtacaatttcggccccaatgccacagctaaaggccgcccagcactggatcttggagaatatcctctacaagattaaaaacgatgtcgcggctcacggtttcgtgcccggaaagtctattgttactaacgctgctccccatacagggcaggacatcgtgattaacattgatttgcgcgacttctttccaagcatcgcctacaagcgagtgaaaggcctgttttgcaaactgggttatgcagagcaggtcgcaactatacttgccctgatatgtaccgagcccgaggttgatgaaattctgctcgatggacgtaaatattacgtagccaagaccgcaaggcatttgcctcagggagctcccacctcccccgcaataacaaatctgatctgcttcaagctcgatcgccgctttaccggacttgcagaaaagtacggctatgcatatacacggtacgccgacgacatgactttttccgccaaagggccagctgcagacaaggccggccaactcctgagagctgtgaaaatgttcgtgaaagaggaagggttcaccatccaccctgataagctgaaagtgatgcgcaaaggtgataaacacgaggtgaccggaatagtagtcaatgaaaaattgtcactcgaccggactacgctgagaaagtttagggcgctgttacatcaggtcgagaagacagggctcgccaataagtcatgggggaagggcaagaatatcatttcttctatggagggctatgcgaatttcgtctacatggttaagccggaattgggagccaaactgaaagccactttggccgccctgctgcaacggcctgacatcaagagtgaggctcgtgggctttggacgggcgaggtcaaagagaagaaggtgtcagatacaccggtagctccaaccgcccccgtgaatccgcctcctagttccgcaagctctgaaaagccatggtgggatgtgctttga

SEQ ID NO: 13223 - RNA, 1608 nt, unidentified
  source 1..1608: mol_type = other RNA; note = synthetic construct
atggctgaatccctgacccgacagcaactgtatgacagaattcgggccagctccaaggaggagttcatccttgaagaaatgatcagactcggcttttgggcgaggaacaccgcacagccctctcccagtgagacacttatcaggcgggagggagaactgagacgggaactgaatgatttattggccgaaaagcagcgttaccagaataaagtcaagatgctggcagatatgcgcaaagatcgtatggccaaatccaaactgaaaatcgcagagacaaagaagaggagggaagaggaacggaaagctcgggccgaagcgtgggcagttgccaaggaccaacagattctgtacttgggcgaggaagttagcgccgggctgaacaaggtgaaccctgacaccgcgcagctcgcaaagtttaacctccccgtatttgccgacgccaccgctctggccaatgccatgggaattaccttagggaagttgagatacctagcctttaatcgaaaagtgggtcaccatacacattatcagcgtttccaggtgcccaagaaatctggtggaaccagggtgatctcagctcccatgccgcaactgaaggctgcccaacactggattctcgagcacatcttatacaaagtctcccattccaacgctgcccacggattcgtacctgggaagagcatcgtgactaatgctgcaccacacgttgggcaggatatagtcataaacatcgacctgcgcgacttcttcccctcaatagcttacaagcgcgtcaagggtctgttctgcaaactgggctatgctgagcaggtggccacaatcttagccctgatttgtacagaaccagaggtcgacgaggtactgctagacggaagaaagtactatgtcgcaaagaccgctcgccatctcccacaaggtgcgcctacgtcaccggccctgacgaaccttatttgcttcaagttggaccggcgctttgccggtctggccgagaagtatgggtatgcatacacccgatacgcggatgatatgaccttctccgcaaagggagctgccgctgacaaagccggccagttgctcagggcagttaagatgtttgtgaaggaagaggggttcactatccatcctgacaagctgcaggtcatgaggaaaggcgacagacatacggtgacaggcatcgtggtgaatgaaaaactgagcatcgatagaaccacactcagaaaatttcgcgctttgctccacaatatcgagaaaactgggctctcgggaaaacgatggggcaaaggcaagaacattatttctagtatcgaagggtacgccaattttgtgtatatggtgaagccagagtggggcgcaaggcttaaagagaagcttgcggcacttctacagcggcctgatattaaggctgaggctcacgcaatttggaccggcaactctagtcagcccgtaactactgaggccatatcagcgtcttcgcacccagccggctacactagcagtgatacaacaactcctgcagccaccaccgatagcagcactacaattcctggacgcataacgcctccagagccaccggctgccactgataaaccctggtgggacgttgtgtga

SEQ ID NO: 13224 - RNA, 1524 nt, unidentified
  source 1..1524: mol_type = other RNA; note = synthetic construct
atgcctgagggactaactcggcagcagctgtacgataggatcagggaaacttccaaggaggaatatatcctcgaggagatggttcggctcgggttttggtccagggacaccgacaaacccagtatccccgaagcgcttatcaaacaggaaggagagctcaatcggcagttgaaccagttgctgtctgagcgtagtaaatatcgcgacaaaaaacgcctgctggtggagatgcgcaaacaaagaatggcccaagccaaagctaagcgtgcggaaaccaagaagcggaatgagcagaagcgaatagagcgggcggctgcctgggctgaaaagaagcagcaagacattatctacctcggcgagaacgtctctgcgggtctgaacaagaaccaatctgataccgcccagctgcagaaatacaacttacctgtatggcacagcgctacagatctggcagccgccatgcaactcccactcggaaagcttagattcctcgcttttaatcgctcagttgctcaccagacccattatcagagatttgccatcccgaaaaagagcggcggtacgcggattatctcggcacccatgccacagctgaaggctgctcagcactggatattagagaacgtactgtacaaggttagcaactctgggagcgctaacggattcgttccaggcaagtcaattgtgaccaatgccatacctcacgtcggcaaggacctggtgattaatatcgacctaaaagatttcttccccagcgtcgcctataatcgcgtgaagggccttttctgtaaattggggtacagtgaacaggtcgccactatactgggactgatttgcacagagcccgaggtggacgaagtgctgttggatggccgaaagtactttgtggccaaaacagcaagggtgttgccgcagggggcaccaaccagtcctgcaattacaaaccttatctgctacaagatggaccgtaggttcgaagggctgtcagcgaagtatggttacgcttatactagatatgctgacgacatgacctttagcgcgaaaggcgaggctgctgcaaaggccggtcaactgctctgggccgtaaaaaaagtggtggccgaggaagggttcgtcctgcatcctgataagctcaaggtgatgaggaagggcgatcgacatgaggtcacgggcatcgtggttaatcagaaactttccatcgacagaactactttgagaaaatttagggccctactgcaccaggtggaactgacagggctggccggtaaatcatggggaaagggaaacattattgcctccatggagggatacgccaatttcgtgatgatggttaaacccgagcagggcagagcattaaagaccaagttagcagcaatcctttcccgcgccgatattaaagctgaagcccaggccatgtggaagaatgaaccacccgccgaacaacccgcaatgcctcccgcaaaccctgtagctccgcctgcaccagagaaaaagacagatgatccatggtggaaggtggtctga

SEQ ID NO: 13225 - RNA, 1539 nt, unidentified
  source 1..1539: mol_type = other RNA; note = synthetic construct
atgcctgagggactcactcggcagcagctgtatgatcggatacgacagagctctaaggaggagttcattctggaggagatgacacgactgggcttctgggcacgtgatgtcaacaagccatcagtgccggagactcttatccagcaggaaggcggcctgcagaggcaactcaacgaattactccaggagaaggcaaagtaccgcaacaagcagagactgttgacagacatgcgcaaagagaggatggccaaggctaaggcaaagcgcgccgagactaagcaaagaaatgagcagaaacggatcgaaagggccgcggcctgggctgaaaagaagcagcaggatattatctatcttggagaagctgtctcagccggcctgaacaagaacacgtccaatgaggcacagctccagcatttcggcctgcccgtttaccacaatgctcagcagctggcagacgctatgcaactggccctcggtaaactccgctttctagcattcaaccggtccgtagccactaccacccactaccaacgtttccagctccccaagaaaagcgggggagttcgcacaatcagtgcccccatgccccaacttaaggcagcccagcactggatcctcgagaacatcctatacaaagtctctaatagtgatgccgccaatgggtttgtcagggggcggtcaattgttactaatgcccaaccacacataggtaaggacgtggtagtcaacattgacctaaaggatttctttcctggcatcgcatataaaagggtcaaaggtttattctgcaagctgggctatagcgaacaggtggcaacaattctgggactgatctgtactgagccagaagtggatgagattatactggacggaagaaaatacttcgtggccaaaacagatagggtcctgcctcagggggctccaacctctcctgcgattaccaaccttatctgctttaagatggatcgcagatttgaaggcctgagcaaaaagtacggttatgcttatacgcgatacgccgacgatatgacgtttagcgctaaaggcgacgctgctgccaaagtgggacaattgctctgggcggtgaaaaaagtagtggctgaagagggcttcgtgctgcaccctgataagcttaaggtgatgagaaagggtgaccggcatgaggttacaggaatcgttgttaacgaaaagctttccattgaccgtaccaccttaaggaaattcagagccttgctgcataatgtggaattgaccgggttgtctgggaaaaagtggggaaaggggagtattatagccagtatggaagggtacgccaattttgtggcaatggtgaaacctgagcaaggcaaaaaattaaaagcccagctggcagccttgttttccagagcggacatcaaggctgaggctcaggcgatctggaaaaatgaagagcagccccaacaggactccagcgtatcgccacagacccccaacacccaggacacaccgactcctcccaagccatcaggtccagaaaagccctggtggaaagtggtgtga

SEQ ID NO: 13226 - RNA, 1545 nt, unidentified
  source 1..1545: mol_type = other RNA; note = synthetic construct
atgcccgagggtctgacacgacagcagctgtatgataagattcgcgaaagttctaaagaggagtacatcctagaagaaatggtgagattagggttctggcaaagggacaccgagaaaccaagcgtacccgaggttttgataaagcaggagggtgccttaaataaggagctaaatcagttgctccaggagaaataccggtaccgcaacaagcaactgatgttgacagagatgagaaaagctcgcatggcaagagcgaaagccaagcgtgcggaaaccaaaaagcgcaacgaggagaagagaatcgcaagggctgcggcctgggccgaacagaaacaacaggatattgtctacctcggagagaatgtcagtgccggcttaaataagaaggtgtccgacgaagcgcagctgcgcaagttcaacctcccggtgtggcataccgcacaggatctggctaatgccatgcagctttcactgggaaagctcaggttcctggccttcaatagaacggtggggcaccagacacattatcaacgttttcaaatccctaagaagtctgggggaaccagagtaataagcgcccccatgcctcagcttaaggcagctcagcactggatcctggagaacgtcttatacaagatcactaacagtacatcagccaacggatttgttcctgggaagtccattgtgaccaacgccattccacacattggaaaggatgtggtggtaaatattgacctgaaggactttttcccttctatcgcatataagagggttaagggcatgttctgcaagctgggttattcggagcaggtcgccactatcctgggtctgatttgtaccgaacctgacgtggacgaggtgatgctagataaccggaaatttttcgtagctaaaacagaacggaggttgccacagggcgcacctacttcccccgccattactaacatcatttgctttaaactcgaccggaggtttgaggggctcagcgcaaagtacggctatgcttatacacgatacgccgacgatatgaccttctccgcaaagggcgaaccagctgccaagattggccagttgctctgggcagccaaaaaaatcgtcgctgaagagggattcgtcttgcatcccgacaagcttaaagtgatgcgaaaaggcgacaggcacgaagtgacgggcatcgttgtgaacgagaagctgtcactcgatagaactactctgcggaagtttcgggccctgctgcatcaaatcgaacttactggactcgccaacaagacatgggggaaaggcaatatcataagctccatggaaggttacgctaattttgtggccatggtcaaaccagaacaagggaccaaactgaaaaaccagctgaacgctcttcttcagcgcaatgacatcaaggcggaggctcaggctatgtggaaaggcgaagaggttgcatctgccaaaccggcagaacacctcccagagaaagagaataagaaggataacaccagcaataacaataaaacgcccgataacgataaaccctggtggaatatactgtga

SEQ ID NO: 13227 - RNA, 1548 nt, unidentified
  source 1..1548: mol_type = other RNA; note = synthetic construct
atggccgaaggccttacacgccagcaactgtatgataggatcagggcctctagcaaagaggagctgatattagaggagatgactagactcgggttctgggctaacaatactagccagccctccccaagcgagagtctaatccgacaagagggcgttttgcggcgtgaattggacgagctgatcaaagaaaagcagaaataccgcaacaaggagaagatgctgcaggatatgcggaaggaaagaatggctaaggcaaagctcaagagagcggagacgaagaaacgaagggaggaagagaggaaagccagagcgatagcctgggctgcggaaaaaaatcagtccattgtgtatctgggtgaggatgtgtccgccgggctgaacaaagtagtgtcaaatacggagcagctggccaaatttggccttcctgtgtggcatgacgcagttgctctggctaacgctatgggcgtcacccttggaaaactcaggtatctctctttcaatagaaaggtaggacaccatacccattaccagagatttcagattccaaagaagtctggaggtacccgcgttatctccgcccctatgccccagctgaaggctgcacagcactggatcctcgagaacatcctctacaaaattaagaacagtgaggcagcgcacgggtttgtgcccggcaagagcatagtcacaaatgcagcaccccacgtgggccaggacattgtgataaacatcgacctacgagacttcttcccttctatcgcctacaaacgggtcaagggccttttttgtaagttagggtacagtgaacaggtggccaccatcctcggattgatctgcaccgaaccagaagttgaagagatcacccttgataatcggaagtattacgttgccgccacagctcggcatctcccccaaggagcccccacttcaccagcaattacaaacctgatctgctacaagctcgacaagaggtttgaagggctgagtgccaagtatgggtacgcctatacacgctacgctgatgatatgacgttcagcgccaagggtgctgccgccgacaaagcaggccaattgctgtgggctattaaattagtcgtgaaagaggaagggtttactattcaccccgacaaactgaaggtgatgcgcaaaggagacaagcgtgaggtgaccggcatcgtagtcaacgataaactgagcctggaccgggttactctgcgcaagttcagagccttgttgcaccaaatttctaccaccgggctgtcaaataaatcgtggggaaagggtaaaaacattattagctccatcgagggttatgctaattatgtgtacatggtcaaacctgagcagggagcaaagctgaaagccacattagcggcactcctgcagagggaagacatcaaggccgcttcgcgttccatttggacaggcgaaactcttgccgccgcgcctgtcgtaacaactgtgaccgcagagactccggcatctaagccaattataaaggaaacccctccggcttcaaaggataaaccatggtgggatgtgctatga

SEQ ID NO: 13228 - RNA, 1581 nt, unidentified
  source 1..1581: mol_type = other RNA; note = synthetic construct
atggcagaaggactaaccaggcaacaactctacgaccggatacgcgcatcctcaaaggaagaatttattttggaggagatgacaagactcggtttctgggccaagaataccagccagccttcactgcctgagactctgatccgccgtgaaggagagttgagaagagagttgaatgagctgcttgcagagaagcagaaatatcgtaataaggaaaggatgctggccgacatgcgcaaagagagaatggcaaaggcgaagctgaagcgcgcggagacaaaaaaacggaacgaggaaaagcggaaagcaagggcagctgcctgggccgagaaaaagaatctcgatattacgtatcttggcgaggaggtgagcgccggcctgaataaggttacacccgatgaagcccagttagcaaagtttggattgcctgtctttaaagacgcgaccgcgttagccgccgctatgggtgtgaccctaggtaaattgagatttctggccttcaacaggcaggtcgcaaatacgagtcactaccagcggtttgaaatccccaaaaaaagcggcggtacccgtgtgatttctgcacctatgccccagctgaaggccgcacagcactggattcttgagaacatcctgtacaagatcaacaactccgctgccgcacatggttttgtgccagggaagtccatagtaactaacgctgtcccccacgtgggacaggacattgttataaacatcgatctccgagattttttcccctctgttccttataaaagggtgaaaggcctattctgtaagcttgggtacgccgaacaggtggccactatcctcggcctcttatgcaccgaaccagaggtggatgagatcctgctggataaccgaaaatactatgtcgctaaaactgagcggcacctgccacaaggggccccaacatctccggctctcacgaatctgatttgcttcaaactggacagaagatttgagggcctggctgcaaagtacggatatgcctatactcgatatgccgacgatatgactttctctgctaagggcgatgctgccgataaagccggccaggtcctttgggctgtaaaacaggtggttaaagaggagggattcacgattcatcccgacaagctgaaggtcatgagaaggggcgataagcgggaggtgaccggcatcgtggtaaacgaaaagatcagcctcgaccgcgaaaccctgcggaagttcagggcccttctacaccagatttcgaagactgggctcgcggggaagcgatggggtaaagggcgcaatatcatatcaagtatggaaggattcgctaattacgtctacatggtgaaacctgaacagggcgctaagttgaaggagacattagccgctctgctccagagggaagacatcaaagcagaagcacataacctgtggacaacagggacaaccgaagggaccgccgccgaaaccactaccgagacacccagcgctccacaatccagtgcgccacaacatcccgagggagtgcacattgccaaggacacaccaactgctaccaacaaacctgacaagccgtggtgggacgttctgtga

SEQ ID NO: 13229 - RNA, 1578 nt, unidentified
  source 1..1578: mol_type = other RNA; note = synthetic construct
atggctgaggggctgacgagacagcagttgtatgatcgcatacgggcatcgtcaaaagaggaatacattctcgaggagatgacaaggcttggattttgggctcagaatagttctcaacccagtctgcccgagacacttatccgaaaggaaggtgagctgcggcgagaactgaacgaattactggcggagcgacagaaatacagaaataaggagaagatgcttgccgatatgagaaaggaacgcatggccaaggccaaacaaaagcgtgccgagactaagaagagaaatgaggaagaaaggatcgctagggcagcagcctgggcggaaaaaaagcaacaggatattttgtatctcggagaagaggtgagcgccggccttaacaaagttaccccggacgaggcccaactgaccaagttcggcctgccggtattcaaagacgcaaccgcattagccaatgccatggggatcacacttggcaagctgcgttttctcgcctttaacaggaaagtgtctaactcatcccattaccagcgcttccagatccccaaaaaatctggagggacacgggttattagcgctcccatgccccagctaaaggctgctcagcactggatactggagaacatcctatacaagatcaagaatagcgatgccgcacacggtttcgtgcctggaaagtctattgtgactaacgctgccccgcatataggacaggacattgttatcaacatcgatctgcgcgattttttcccaagcattccttataagcgagtgaagggcctcttctgtaagttggggtatgcggaacaggtcgcctcgattttggggctgatctgcacggagcctgaagttgacgagattctgcttgataaccggaggtacttcgtggctaaaaccgaacgccacctaccccagggtgctcctacttcaccagcaattactaacctcatctgctttaagctggacaggcggttcgaggggcttgcagccaagtacggctacgcctatacccggtacgccgacgatatgacgttttccgcgaaagctgctgtggccgacaaggcaggccaggtcttgtgggccatcaagcaggtggtcaaagaggagggttttacaatccatcctgacaaactgaaagtcatgcgtaaaggcgacaaaagagaagtgaccggcattgtagtgaatgagaagctgagtttagacagggagacattaagacgcttccgggccttgctgcaccagatatccaaaactggtctggccgggaagtcctggggaaaggggaaaaatatcatcagctccattgagggatatgcaaactacgtatatatggtcaagccagagcagggagcaaaactgaaagccaccctcaccgcgctcctgcagagggaagacataaaagcccaagccagaagcctctggaccggcgaacaagctccagcccagcaacaagcaggccccgcttcacaggctgatactactaagacgaccgacacaacagctactacccaggcaccacctgcttccaatcctagcagttctgcgaagacagaaaaaccatggtgggatatcctctga

SEQ ID NO: 13230 - RNA, 1554 nt, unidentified
  source 1..1554: mol_type = other RNA; note = synthetic construct
atggcagagggcctgactaggcagcagctgtatgaccggatcagagcctcctctaaggaggaatatattttggaagaaatgacccgacttggcttttgggcacggaacaccacacagccatccccttctgagacactcatacgcaaagaaggggaattaagaagggaactaaacgaacttcttgccgaaaagcagaagtatcgcaaccgggagcgcatgctggcagatatgaggaaagagcgcatgcagaaagcaaaggataaacgagcggagacaaaaaagagaaatgaagaaaagaggcgtgagaaggccgctgcttgggtggtgcagaaaaatttgaacattgtctacctgggcgaggaagtttccgccggcctgaataagaatgtcagtgacgaggcacagctaaagaagttttgtcttcctgtgtttaacgacgccgtcgccctcgctaacgctatggggataaccatcggcaaactgaggttccttgcattcaataggaaggtggccacaggtacgcactatcaaagatttgccatacccaaaaagtcaggtggtacacgggtgatcagcgcacccatgccccagttgaaagccgcgcaacattggattttggagcacatcctgtacaaaattgagaacgggaaagctgcccacggtttcgtgccaggcaagtcaattgttactaatgcggcaccgcatgttggacaagacctggtaatcaatatggacctgagagatttcttccccagtataccgtacaagcgggtaaaggggctcttttgtaagctgggatatagcgagcaggtcgccacaattttggccctgatctgcactgagcccgaggtggacgaggtgatgctggataatcgcaaatactacgtagctaaaaccgatagacatctgcctcagggggctccaactagtcctgccatcaccaatctcatttgcttcaagctagatcgaaggtttgagggcctcgccgccaaatacgggtacgtttatacgcggtacgcagatgatatgacattcagcgtcaagggagacgccgctgacaaagccggccaagtaatctgggctgtcaagcaggttgtgaaggaggagggtttcaccctccaccccgacaaattgaaagtgatgagaaagggcgacaaacgtgaagtcaccggtattgtggtcaacgagaaactgtctatagatcgcgataccctccacaaatttcgtgccctgctccaccagatctccaagaccggactcgccgggaagcattggggaaagggcaacatcatttcttcgatggaaggattcgcaaactacgtgtatatggtgaaacccgagcagggcgccaagctgaaagctactttagccacgctgcttcaacgggaagacatcaaggctgaggcgcgatcaatctggactggagaggcaacggctgtggctgcggcaccagctgacacaatcgcagatactaccgccagcgttacacctgtgaccccaaagcctgaaggaaaggcgactggggctgaaaagccatggtgggacattttatga

SEQ ID NO: 13231 - RNA, 1437 nt, unidentified
  source 1..1437: mol_type = other RNA; note = synthetic construct
atggcccaggggctcacacggcaacagctttacgacaaaatccgcctgtcgagtaaggacgaggtgattctgcaagagatgactcgtctcggtttttggagcaaggattcagcctccgcgtcccctagcgccctgttgatcgaacgggaggatacccttcggaaagagctcaccgatttgcttaaggaaaagcagaagtatgcaaaccaggagaagctcctcgctgagatgagagctgtgagaatggagaaggccctcaaaaaaaggcaggaaacaaagctgcgcaaagaagaacagcgcaaagaaagagccgaggaatgggcagagcagaagaacaacagcatcttatacctaggggagaatgtaagtgcagggttacacaagatagtgtctgatgtgacacagctgcagaagtacggactgcctgtgtggcacgatgtcaatgccatggcagcggagatgggactgggactgggggagatccggttccttgcctttaatcggaaagtcgctcactgctcccattatcaacatttctacctgcctaagaaatcagggggaaagaggctgatatctgctccaatgcccaggctgaaagctgtgcagaactggattttgcacaacatcctgtacaggattaaaaattccgacgccgctcacgggtttgttccaggcaggtctatagtcacgaacgccacaccccatgtgggcaaagagttagtaattaacatcgatctgagggacttctttccgtctgtcgcctacaaacgggtgaagggcttattcgttaaactaggttactccgaacagttggccacaatcctgggcctgctgtgtaccgagccagacgtagatgagattgtgcttgacaatcgtaagtactatgtcgctaagactgagcgccatcttcctcagggcgctcagagctcacccgccattactaacctaatttgctataagttggacaagaggtttgagggcttggccgcacgccatgggtatagctatactcgctatgcggatgacatgactttctctgctaatggcgagggtatcgaaaaggccggacaactgatggctttcgtcaagaaagttatcaaggaggaaggttttaccatccaccccgaaaaactcagagtgatgagaaagggcgacaaacgtgaggtgaccggagtggttgtgaacgacaagctgagcatagaccgagaaacgctgcgaaagttcagagcactcttgcaccagataagcaaaaccggactcagtcaaaagcaatggggcaatggaaatatcgtttcctcgctgcagggctacgcaaactacgtggcaatggtaaaaccgggggcgggtgccaagctcaaagcaagtattaacgagcttttcaatcgaccagaaatcaaaagagaagccgtctcaattctgggcgataaaaaggaatga

SEQ ID NO: 13232 - RNA, 1533 nt, unidentified
  source 1..1533: mol_type = other RNA; note = synthetic construct
atggctgagggactaactaggcagcagctgtatgaccgcatcaggagttcctctaaggaggaatacatcttaaatgagatggtccggctcggcttttgggcacaccagacagccactcctaccttacctgagagcatacttaaccgggaacgagagttaaggaaggaactaggcgatctgctggccgaaaaacagaagtaccgggacaaagaaagattgctggccgagatgaggaaacagcggatggaggctgccaaacagaaacgcgccgccactaagcagcgacgtgaagaagaaagacagtctcgggccgctgcttggaccttacagaaggcacatagtgtagtatatttgggggaggatgtatcagcaggcttgaataaagccgtctcagacaccgtccaactggctaagtacggattgcccctgtttcataatggagaggctctggccactgctatgggcgtgtcactggggacactccgctttctcgcctttaaccgaaacgttggctacattagccactataaacggttcaagctccccaaaaaatctggagggcacaggaccatcagcgctcctatgccacagctgaaggctgcacagcattggatacttgagcacatcctgtataaggtgcctcacagcccagccgcccatggatttgttcccgagagatcaatagtgacaaacgcagccccacacgttggacaggacatcgtcatcaacatcgacttgaaggacttcttcccctccatcgcgtacaagagagtgaagggtctgttctgcaaactggggtactccgaacaagttgcgacaattctcggtctgttgtgcacggaacccgaggtcgatgaggtcagtctggataataggacctactatgtcgccaagacagcaaggcatctacctcagggtgctccgacctcccctgccattaccaacctgatttgtttcaaactggatagacgctttgaaggcctggcggcacgtcttgggtatacatacaccagatatgccgatgacatgacgttctcgacgaaaggcgccgccgctgaaaagccagggcagcttatctggagcgtgaaacaggttgtgaaggaggagggctttaccattcaccccgacaaactcaaggtgatgcgaaaaggtgatcagcgtgctgtgactggtatcgtggtgaacgaacaactttcccttgatagggcaacattgcgcaaattcagagccctccttcaccagatctctcaaaccggcctggccaacaaaagctggggcaaggggaatataattagtagcatggagggctacgccaattacgtggccatggtgaagccagcactcggagcgcaattcaagcaaaccctggctaatctcctcgctcgcgatgacattaagcaggcggcgcgggctatgtggactggaactccagtgtctccggtacctattcctgcacccactcccacagcatcccccgcaaaggaggagacaccacctccggctggggacaagccatggtgggacgtgctgtga

SEQ ID NO: 13233 - RNA, 1506 nt, unidentified
  source 1..1506: mol_type = other RNA; note = synthetic construct
atggccgaggggttaactcggcagcaactgtatgataggatccgggcttcaagtaaggaagaattcatacttgaggagatgacgagattggggttttggaccaaaaatacggcgatgccttctcccagcgaaatgctgataagacgcgagggcgaattgagacgggagcttaacaaattaatggaggaaaaacacaggtatcgtcatagggaacagatgctgaatgagatccgaaagcagcggatggaagccgcgaaggccaagcgagcagccactaagctgcggaatgaagagaagaggaaggaaaaagctgcaaagtgggcaattgagaaggaaaagaacattgtctacctcggcgaagaggtgagcgctgggttgaacaaggtgctgagtgacgaggctaaactgcgcgcagccggactcccaatttatcacgatggcgcagctctagccgaggccatgggtataacactgggaaaactgcgcttcctgtcttttgatcgcaaggtggctaccgtcacccactacaaacggttctacataccaaagaagagcggcggacggcgactgatttctgccccaatgccccagcttaaggccgcccagtattggatcttagagaatatcctctacaaggtaaaacacagtgatgcagcccatgggtttgttccagggaaatccatcgtcacaaatgcagctaaccacgtgggccaggatatcgtgattaatatcgatctccgtgacttcttcccgacagttgcgtataatagggtcaagggaatgttttgcaacttgggttactccgagcaggtgagcaccatcctggggctgttgtgtaccgagcctgaaatggaacccgtaaacctcgatggaaaagactaccatgtggccacatcagccagacatctacctcagggcgcaccctgcagtccagccattactaacatcatttgttataagctggaccgccgtttcgaaggactcgcgaggcgatttaattacacctacaccagatatgcagacgacatgacattttcagctaaggaggccgctgcgaacgacgctggcaagctaatttggggagtcaagcaagtggttaaggaggaggggttcgtcgtgcatcctgacaaactcaaagtgatgcgcaagggcgacaagagggaagttactggtgtggtagtcaacgagaaactgtcaatcgacagagagacacttcgcaaattcagggctctgctgcaccaaatttcggtgagcggaatcgaagggaaacagtgggggaaaggcaatatcgtgtctagcatcgagggctacataaactacgtccagatggtaaaaccggaagccggacaacagctgaaaaccaagtggcaggtgctccttggtagaactgatatcaagtcccagactagagcctcctctacgggccagattgtgattccccccgttgtgcctcctgcacaagattccggtgagacaggcgagaaaccatggtgggacgttatgtga

SEQ ID NO: 13234 - RNA, 1506 nt, unidentified
  source 1..1506: mol_type = other RNA; note = synthetic construct
atggcagaggggttaactagacagcagctctatgacagaatcagaagttcaacgaaagaggaagtgattctcgaggaaatgacacgtctcgggttctggacccgtaaccaggcaatgcctgccccatcggaggtgcttatcaggagagaaagtgagctgcgacgggaactcaataagctggtggaggagcagcaaaggtacaggaataaggagaaaatactgagtgatttgagacagcagaggatggccgctgctaaagcaagacgcgccgagacaaagctacggaaggaggagaaacgcaaggaacgggcagcccagtgggccattgagaaggagaagaacattgtgtacctgggagaagacgtctccgcgggcctgaacaaggtggtaagcgatgaggaaaaactgaaagctgctggactgccagtttatcatgacggacttgcgttagcagccgcgatgggcatcactatcgggaagttacggtttctttccttcaaccgcaaagtggcaaacgtttcccactataagaggttctacatccccaaaaagagcgggggaaagcggcttatttccgctcccatgcctcagctgaaagccgcccagtactggattcttgagaatatcttgtacaaggtgaaactctctgaatctgcccatggcttcgtgccggggcggtctatcgtgacgaatgcaacacaccatgtcggacaggacatagtcatcaacattgatctcaaggatttcttccctaccatcgcctataagcgggtgaaaggtctgttttcaaaatttggatactcagaacaggtcgccaccatcttggctctcctgtgcaccgagccggaggtcgaacaagtagccctggacggccgtgaatatcacgtggctacaaccgagcggcatttgcctcagggtgctccatgtagcccagccatcactaatatcatttgctacaagctggataggcgcttcgagggactggctcgcagatttggctatgcatacactcgctatgcggacgatatgacttttagcgccaaggaggcagccggagataacgcaggtaaactgatttggggtgtgaaacagattgtcaaagaagaggggttcgttatacaccccgacaaactgaaagttatgagaaagggggacaaacgagaagtgacaggtgtagtggtcaacgaaaagttgtccatagaccgagaaaccctgaggaaatttcgcgccctgctacaccaaattagcgtgtcaggcctcgagggcaagcaatggggcaaggggagccttgtcaattctatcgagggctacatcaattacgtgcagatggttaagccagaagctggtcaacagttgaaggccaagtggcagctcctgctaggcagggaagacgtcaagacacaagtacgagccgctgccaccgcagcacccatattaattcctcccgttgctcctgcgcaggaagagccaaaagatggcgagaagccctggtgggatgttatgtga

SEQ ID NO: 13235 - RNA, 1509 nt, unidentified
  source 1..1509: mol_type = other RNA; note = synthetic construct
atggctgagggccttacccgccagcagctctatgacagaattagagcctctacccgcgatgaggtgattctggaagagatgactcgtttgggcttctggaaaaaaaacaccctcatgccctccccatccgaagtgctgattcaccgggaggctgatttgactagggaactgaataaactgatggaagagaagcggcggtaccagaacagggagaagatgctcatcgagatgaggaagcaacgcatggcggccgctaaagccaaacgcgccgagacaaagctccgtaacgaggaaaagcgcaaagagaaagccgcccagtgggccgaacagaaggagaagcaaatagtctacctgggtgaggacgtgagccagggtctgaacaaaacagttagcgataccgagagattgacagccacaggccttccagtgttccatgacggggtagcccttgctgccgctatgggtatatctattggaaagttgaggtttcttgcatttaatcgtaaggtgggacacatcactcactacaaacgcttctacattcccaagaagtcaggaggcaaaagattgatttcagccccaatgcctcaactcaaggctacccaacactggatcctggagaacatactctataaagttcccaattccgacgcggctcatgggtttgtcccagggcggtcgatagtgactaatgcagtccaccatgtcgcacaggacattgtgatcaatatcgatctgagggacttcttccctaccatcgagtataagagagtgaaggggatgttctgcaagttaggctacagcgagcaggtggctacgattctggcactcctatgtaccgagcccgaagtagatcaggtggccctggacgggaaggattactatgtggcaaacacaaatcgacacctgcctcagggagccccttgtagcccagccatcactaatatcatttgcttcagactagacaggcgatttgaaggcctggcacgccgattcaactatacttatacgaggtacgcagacgacatgacattttccgcaaaggaaccggcggctgacgacgcaggcaaactgatctggggtgtgaaacaggtagttaaagaagaggggtttgttatccatcctgataagctcaaagtcatgcggaagggagacaagagggaagtaactgggatcgtggtcaatgataagctatctttagaccgggagacattacggaaatttagagctctgcttcatcagatcagtgtgagcggtcttacaggcaagcagtggggaaaggggaacatagtgtcaagtgttgaaggctacatcaactatgtcctgatggtcaaaccagaagcgggaaaacagctgaaggataagtggcggttgctcctgaatagagatgatatcaagacccaggttcgagccgctgcaacgcaatctgatgccccccctgccccctccagtagtaacgagaacaataccaccaacgacggcgaaaaaccgtggtgggatattctgtga

SEQ ID NO: 13236 - RNA, 1488 nt, unidentified
  source 1..1488: mol_type = other RNA; note = synthetic construct
atgatgacgggcctgactcgacaagaactctacgaccgcattaggagttcaacgagagatgaggtgatcttagaggaaatgaagaggctgggcttttgggccaggtctaccggcgcaccctctctgtctgaaactcttataaggaaggaatctgagctacgccgtgagcttaacaaactgatggaggaaaaagctcggtatcggaacaaagaaaaaattctcaacgaccttcgcaagaaacggatgatggatgccaaggcaaagagagctgagacaaaacagaggaatgaagagaagagacgggaaaaagccgcagcctgggccgctgaaaaggaacgatccgtggtttatctcggagaagacgttagcgcagggctcaataaaaccttttcagatattacacgcctgagtgcggccggattgccaatcctgcatgacggagttgggttggccgcggctatgggaattactctgggaaagctcaggtttctttcctataacagaaaggtcgaagaggtgtcacactataagcggttctatctgccaaaaaaatccggcgggcgacgtctaataagtgcccctatgccccaattgaaagccgcccaatactgggtgttacagaacattctctataaaatccctggctctcagagcgcacatgggttcatccccgggaggagcatagtaaccaatgctcagcagcacgtgggtaaggatgtggtcatcaacatcgacctccgtgacttctttcctaccatcgtgtacaagagagtgaaggggatgttctgcaagctgggatacagcgagcagattgcaaccattctggccctgttatgtaccgagccggagcgggatcaagtaatgctggatggcaaagagtaccacgtcgctaacacaaaccgacacttacctcagggagccccttgcagccctgctatcaccaacattatatgttatcgcctggacaagcggtttgagggcctggcaaagaaattcaactacacttacactcgctacgcggatgacatgactttttcaacatccggagagactgctggtaaggctggccagctactgtgggcggttaagaaagtagtgaaggaggagggtttcacaatccatccagacaagctgaaagtcatgcggaagggggacaaaaaggaagttacgggcattgtcgtgaatgagaagatgagcctcgacagaaccacactgagaaagttccgcgccttgttgcaccaggtaagtgtgtccggtttcgccggcaagaagtgggggaatggtaatatcgtgtcctcgatggaaggttacatcaattacgtccagatggtcaaacccgagacaggcaaacagcttaaagacaagtttagactgctcctcaataggaaagatatcaaagcagatcttcccgaggctccgaaggaggttctgccagacacctctttgccagatcagaataacgataagccctggtgggacgtggtgtga

SEQ ID NO: 13237 - RNA, 1530 nt, unidentified
  source 1..1530: mol_type = other RNA; note = synthetic construct
atgagcgcgggcttaacgcggcaggagctgtacgacaagattagggcttcctcaaaggaggaagtgattttggaagaaatggtccgcctgggcttctgggccaagaacgaatctgtccctagtgtgccagaaacattcattagaaaggagggggagttaaggcgcgagctgaacgaactcctttctgaacaagctaggtatcgcaataagcagcaggtgctgaccgatatgagaaaggcccgtatggccgccgcaaaagcaaaacgagccgaaaccaagaagaggaatgaagagaaacgtctccaacgcgctgcagcttggaaagaggagaaggaaaaaactatcgtctaccttggagaggatgtgtccgcagggttgaataagaccacctctgacgctgaacagctgcagaaattcggcctcccccttctaaatgatggtgctcagctggcagccgccatgggaattagcctgggcaagctgagatttctcgcgttcaatagaaaggttggaactgtaagtcactataaaagattctacctcccgaaaaaatcaggcggtaggcggttaatctccgccccaatgcctcagctcaaagctgcccaatactgggttttggagaacatcctatacaaggtaccaaattccgaatctgctcacggatttgttccgggtaaatcgattgtgacaaatgccagcaaccatgtgggccaggaggtggtgattaacatagacctcaaggacttttttcctacaatagagtacaagcgagtgaaaggcctctttatcaaactggggtattccgaacagattgccaccatcctggggcttctgtgcacggaacccgaagtcgaccaggtggcgctagacggcaaggagtacttcgtcgccaacacccccagacacttacctcagggtgcacccggtagcccagccataacaaacctcatctgttatggtctggacaaaaggttcgagggcctggcgaagcgttttggatacacttattcccggtatgcggatgacatgacttttagcacaaagggggaggccgctgataagatcgggcagctgctgtggagcgtgaagcaagttgtcaaagaggaggggttccacctgcatccagataagttgaaagtgatgaggaaaggtgacaagcgggaggttaccggcattgtggttaacgataagttgtctcttgaccgagagacactgcggaaattcagagccctcttgcatcagatcgataagactggcctggctaacaagcaatgggggaacggaaacatcatctcaagtgtcgagggctttgccaattatgtagcaatggtaaagcccgaggctggacgccagcttaaagataagatcaaagtgctgttcaatcgcgaggacataaaggcacaggctcgggcaatgatgagtggggccgcagtcaatggagccggaagcaccggatcaattgggggcgctgcagccaaggatgagcacatccctaaaaaagaagatggcaactggtgggacgtggtgtga

SEQ ID NO: 13238 - RNA, 1407 nt, unidentified
  source 1..1407: mol_type = other RNA; note = synthetic construct
atgctattcaattatcgctactcaggcagcactcaggtctactcaaatgctacctccgccggcatctctttctcgccagatactcggcgggagccaaccttctttaacgagtacagaaacaagcaacaggtactgaccgatatgcgaaaagctagaatggcggcagccaaagcgaagcgagccgagacaaagaaacgtaatgaagaaaaaaggcagcaaagggccgcagtttgggcagaggaaaagagcaagtccattgtctacctgggagaggatgtctctgctggcttgaataagacatccagcaacacggaactcctccagagatttggactgccactcctccacgacgctgtgcaactgagcgctgccatgggtattacactgggtaaactgaggttcctggccttcgacaggaaagtaggtacgatctctcattataagaggttttatctgcccaagaaatcgggcgggaggagattaatctcagctcctatgccccagctaaaggcagcccagtactgggtcctggagaatatactctataaggtccccaatagcgaagctgcgcatgggtttgttccaggcaaatctattgtgacaaacgcaacgaatcacgtggggcaggacgtggtgattaacattgacctgaaggatttcttcccaactatcgagtataagcgtgtgaagggcctgttcataaagttggggtactccgaacagctggccaccatcctttgcttgctgtgcactgaacccgaggttgaccaggtggccctcgatggtcaggaatattttgtcgctaacaccccgcggcatcttcctcaaggagccccctcctctccagctattaccaatctcatatgttacggtctggacaagcgatttgaggggttggcaaagaaattcggatacacctacagccgctatgccgatgatatgacattttctaccaaaggagagcctgccgataaaatcggtcagttattgtggagtgtgaaacaggtggtgaaggaagagggcttccacctccaccccgacaagcttaaagtgatgcgcaaaggcggaaagcgggaggtgacaggaatcgttgtaaatgaaaagttaagtctcgaccgggatactttacgtaaatttcgggcactgctgcaccaaatcagtgtctccggccttgcgaacaaaaaatgggggaacgggaacattatcagttccattgaaggatttgctaactacgttgccatggtgaagcccgagacaggcagacttctgaaagacaagatcagacttctactgaatcgcgacgatataaagtcacaggcccgcaccttgatgactggcgcacctgccccggcaagcgagaagaaccctcctcagaagggggacgacaactggtggaatgtggtatga

SEQ ID NO: 13239 - RNA, 1503 nt, unidentified
  source 1..1503: mol_type = other RNA; note = synthetic construct
atgaccgagcgcttgacccgacaggaaatctatgaccggattcgcgccacatctagggacgagtttatcctatcagaaatgaagaagttgggcttttggccttctgacgaagagaagccctccgtatcggaacagctgatcaaacacgagggcgagctgtccagagagttacaagaactaagccagaagcagcgaaagtttgataaccaacaagcaatgttggctgaaatgcgaaaagcccgcatggccgcggctaaaaaaaaacgcgttgagactaaggaaaagaacgaacagaagagaaaagataaagcagagcagtggaaacagcagaaacagaatgagatcgtgtatctgggcgaggacgtctcccacgagttaaacaacacagaagctgacacagctaaactggcccagtttggccttccgcactttgcagatgctctggcattagccaccgctatgaacatcagcctgggtaagctgagatttcttgcctataatcgcaaggtgtcaacaactactcattacaagaggttctatctagcgaaaaaaaccggcggcaagagactgatcagtgccccaatgcctaagctcaaagaggctcagtactggatcctggacaatatactctacaagttgaagaacacggatagcgctcacggtttcgtcccacagaggagtatcctcactaacgccagtaatcatattggccaggacgtggtaattaacatcgatctcaaagactttttcccctcaatcgattacaaacggatcaaagggctgttcgcagccctgggatatagcaaacaaatcgcctccatactggccctggtgtgtgcagaacccgatgtcgacatgattgacatagataagaagacctattacgtcgcacacacagagcggaaacttcctcagggggcccctacgtcaccagcgattaccaatctcatctgctacaagctcgatcaccggttcgaagggatcgcaaggaagtttaatttcaattacagtcggtatgcggatgacattactttttctgcaaagggagacggcaagaaactggtaggacaagtgctctgggccattcgccagattattgaatccgagggcttccagatccatccggacaagctcgccgtcatgcgtaaggggaggcaacaggaagttaccgggattgtcgtgaacgacaagccgggaatagataggaaggagctgagaaggttccgggcccttcttcatcagattgagctgaacggtaccgaggggaaatcttggagaaatggagtggatctggaaaatagcatgagaggttacgctagcttcgttgggatggttaagccagagcaaggaatccagttcaaggcccaattggaccagatattcggagtgcgtgctaaggtgaaacccgtgcctgctccagagatcaagatcgtgcctcccactattcaggatacaccacccaaacctgataacgacgaaaagccctggtgggagataatttga

SEQ ID NO: 13240 - RNA, 1503 nt, unidentified
  source 1..1503: mol_type = other RNA; note = synthetic construct
atgtccgagaggttgactaggcaggaaatctacgatcggataagggcaacgtcacgcgacgagttcatacttagcgaaatgatcaagttgggcttttggcagtccgacgaagatcagccaaaggtgaccgaacaactgatccgccgtgaaggagagcttcatagagaattaaatgaactaacccagaaacaacgtagatacgacaaccagcaggccatgctggccgacatgcgaaaggcacgaatggaggccgcaaaaaaacggcggattgagacaaaagaaaagaacgagcagaagcgtaaggacaaagctgaacaatggaagaagacgcagcaatctacaattgtttacctcggggaggcggtgagcggcaatctgaacgacaccctggctgatacagccaagctcactcagttcggcctgccccattttgaagacgcactaggtctagctaatgccatgaacatgtctttaggaaaactgcggttcctggcctacaatcgaaaggtgtccacaacaactcactacaagcgcttctatctggcaaagaagagtgggggcaaacgcctgattagtgcgcctatgcccaagctgaaggaggctcagtactggatcctggagaacatcctttataaactcaaaagcaccgatagcgctcacgggttcgttccacagcggtctatcttaactaatgcccgaaatcacatcggccaagacgtcgtgataaacgtggacttgaaagattttttcccgagtatcgattataagcggataaagggactctttgctaaactggggtattcccagcagatcgcctctgtgcttgctttgatctgcagcgaaccagatgtcgacattgtcgatatagacaggaaaacctattatgtggcctctacagaaagaaaactgccacaaggtgctcccacctccccagccattactaacctcatctgttacaagctcgaccataggtttgagggcatcgcacaaaagtttaatttcaggtattcccgctacgccgatgacatcacatttagcgccaagggtgagggcgccaagcttgctggacaggttctgtgggccgtgaggcaggtaattgaggatgagggattccagattcacccggataagctcgccgttatgagaaagggcagtcagcacgcggtgactggaatcgtcgtcaatgagaaacctggaattgaccggaaggagctgcacagatttcgcgcattgctccatcagatagagctcaccgggaccgaaggtaaatcatggagaaacggcgtgaatctggagaactcaatgagagggtacgcaaacttcgtcactatggtaaagcccgaacaggggaacaaatttaaggctcaacttgatcgcattttcggcatcaggacaaaaagccagtcactgcctgtggtagagacgtcgattattccccccgcaattcaggcgacccctcctaaaccagagaataacgagaaaccttggtgggaaatcatttga

SEQ ID NO: 13241 - RNA, 1512 nt, unidentified
  source 1..1512: mol_type = other RNA; note = synthetic construct
atgtccgaaagactgagcagacaacaactgtatgatcggattcgcgagacgtctaaagacgagtatattctgtccgaaatgaagaagctcggtttctggaagtcaaatgagactgagccccagatcagcgaacaacttattcagagagagggcgacctacacagagagttgaatgacttaagccaacagcagagacgatacgataaccagcaggccatgatcgccgacatgaggaaatcccggatggaagcgtccaaaaaaaagcagctcgaaactaaacaacgtaaccagcagaaacgaatcgaaaaggccgagaagtggaagacacaacagcagaatagcatcgtgtatcttggggaagaggtgtctggtggacttaactctacccagacagatatcgcaaaattgaactcattcggactgccgcactttactgatgtactggcactagcccaggccatgaagctgactctgggcaggctccgtttcttggcttacaatcgcaaagtgtctaccgtcagtcactacaaaaggttctatctgcctaagaagtccggaggaaagcgattaattagcgctcccatgcccatgctgaaagacgctcagtactggatactcgagcacatcttatataaggtcagtcccacagatctcgcccatggcttcgtacctaatcgctctattatgacaaacgcacagaaacacattggccaagatgtggtcataaacctcgacctgaaggattttttccccaccattgattacaagagggtaaagggcctgtttaataagttcggctattcagagcagattgccactattctggctctcatctgctccgagccagacgttgaattgctggaaatagatgggaagcagtactacaccgccaaatcagagagaaagcttccacagggagcacccacatcgcctgccattaccaaccttatatgttaccgcttggactgccggtttgagggcattgctaagaaatttgggtttcagtacagcaggtatgctgacgatttgacattcagcgcgaagggtgaaggtaaaaaacttgttggccagctactgtggagtgtgaaacaagtcataaccaatgaaggttttactctccatccagacaagatagccgtgatgcgcaaaggcagtcagcagaaggtgaccgggattgtcgtgaatgacaaggccgggatcgatcataaggagctgcataaattccgggcactgatccaccagatcggaaaaaccggcatcgctgggaagacgtggcggcaaggagtgaacctcgagaattccatgaggggctacgcagagttcgtgtcaatggtgaagccagagcaggggcagaaatttaagattgcgctggacaaagtttttggggttaaagtcaagagtgacaagcaagatatcccacagaacccgatcatcgagaacaaactgcctgaagagaagcctaagaacatcaacaaaaatgaagacggaaagtcttggtgggaagtgatctga

SEQ ID NO: 13242 - RNA, 1494 nt, unidentified
  source 1..1494: mol_type = other RNA; note = synthetic construct
atgagtgagaggcttacccgtcagcagatttatgaccgcatccgtcagaccagtagggatgagtttattctgtccgaaatgaagcgactaggattttggcaaacagatgccaatcagcccaaactttctgaggccctgattgataaagagagggagctgtaccaagaactaaacgaattgtcccaaaagcagaggcgttacgctaataagcaggccatgttggctgaaatgcggaaaagcaggctggaagcctctaagaagcgcaggcaggagactaaagctaaaaacgaacagagaaggcaacagaaagctgaagcatggaaagtccaccaacagtactctattggttacctgggcgaaggggtcagcggagggctcaatcaaactcagagtaatccacagcagctcgctctgcttggactgccagacttccgcagtccattccagctggcacaggcgatgggagtatctctcgggcatctgagattcctggcatttaacagaacggtgtccaaaataagccactataagagattctacctgcctaagaagtccggtggcaaacggctcatttcagctcctatgcccctgctgaagaaggcccagtattggatcctcgaaaacatcctatataagatcccgtcaagcgaggccgcccacggctttgtccctaaaaaatcaatcctgagtaatgctcagaaccacactggccaggacattgtggtaaacatcgatctgaaggacttttttccaaccattacgtaccacagagtgaaggggttgtatcataagctcgggtatagcgagcagatcgccactatccttgcgttaatatgtaccgagcccgaggtggatattgtcaagatcgattcgcagatatactacacagccaagtccatacggaaacttcctcaaggtgcacccacctcccccgctattactaatttgatctgccatcggttggatctcagattccagggtctggcccaaaagttaggatttaactattcccggtacgctgatgacctgtcttttagcggcgcaagcgagggatccaaactcgttggtcagctgctctggtcaatccataagatcgttaaggacgaaggattcgttgtgcatccggagaagatagcagtgatgcgcaaagggacacaacagcgagtgaccggcatcattgtgaatgagaaggtgggcatcgatcgccaaatgcttcgaaagttcagagccttgatccaccacattgaacagtctggagtgcagggcaagacatggaacaatagtaaaaatctggaagcctcaatgcgcgggtacgttaacttcgtatcgatgataaagccagagcagggcgcgaagttcaagatgaaattagacgccatttttggccagaaagagaaaaccagcacatctcggcctatcaaagacattcccccgcccagcccacctttccaggactcaaacgacgacgataaagcatggtgggaggtggtctga

SEQ ID NO: 13243 - RNA, 1518 nt, unidentified
  source 1..1518: mol_type = other RNA; note = synthetic construct
atggccgacaagcagcctacccggcaacagttatatgatcgcatcagagaatccaccaaagacgccgtggttctggaagagatgaagcgcctagggttctggcccaagggagagcaatctcccagcgttcccgaactcttaattaaccaagaagccgagctgaacaaggagtttaatcagctctttaaccagcagaggaggtatcagaataaggaggctgttctgcaggagatgcggatgaaaagaatggcagacgcaaaggcgaaacgtgaagccaacaaaaaaaagagagaacttcagcgacttgagaaggcagaagcttggaagaagaggaagactacagagatcatttatctgggcgaagatgtgagcgtcggactgaataacattgaggcaaacgtagcagccctccagaagtaccaactgccagcctttgccaatgaaacggagctggcacaagcgatgggcatcacgcttcccgatctgcgttttctggccttctcgaggaaggtgtcaaatatctcacactaccgcaaattctacctgcccaagaagtccgggggcaagcgtctgatcagtgctcctatgccacgcctgaaaaaaactcagtattgggtcttggagaacattttgaataaagtagccgtacacaccgcggtgcatggcttcactctgaaccggtcaatcctatctaacgccttaccacatgttggcaagaaagtagtccttaacattgacgttaaagactttttcccctctatccattacaagcgagtgaagggacttctccagcagttggggtacagcgagaaaatagcaactatcctcagtctgttgtgcaccgaggccgtgacggaggaggtggagatcgacggtaagaactacttcgtgcagaaaggaaatagggtgttacctcaaggggctcctacttctccggccatcacaaatattctctgctataaactcgatctgagactgcagggcctcgcagctaaacatcagtgtcagtacacccggtacgctgatgacgtgacattcagctggaatagcagtgatataaatgcccaacagatggtttggaggataaagaaaattctgtccgatgagggctttaccgtgcacccagataaaattagagtgatgcaccaaggtgcccggcaggaagtcaccgggattgtggttaatgaaaagcctgggatagacagaaataagctgcgaaaattccgcgccctattgcaccagctgcagaccaaggatgcagccgtcctgttgccgggagctgagtccccagcgaatgtggtcatcggttatgctaacttcgtgcgccaggtcaaacccgctcttggagcatttttcgctaagcagatcgaccagctctttcagacaggccggctccaatatgtggtgaaggaaacaccccctgccggtacaaacaacgacactcccccggctaaacctggcaatgacaaagaacctccaaagggggatgatgacaagccatggtggaacgtcgtctga

SEQ ID NO: 13244 - RNA, 1509 nt, unidentified
  source 1..1509: mol_type = other RNA; note = synthetic construct
atgtttgattctaagcccacccgtcaacaactgtacgacaggatcagggaaagtagcaaggacgccgtggtactagaagaaatgaaaaggctgggcttctggtcaaaaaacgatcagtctcctactattcccgagctgcttatcaaacaagaggtcgagctgaacaaagagtttcagcagctctttaacaggcatcgccagtaccagaataaagaagcagttctgaaagagatgcggctgaagcgtatggctgaagcgaaggcaaaaagggaggctaataagaagaaacgcgagcagcagcggttcgagaaggctgaagcctggcgcaagcagaaggagactgagattatttatttgggcgaagaggtatctatcggtcttaatcacacggaatcaaatgtcgcagcactgcagaaacatcagctacctgtgtttgtcaatgagaacgagctggccttggcaatgggtgtaactctcaaagaactgagatttctcgccttcagcagaaaggtgtcgacagtgtctcattacaggaagttttacttacccaaaaagtccgggggaaaacgactcataagcgctcctatgcctagactgaagaagacgcagtattggatcctcgagaacatactcaacaaagttgccgttcatcaggccgtgcacggcttcacactgaatagatcaatcctgtccaacgcccagcttcacgtgggtaagaaggtcgttcttaacatcgacgttaaagacttcttcccctccattcacttcaaaagagtgaagggactactccagcagcttggatatgctgagaaaattgcgactatactggcgctcttatgcacagaagccgtgacggaggccgtggaaattgacgggaaggactactttgttcaaaaaggcaatcgggtgctgccacaaggggctcctacctccccagccataactaacattctttgttacaagttggacaagagattgcaaggcctggctaccaagcaccagtgccattacacccgatatgctgatgatgtgacattctcctggaacagcaatgatgtgaatgctcagcaaatggtatggcgcatcaaaaatatcctccaggacgagggtttcaccgtccacccggataaggtgcggatcatgcacaccgggacacgacaggaggtcaccggaatcgtggtgaatgaaaaattgggcatcgatcggaataagctgcgtcggttccgcgccttattgcaccaattacagacaaaggacgccgccgagctgatgcctggagtggaaagtcccgctaacgtggtgattggctatgcaaacttcgttaagatggtcaaaccagcgcagggcgccgcatttagcaaacagattgatcagctgtttcagtcaggccgcctccagtatctggtaaaggaaactccccccagtccagggaacaatggagtccctccaaccccaccgagccaacaggcagggaaggatgacgacaagccctggtggaacgtcgtctga

SEQ ID NO: 13245 - RNA, 1518 nt, unidentified
  source 1..1518: mol_type = other RNA; note = synthetic construct
atggccgataataagttgacgagacagcagctttacgacaggatacgcgaatcaagcaaagatgccgtcgttctcgaggagatgaaacgcctgggtttctggcccaaaggagacgagagccccactatccccgagctgctgatcaacaaggaagcagccctgaacaaggagttccgagaactattcgaaaagcaccgtcagtatcagaataaggaagccgtgctaaaagagatgagattaaagagaatggcagcggcaaaggcgaagagagaggagacaaaaaaaaaaagagaacagcagcgcttcgagaaagcagcggcatggaaaaaacggaaggaaaccgaaattctctatctcggggaggacgtttccataggcctgaacaatatggcgggcaacgctgatgccttacataaacatcatctgcctgcctttgcgaacgaaaacgagcttgctgctgctatggggattgaacttaaagcactgcggttcttagcattcagtcgtaaagtgagtactgtatcacactatcgcaagttttatttgcctaagaagtctgggggaaagcggttgatcagtgctccaatgccacgtctgaagaaggtccaatactggatcctggagaacattctcaataaggtagccgtccaccaggccgtgcacggcttcacacttaatcggtcgatcatctccaacgcccaactccatgtgggcaagaaagttgtactgaaccttgatgtgaaggacttttttccgtccatacattttaaacgggtgaagggtcttctgcagcagttgggatacagcgagaagatcgctacaattctgagtctactctgcactgaggccgtgacagaagaagtggccctggacggcgggaactactttgttcagaagggaaatagggtattgccccaaggagccccgacgtctcccgcaatcaccaacatcttgtgttttaaactggacaaaaggctccagggcctggctacccgccatcaatgccactacacccgctacgccgacgatgtgaccttctcatggaactccactgacatcaatccacagcaaatggtgtggcggattaaaaagatactcgctgatgagggattcgccgtccaccccgataaaataagaatcatgcaccagggggctaggcaggaagtcactgggatcattgttaatgagaaactgggtattgacaggaacaagttgcgacaattccgagcccttctgcaccagttacaaacaaaggatgcctctgagctgatgcctggccaggtgagccctgccaatgccgtcattggctatgcaaacttcgtgaagatggtgaagccggctcagggcgccgcttttgcaaaggcaattgacaaactctttcagacaggtaggctccagtacctggtgaaggacgccccacccgtcctgaatggaaatccagctccttcccccagcccaacctctaatcctccagctaacaagggggatgataaaccttggtggaatgttaccggctga

SEQ ID NO: 13246 - RNA, 1509 nt, unidentified
  source 1..1509: mol_type = other RNA; note = synthetic construct
atggctgataaccggaatatcagacaagagctctacgacagaatacgcgaatccagcaaggatgaggtggttttagaggaaatgaaacgtatgggcttttgggctaaagatgagaacgggcccactatccctgaattgctcatcaaaaaggaggtggagctgaacagggagctcaacaaattgtatgaagagaagcggaagtatcagaatcgagaggccgtgttgaaagagatgcgccttaaacgcatggcagaatcccggctgaagagagaggagaacaagaagaaaaaggagctggcacaccttgaaagggccgaggcctggaaaaagaaaaaggacacagccattatttacctgggtgagggagtgagtgtgggcctgaacaacaccgacaataacctggccgcactccaaaaacataacctgccagtcttcaataatgaaaatgagctggcaaacgccataggaatccccctgaaagaacttagattcctcagcttcaatcgcaaagtcagcactgtttcacattatcggaagttctacattcctaagaagtccggtggcaagcggctcatcagtgcccctatgccaagactgaaacaggtccagtattggctgctggaaaatatctttaacaagatagctgtgcatcccgcggttcacggtttcgctctgcatagatcaatcatttcaaatgcccaacctcacgtgggcaagtctgtggtagtaaatattgacgttaaagacttcttcccatctattcactataagagagtgaaagggctgttacagcagctgggctttgcagaaaaaatcgccgtgatcatggcactcctttgtacggaggctgtaacagaagaagtggagatcgatggcaggaattactttgtgcagaaagggaacagggtccttccacagggcgcccctacttctccagcgattacgaatatcctctgttacaagctggacaagcggctccagggactcgcgactcagacacagtgcagctttaccaggtacgctgatgatataacattctccttcaacaacgaaacaaccaatgctcagcagcttgtctggcgcatcaagaaagtgttagccgacgaaggatttaccgtccatcccgataaggtgaggatcatgcgcaagggagcctgccaagaagtcaccggagtggtggttaacgagaagttaggcatttctcgaaaaaaactacgtcagtttagggccgtattgcaccagctgaaaactaaagacgcagctgagctgaagtgggggcacgggaacttggcctccgcagttaccggttatgcaaactttgtcaagatgataaaacccgtgcagggggccgctctgcaaaataccattgtaacgttgctgcagaccaatcgactacagtacccgctagcggtcactagcagtaagaagaatattcagacacctcccgcccaaaacaacgacccatcggctaagaaggatgacgataagccgtggtggaatgttgtgtga

SEQ ID NO: 13247 - RNA, 1506 nt, unidentified
  source 1..1506: mol_type = other RNA; note = synthetic construct
atggcgcacaaaaatatccgacaagaattatatgaccgaatcagggagagctccaaagacgaggttgtgttagaggagatgaagcgtatggggttttggagtaagaatgaagggggtcccgctgtgcctgaactcctgattaaaaaggagagcgagcttaataaggaactcaacaagctttacgaagaaaaacgccggtaccagaacagagaggctgtactgaaagaaatgcgccagaagcggatggccgaagcaaggcttaaacgggaagaaaacaagaaaaagaaggagcaggagaggttcaataaagctgaggcctggaaagagcagaaaaaaaaggagatcatatacttgggggaaggcgtgtccgtcggtctgaataacatagataataacttggctgccttacaaaaacacaacctccctgttttcaacaacgagaacgacctcgctaatgccatcggcatcccactgaaggagttacgtttccttagctataacagatccgtctcgaccgtgagccactatcggaagttttatattcccaagaagagcggagggaaaaggttgatctctgcccccatgcctagactaaaacaggttcagtattggatcctggaaaacatcctcaacaaggtggccgtgcatgccgcagtccatggatttgcccttcaacggtctattatttctaatgcacagccgcatgtaggaaaggaggtggtcctcaatgttgacgtcaaagacttctttcccagtattcactataagagggtgaagggcctgctgcagcatctgggatactcagagaaaatagcggtcatactggcactcctctgcacagaggcagttaccgaagaggtggccattgacggacggaactatttcgtgcagaaaggaaatcgcgtcttgccccaaggcgctcctacctcaccagccattacgaacatcctctgctaccaattggataagagactacagggcctggcaaacaaaggccagtgttcttttactcgctacgcagatgacatcaccttctcctttaatgatccaggtacaaatgcccagcagctggtttggagaatcaaaaaggtgctggcggacgaagggttcacagtccaccctgagaagattcgcatcatgcgcaaagggactcatcaggaagtaaccggtgttgtggtgaatgaaaagcttggcctgaatcgtaagcagctgagaagatttagggctgtactgcaccagctcaagacgaaggatgcggcagagctgaagtgggggaatgataacctagcttccgctgtaactggctacgcaaatttcgtgaagatggtgaagcctgctcaaggagccgccttgcagaaccgaattgccgccctgctgcaaactaataggctgcagtacgcaagtaccgtgacaggcgctcccaaaaagaaagatcccacaccaccggccaacaactcagccgatccaaagaaagaggacgacaagccatggtggaacgtggtctga

SEQ ID NO: 13248 - RNA, 1470 nt, unidentified
  source 1..1470: mol_type = other RNA; note = synthetic construct
atgtttgataatcagcagacccgccagcagctgtatgatagaattcgtgagtctagccgcgatgaggtaattctggaggagatgaaacgcatgggtttctggggtaaaaaagatgctgagccatcactgcccgaacaactgatcaagcaggaaacagctctgagcaaagagcttaatgccctggtcgctcagcagcgcaaattccaagacaaggagaaaatgctgaaagaaatgcggatcaagaggatggccgaggccaagcagaagagggccgagaataagaaaaagcgagagcagcagcggttcgagaaagcagaagcctggaggaaaagaaggggtggagaaatcctgttcctaggcgaaatggtttcaactggcctgaacaatacaactaacaacaccgagtcgttgtccaagttcgggcttccggtctttcataatgaaaacgacctggccattgctatggggatttctttgagtgctctccgatttttagccttttcccgcaaagtttctaccgtgagtcactaccgaaagttctacctggcgaagaagtctggcgggaagaggcttatcagcgctccaatgccaaaactcaaaggagtacagtattggatcctacagaatatcctgcaaagagtgaatgtccacccctccgtacacggttttattgcaaatcactcgattctgaccaatgcccaacctcatatagggaaggaagtcgtcttgaatatcgatgtgaaggacttctttcccagcattcatttcaaacgggttaaggggatgcttcagcaactcggctacgctgaaaaaatagccacaatccttgcattgctctgcactgaagcagtaactgaagaggtggccatcgacggaaagacatacttcgtgcaaaagggcaacagagtgctccctcaaggagctcccaccagtccagcaataacaaccatactctgctataagctagataaaagactccagggcttagctgaccggcaccagtgtaactacacgagatatgccgacgacgtgacgttctccacgagccggactgagctgaacatgcagcagatggtctggcgtattaaaaagattttggcggatgaggggtttactgtgcatcctgataagatttctatcatgcgtaagggggcccaacagcaggtgaccggcatcgtggtgaaccagaaactcagtgttaaccgagagaagagacggaaactgagggctctgctccacaaccttgaaacaaagccgggcttcgttcccgtctggggacagaactcatctgcagcagccatcttgggctacgcccattttgtgaagatggtggatgcggagaaaggagaaaagtttaaggacaaggtgaggagcttaatcgcgcagggaaaactgtcactgacccagtccaacaacgaccgctccggtggcaatgcagggagcgacaagccttggtggaatgttacatga

SEQ ID NO: 13249 - RNA, 1464 nt, unidentified
  source 1..1464: mol_type = other RNA; note = synthetic construct
atgtctgacaaccagaagacacgccaggagctgtatgatcgtatccgcgagagctccagagccgaagtgactctcgaggaaatgaagcgactgggcttctggtctaagaacgacaaggagccaaccctaccggaacagctcatcaagcaggaggccgccctagtgaaagaattgaatgcgctgaacgcccagaagcagaggttccagaacaaagaggctatgctcaaagaaatgcgaatcaagcggatggcggaagccaaaaagaagcgggaggagaacaagaaaaagcgggagcagcagcgctttgaacgagctgaggcctggaggaaaaggaagacgtctgaaatcatatacctcggagaactggtgtcaactgggctgaatgacgttacgaacgatacagccaaattatccacctacaacctgcctgtcttcaataatgagaacgatctggccgctgcaatggggatcacgctgtcacagttaaagtttctggctttttccaggaaagtgagcacagtgagccactaccggaagttttacctgagcaagaagtcgggagggaaaaggctgatctccgcccctatgcccagacttaaaaccgcgcaatattggattcttcaaaatatcctgcagcgtgtccctgctcaccctgccgttcacgggtttattcagcaacacagcattcttaccaatgccgccccccacgttggcaaagaagtagtgctgaatattgacgtgaaagacttcttccccagcatacattttaaaagggtgaagggtttactccagcaactgggatatgctgagaagttcgccgcaatcttggccctgctttgtaccgaagctgtgactgaggaaatcttcatggacggtaaaaactattttgttcagaaaggtaaccgggtcctcccacagggtgctccaacctcaccagctatcaccactctcctctgctacaagctggacaaaagactgcagggcttggcggataaacaccagtgcgcctacacaagatacgcggatgacattaccttcagtacttctaacgcacaattcaatgctcagcaaatggtctggcggattaagaaagtcttagccgatgagggctttgaggtccatcctgacaaaattgctatcatgagaaagtctaccagacagcatgtgactggaatagtcgtgaacaaaaaaatagcagtaagtcgcgataagagacgcaagtttcgcgctctacttcataatttggagacaaagccgggattcgtgccaacatggtcaaataacagtagtgggtttgcaatcctcggctatgcaaatttcatgaagatggtagaccccgtaaaggcatccaatgcattgcagaagttgcaaagccttattgcatccggcaagctgcccctgattgcagccgttaagcccgccagggagcaaggcgatgataaaccttggtggaacgtgacatga

SEQ ID NO: 13250 - RNA, 1644 nt, unidentified
  source 1..1644: mol_type = other RNA; note = synthetic construct
atggcatatacctatcagtgtacctttcctggagctggtacctggtgtcacaatgggacgctcgtgcgtgtgtgtctggcactgataaacctggttaggggcagacacgagggagctgcgaccctctgccaaaacatgaattttttcagtccaatcatggcggacacacaccttacaaggcagcagatttatgaccggattcgagagagctctaaggatgaatatattctggaggaaatgaagcgccttggtttctggaaatccaaggaaagcagcagcatcgtaccagagttaatgatcaaaaaagagactggactccagcaagagctgaatcgcctctttgagcaaaaacggaaataccagaataaggaagccgttcttaaggaaatgagacagaaacggatggaggaggccaaacggaaacgggaagagactaaaaagaaacgcgagcaacagcgcgctgataaagccgccgcgtggcagaagaagaaggaaacatcgattctatacgctggcgagaacgtgagcgctggcatgaactcaactgagacaaagccagatatcctgcaaagatatgggttgcctttgtttaccgatgagctgagcttggcagccggccttggaataaccatcaacgagctcaggttcctgtccttctcgcgaatcgtctctaccgtaagccattacagaaagttctacctaccgaagaaatccggaggcaaacgcctgatcgctgccccaatgcagagattgaaagaagctcagtatcatgtcctggagcaagttcttaacaaggtggttctccatgatgcagccaacgggtttgtcaagaagagaagtatcgtgacaaacgcccaacagcatgtggggaagacattgctgcttaacctggacattaaggattttttcccgaccgtcgactacaagagggtcaagggcgtcttccgcaagctggggtacgcagaaaaaatttctaccctgctagccctgatatgcaccgaagctcccaccgacgaagtgtcaatagacggtaaaaactatttcgtacagaagggtaatagggttttaccacagggcgcccccacttctccagcactgacgaacatactattctacaagtgcgataagcgactgcaaggcttggctgccaagacagggtgcacatacacacgatacgccgacgatatctccttttccactaactccaataccctgaatcctcagcagttaatctggaggattaaacggatccttacagacgaaggctttacggttcaccccgagaagattcgggtgatgcgtcagagttctaaacaggaggtgacgggagtagtggtgaataaaaaactgaacatcgacaggaaaaagatgagacagtttagggcactcatccatactctcaagactaaaggacccgacgcgattcactggggacagagtcacccggcctacgctatccccggctatttgcagttcatcactatggtgaatcctgaaaaaggtgccctcctgaagaatgccctcacacctctgttagataaaattccaaagcctgtgcgtattacccagtcaccccagcccgggaagcccgatacttcaggggaagcacctaaggagggtggcgactggtggaatgtcgtgtga

SEQ ID NO: 13251 - RNA, 1524 nt, unidentified
  source 1..1524: mol_type = other RNA; note = synthetic construct
atggccgacaacaggctgactcggcaacagatatacgatagaatccgttcttccagtaaggaaagctacatcctgtccgagatgaagaggttggggttctggtcagtgaaagacggtgcatcggcagtgagcgaggcactgataaataaggaggcaagtctggaaaaagagttaaaccagctcttggcccagaaccgcaaatttaataatcgcgaggcggtactgaaagagatgagactgaaaagaatggcagaagcccggcagaagcgtgaggaaaataagaagaagcgagagcagaaacgatacgaaaaagctgaagcctggcgagcccggaaacagcaggagatcttatatctgggcgagggagtgagtgccgggctacattatacggacaccaacgaagccttactctgcgaaaaagagcttccggttatcaccaccgagaagcaactcgctgagtacatggggatcgcgctgcaggagctgcactttctcgctttcagtaggcgggtttccaccgtaaaccactaccgcaagttctatcttcccaaaaagagcggagggaagcgcttgatcgctgcgcccatgccccgtctcaaaaactcccagtactggatccttaacaatatacttgctcgcattcctgtccacgctgccgcgaacggctttgtcgcagataaatcaatcgtgaccaatgccagaccacatctcgataaagaggtcgttatcaatatcgatgtcaaggacttctttccttctattcactttgctagagtgaagggtgtcttcgtgaagctgggttattcagagaagatagccactgtgctttccctgttgtgtaccgaaccagtgacacaagagatctcaattgatggacggaattacttcgtacagaaaggtcagagggtccttcctcaaggcgcccctggaagccctgtgattacgaatattctgtgccaccacctcgaccagaggatgcaaggggtggccgccaagcatcagtatacttatactcggtatgccgatgacattacattttctggcagcgaaaacaccctacatgcacaggctctgctatggcgaatcaagaagatcgttcaagaggagggattcacagtccaccccgacaaagttcatgtcatgaggaaaggcgcaagacaagaagtgacaggggttgttgtgaacaagcagctgggcatccagagagagaagctgaggcagttccgcgccctgctgcacaacattaaggtgaagggatgggaaaatgcacagtgggggaacggcaatattattagctctattctcggctacataaactacattaagatgatcgatccggcaaaggccgctgtgttccagcagcaagtgaatgtgttgtttcagcagcccggtttttctgctattcagcagcaagtccagccacaagcctccgcggctgctacaacacatgacccaaccactaatccccagcctgccccaggcaaaggaactgaaggcgacgaaaactggtggaaagtggtatga

SEQ ID NO: 13252 - RNA, 1515 nt, unidentified
  source 1..1515: mol_type = other RNA; note = synthetic construct
atggccgataatagactcacgagacaacagatctatgaccgcatacgttctagctcaaaggaagagtacgtgagatcagaaatgttacggctcggcttttggaccgctaaatctggcaacactcagatcactgaggtgctgcttcaacaggaggcaaccctgacgaaggagcttaatcagcttatgcaagagcgaactaggtatcggaataaggaggccgttctgaaagaaatgcgcatgaagcgaatggcggaggccaggaggaagcgggaagaaactaaacagaaaagggagttgcagcggctggagaaagccgaggcatggaggaagcgtaaacaggacgagattgtctatctgggagagacagtcagtgctggcctccagcccggacagagtaacgaggcccttctcctgcagcggggtctacccgtatttcatactgagaaggagttggccgcagccgctggagtcgatctgcgagagctccgatttttgtgttaccaccgcaaagtgagtgcagttaaccactacagaaagtttctgcttccaaagaagtccggtgggcataggctcatatcggcgccaatgccacgcatcaagaaggtgcaatactgggtgttacaccagatcctgaataaagtgccgttgcatgccgcagccaacgggtttgcaaccggtaggtccattgtgaccaatgctcagccacacgtggggcgtcaggtagtgattaacgcagacgtgaaggatttcttccctagcatccacttcaaaagggtaaaaggcgtgttcgaaaaactgggctataatgaacggatcgctaccatcttggctctgctctgtactgaagcagtcacacaggaagtagtcattgacggcaagacatacttcgtacagaaaggatgccgcgttctgcctcagggagcccctggttcacccgcaatcaccaacatactatgctaccagttagataagcggctgcagggggtggctggcaaacaccagtaccaatatactagatacgccgacgacatcagcttttccggatccgagacaacactggctgctgaggccatggtctggagaattcgcaaaattctgcaggaagaagggttcaccgtgcatccagataaggtgcgaattatgagaaagggcgcccggcaggaggttacaggaattgttgtgaataagcaacccggtatccccagggagaagctgcgcagatttcgcgccctcctgcatcggatcaaaaccaagggctgggaaggggtccaatggggcgaaggcaatattgtgagcgcaatgcttgggtatgtgaacttcatcaagatggtcgaccccgttaaagccgccagattcgaaaaagagatagccttactagggcagctccctgggttcacggaagcgcagaagcaagtgcctttgacacccgcgccggaggctctgcaaaagccttctgacacaaaccctccatctgctccgaacaccggcgaaggagattggtggaaagttgtctga

SEQ ID NO: 13253 - RNA, 1524 nt, unidentified
  source 1..1524: mol_type = other RNA; note = synthetic construct
atggctgataacagactgacccggcagcaaatttatgaccgtataagggaaacctcccgcgacgatttcatcctggaagaaatgaaaaggttggggttttggggaaggggccaagacgaccccagtgtgtcagagctcctgataaagaaagaagtcgagctaggaaaagaactcgataagctgctagccgagcagcggaaatatgataacaagcaggcagttctgaaggagatgcgaatgaagcggatggcagaagccaagcaaaaacgggccgacaataaaaagaaacgtgaagagcagcgctttaataaagctgaggcctggcgacagaaaaaggaaactgagattttctacctgggccaaggagtctcaggcggtttaaaccacactgagaacaatgtggttctcctccagcaaaagggcctgccggtgttttatgacgagcaagagctcgcatcagccgctggaatcgaacttaaagagctcaaatttctgagcttcagccgctccgtctctacggtgaaccactaccgaaaattctatctgccaaagaaatctggggggaaaagactgataagtgcccccatgcctagactcaagaagttacagtactggatcctgcacaatgtgctgcaaaaggtgacattgcacacagccgtacacggattcacaggcaagagatccattgttactaatgcacagcagcacattgcgaaggacgtggtcatcaacgccgatgtgaaagatttcttccctagcattcatataaagcgggtcaagggtatttttaaggcattgggatatagcgagaaaacagccactattctcgccctggtttgcactgagccagtcaccgaggaggtgatgatcgacggaaaaaactactttatccagaaaggcgaaagagtacttccacagggcgcaccaacctccccagctcttacgaacatcatctgttaccatttggataaacgcctgcaaggcgtggcgagcaagcatcagtacacatacacccgctatgctgatgacatcaccttctctgctactggccagcagttgaaggaggaggcactgctgtggagggtgaagaagattctgaaggaagaggggtttaatatccaccctgacaagatccgcatcatgcataaaggtacaaggcaggaggtgacaggggtagtggtgaataaaaagttatccctttcgaggcagaaactgagaaattttcgggccatgcttcacaatttaaagactaagggttacgcggatataaaaaccgggaataaggacattgcagctgttattctcgggtatctgaattacatcaagatgatcgatcccgtaaaggcgctccagtttcagcaacaggtcaaccagctattccagcagcccagtttccatcagcttttgaaggaacaggctgccgctcgtgctgccgttaagcctgtggaaaaaagcgccatgccctcaccggaatctaccacgcctcagcagggcaacggtaactggtggaacgtcaccgagtga

SEQ ID NO: 13254 - RNA, 1527 nt, unidentified
  source 1..1527: mol_type = other RNA; note = synthetic construct
atggcagacaataggctcacacgacagcagatttatgatcgcatcagagagtccagcaaagaggaatacatactagaagacatgaagcggctggggttctggcagcgcaatgaagaagggccctccgtgcccgaactgttgatcaaacgtgagagtactttgaacaaagaacttaactctctgttggctgagaagagaaaatatcaaaacaaggaggccgtgctaaaagagatgcggatgaagagaatggctgaggctaagcaaaaaagggaggagaataaaaagaagcgagagcagcagcgctatgaaaaagcgcaagcgtggcgggctaagagagagactgaaatattcttcctgggggaaggcgtttccgcaggcctgcattatacagagtctaatctcgaagagttacagaagaaagcgctgcctgtttttgagaatgagatgcagcttgcaaacgcgatgggcattgccctcaaggaactgtcctttctgagctatagcaggagagtgtccgcagtctctcactaccagaagttttacctgcccaaaaagtcttcaggaaaacgcctcatttcagccccaatgccacgcttgaagaaggcccagcactggatcctacagcatatcttgtataaagtgcccgtccatgcccaagccaatggctttgtacctggcaaatctattgtttcaaatgcaaccccgcacatcggaaagaacgtggtggtgaatgccgacgtgaaggacttttttccctcaattaccttcaaacgggtgaaagctctctttgggaagctcggttacgccgacaaaattgcaacgatcctttcgctcctctgcacagaaagtgttaccgaagaggttatgctggatggtaagaagtatttcgtgcagaagggagagagggttctgccacagggagctcctaccagccctgccgtcacaaacatcttatgcttccggctggataaacgcctctccggcgtagcaaagaagttcggatgtggttacaccagatacgccgatgatattaccttctccggcacactgaacaacagtgacgcgagcaagattgtatggcacatcaagaaaatattgagtgaggagggcttaacgatccatccagacaagattcgagtaatgcagaaatcagagaggcaagaggtcactggggtggtcgtgaacaggcagctgtcggtcagtcgtgaaaagcttaggaacttcagagcacttctgcaccagctgaaaaaaaacgggcatgaaaatgccaagtggtctgagggaagccttagcaacgctatcgccggttacgctagctttattcgaatggtgaacccagctaaggccgaaaaattcatcaaggagatcagcgatatccgtcaaagtcaaacctggcagcacctgttactctccgaggccgccgcaatagctaagaaactgaatcagcagactctgccttctactccggctcctccacccgccaataataaccggaaggaagacggcgaatggtacaatgtcgtgtga

SEQ ID NO: 13255 - RNA, 1209 nt, unidentified
  source 1..1209: mol_type = other RNA; note = synthetic construct
atggcagataatcaccttacccgccaacagatttacgaccgcattcgagaaagctctcgagatgagtacatactggaagagatgaaaaggctgggattctggaacaaaaacgagagctcgcccaccctacccgagctccttatcaagaaagaaagcaatcttcataaggaactgaacgcactcctggcggaaaagcagaagtttcagaatagggaggccctgttaaaggagatgaggctgaaacggatggaagccactaagttgaagcgggaggacaataagaagaaaaaggagaaggagcgcttcgaaaaaacaaccgcttggcggaagaagcaggagactgagattttttatctgggggaggaggtcagtgcaggccttcactatgctgagaataaccaccctctcctcaatcagaaagccttacctgtttttgagaacgagcagcaactggccctggccatgaactgtacggtcaaagagttggcgtttttggccttttctcgcagagtgtccgagttaacacactaccagaaattttatctgccaaagaaatcagggggcaagagactaatttccgccccaatgccgcgtctgaagaaagctcagcactggattttgcagactatactgtacaaaatccccctgcatactagtgctaatggttttgtgccgacaaaatcaatagtgagtaatgcatggcctcataccgggaagcaggtagtcatcaacatggatatcaaagacttcttcccctcaatctcttttaggagagtgcgcgcactcttcaaaaaccttggctattccgacaaaatcgctacaatcctggccctgctgtgcacggaagcaccaaccgagcaggttgaactcgatgggaagaagtacttcgtccaaaaaggtgaaagagtactccctcagggagcgccctcctcaccagctatcaccaatattctttgctaccggctcgacaagcggctagtgggagttgctaacaaattcaacggcacatataccaggtacgccgatgacataacaatttctggcagcttcgcccataacactgccaccaggatcgtgtggcaaatcaagaagatactgagcgaagaaggattcatcttgcaccctgagaagattcgtattatgcagcaatcccagagacaggaagtgactggtatcgtcgtgaatcaagaaatgagcgtgaaccgatga

SEQ ID NO: 13256 - RNA, 1443 nt, unidentified
  source 1..1443: mol_type = other RNA; note = synthetic construct
atgcagagactaggattctggcctaagaacgataacgctcccacactgccagagcagcttattaaaaaagagggcgagctgcaacgcgagctctcaacactcctccaggaaaaacgtaagttcgaggataaagaggccatgctcgcgcagatgagaaagaagaggatggaggaggcaaagaagaagcgagaacaaacaaagcagaagagggaagctaaacgtatagagaaagccgaaaagtggaaggcatctaaagagaaagagatcatttatctcggggaaaaagttagcggcggattaaacgccaaggaaagcgatgtcccagccttagactccaagggtctgccgactttcaccgaagagacagagctggctcaggccatgggaataacgatttcacagctgaggttcttctgctaccaccggtcagtcgctaccaccactcactacaagcgcttcggcatcaagaagaagtctggaggcatgagaatcattagcgcacctatgcccaggctgaaagccgcccagtattgggtgtttcacaatgtactgaacaaactccgacaccatgaagcagcccacgggtttgtgcgggaacgttccatcttgtcgaacgccaaagaacatctgaataaagaggtggtggttaatatcgacctcaaagactttttcccttccatacatttcaaacgggtgaagggcttgtttcataaactgggctacagcgaaaagatcgctacgatcttttctctgctatgtactgaacccgacgtggaagaggtcgagctggatgcaaagacctatttcgtcgccaaggggaaaagagctcttcctcagggagcgccaacaagccccgccattaccaacctgctttgttacaaacttgactgccgattgcatggagtcgcgaaagctatggggctgtcttacaccaggtacgcagacgacatgactttttcaggcgatggcgaggcagcagccaaggttcagcagctactttggcgcttgcatagaatcattaaagacgagggctttacaatccatccaaagaagattcacgtgatgcgcaaaggtgccagacaggaagtgaccgggatagtcgtaaataagcaaccaggaattaaccggcagaccctgcatcggtttcgcgccttactgaataagatcgagaagaaggggatcgagggtaagaggtggcgcggagggaatgtcatcgcggaaatagcaggttatgccgagttcgtgagtatggttaaacctgctcagggcgtaaaatttaaggaccaagtgaggagaattctgcagcagcccgacgtgattgaacacctccaaaaagctcctttgcaagctgtgcacgcctcccacgctagtaaaccgatcaaggatactcacagtaacagcgatcggaatgagtccagtaagccctggtgggatgttctgtga

SEQ ID NO: 13257 - RNA, 1566 nt, unidentified
  source 1..1566: mol_type = other RNA; note = synthetic construct
atgaatcagagtcagcccgcaactcggcaagaactgtatgagcggataagggaatcgagcaaaaacgaggtcatccgcagcgagatggaacgtttgggtttctggaatcccaatgctccagaacccaaggtcgcagatgactggctgaaagaatacgacaggctcaccaaagagttgagggagttgcggggaaaacaagagcggatgaataacagagacaccttactggccgacattagaaagaaaagaatggccgagtcacgcgagcgccagaaagagacaaagcttaggcgagaacgggagaggatagaaaaagcggagcgttggaagaaactaaaggaagaggacatcctataccttggggaggatgtgtccactcagctgaataagaaagaacccagaccagatctcctggccgaaagacagctcccaaactttgtgaacgccaaggcactcgctgcatctatggaagttccgatcggagagctgaagtttctcgcctataatcgtaaggtgagtaaggtatctcactacaaacgcttcttcatgaaaaagaagtcaggcgggcagaggttaatcagcgcccccatgccacggctgaaacgcttacagtactggatcctacactccatattgtacaagatacctgtccacgaatgtgtgcatggctttgtccctgaccgatccattaagaccaatgctgccccacacgttggccaggatgtggtggtgaacattgaccttaaagatttcttccctactgtctctcagtcccgggttcagggcctctttaacgctctgggctacagtaatcaaattagcacaatctttagccttctctgcacagagccggaggtgcagcaggccaaactggatggagaatcatggtttattcatcaaggagagcgccatctgcctcagggtgcaccaacgtcccctgcaatcaccaatctgatttgctatcgcctggactgccgaatcaagggggcgactgacaagctggggttcaattacacacgatatgctgacgacattacgctcagtgccagtggggaagccgtgagcgatatctgtagactgatctggcaggtgagaaagatcatcgaggaggagggctttaatttccaccccgataagtttagggtaatgcggaaaggtcgcaggcaggaagttaccggcttggtggtaaatgagacactttctatcaacagaaacaccctgagacgtttccgcgccctcctgcatcagattgagaaatcaggcatcgagggcaagtcgtggcaagggaactccgtcaaccttctgaacagcattcaggggtatgctgactttgtcgccatggtgcgacctgaaaagggtcagctgctgcaagctcgggtaaaggcaattaggatggtgcagaaacataagaggagagccaagcccgaggctaagcctaaaatacctgctccgctggttccaattaacaaagcgaacgaactttctcacgcgggatcagatcaaaccccaaagtctagctccggacccaagcccttctggaagaaactcttattctggttggattga

SEQ ID NO: 13258 - RNA, 1548 nt, unidentified
  source 1..1548: mol_type = other RNA; note = synthetic construct
atggccgacccggacccgtcccagccttttaggcccctctcccgccaggagatatacgatgcgatcaaggcaaccagcaagcaggagttcattctggatgatatgatcaggttgggattctggatgcccgagcagggcaatcctgccgttccagacgcaataattcgacgcagaggagaactgaatagagaacttaacgagctactgcataagcaacggcggttcgagaatcgggaggctgctcttgcggcgcaccggaaaaaacgcatggccgagagtaaggttaggcagaaggaaacaaaggaaaggaatgctcgactgcggcaggaaaaagcagagcggtggagggagagaaagcagcgcgagattttgtatctgggtgaaggcgtctccgggggtctgtctgagctacagtctgtgcccgagcggctgtcacggcatcaacttccagatttcgcaaacgctgaaactctcgcgtcggcgatgggtattacactcggggagctgagttttttagccttccaccgcgaggtgtcaaaaacaacccactatagacgctttgccattcctaaaaagagtggcggcgagagaatcatcagcgcccctatgcctaggctgaaggctgctcagacctggatcctcgagaacttgctccagaaggtgagcgtgcacgatgccgcccacggctttgtacccgacaggagcattattacgaatgcctccaatcatataggcagagacatagttatcaacgtcgacctccaaaacttcttcccaagcgtgactcaagccagaacaaaaggcttgtttaagagtctgggatatagcgaacacatcgccaccatcttgagcctgttatgtacagagcctgagatggatactctggagctggacggtcagatttggcacgtggccatgggggggcgttttctgcctcaaggctctcccgcatctcccgccattacaaacatcttatgcagaaagtttgacgcacgcctttctggaatggcccggaaactaggcttcacttacacgcgttacgccgacgacgtcaccttctcagcaggcggagaaactgtggaaaagtataaaaccctcctgtggcgcgccaaggctattatccatgaagaaggcttcatcgtccatccggataagctgaggataatgcgccttgggtcacgacaagaggtgaccgggctgatagtgaacaaggctattggaattccacgagaagacctgcgtaggttccgagctgttctgcggcaggtagaacaggatggtccagcaggaaaaaggtggcacggctccgggcataatatccttgctgtcctcggagggtacgtaaactttatccatatggtgacccccgaaaaagctgcccccttacgtgagcgagtgcttgcactccagtccaaacacggatggcagcgggagatcagacacagacctagagccctcgcaccagaagctgggaatccagccgcaaggtctgctgatggtggcgggttctttaaatcgatcttgcgcaaactgggctttggaaagtga

SEQ ID NO: 13259 - RNA, 1503 nt, unidentified
  source 1..1503: mol_type = other RNA; note = synthetic construct
atgagaaatagcacagagcggaggcaggagatctacgataagatcaaagcatcatctaagcaggagtatatcttgagcgaaatgaggcgcctcggcttttggaatgaagaggatctggactttgaagctgtcaatttgttctttaaacaggaatctgagctgtctgcaaaactccagaagcttctgagagaaaagcgtgtcatcgaagatcctgaagctttcttggccaagaaacaccaagagcggaaaatcgcttctaaagcttctcagaaagagactaaggaacgcagagagaagaccagattggagaaagccgaaaagtggagggtgagcaaagcaaaggatattgtgtacttgggagagaattactctcaccagctcaatgacaaaacttccgatgcatcacggctgaaagcgcaatccctccccgtgatgcatcacgctgaagacttagcactggccatgaagattagcatcggggagctcagatttctgtcatacagcaggaagaacagcaaaatctctcactacaaacgattccaggtcgccaaaaagacggggggatatcgcctaatttccgcaccaatgcctaagctgaaaaaaactcagcactggattttagaaaacatactgaacaacgtgcctgtacatgagaatgcccacggctgcgtgattggcaagtcaatcaaaacgaacgccattccccacgtgggtaaagacgttgttatcaatcaggacttcaaaaacttcttcccatccgtcacttacaacagaatcaaaggtgtctttaagtcccttgggtactcgaaccaggttgctacaattctgtctttattgtgcagtgaacccaagatccttgacataagtctcctgggagaggattattacgctcagcaaggagagcgatttctaccgcagggcagcccatgttcgcctgcaattacaaacatcctatgtaaaaagctggatcatcgcctttccggactggctaagaagtatggctttgaatacacccggtacgttgatgatattaccttctcatccaacaacaacaatttcaagaagattacccccctccttaagtattcccgttacatagtgaatagcgagaacttcaaactccatccagagaaactgcgagttatgaaacggaatgccaagcaggaagtcaccggggtggtagtgaacgaaaaagcgaacatcagcaagaaaagtctgaagaggtttcgtaccctgctgtttcaaatcgagaaggacggaatagagggtaagttctggaacaagagtgggaacgtgcttgcccaaatagacgggtacgccaatttcatttatcagatagaccaggacaagggcgtagtgtataagaagagggtcaatgccatcctggagacatataagtataaggagaatcatcgcagtaagtatatctcaaataccaataagggctccgcgagttcatttggccgcttcgtgaaaaaaattgccagcctctttcggaagtga

SEQ ID NO: 13260 - RNA, 1521 nt, unidentified
  source 1..1521: mol_type = other RNA; note = synthetic construct
atgaggaacaattcaacagaacgccggcaggagatttatgataagatcaaggcctccagtaagcaggagtacatcctgagcgagatgaagcggctgggcttctggaatgaaggcgagttggacttcaaagcagtcaatactttctttaatgaggagcgggaactaagccagaagttacagaaactcctgaaggagaaaaaagtgattgaagatcctgaggcttttcttgccaagaaacaccaggaaaggaaactcgcctcaaaacaatcgcagaaagctactaaggaacgacgggagaaagagagactggaaaagaccgagagatggcgggttagtaaggaaaaggacataatctatctgggcgagaattactcccaccaactgaacgaacagatatctaataccgagcgacttaagagcaagaacctccctgtactgcataccgctgaggatctcgccaaggctatgaacatatccatcggagaactgagattcctttcattctccagaaagaacagtaagatttctcactacaaacgtttccagatggccaagaaaagcggcggataccgcctgatcagtgctcccatgcccaaattgaaaaaagctcaacattgggtgctggagtcagtactgaacatcgtgtctgtccatagcaatgcccacggttgcgtgattggacgcagcattaagacaaacgcagagccccacgtcggaaaggccgtcgtgatcaaccaggactttaaaaacttcttcccctctgtgacatatgcacgaattaaaggtgtatttcttgcgctggggtactccaaccaggtggctaccatttttagcttgctgtgcagcgaacctaagattctggatgtttcactattgggcgaagactattatgcgcaacgtggggaacgctttcttcctcagggcgccccaacttctcccgccattacgaacatattatgtgagaagctcgactttcgcctgaccggcctggcgaataaatacggcttcacatatactaggtatgtggacgacatcacgttctccgggacccatgactctttcgataaaatcacaccgctcctcaagtacagtcgttacgtagttaattccgagaactttaatcttcatcctgaaaagttgaggatcatgaagaggaatgcaaaacaagaggttacaggcgtggtggtcaacgaaaagaccaatatcccaaaaggggatctgaagaggtttcgggccctcttatttcagattgagaaggacggaattgaaggtaaatattggaccaaggggggaaatgtgctggcacagatagatggatatgctaattacatcttccagattgagccggagaagggggtcctatacaaaaagagagtgaatgtcatcttggagaagtataactacaaggaaaagcacaaagcaacttacgtgccaaaggtgctcgataaaagagagaaagccaacaagccagactccgttgggggtatctttaacaaaatcatgtcgttctttcgcaaatga

SEQ ID NO: 13261 - RNA, 1503 nt, unidentified
  source 1..1503: mol_type = other RNA; note = synthetic construct
atgaaaaactccactgagaggcgacaggaaatctacgacaagataaaagcatcaagcaagcaggaatacatactctctgaaatgaagcggttggggttttggaatcaggaggagctggacttcgagtctgtgaacgcatttttcaaggaggagacagagttatctaagaaactgcaaggccttctcaaagaaaaaagggtgattgaagacccagaagcttttttggctaaaaagcatcaggaacggaagcttgctagcaagcagtcacagaaggaaaccaaggaaagaagagagaaggaacgactcgagaaagccgccaggtggaaaactagcaaggagaaagacatagtgtacctcggaagcgggtactccaacaatctcaataagaaggaatccgatgtgacacggctgaaaacacagcaattgccggttctcaatactgctgaggatcttgcaagtgccctggggatcacggtcggagagctacgctttctgagtttcacgcggaagaatagcaagatttcccactataaacggtttcagatgccaaagaaatcagggggctacagactgatttccgcacctatgcctaagctgaaaaaggctcagcattggatcctggagcatatcttaaataatgtcaaggtgcacgataacgcccacggctgcgtgatcggaaaatctattaagaccaatgcagtgcctcatatcggtaaagccgtcgtcgttaaccaggacttcaaaaattttttccccagcgtgacctataaccgtatcaagggggtctttatgagtttaggttacagtaaccaggttgcaaccatcctagcgcttctttgttcagagcccaagatcctcgatgtttcactgctgggcgaggactactatgcccaacgtggagagagatttcttccgcagggtagcccctgctcgcctgctattaccaacgtgttgtgtaggaaactcgatttccgcttgtccggcctggcgaaaaagtacgactttgactataccaggtatgtagatgatattaccttcagcggagacaaaaaatccctgcccaaaattacagctctgctgaagtatagtggcaaaatagtccgcgacgagaactttatgctccacccagaaaagctgagagtgatgaagaggaacgctaagcaagaagtgactggcgtggtggtcaacgagaaggccaatattgccaagacttctctgaagcgattccgcgccctcctgcacctgattgaaaaggaggggatcgaaggcaaatattggaataaggggggcaatgtattggcccagatcgatggttatgcaaacttcatctttcagattgatgaggttaagggtgcgatctataaggagcgcgtaaatgccatactggtaaaatacaactacaaggaggaacacatcaaacaatacgccccaaacgcgaaaaaaggaacatcgggattactatctggcttcattaaaaaggtgtcctctttcttcaagaaatga

SEQ ID NO: 13262 - RNA, 1503 nt, unidentified
  source 1..1503: mol_type = other RNA; note = synthetic construct
atgaggaattcaactgagcgccgccaggaaatctatgataaaattaagggctcttccaaacaggagtacattctctctgagatgaaacggctgggattttggaacgagggcgatgtggactttgaagctgccaacgcctactttaaggaggaagccgagcttagtaaaaagttgcaagaacttctgaaggagaaaaggatcgtcggggatccagacgcgtttatcgccaggaaacacaaggagagaaagctcgcctccaagcaatcccagaaggagacaaaggagagacgggagaaagaacgcttagaaaaagcaaaacggtggaaagcaatcaaagaaaaagacatcatctacctgggaacaagctacagtaataacctcaacaagaaaatcagcaacgtggagaagcttcgaagccagaatttacccgtgttacagaccgctttggacctggcatcagctatgaatataaccattggcgaactccgctttctggcattttcaaggaaaaatagcaaaaccaaccattacaagagattcaaggtgcctaaaaaaacaggcgggtatcgccttattagtgcccccatgcccaagctcaagagagcccaacattggattctagaacacatcttgaatcatgtggtcattcacaagaacgctcacggaggtgttttgaagaaaagcattaagtcgaatgcgattccacacgtcgaaaaggccgtcgtgatcaaccaggactttaagaatttcttcccaacagtgacgttcaatagaatcaaaggagtcttcgtttcgtttgggtacagctctcaagtatccactatccttgcgctcctgtgctccgagcctaaaattcttgatgtggagctgctgggggaaaagtatttcgcccaacgaggagagaggtttctgcctcaggggagcccctgttcacctgctattacaaacattctatgcaagaagctggactaccgtctcaccggtctggccaaaaagtacggcttcgactacacccgatatgtggatgacataactttctcaggcgataagcattccttatctaagatcaccccactgctgaagtatagtcggtttatcgttaacgaggaaaatttcaaactgcatccggaaaaactgagagtcatgaaaaggaactctaagcaggaagtgaccggagttgttgtaaacgaaaaaccgaacatatcaaagaagagcctgaaacgttttaaggccctcctgtttcagatagagaaagacggcatagaggggaaattctggaacaagggtggaaatgtcttggcacagatcgatggctatgctaacttcatatatcagattgactctgagaagggtatgctctacaagaagcgggtgaaggcaatcctggattcctataattacaaggagaatcaccggaaagcttatgtattgaattcccagaagactgggattagcgtgggccgtctattcaagaaaatcacgagtttcttcaagaaatcttga

SEQ ID NO: 13263 - RNA, 1509 nt, unidentified
  source 1..1509: mol_type = other RNA; note = synthetic construct
atgacggatagcaaagaaaggcgtcaggctatttacgacaaaatcaaggagtcttccaagaacgaattcattttatccgagatgaaacgcttgggtttttggtctgatgaaaacgtagacttcggagcggtcacaaagttcttcaaagacgagggggaactgtctaagaagatacaggagaagctccgtgataaaaacatcctggacaatcctgaagtctttatagcccaaaagcataaagagcggaaactagcctcgaagcagagacagaaagaaaccaaagagaagagggaaaaggtgaggcaggagaaggccgccaagtggcaagagtccaagaaatcagacataatctatcttggggaccagtactcccaccagcttaatcagaagctctcgctcgtggaacgcctgaaaagtcagggactaccagtgattcaaacagcagccgaattggccaagaacatgggagtgtcagtaggtgagctgcggtttctgacttactcacgcaagaacagcaaaatcagtcactataagcgatttaaggtgccaaagaaaagcggcggttatagactcatttctgctcctatgccccgcctgaagcaggctcaaacttggatccttgaggaagttctgaataaggttaaggtgcatgagagcgcgcatggctgcgtcacagggaaatctataaaaacaaacgccgagccacatgtggctaaagcagttgtcatcaatcaggatgtgaagaactttttcccctccattacctataacagaattaaaggcgtgttcctgtctctgggctattcacaccaggtcgccgtgatcttcgccctgctctgtagcgagccaaaaatagtggacattgatctcctcggtgaagattacttcgcgcagaagggggaaagatttttgccccagggaagcccttgtagtcccgctatcaccaatatcctgtgccgcaggctggattttcggctgactggcctggctaagaaatataaccttagctacacccgatacgtggatgatttgaccttcagctctactgagtaccctgaccactccgtagtgaccaaagtgctgaaatactcacgcctcattgtcaaggacgaaaattttaggctccacccggacaagctgagggtgatgaagaaaggagcccggcaagaggttacgggcgtggtcgtcaatgagaaacctaacgttagtaagaagacactgaagagatttcgtgcactattgtttcagatcgaaaaggatggaatcgaggggaaacagtggaacagaccagggaatgtattagcacaaattgacggcttcgctaatttcatttaccagatcaatcccgagaagggcgcacggtataaagcacaggttgccgttatcttagtgacacacaactacaaggagcttcataaaaaggctttcccccctaaaagtaacccgaccaacgagactccacaaaatcgattgtggtcccgggtcaagtccttctttaagaaaaattga

SEQ ID NO: 13264 - RNA, 1512 nt, unidentified
  source 1..1512: mol_type = other RNA; note = synthetic construct
atgaaaaactcacaggaacgccggcaggagatttacgacaagatcaaggagagctcaaagcaggagtacattctcagcgagatgaagagactgggattctgggatgatcagcaggtggactttaaggaagcggaggccttctttaagttagaatcaggcttgagcaaagaactccaagttttgatcaaagagaagaacctgatcgacgaccccgccgctttcctcgccaaaaaacaccagaaaaggaaactaaagagcaagcagaaacaaagagagacaaaggaaaagcgggaactcctgcggctggagaaagccgagaaatggcagctgagcaaaaaggaggatatccggtatctgggagacggcttctctcatcaactcaacgatcagacgtcccaggtggatcgacttaagtccctggatctgcctcttttgaacaatgcaaaggaacttgcccaggcaatggacatccccatcggggaactgaggtttctttcgttttcgcgaaagaatgctcggctgagtcactacaaaagattcaagatgaagaagaagtcagggggttttagactcatctctgctcccatgcctcgcctgaagaatgcccagtattggatactcgaggagatccttaataagatagcggtccaccccctggctcatgggtgtgtgataggtaagagtatcaaaactaatgctgagccacacctccagaaagcagtggtgattaatcaggacttcaagaacttcttcccttccattacgcacaatagaatcaagggcatctttaagagcttcgggtattctgaacaattagccactatcttctcccttctatgctcagaacctaagattgtcgaggtgagcatgctgggagaagattacttcgcccagaggggtacccgatttttaccgcagggtgctccgacctcccccgctataactaacatcatctgcaagcagctggacttgagactgcatggcctggcaaaacattatggtttcgattatactcggtacgttgacgatataaccttttctgggaatcaagagcagctgccaaaaatcgcagcaattctcaagtactccaagaagattgtggaagacgaaaacttcacactgcacccagaaaaattgcgtattatgaaaaggagcgatcgccaagaggtgacaggcgtggtagtcaacgagaaaaccaatatcccaaaaaagaaccttaagcgctttcgtgcattgctctttcagatcgagaaagacgggattcaaggcaaggtctggaataaaaaggggaacattttagcccagattgacggctacgctaacttcatctatcagatagatacagagaaaggcattgcctacaagaagagggtcggactaattctgaaagcgcacggatataaggaggcccatcaatccaaatttggaaggcgcagtaaggattctagtacaagttggtttacctctctggtatccaaagttaaagacattttcggatctggcggcaaatga

SEQ ID NO: 13265 - RNA, 1452 nt, unidentified
  source 1..1452: mol_type = other RNA; note = synthetic construct
atggataacagcgctaccaggaaacaggagatctacgacaaaattaaagagtcgtctaagcacgagttcattctaagcgaaatgaagcggctgggattttggggggatgacaatgtgaatttcgacaaggtgaatgatttcctgaaggaggagaatgctctgtctggcgatttgagtaagcttctcaagaaagagcggctcataaaagacacagatgcattcatagccaacaagcacaaggaacggaagaagctctccaaagaaaaacaaaaagaaaccaagctgaagagggaacagatcaggaaagagaaggcggaaaagtggcagcaaacgaagaaagaagacattacttatctgggggccgggtactcacatcagctgaacgacacccagatcgatgaggtccgactgaaagaagccggtttaccaatctaccacagcgttaaagacctggccgaggcaatgaagattaccgtgaatgagctgcggtttttggccttctccagaaagaactcccagattgaacattataagcgctttaaagtcgccaagaaaagtggcgggtatcgactcatttccgctcctatgccgaggttgaaaagagcccagcactttattctggagaatatcctgaacaaagtgatcgtacataacaaggcccatggttgtgttaaagaacgcagcattataagtaacgcaatgccccaccttaacaaagctgtggtaataaaccaggacttaaagaacttctttccatctgttacgtataaacgaatcaaaggggttttcaagtcattggggtatagcgagcagctggctgtcatcttctctctcttatgttctgagagtaaaatcctagacatttctcttcttggagaaaactacttcagcaagcgcggcgagagatttcttccccagggatcgccttgctcacctgcaattactaatatcttgtgccggaagatggattatagactagatggccttgcgaaaaaatacggtttcgactatagccgctacgtcgatgatacaacatttagtggcaaccacgaacaatttaagcatattacagccatcctcaagtatagcaagaaaatcatctccgaggaaaacttcaatctgcaccccgataagctcaagataatgaagcgcaatcagagacaggaggtgaccggcattgtggtcaatgagaaattgaatatcgacaagaagtcactgaaaaggtttcgtgccctgctgtaccaaatagagaaggagggcatcgctggaaaaacttggaatggaggcctcaacgtgctcgcagaaattgacggttacgcgaattacatctaccaagtggacaaggaaaaaggagccaaatacaaatcccaggtggctgatattctgaaggcacactcatataaggagtccaagggcatctttaataagatcaactccctgttcaagcgttga

SEQ ID NO: 13266 - RNA, 1506 nt, unidentified
  source 1..1506: mol_type = other RNA; note = synthetic construct
atggataattccgcaactagaagacaggagatttatgacaagatcaaagagagttccaaggacgaatttattctctcggaaatgaagcggctcgggttttggggggataatgaggtggacttcgagaaggcaaacgcattccttaaagaagaaagggagctatcaaataacttaaccgccctggtgaagaaagaaagggcaattgaagacacagaagccttcattgccaataaacacaaggaacgcaaaaagctgtcaaaagaaaagcagaaggagactgcccttaagagagctctgatcaggaaagaaaaagctgctaaatggcagcaaaccaagaaggaggagatagtgtatataggggacgggtactcccaccagctcaatgataccgagacaaatgtggcccgactgaaggagaacgatctcccaatttacgagagcgcaaaagagcttgctgaagctatgaaaattacagtaaatgagctgaggttccttgccttttcgagaaagaactccaaaatccaccattataagcggttcaaggtggccaaaaagagcggcggctaccggctgatttcagcacccatgcctcggctgaagagagcccagcacttcattctggagaatattctgaataaagtgacggtccataagaaagcgcatggatgcgttaaggagcgctcaattgtcagcaatgcagaaatccatgtgaacaaagccgtcgttatcaaccaggacctccaaaattttttccccagcgttacctataaacggattaaaggcgtgtttaagagcctgggctatagtgagcagttggctgttatcttctctctactgtgcagcgagtcaaaaatcctagacctgagtttgctcggagagaactactttacacaacgcggcgatcgctttctgccccagggatctccttgttctcctgctataactaacatcttgtgtaggaaaatggactatcgacttgatggacttgctacaaagtatggatttacctattctcgttacgtggacgatactaccttctctggtaaccaggaacagtttaagtacatcaccgcgatcctgaaatacagcaagaagatcatcaaggaagaaaatttcaagttgcatccggataaattacgaataatgaaacggaacgagcgccaggaggtaactggtatcgttgtcaacgaaaagctgaacataaacaagaagtccttgaaacgtttcagggcgctcctcttccaaatagaaaaagagggtattcaagggaaaacgtggaacggcggtctgaatgtcttagccgagattgatggctacgcaaattatatctaccaggtggacaaaatcaagggagtgaaatacaagagtcaggtgtccgccatcctgaaggcccacagttacaaagagaatcacgtcgctaagtacgcgtctaactccacagaagccgccaacgagcacaaggtaccatccttctttaagaagatcatcagctttttcaagaagtga

SEQ ID NO: 13267 - RNA, 1581 nt, unidentified
  source 1..1581: mol_type = other RNA; note = synthetic construct
atggtgccgatcagcctcgaactattcaatagcgtcttccgggttgtcagacgcgagcttaagtacatcctcctgctacctttttttgtgttcatgagcaattccacagaaagaaggcaagagatttatgacaaaatccggcaaagctctaagcacgaatatattctgtcagagatgaagagactgggcttttggggcgaggataatgtggatttcgaacaggtgaataagttcttcaatgatgagtccgaattgagcaaacagctgaacgaccttctccggaaagagaaatctattgaggacacagaagcatttattgctgctaagcatctggagagaaaacgcatttcaaaagagaaacagaaggagacgaaggaaaagagggagcagcaaagactggagaaggccaagcagtggcagctctcaaagctggaagatatcgtgtatctcggagaagggtattctcatcaacttaacgacaaaaccactgccgacgatttgctgaaacgccaggggctccccatcttgcactctgccaaagacgttgcaaaagccatgaacattacagtggcggaactgcgtttcctggcgtactcccggaagaacagcaagacatgccattacaagcgatttaaggtagccaaaaagtccggcggcttccgattaatctccgccccaatgccaaggttgaagaaagcgcagcacttcattctggaacacattctgaacaaggtaaccatgcatcccaaagctcatgggtgtgttctagagaagtcgatccttaccaacgcacttccacacgtgaataaggatgtggtcataaaccaggacttaaagaactttttccccagtataacttacaaaagaatcaagggtgtcttcaagagtatgggttacagcgaacaggtcagtgtgatatttgctctgctgtgctcagagcccaaaatcctcgacgtaacgctcctgggagagaactactttgcacagcagggcgataggttcctgccacaaggctccccttgtagtccagctctgtccaacatcatttgcaaaaagcttgattatcggctcgatggccttgcctctaagtacggattcatttattcccgatacgtcgatgacataaccttctcggggcctaaagctcagttttctaagatccccgccctgctgaaatacagtaacaaagtcgtgaaagccgagaattttattttacaccctgagaagctccgcttgatgaaacgtcatcagaggcaggaagtgaccggggtagtggtgaacgagaaaccgaacattaataagaagagcttgaagcggtttcgcgcattgatctatcagatagaaaaggacggaatcgagggtaaaacttggaatggtggactgaatgttctggcagaaatcgacgggtacgccaatttcatctaccagataaacaaggagaagggcaagccttataaagagagggttgcttcaattttagttgcccacaattacaaggaggcacacaagcaaaaatatgtgaaagctccccccaaaaaagaaggattcatcaagaagctcttttcttggtttaagttgtga

SEQ ID NO: 13268 - RNA, 1515 nt, unidentified
  source 1..1515: mol_type = other RNA; note = synthetic construct
atgtcaaatagcacagaacggagacaagaaatatatgataagattcggcaaagctcaaagcaggagtacattatatctgagatgaaacgcctggggttctggggggaagacaatgtggatttcgataaagttgacaggtttttcaagaaggagtccgagctgtcaaaacagctccacgatctgctcaaaaaagagaaatcggttgaagacactgaagcatttatcgctgctaaacatatagagcgcaagcggattagtaaagaaaaacagaaggagacgaaggagaaacgagctttggagcggatcgaaaaagccaaacgatggcagctgttgaagaacgaggacatcatttatcttggggaaggttactctcatcagttaaatgataagaacacagccaccgacctgctgaaagcccagggtttgcctgttctagaaagcgctaatgatatcgccaaagctatgaaaatttctctgggcgagctgcgttttttggcgtatagccgaaagaactccaagacatctcattacaagaggttcaaagtcgctaaaaaatctggaggtcacagactgatcagcgcccctatgcctaggctcaaaaaggctcagcactacattctcgagcacatcctgaataagatcaccatgcacccaaaggcacacgggtgtgttcttgaaaagagtatactctctaacgcactaccacacgtaaacaaagatgtcgtgatcaatcaggacctgaagaatttttttcccagtattacctacactcgcataaagggagtatttaaggcaatgggctacagcgagcaggtgtcaatcattttcgcacttctgtgctccgaacccaaaatcctcgacatctccctgcttggagaacattatttcgcacaacagggtcaccgcttcttacctcagggatctccatgtagccccgccatcactaatatcatttgcaagaagatggactatagattggatggactgggctccaagtacggatttacctactcgagatatgtggatgatattacattttccggggacaaaaaccagttctcaaagattaccgccctcctaaagtactccaaaaaaattgtcactagtgagaactttacgctgcatccggacaaattgcggattatgaagaggcatcagagacaagaggtcacaggcgtcgtggtgaacgagaagcccaacatcaataaggtgagcttaaagaggtttcgtgctctgatatatcaaatcgaaaaggacggcattaagggaaagacttggaatggcggggcaaacgtgcttgccgaaattgagggctacgccaacttcatctttcagatcgaccaggaaaaaggcaggggcttcaaggagcgcgtggcgaagatcctcgcgcaacacaactacatcgagaagcatatagtgacctatgccaaggagaaggtagtggtcgccacctccagtgacgccaaacccaaggatacattcctgaaaaagctcttcagcatcttcaagaaatga

SEQ ID NO: 13269 - RNA, 1542 nt, unidentified
  source 1..1542: mol_type = other RNA; note = synthetic construct
atgtatgaaggaaataagatccatcttatcgccacatttttcatcccctacacaatggccgacagcgcaactcgacgccaggaaatttatgacaagatcaaggagagctctaaagaccagtacatcttggaagaaatgaagagactagggttctggaacgagggacaggtcgactttgaaaccgtgaatcagtattttaaggaagagtctgaactgtcccagcagctgcaaaaacttttgcgggagaagagactggtcgagaaccccgaggcctttctggcacaaaaacacaaagagcgcaaactggcttcaaaacagtctcagaaggagacaaaggagaagagagagaagctacgacaggaaaaggcagatagatggaaggaaagcaaggaaaaggatatactcttcctgggggccggatactcgcacacccttcacgacaagtcaaccaagcaggatcgcttacaacaagagaaactgccggttctccagaacgccgaggatgtagcaaaggctatggacatttcgataggccaactgaggtttctgtcctttagtcggaaaaactctaagatcaaccactacaaacgatttcagatcccaaagaaaactggtggctttaggtacatatccgcacctcagccaaaactcaaaaaagctcagcattggatcttagagaacatcctgaataaggtgactatgcaccctcaagcgcatggctgtgtgatcggtaaaagcatcaaaacgaatgccatccctcacgtggcgaaggatgtagtcatcaatcaggacctcaaaaatttctttccctccattgtttacccccgcattaaaggggtgttccaaagtctggggtacagcgaccaggtcgccacaattttcgctctcctttgttcagagccgaaaatagttgagatttccgttctgggcgaggattactatgctcagcggggtgaaagattcttgccccagggctcaccttgcagcccagccattactaacattatatgccgtaagttggattaccggcttgacggtctagccagaaagtatggattctcctatacaaggtacgtggacgatttgacgttcagcggcgaaaaggaccaatatgcacatatcactaatatgctgaagtacagtcgcagggtcgtgaaggaagaaaatttcaccctccatccagacaaactgagggttatgaaaaagggagtgaggcaggaagtgaccggcgtggtggtgaatgagaagccaaacattgacaaaaaatctctgaagcggttccgggccttactgtatcagattgagaaggatggcctcaaagacaaggtatggaccgggaaggcggatcttttgtcccaaattcacgggtacgctaattttatcaaccagatagatcaggagaaaggcaaaaagtataaggagaaggtcaacatcattctcgagaggtataactacaaagataaccaccgcaaacagtatgtgaagacctttgtcaaacctaagggactgatgagtaaactccgttctttcttcagaaagtga

SEQ ID NO: 13270 - RNA, 1497 nt, unidentified
  source 1..1497: mol_type = other RNA; note = synthetic construct
atggctgatataagacagcagctgtatgaccgcattaaagccagcactaaagagtccgttatcctggaggaaatgaaacgtcttgggttctggaaacaggaaaccggcgttcccagcctacctgaacaattaatcctccaggaagcagacctcacgaaggaattgcaatctctgcttgagcagcaaagaaagtaccagaacaaggagcaggcactgaaagagatgaggaaggctcgcttagagaagtcgaaactgaaaagagaggaaaacaagaagctaagaaagcagaaacgggaggaaaaagccgctcggtggaaggccacccaggaaacagatattatctacctcggggaggatgtgagtaaaggtctgaacaacaaagagacagatgtcgccaagatcaatacccatcagttgccaggcattacgactgtcgaagagcttgccaaagctatgaatatctctgtgggaacagtccgatacctttcctataaccggatcatttcaaagactacgcactacaagagattttacatacccaagaaaaccggcggaaagcggctgatctcaactcccatgccaaagttgaagcgagctcagtactggattctcgagaacatcctggaaaagattgccattcaggacagcgcgcatggcttcgtgaaaaagaagagtattgtgagtaatgctttgccccatgtaaaggctgaggtggtagtcaatatcgacatgaaagatttctttcccaccattacttaccctagggtgaagggagtcttccaatccttcggatattccgaacagatcgcgacaatcctggccctcatgtgtaccgaggctgaatgcgatcaaatcgatctggacggcataacctactatgcggcaggtttagagaggtttctgcctcaaggcgcgccaacatcaccagcccttaccaatatcatatgccgtaaattggatgcacgcctgaaggggattgccacaaagttcaacttcaactatacaaggtatgccgatgacctgaccttttcagcctccggggaagcaactgcccacctcaagacactcatggggtttattaaacgcatcatcaaggaggagaatcttcacatacacccggacaaggtgagggtactgcgtaagggggcccggaaggaagtgaccggtatcgttgtgaatgaccgccccgctgtcaacgcaaaggagctagaccgatttcgcgctctgctgtttcagatagagaaggacggcctcgatggtaagcattggaaaggatctaataacctgctggcaagcattaagggatatgcaaatttcgtgctgatggtggacccaatcaaaggcaaacctctcatggaaagagttagtaaaattttgagcactcacgagttcaagcatgtgatccggcacaaaccgaaatctttactcgccaatgagccagagaaacctaaaaacaccgaggaacagagcaaaaagccttggtggaggttttggtga

SEQ ID NO: 13271 - RNA, 1488 nt, unidentified
  source 1..1488: mol_type = other RNA; note = synthetic construct
atggcagacattcgtcagcagctctatgaccgcattaaagcgagcacaaaagacagcgtgatactggaagagatgaagcgtctcggcttttggaagagggatgtggggatgccatctttgtcagagcaaatcatcctcaaagaggcagacctgactaaggagctgaatgcacttctagagcaacagcggaggtatcagaacaaagaacaggctttgaaggagatgagaaagtctcgtttggagcagagcagagccaaaagggaagagaataaaaagcgaagaaagcagaagcgagaggagaaggcagcccgctggaaagcatcaaaggaaacagatatcatctatctgggagacaatgtgtcgcaggggttgaataacaaggaaacagaccccgcgaaattaacccaacaccagcagccccttgttaccacagtcgaggacctggctaaggccatgaatgtctcagtggggacactgagatacctggcttacaaccgcataatctccaagactacgcactacaagcgcttttatatccctaaaaagaccggcggtaaaaggctgatttccaccccgatgcctaaactgaagcaggcccaatattggctgctggaaaatatgctgaacaaagtcgccacccacgacgcagctcatggctttgtgaggcagaggagcattgttagcaacgccctaccccatgttggggccgaggtggtaatcaacattgatatgaaggacttcttcccaacaatcacttatccccgggtgaaaggtgtgttccgctcctttggctacagtgagcagatagccaccattctggctctcatttgcacggaaccagatgtggatcagatagaattagacggccaaacatactacgctgcgggatccgaacgcctactgccacaaggtgcacctacctctcccgccctcactaacatcatttgtcggaaactggacgcccgacttaaagggattgccacaaagttaggctttaactacaccagatacgctgacgatctaactttcagtgcttcaggagaggccgtaacgcatgtgaaaactctgatgggattcgtgaagaaggtggtcaaggaagagaagctggtcattcaccctgataaaattcggatcctccggaagggtgcacggaaggaagtgactggaatcgttgtcaatgataagccggctgtgaatgccaaggagctcgatagattcagagcgctcctcttccaaatcgaaaaggatggaccacagggcaaacactggaacaattctcctaatcttttggcttccatcaaaggctttgctaacttcgttgcccaggtcgatcctgtgaaagggaagccacttgtagagagggtaaacgccatattggttacccatcagttcaagcacaccatcaagcataaaagcaaagcacaacaggccaagcaggaggcggaacagaagcagaaaagtaaaaaaccctggtggaagttttggtga

SEQ ID NO: 13272 - RNA, 1503 nt, unidentified
  source 1..1503: mol_type = other RNA; note = synthetic construct
atggccgatatccggcagcagctgtacgaccgaataaaggcctcaactaaagagagcgtcatcctggaagaaatgaagaggctgggcttctggaagaaagaagaaggcattccgtccctaagtgaacaactgatagtgaaggaggccgacctgaccaaggagctgaaagaactcctggaacagcagcgaaagtacgagaacagggaagccgcacttaaggaaatgcgtaaggccaggatggcccagtctagagcaaagagagaggaaaataagcagctccgcaagcagaagcgtgaggccaaggcagctcgctggaaagatagtaaggaaaaggatatactctacctaggcgaggacgtgtccaaagggctcaacaacaaggagtctgaccttacaaaattagcaacctacggtttaccagttattcatcacgcagaggccctcgcccaagccatgcagactacaatcggaaacctgcgccacctagcatatcatcggattatatccaaaaccacccattataaacggttctacatacccaagaaaacaggtgggaaaagactcatcagcacgcccatgcctaaactcaaacaggctcagtattggatcctggagaacattttgaacaaggttacccttcacgacgcggctcacggcttcgtcaaaacacgctccattgtgagtaatgctcaaccccatgtgaaagctgatgtagtcattaatatcgacctcaaggatttctttccaagtatcacatacgtgagggccaagggcgtttttaagtcattcggttatagcgagcaagtggctactattttcgccttgttatgtactgagccagagtgcgaccagatcgcaatcgatggcgtgacttactatgccgcttccatggaaaggtttcttcctcaaggagccccgacctcccctgcgattacaaacattatctgcaggaagctggacgctcgtctgcggggaatcgcaacgaagttgaatttcacgtacaccagatatgccgatgaccttacctttagcgcttctggtgatgcagctgctggcactcggaccctgttggggttcgtaaagaagatcattaaggaggagaaattgaacatccaccctgacaagtttcgagtgcttcggaaaggagctagaaaagaggtgaccggaattgtcgttaacgagaagcccgcggtgaatgccaaagaattggatcgctttcgcgccctcctgttccagattgagaaagatggcatagccggcaagcattggaacaattcaacaaatctgctggcttcgatgaaggggtatgcctcttttgtggccatggtcgacgctgcgaaggggaaacctctggtagaaagagtgaatgccatcctggcagcgaatcagttcaagcacgtcatcaggcacaaaagcaaagccatgagagataaagagactgcacaggcacccaaggggtcaggaagctctgacgcgaaaaaaccatggtggaagttttggtga

SEQ ID NO: 13273 - RNA, 1512 nt, unidentified
  source 1..1512: mol_type = other RNA; note = synthetic construct
atggtgggatcgcagaatacacggcagcagctgtacgatcgcatcaaagctagcactaaagaagccgtcattctcgaggagatgaaaaggctagggttttggaagtccgaggaaggtatgccctctcttccagagctgattattgaaaaagaggccgtgcttataaaagaagtccgcgaactggtggagcagcagcgcaaatacaagaacaaggaagaggccctcaaggaggtacgaaaactccgtttggagaaatcaaaacttaagagggaggagaacaagaagacgagaaagcagaagcgggaagagaaggcagcgcattggaaggagcgcaaagaaaaagacattctgtaccttggggagaaagtttctaaaggcctgaacaacaaggagagcgacttagcaaagctgacctctctgcaactgcccgtactccaaaatgctgaagatattgctctagctatggggattccagtgggccaagtgaggtttctctcattccacaggattgtgtccaagacaactcactatcgtcacttttacatccctaagaaaaccggcggtaagcggctcatttcaacccccatgcctcgactgaaatccgctcagtattgggtactgacgaatgtcctcgacaagatcctgatacatgatgcggcccacggctttgtcagaaagagatcaatcgtgagtaacgctctgcctcatatcaaagccgaagtcgtgatcaatatcgacttaaaggacttctttcccagcatcagctacatcagagtgaaaggcttgttccagagtttcggctacagtgaacaggtggcaacgattttgggtctgatatgcaccgagccggagagcgatgaaatagagcttgatggcgagacatattttgccgccaacggagagcggttcctacctcaaggagcgcccaccagtccagccatcactaatatcatttgtcgcaagcttgacgttcggctgaagggaatcgcctccaagctcaatttcaactacacccggtatgcggacgatttaacattctccgcctctggcgagtcagccgctagcactaaaaccttactggggtttgttaagaagattatcaaggaggagaacctgaacatccatcccgataagctgagggtcctgcgaaagggggccagaaaggaagtgactgggatcgtcgttaatgacaaaccaagtgttaacgcaaaagaactcgacaggtttagagcattgttgttccagatagagaaggatggaatcggcggaaagcattggaagaacagcaacaatctgttggcatccatgaaaggttatgcctctttcgtagccatggtgaatccggaaaaggggaacccaataaaggaacgtgtgaataagattctcgccgctaaccagttcactcacgttattaagcacaagtccaaagctatgatcgcaaaagacgcagcaaaaaatacaaataccgcttctacaagcgaagtgaaaaaaccttggtggaaattttggtga

SEQ ID NO: 13274 - RNA, 1572 nt, unidentified
  source 1..1572: mol_type = other RNA; note = synthetic construct
atgactaagaatatcctatatacgaccatcttctatacacctatggcaaataccgaaaactcccagccgactagacagcagctctatgagcggattaagtcatcaggacgtaacgcggtgatcctggaggaaatgcagaggctgggcttttggaaatccgacgaaggtgcttctgttattcctgagatgcttatacataaggaggctgatttgatcaaagagctcaataagctgcttcaacaacaacgcatttatcagaatcgcgaggaagctttaaagaaggtcaggcaggctaggttagagcagagccggaagaagcgcgaggaaaataaaattctccgaaaacagaagagagaagctaaggctgcgagatggaaagaactccgtgacaagaatattatatacctgggcgagaaggtgtccaagggcttaaacaaccagattagcgagaacagtaagctcctaaagtaccagctccccgtcctgcagacagccgaagaactgtctgcggccatgaagatcacaataggggaattgagatttcttagctataaccgtacgatttccaaaatcaaccactataagcggttctatatccctaaaaaaaccggggggaaacggctcatctctaccccgatgcccaggttgaagaaagcccagcactggatactcgaaaacattctgaacaagatcgaccccacagagtcagcccatggcttcgtgaagaagaaaagtattgtgagcaatgcacttccacacgtaaaggctgacgtcgttgtgaatattgacctgaaagacttttttccctccatcaactacagacgggtgaaaggcttgttcatcgcactgggttacagcgaacagatttctactatcttcgccctgatatgcacagagcccgattgtgatcaggtcgagttagatggcgaaacttactacgcagcgggaagtgaccgcttcctcccacaaggtgccccaacgagcccagctatcaccaacctgatatgccgaaagctggaccttaggctgaagggaatcgcatcgaagcttaattttaattacactcgctacgccgatgacctcacctttagtgcctccggagtagcaacatctaacactagtacacttctggggtttgtgaaaaagataatcaaagacgagaagctgtacatcaaccccgataagctgagagtgcaaagaaagggcgccaggaaagaggtaactgggattgtcgtgaatgataaaccatcagtttgtcgcaaggagctggataagttccgagccctactgcatcagattgaaaaagagggaaccatcaaaggcaagcactggaataattccaacaatctgttggcaagcattaaagggtacgccaatttcgttaagatggtgaatcctgagaaaggaaaacctttggaggaaagggtgaagaaaatcctggaggcccaccggtttaaacacgtgatcaagcataaaccgaagaaacagtctgccaccaccaacgtcgttgattcaaagcctgctaaccaaccagaagcagagaacaaaaagccctggtggaaattctggtga

SEQ ID NO: 13275 - RNA, 1497 nt, unidentified
  source 1..1497: mol_type = other RNA; note = synthetic construct
atggctgattcccagagtacaagacagcagctgtacgaccgtataaagaattcgtcaaaggacgctgtagtgctggaggagatgaagcgcctagggttctgggccaagaacgagagtgccccctcgttgccagagatcctgattcaaaaagaggcagcccttgtccaggagctgaggcaactgaccgagcaacagcaaaaactgaaagacaaacaacaactcctgaaggaggtccgcaaagcgcggctggaaaaaagcagagcaaagcgtgaagaaaacaagaaattgaggaaggaagcacgagaggccaaggccgcccgttggaaagagaagaaggagaaggatattgtctaccttggcgccaacgtgagcggaggactgtcacatactgccagcgacgcgacccttttaggcaagcaccagctccccatctggaactctgtggaagaacttgcaagggacatgaaggtgaaagtgggagaactccggttcctggggtttaatcgcgctgtgtcaaaggttaaccactataagaggttttacattccaaagaagactggcggtaaaagactcatctccgccccgatgccgcggttaaagacagcacagacatggatcttggagactattctgaataaggttgcccctagcgagcaggcccatggttttgtcctgaagcggtccatcgtatccaacgctttacctcacgtgaaggctgatgttgtcataaacattgaccttaaggacttctttcccagtattcattatccacgcgtgaagggcgttttccagagcctgggctattctgagcagctcgctacactcttcggcttgatatgtaccgagcccgactgcgacactgtggagctggatgggacgacatactacgtgtctaattctgaacgctttttgccacagggagctcctacttcacccgccattaccaatattctatgcagaaagctggatgctcgactcaaggggatctctaccaaattaaacttcacctatacaaggtacgctgacgatctcacttttagcacctccggcgagcatgtcaacaaaaccaaaacactcttgggattcatcaaaaaaatcatccgggaagaaggtctggtgatccatcccgataaattgagagtccagagaaagggtgctaggaaggaagttaccggcctggtagtgaatgataaaccttctatagcagcaaaggaactggataaattccgagcccttatttatcagatagagaaggacaaaacgctgcagggaaaacactggaagaattccccccacctgctcgcaagcatgaaggggtacgcaaatttcgtggcgatggtggatccagcgaagggcaagccactggtccttcgggtgaacaaaatcctagacgaacacgggtataaacacgttatcaaacacaagcctaaaccaaaagtcgtggccgccagtgagcagcctgtacctgccaaaaagccctggtggaaattttggtga

SEQ ID NO: 13276 - RNA, 1515 nt, unidentified
  source 1..1515: mol_type = other RNA; note = synthetic construct
atggctgataacagccaggtaacacgccagcagctctatgatcgcattaaggctagtactcgcgattcagtcatcctcgaagaaatgaagcgtctggggttctggaagaaagacgacgggattccatccctgccagagatactgatcacaaaagagtccatactgacacaggaactacatgtgctattggaccagcagaggaaatataaaaataaggaggaggcccttaaagaaatccgcaaagcaagactagaacaatctcgactgaaaagagaggagaacaaaaagcttaggaagcagaaacgcgaagctaaagccgctcagtggaaggagcggaaagagaaagatattatatacctcggagaggacgtttctaaggggttgaataataaggccagcgatttgaccaagctcgctacctatcagctgcctgaaatgcacatggccgatgagcttgccaacgcaatgggcatcactgtgggtgagcttagatttttggcctataataggaccgtcagcaaaattaaccactacaagcggttttacatccctaaaaagaccggcggtaagagactcatctcaacacccatgccccgattgaaaaaagcccagcattggatcctggaaaacattttgaacaaagtgtcgattgacgaccatgctcacggattcgtgatgaagcgctctattgtcaccaatgccctgccccacgttaaggcagaggtggtgattaacatcgacctgaaggatttcttccctaccatatcctatcagagagtgaaggggctgtaccgtagtcttggctactcagagcaactgtccacgatcttcggcctgatcagcacggagtccgaatgtgaccaaatcgaactcgacggcgaaatctactacgcggccggaattgaccggtttcttcctcagggagcccctactagcccagccatcactaatataatctgccgaaagctcgatgcgaggttaaagggcattgcctctaagctcaattttgcctataccaggtacgccgacgacctgaccttcagcgcaagtggtgaaaacgtcaacaataccaagaccctgttagggtttatcaagagaatcatcaaggaggagaacctgactatacacccggataaattccgggtcctgcggaaaggggctcggaaagaagtgactggagtgatcgtaaatgataaacccgctgtgaatgcaaaggagctggacagattcagggcattactctttcagattgagaaagatggtacactggagggcaaacattggaagaatagtccaaacctgctcgcctcaataaaaggatatgcgtcttttgtggctatggttgatcccattaaaggcaagcctttcgtagaaaggactaacaagattttagagacacacggctttaagcatattatcaagcacaaaccgaagccaccccagacagctgcagcggttcaaacggaagagcaagcagcccagaagaagaagccatggtggaagttctgggcatga

SEQ ID NO: 13277 - RNA, 1506 nt, unidentified
  source 1..1506: mol_type = other RNA; note = synthetic construct
atgtcgaaccagccgaatagacaacaactgtacgaccggattaaggcatctactcgtgatgctgtgatcctcgaggagatgaaacgatttggcttttggaaaaaggacgaagctcagtctatagtgccagaaactcttatcgagaaggaagctgcgttgaccagggagttacgggacctcttagagaagcagcagaggttccagaaccgagagcaggcccttatagaggttcgaagagctcggctggaggcatccaagaaaaagcgtgccgaaaacaagttgttacggaaacagcagaaggagcagaaagccgcacgttggaaagagaagaaggagaaggaaatcatttacctcggggaagacgtgtctcccggactgaacaatgtcagcgctaaccccgataatctaaataagcagaagttacccgtcatcgccaacgccgaagagctggcgaaagccatgaagacaactgtcgcagaactaaggttcctggcctatcatcgcacagtgagtaaaacaacccactatcagcgcttctatatccctaaaaagacagggggcaaaagattgatctcaactccaatgcccaggctgaagtccgcccaacactgggtgctcgagaacattctggagctcccggagattaaagacacagcacatggttttgttaagaagcgctctatcgttagcaacgcggtgccccatctcaaggctgaggtcgtgattaatgtcgatctgaaggacttcttccctagcattgactacaaaagagtgaagggtctatttatctcattgggatattcagaacagattgctatcatccttggcttgctctgcaccgaacccgagagcgaccagatcgagctggatgggcaaaaatactatgtagccggcactgaaagattcctgcctcaaggcgctccaacctcacctgctataacaaatctgatttgtcggaaacttgatgcccggctcattgggataagtaaaaagttgggatttacgtacacccgctatgccgatgacctgaccttctctgcaagtggcgaggcagtaaagagcgttaaaacccttatggggttcattaggaaaatcgtgaaggacgaaaatctgaacatacacccagataagctcaggattctgcgcaagggatccagaaaggaagtgacgggtatcgtggtgaatgacaaaccagccattaacagcaaagaactcgaccgctttcgggccctgctgtttcaaatcgagaaagatggaatcgcggggaaacactggaaaaattcccctcaccttctgccttccattaagggatacgtgaactttatcagtatggtagatcaggagaagggcaaagccctgaaagttagggtcgatgcaatactgcagaagcacggctacaagcatgaaattagacataagtccaagcaacagatcgccaaggaacaggagcgaatcgaagctgaggcagtccaccagaaaaagaaaccatggtggaaattctggtga

SEQ ID NO: 13278 - RNA, 1512 nt, unidentified
  source 1..1512: mol_type = other RNA; note = synthetic construct
atgaccagacaggaaatctacgacaggattaagaatagtaccaaggatgcagttattttggaagagatgaagaaactgggattttggaaagaagacggagctgccgccagtgttcccgagcagctgattcttagggaagccagtttaagaaaagacctgaacgagctgttgcagaaacagagaaactaccaaaatcgggacctggcactgaaggatatgagggccgctcgcatggaagcaagccgcaagaagcaggctgagaacaaactgctcagaaaagaaaaggctgagaagaaggcagcagcctggaaggagaaaaaacaaaaagatatcacgtacctcggggaagccgtgtctacagggttgaacaatgctgaagctaatacagaaaagctgcaaaaatcaggcttgcccctgatcgagtcagcggagaaattggcagccttgatgcagatttctatttccgagcttaggtttgtggcttataatcgagtcgtttccgagataacacactacaagaagttccagctccctaaaaaaaccggtgggtttcgcacaataagcgccccactcccacgtctcaaatcagctcagcattggatcttacaggagatcctgaacaaactgcctgtgcacgccgcggcacatggcttcgtgaccaaaaggtccattgtctcgaatgccaaggagcatctgcagaacaacctccttatcaacatagatcttaaagacttcttcccgtccatccattacccacgggtaaaaggattctttaaggctatagggtactcagagcaagtagcgactattttcgcgctgatttgcactgaatccgaggtggatgagatagagctcgataagaaaacctattatgtgaaatctggggatcgcagtctgcctcagggtgctcccactagccctgccatcacaaatctactgtgtcgtagacttgacgcccggtttgccggcttagcaaagaaatacggctttgtttacacccggtatgccgacgacctgtcatttagcgcgcccgaagaaaagaaggaggaattcaagaagtttattggtttcgtgaagaagactattaaggctgagaattttactctgcacccagataagttcaaagtgttaaggaaaggagcccgacgggaggtaacaggtatcgtcgtcaatcagaagctatccgtttccagcgacaaagtgaagaagtttcgagccctgctgttccagatcgagaaggacggcattgccgggaagcactggaacggatctaccacactacttgctagtatcaagggctatgctagcttcatctatcaagtcgaccctgtcaagggcaaaccgatgctcgagcgcgtgaacaaaatactcgtggctaacgcattcaagcacatcatcgtgcacaagtctaaggcacagaaagaaaaagaagcacccaagaaacaggccggaatcggcgccagcacgaaaactacctctgatacgaagaagccatggtggaagatttggtga

SEQ ID NO: 13279 - RNA, 1437 nt, unidentified
  source 1..1437: mol_type = other RNA; note = synthetic construct
atgaaaaagtttggattttggaacgaaacagaaggacagtcctccctgcccgaacaactgatcatgcaggaggcacggcttagtaaagagttatacgacttgctggagaaacagcgaaagtaccaggatcgggagaaggccctcaaggaaatgaggacagcgcgtctgcagaagagccgcgagaagatagcagagaataagagattgagaaaggagaagaaagaacaacgggcgcaggattggaagaactcgaagcagaaggatatcatttatctcggcccaacagtgtcaaaagggctccagcagacggccgacggagaaagcgataaactgaagcagaagcaactacccttgatccatacagccgaggagctggcatcccagatgggcatcggcattggcgaactgcgcttcctgtcttataaccgtccggtttcaaccgtctctcactatcggcagtttcagatgcctaagaaaaccgggggtttccggaaaatttctgccccaatgcctaaattgaaagaggcccagcattggatcttacactacattctgaataagctgcctgtccacgaaaacgcccacgggttcactcttcgaaagagtatcgtgaccaatgctcaacctcatctccagaaggtgctcttaatcaacatcgacctcaaggacttttttccaagcatccattatcccagagtcaaaggtatgttcaggggcatgggttacaatgagaagatagctacacttcttgctctcatatgcacggaaagcgagactgacgaggttgaactggacgggaagaaatatttcgtgaaatcagggaatagagcactgccgcaaggagctccgacttccccagccattacaaactatctttgccgcaggctggatgctcgactgtccggtctagcgaggaaatatcacttcacttacacccgttacgctgatgatatgaccttcagtttcagcgccgatcaacaagatagtatcaaaacctgtatcggattcatcaaaaagacgattcgcactgaaaactttaacatacacccagacaagttcaaagtgctgaggaaaggcgcacgccatgaagtcaccggagttgtggtgaacaataagctctcagtggacagcaagaaactgaaaaagtttagggccactttgtaccagattgagaagcatgggttgcagggcaagcactggaaccactcccataatctgcttgcctctctaaagggctacgctaactttattaatcaggtagacccagtcaagggcaagatatataccgagagagtaagaaaaatcctggaccagtaccagtaccggcacgagattattttcaaacccaagcccaagccatctcctctcaaagaaatccccaatcctattcctgcccccgaggcaaaaacacgcaagccctggtggaaattttggtga

SEQ ID NO: 13280 - RNA, 1296 nt, unidentified
  source 1..1296: mol_type = other RNA; note = synthetic construct
attgcacgcaaggaaaaaatagaggcagccgccaaggcttgggccaggaaaaaagagaaagagatcgtgtaccttggcgaaaacgtttccgctggactgaacaacctgcaggactcggatgcagagcggctaaagaagaacaatctcacggatatagccagcgcagaacagctcgctgcccttatgaaaatcgagatgggtcagttacgcttcctaagttatcatagagcagtctcccgggtcagtcactacaagaagtttacaattcccaagaagaccggtggcgttagaacaatttctgctccgatgcccaaattgaaaaccgctcagcactggatcctggagaatatcctcgataaaattctcctgcatgacgcggctcacggatttgtgaataagaagtctatcgtgactaacgcaactccccatctcaagtcagaggtggtcatcaacattgatctgaaggacttcttcccttctgttcactacccacgagtgaagggtatgtttcggaaattggggtataatgaggccatctctacgatcttcagcctgatatgtactgaggctgaacaagacgaagtggaaattgacggcgtaaaatattacgtgaaggatggaaacaggaagttaccacagggagctcctacctcaccggcaattaccaacatcatttgcagaaaaatggatgcccgcttcactgggcttagcaagaagtatggctttgcttacacaagatatgctgatgacttaactttcagtgcctcgggcgacgctctcttgaaactgaagcaattcattgccctggtgaagaaggtcatctcctccgaaaggttcactcttcaccctgataagtttaaagtcatgcggaaaggcgcgaggaaagaagtgacagggatcgttgtgaatgaaaaacccgcgatagagaagaagaaactgaagaaattccgagccctcctgtttcagattgagaaagaggggtcaattgcaggaaagaagtggggtaatagcaagaatttgctggccgccataaaagggtacagcaatttcatcaacatggtagaccctgtgaaaggcaaaagcctgatcgaccgtgccaacaagattctggagcagcataagtttgcccacgtgatcgtacataaggccaaacctaaagtcgaacccgtcgttatccagaaaacgaccagtaccgtgtcacaatcccagtacgtgagcacaacaaccgcggcaacacagcaagtagccccagagaagaccgactctaagaagccatggtggaagttttggtcctga

SEQ ID NO: 13281 - RNA, 1506 nt, unidentified
  source 1..1506: mol_type = other RNA; note = synthetic construct
atggccaaccagtctaaaccgaccagacagcaactgtacgacaggatcagacagagctcccgcgatgaggtggtcctggaggaaatgaagaaactcggattttggcctgacggggagggagcccccagtttacccgaacaggtgatccgtagagagggggaactgagcagggagctgggtgatatgctggtacagcagcgcagatattcagatcgggagcagatgctcaaggaaattagacagcaacggatggaggcttcccgacagaaacaaaaggaaaacaaggaaagacggcgacaggagaggcagcagcgtgcagagcagtggaaggcaaggcaggaaaaggagatcttgtaccttggcgaaggggttagcgctggtctgggcgaatctgataacgacgcggctaagttgcggctgaatggactccctgactttattgatatagaatcactggcgcgcgccatggagatcgatgtagcatctcttcgcttcctggcttactccaggcaggtttccaaagtgagccactacaagcggttttacatacagaagaaaaccggaggaaggcgtatgattagtgctcctatgccccggctaaagcaagcccagcagtggattctcttacacattctggagaatgtcaaggtcaacggtgccgcccatggcttcgttttaaataggagcatcgttacaaacgccctgcctcacttgcagccagacctgcttgtgaatttggatttgaaggacttcttccccaccgtaacttacaaacgaatcaagggagtgttcagatcgctcgggtatagcgagaaggtggcttctatttttggcctcatctgtacagagcctgatattactgaggcagagatggacggtcgaacctattttatagcatccggagaaagattcctcccacagggcgctccaactagtcccgccctgaccaatattctctgcaggaggctggacgtcagactcaaagggctggcgcgaaagtacggcttcacatacacacgctatgctgacgatttatcattctcagctcgcggggagggcaaagagaatcttacgaaacttctggggaacgtccgcagaatcataaaagacgaaggctttgtgatccacccagacaagctccgggtgatgcggaagggcagtaggcaggaagtgacgggcgttgtcgtgaatcaaaaactgaacgtctgccggaagaaagtgcgcaactttaaagccctactattccaaatcgaaaaggatggcatcgagggtaagagctggcagggatcctctgacaacctgctggccgtgataaaggggtatgcacattatattgccatggtgaatcccgtacagggtaagcccttggcggagcgtgtggaagcaattcttaagaaacatcactatcgccacatcatcaaacatccagccaagaaacctttcatgcaagcagccgccgaggaggaacctcaaccaaaaaaaaaaccgtggtggaagttttggtga

SEQ ID NO: 13282 - RNA, 1542 nt, unidentified
  source 1..1542: mol_type = other RNA; note = synthetic construct
atggctgatagctcactcaaccgccgtcaggagctgtatgacaggatcagatcttcaagcaaagatcaggtcatattggaggagatgcagaaaatgggcttttggccagacgattcagaggaacctagcgtgccagcgttgtattttaagagagagctagagctatcccaggaactgagagacttagtcataaagcaccgccgttttgacgaccaggcaaagatgctggagcacatccggagggagcgcatggccgagagtcggaaaaagcaaaaagaaaccaaacagcgcagaaggcaagagaggcttgcccgggccgaagcttggaaacagcgcaaagcctctgaaattctgtatttgggcgaaggagtcagtcagggactgcagggggctacacccaaccgagcaagactgacacagcatggccttaccgacattgcttccgtggaagccctggccttggccatgggtatgacagtgggtaagctgagattcctggcctacaatcgagaaatctccagagtctcccattatattagattccacctaccgaagaagagggggggtactcgtctcatttccgccccaaagccaggcctcaaatctgcccagtactgggtgctccagcatattctggaccggatcgaacttcatgatgctgcacatgggttcagaaaggctcgctctattgttacgaatgccaagccccaccttggggcagatctggttgtgaacattgatttgaaggacttctttccaaccgtgaactaccggcgcgttaaaggcctgtttgggggcctggggtactccgagagaatatctacggtgcttgggctgctctgtaccgagcccgatgtcgatgtagtggagctggatggcgagacatggtacgttgctaagggcgaaaggcacttacctcagggagccccctgctcacctgcgataaccaatatcatgtgcaggcgacttgacgctcgaatgcgcggacttgctcaaaaatacggttttgtatatagcaggtatgctgacgatatgacatttagcgcaagtggcgattcgaggaagttattaatgactctgctcggaaatgtgcggcggatcttgaaggacgagaatttcaagctgcaccctgacaagctccgtatcatgcgcaaaggagcacaaaaagaggtaactggcatcattgtcaatgaaaagctcaatgtgagcaggaagaagctcaaaaagtttcgggccctgatcttccagatcgagaaagacggcccagaaggtaaaacctgggaaggcgcgcgagatttgctgcccgccatctgggggtacgcaaacttcatcaaaatggttaaccccgacaaaggggctgagttcgttgcccgggtcaaggccatcttcgatcacctgggcgagactccgccagtaaaacccgtggtggcacaacctgacggaagcgaagtggaagtggaaattctccagggaagtgacgaggatgaggcacctggtgcgactggaaacgaccctgataagccctggtggaagatttggtga

SEQ ID NO: 13283 - RNA, 1458 nt, unidentified
  source 1..1458: mol_type = other RNA; note = synthetic construct
atgtttgagggcttccgagactctcactttcccctgaacgatatgagtaacacagagaactcccaagactcacggttaagtcgccagcagatctatgatcggattcgcgcaacctctaaacaggaatacatactgtcagaaatggtgcgactgggattctggccagattcccaggacgctcctacactgcctgaacagctcatacgccgtgagggagagctgacccgggagttgacggagctgctggaaaaacagagaaagttcgacaatcgggaacaaatgttcaaggagatgaggaagaagagattggaagagtcccaccagaaacaagcagagacaaaagaacggcggcagagagaacgcgatgaacgtgctcgaagatggaaggaactaaaggcacaggacataggatatctaggtgatggcgtcagcggcgggcttcagaataaggaacattccgcagagaggctggcccagaacaacctgcctgcctttgctagcgtggccgagctcgttcaggcaatggggatctccgtgggggagttgaggttcctgacgtttcagagggacgtcagcaaagtgagccattacaaacgcttctacatgccgaaaaaatctgggggaatgcggctcattagtgcgcccatgccacgattaaaagccgcccagcactgggtgctcgaacacctcttgcagactgtgccacttcatcccgctgcgcgaggttttagatcgggggagtcgatcgtcaccaatgctgccccacacgtgggaagggacgttgttatcaatctggacgttaaggactttttccccaccgtcagctacccccgggtgaaaggagtgtttcgcgggctcggctacagtgaacagctggccacaatttttgcactgctctgtaccgagcctgacgtagatgctttggaactggacggcgagacttattatgtcgtggctagcggaagacatctaccacagggtgccccgacctctcctgccttaacaaatatcctgtgcaggaggcttgattcccggctttccgggatggctcaaaaaatgggtttcgcgtatactcgctacgcggatgatatgaccttttcaggcactgaggacacgctgcagaatcttactaaactgttgtggagggctaagaagattatcagcgatgaagggttcgtcgtacaccctggcaagctccgaatcatgaggtctggctcaagacaggaggttactggtattgtggtgaacgagcaaatgaccttggagagaggcaccctccgcaacttcagagccctgctcttccaaattgagaaggatggccttcggggcaagacatggaagggccgcgaacttacacccgcatctctgcgtgggctcgcccattacatcgtcatggtgaatccccaaaagggaaggccactgctagagcgtgtaaacgccttactgagacaggcctga

SEQ ID NO: 13284 - RNA, 1401 nt, unidentified
  source 1..1401: mol_type = other RNA; note = synthetic construct
atgaatgattcagaggactccagagctgtccgccagcaaatatatgaccgtatccgacagtcgtcgcatgatgagtatattctcgatgagatgatcaggcttgggttctggagtagcgacaaagacgctccctctgttcccgaacaactcattagaaaagaggctgaactctctcgagaactgagggaccttttgaagaagcaacggcgtttcgaaaatcggaagaaaatgctgaaagaaatgagaaccaagaggcttgccgagtctaggaagaaacaacaggaaactaaggagagaaaaaaacgggaaagggatgagaaagcccggcagtggcagcagaagaaggctactgcgatcttctacctcggtgaaggcgtatccgctgggctgaaccagaaggagctactgaccgagcggctgaaccagtacaatctgcccgtttttactagcgtggaggcccttgcacaagcaatggagattagtgtgggcgagttgcgctttttaacctttcaccggaaggtgagcaagaccacacattatcagcgcttctacatgcccaagaaaagcgggggagtgcgcttgatctccgccccaatgcctagattaaagcacgcacagtactgggtgtttcataatatccttcagcagatcccgctgcattccgcaggccacggttttagacccgcccacagcatagtttctaacgcagagccgcaccaaggtcaggacattgtgatcaatatggatctccgagatttctttccatctatctcatacaagaggatcaagggcctatttcacgccctggggtactcagaacagattgcgacaattctcgggttactgtgcacagaacctgagatcgatcaggtggagctagatggagagacgtattacgtggccaactcagaaagacatctgcctcaaggcgcgccaacctccccagctctcacgagtatattatgtcggagactggactccaggctgcaaggcatggccgataaattgggcttcgcatatacacgctatgcagacgaccttaccttctccgcctctggtgaaaccgcccgacagttcacacagctgctctggcaggctcgcaaaattatcgaggacgaaggatttgttctgcatccagagaaactgaggattatgcggaagggcagcagacaggaggtcactgggatagtcgtcaacgaaaagctgagcgtgaaccgaaaaactttgaaaaatttccgtgccctcctgttccacatagagaaggacggacttgacggaaagcactggaaaggacagcctgtaagtttggctttcctgaaaggctttgccaactacgtaaagatggtcgatcctgataaggggcgccccctcctggacaggattaataagctgatcgtgtga

SEQ ID NO: 13285 - RNA, 1515 nt, unidentified
  source 1..1515: mol_type = other RNA; note = synthetic construct
atgaccgatacggatacgagtcgactgaccaggcaacagttgtatgatcgaatccgcgagagtagcaaagatgaatacattctcgaggaaatgattcggatcggcttctggccttccgggaaagatgcccctactctgccagagcaggtgattcggcgtgaaggcgagttgactagggaactcgatgacctcctgaggaaacagagacgctacgagaacaaggagctgatgctcagagagatgcgaaaagccagaatggctgagtcacgccgtaaacaggcggagacaaaggctcgtcgtgaagaagaaaggcaggctagagccgagagatggcaggacatcaagacaagagaaatactttggcttggccacggagtttcagggggtctgaatcggagaacctctgatgttggcaagctggcacaaaacgggctcccgcattatgatgacgtcaaggccttggctaaggcaattggtattcccgtaggcgaactgaggttcctcgccttttccaggaagacctccaaaatctcccattacagacggttctttataccaaagaagagaggcggaagacggctgatctcggctcccatgccacgcctgaaagctctgcaatacttcgtgcttgagaatatcctggcgaagatccctccgcataaagccgcgcatggatttctgccaggacacagcatcgtgacaaatgcggtgccccacgttggcaaggacgtcgtgattaatttggacttgaaggacttctttccgactattagttatccacgggtaaagggtctgttccggagcctgggatactccgaacagcaggcaacgctcttcggactaatatgcaccgagcccgacacagatgcagtcgaactggatggcgagacttactttgtcgctcgaagcgaacggcacctaccccaaggagcacccacaagccccgccatttctaatctgatcttcaggaaagcagatcgcagacttcaaggggtggccgaccagctgggctttgcctacacacggtatgctgacgaccttaccttttctgcctcaggagatgccgcagaagctttaaccaggctcctatggggagtgcggcagatcgtgaaggatgagggctttgttcttcaccctgacaaattacgcgttatgaaaaagggggcccgacaggaggtgactggtatagtggtaaacgaaaagctcaatatcagtcgcaagagcctcagaaacttccgagccctgctgttccagatcgagaaggacgggtttgagggcaaacgctggaacggcgcaaaaaacttacctccagtgatatgggggtatgccaactatgtggctatggtcaatccagaaaagggtaaacccctggtcgcccagaccgaccgcatttttaggaagtaccggattaggaaatctgacatcaggcctgacttagcacgcaaagccgccttggctaagaaaggggagacttcaggggcagacgaggagaagccttggtggaagttctggtga

SEQ ID NO: 13286 - RNA, 1818 nt, unidentified
  source 1..1818: mol_type = other RNA; note = synthetic construct
atgtccaacgagcagcagaacgacagtccaattcaggatccatctcctaagctcacccgacaagaattgtatgatagggttaggcgggtaggcaaagacgaatacattctttccgaaatgatacgcctgggcttctggaaaagagacgccaataaaccctcactgacagacactttcctccagaaaaggagcgccctgcaaagtagactccgggaactgtcgaaggaaaatgcactgtattccgaccctgaaaaggcccttaaggccctgcatgaagagcggaagaaggctgcattggagaagagagagttaaccaagatcgaacgcaatactgcccggtaccagagggcattcgcttggtataccaagcagcagacaagctttacatacctgggtgataacgtgagtgctgggctggaagacaaaaccagcgacgaggaaaaactagtgagccaggccctgccagtgtttgacaatgcgggcgccgtcgcagacgctatgggaataagcacctcagagcttcgatttctctgctatcagaaggatgtcagcactatctcacattaccaggacttcaccatcaataagaagtctggcggggtacggacaatctccgccccaatgcccaggatgaaaagatcccagtattggctcctagacaatgtgctgaacaaattggcaatccacgatgcggcacacggttttgtgtctgggaagagtatcgtttctaatgcacaacctcacgtgaaaaagcaagtggtgattaacctagacatgaaagatttcttcccttcagttagctacaagcgtgttaagggcatgttcattaatctgggttactccgaggaactggccacgacgttcgctctactcgcaacgaagcgagaaactcaagcccttgagatggatggtaaaacttggcacgtagccgtcggcgagagagtgttgcctcagggttccccatgttcacctgctatcacaaacgtgctttgccgtcgcctcgatgctcgcttgctggggatggctgagaaactgggctttacctacactaggtatgcagacgatcttacgtttagcagtgatgatgccagtaaggtgcaggccctcctctggagatcgaagcaaattgtgtcaagcgagggctttgtgatacaccccgataagacacgcgtcatgcgaaggcaccaaaaacaggaggtcacaggggttgtagtcaacgacggcctgagcgtggagagaaaaaccctcaaaaggttccgtgccgtcctgcgccatgtggagatggatggacccgaaaacaaacactggggctctggagagttattccagtctctggcagggtatgcgaattttgtggcaatggttaatccagagaagggaatcccgttacagaaagcggtcgtacacctgaagcgacagcataacatcccgacccccgcgggaaagatctctgctctcaacaagaagttatttcggattaaagccgccaaaggagaagctccccgcgaaacctggtggcagcctatgataaaacccgctccagagttggagttcactccggcccagattcagcataagaagagggaagccatggccgagcagcggcaactgagtgacgcatcctccgggacacagactgaggatgttgacaacaccgcttctgagtctgggaagaagaaacggggaattggattctggatatttgccgtgatcttttcacccatcattctgttggtcgccatcagcagaacatccaccacagctaaaatcgcgctggccgcttccattcttttctggatgtactacttctttatgtga

SEQ ID NO: 13287 - RNA, 1818 nt, unidentified
  source 1..1818: mol_type = other RNA; note = synthetic construct
atgagcaacgagcatcagagtgactcccccatccaggatccttcgcccaaactcacaagacaagagctgtacgaccgcgtcaggcgtgtgggtaaggacgaatacatcctcaatgagatgatcagactggggttttggaagaaaaacactgataaaccgaacttaactgatacattcatggagaagcgcgcttccctcagggctcgacttcgggaactgtccgccgagaatgccttgtattccgatcctgaaaaagctctgaaagcactacatgatgagcggaagaaagctgcattagagaagagggagctcaccaagctcaagaaaaacacagccaggtacaagaaagcgtttagttggtacatgaagcagcaagatacattcacttaccttggcgaaaacgtcagcgcgggtttggacgacaagacctccgacgaggagaaactgatttcacaagaaatacccgtgtttgagaacgcaggcgcagtagctgatgctatgggtgtgtccactagtgagttgcgatttctctgttatcagaaagatgtgagcaccatttcacattaccaggacttcgccatcaccaagaagagcgggggcgtgcgtaccatttcagccccaatgccacgtatgaagagggctcagtactggcttctggataatgtgctgaataaactcgccgtgcacgacgccgcacacggattcgtaagctcacgaagtattgtctctaatgccgaacctcatacaaaaaaacgcgtggtaatcaacctggacatgaaggacttcttcccaagcgtgagctataagcgcgttaaaggaatgttcaaacagctggggtactcagaagaattagctactacctttgccctcctgaccaccaagccagctaccgaagccctcgacatggatggtaaaacgtggcacgtggcggtcggcgagagaacactaccacaggggtcgccctgctctcccgcaataaccaatgtgctgtgtagacgattggacgccagacttaaaggcatggccgagaaactcggatttacttatacccgctatgctgacgaccttacattttccaacgacgacgatagtcaggtgcaggccctgctgtggcgctgcaagcagatcgtgtcctctgagggattcgtaatccaccccgataagacccgggtgatgaggcggcaccagaagcaagaagtgaccggcgttgttgtcaacgacggattgtccgtcgaaagaaagacactgaagagattccgggcggttctgaaacacgttgagctagatggcccagagaacaagcactggggaagcggggagctttttcagtctatggcagggtacgccaattttgttgcgatggtgaacccggagaagggcatccctttgcaaaaggctgtgattcatcttaagcggcagtatgatattcctactccgagcggtaagatctcagcgctgaataagaagctgttcaggatgaaagcagccaaaggagaaactccaagagatacgtggtggcaacctcccataaagccagcccccgagttagaactgacgcccgcccagctggaacataaaaaacgggaagccattgcagagcagaagaggcactctggcacgcctacagactcaaaaactgagacacagaatagcgatgccactgacagtgaaaagaagaaacgcgggatcggcttttggatattcgctatcgtcttttctcctataatcctgattgtcgccatggctcgggcatctaccacagcaaagattgcattcgctgcctctttgttcttctgggtctactatttctttatgtga

SEQ ID NO: 13288 - RNA, 1818 nt, unidentified
  source 1..1818: mol_type = other RNA; note = synthetic construct
atgagcaattctcacagtaatccacaaactcatgagccgacacaagatcctagccccaagctgaccaggcagcaaatatatgatcggattcgcgagtcctctaaagatgaatacattctcagcgagatgactcgcctaggtttttggaaacctggggattctaagccatctctcgccgaacagttcgtgaataagagggcctcactgatggccagactgcatgggctatcacagctggacaaaagatacagtgatccagagaaagccctggcagaaatgcataaggctaggaagctggccgcactggagaaaagggaacaaacacgcatagcccggaatcgagcagcttttgaacaggcactggcttggtaccagcgtcagaagaaacagttcacttttctgggcgagagcgtcagtgctggcctatcccagaaggcatccgaccccttacgactctcaaccagacacctcattcattttcagtcagtcgaagatgtggccaggcaaatggacatcagtaccgccgaactccgattcctttgttaccgtaaggaggtcagcactgttactcactatcaggaattcgagttacccaagaaatcgggtggaacacgggtgatctctgcccccatgccgcgaatgaaacgggcccagtattggcttctggactatgtgcttaaccttttgcctgtccatgatgccgcgcatggattcgtgccagggagatctatcgtgactaacgcccagcctcacgttggcaaggccgtagtgattaacctcgacctgaaggacttttttccctcgatcacctatcggcgggtgaaggggttgttcggaaagctgggttacagtgaggagctggccacaacattcgccctgttggctaccaagccagtcactcaggcggtagagatggacggcaggacctggcacgttgctcaaggagagcacgtgctcccacagggttccccatgctcccctatgattactaacgtactgtgtaggcgcatggatgcccgattacaaggtatggcagataagcttggatttacctacacaaggtatgccgacgacctaacatttagctcacaggacgctggcaaagtgcaatccctgctgtggcgctgcaagcagatcgtcacggacgagggctttgtggtgcaccctgaaaagacgcgcgtcattcgcagacatcagcgccaggaggtgacgggggtggttgtgaacgacagattgagcgtagatcgtgcaaccctcaaacgttttcgggcagtattacagcaagtcgccctggacggaccagaaggcaaaacctggggcgccggcgaattattccagagcctggcgggctacgcaaattttgtggcgatggtgaaccctgaaaaaggtcttcctctgcagaaacaggtcctgcacctcaagcggcagtacgggtttacagttcccaagggaaagataggagagttgaataagaggctgttcagacttaaagttgctagagggcagaaaccccggacacactggtggcagccggaagaaaaacctatgccggtgctcgctctgacccccaaacaaaggcaggaggagctcgagcagaagagagcagttgtgcccaagaaggaggctagcgtgtcagatgtcgagcctgaagaaaccgaggccgcgtccgatgaggtcaagttgtctccattcgcttgggtgatggtagttgctgtcatgcccttcgctcttttgtggatgttcatcaaggcacccattaaatccaaattgtgggttctgggcatcggggcagtgatctattggctcttcttcagttga

SEQ ID NO: 13289 - RNA, 1812 nt, unidentified
  source 1..1812: mol_type = other RNA; note = synthetic construct
atgagtgactctaacaaacatcaatccgctgagacagtccaggaccccagcccaaaacttactaggcaacagatatatgataggattcgtcagtcatcaaaggacgattacatcttacgcgaaatgatccggctggggttctggaaatccgacaaggaccagccctccttgacagagaggtttgtggcgaaacgcacagctctcatcacccggctgcggactttgacccaactcgataggctttatagcgaccccgagaaggcactagctgccatgcacaaagctcgaaaaaaggccgcactggagaagagagagcagaccagaatcgcacggaatcagacaagatttgagaaggctctggcatggtaccagcgccagcgagaggccttcacctttctgggcgaatccgtatccgggggattggcccgcaagactagcgatcccttgcggctttctcgatatcagcttatgcacttccagtctgttgcagaggtcgccggctcaatggctatacctatgtctgagctccggttcctgtgttaccgaaaggaagtttctcctgttagccattaccaggattttgaagtagctaagaagtccggaggtaccagaatcattagcgcacctatgccacgcatgaaacgagcgcagtactggctactggatgccgttctgaccaggatcccggtgcacgatgccgcgcatggattcgtcccggagagaagtatcgttagcaacgcccggcctcatgttggaaaggccgtcgtgatcaacctggacctcaaggatttcttccccaccatttcgtacaggagagtgaagggcatgtttcaccagctaggttactccgaagagttagcaacaaccttcgcgctgattgctactaaacctgtcacgcaggccgtggaaatggacggcaagatttggcacgtcgcacagggcgagcacgtactgcctcagggctctccctgtagccctgcgatttccaatctgctgtgccgcagaatggacgctagactgcagggtatggccgataagttgggctttacatatactaggtacgccgacgacctcacgttcagtagcgatgacgtgtccaaagtacaaagcttattatggcgatgcaagcagatagtggccgatgagggattcgtcgtgcaccctgagaaaacccgtgtgatgaggcgccaccaaaggcaagaggtgactggcgtggtggtaaatgatgggctgtctgtggaacgtaaaaccctgaaacagttcagggcagtgctgcggcaggtggaactcgatggacccgctgggaaacaatgggggaaaggggaactgtttcagtcactggcgggatatgccaactttgtcgctatggtcaaccccgaaaaggggattccattgcagaagcaggtagtgcgcctcaaaagacagtacggattttcagtgcctaaggggaagatgggcgaacttaataaacgtctttttcggctgaaggtggccaggggtgagtcgccaagaagtcgctggtggcaaccacatgaaaagccagccccggaattggctctgacccagcaacagaaggccgcacaacggcaggcagccaaagcagactccgtcagtccacaggtcgttacacccgccgctaccagtgagactgactcagagacagacccaacagccttcagccccatgatgtgggtgatgatgatgttaactcttccatttgctctcctctggatgctcgtgacggcctcatggaaaacgaagctctgggttctctctctaggctatgtgctgtattggctgttctttggttga

SEQ ID NO: 13290 - RNA, 1824 nt, unidentified
  source 1..1824: mol_type = other RNA; note = synthetic construct
atgcgcaattccgacccctcacagaataacagcaacaacaacaataattccgttctgccccccgaaccttctcccaaacttaccagacagcagatttacgacagaataaggcagtcctctaaagacgagtacatcctgtctgaaatgatccgcctgggcttctggcagaaagacaggactaagccatctatcgccgaaaaattcatcgagaagcgatcagccctactgtccagactgagagagctgacacgtctgaacaggctgtatcaggatccagagaaggctctcctcgccctgcataaaacacgcaagaaagctgccttggaaaagcgggagcagattagaataaaccacaaccttgcacgttacgaaaaagcgcttaggtggcataagaagcaacagacccattttacttatctaggcgatgccggatacggagataaggcactgactgcaggcctgcaacagacgacgtgcgatacagcgaggttaacggcgcacggtttacccgcgtttagccacgtcggggagctcgcagacgcaatgggaatcagcactagcgagctgcgtttcctctgctaccagaaagacgtgagtacagtcagccactaccagcatttcgcactgagcaaaaaaaccggcgggacccgactgatatccgctcccatgccgagaatgaagagggcacagtattggctgctcgacaatgtgttaaatcttctgccaatccacgatgccgctcatggatttatccagggtaggagcatcgtaactaatgccaaaccccacactaataagcaagttgtgatcaaccttgatctcaaggactttttcccaagtattacttatccccgggtcaaggggatctttaagcaatctggctattccgaagccctggccactaccttcgccctgatcgcaaccaagagtgacacccaggccgttgagatggatgggcagacataccatattgctaacggcaagcgcgagctacctcaagggtcgccatgtagcccggcgataaccaacgtcctgtgtagacggctagacgcacgactccaggggatggctcacaaactgggtttcacctatacacgatatgccgacgatctcacattttcaagtgacgagacagataaaatacagtacgtcttatggcgctgccagcggattgttactgatgagggatttaccctccatccggataagacacgggtgatgcggaaacaccagaagcaagaggtaacaggcatcgtggtgaatgacggtttgtctgtggaccgccctacccttaaacgatttagagcagtcgttcgccaaattgagcttgatggacactatggaaagcattgggggactggagagctgtttcagtcgttgaccgggtacgccaactttgtggctatggtggcaccagaaaagggcattcctttgcagaagcaggtggctcacttgaagaggcagtacaacattcccgtggctgccggtaaaattacggccctcaataagagactcttccggttaaaagcagccaagggcgaggctccacgggaagcttggtggcaacctgccgaaaaacccgctcctgtccttgccctgacccaacagcagatggatgcccagaagcaacaggcaaggcaggccgcgaaggccaaccaagctaatacacatagtgcccacccagaaatggctcctgaccacacgaaccctgctttcatctcaggtggcaacgaaacaaataccgcctcccctaatcgcttcggctcaccagtagtgtggaccgtggttgtggtactgctcttgttgaaaattttcgtgtactga

SEQ ID NO: 13291 - RNA, 1899 nt, unidentified
  source 1..1899: mol_type = other RNA; note = synthetic construct
atgagcgacagcagctcccaaagcacatcccggagtaactcatcaaacgctagccatcaggaggcctcggtgactgattctgcaccaaaacttaccaggcagcagatatatgaccgaattcgcgaatcctctaaagatgaatacattctccaggaaatgatccggctgggcttttggaacaaggatgacgaacagcctagtctcactcaggagtttatcgagcgcagatccgagctcaccagaaagctgcgcgagctttctgatctcgactccctctacgcagaccccgagaaggctttggaagctctccacaaggagagaaaaaaagccgcgctggaaaagagggaacagacaaggcaggccctaaaccagaagcgttatgatcgtgctctcgcatggtacaaccagcaaaaggagactttcacttggctgggggacgatgtgagtctgggattgaagaataaagaaaatgatgatggccggctggaggagagggagctgccaacatttgagaacattgctgccctagcgggggccatgggcatctcagttagcgagttaaggtttttggcgtatcagaaggatgtgtcaaacgtctctcattaccagcgattctcaatcgctaagaagactggcggactccggcacatttccgcaccaatgcctcggttaaaaagagctcaatattggttgctggacaacatcctggctaaactttctgtgcacgacgccgcccacggttttgtgaccggtcgctcaatagtttccaacgcccaaccccacgtcggcaaagccgttgtcatcaatatggatctgaaggacttcttcccgtccatcagctacaagagggtaaagggactgttccagtcccaagggtacagcgaggagcttgccacagtgttcgggcttctcaccactgagtccgagacacaggagctggagatggatggccaaacctggttcgtggctcagggagaaagaagactgccccagggttctccctgcagtccagcaattacaaatgttatgtgccggcggttagacgcacgtctgcagggtatggcggataaactggggttcgcctatacccgctatgctgacgacctgaccttcagtacggattcggccgaaaaagcccaggcactcttgtggcgagccaaacaaatagtggtgtcagaagggtttaccctccaccctgacaagacgagagttatgcgcaggcaccaaaaacaggaagtaaccggtgtggtggtcaatgagaaattgagcatagaccgaaagaccttgaagagatttcgcgcaacactgaagcagattgagttggacggacccgatgggaagcattggggtgcaggagaactgtttgcctctatggagggctatgcgaatttcgtcgcaatggtggacgccgaaaaggggattccattacagaagacactggtacacctgaaacgtcagcatggggtgacaacgaaacatggaaaagtgaccgagcttaataaaaggctgctgagagtcaaagcagccaatggcgaaaaccccaaggaaggatggtggcaacccgaagagaagccggcccctgaacttgagctcacgccaaatcaaatcgctgagcgaaagagggctattaaaaggcaacggaatcaggaacagcgcgagaatcagggcgctaactctgaatggcaggatgcagacttcaaccaggacaatgaggccaaccagggcgatggctggagtgacctagaaagcgatgctaaaaagaaatggactactcgggagtacatcctaggactgctctttcttcctatcgttctggtaatgctttttttcaaggccccttggaatattaagtgtatcgtcgtgggcgtcttatggctgctgtacttgtacctgaactga

SEQ ID NO: 13292 - RNA, 1851 nt, unidentified
  source 1..1851: mol_type = other RNA; note = synthetic construct
atgagtgatacctctcaccactcaagccaaagtgacagccaggaggctacactgtcggattccgcccccaagctgacgcgacaagagatctacgatcggatcagggaaacttcaaaggacgagtatattctgcaggagatgatacgactcggcttctgggacaaagacgaggagcaacccaatcttacacaggaattcattgaacgccgagccgagctgatgcgtaagatgagagagctctcacagttggattcactctattccgaccccgaaaaggccttggaagctcttcataaggaaagaaagaaggcggccctcgagaaaagagagcaaacacgccaggccaggaatcaggagcggtacgagcgcgctctggcttggtatcacaaacagaaagagagctttacgtggctcggggacgatgtctcactcggacttgtgaacaaggaatccgacgctggaaaattagagaatcaggacctcccccattttgaaaacatcgcctccctcgcccaggctatggggatttccgtgagtgagctgcggttcctcgcctaccagaaagatgtcagcaatgtgtcccattaccagaggttcactatagcgaagaagagcgggggtgaaagacacatctctgctccaatgcctcggctcaaacgcgctcagtactggttactggacaatgtgctcgagaaactgaccgtccaccaggccgcacatggttttgtgtctggcaagagtatagttacaaacgcccagccccacgtcgggaaggctgttgttatcaacatggaccttaaagatttctttccaagcattagctacaaaagggtgaaaggtctgtttcgtgcccaaggatactctgaagagctggctacagtcttcggtcttttgaccaccgagccagaagtgcaagaattggaaatggatggcaaaacctggttcgtagcccagggagagcgccgattaccacagggctccccctgtagcccagccatcaccaacgccctatgccgaaggctagacgcacgcttgcaggggatggcagacaaactggggtttacgtactccagatatgcagacgacctcacattttccacagacgagcctgataaggttcaaagtctgttgtggagggccaagcaaatcgtgagtgatgaagggtttactctgcatcccgaaaagacaagggtgatgcggagacatcagaagcaggaagtgaccggcgtcgtggtcaacgacaaactgtctgttgataggaagaccttgaaacgttttagggccgtgctgaagcagattgagttggacggtccagagggaaagacatggggagcgggcgatctattccgctctctggaaggctatgccaatttcgtcgccatggttgatcctgagaagggaattccacttcagaagactctggtgcaccttaaaagacagtacggcattcagactaaacacggcaaggtcactgcacttaataaacggctgcttcgggcaaaggcagcgaaaggcgaagcgtcaagagagaattggtggcagcctgaagagaagcctgagccggagctggaactgactcccaaccagaaggcagaacaaaaacgggcagagcagtcggcacgtagggcagagcaaagagccaacaccgagagccagaacgtagaatctgagcagggagatggctgggacgagctggattctgatgctaacaaggtttggacccctcgggaatatgtgctggtgactctgatgttacctctggtgctgatccacctcttcttccgcgctccgtggaatgtaaagtgcatcgtggtaggggtattatggctattgtacctgtatctgacctga

SEQ ID NO: 13293 - RNA, 1779 nt, unidentified
  source 1..1779: mol_type = other RNA; note = synthetic construct
atgagtgagtcaagcacaaaactcactaggcaagagatttacgataagatacgcaaaagctccaaagaagaatacatcctggatgagatgaaaaggctggggttctggcgcaacgatgaagagcaacccaatctgacccaagaatttgtcgagaaaagagcacagctgatggcacagctgcgggaattgagctcccaggacgagctttatagtgacccagagaaggccctggcacatctgcaccaggaacggaagaaggcagctcttgaaaaacgtgaacaggttagacagactcggaacaaaactcgatacgaaaatgctttgaattggtatcagaagcagcagaaggaaataacctatctgggagagaaattctctgccggcttgagtgagaagattagtgacaagtctaaactcactagccagggtctgccttattttgccgatagccaggcccttgctcagggcatgggcatctccataggagagctaagatttctgtgttaccaaaaggaggtgtctcaaacaagccattacaagaagtttgcaatagagaagaagaccgggggcaagaggcacatctctgcccccatgcctcgtctcaaacgggcacagtattggctgttggaaaatgtgcttgcacctgttaaactgcactcagcggcacacgggtttgttccgggaaggagcatcttatctaacgctcttccccacatcaacaagggggtggtagtgaattttgatctaaaagacttcttcccatctatctcctatgctcgcgtgaaggggctcttctgcaagcagggctattccgaagaactgggcaccctctttgccctcttagctacagagccagatacagaggctgtggccatggacggtcagatttggcatattgaccagggaccccggattctgcctcaaggagccccttgctccccagccatcacaaacatcctatgtcgcagattggacgcaaggctggccggtatggctgagaagctaggcttcgcgtacacgcgatatgcagatgacctctcttttagttctgatgagcctaacaaagtgcagtccctgctctggcgcgtaaaacagatcgttacgtcggagggattcttgctgcacccagacaagacgaaagttatgcgccggcaccagaagcaagaggtgaccggcgtcgtcgtgaatgagaaggcctcagtagaccgaaagacactgaaaagattcagggctatcctccatcaaatcgacctctacgggcctgaggggaaatcctggggtccaggcgccctttttcctagcctcgaaggatatgccaacttcgtcgccatgctggatgcccaaaaggggattcccttacagaagcagctggtgcatatcaaaagaaagtacggcgtgaaaacccggtcgtcaaaagtcacccagctgaacaagagacttatgcgagtcaaagccgggttgggcgaagctccccgtgagaattggtggcagcccgcggagaagccagaaccgattttagagcttactcccaagcagcaagccgcccagaagcaggccaggaaggtgaccggaccagtcgagcaggaatacgcggagagtgcttcagagcaaaatccccagtcagaggcagaagaagacactaaactgtccacaaaggattacatattcattggcttgttcatgccgatcgctttagcgcagatgatttacaaagctagctggaaaaccaagatcaaactcatggtggtaggaactattatttggctgctgtttggttga

SEQ ID NO: 13294 - RNA, 1710 nt, unidentified
  source 1..1710: mol_type = other RNA; note = synthetic construct
atgagcgaatctccaaaattgacaagacagcaactatacgagcggatccgcgagacgagcaaagaagaggtgatcctggcagaaatgatccgtctcggattttgggatggcgagcagaaaaaacctgaccttaccgcagaatttatcgcgcaacgagcagctttggagaagagactggccgaacttgggcaacagcagcaactctattcagatccccagaaggcattaagggagctccacaaggccaggaagaaggccgccctcgagaaacgggaacagactagaattgcccgaaaccaagcacgctatgagagagcacagcagtggcatcagaagcaacagtccgaaatttcttggctgggggaaggcttttcctttggcctctctgatacgacacagaatgaggcaaggctgaaacagcagaatctgccgttgttagctgattcccagaccctggctaccctgatgggcatcaccattaatgaacttcgttttctgtgcttccaaaaggacgtttcccgtattaaccattaccgcagattcagtctgctgaaaaagtcagggggggagcgactgatatcggcacccatgcctcgccttaaaagggcccaatactggatattggagaacatcctcaacagagttaaactgcacgatgccgcgcacggattcgtagccggaagatccatccttacgaacgccctccctcatgtgggtcgcgctgtcgtcattaatctagatatggagaactttttccctacagttagctatcgccgagtgaagggcctgttccgacagctggggtatggagaacaaattgccaccgagctagccctgttgactactgagccagaaaccgagcaggtagtgctagacggtgaaaattggtttgtgcagcagggagagagattcttgccacagggagctccgtctagccccgccataagcaacataatctgtaggagactggacagccggttacacgcgatggctcacaagcttggcttcgcttacacaaggtatgccgacgacatgacctttagttgtgccgacaaccgtgggaatgtccagcagctcctgtggcggtgcaaacagattgtgcaggacgaggggttccgcgttcatccccagaagactcgggtcatgaggaaacctcagcagcaacaggtgaccggaatcgtggtaaatgagaagccttccctcgatagaaagactctcaagcggtttcgcgcactgctgttccagatcgccaaggacggtatggaagggaaacggtggggccccggagaattgatggcctctatcgagggttacgccaatttcgttgccttagtcgctcccggcaagggtattcccctccagaaacaggtgacagatatcaaaaggcagtacggctatgctacacagcctggcaggataactgcactgaacaagaagctttttcgcgctaaggctgctcggggtgaatccccaagggactcgtggtggcaagcacaaggcccgagtgcgccagagctcgagcaaaccgccctgcagaagcaggctcttaggcgagcggcttcagccgcggaagatgtgccaagcgctgcaaagaacgcctctgtgcccgatgacttcgcagagacaccccctgagcggccaaaaaaaagttcacggttatggtggtggttcctggccttcgtggtctacctgatttttagatgggcctga

SEQ ID NO: 13295 - RNA, 1704 nt, unidentified
  source 1..1704: mol_type = other RNA; note = synthetic construct
atgagcgagacacccaagttgacacggcaacagatctatgagcgcatccgcgaaactagcaaggaagagtacattcaggcagagatgatccggctcggattttgggatgcaacgcaagagaagcctgacttgacgactgagttcattacaaggcgcgcggctcttgagaagcaactggccgagcttgggagaaaacagcagctctacagcgatccccaaaaggctctccgggaattgcataaagcccgcaagaaagcggccctcgagaagagagaacagacccggatcgcccgaaacaaagcacgctatgagcgtgcccagcagtggcacgaaaagcagcgctcagaaatcacctatttaggcgcaggctattcatttgggcttgacgagacaacccatgatgacgctaggctgcagcagcaccacctcccccagttagctaattcccaggccctagccacggccatgggcatcactctgaatgagctaaggttcctttgtttccagaaggaagtgtctcggattaaccactacaggcgcttttccctcatgaagaagaacggtggacagcggctaatctccgcaccgatgcctcggctgaaaagagcccagtactggattctggagaatatcctgaacagagtgcccctgcacgatgccgcgcatggcttcgtaaccggccgtagcatactatctaacgccctgccacatgtgaaccaggctattgtcgtgaaccttgatatggagaattttttccccacagtgaattacaggagagtgaagggtgtttttagacaattggggtatagtgagcagattgcaaccgaactggccttattgacaacagaacctgaggccgagcaggtggttctggacggggaaaattggtttgtgcagcagggagaacgatttctgccccaaggggcaccatcttccccagccctgtcgaatataatatgtcgaaggctggatagtcggatgcatggaatggctaacaagttggggtttacttataccaggtacgctgacgacatgacattctcttgcgccgacaaaagcgccaacgtccagcagctgctgtggcgctgcaaacaaattgtgcaggacgagggctttagacttcacagcgagaagaccagggtaatgagaaagccccagaagcaagaagttactggcattgtcgtcaatgaaaagccttccctggatcgtaagactctcaaacggtttagggcgctgctgttccaaattgctaaggatggtatcgaaggaaaaagatggggcgccggagagcttatggcctctttggaagggtacgcaaacttcgtagcccaggtggcgcccgataagggcatcccactccagaaacaggtcacggatctgaaacgacgcttcggttatgccacccgtcctggacgaattaccgcactcaataaaactctcttccgggctaaagctgcacgaggcgaagcgccgagagacaactggtggcaggctcagggtccaagtgcaccagttttagagctgacaatgcagcaaaagcaggccatgcgcagaccggtttcagtgaccagtccaacttcccctaataacgacacacctcggaccgtgaatgccgacgcacctgctcaccaacccgctaggacctcagtcaaatggtggataatcctcatcgctataatcctgtacttcctgatgaggaaatga

SEQ ID NO: 13296 - RNA, 1611 nt, unidentified
  source 1..1611: mol_type = other RNA; note = synthetic construct
atgagtgagtctccaaaactgacccggcaacagatctacgagcggatccgcgaaacttctaaggaggagtacatacttgcggagatgatcagacttgggttctgggacgcctcccaggaaaagcctgacctgacagcagagttcatcgcggaaagggctgccttgcagaagaaactagccagtttaggtgagcgccagaggctgtacgacgatccccagaaggctttgagagagctgcataagacccggaagaaagctgctcttgagaaacgcgagcagacacgcatagcgaggaatcaggccagatacgaacgggcccagaggtggcaccagacacagcaaagcactatcacctggttgggagagggctactcgttcggactcgacgatacaacacacaatgaagcacgcctggcacaacagaacctgcctccattggccgatagtcaggctttggccagcgccatgggcattacgctaaatgaattacgcttcctctgttttcagaaagccgtcagccgtgtcaatcattatcggcgattctctatcgctaagaagtctggcggcgagcgatttatttcagcaccgatgccaagaatgaaaagggctcagtattggatcctcgagaacatactgaatcgcgttgcactgcacgatgccgcacatggctttgtggctggccggagcatactgaccaacgccctgccccatgtcaaccgtgcaattgtggtgaacctggatatggagaacttctttcccaccgtgtcatacagacgggtgaaaggcctgttccggcagttagggtacgccgagcagctggcaaccgaactggctcttctgactaccgagcccgaggccgaacaagtcgcgcttgacggagaaaactggttcattcagcaaggtgaacgcaccctgcctcagggagctccatcttcaccagcaatctccaatatcatttgcaggagactcgatagccggctccacgcgatggctcagaaactaggctttacgtatactcgctatgccgatgacatgacattttcatccgcagacaaaaccgccaacgttcaacagctgctttggaggtgcaaacagatcgttaatgatgagggttttagactccacccggagaagactcgagtgatgagaaagccgcagaaacaagaagtaactgggattgttgtaaatgagaagccatccgtggaccgtaagacattgaagaggttccgtgctttattgtttcagatcgccaaggacggcacacaagggaaacgatggggagcgggagaactcatggccagcctggaagggtacgctaacttcgtcgccctcattgctcccgagaaaggcattcctctgcagaagcaggtgactgaccttaagcggcagtatggttatgtgacgcagcccgggagaattaccgccctgaacaagaagctctttagagccagagctgccaggggagaggcacctagggaaaaatggtggcaggcacaagggccagcagctcctgtactcgaacagaccccccagcaaaagcagcccgcacctcaaccagcccctgtgtcctcccagcccgaacctcaaagtttcgccgcccgaaggggttga

SEQ ID NO: 13297 - RNA, 1701 nt, unidentified
  source 1..1701: mol_type = other RNA; note = synthetic construct
atgagcgagtccagtaagctaacccgtcagcagatatacgagaggattagggaaacttccaaggaggagtatattctggccgagatgatacgtttggggttctgggatgagacacaagataagcccgcgctcactgcagaattcattgcccaacgtgctgcattacagaagcagctcgccgagctcggacagaaacagcgcctgtatgacgatccacaaaaggctttaagggagctccacaagactcgaaaaaaagctgccctggaaaagagggaacagacaaggatagcaagaaatgaggcacggtacgcgcgcgcactgcaatggcaccagaagcagcaggccgaaatcacctggctcggcgaaggtgttagctttggattggccgatactgcccacaatgaagcacggcttcaggcccagaagttaccactcctggccgactcacaagctctggcatccgccatgggaattacgattaatgaactcaggtttctgtgcttccaaaaaaatgttagcagagtgaaccattatcggcgcttctctctggccaaaaaaaatggtggggagcgcctcatcagtgcccctatgccccgcatgaagcgagctcagtactggattctggaaaacatcctgaatcgtgtcaagttgcatgaggccgcccacgggttcgtaactggtcgcagtatcttgtctaacgctcttccgcacgtaaatcaagcgatcgtggtcaaccttgatatggagaacttctttcctaccgtgaactatagaagggtcaaaggcctgttcagacagctcggctacgccgagcagctggctactgagttggcactgttgaccaccgaacctgaggtgacgcaggtcgcccttgacggcgagacatggttcgtacaggaggacgccagatttcttccccaaggcgcgccaacatcaccagctatcagcaatataatctgtcgccggctggattcacggctgcaagcgatggcacagaaactcgggtttgtgtacacgagatatgcggatgacatgaccttttcttgcgcccagccctccgccaacgttcaacagctcctatggaggtgtaagcaaatcgtgcaggacgagggcttcaagatccatcccgagaagacacgcgtgatgcggaaaccccagaagcaggaggtgaccggcattgtggtgaatgagaagccgtctgtcgataggaaaaccctgaagaggtttagagctcttttattccagattgccaaggacggcatggaagggaagcggtggggatccggggaactgatggccagcttagaagggtatgctaactttgtcgccatggtggcgcctgaaaaaggaatagtgctgcagaaacaggtcactgacttgaagcggcagtacggttacaccactcagccaggacgaattaccgccctgaacaaacagctgtttcgagctaaggctgctagaggcgaaagcccccgagacaactggtggcaggcacaagaagctcctcctccagtacttgaacagacagcccaacagcaggcaacacagaaagccaccagttcggcaacagaggctctacatttcgatgcacagcctgagacacacgcaggacaggtgcccgacaaatcaagatctccactgcggttcttttgggttctgatcctcgttcttctaatcatgatcctggctagaatgttttga

SEQ ID NO: 13298 - RNA, 1764 nt, unidentified
  source 1..1764: mol_type = other RNA; note = synthetic construct
atgtcggaagagaagaagctcacacggcaggagatttaccagcgaatccgagagacttccaaggacgagtatatactttctgaaatggtacgtttaggcttttggcctgataattcggagaaacctaccctctctgaggcgtttatcaagaagcgcactgagctgcaagcggcactgagggaactgggacagcaacagatgctatactctgaccccgaaaaggctctgaaggaaatgcacaaacagagaaagcaagccgctctcgctaagagagaggagacaaggagaaagaggaatgaggagcgcttccagagggctcagcattggagagaggtgcaggcacatcaaattacctacttaggcgagggggtgagcggaggccttgaagacgcgaccgccgatgaggccagacttcggagccagaatctgcccataattaatgccgcagaggagctcgcaactgcgatgggtgtgactctcaacgagctgcgattcctggcttattcaaaagaagtgtctaagctgagccactaccagcagttcgcaatcgcaaagaagaccggtggtgtccgcgaaataagcgctcccatgcctaggatgaagcgcgctcagtattgggtcctggataacatattggcaccactcacactgcacgaggccgcccacggattcgtggtcgaacggtccatcgtgtcaaatgcccagccgcatgtcggcaaggacgtggttattaacctcgacttgaaagatttcttccccactgtaagctatgctagaattaaaggcgcctttcggcacttggggtactccgagcagatcgcaacaattctgggactgttatgctcacagcccaagactcaggaagttgaaatggatggccagaaatggtttgtcagcgaaggggaacggttcttaccccaaggagctcccacgagtccggccatctccaacgtcatctgccgaaaactcgacagacggctacagtccatggctgcgaagctgggctttacgtatacgagatacgccgacgacgttaccttcagtgctgacgggaaatccgacgatgatgtcaagcgacttctttggaggtgtcgctctatcattaaggacgagggcttcgtcgtgcacccagacaaaacccgtatcatgagaaaacatcggcgtcaagaggtaaccggggtcgtggttaacgacaaggcctctgtggagaggaaacagctgaagaggtttcgggctttgctgttccaaatcgatcgcgatggtcctgcgggaaaatcatggggtcgcggggagctgtttgcggcaatagatggttttgccaactacgttgccatggtaaatccagttaaaggagtgcctcttcagcaaaaagtggcccaactgaagctgaagtatggagtgaaggttaagcctagtagggtgttggccctgaacaagaaacgtatgaggctcaaagctgccaaaggggaagccccaagagaagattggtggcaggctcaggcatccgctgcacctgaattggagaaaaccgccgaacaggtgaaggaagaacgcaaggcagagaaagccgagcagcagacacaggccgtacccgctgcctcaagtgcagatccggcccctgtgcggacaagcacaccagtgcagagccagcagcaagcacaacccagtgctccagccccagagggcgaatcccatgccaaaaccgggtggatcatgctagctattggcattcttatctacctggccatgaaaatgctcggctga

SEQ ID NO: 13299 - RNA, 1728 nt, unidentified
  source 1..1728: mol_type = other RNA; note = synthetic construct
atgtcagatgggaacaaacttaccagacagcagctatatcagagaatacgggaaacctctaaagacgaatacatcctttctgaaatgaagcgcttgggcttctggcccgaagatagcgacaaaccttctctagccgaggaattcattaatgagaagagcgagatttccaagaaactgcgtgagctggggcaaaagcagggtttgtattccgaccctgaggccgctctgaaggagttacacaaacaacgcaagaagcaggcgttggagcgacgggagcaaaagcgtcaggagaggaatcaagcacgctacgatagggccagtcggtggtataccacccagcagaagctcatcacatatgtgggcgaccacttctcaaagtccttaaacaacgtggaatcccacgaggataagcttaaacagcaagggctccctgtcctccactcttcaaaagatctggcaggcgccatgggaatcacgctcaatgagttgaggtttctggcataccagaaagacgtttccgcagtaaaccattaccagcatttcgagatcctcaagaagaccggcggatcacggctgatttcagcacccatgccccgcctgaagagggctcagtactgggtgctggctaatgtcctggaaccgctgagcattcatgacgcggcacacgggtttgtgccaaaaagatccattgtaagcaatgccatccctcacgtggggaaggacattgtcatcaacctggatttgaaggacttttttccgactgtgacctacccccgaatcaagggggtatttcacactctgggatacagcgagcacctagccactattctgggattactctgtactcagtctaacatccaggaagtggagctggacggccaaacctggtttgtgggcaatggagagaggtacttgccacagggggcccccactagcccaaacttaacgaacatactttgcagaaaactggacgccagactcaatggcatggccgagaaacttggattcacatataccaggtatgcagatgacctgacatttagcagtgatagtaaggacgaacagcaggtcaagaagcttctgtggcgctgtagaaaaatagtccaggatgagggtttcgtgatccatcccaaaaaaacccgaatcatgcgacgtcataaaaagcaggaagtgacaggcatcaccgtgaacgataagatgggcgttgataagaagaccctcaaacggttccgcgcggtgttatttcaaattgacaaggacggtccagatgggaagacttgggggaatggtgatatcttctgcgccatcgacggttacgctaactacgtggccatggtttcgcccgataaaggcattgctttgcagcaacaagtagctcatataaaaaggaagtatggagtgaacgttaagaaaggcaaggttctgtcgctcaataagaagctactgagacttaaagccgctgctggagaacatccacggcaggagtggtggcaggctctcccacctgcgaaacctgaaaaagagaagacggccgaagaaattaaacaatctaaggtcacagaccagcaggagaaaagtaaggaccgggataataaaaaccactggacacaggccaatacaaacctgtcccaggatgacaagaaagttagttccacaggctacaatatgctgaaaatattcctcttcgtcactgcactggctatcgcctatagctttctgaagaactga

SEQ ID NO: 13300 - RNA, 1725 nt, unidentified
  source 1..1725: mol_type = other RNA; note = synthetic construct
atgagcgcttcctctccaggaaagctaactcgtcagcagctctacgacttaattcgcgaatccagcaaagatgaatacatactcagcgagatgatcagactgggctactggaacgaggacagtgggaagccgagcttgcccgctgaattgattgctcggaaaggggagctagagcgggaattccaggcccttctgaaaaagcaacagcagtaccaagatccgcagaaggcgcttaaagagctgcataagcagcgaaaggcagaagcactgaagcggcgcgaagagacgaaacagaataataacgaggctcggtatcagcgtgccgtgaattggcataacaaaaaccaagccgagataacctacctgggcgaggatttctcggcgggcctacagggttcatttaccgacagagaaaggctgactaaccaagaactgccagtgatagactccagtctcgcattggccaaggccatggggatttctattaatgagctccgctttctttcctttggccgcaagacatctaaaactacacattaccagcagtttcttatagagaaaaagacaggaggcacacggcgaatttctgcccccatgcctaggctcaaacggctccaatactggatcctgggaaacattctggaaaaactgccactgcacgacactgcccacggctttgtggcgcaaagatccatagtcaccaatgccaagcctcacgtcggagccgacgtagtggtcaacatggatttaaaggactttttccccacagtgacttataagcggatcaagggactcttttgcaagcttgggtatagcgaacaggtcgccaccgtacttgccctgttatgttctgagcccgaaattgacgaagtagagttggatggtgagactttctacgttgctaggggagagcgatatttgccccagggagcccctacatccccagcaatcagcaatttactctgcagaaatctggacaggcgtgtgttcggcgcgagtaaaaagctggatttcacctatactaggtatgccgatgacctaaccttcagtgggaccagaaagtctgcacaccagttaaggaagttgctgtggagagtggaacagatcgttatcgacgagggcttcgtggtgcacccagataaaacccgcattatgaggaagaatgcccggcaggaggtgacaggcctggttgtcaaccagaagttgagcgttgatagaaagacactgaaacaattccgcgctctgctgtttcagattgaaaaagatgggatcgagggaaaggtctgggggaaggggcagctgatcccgtcaatcgagggttatgccaactttgtagctatggtgaatcctgagaaaggcctcgcactccagaaacgagttactcagattaagaagcagtacggattcgaggtcaaaccaggtaaactggccgctctgaacaagaagattatgcgcgtgaaagctaccagaggcgaggcgcctagggaagactggtggcaggcagagcctaaaccctcacccgtgaaggagaataccgcagaacagctgaaagcccagaagaaagcaaaggcaatcgagaagaaagaagctgaacaatcattgcctgaacattccaccaacgagcaacgagagattgaaaacacggaggatacaaataacatcggtacgctgatgatctacatagctatcggcctccttcttatcgtgatcttcctcgggtcgtga

SEQ ID NO: 13301 - RNA, 1704 nt, unidentified
  source 1..1704: mol_type = other RNA; note = synthetic construct
atgcaaactagcgctccagggaagctgactaggcagcagctgtacgacctcattaaacagagcagtaaagacgggtatatcctgaaagaaatgatccgtcttggcttttggaacgaaacgacaggcaaaccttccctgacccaggaatttattaccagaaaaggggaactcgagaagcaatattctcagttgctgtcactgcaccacaagtatcagagcacagagtctctgctgaaagatttccacaaacagcgcaaagccaaggcactcttgaacagggaggagacaaaattgaagaacaagcaaatcaagttcgaaaaggcccagaactggtttaagcgaaatttaaccgagatcttatacctcggagaaaatgtgagcgctggtctgaatgggaagtttacggaccatgacaagctgaagtcaaattcgctgcctgttatagaaaactttgagacattggcacagtccattggcgtatctgtgagcgaaatacgcttcctgtcctatgatagaaaggtgagtaaagtttcccattaccagcaattcctcatcgccaaaaaaacaggtgggacgcgaaagatttccgcgccaatgccccgtctaaaacatgtgcagtactggattcttaccaacatcttagaaaaggtggcgatacacgattccgcccacggtttcgttaccggaaagtcaatcgtcacaaatgctaagccacacgtaggtgctgatgtggtcatcaacatggacttggaaaacttctttcccacagtcaactacaaacggattaagggcgtgttctgcaatttaggatacagcgagaagattagcaccgtgctggctcttctgtgctctgagtcggataactgtgaggtcgtcctcgatggccaaacttattataggaatcagggggaacgagtacttcctcagggagcacctacatcccccgctttgaccaatatactgtgtcggaagttggataggcggatgttgggcatgtccgataagctcgggttcaagtatactagatacgcagacgacctaaccttcagtagttcacagcagaccgcccataacctgcagaagcttttctggcgcgtgaaccagattatccccgatgagggctttattctgcaccccgacaagacccgcgtgatgcgcagaaataataaacaggaggtgactggagtagtcgtgaatgagaagctgagtgtggatcggaaaaccctaaagaaatttcgggccctgctgtttcagattaacaaggacggagtgggcgacaagacatggggcaaaggggcactgattccatctatcgagggatacgccaattttgtctatatggtgaacccgattaaaggcgttgccttacagaaagccgttgtgctcatcaaacaaaaatacggcatgccagttaagcctcacaaactctcactcctgaacaagaagcttatgaggctcaaagctaaggagggactcctgcccaagaaggattggtggatccctaaacagaagactactccccttgtcgaacttactcagaaacaaaatgaggaggccaagatcgagcataaacagcagatcacggacgacaatagaaacgtcaatatactaaccccgcaatctgacaaaccaaagagctacggttatgttttttacgtgatagcggtggtaattttcatcctgttccaaatcttcaacaagtga

SEQ ID NO: 13302 - RNA, 1782 nt, unidentified
  source 1..1782: mol_type = other RNA; note = synthetic construct
atgtctgaccagcagtctacaccagcatccccctcccggcttactaggcaacagctgtacgatcgtattcgcgagagtagcaaggacgaatatatcctggcagaaatgaaaaggttgggcttttgggatgcctcagaggatcggccttctctgagcgagtccctcatcatcaagcaaggagaactcgaacgcgaactccgagagctgttggctaaacagcgacagctcaagaatccagaaaaagccttaaaggccatgcacaagcagaggatgaaagaagcacgcgataaacgggaggtaactcggcagcatcaggccgaggagcgctatcagcggagtctggcttggtacaacaaatctcaacaaaccctgagctatctgggcgagaaagtgagttcaagactggattccgtcgaggcacagcaagcgagattattggacaaccacctgcctattattaaaagctatctacagctggccaccatgatgggagtctctctggcggaattgagattcttggcatttagcaggaatgtgagccaggtgtctcactatcaacactttctcctgccaaagaagaatggagggacgagacttataagcgcacctatgccgagactgaagcgtgttcagtactgggtgcaggctaatatactagagtcggtggctctccacgacgccgcacatgggtttgtgaccaagagatcaatagtctccaatgccgaacctcacgttgggaaggctgtagtgatcaatatggaccttgcggacttctttccgacaatcagttatccccgtgtgaaaggcgtcttctcccacctgggatacggcgaaggtattgccacggttctggcccttattacaaccgcacagactgtcacacccgtggagctggacggcaagcagtactttgttggtcagggtgtccggcatctgccacaaggagcccccagttccccagccctcaccaacattatctgcagacgcctggacaagaggattcttggaacggcgcaaaaactggggttcgcttacaccaggtatgccgacgatctgagtttctcctctgagcagggtgaaccggccaaggtgaggcagcttttgtggcgaatcaaacgcatcgtcaaagaagaggggtttgccgtgcacccaaacaaaactagggtaatgtaccggcataagcggcaagaggtgaccggtgtggtagtaaacgacaaacccagcgttgacagaaggacattgaaacgctttagagctttactgttccagatcgaaaaggatgggatcactgggaagtcttgggggacaaagtcaggcaaagagtccgcggccctaattccatcaatcgatggctacgctaactacgtggctatggtgtcgcccgaaaaaggcgtcaaactgcagcaacaggtggcaaaaatcaagcagcagcaaggattccaggttagccccaagcgcgttatggcacttaatcgaaagctcttcaagcaaaaggccatgaaaggcgaggcccctcgagactcatggtggcaacctgctgaaaagcagcctccagtcaaggagctcacatcactccagttagaagctgagaagcaacaggagaaggttgagtgtagcgccgagcagcaggctgataagaaacagcctctggtggagcaggtgcagcctcccgtccagattcatactaagcccaagacccagcagttccagttcgataaacaccattactgggtgattttctggatcggcctacttctcctcttactgatgatatttaactga

SEQ ID NO: 13303 - RNA, 1770 nt, unidentified
  source 1..1770: mol_type = other RNA; note = synthetic construct
atgtctgagattagccctggaaaactgacacggcagcagctgtatgatcgcattagggaatcttccaaagacgaatacatactggaagaaatgaagcgcttaggattctgggacgagagtgagcaacctccagaggccgaagagttgattaaagagaaggctagactgcgcaaagaactcaacaagctgctgagaaataaaagactgatggatgaccctgagaaggcgctggagcttatgcacaaagagcggaagaagaaagccctggagaagcggaaagaaaccaagaaagagcggattaagtccgcctacgagcgagcattgaactggtttaagcttaaccagaaagagatcacctacttaggtgagaacacaaaaattgagatctcacagacagaaacaaacgagcaaaagctgaaccagcagaatctgcccaagtttgtcgaaagctctgagctggctgaagccatgggcctgtgcttgtcagagcttaggtttttaacctacactcgagacgttagcaaagtgactcattatcagaggttttccctagtgaaaaagagcggaggcgtaagacacatatccgcccctatgccacgtctgaaacgcatacagtattgggtgaaaaccaacatcctcgatacgctgccacttcacgactgcgcgcacggcttcgtgaaggagcgtagtatcgtttccaatgccgcaccacatatcggacagtccattgtcatcaacatggacctcaaggattttttccccactattacttataagagggtcaaaggactgttccaacagctcggctacaacgagaagatctccattctatttgcactcctgactacagaaccccactgtgatgagctcagcctagacaccgaaacatactacgtggcccaaggcaagaggctacttcctcaaggcgctccgacttcacccgctatcgcgaatctgatctgccgcagactcgaccggcgaattagtgattgtgcaaagaagctggggtttgaatatacaagatacgctgacgatcttaccttcagcattaaggacaatgattcagacaaggtgcggaagcttctgtggagagtcaaagctatcattaaggacgaaggtttcaatttacatcctgaaaaaacacggattatgaggagtcaccagcagcaggaggttactggtatagtggtcaatgaaaagatcaacctctcgaggaaaaaactgaagcgcttgcgcgccactctcttccagatcgaaaaagacgggttcagcggtaaaaattgggatgattccaaggatatcctgagaagtctgaccggattcgtgaattactatgcaatggtcgaccccgctaagagcgtgaagtacaaggagcaactaaagagaatcattcaaaagcatccgtatgagatctccaaaacgccctttatcggcaagctcaagaaatctgtattcattgaaaagagcaagcaggggttgtccccttgggacgactggtggcagcccgttgaaaaaacggagccagagctcattcttcccaaggaaaatgagaaacaggattcacgacggaaagcaaccgatagtatcgaatctacctcttcgtctcagtcaaacagggggagtacccgaaacaggtcttcagagctcccagagcttatagggaaagggttctttacagtgaccttgataataatcgccgtagccttggctaaggtgagcccactgatcttgctgttagccggctatctgatctaccgtctctggaaatga

SEQ ID NO: 13304 - RNA, 1671 nt, unidentified
  source 1..1671: mol_type = other RNA; note = synthetic construct
atgtctcaactgacccggcagcaactgtacgataagattaaggaaacaagcaaagacgaatacatcctgtccgagatgcaaagactgggatattggaaggaggatgctcagcccacgctcgctgcctctctcattaagaggcgtggcgacctgcagagacagatcaatgcgcttagcagccagattacagatccccaggccgcactgaaagctatacaccaggagaggatggcagccgccagacagcagagaatagacacgaaggtgaaacgcgaagttgatcgttatcaccgagcacaggcttggcatgagaagcagcagaaccacatccattatctaggggatgcagctggattcaaaccctctgctgctgccgacgtctcggacgcagaacggttaaacagtcttggattgcccgtttattccaacgccgcagagttagcggcggggatgggaataactctcaacgagttacgatttctgacatatagcaatcaggttagtcgcgtatgccactaccagcactttgctatgcagaaaaagagcggcggtactcgcttgatttctgcccccatgcctagattaaagaggcttcagtactgggtcctcgataatatcctccaacctctcgagctgactgagcaagctcacggtttcgtgaccggccgctccattgtctccaatgcccagccgcacctggctcagaaggtagttatcaatatggacctgaaggacttcttcccaaccgtgacttacccaagaattaagggcacttttgcgcagctaggctataacaacgaagtcgcaagcctgctggcactcttgtgctccgaagccgatactcagacggtggagatggatgggcagcggtactacttaaattccacgtcaaggcgtcttcctcagggcgccccaacctcacctgccttgtcaaatgttatttgtaggaccctggacaagaggctacaaggcctcgcgacaaaacacggctttgcctacacaaggtatgccgacgacctgaccttctctggaacagacactgcggcagtgcctgctctcctgtacggtgctaaagcaaccgtgaccgcagaaggatttaacgtgcatcctgacaaaacacgcatcatgaaacaagggtctaagcaggaggtcacagggattgtggtcaatcagcacctgtccgtggataacaaaaagctgaagcaattcagagccctgctatttcagattgataaagacgggtacggggacaagtcgtggggcaatggatacaacatcttggcctcaataaaaagctatgcccattatgtacgcatggtcaaccctgaaaaaggttcacaattcctgcagcagatcgccgctatccaacagaagcatggaaagcccaacgtggccatgaagttcagtactacccagtttcgggaacgagccgctcaaggtaaacttccactggatgcaatgcatgtggcccccatcaagccggctcccacattggacgatacaatccagcatcgggatgttctgccacaggtggaggccgcactcggccttagtgtgcctgaagccgtagaaaccgagccagagtctacccccgccactaccccggagacaccaaatcaaccacaggggctggtgagcacccttatgtccttgctccggggcaaaagttga

SEQ ID NO: 13305 - RNA, 1680 nt, unidentified
  source 1..1680: mol_type = other RNA; note = synthetic construct
atgacgaaccttacccgacagcagatctacgaccaaataaaagctactagtaaggaacagttcattctctctgagatgcagcgactggggtattggccaaaccccgaggcacccacactccactcagagctgatcaaaaggaagacccagctgcagcagggcatccgggagctctcacagcaggttgacgatcctcaggccgctcttaaacagcttcataagacacgcatggcagaggccttggccaaaagagagcaaacgaagatcaacagggaactgaaacggtacgaaaaagctttaagctggcatgagaggcggcaaaatcagctagactatctgggggatgccgcagggtataagccctcccccaacccacaggacagccattcacaaactttactgcactaccatttgcctgtctgttccacaggcaaagagctggccgcgcttatgggggtgactctaaacgagctcagatttctgacttacaccaatcaggtatctacagtacagcattatcagcaatttgccttagctaaaaagactggcggaactagactcatttccgctccaatgcctcggctgaagaggctgcagtattggatactggagcaggtgctccagccactagcactaaccgatcaggcccatggtttcgtccagggcagaagtatcgtgacaaatgcccggccgcacttgggccaagccgtagttatcaacctggatctcaaagacttctttccaacgattacttatccccgcatcaagggggtcttcgaacagctgggttacaaccacgagattgcaaccctgtttgctctgttgtgctcagaaccaattacacagacagtggagctggacgggcagcgctactatctggcacaaaatcctcgtagactgcctcagggggcgccaacctctccttacctcagcaatttaattaccagacagcttgataagagactgcagggactcgctcagaaatacggttttgtgtacacaaggtacgctgacgatctgactttctccagcgccagtaccgaagctcccacttgcggtcttctccactggattaaggccatcgtgcaggaagaaggcttccaactgcatcctgataaaaccaggataatgcacaagggccgacgacaggaggtgaccggattggtcgtgaaccagcagttgaatatcgagcgccaaaccttgaagcaatttcgcgcactcctgttccaaatccagaaagatggctatgtgggcaagagctggggaaagaatcgcaacctgcttgcctccataaagtcctacgcccactatgtgcggatggttaatccggtgaaaggtgaacagttcctgcagcagattgccgtgattcagcagacgcacggcgtccccgctcaaacccttaagtactccacacaagactttcgtcaacgttctgcccagggacagctgcctcttgctaccatgcaaatcgcccaggcatctcacaagccccagctcgaggacataattcagtatagcgaagtcatcgaacaaatccgggcggagctaaagttagcaccgccccagacaagcttgaataccgagacaagtcctccatacccaccccctatctcagaaccggcgtctctgattcacaacgttatctcgttgttcagtggactctttaggggaaaactgtga

SEQ ID NO: 13306 - RNA, 1731 nt, unidentified
  source 1..1731: mol_type = other RNA; note = synthetic construct
atgacccagttgtccaggcaagaactgtatgacaagatcaaggagacatctaaggacgagtacattctgtcggaaatgcagcgcctaggttactggaaggaaggggagaaaccctccgttgcagagacattaatcaagaaaaaggcagagcttcagactgagatcaataaattgtctcgggaaattaaggatcccaaagaagcactgaaggctatacataagcagcgcatggcggaagcaaggcagagaaggattgatactaaagttaagcaagagttgaagcgattcaagagtgctgaagaatggcacaagcgaaaacagaacaagatcgaatacctgggtaacgcatgcagcaccaacagcaaaagtgatgagactgctaagaataccaattcggataaacttcgcctgcatcagctgccgacctgttccaccgcaattcagctcgccgaggccatagccatcaccctgaacgagctaagatttctgtgttacaccaacgaggtttccaaaattacacactaccagcgctttggtatccataaaaagaccggaggggtcagacttatcagcgccccaatgccgaggctgaagcgtcttcaatactgggtccttgacaacattctccagaaaattccactctccaacaatgctcatggattcgtgcccctgcggtcaatcgtgactaatgcgcaacctcacgtaggcaagaaagtggtgatcaacatggatctgaaagactttttcccaaccgtggggtatccgcggattaaaggactgttcgccaaccaggggtacggcgaggaagtgtcaatactgctcgctctcatctgcagcgaacctgacacgcagacagtcgagatggatgggcaacggtactatatacacagcaaggagaggttcctcccacaaggagcgcctacttcacccgccatctctaatatcatttgctaccgtatggataaacggctgcagggcctggccaaaaagtatggctttgtctatacccgctacgctgatgacctgaccttttccagtcaggacatcgataagattatgcccctcctgaactgggtcaaagccacggtaacggaggagggcttcgttgtgcacccagagaaaacacgcataatgcaccaaggcgtgcggcaggaagtcactggaattgtagtgaatgagcagctctccgtaaatagaaagcaccttaaacagttccgtgctctactctttcaaatcaaaaaggacggatatggaaacaaaaagtgggggaagggcggatctctattgcccacattaaagggctatgcgcatttcgtcaagatggtgaaccctttgaagggacagcagttcttgactcagatccaggagataatccaactgcacgggtatccaaatgagacgcctaaacagggtaggtcaacaagtgactttagaaaagccgcagcccagggcaagcttcctttgggtagcatgcaggttgcccaacccactctgccccccgatattaataaaatgatccagcacagagacgtgctcgacctcgtgcgagaggaattaggcctgccagccttagaggaccctaagcagaagaaggaaacagggagttctgataaacctatggtgcagccactgacagctgaggacgaaaacagatcccatgtgaacgaaaatgacattaattcaagcggctttttctctaggatcaagagcctgtttgggggcgataagtga

SEQ ID NO: 13307 - RNA, 1689 nt, unidentified
  source 1..1689: mol_type = other RNA; note = synthetic construct
atgacgcagctgtcccggcaggagctgtatgacaagattaaagagacttccaaggacgagtacatcctttctgaaatgaagcgactgggttactggaaagagggtgacaagccatccgtcgccgcaacccttattaaacgcaagactgagctccagacagaaatttacaaactcagcagggagatcaaggatcctaaggcagctcttcaggccattcataaacagaggatggcggaagccagacaaagaagagtcgacacaaaggtggcgtatgagttgagacgttaccaacgtgcgaccgattggtatcagagaaagctctctacaattgactatctgggatcagcatgcgtgttaactcaggagaagaagcagaaaatcaaagtgctggataccgcaaaacttgctcgctaccagctcccgaatataagcacagctaaagagttggccgaacagatgggagtgacactaaatgagctccgatttctgtgctacactaacgaagtttccaagataactcactatcaaaggttcggcatacataagaagaccggtgggacccggatgatttctgctcctatgcccaggttgaagcgcctgcagtattgggtgctggataatctcttacaaaagattccgctagctgagcaggcccacggatttgtccccagtaaaagtatcgtcaccaacgctaaacctcatattgggaagaaagtagtcattaacatggacctgaagaatttctttccgactgtttcatacccccgtataaaaggggtgtttctgtctcaggggtacaatgatgaagtagccacattgtttgcactgatctgttctgagccagagacacagacagttgaaatggatggacagcggtactatattcactccaagcaacggtaccttccccagggtgctcccacctcccccaacataagcaatatcatctgttacaaactggataagcggctgcagggcctagccaacaagtacggcttcgtgtacaccagatatgccgatgatatgacgtttagcagcaacgacgcgtccaaggttaaagcactcctaaactgggtgaaggccacagtgaccgaagaagggttcatcatccaccccgaaaaaacgaggatcatgcatcagggggctaggcaagaggtgaccggccttgtggtgaatgaaaagctcagtgtgtcacgaaagcagttgaaacagtttcgggcactgctctatcaaatcaagaaggatgggtatgacggcaaacagtggggtaaaggcggcagcttgctgccaaccatcaaaggattcgcgcacttcgtaaaaatggtcaatgccgaaaagggagagaagttcctggcaaacattaaggagattatagatctgcacggctatcctgacgccgataagaaacagaacaaaacttctgacgactttcgcaaggctgccgctcagggaaagctgcctctgaacagtatgaggatcgccactgctcctccaccaccagacatcaataccatgatccaaaacactgacgttttggatctggtccgcaaagagctgggtcttagcgaaaacaaccctgaaacgaccaatgacacagccatctcatcggcccaaagtgaagacaatagagaggagggctcagccggcttcttagcacgcttaaagacattcctcgggggagagaaatga

SEQ ID NO: 13308 - RNA, 1587 nt, unidentified
  source 1..1587: mol_type = other RNA; note = synthetic construct
atgggcttgtctcgtcaggaactgtacgagcaaattaaggccagtagtaaggaggggtacatattagccgagatgcagaggctgggattttggactgagtcagagccacaacccgcccgcgaactgatcgctagaaaggcagaaatccaacaggaaatcgcgagcctcagtgcgaagatcaaggatcccgaagcagctctaaagctgattcataagcagcgaatggctgcggctctggaaaaacgacttcagactcgcatcaagcgcgagcttaagcggtttcagtcagcccatctgcaccatcaaaacaagcagaagaagcttataacactcggtgacgccgcacattttgggcctaagcaacaggccacccagtcagaaaaattgcaggcctataagctgcctgaaattgatacagccctggagctggccgaacacgcagggattaccctcaacgagttaagattcctgacgtactctcgtcgtgtgtccaaattatcccactatcagcggtttgaaatggcaaaaaaaactggcggcactagactgatttctgctcctatgccacgcctgaaacgattacagtactggattcttgagcacatccttaatccactccctgtaacccctgccgcacacgggtttgtccctcagaagggcatactgtccaatgccaggccccacatcgggaaaaaagtggtcatcaacctggacttgaaggacttctttcccacaatctcctaccctcgcgtgaagggcttgtttctgagcttggggtatggaaatgaggtcgctacgttgctcagccttctgtgtacagaggccgagagtcagcaggtggagatcgacgggcaaagatacttcattgcagcggaccagcggagacttcctcagggcagtccctgctcacccgctattagcaaccagatctgtaaaaggctggacaaacgacttgctggactggcgcagaagtggaattttgcttatactaggtatgcagatgacctaaccttcagcgccgatagctcacagtatctgggagccctgttcaaaggactccggcagatattgaaagccgagggtttcgttctccacccggacaagaccaggatcatgcatcagggtgcccggcaagaagtcaccggcctcgtggtgaaccaaggcctgtccgtgagcgcgtccactctaaagcgcttcagggctctcctgttccaactcgataaggacgggctcaacggtaagacatgggctggacactcctcgaccgagcccggattcttagaaagactgcagggcttcgcacagtacattcggatggtccagcccgagaagggccaaaaactctgcgctcatctgcaggccattaggcagaaatacccggatacaggcctactctctgcccactctaccctgccaaaaggcaaaaaaacggcctttcggcagaaatctgcaaatgcagagctgccgttgccaggtcagagggttgccccagtacccccaccaccaagactggccgagacaatacttgatagaggaatcttggcagaggttgaagccgcttggcaggctcagggagggcaagtgtga

SEQ ID NO: 13309 - RNA, 1665 nt, unidentified
  source 1..1665: mol_type = other RNA; note = synthetic construct
atgcagttactcagtatccttgaccagttggggtttgggctgtcgtctcccaagcttaaagtggtcttcttttgcctgaacctgctcccaatgagcgaccacaggatgacccgacagcagatctacgacaggatccgccaaaccagcaaggaggagtatatcttagaggaaatgaagcgtctgggtttctgggacacgacagaggaggccccaaaaatttcagaagagctcatccaaaagaagggtgcactccggagggaactccgcgaacttatggaaaaacagcggatgttccgcgacaaagagcggatgttggcagaaatgagaaagaaacgaatggcagacgcactggccagaagggaagagactaaggagagaaggaaagcagaaaaggaggcacgcgccaaagcctggcaggagaagaaagagcggtctatcgtgttcctgggcaaagactatagcgcagggctgtcggaagaagaagccgatttggcgaaactggccgctctgaatttgcctgcgtttaaggacatcaaagaactggcagaggctatggacatttctgtgggccgcctgcgttatctgtgctttcagagaaagttgtcaaccgtgagccattatgaacgcttttacctggctaagaaaaccggtggaaagaggctcatttccgcccctagaccgatgcttaagaacgctcaatactggctgctggagaatgtgctggcccggcttgaaatgcatgaggctgcacatgggtttgttcctgaacggtccattgtctctaacgccaaactgcacgaaaagaaggagctcgtaatcaacatggacctaaaagatttcttccccacggtgacatacccacgagtgaaaggcatgttcaaaggactgggatactccgagcagcaatccataatctttgcgttactcactacagagcctgaggtggaccaggtcgaaatcgatggccaactgtactatgctcagaaaggcgagcgctatctaccacaaggggctcccacttccccggctatcacaaactggttgtgtagacggatggaccgccgattcgagggggttgccaaaaagctcggctggacatacagtaggtacgctgatgatttgagcttttctgctaatgacacctcaaatataagccgaataatatggcaggcccaacagatcatacaggatgagggatttgtgattcacccaaagaagttaaagattatgaggaagggccggagacaagaggtgaccggccttactgttaatgagcaggttgcagtcgatagaaagaccctgaagaagttccgggcttgtctccacactattgagacaaagggctatcaggctgctgaatggggacaggggttcatcctcgcgagtattaagggtttcgccaactatgtcagaatggtgcaggccgagaagggacaggccctgtgcgaacaggtagatcgtattctagcaaaggaggagaataaacaggcctggaaagcctacttcgctaaccctagtaggaagaagtacgcctacgaagcccagaaacagcaggccaccattgaagccaatgcagtagattttggctcttcaggacttgcggaatccctaactcccgtcgatccccaacagaaagatgaggagcagtggtggagcctgtggtga

SEQ ID NO: 13310 - RNA, 1503 nt, unidentified
  source 1..1503: mol_type = other RNA; note = synthetic construct
atgactcgccaggagatctgggaccgcatcaaagagctgggcggacgggacgagttcattctccacgagatgaaaaggcttgggttctgggatgtgagcgagggcgttcctcagttatccgagagtctgcgtgagcagcgaaaatctctggaaggcgagctgaaagaagccctgcagcagcaggccgtatataagaacaagaagaagatgttacgggacatgcgccagaaacgcatggctgaggccaaggccaggcgggttgaaaccaaagaaagaagggagcgccaaagggccgagaaggctgcagcctgggctgaagcccagcagcaagacattggttggttagggccggctgtgtccgctggtcttcagcagaaagaaagcaacgtcccccagctggaatcattcgggcttccagtgtttaatggggttaaggggctcgctgaggctatgaatctgcccctgaatgaactccgattcctggcttttgaccgtcaagtgtcaagaacatgtcactatcagagattcaaagtcgcaaagaaaacagggggattccgggagattagcgcccctgctcccaggctgaagaaagcccaacactggattttggatcatttgctgtacaagctccagctacacgaggcggcacacggttttgtgccacagcggtcaatactgtccaatgcactcccacatgtgggcgcacaggtggttataaacatggacgttaaggatttctttccgtctgttagctatcgacgggtcaaaggcgtgttccaaagcctaggctactccgaacaactggcaaccatactcggtctaatttgcacagaacctcaaactgacgaagtgaccttggatggacaaaggtttttcgtggctaagggagatagacgacttccccaaggcgcccccacttctcctgcaatcactaacattctgtgccggggattggatcggagattcgaaggaatggccaaagcactgggatggacatacacgcgctacgccgatgacctgacatttagtaagaaggccaccgatgctagagacgtgaatagagtcctctggcaggcaaggcagatcgtagagaatgagggatttgtattgcatcccgataaaatcaaagttatgagaaaagggacccgacaggaggtgaccggggtggtagtcaatgagaaaccaaatgtgtctcgtgccaagctcaagcagtttagggccgtgttgcataggatcgagacgcagggtctttccgcggctgatttcggcaaaggtcaggtcctggaaagtatccagggctttgccaactacgtctggatgattaacccagagaagggcgcggctctgaaggcccaggtcaagaacatcctcgccaaacccgaattacaacaggtgctggcacagaagaacacttatcctgaaaagggcaaggtggcgatctttacaccttacaaggacaaggaggtccagccactttcgaccgactggtggcgcctctggtga

SEQ ID NO: 13311 - RNA, 1554 nt, unidentified
  source 1..1554: mol_type = other RNA; note = synthetic construct
atgaccaggcaggaactgtacgacgagatcaagaaaactagcaaagattcctacatactctctgagatgaaacgacttggattttgggacagcgcaaaaccaaaggtagctcaggagctcattgaaaagaaaactgcccttcagaaagagttgaatggcttatctaccaaaattaggaatcccgaagccgtcataaaagacattcacaaacagcgcatggcagacgccctccttcgccgagaagaaaccaaggcaaagaaggaaaagatctttcaggagaacctagccaaacgccaagagaaaaagaacagtgagctgggcttcatcggccatgctttcatggctgatctcgacgagaaggagtcgaatcagaagctactgaacgagaacaacctgttcttgattaaagatgcgaaagatctggcctcaaaaatgggcattacgctgaaggagctgagatttcttacacacacacagaagctgtctaacagaacagattacgtgcacttcaagatggttaagaaaagtgggggttttcgggagatctctgcgccaaagccgcagctgaaaagactgcagtactggatcctagaaaacatcctgaacaaggtggccgtaagcaacgaggcacatggatttgttgctaagcgtagcatcgtgtccaatgctaagccacatctgcagaaagctctggtgattaattgcgatctcgaaaatttctttcccacactgtcctatgcccgggtcaaaggcctgtttaaatctctcgggtactccgtggagcttgccactatcttggcgatattgaccaccgaagcagaacaaaaagaggttctgttagatggtgagaagctgtatttatatacagggaagaggtacctgccccagggatcgcctgcttcacctatgattaccaatctcatttgtcgcaaattagacaaacggatgagtggaatctcaaagtccttagacttcaactacacccggtatgctgacgatatgactttctcctcagacacttacctcaacatcaacaagatgatgttctggatcaaggggattgtgaaagaagaaggatttatacttcaccccaaaaaaaccaagattatgaagaaaggtgctagacacgaagtgactggcatagtggtgaatgagaagttgtccgtgaaccgtaaaaatctgaagaagttcagggccctattgtatcagatcgaggagtctggtctggaaggcaaacggtggcagggaaaatccgagaatctcatggcaagcgtgtgggggtatgccaattttatcaatatggtagaccctgagaagggggcgaagtacaagaaacaagttgaagtccttttggagaagtatccactgggcaacctgggatcaagcagcggggaatttagggccaagagcgccaagggcgagcaaccctgggaaagtaaggtccaggagatcgaggcaaagacactcgaacctgaaatgcaggtgaaggaagtcgccgagcaaaaggagacgccgtctttcgtcaataacattctcagtatgttcagaaagtga

SEQ ID NO: 13312 - RNA, 1563 nt, unidentified
  source 1..1563: mol_type = other RNA; note = synthetic construct
atgacccgacaggagctgtatgatgagatcaagaaaacatcgaaagatagttacatcctgacagagatgaaacgcctgggtttctgggacaacgctaaaccaaaaatgcctgaagagcttatagagaagaaaaccgagctgcagcacgagcttaaccagctctcaaccaagatcaaaaatcccgctagcgttattaaggaaatacacaagcagcgaatggctgacgccctcgttcggagggaagagacgaaagccaaacgtgaggcacaggcgcagaaaaaggctaaggaacgggcagagaaaaaggaaaataagctcggcttcatagggcattcgtttattcatgacgacgaaacctccgctaagctagaactgctggttaccaacaaccttttcttaataaaggacgcaaaggatctggcaaataagatggggattgacctcaaggccctacggtttttaacctacacccagaaactctcaaggcaatccaactacgttcacttcaagatggctaaaaagacgggaggattcagggaaattagtgccccgaaaccccagctgaagaggctgcagtactggatccttgagaatatcttgaacaaagtggcagtccatgagaaggcacatgggttcgtgacaaacaagagcattatgtccaatgctcagccgcatattgggaaggccgtagttatcaattgcgatctcgagaacttctttcctacattggactatggaagagtcaaaggcctcttcaaatctctaggttactctgctgaggtggccacaatcctcgctatcttgactaccgaagcccaacaaaaagaggtgactctcgatggcgagaagctttacttatacaccggcaagagatacctaccccaaggatctcctgcctcccctatgatcactaaccttatatgtcgcaaactcgataagcgtatgtcaggcatcgcggactccttggcgtttacttatactaggtatgccgacgacatgacttttagcgccaccgcctatcagaacattaataagatgatgttctggatcaagaaggtgactaaggaagagggtttcatcttacacagcaagaagacaaaaattatgaagaaaggggcatgccacgaggtcacagggattgtggtcaatgaaaaactctctgtaaatcggaaagagctgaaaaagtttagagctctgctgtaccagatcgaacagcacgggttggaaggtaaaagctggcagggaaaaacagagaatttgatggcaagcgtgctgggctatgccaatttcattaatatggtggatccagtgaagggcgccgactatctgaagagagtgaaggccctgctgcagaaataccccatgccttcactgggcctgtctgataagacctttcgcattaaatccgcggagggcaagcaaccctgggagtctaagccagtatttcttgtcacagaagagacgcgcgtggtcagcagtaaagaactgggagaagaggcctccaagacgactctggaaaacccaagttttctgaacaacatcttggatatgtttagaaagtga

SEQ ID NO: 13313 - RNA, 1566 nt, unidentified
  source 1..1566: mol_type = other RNA; note = synthetic construct
atgaccaggcaagaactctatgacgagataaaaaagacttccaaggactcatacatcctcagcgaaatgaaaagactcggcttttggaataatagcaagcctaaagttgccacagagctgatagagaagaagaccaaactgcagcaagagctaaatcagctctctactaagattaagaatccagaagctgtgatcaaggacattcacaagcagcgaatggccgacgcgctggtgcgaagagaggagactaaggccaagagggaagcaaaggagcaggaggcaataaagaataggcgcgagaagaaggagaataacattgggtttatcggaggcagttttatttcagatattaacgagcaagaggctaatacagaattactgaaaagcaacaacctatttctcattaaagacagcagagacttggcgaacaagatgggcatcaatcttaaacagctcagattcttgacctacacccagaagttaagcaacagaacggactatgtacgtttcaagatggccaagaagaccgggggctttagggaaatttcggcaccaaagcctaaactgaaacgattgcagtactggatccttgacaatatcctaaacaaagtggaggtcagtgagcaaacccatgggttcgtcgttaaaaggtcaatcatctcaaacgcaacaccccatattaatcgcgccgttgtgataaactgcgatctgcagaatttctttcccaccctgtcctacccgcgggtcaaaggactgttcaaaagcctggggtactctgctgaaattgctacaatccttgccatattgaccaccgaagccgaacagaaagaggtggtgctggatggtgaaaagctgtatctgtatactggaaagcggtatctgccccaaggctcccccgcaagtcctatgatcactaatcttatctgtcgtaagatggataaacggatgcagggcatagccactacactgaactttacatacacccgctacgctgatgatatgacattctctgcgaacgaataccccaacatcaataagatgctctattgggtaaaaggtatcaccaaggaggagggcttcactctgcacccagagaaaacacgcattatgaaaaagggttcctgccaggaggtaaccggagtggtggtgaatgagaaggcctctgtcaacaagaaggagctgaaaaaattccgggcacttttataccagatcgaacaaacaggaattgaggggaagagttggcacggcaaatctgaaaatctggtcgccgtcatttggggatatgcaaacttcatcaagatggtggactccgaaaagggggctaaatatatggctcaggtgaaagctatcatggaaaaatacccttctttgaacattacctccacaacgaacgaatttcgggtcaagagcgccaaaggcgagcagccgtgggaagatgagatcatagaagaaatcgaagaggtgacggaggtagtgacggatcagactaaaactaacgttcaggagaaagaggttcctaccacaccatcgtacattaacaacatcctcaatatgttccgcaagtga

SEQ ID NO: 13314 - RNA, 1890 nt, unidentified
  source 1..1890: mol_type = other RNA; note = synthetic construct
atgtttaattctgcacctggccagttaaccaggcaggagctttatgataaaatacgcgaaaccagcaaggacgagtacattctggcggagatgaagcgactggggttctgggaatctgacgatgacaagcctgaggtgcccgagactataattaagaggcgtggcgagctgcagcgccagcttaatgacctgcttaagcagcagagactctacagcgatccggaggaagccttaaaggctttgagaaaagaacgaatgcaggcggccctgcagaaacgcgtcgaaacccggaagaagaaggcagacgaacgccatgagagggccttgacctggcatgagaaacagcagcacacaataagttggcttggtgaagctgtatccctgggactgacggccccaacagcagacagtaatgcctctcaccaagggtccactacgtctctctcaagcgaccaagccgtgtcagcccatggcgcaaatactcaaaacgaagccgtaaataatgcctccggcatgaaacaccaggatctccccaccttcgacaaccacaaggctctggctgaaagcatcggcataactctgaacgaactcagatttctctccttccagaggagtaccagcaaggtgtcacactatcagcactttcagatcgccaagaaaacaggcggatttcgagagatcagtgccccgatgccaaggctgaaaagagcccagtattgggtgttggacaatatcctatgccacgtgcctctgcatgaggcagcacatgggttcgttgccggacgcagtatcctaactaatgcaaaaccacatgtgggccaggctgtcgtcgtaaacctcgatttgcagaacttcttccccacgatttcgtatcggcgcatcaaaggcctattccacaaaatgggatatgacgagagcatcgcgaccgttttagctttgctctgctctgaggccgatacccaaaagatggaattggatggggagcaatggtttgtgcagcagggagagcaacacctaccccagggggctccaacttctcccacaatttccaatattatttgtcgctccttagacgtccgcctgcagggccttgccaaaaagcacggcttcaactacagtcggtacgcagacgatatgaccttctcaggggataagacagctagagagtcactgcgcaagctgctgtggggggttcaagccatcgtggctgatgagggtttcatcctccatcccgataaaacaaggattatgaacaaaggtcagcagcaagaagtgacaggaatcgtggtcaacgattaccctagcatcgatcggaagaccttgagaaggttcagagcactcctgcaccaggtggagcagactggcatccaagggaagagctggaacggtgtttcagagccagaacatctgctgaggtccatgctgggcttttctaatttcgtggctatggttctccccgagaagggcgaggcttttaagcagcaagcaaaagccctgtacgaaaagcactctaacaaagtaggtacaaaaacaattggacagctgcgaaaggccgaatttcgaaaacgggctgctgctggtcaagcaccctgggagagctggaaggaggccccagttaaaatcgcgccagtccgtgagaagactgtggatgagcttcaggaagagcggaaccaggtgctcgccgaaagacgtgaggcgaaaaaaattgaaaaggaacaacaggatcggcagcgttcacggaggggagggtttcctggcgcaagtagatccgactcccggagagaagacgacaggtggaatcttcctgaggactcctcgggagacaacggtcctaacgtcatcattcggtttttagggttcatagggagcctgtttaccggaaagaagtga

SEQ ID NO: 13315 - RNA, 1680 nt, unidentified
  source 1..1680: mol_type = other RNA; note = synthetic construct
atgagtaatagcaattctcgccagcagtggtatgacagaataagggcatccagtaaggatgcggtgatccttgccgaaatgaaaaggctgggattttggcaggacactgatgttccaaccctttccgagacaatcattcagcgtcgttccgagctacagtctgaactgagtagattatatcatcagaagaatctgtaccaacaccccgaacaggctctaaaagccatgaggaagcaacgcatgcagaaggcacgtgagcaacgcgctctgacgcaacgcaagcaggccgagctgagacaacagcgagccaggaactggtatgaacagcatcagaacggcattgtgtggctgggggaagggatttctgccggtctgcaggacctttccagtgacatcgaacgccttcaggctcacgacttgccagtgctgcattcccctaagatgctcgcggaggccatgggcataaccctcaacgaacttagattcttggcgtaccaacggaagaccagccggattaaccattaccagcggttccagattgtgaaaaagactgggggtttgcgggacatcgcggcacctatgccacggttgaaacgcgtgcagtactggctgctggacaatattctccacaagctggctttgcacaatgccgctcatgggttcgtgctcggacgaagcatcatttctaacgcacagcctcacacagccaaggcactggtcatcaatctggatctggagaatttcttcccgtccatcagatacgcccgtgtcaaggggctctttaaaagcttaggttatagcgaaagcctcgctacagttctggggctcctttgtactgaggccgcagtggatgagataatcctcgatggcgagacgtggttcgtcatgagaggtgagcgacacctaccccagggcgcacctacaagtcctatgatttcaaacctcctcactcgaagcttagatagaaggctgcagggaatcgctaccaagtatggctacgcttacactaggtacgctgacgatcttagcttctcgtgcgagaaaccatataccgccaatgtaaccaggcttctgtgggccgtacggcagacggtgcaggaagaaggctttaaactccatccagacaagacacggttgatgcaccagggacgcagacaggaggtcaccggactagtggtgaaccaacacctctcacttgagaggaaaacattgcggcgattcagggcactactgcaacagatcgagcacaccggctggcagggaaagcactggaacggcgtaactgacccgatcaggctgcagcagtttgtttggggctatgcacattttgtggctatggttctgccagataaaggtgcgcagtttaaagcccagctgaacagaatccagcacatacattttggcggggtagtcaacaaaaaataccagtcagctcagaattccaaggcccagttccgcgtcttatcagctaaagcacaagcccccctcgtctcgtggaagcaagcacaagcccgccccctggttctgctggaaacaatccaacagcccttagcccaaacccagcacgagcccgtggagcaagccgcttctgggattattgaacagcagtctgccgttactgaggtgaagcaggcacctctggctggattggtggcctggctgagatcattgctgcggtga

SEQ ID NO: 13316 - RNA, 1905 nt, unidentified
  source 1..1905: mol_type = other RNA; note = synthetic construct
atgtccgaacgtactcccactagggcggagctgttagcccggattgcccagtcctctaaagacgccgtggtattagcagaaatgcaacgcctcggtttctggccaaaagatactacgcaaccgaccttagaggccgctctaatagagcgtgaggccgaactggcccaggcactcaatggcctgcaagaggaactgcgggtcaagggggatccacaagccgccctgaaggccatgcggcaagaaagaatggccagagccagagagcaacgcgaggcccacgcacaggcaagggaacagcaacgctacgagcgggcccttcggtggcatcaagccagaacacagcaggccggcttccttgggctaggggtcagtggtggactccaggcagaagctgaccccgcagcatgtgctgcccgactcgagaggcatggcctgccagtcctgaatacagctctcgaactggcggaggctatgggcctgtccgttcccgaactgaagtttctgtgcttccaccgggaggtagccacgacgactcactaccgtagatttaaccttccaaaaaagaccggcggagtcaggacaattagcgcccccatgcctagactgaagagagcgcagtattgggtgttggaccaggtccttgctaaagtagcctgtcatgaagccgcgcatgggtttgtgcctggtcgtagcatcgttagcaatgctgctccccactgcgggcaggcagtggttataaacctggacctgaaagactttttcccatcaattcacttccctaggatcaaaggtgtgtttaaagggctcgggtatggcgaagcagtggcttccatgctcgcgctcctatgtagcgagaacgcctgcgatgagctagaggttgatggagagcgcttttttgtcggaggaaagggtcgagacagggttttgccccagggagcccctacctcccctatgctgaccaacatattgtgccgtaagctagaccggcgcttgcaggggcttgcacagaagctgggattcacatacaccaggtacgcagacgatctcaccttcagtgctagtgatgaaggggcggcgagggtaggcagtctccttcgacaggtgcaccatgtccttcgatcggaaggcttcacaccgcatccagataagcagcgggttatgagacaaggggccaggcaggaggtcacaggcgtggtagtgaatgcaaagccctccgtgtctcgcacagaacgcagaaagttgagagcagccttgcacagggctaacacccagggcctcggtgctgctacttggcagggacagcccgctaccaatgaggtgctgaccggctatgcccgcttcgtgcgcatggtgtcagctcagcagggccagccgttactgcagcaggcactggccctgccttctgctaaaaccgccgcaactgccgcccgaggcaactcatttagacagagggccactcaaggtcaggcccccttgaggcagcaaggtggggagtggtggcaggtcatcccacctccagtgccccagttagctctgacagcgggacagatcaaggccgcccggcaagagcgactgaacgcagaaagagctgcgcgacagagcgcacttcaggcccaaaggttggccgacggcaattcaagcgcttctcggcctagcgcagctagcactggcgcttctgcagcagagcacacggagcaccagaataccgctgctcctgtggcttggtggcgcttcttcttccagctgtttatcatcattaagcttgcagcctcctttaaatctgccctcgtgttgatgctgggcgccctgatcctcggacaggcactgatgacacgctcactcgggtggggacggtttgcgctgaccgtgattgttctcgctctggtgggaagtctgttacggtga

SEQ ID NO: 13317 - RNA, 1902 nt, unidentified
  source 1..1902: mol_type = other RNA; note = synthetic construct
atgacagagagaacccccactagagccgagctcctggccaggattgccctatctagcaaagatgcagttgtgctggcagaaatgcagcgcctaggcttttggcctaaggatgccgctcagccaaccctcgagtccgcactgatccagcgagaagctgaacttcagcaggcgctgaatgaattgcaggacgaacttcgggtcaagggagatccacaggcggccctgcaagctatgcggcaggcaaggatggcccgagctagggagcaacgggaggctcatgctcaggtacgggagaaggctcgctatgagcgagctttacgctggcaccaggcgagagacacggaagtgggatttctggggctgggcgttagtgggggtttgcaggccgatgctgaccctgccgggacaacagctagactggtgaggagcgggttgccagcacttagcaccccgctggaactagctcaggccatgggcttaggcctccctgagttgaagtttttgtgtttccatcgagaagttgcccggaccactcattaccgccgcttcgacttgccaaagaaaacagggggcgtcagaacaatctccgctcccatgcctaggctcaagcgagcccagtactgggtactggaccagatcctggtgaaagttccttgtcacgacgccgcacatggcttcatgccgggacgcagcatcgtgagcaatgcagcgccacattgcgcccaagccgtggtcattaacctcgatttgaaggacttttttcctagcatccacttcccccgtataaaaggagtatttcagggtctgggctatggtgaggccgtggcatcgttgctggccctcctgtgctcggaaaacgtgtgtgacgaactggaggtcgatggcgagcgatttttcgtcggcgggaagggtcgtgaacgggtcctaccccaaggcgcccctacatcaccaatgctcactaatattctgtgccgtaaactggaccggcgtttacagggcctggctgacaaactgggctttacatacaccagatatgctgatgacctcaccttctcagccagtgaggaaggtgctactagagtggggtccctgctgcggcaagtgcaccacgtgctgcgttcagagggcttcacaccccacccggacaagcagcgggttatgcgccagggtgctcgccaagaggttactggcgtcgtggtgaacgcaaagccctccgtgtccaggaccgagcgacggaaactgagggctgccctgcaccgcgcaaagactcagggactggccgctgccacttggcaaggtcaggctgcctctagagatgtgttggtaggctacgccaggtttgtgagaatggtcagtgctccccaaggccaggcactccttcaacaggccctcgcgttaccgggaacggctccttctgcagcggctgcaagagcggatgccttcagggtcatggcggccaaaggacaggcaccccagaggagacaaggagcatggtggcagcccacccctcctccattacctcagctggcccttacagcccagcaggttaaaaccgcccgccaggagaggcttaatgccgagcgggctgcacgccaagcagccaaaagacccgcagctcccgcccaaggaagggatgcaaacacccaggccccagggatgagtcacacgcagggacacaccccagatgcccccacaacttcagcaccaccagtatcttggtggagattcttcctccagctgtttattctcatccgggttgcggtggggttgaagagcgccctcttcctgatgctgggggctctttgcctggggcatgcgctcatgactcggaggcagggatggattagatttgcactaaccctcgtgatacttgccgtgttatcctctttcacgaagctttga

SEQ ID NO: 13318 - RNA, 1905 nt, unidentified
  source 1..1905: mol_type = other RNA; note = synthetic construct
atgtctgagcgcgtgcccacacgggctgagttattggcccgcatagccctcagcagcaaggacgccgtcgtcctgtctgagatgcagaggctcgggttctggccgcagaatgcaacccagccgactatagaggcggccctgatagaaagagaggtggaactgcagaaagcccttagcgagctccaagatgagctgagagtaaagggcgacccccaggctgcactgcaggcaatgcggaaggaacgaatggccagggccagagaacaaagggaagccaatgctcaggctagagagcgtcaacggcacgagcgcgcaatgcggtggcatgaagcccggaaaaccgaggccgggtatttgggggacggtgtgagtgggggcctacaggtcgatgctgaggcagccgcagtcaaggccagactgcagtcacggaatttgcctgccctatctaccccccttgaactcgcgcaagcgatggggctgaccttgcccgagctcaaatttctctgcttccaccgggaggttgcccgtactacccattaccggcgattttccttaccaaagaagacaggcggcgttcggacaatctccgccccaatgccccggttaaaacgcgcccagtattgggtgctagataacttactcgcaaaggtgccatgccacgacgccgctcatggcttccttcctggccgctccattgttactaatgctgctccccattgtgcaaaggcggtcgtcataaatctggaccttaaggactttttcccatctatccactttccacggattaagggagtctttcagggactgggttacggagaaagcgtagcttcacttcttgcactgctgtgctcggagaacgcctgtgacgagctcgaagtggatggggaaaggttcttcgtaggcggcaaagggcgagatcgcgttcttccccagggagccccaacctcccctatgctcacaaacattctgtgtcgtaagttggatcgccgtctgcagggcctggcctctaagctgggattcgcctacactcgatacgctgacgatctgactttttcagcccctgctgagtcagccgataaggtgggccggttattgcgccaggttcaccatgtgttgcacgacgaggggttcaccccgcaccctgacaagcagagggtgatgcgaaggggagccaggcaggaagtgacgggtgttgttgtgaacgctaaaccgagcgtgagccgagaggagaggagaaaactgcgcgcggctctccacagagctggtcagcagggtgtagaagccgccacgtggcagggacatgctgccactcgcgacgttctcgtcggttatgcgaggtttgtgaaaatggtggatgctcgacagggccaacctctgcttcagcaagctctggctcttcccggagcaaacgccagtttggcagccggtaagccagatgtgttcaggattcaggctgcaaagggagaagcccccgcaagaaaacaaggagcgtggtggcagccagcacctagtccagagcctcaactggcactgacagcaatgcagatcaaaaccgccaggcaggaacgtctgaacgccgaacgcgcagccagaaatgaggctaaaaggcaggagcaaatcgccagaggggaggctcccgctcctagaagaccccaacccagcgctgaagcaatggcatccgcggcgcaaatgacaggcgccgtccacaagccaattgcgtggtggagatacgctatccagctcgtcatcgtgatcaggctggctgtaggcctgaaatcccctctggtcttcatgttgggcatgctgtgggtgggatatgccgtgatgacgcgccagctagggtggtggcggtttgcaattgcaatcctgggcatcgccattctagggagtgtgctcaacgtgtga

SEQ ID NO: 13319 - RNA, 1887 nt, unidentified
  source 1..1887: mol_type = other RNA; note = synthetic construct
atgtcagagaggatgccgacgcgcgcggaattgctggctcgcatcgcagcctcttccaaggaggacgtcgtgctcgccgagatgcgaaggttgggctactggcccggcgaagcaggtcaaccagtgatccaggcggccttgctcgaacgtgaagctgagctgcagcaggctctgtcggcgctgcaggaggagttgcgggttaaaggtgatcctcaggctgcccttcaagcgatgaggcgcgagcgcatggcacaggcacgagaacagagggaggctagggctcaggcccgagaaagggaaaggtatgagcgtgccctgagatggcatgagcgcagaaaaatggaggcaggctacttaggcccaggagtttctggtgggctgggggcagaagtcgacccagaggctgtgaaagccagattagccgcagcaggactccccgcccttacaaccccttcagagttggctcaggccatgggactcagtctgcctgagctcagattcctgtgcttccaccgcgaagtggccagaacaacccattatcgacggttccagctaccaaaaaagactggaggggtgaggactatctcctctccgatgccccggctgaaacgggctcagtattgggtcctggataacctgctggcaaaggtgccatcccatgcagccgcccatggtttcctgccaggaaggagcatcgtgagcaacgctgctcctcactgcggacaggacgtggtgattaatcttgacctcaaggacttctttcccagcatacacttcccccgcataaagggcgttttcagagggctcggctacggcgatgcggtagcctcactgctagccctgctgtgtagcgagaatgtctgtgacgagctctctgtggatggcgagcggttctttgtggggggaaaaggccgggagcgtgtcctacctcaaggcgctccaaccagtccgatgctcaccaacctcctgtgccgcaagttagacagacgtctgcagggcttggccttgaaactgggcttttcttacactcggtatgccgatgacttatccttttccgccgctggtgatgccgctcagcgtgtagggcgtctacttcgacaggtgcaccatgttctgcgggacgaggggtttactccccacccagataagcagagggtaatgcggcggggagcaagacaggaagtaaccggagtggtcgtgaatgacaagcccagcgtgtctagagccgcacggagacagctacgagctgcgctgcacagagccggcagacagggtgttcaagccgccacctggcaaggcgaagcagccacacgcgacgtgctggtgggctatgcacgatttgttcacatggtgaacgccgcgcaagggcagcccttacttaagcaggcccttgcgctgcctggagcaagttcacacgctcccaggcctgatgcattcagagcccaggccgtgaagggagtagcacctgctcggaggagtggtccctggtgggaagtcgtccccgctccagagcctcagctggcactcacagcagggcagatgcaagccgcccgccaagcaaggctcaatgctgaaagggctcagaggagcggaaaacccgccgtggccccatcagctcaacctgctactgcgacgccaggagcacgaccggttgccagacctgcgcctgttgccgaacaacccgtgccgtggaaacggtacgggctccaggtctttgggtacgcatttatggctcttgtgctgcattccgccgcttttttgttccttgccctgatttggcactcccagagtctgaagaagcgcgatctgggctggggtcggtttgggctgggggtattcgtcttaagcattgttgccgtcatgcttaagggcttgctcgctcgctga

SEQ ID NO: 13320 - RNA, 1917 nt, unidentified
  source 1..1917: mol_type = other RNA; note = synthetic construct
atgtctgatagaatccctacgcgggcggagctcatcgcgcgtattatgctctcgtccaaggatgctgtcgtgttagccgagatgcagcgcttgggtttttggcctgccgacgccgggaaaccaactcttgaatcagcgctgattcagagggaggtggagttggaacaggcactgcaggggctctacgcccagcttagggttaagggggaccccgaagccgcactgaaggccatgagagaggagcgtatggcacgagcccgggagcaaagagaggccaccgctcaggctcgagaaagacggcggtttgagcgcgctttacggtggcacgaggctcggaagaccgacattggctatctcggagcgggagtgtccggtggactgcaaccacctcctgctgctgctcccgcaaggaccctgcagccaggtctaccgccattggcctctcccctggagctagcccaggctatgggcatcgcccttggcgagcttaaatttctggggtttcatcgcgaagtggcccgcagcacacattatcggaggtttaccctccccaaaaaaacagggggagagcgcacgatctcagcccctatgccgcgcttgaagcgggctcagtattgggtcctggataatatcctcgctaaggtcccatgccacgacgcagctcacggtttcttgcccgggcgctctattgtaacaaatgcggcgcctcactgcgcaagggccgttgttatcaacctggatctcaaagatttctttcccagcattggctatcccaggattaagggcgtgttccagggactcggctacgacgaacgcgtagccggcgtcctggctctcctgtgtagcgaaaatgcatgcgacgagctggaggtggacggcgaacggttcttcgtgggtgggaaggggagggatcgggtgttgcctcagggtgcgccaacatcccccatgttgactaacatactgtgtagaaaactggaccgccgactacagggcctagcagataagatggggtacacgtacaccaggtatgccgacgacctgacttttagtgcaccacccgaagctgccgaccgtgtaggtcgcctgctgaggcaagtcgatcatgtgctgcatgacgaggggttcactccgcacccggataagcagagagtgatgagggccggatcacgacaggaagtcaccggggtggttgtcaatcagaaacccagtgtctccagggatgaaaggcggcgcctgagagcagccctgcacaatgctcagagaaacggaatcgaagcagctacctggcagggcaggcctgctacacgagaaactcttgtgggatatgctcgattcgtacagatggttgacgcccaccagggagccggcctttttgcccaagctcttgccctgccaggaggggctcatgccgctagacctgccagagcaggcgccttcagaagatctgcggcccagggccaggctccagctttagcacgtggagcctggtggcaaccagccgaaagacctgcgccacgcttagcacagaccgccggtcagatgaaggccgccagacaggaacggttaaacgctgagcgagccgagcgtaacgctgcagccaaacccgcacgagatgccgcaagagaggaggcgcggaggcatgagcagcaagagagaagggcagcacaacgggccgccgcagaaactgctcggcaaagcctccgccagcaacccgcacttacatggcgacactggctccaatacgcaatccagctctacatagtgataagagtagccaccggaatgaagagtgctgtcgtgttcgccgcaggaatggcctgggtgggctacagcatgatgacaaggaaaactggctggctgcgtttcatcgttgccatggttgtgatcgcgctggtgggcgctatgattcgcctgtga

SEQ ID NO: 13321 - RNA, 1887 nt, unidentified
  source 1..1887: mol_type = other RNA; note = synthetic construct
atgagcgccccgcagccaactagggccgaactgttggagagattgcgaaagtccagcaaggacgctgtgatactcgaggaaatgcagcgactgggcttttggccggcaggctctggagctcccacagttgaagaggcaatgatccagcgcgaggtcgaactcgcaaaggccctggaacaggtgagaagccagctgggcacacgtaccgatcctgagtctgcccttaaacagatgcgcaaggaacgaatggcggaggctagagctcgcagggaggccaacgcccaagcgagagaacagcggaggctcgataatgcgctccggtggcacgagaggtccggacaagagattgcctatttgggcgaccaggtgtcagccgggttgtatcccggtcacgcagctgtgaggccagagaggttagcgcggcatggcctccctctcttcgaaacccccctgcagttagcaaccgccatgggagtcccactcgccgagctgaagtttctggggtttcaccgagaggtggcaaggacgtcacactatcgtcggttccgcctgccaaagaaaaccgggggcgagagaactataagcgcacccatgcctaggctcaagagggctcagtactgggtgctagataatattctggcaagggttccagtccatgcggcagctcatgggttcgtcccgggacgaagcatcactagtaacgccgctccacattgcggccaagccgtcgtaatcaacctggacctgaaagacttctttcctggcgtggcctttcctcggatccggggtgtcttcaggggccttgggtacggggaggacgttgccactgttctcgcccttctatgctctgagaaccccgccgatgagcttgtggtggacggcgagctattcttcgtggggcgtaagggacgcgaccggacgttaccacagggagcccctaccagtcccatgctgacaaatgtactgtgtcgcaagctggatagacggcttcagggtcttgccgggcgctttgggtttgcttacacacgctacgccgatgacttaacctttagtgctccaccagagggctctgcatctgtcggcaggctgcttaggcaggttcaccacatcctgcatgatgaagggttcacaccgcaccctgacaagcagcgggtaatgagatccggcgcgcggcaagaagtgacgggagttgtggtgaacagagaaccctcagtggcccggagctcaaggagacgcctcagagccgcattgcaccgagctcagaaaagcggcgtcgcccaagcacactgggaaggtgctcccgccaatgccggccaactacagggccatgcccaatttgtgcgctccgtgaatgcccgtcagggtgcaccgctcgtagcacaggcacgaatgctggtgcggtcacctcatacactggcggcagctggttcgggtgctgcgtttcggcaaagagcagccgctggtcaggctcccatgaggccaggagatcgcgcctggtggagtcctgctgctaaagcggccccccaactccagctgactcaggagcagaaaaaagccgaacgagccgaacgacgggctagacggcgtgacgaggctagagctgcagctcaacccgccaggggtgaaagagctgctggagccggacctggccctttcactaccccacccgagattcccattagctggtggcgcttcgggttccagctgttctttgtcctgtggttcgcatccgcaacccgctcttccttggtgtttatggggggagcggcctggttcgggtggagtttagcccagagacgccagggatggcctcgttttctgctgggaatgttgattgtcttccttgcctccgttgtaatccagggcttctggaggcacagatattga

SEQ ID NO: 13322 - RNA, 1866 nt, unidentified
  source 1..1866: mol_type = other RNA; note = synthetic construct
atgagcgagcgggtgccgacgcgcgcagaattactggctagaattcaggcctcaagcaaagacgctgtggtgctggctgagatgcagaggcttggtttctggccagccggctctggcactcctactctcgaagcggctctgattgagcgggaagtcgaactgactaaggcgctggacggtctacacgccgagcttagagtgaagggtgaccctgaggccgctcttctggctatgagaaaagagaggatggctcaagcaagagagcgccgagaggcaacagcccaagccagggaacaacgccggtttgagcgggctcagcgctggcatgaggctcgaaagaccgacgctggatatctgggagccggcgtgagtgctggccttcaagctcctgctgccgaaggaagggcattggcccccggactaccacctttggcatcccccctggccttagcgcaggcaatggggatcgccctcccggaactgaagttcctgtgtttccatcgagaggtcgctcgcacaacccattaccgccggttcacccttcccaaaaagaccggtggagagcgtacgatctccgccccaatgccccgtttaaagagggcccagtattgggtactcgacaacgtgctcgccaaagtcccactccacggggcagcccacggatttgttcctggcagatccattgtgtctaatgccgcacctcacaccggcaaagcagttgttatcaacctggacctcaaggacttctttccgtccgttacatatccccggataaaaggggtgttccgagccctgggctatggggagcatgtggcgactacattggctctcctgtgcagcgaaaatgcggccgatgagctggaggtcgacggggaacggttcttcgtcggcggaaaggggcgggatagagtgcttccccaaggggctccaaccagtcccatgctcaccaacatactctgccgcaggctggatcgccgtttgaagggcctggccgcaaagctgggctttacctacacccgatacgcggacgatctgaccttctctgctgcacctgagggtacaacacaggtcggccagctgctcagaagggtacaccacgtgttgagggacgagggattcacccctcacccggataagcagcgcgtcatgcgggcctcaagcaggcaggaggtgactggcatcgttgtcaacgagaagcctagcgtctcccgaacagagagaaggcgtctacgcgccgcgttgcatacagcccagcggaaaggactggaagcggcaacatggcagggacagcccgcaacgagagataccctggtggggtacgctagatttgttcagatggtagatgccaggcaaggcgcagccttacttccccgcgctctagccttacccgggtcagcagctgccgttagtccatttccatcaagatttaggcggcaggctgctaagggcgaagcccctacactggccagtgggacttggtggcaacccgccgaaccagcagctccaactcttgctctgaccgcgggccaggtcaaagctgctagacaggaacggttgaatgcagaaagagccgcacgcagggccgatgctgaagcagaagtggagcggatgtccgcaacagaggatgtagcccacggtgaggatgcagacgacactcctactacggcacagccacccatccgatggtggtcgctggcgattcagttttttttggtggtgcagctcgcctctggtgccaaaagcgccatagtttttaccctgggaatcgcctggctcgtgttctctttggtgactcgtaaaaccggctggtggaggttcgtgtttgccatgatgtgtatcctggccattgtagccgggctcaagtga

SEQ ID NO: 13323 - RNA, 1974 nt, unidentified
  source 1..1974: mol_type = other RNA; note = synthetic construct
atgagcgacagggtcctgactagagcggaaattatcgagaggatccgggcgtccagcaaagacgccgtggtgctggaagagatgcagcgaatgggcttttggccagccggtgacggaaaacccggcattgaggcagcccttatcgaacgagaaattgaactgactagagctctggacgaggttcaggcaactttgcgcacgcacagcgaccctgaagccgctatgaaggcgatgcgggagcagagaatggcagagagtagagccagacgggaggctacagcgcaggctagggagcagcgaaggcacgagagggccttacggtggcatgctgcgcgcagaaccgacgcaggttacctgggcgctggagtgagcggcggattgcagtctccggctgctgatgccatacacactaccgacgccaccggagtcacaggggaaccaggagcaaagccaagggcactgctggatggactcccagctctggcaaccccactggatctagccggtgccatggggttgactctgcctgaactcaagtttctctgcttccaccgtgaagtcgcacggacgacccactaccgcaggtttctattgcctaagaaaacagggggccagagaacaatatctgccccgatgccgcgactcaaacgggcacagtattgggtactcgatcaactgttagcgaaggttccgtgccatgcagccgcccatggtttccttcccggtcgagggatcgtgagcaacgcagcccctcatacgggtcgtgccgtagtcatcaacttagacattcaggatttctttcccacaatcacgttcccccggatcaaaggcgtgttccgagggttgggctatgacgagcgtgtggcaacaatgttggccctcctttgttccgagaacccctgtgatgaactggaggtggatggagagcggtttttcgtcggcggcaaggggcgtgatagagtcttgccacagggcgctcctacatcccccatgctcactaatgtattatgccgcaagatggaccgtcgtctgcagggactagccgacaaactggggtttacctacacccgctatgcagacgacctgacatttagtgcttctggcgagggggctgccaaagtcggcaccttgctccggcaggctcgacacgttctcctggacgaggggttcacaccccatcctgataagcagcgcgtaatgcgcgcaggatctcgccaagaggtgaccggcgttgtggtgaatgagaaaccttccgtctcacgcgaagagcggagaaagctgagggcagcccttcacaaggcgacgagagatggggttgaagccgccacatggcatggccaccctgccacaagggaggtgctagtcggatacggcaggtttgtggcgatggttgataggcaacaaggggccaccctgctgaagcaagcactggcccttcccggcggaagtgccaagaaaagatcggcatttggcgccctctttcgaaagaaagccgctgaaggtgaggccccaactctggccaggggagcatggtggcaaccagccgatcggcctgaaccagtgctgcagcagactgctgcccagattagagcggcccggcaggaaagaattaatgccgctagaaccgaacgcaggggaggagcagctccaaagcccgaccagtaccaacaacgccgccaggagcagtcaaaccgcgcagcagagaatgctgctaggtggagcgccgctacttccgctgcctctggtgctgctcctagggctggacaccccattaactggggcttatatgcccggcagttcggggtgatgacccttgcggccttccttatagccagttggctcgtgttcttcggcggtctggctcacctcgcactgagaatcaaaactcggtcaaccgggtggggggagttctggatcggcctgatccttctcatagcggctgccgtgaagttctttccccattcaaccgcatga

SEQ ID NO: 13324 - RNA, 1917 nt, unidentified
  source 1..1917: mol_type = other RNA; note = synthetic construct
atgtccgacagggtcccaacaagggctgaaatcgtggaacgaatcagggcttccagcaaggacgcttttgtgttggaggagatgcagcggcttggattctggcccgcaggagaaggcaagccgtccatcgaggcggccctcatacagcgggagctcgagttgatgaaggcgctggaggatatgcagcaggaattacgctcacactctgaccctgaagcagccctaaaacgtatgcgcgaggaacgacttgcccaagctcgggccaagcgggaagccactgctcaagcgagagagcaaaggaggcacgagcgggccctaagatggcatgaggcccgcaaaacagatgccggatatctgggcgagggagttagtggagggcttcgcccagcagctgctggtgctcctgcaaggcctctggcagatgggttacccaccctggccacccccttggaacttgcccgtgcgatgggcttaaccctgccagagctcaaattcctgtgtttccacagagaggtggcacggactagtcactaccgacgcttcctcctgccaaaaaagactggagggcagcgtacgatttcagctcccatgccgagactgaagcgggcccagtactgggtacttgaccaggtccttgccaaagttccaagccacgccgcggctcatggttttcttcccgggcgcagtatcgtcaccaatgccacgccccatgcgggcagggaagtcgtaataaacctggacattcaggactttttccccacaataaccttcccacggatcaaaggcgtattcagagggctcggctatgacgagagggtggctactatgctggcccttctgtgttcggagaatccgtgcgacgagctggaagtcgacggggagagattttttgtgggcgggaagggtcgcgacagggtgttacctcagggggcacccacctcccctatgctgactaacgttctgtgcagaaaaatggaccggcggctccaaggcatcgcggacaagttaggatttgcatacacccggtatgctgatgacctcaccttcagcgcatctggcgaaggggccggtcaagtgggtacactcctgagacaagtgcgacacgtcctgaaggatgaggggttcacgcctcacccggacaaacagcgagtgatgcgggccggctctagacaggaggttacaggcgtcgtggtgaacgataaaccctcagtgagcagagaggagcgtcgaaagttacgcgccgcgcttcacaaggcgtccagggaaggggtcgaagccgctacatggcagggccagcctgccactagggaggtactcgttgggtacggacggtttgtggccatggtcgatcgagaacagggggcccccctactcaagcaggctctagcactgccaggtggtgcagctaagcggcgtagcgcgtttggcgccctgtttcgccaaaaagctgctgccggagaagcccccgttttggctcgaggcgcttggtggcaaccagccgaacctccagagcctgtgctgcagcagaccgcaggccagatcaaggccgctcgccaagccaggctcaacgatgaaagaacagcacgtagggggggaaaaccacccgcaccttcacgcgccgatcagagaagggcagaacaggcccagagactggctgatcatgaggcacagcgcgccgcaagaagatctgcaggtgctgctccaggagcagccggagcagatagaccttggctcttgtatgtgaaacagtttgccttgctgctaggaattgctgccggattgaagagcgagctgattctgtacgccggcgtgattcatttgttgctgcgcattaagagtcgggatcgcggttggtgggagttctggctcggcatcggcctgctggttctggtgaatgccctcctgttcaggaggtga

SEQ ID NO: 13325 - RNA, 1944 nt, unidentified
  source 1..1944: mol_type = other RNA; note = synthetic construct
atgactgagaggatgccgacaagagcagacttgatcgaaaggataaggacgtcgtccaaggacgcagtggtgctccaggagatgcagagactggggttctggccgcaaggcgaggcacaacctacccttgaggcagccttgattgagcgtgaggcagaggtcacccaggccttgcaaggtctgcaggagcggctgcgagtgattcagaaccctgaagcggctctgcaggcaatgcggaagcagcgcatgcaggaaagcctcatacgccgcgaagccgccgcgcaattgagagaacagcgccggcacgagcgagccttacgatggcacgaggctcgcaaaacccaggtgccttatctgggtgctggagtctccggggggctgagtctgccaactgctcaggcccccgctcgtgctctacaagccggtctgccctcactcgatactcccatggccttggcccaagcgatgggcttgaccctcccggagctgaagtttcttaccttccatagggaggttgccagaacgcatcactacaggcgcttcctattgcccaagaagactgggggacatcgtaccatcagcgcacctatgccacgcttaaaacgggcccagtattgggtgcttgacaatgtgttagcccaggtcccctgtcatgcagccgcacacggcttccttccagggagatctatcctcacaaacgccaagccccatgtggggcaggatgtggtgatcaatctcgatattcagaacttcttccccaccatcacatttcctcgcatcaagggggtatttcagggtctgggataccccgaaccagtagcaactatgctcgccctactttgctctgaaaatccatgtgacgagctggtagtggacggcgaagccttttttgtcgggggcaagggcagagacagggtgcttccacagggcgccccgacatctcccatgctgacaaacgttttgtgccgacgtatggaccggcgtcttcagggcctggcccacaaactggggttcacctacactagatacgccgatgatcttacattttcagggtctggagaggctgcagccctggttggcaaattgctgcggcaggtcagacacgtgctcaaggacgaaggctttacccctcatccagccaaacagcacgttatgcgggctggcgcaaggcagcaggttacaggcgtcgtcgtgaacgatcagcctagcgtaagtcgacaggaacggcgcaagctgagagctgcgctgcatagggcacgccatcagggcatggaagctgccacatggcacgaccaaccagccacccgggaggtattactgggctatagtcgattcgtcgcgatggttgatgccgcccaaggcgctcccctgattgcacaggctatgagattacccggaccagccgctcctccaagaagcggagatgccgccgcgtttcggactaaatcagccgagggtcaagccccccaactgaagcgcggatcctggtggcaacctgccgaaaggcccgcaccagttctccagctcaccgatgcgcagaggaaagacgccaggagggacaagagagcggctgccctagggcaacctagccctgctgctgtgggaggagctccctctcgagctgcagtggcgagtgccggtcttgcaggcactcctgttccaggggccacaggaggtgcaagcgctgcttcagctaggggagcagctgatgcggctcaccccgcaaatgcaacgaaactcccaccgcctccttgggcccagtatggatttcagtccagcctgctgctgttcctgtggattgctggtgtgtcctcctttgtggtggtcgggggattcgcacacatggccttccggttcaagaaaagagagggcggatggaatggcttttggaccggtctgggggtgctactcctcatccagtggctcgtccgggctctgacgtga

SEQ ID NO: 13326 - RNA, 1872 nt, unidentified
  source 1..1872: mol_type = other RNA; note = synthetic construct
atgacagccaggcagcccactagagctgagctgattgagcggatcgccgcgtcctccaaagatgctgtcgtgctggacgagatgcgcagatttgggttctggcctgccgacgcaggcaagccatctgtcgaggctgccctgattgagcgtgaggcagagctggtccaggccctgaatcgactccaggcagtggtgagagagcgtggtgaccccgtagccgctctcaaggctatgcgcaaagcccggatggctcaagctcgggaacgtcgagagacgaccgcccaggcacgcgaacagaaacgacacgaaagggcgctcagatggcatgcggcaagggctagtcacgccgggtacctgggacaaggtgtgtcgggcggtctacaggctcctacagacgcggaagctgctttggccaggctccgcgaaggagggctcccattgttggccacaccgcaagctctcgccgaggctatgggcctgtctgtgccagagctgaagttcctgtcattccatcgagaggtggcaagagtgactcactatcgccgctttgcactacccaaaaaaaccggcggtgaacgcattatatctgctccaatgccccggctgaagcgggcacagtattgggtgctcgacaatgtcctagcaaaggtcccctgtcacgccgccgcacatgggtttctccccggaaggagcatcgtaactaacgcagccccacacgcaggccaaggtgtggtgatcaacctggatctgaaagatttctttccaggggtggcctaccccagaatcaagggcgtgttcgccgcccttggctaccctgaggctgtagcaactgtgctggcactgctgtgcagtgagaacgtaagcgacacccttgaggtcgatggggaaccgttccacgtaggcggaacggcccgtgaacgggttttgccgcaaggcgccccaacaagcccaatgttaacaaatatattgtgccgtcggctcgatcgacgccttcagggcttagctgccaagctgggctttcgctataccagatacgcagatgacttgactttttccgctagcggggatggtgaggcgcttgtcggacggttgctgcggcaggtgcaccatgttctcaaggacgagggattcactccacatccagataaacagcacgtgatgaggaggggggcgagacaggaggttaccggagtggtggtgaatgatgggcctagcgtttccaggacacagagacgggcgttaagggccgccctgcatagagcaggtacagcgggtggcgggcaagctacatggaacggaactcccgcctcacgggacacgctgcttggacaggctcagttcgtgagaatggtgaacgcaacacagggaggcaagctggtcacagccgctagggcccttccggttggtggagaagccgttaggccccgggctgctgacacctttagacaacgctcagccagaggcgaagcccccttacgggcagaaggggcatggtgggttcctgcccctaggcctgtgcctcagctgcagctgaccgcaggccagattcaagcgcagaggcaggccgctagacaggcacgacagcaagccgctcgagctacggaacctgcccctgctgcaaccgaaaccgccaccgagactgctaccgccgaaggagacacaccagtccttacccctccccaggttgccgtaccctgggtgacttttggaatccaggccggcttaatgatgctcgtcgccgcgagatctggatccgcactggcccttctgctggcaagtggctggttgggctatgccctactccgcaggaagttcgggtggctgaggtacgctgttgcccttgcggtcctcacccgcctgaccttggggtga

SEQ ID NO: 13327 - RNA, 1923 nt, unidentified
  source 1..1923: mol_type = other RNA; note = synthetic construct
atgtcgggagagagacagcccaccagggccgagttgatcgcgaggattgccgccagttccaaggatgccgtcgtgctcaaagagatgcagagaagtggcttttggcctgctgatgccgccgcccctacagttgaagcagccctaatacagcgcgaggccgagctagtgcaggtcctcaacaagctgcaggccgaactgcgggagaagggagatcctcagggggccctgaaggcaatgagacagcagagaatggctgaggctcgtgaacgtcgcgaggccactgcccaaaagctggagagggagagatacgaaagggcagttcagtggagggagcggagccgtcacgagatcgggtacctcggccagggggtttctgcagggttgcaggctcgtgctgacaacgcggggagccacgaaaagcttcaaagagagggcctgcccctcttagacacaccccaggccctggcagacgctatgggagttccagtagcagaactgcgttttctcgccttccaccgcgaagtggcccgcactcagcactatcgacgcttctcactgcccaaaaagaccggcggtgttcggaccatcagtgccccgatgccacgattgaagagagcccagtactgggtccttgataatttgctcgccaaagtaccggtgcacgcggctgctcatgggttcctgccaggaaagtctattgtgagcaatgccgcgccacatgtaggacaagccgtcgtcatcaatctggatctaaaggacttctttccttccgtcagcttcccccggattaagggagtgtttcgagcattgggatatggcgaagccacggctacccttcttgctttgctgtgctccgagaatgtgtgcgatgaactgcaagtggatggggagcgcttctttgtgggtcgcactgcccgggagagggttttgccacaaggggctcccaccagcccaatgctcacaaacatcctctgtcggacgcttgataagaggctccagggcatagccacaaagcttggatttacgtatacccggtacgccgacgacctgtccttcagcgcttcaggtaacgctgccggcctcacagggcgactcttgagacaggtgcatcacattctgaaagccgagggttttactcctcatccggacaaacagcacgtcatgcatgcaggtagacggcaagaagtgaccggcgtggtagtgaaccagcagccggcagtctcacgggagcagagaagagctctccgcgcggctctgcatcgggctaagcataaagggctggacgccgcaacatggcaaggcgagcctgctgcgaggaacgtgctgcttggctatgcacagttcgtcgccatggtgaatgcacgccacggtgccccgctccttgctcaagcaaaagcccttccctctgcagccactccagcagccaaagtgcccccttcacagttcaggcagcatgccgcagctggtaaggcacctcctcgagcgaatggcctgtggtggcaacctgcccccaaacctgaacccgtgctgctgaaaactgcggggcagatcaaagcagaaaggagagcccacctggccgctcaaagggcagagagagacgcggcccgcaaagctgcggaaatagcctcttccccccggagggctttacgagcagcgatgcaggctgcggctgcagctccagctccagaaggcggagcacctcaggaaacccacgccccactgctgccactgattcggtggcccttagttattgcacaggccgccctattggtatacttaagtgtcaagctgaaatcccccggcctctttttagctggcggactgtggctaggctggcgagtgatgaggcgcaagtttggatggccatcttacttcctggctctgttcgttatcggctttgtggcagggatcctgcacttatga

SEQ ID NO: 13328 - RNA, 1893 nt, unidentified
  source 1..1893: mol_type = other RNA; note = synthetic construct
atgtctgaccgacagccaaccagggctgaattgatcgcgcggatcgctgctagtactaaggatgccgtggtgctccaggaaatgcagcggctaggcttctggccccagggttctggcgagcctggaattgaggccgctctgatcgaacgggaggctgcactggtgcagcgcttgaacgccctgcaggcggagttaaagattgtgggtgatccccaggcagccctgcaagctatgaggagagagcgtatggctgcagccaaagctcggagagaggccaccgcacaggctagagagcaacggcgccacgaacgagcactgcaatggctggaacgctcccgcgacgcaataggccatctggggcacggcgttagcgcaggtctttcccctcagcccctcgaagccgacgataggcgacgcctggaggccactggtcttccgtgtattgatactcctctcgctttggcccaggcgatgggtataggggtagccgagcttaagtttctttgcttccaccgtgaggttgcgcgcacccagcattatcgtaggtttgggatccctaagaagaccgggggagtccggacgatttctgcgcctatgccacgcctcaagcgagcccagtattgggtcttggacgcccttcttgccaaggtccccctccacgctgctgcccatggcttcgttcctgggcgttccatagtcagcaacgcggcaccccatgctgggagagacttggtgatcaacctggatctgaaggacttcttccccagcatcacgttcgccaggattaaaggggtgttccggcgcctgggataccctgagcagatagcaactctgttgggactcctttgctctgagaatgtgtgtgacgagctgcaggtggatggagagagattttacgtgggccgtaccgccagagaacgcgtcttgccgcaaggggcaccaaccagtcccatgctgacaaatattctgtgccgacggctggatagaagattgcagggcgttgcggccaagttgggctttacatacactcggtatgctgacgatctaaccttctctgcctgtggcgaggctgctggtaggagcgataggctcctccggcaggtccactttatcttaagggatgagggcttcaccccacatcctgacaaacaacgggtgatgcgggctgcctcccgacaggaagtgacagggatcgtagtcaatgagcggccgggcgtgagcagagaacagagacgtgcactgagggcggcattacaccgggcccagcaaaaaggaatggaagctgccacttggcaaggccagccggctaggaaggacgtgctggtgggatttgctcaattcgttgccatggttcagcccgcgcaaggacaggccttactcgctagggccaaagcactgccagccaccggaacaaaagctgccgccgcagccccatcaaggtttagagagttcgccggacagggaaaggcaccgccaagagctgctgggccttggtgggaacctgccccaaaacccctccccgttctgcagaagacggcaggccagctgcgagaggaacgcagagccaggctggccgaagctagagcgttacgagaaggtagacctcctcgcactgctgccaccccaacagcaccttcggcctccggtagccccccatcaagtgccacagcacccacaggcccaaatgcaaaagccggacccgtcaactgggacgcctggctactccagctgggcatgatggtgctgatgagtgtgcgcctgcactcagcggtctttttcctactgggggcaatttggatgggatcaaggcttgtgcgcaggcggtttgggtggccatcctttatcgccgtacttctcgccgtaggcctcgcagcagagtggctgaaaccctga

SEQ ID NO: 13329 - RNA, 2016 nt, unidentified
  source 1..2016: mol_type = other RNA; note = synthetic construct
atgagcaaccctcagcccacccgtgccgagattttcgagagaatcaagcagtcctctaagcaagaagttatcctcgaagagatgcaacgactcggcttttggcccaggtccgaaggacagccggaagtggctgctgacctaattcagcgggaaggggaactgcaacgagagctcgcggaattgaataagaagctggcggtaaagcggaaccctgagcgcgctttacgcgaaatgaggaagcagaggatgaaagacgccagagacaagagagaggtcaccaaacgagctcaggcccaacagcgttatgacaaggccctgctttggcacgaaaaaagggcatctcacgttgcttatctgggccccggcgtgagcgcatccttgcatgagaactcttctgctacccaggagcagggcgataagggcaaacccaaacgtgccagagatagggccgtgcccgatcttcagcgactcaccctgaacggtcttcccgcacttatttccgctgcccagctggcagaatctatgggcgtttctgtagccgagttaagattcctctcttttcaccgagaggtcgcccgaacgaaccactatcacagctttacactgcccaagaagactggtggggaaagactcatatcggctcctatgccgcggctcaaacgcgcacagtactgggtgcttgataacgtactggcaaagatgcccgcgcacgatgccgcccatgggtttttagcggggaggtccatcataagcaacgctaaacctcacgccggacaggatgtcgttattaatctggacgtgaaggactttttcccctcaatagcttttgggcgcatcaagggggtgtttaggcagctggggtatggcgagagtattgccacagtgttcgccctcttgtgctccgagaatcgtgcgcaggcctggcaagtcgacggtgagaggctgttcgtaggaggaaaggctcgcgagagggtgttaccgcagggagcacccacttcacctatgctgaccaacctgctgtgtcgcagaatggaccggcggctgttaggactggctaaacagctcggcttcgtttacaccagatatgccgacgacctaaccttcagcgcctcaggcgaacccgcaagggataatgtgggcaaactcctgagcagggtgcggtggatcctacgggacgaaggatttacccctcatccggataaagagcgggtgatgaggaaaggccggcggcaagaggtgactggattggtcgtcaattccgatacgcccagtgttagccgagagactcgccgcagactgagagccgcactacatcgcgcgtcccagccagatgccgcctcaaagccagcacattggcagggtcacactgcccagcctagtcagcttctggggctggctaccttcgtccaccagatcgaccccaaacagggcaaaacgctcctggccgatgctcagcagctcatgcgcagcccaatcgacagagccaacgacgcagcgaagagtgctagcagggcagatgcagcccagcagtcattccgagtactggccgcagccggaaagcctccagtcttggcagatggcaaaaattggtggcagcctgcaccacccgcaacacctgtgctggagaagacagatcagcagcggagagaagagcgtcaggctactagacgtcaacaggcagcggccgcagctccaccaccaagttcaacaagaaggaacgagaggccacaacaagccgcccatgaacaacagggcgacgcccagcctcaaaatgaggcccctccacgctttgaccctgaccaatacgctccgccaccacggaatgtcatgacttactgggcccaaatcgctatcagttttttccttgggtcgattctccataatcggttgattacaattttcgcgatggtggctgtgatagctttgtactacatgcggcgccagcgctgggatgttttcatggggatcctggtggtggctacacttctgggttacttggtgagaggtatgggatga

SEQ ID NO: 13330 - RNA, 2022 nt, unidentified
  source 1..2022: mol_type = other RNA; note = synthetic construct
atgtcgaacccacagccgacccgcgcagaaatctacgaacggatttcacagtcctccaagcaggaggtcatactcgaagagatgcagcggcttggcttctgggccaaggatagcgggcagccccaactggcagaagaactcatccgtcgtgaaggcgagctgcagagggagctgtctgagctgcacaaacagctagctgtcagacgtgacccagagcgggccctgagagagatgcggaaacaaagaatgaaggacgctagggacaagagagaggttactaaacgggcccaggctcagcagcgttatgaaaaggcactcgcttggcacgacaagcgggcaactcacgtgggttacctgggaccaggtgtatcagccagtctgcaggatgccgacgagcctatcgctcagagcgataaaaaaccgaagcgagcacgagatcgagcagtgccagatctgacgaggttagctgtcaatggcttacctgccctgacctcagccgctcagctcgcacagagcatgggggtcagtgtagcggaactgagatttcttagctttcaccgggaagtggccaggtcccaccactaccactcattcacactccccaagaagacaggtggagagcgccttattagtgcccctatgccgagacttaagcgtgcgcagtattgggtgctggataacgtgctcgcaaagatgcctgcacacgatgctgcgcatggctttctcgccggccggagtatcatctccaatgccaaacctcatgccgggcaggacgtcgtgatcaatctcgacgttaaggatttttttccctccattgcattcgggcggatcaaaggcgtctttagacagttgggttatggcgagaaaattgccacagtgttcgcactcctgtgttcggaaaacagggcccaagtgtggcaggtggatggcgagaagctgttcgtcggggggaaggcacgagagagagtcttgccccagggagccccaacatctcccatgttaactaatcttctatgcaggcgaatggataggagattgcaaggcttggctgctcagctcggattcgtttatacacgatacgccgatgatctaaccttctccgcatcaggcgaggcggcccatgacaatgtgggcaggctgctcggtcgtgttaggtggatactgcgcgatgagggctttactcctcatccagacaaggaacgggtgatgcgcaaaggtaggcgacaggaagtgaccggactcgtagtaaacggggacacgccaagcgtctctcgcgagacaaggcggagactgagggcagccctgcatagggctagccaacctggcgctgctgcgaaacctgcgcattgggaaggtcatgccgcccagccctctcagctgttggggttggctacttttgtgcaccagattgacgccaggcaagggaagcctctgcttgccagcgcacaacagcttatgcgcaatcctatcgacagggccaacgacgcactgctggctgcatcccgagccgatcgcgcaacaactaccaacgccggagatttccgccgcttatctgctgcaggacatccccccgtgagagctgacggcaaaacctggtggcaaccagccgagccgtcagctccagtgctggaaaagaccgaccagcagagacgcgaggaccggaaagccgcgagacaaagcgctcagccacagccccagcttcagctgcagccccaaaccgggggaaacgcgaatggaaccgccagaacgagccagtccggaaatagacagcagaacgcttctcagactgccccccaatctgaccctcccaaggagcggggcacacggaacatgatggtgtattgggcccaaattgccatcacctttttcctaggcagtattctccacaaccggttaatcaccatattcgctatggtagccgtcattgctttgtactacatgcgcaaacaacgctgggacgtgttcatggggatactggtggttgcgactttgctggggtacctggttcgcggagttggatga

SEQ ID NO: 13331 - RNA, 2037 nt, unidentified
  source 1..2037: mol_type = other RNA; note = synthetic construct
atgagcaacccacagcctactagagccgagatctacgagagaatagcgcagtctagtaagcaggaggtcattctcgacgaaatgcagcgcctgggcttttggcccaaagccgaaggccagccacaactggccgcagagctgattcaccgtgagggcgagctccagcgggagctttctgaattgaaccagcagctgggagttcggagagatccagagagggcgttgagggaaatgcgcaagcagaggatgaagaacgctcgggagaaacgtgagacaaccaaaagggaacaggctaagaagagacacgagcgcgctcttgcatggcacgcaagacgtgcttcccatgtcggttatttgggacctggagtgtctgctgcactcgttgacgggccactcacccagcaagaacaggaacagaccagcaggcgaacgagggaccgagccatcccagatttgcctagactcgcccggcatggtctacccgcattatccagcgccgcacagttggctgagagcatgggcgtctctgtggcagagctgcgctttcttagtttccatcgcgaagtggctcgcacacaccactatcactccttcacactccccaaaaaaacaggtggcgagcgcctcatctcggccccaatgcctaggctgaagcgggctcagtactgggtactggataacgtgctgaataaaatacccgcccatgaagccgcccacggtttcttagctggccggtctatcataagtaatgctgctcctcacgcgggacaggatgtggttatcaacctggacgtgaaggatttctttccaagcattgccttcgccaggattaagggagtgttcaggcagttgggttatggtgaaggcgtggcaacagttctggccctgctgtgctcagaaaaccgggcgcaagcctggcaggtcgatggagagaggctgttcgtagggggcaaagcgcgtgaaagagtgttgccccaaggcgcccctacatccccaatggtcaccaatctgctttgtcgtcgtatggatcggcggctacaggggctcgctagacagctggggttcgtgtacaccagatacgccgatgacctgacgttttctgcatcgggcgaagccgctagagatcatgtggggaagctgctgggccgggtcagatggattctccgcgacgagggctttaccccgcatcccgataaggagcgggtaatgcgaaaaggcagacgccaagaagtgactggactggtggtcaacggcccttcacccagcgtgagtcgcaagactaggcggcgattgagggccgccctgcatagagcctcaaggagtgctgcagacgcaagtacctccactcaggctcattggcagggacagcaggcgcaaccgagccagttactggggctcgcccagttcgtgcaccagattaatgccagacaagggcgccaactcctagccgacgcccagcaactgatgcggtcccctcttgaccgggccaatgacgccttgctagcggcctccaggcaggatcagagaagcgcaagcagctcctcacccgcatcttttcgcgcattagctgcagcgggaagggctcccgttcgaaccaatggcgagccttggtggcaacctgctgccgctcttgagcccgtgctcgagcagactgacttacagaggcgagaagctcgccaacttgcccgacacggggcctcaagtgcgtctggagcctcctctaataggagatcctccagtgacagccactttgggagaggaccgcagtcagggtcatccaggcaagaggatcaggggaacgcctctggtcgctttagcttcgacgacgcagcaggacgggacgatcaaggagctagcaaagacaagccagcaggccgactcggtacgtattggatgcagatggttatttgcttcgttatgggctcaatcctgcacaatcgcctgatcactatttttgcaatgatcgctgtcatcgtactttactacatgcgacggcagagatgggatgtgtttatgggggtactggtcggcctgtga

SEQ ID NO: 13332 - RNA, 2022 nt, unidentified
  source 1..2022: mol_type = other RNA; note = synthetic construct
atgtcggctccacagcccacacgggcagagatttacgaccgcatcaagacttcgtccaaacaggaggtgatactcgaagagatgcagcgcatgggcttttggccgcagggggaaggggaacctcaagtcgcagcggaccttattcagcgagagggtgagctacagcgggagatgtctgagttgagagagcagcttgcagtccgcaggaatccagaacgggcactgagagaaatgcgaaagcagcgcatgaagcaggccagggaccaacgcgaggaaaccaggcgtagacacgcccaggagagacacgacaaagccctggcctggcatgggacaagagcctctcacatggggtaccttggacccggagtctctgccgctctacacgctcccggacaagatggcagtgccgacggtgcctcaggacgcaaacctgcaagggagagaagcgctccagatctccggcggctagccctgaacggattacccgccctgacaagtggagcacagcttgcagaagctatgggggttagtgtggctgagctgaggttcctgtctttccatagagaagttgcccggacccatcactatcattcctttacactccctaagaagacagggggcgagagacagataagcgctcccatgccccggctgaagagagctcagtactgggtgctggacaatgtcctggcaaagatgcccgcccacgatgctgcccacgggtttctggccggcagatccattgtgagtaatgcaaggccccacgctggccaggatgtagttatcaacctggacgtgaaggatttcttcccctcaatcgcttttggcaggatcaagggggtctttcgccagctgggctacggcgagggaattgcgactgttctcgccctgctttgctccgagaatagggcccaggcctggtccgtggacggtgaaaggctgttcgtgggcggtaaagcacgagaacgagtgttacctcagggggcgccgacctctccaatgttaaccaacctgttatgccgcagactggatcggaggttgcagggcctggcggcacaattgggcttcgcgtatacgcgctatgccgacgacctcacctttagcgccagcggcgacgcagcacgtgatcatgtcggcaagctcttgtcccgcgtgcgttggatactgcacgacgaaggcttcactcctcatccggataaagagagggtgatgcgtaaggggcgtaggcaagaggtaactggtttggtcgtcaacggaagtcagcccggcgtgagcagacagatgcggcgaaaacttagagcagcgctacaccgagcatcccacgccgctcctggagatgcaccagctgcccattggcaggggcaggctgctcaaccctcacaactgctgggacttgctcagttcgttcagcaggtggacgcccaacaaggaaaagccctgctggcgtccgccagacaactcgtaagggatccagtggcccgggtaaatgacgctctccgggaagcagccgctgaagaccgacttgcagccgcgtcagaggccgctgtttcctttcgccaggccgctgccagtggtcgttcacctgtgagggcgaatggggagggctggtggcaacctgaacagaaagccgccccagtgctggaacagaccgatcagcagagacgagaagcccggcagcaagctaggcggcaatctcttgcagctgcctcacccgcgagcccagagactgcacctgggaacggtgctcgcagagtccagggtgttcctgcagagggcgtgtctccggctcagcctggtaaagccccagaggcttctggactcccaccagtccgacggatgctcaggtactggagccagatgggactgtgttttctgctcggaagcattctccataacagattgatcacgattttcgccatggtgatggtgatcgccttgtattatatgcgcaagcagcggtgggatctgttcgcaggcgttctcgtgatcgccaccttgttagggtacctagtacgcagctga

SEQ ID NO: 13333 - RNA, 2010 nt, unidentified
  source 1..2010: mol_type = other RNA; note = synthetic construct
atgtcgcagcctcagcccactagagccgaaatctacgagcgcattaaagccagctctaaacaggaggtaatcctggaggaaatgcagcgcctcggcttttggcccaaagacgagggacaaccgcagttggccgctgcccatatccagagggaaggcgaactacagcgggaactggccgaactgcgacagcagatcgccgtgagacagaatcctgagcgggctctgcgccagatgagaaaggagcggatgcagaaggcgttggcccagagggaagagactaagcggcgccaggcccaggagcgacatgacaaggccctcgcctggcatgctaggaggtctacccacgttggctaccttgggcccggggtcagtgctgcactccaagacgccgcgagagacggaaccgagcgtaggcaagccgatccccaacgccttgccagacacggactccctcagctcgccgatgccgcacagttagcccaggcaatgggaataactgtggccgagcttcgcttcctagggtttcacagagaggtggcgaggacacatcattatcatagctttaccctgcccaaaaagacaggaggcgagcgccttatatcagccccaatgcccagactcaagagagcccagtattgggttctggataacatcctggctaaagtgcctgcacacgatgcagcacacgggtttctggccggccgtagtatcgtgagtaatgctgcgccgcacgcaggacacgacgtggttataaacctggacgtcaaggatttcttccctagcatcgcatttggcaggatcaaaggggtgttcagacacctgggctacggcgaggccatggccactttgctcgctctcttgtgttccgagaacagggcccaagcctggcaggtggacggagagaaattgtttgtagggggaaaggcccgagagagagtgctgccacaaggcgcccccacctctccaatgctgacgaacttgctctgcaggcgcctagatcggcgactcctgggcttagcccgacagcttgggttcgtgtatacccggtacgccgatgacctgacgttctctgcgtcgggagaagctgccagggacaacgtcggacgactgctgggtcgggtgagatggattctccgggatgaaggtttcacaccccatcccgataaagaaagagtcatgcgcaaggggcggaggcaggaagttacagggcttgtcgtgaacgcagacaagcctggtgtgtctcgccagaccagacgccgtctgagagcagcgcttcaccgcgctacccaagcaggcaccggcttaccaggccagtccgtacagcctgcccaagtcccccactggcagggacaaccagcccatgcttcacagctgttggggatggcccagttcgtccaccaggtggacccagttcagggcggtcccctattggcacaagcccggcagctcacacgtagccccgttgaccgggcgaatgacgcactgctggaggcatcaaggcaggatcgagcagctgctagggctaaaccccctgccaatgctactttccggaggttggctgccggtggtcaagctccagcgttagccagcggcaagccatggtggcaaccagcagccccagcagctcctgtgctggagaagactgatcagcagcggcgggaacagagacaggaggaacggcaagcggctaggcaagctgcaggtccggctccaggagcagcttccacactgccagctgcaagcacatcccctagcccttcacctagtcctgctgctcccgatccgaatccaccggcttccaagcgtcctcccatggctgggctgcttacttattgggcgcagattgtcatttgctttctccttggtacggtatttcaggcccgtctgatcaccttaattggcattgtgctggtggtgattctgcgctacaggagaatacagcgctgggacgtcttcggagccgcaatggtcgtggcagtactggttggcctcgggttacgactgtcctga

SEQ ID NO: 13334 - RNA, 1896 nt, unidentified
  source 1..1896: mol_type = other RNA; note = synthetic construct
atgtctcagccccagcccacccgcgctgagatatatgaaaggatcaaggcctcctccaagcaggaggtcatcctggaggagatgcagaggctcggcttctggcctaagggtgagggtcagccacagctcgctgctgcccacatccagcgggaaggcgagctgcagcgcgaattggcagagcttaggcagcagatcgccgtgagacagaaccccgaaagagctctgcgccagatgaggaaagaacggatgcagaaagctcttgcacaacgggaagagacaaaacgtcggcaggcccaggagcgtcacgataaagccctcgcatggcatgcccggcgttcgactcacgtgggataccttgggccaggcgtaagcgccgccttacaagatgcagcgcgcgacggtactgaacgacgccaagcggatccccaacggttagctcggcacggcctgccacagttagcggatgcggcccagttagcccaggccatggggattacagtggccgagctgcggttcctcgggttccacagagaggttgcccgaacacaccactaccatagcttcaccctgcccaaaaagaccggcggcgaaaggctcatctcagctccaatgcctaggctgaagcgcgctcagtactgggtgcttgacaatatcttggccaaggttcccgctcatgacgcagcccatggattcctggcgggacggagtattgtgagcaatgccgctccgcatgccggacacgacgtcgttataaacctggatgtaaaggactttttccctagcatcgccttcggacgcattaaaggcgtgtttcgacacctcggctatggcgaggcgatggccacccttctggctctgctgtgctccgagaaccgcgctcaagcatggcaagtagacggcgagaagttgtttgtcggggggaaggcgagagaacgcgtgttgccacagggtgcgcccacgtctccaatgctgactaatctcctttgtagaaggctggaccgtagactactgggcctggcaaggcagttggggtttgtgtatacacgctacgccgacgacctgacatttagcgctagtggcgaagccgcccgtgataacgtgggaaggctcctgggacgagttaggtggattctgcgcgacgaaggcttcaccccacacccggacaaagagcgagttatgagaaaggggagacggcaagaagtcacgggcctggtggtcaatgccgataagcctggggtgtctagacagacgagacgacgcctacgcgccgccttgcacagagcaacccaggctggtactggtctgccgggcctacctggacagagcgtacagcctgctcaggcaccccactggcaaggccagccagcacatgcatctcagctcctcgggatggcccagtttgtgcatcaggtcgatcctgtgcaggggggccccttgctagctcaagccagacaactcactaggagtcccgtcgatcgggccaacgacgcactgctggaggcatccaggcaggatagagcagccgcacgtgccaaaccccctcaaactccacgatcaggtgcgtggcagcctgctgggagacatcttaggtggccagctgcatctcatggaggaagccgaccccaccctcaaaggccgtgctggaggcgacctaccagttcaggggcaagtagcgctaggaggaatggtcgcccaccagggaggcggttagccttgccaccggcatcacaggctccctgccctagacaccggcccttacaccggcatcggcaccatcgaccccatcggacacgcattagacctcaccgtaaaggaaggcggtggcctgcatgctccccaaccggaagacgctcaagatccgcttcttgttgggccccgtgttccagacccggatga

SEQ ID NO: 13335 - RNA, 1983 nt, unidentified
  source 1..1983: mol_type = other RNA; note = synthetic construct
atgtcccagccgcagcccacaagggcggagatttacgagaggataaaggcgtcctctaagcaggaggtgatcctggaagagatgcagcggttgggcttttggccgaagggcgagggtcaaccacaactcgcagccgcccacattcagagagagggcgagctccacagagaactcgccgaactgcgaaggcagcttgctgtgcgacaggaccccgagcgtgctctaagacagatgcgcaaggaacgcatgcagaaagcgctggccaggagggaggaaactagaagacgccaggcccgggaaaggcatgacaaagccctggcctggcacgcacgaagggatacacacgtgggatacctgggccctggagtatcagccggactgcacgagccccgcgatgaagctcaacagcctgcagctagagatcgccggcaggcagatccccagcgattagcccgacacggcctacctgagttggccgacgcagctcagctagcgaccgccatgggcatcaccgttgcagaactccgttttctgggcttccacagggaggtggcgcgaacccatcattatcacagcttcacactgcccaagaaaacaggcgggcagcgcctgatctctgcccctatgccccggttaaagcgcgcccagtactgggtgttggataatatactcgccaaagtccccgcccatgacgccgcacatggcttcttggccggtcgttccatcgtgtcgaacgctgccccccatgcaggccacgatgtggtcatcaacttagacgtcaaagacttctttccctccattgcctttgggcggatcaaaggcgtctttcgccaactcggctacggtgaggctatggccaccctcctggccctcctgtgctcagaaaatagagcacaggcatggcaggttgacggggagaagctgtttgtaggggggaaggcgagggagagagtcctcccacagggagccccaacttctcccatgctgacgaacctgctgtgccggaggctggacagacggctgcttggattggctcgtcagcttggattcacttatacccggtatgccgatgatttaacgtttagcgcctcaggacaggctgcccaagaccacgtgggcaggcttctggggagagtgcggtggattctccgggacgaaggtttcacacctcaccctgacaaagaaagagtcatgcgcaggggtcggaggcaagaggtgactggcctggtcgtgaacggagagcagcctggggttagccgcgagactcggagaaggttgcgggcagcattacacagagctgctcaggcagttcccgggcaacggccacattggcaagggcatgccgcgcagcccagtcagttgctgggccttgctcagttcgtgcatcaggttagaccggcccaaggaggggctcttctccgacaagcgcgacaactattaaggagccctctggagcgcgctaatgaagccctgatcgaggcgagtagacaggatagagcacgcgcccccgaagcccaagctttcaggcagagagcagctgctggtcaggcacctgcactcgccagcggaaagccatggtggcagccagctgcaccagcagctcctgtgctcgagaagaccgatcagcagcgccgggaagagcgtcaagagcagcgccagcagcagaggcaggaacagcagcaggctgccagagcacaagcacacgctgccgctgcaccagctcctcaagctgcgagtgccccagcccttccacaagaacctgctccacctcccccggccaagtctgctctgccaggacttctgacatattgggcccagattattatatgtttcgtcctgggtactgtgtttcagacgcggctggtaaccctaattggcatcgttttgaccgtgatactcaaatggcgacgcctgcagcgttgggacgtgttcgccggagccatggtaatcgcggtcctgctggggcttgtgttgaaaccgtga

SEQ ID NO: 13336 - RNA, 2073 nt, unidentified
  source 1..2073: mol_type = other RNA; note = synthetic construct
atgcggtgttctaccttctggagactgctgatcgggagtactgccgccgccaccaaggaaggacgcatgtcacagcagagcacaagtcgggctctaacccgggcagaaatctatgaacgtatcaaagcatctagccggcaggaagtgattctggaggagatgcaacgcctgggattctggccgaaagccgatggggagccgagactggcagctgagcacatcgaacgagaggcccacctccagcgcgagttagcagagctgagagcccagatcgcagtaagagagaatcccgaaagagccctccgccagatgagaaaacagcgaatgcagcaggcccttgcgcagcgcgaggaaactaagagacagcaggccagactgcggcacgaaaaggcattggattggcatgcccggagggcgacacatgtgggttatctcgggcctggcgtgtcagccgcattgtcacctgctgctagccagggaagccccgctaggaaagctgcattgacggacgcccctaagcttataggctctggtctgccagtcctagaatcagccgctcagatggcccaagccatgggcgtcactgtggccgaactgcggtttctttcctttcatagggaagtcgcccgtagccaccattaccacagtttcaccctgcccaaaaaaaccgggggccaacggctaattagcgctccaatgcctaggctcaagagagcccagtactgggtcctcgataatatactgggtagagtgcctgcgcatgaggccgcacacggctttcttgcaggccggtctatcctcagtaacgcccttccccacctcgggagagacgtcgttatcaacctggatgttcgggacttcttcccctccatttcctttgcccgtattaagggagtgttcgttcgcctcggctacggagaggcagtggcgacagtgctggcactgttgtgttctgagaaccgggcgcaggcttggcaagtagacggcgaaaggttgttcattggtggaaaggctagggaacgagtactcccacagggggcacccacctcgcctatgttaactaacctgttgtgcagaaggttagaccgccgcctgcaagggttagccagccagctgggctttgcgtatacccgttacgctgacgacctcacctttagtgcttccggtgaggcggctagggacaatgtgggcaggttgctgggccgagttcgctggattctgagggatgaagggttcacaccacaccctgagaaggagcgcgtcatgaggaaggggcgtcgccaagaggttacgggggtcgtggtgaacaacgctcagccagggtcttcgaggcagatgagaaaacagctgcgcgctgccttacaccaagcagctcgacatggggccggtgcctctgataagccagcccactggcagggacagacagcacaggtcagccagctgctgggactagcccagtttgtgcatcagatcaatcccagacagggactcgcgctcgtcgaacaagcccggtccttaggaaagggcccgctggagtccgctaatcaagccctcacgcaggcggcaagggaggatagggagcgcaaggctgcctctgctgggtttcgtaggagcgcggcccaaggtcaagctccagtgcgagcgaatggtcagccctggtggcaacctgcaccggcagaaccccctgttttggagcagactgaccagcagaggagggagctacgacagcaggccagaagagagatgcactccctccaggcaggatcctccgcccaagcagcttcaggcgagcgagctatggcagaaggaccaactcctgcccccgctgtacagagtcaagccgcccatgagactgccccaccaacatcaggccccgctcttcggcgccttctgacctactgggcccaaattgtggtgtgcttcgtgctgggcaacctgttgcacacaagagtggtaaccctggtgggcatagcccttgtcgtggttctgtattaccggcggaaacagggttggggacttttcttcgctgctatggtgctggcagtcctcgttggcatggtgtttaaacagtga

SEQ ID NO: 13337 - RNA, 2025 nt, unidentified
  source 1..2025: mol_type = other RNA; note = synthetic construct
atgagcacaccccagcctagcagggcccagatatacgaacggattaaagcctcctccaaacaggaggtggtcctggaggagatgcagcgcatgggcttttggcctaaggatgccggccagccacaacccgcagcagaactgatccagcgcgaaggagaactgcagcgcgagctgcagacactgagaaaccagttcgccgccaggaaggatccagagagggccctcagagaaatgcgtaagcagcgaatgcaggcagccagaacacagcgcgaagccacaaaacgcaagcaggctcaacagcgacacgacaaggctctggcctggcatcgggagagggcaacgcacatcgggtacttgggccccggcatcagtgcagggctacagacccctgcacaggacgaagccgctgttaaatcaacctccgaacgccaaagaagaggcccagatatggccaggcttgcacggcacggacttcccgagctgacttcaggggcccagttagctgaagctatgggcgtctccgtcgctgagctccggttcctttccttccacagggaggtcgctcgctctcaccattatcacagctttactctgcccaagaagacgggcggtgagcgcctgattagtgcgccaatgccacggctgaagagagcacagtactgggtgcttgaccaggtcttggccaaaatccctgcccatgacgccgcccacggattcctagcaggccgaagcatcatcagtaatgcgcagcctcatactgggcaggatgtggttattaacctggatgtaaaggactttttcccttctatagcatttggtcggataaagggggtgtttcgccagttggggtatggggagtctgtggcatctgtgttagccctgctgtgctcagagaacagggcccaagcctggttagtggacggcgagcgattattcgtaggcggcaaggcacgagaacgggttctgcctcaaggcgcgcccactagcccaatgttgaccaatctcctctgtaggagactggataggcgtctacaaggtctggctgcccagctcggctttgcttatacacgctacgccgacgacctcacatttagcgcctcaggagaggccgctcaggaacgtgttggtgcgttgctgcggcgtgtccggtggattctcagggacgagggattcaccccgcacccggacaaagagcgggtgatgaggaagggacgacggcaggaggtaaccggattggtggtgaacggtgccgccccctctgtgtccagacagaccagacgccaactccgagccgcgctgcatcaggctactcaagccggctctgctagtgccgccgttgcacctcattggcagggtcaggccgtgcaaccaagccagctgcttgggctagcgcagtttgttcaccaggtcgacgccaagcaaggacaggctcttctggcttccgcgcaacagctggcagcagtacccggtgcgcgcgtaaaccaggacttggctgatgctgctgcaagggataggcgcgcagctacaaggccgcttcctttcagacaggcagcggctgccgcacaagctccagtgagagccaatgggcaggcctggtggcagccagaagagaaagctgctcccgtgctggaacacaccgatcagcaacgtaaagagcaaaggcagcagttgcgtagagaggccgcagctgctcaaaccccagatgcggcatggggacgggctgaaccccataatagatcagcggaaagaaactccagtcaagagcctgctagccatgtcgcaccgaatcgagcatcgtcaagagccaacaaagggaaacctgctacgccacggagcctccccaggcttggaatgcacatcctgctcggcatcgcccaggggatgtctctgaataagcccctgatcaccgtgttcgccctcgccctcgccattactctctattacatgaaaaagcagcggtggggaatcttcattggcttagtcctggttgtgtcgtggcttgtgattgggtttactgcctactga

SEQ ID NO: 13338 - RNA, 1998 nt, unidentified
  source 1..1998: mol_type = other RNA; note = synthetic construct
atggcggccccggctccgacaagagcagagttgctcgagcggatacgcgccagttctaaggacgccgttgttctggccgagatgcagagattgggcttttggcccagagacgaagccagaccggctccagccacagagctgatcgaacgcgaggccgctctcatgcgcgaattgggggagctccaagccgagctccacctacgaggtgatcccgagaaagccctccgggccatgaggcaggaaagattagcggcggcacgggctcaacgagacagtcgagcccgggagagagcccagcgacagtacgaacgggcccagcagtggcatgcccaacggcaacagcgcattgggtacctgggagccggggtttccgcaggactggaacgacccgcggatagacccgctgctcatgtcccactgcgcgctggacgctctgagcgactggctaggcacggactgccggcacttgacagcccacaagctcttgcccgggccatgggtgtagcattgggggagctgcgctttctcagcttccaccgcgaggtgggacgtcacacccactacagacgcttcacactgcctaaaaagtccgggggggaaaggctcatcagtgcccccatgcctcgtctcaaaagagcccagtattgggtcttggataatatcttggcaaaggtgcccgctcacgacgccgcacacggattcctacctggcaggagcgtcgtcggaaacgcccagccacattgcggccaggaagtggtagtgaatctggacgtcaaagacttcttccccagcataggttttggcagaattaaaggcgtgtttacgcatctggggtacgccgaacctgttgccaccgttctagccctgttatgtagcgagaaccgggccgatgaacttcaggtggatggcgagaggtggtttgtgggcggggcagcaggccaaagggtgttaccacaaggggcgcccacatcccccatgctcactaacctgctctgcagaagacttgaccgtcggctggccggcctcgctagaactctgggatttgcctatacccgatatgcggatgatctgtccttttcggcttctggagaggccgcacaacgcgtcggccctttgctaaggcgagtgcggtggatcttacgcgacgaagggttcgagccccaccctgacaaggaacgggtgatgaggaagggcgccagacaggaagtgactgggatcgtagtcaacgcggcccagccaggcgtgtctcgtcaatcacggcgcgctctaagggcagcgctgcatagggctagaaccgcaggtgcgggtccagctcactggcaaggtgagcccgcctcacgggagaggttgcttggctacgcccatttcgtgcagggggtaaacgaagcccagggtagggctctcgtccgagctgctgaagcccttcctctggccagcagggctgcagcatctcctgctgcagctcccggaactgcagcgggtgattttcgcattcgggcagcacaaggagaggctccagtgcgcgcccaaggaccttggtggcaaccagcctcaccccctgctccagtaaggcagagaactgatggggagattcgggaggccagggctgctcagcgacaagcagcagcggaagccaggcgtgcagctcaagcaggagcagcggttgcagcaccagctggacggagtggcaatggcagcccagctaggtcaggagctcctgcctcagttgataccgcccgtcaagctcggaatgctcgcgctgcaggcaggggtagaaaggccgacgcatctccgaggagccgcaagacctattggctgcagttattcgtggtgtggcttgcaggcacgttgtcggggtccgggtttgtgacagtgttcggcctgatctacctgcttggcgcctattgggcccggcaccagagatggtcccatttctccctggccatgctggccatcctcgttctggtccctgtgctgcgtagtattggcatactgtga

SEQ ID NO: 13339 - RNA, 2127 nt, unidentified
  source 1..2127: mol_type = other RNA; note = synthetic construct
atggcagccccacagcctactcgggcagaactgatagaacggatcagggcctccagcaaagacgctgttgtcctggcagagatgcagcggttagggttctggcccggtggcgaatcacaacccgaaccggccgccgagttgatagagagggaggccgctcttataagagaactgggcgagctgcaggccgagttgcagttgaagggcgaccccgacaaggctctcagagccatgagacaggaaaggctggcagctgcccgagcccagagggaaagcaaggccagggagcgcgcccaacgccaatatgagcgggctctgcagtggcacgcacagaggcaacagcggatcgggtacctcggggctggtgtgtcagcagggctggagaggccagatggccaagcagcgcatgcccctctacgaccagctcgaccggaacgcctggcacaacacgggttacccgcccttgagcaccctcaggctcttgcgttggcaatgggcatcgaactgggcgagctccgctttctgagcttccacagggaggtggcgcgccatacgcactaccgacgctttaccctgccgaagaagagtggaggtgaacgccagattagcgctcccatgcctaggctaaagcgggcccagtactgggtgctggacaatatcctggccaaggtgccaactcatgacgccgcccatggctttctgcctggcagaagtattgttggtaacgctctgcctcattgcgcccaggacgtggtcatcaatctcgatgtcaaggatttcttccctagcattggctttggccgcattaagggcgtatttatgcgcctgggatacggcgagccagttgccacagtgttggccctcctctgctcagaaaaccgggctgacgaactgcaggtggacggtgagcggtggttcgtcggaggcacagctgggcagcgtctccttccgcagggagctcctaccagtcccatgctaacgaatctgttgtgtaggagactggaccgtcgactcactggcttggcccaggcattagggttcaactatacccggtatgcagacgatctgagtttttctgccagcggggatgccgcgcaaagagttggctctcttctccggcgtgtccgctggaccctgcgagatgaaggattcgaaccccaccccgataaagagagggtgatgcgcaaaggagcgcgccaggaggtcacagggattgtggtcaacgcccctcagcccggagtttcccgtcagtctcgcagggcccttagagccgcacttcatcgctcccacgccgagggacctgaccaagcacactggcaaggtcagtccgcctcacgggagcgtctgcttgggtacgcccacttcgtgcagggcgtgaatgaagaccaaggccgggcccttgtaatggccgcggaagctctgcccttagcttcccgagccgccgatggagtaggtgcagctgccgatgtcgacgctgttggtgcagatgctgccgcagccgcgactgacgcaaccacaccagccgctgcagtagggggctctagagccttagatgctgcagctgcggcagccggcacaacaatggcgatcgggctctttaaagccggaaaagccgacttcagagctcgggctgctcaaggattggcccccgttagggtggatggcccatggtggcaacctgctccgcctccacagccagtgcggcaacgaaccgacggagagatccgtgaggcaagagcggctagacgacaagccgctgcggaggctagaagagcagcacaacctggtgccgcagcacccgcaaatgccaggcatccaacccaggccggagcaagggcacaagccactgtggatgctgcccgtcaggcgagaagagggggaccaacagctccaggagccgatgaccggacggctgatgcagccaaaccccccaggagcgcgaaaacttattggatgcagctgttcgtggtatggctagctggctcttttaccagaaacggtctggtgaccgtgctggggttgatttacctcctcgggacctattggatgagacatcagcggtggtcccactttgccatcgccatggctgcgattgtcgctctagctactctcatgaggtcgctgtga

SEQ ID NO: 13340 - RNA, 2130 nt, unidentified
  source 1..2130: mol_type = other RNA; note = synthetic construct
atgtctgctccgcagccaacaagggccgagttgctggaaaggatccgcgcatccagcaaggacgccgttgtgctggctgaaatgcaacgcctcggtttttggcctcagggcgagggagagcccaggttagctgctgagctgatagagagggaggccgaactgtctcagcagctcaatgccctgaggcaggaagcagcccagtatgccgaccctgagcaggcgcttaggcgcatgcgaagagagaggatggctgctgcacgggcccaaagggaagcgactcggcgacaacgtcacgaggcccgtcatgagcgggcactggcatggcacgcagaaagggatcgtcatatcggctggcttggagagggggttagcgctgccctccaacctgtggcacgcttacccgctgaccctgctccacgcagtgcccaaccaagtgccgaccaggctgacccctctgccaatgccgaacatgctgccgaaccagcaggtcaagcccgcgcagctacagctgatagaggtggggccgctagagcttcaaccccacgcaccgataggttggctcggcacgatctgcctctcctgactgatgcgcctgccttggccgacgcgatgggaatcggtgttcgtgagctccgtttcctggccacacaccgcgaggtgagcaggtccacgcattaccaaagattcaccgtcccgaaaaaaaccgggggcgagcggttgatttccgccccaatgcctcggctcaaacgcgcacagtactgggttctcgataatatccttgctaaggtgccggtccatgccgcggcccatggattcctacccggacacggaatcgtaggaaacgcacgaccccacgctgaccaggatgtcgtcattaacctggacctgcaggacttttttccctcagtgggccttccccgagtgaagggcgtcttccagcacctcgggtacggcgaagctgtggctacagtgctcgcccttctttgcaccgaggccagggccgacactctgaggatcgacggtgagacagtccacattgccggccgagccagggatcgggtgttaccacagggggccccttccagccctcagttgactaacatcctgtgtagacgtctggacagacgcttggcggccttagccgcaaccttgggcttcgcttataccagatatgcggacgacctatcctttagcgcctctggcgaagctgccgacagagtgggcgagttactgcggcgagccaggtggatagtgcgggacgaagggtttaccccccatccgacgaagcaggccgtgatgaggagagggagacagcagaccgtcaccgggctagtggttaacggcgcggctccgtcagtgtctagacggcagagacgccgattacgagccgccttgcatcgcgcccacacacagggtcttgctcaggcgcactggcagcagcagcccgttactcgtgcgcagctcattggctgggctcagtttgtgcaccaagtacagccagcacaggcgggcgccctgctttctcaagctcaggccctactacccgcagcacacgaagcgagcgccgctacagtgaatgccctcgcccaggcagcatcagccagaccagctggtggagggcgcctgagttttcgcgcagctgcagcacaagggcagaccccacccttagcatcggggaggtggtggcagattgcgcctaggcccacaccagtgcgagtgctgaccgatcaggagagacgggaacaaagacaagctagaagagccgctcaagcagccgccgctgaaccagcaactactgccgcaggagtgggccctgctggagctagacctggacagggcggtaggcggttgtccgatcccagaacggaggatgcaggacgggcaggtgtaccagcccccgatggacatgcccctcagagtcgcactcggcggcgacttggcacgtacgtcctccagctgatggcagcatggggcctcggcaacgttgtattccacgatcggctgttcacacaggtcgccctcgtaatgctggttttcctgtatctgatgcgccggcaaagttgggctctttggggggggacaatgctgttggctgcgctggtcgcatggagcctgcggttcctggggtga

SEQ ID NO: 13341 - RNA, 1923 nt, unidentified
  source 1..1923: mol_type = other RNA; note = synthetic construct
atgctggcttttagagtgcgactacccgctgggagtcttcccatgtctgctccaccccccacaagtatgacaaggcaagagctgtatgagcggctacggactgccacaagagaggaggttactctgagcgaaatgcagaggctcggattttggcccaaggacgatcccggtgtgactgccgcacaggcgctgattcagcgggaagccgagttgtctagggccctcagagagctgtcttccgaactgcggggtaccgaagaccctgccctcgcactaaaggccatgcgcaaagagcgaatggctaaggcgagagctcggcgagaagagacgaaacagaggagcgcccgggagcggtttgaaagggccagtgcatggcatcatcgccacgccggggagatcctttacctgggggaagaagtttcagccggcctgaatgaggcaaggtccgatggcgacaagttggcacgcgctgccttacccgctctccatgacgctagggaattggcccaggccatgggcctgtcgctgcaagaactgcggttcttagctttcgacaggcgggcctctcgcatctcacactacagacgcttcgccatgccaaagaagactggcggcgagcggattatttctgcccccatgccacgactcaagcgctcccagtattgggttcttgacaacgtgctcgcacgcgctcctgtacatccggctgcccacggttttctcaaaggtaggtccatagtgagcaatgctgctccccacgttgcacaggcagtggtgatcaacgtggatcttaaagacttcttcccttccattgatatgcggcgggtagccggcgttttcggacagctgggctattctaaacaggtggccactacactggcccttctctgcaccgaggcagctaccgaacaagtcagcgtcgacggggagacatttttcgtggcgaggggagcacgagtcctcccacaaggagcgccaacaagccctgcactgaccaatattctctgtcgaagattggatgcccgcctccagggtgccgcagcaaagttagggttctcctatacccgatacgctgacgatctcacctttagcggccctgaggcgacacgcaagttagccgggaaactgctctggcgtgtaaggcagatcgtggcggacgaagggttcactccccacccccacaagcagcatgttatgcgtgcctcccagcgccagtccgttacagggatcgtcgtgaacgagaagcccacgatagagcgcgacaccctaagaagattcagagccactctgtttcaggtggaaaaggatggaccggctgggcggcaatggaacggcaaccctaatgtgctagccgccttggagggctacgcccagttcattaggatggtggacccagcgaaaggagcccctctgctggcaagagtgcgtgcagcgcgagagagatggtcagatgccccagccgccagtcttccaggacctgcaagaagaggaggcgattttcgtgcattatcagcccagggaaaagccccctgggagggcttttggcaagctgctccacctgccccaccggttctggaacagacccaggaacaagtaaccctggctaagaaagaaacaaggcgctgggctagtgtcgctcctgtggtcgagccatctgcggcagccgcagatgtcgcaaccgatgctgtagaggacggacctcaagtgcgggctccgtggagagcattgttatcacagtttttgatcgccctggtcctcgctctgacttaccgcacgccattgccggtcgccggcatactgctgcttagcaggaccagcaggagagacggtcgtcctcactggacgaggttcatctgcgctatggtgctgttggtcgcgcttgcagacgtgctgcacagatgggatctggggctgctttcgtga

SEQ ID NO: 13342 - RNA, 1845 nt, unidentified
  source 1..1845: mol_type = other RNA; note = synthetic construct
atgaacgccaagtcaccagcgtcaatgtcccgccaggacctgtacgagaggctccggacctctagtcgcgaggaagtcaccctcgcagaaatgcagcgattgggcttctggcctgccaatgcggcaggtcgtcctgacgtggaagaactcatccgtcgcgaagcggagctgtcttccgccctacgcgaattgggctcagagctgagagctgtcgaagatcctgctgtggcactgagagctatgcgcaaggagcggatggctaaggccaaagcacggagagagacgaggcagaggagagcgagggagcgattcgagcgagcctctgcctggcatcagagacacgccagcgagattttgtatttgggcgagggagtgtctgctggcctaaacgacacacattccgacggggatagattagcccgggccgcgttaccacctcttaacgacgctagggagctggctcaggcaatgggactcactctgcaggagctgcgttttctggcattcgacaggcgggtgtcaaggataagccactatagacggtttgctatgccaaagaagacaggaggcgaacgcattatctctgcacccatgccgcgtctcaagcgaagtcagtactgggtcctcgataatgttctggccagagcaccagtccatcctgcggcacatggtttcctggcaggtcggagtatcgtgtctaatgctgctccccacgctggcagagcagttgtggtgaacgtagatctgaaagactttttcccgagcatcgacatgcgaagggtggccggtgtcttcgggcaacttggctattccaagcaagttgccaccactctggctctattatgcactgagtcggccaccgaggaggtcagtgtggatggggaaacgtttcacgtagcttacggaccgagagttttgccccagggagcacctacaagccctgctcttaccaatattctgtgtcggaggttagacgccaggctgcaaggcgccgctgccaaactgggattcgcgtacacaaggtatgcggatgatttgacatttagcgggactggggagtcaaggaaactggccggaaagctgctgtggagagtgcggcagatcgtgatcgacgagggctttaccccccaccccgacaaacagcacgtgatgcgcgactcccagaggcagtccgtcactggcatagtggtaaacgaaaagccgaccattgaccggcctactctgcgcagatttcgggccaccttgtttcaggtggagaaagacggccccgatgggaaggcctggaacggaaacacgaatgtgcttgccgcattagaagggtacgcccagttcgtacgaatggtggatcccgccaaaggtggcccacttctccagcgcgtcagggcagcaagagagcgttggagcactcctgctgggaccccagccgcaacacatagtacaggggactttcgggcccttagcgcgcagggtaaagctccctggcctggattctggcaagctggaccagctcccgccccagttgtcgagaaaacccaagtgcaggtcacactggccaaaaaggctgtccagcaagaacaaaaggaacgcgttgccgccctggcagatgcacaacccgatacgatgctggaagccccaccacaggcactgttgccctggagggctctactcccccagttcgttacagcctttctgttggccctcacttaccgaacccctctgccactcgctgggatgcttctcctggcccggaagtcccgtcgagatggtcggcttggctggggacgcttccttggcgtgatggttgccgtagtggtgctgcacgggctcctcagacgctggaattga

SEQ ID NO: 13343 - RNA, 1839 nt, unidentified
  source 1..1839: mol_type = other RNA; note = synthetic construct
atgtctgataacactcccgcgcccatgacacgagctgcactgtacgctagactcagaacgcagagcagagaggaagttacactggctgaaatgcagcgtctcgggttctggcctgaaaacgatccgggaaaagccgtggcagagcagctgatccagcgtgaatcggagctggttcgggccttgcgcgagttgggctccgacctaagggtcgctgaggatcctgccttagccctgaaggccatgcataaggagagaaaagcaaaggctcgggcgcgccgagaagagacacgagagaggcgagcacgcgagcggtttgaaagggccaacgcatggcatcaacgcagggccggggaaattttgtacttgggacagggcgttagcgctggcctaggtgaggccaggtcagatgccgacaagcttgcccgagcagcactcccggccatgcacgatgcgaaggacctggcacaagccatggggctgtctctcccagaattgcggttcttggcttttgacaggcgcgtgtcgcgtatctctcattacagaaggttcgccgtgccaaaaaaaactggcggggagcgaataatctctgccccaatgccgagactgaagagggggcagtattgggtgcttgacaatctgttagcaagggcggccgttcatcccgctgcccatggattcagagctggaagaagcatagtcacaaacgctggtcctcacgtaggccgggcggtagtgatcaatgtggacctcaaagatttttttccctccattggcatgcagcgggtggccggtgtcttccgtcagttgggatattcaaaacagattgctaccatccttgcactgctgtgcactgaaagcgcaactgagcaggtgtcaattgacggagagacattccacgtcgcacacgggcccagagtcttgcctcagggtgctcccacttctcccgccctaaccaacatactgtgccgccgcctggacgcaaggttagagggagccgctgctaagctggggttcgcctacacaaggtatgccgacgacctgacattcagtggtggggaggaaacccggcgactagccggaaagctcctctggcgtgtgaggcaaatcgtggctgacgagggctttaccccacatcccgacaagcagcacgtgatgagggatagccaacggcaaggcgtcaccggcatcgtggttaatgagaagcctgctgtggaccgcactaccctgcggaggttcagagccacgctgtttcaggtcgaacgggatggccctgctgggaaggcgtggaacggcaatgccaatgtgctggctgctctggagggctacgcacagttcattaggatggtggatccagcaaagggcaccccactcttagctcgtgttcgggcggcgagagaacgctggagcgataccggatcacctgctgtgaccgtggccaaagccattagtgctgggaacttccgcgcccttagtgcccaagggaaggctccttggccaggattttggcaagctggcatggcgccagcccctgtactcgaaaaaacacaggaacaggtcgtagcaatgaaaaaggaggcacggcagcttgcacgatcccacgcagcgactagtcccacacccggtggcaaagcccgcaatgcacggtccctttggcacgccctcctcctgcagattctgatcgcctgttttttagccatcgcttttcggtccccatggccgatcattgccatgcttgctctgttctacctttccagaagagatcgcagcgcctattggaccagatttataggtattcagacgctggccgtcgcaggaatgctggccctcatgaaacactga

SEQ ID NO: 13344 - RNA, 1872 nt, unidentified
  source 1..1872: mol_type = other RNA; note = synthetic construct
atgagtgactacccaactagtacgcgcgaggccttgtacgccagaattagggccagctccaggacggaggtcactctggaggaaatgaagcggctgggcttctggccagaagatgacaccagcctcgctgaggctgagcaactcattaaacgggaagccgaattgcagcaggcgttgtctgccctgggccgagaactgcgggaggttgaggatcccgccctcgctctcaaacggatgcgaaaagagcggatggccagggccaaggcgaagagagaagaaacacgacagagacgggctagagaaaggcacgaacgcgcgttagcatggcatgcaaggcgggccaaggagttgctgtacctgggggccggagtatctgcggggctgaacgaagcccgttccgatgcggatagactcgcccggcttagcctgccctcaatgcacgacgcacaggatctcgctaatgccatgggccttagcctggaggagctgaggttcctcgcatttgaaaggcgcgtgtcaaggattagccactatcggcgctttgcaatgcctaagaaagccggtggtgtgcgaatcatctccgcgcccatgcctaggctcaaaagggcccagtattgggtgcttgataatgtgcttgctagagctccggtccatccagccgctcacggctttctggctggtcggtcgattgtaagcaacgcagccccccatgtgggacaggctgtcgtcatcaatgtcgacctaaaagacttctttccttccatcgccctgccgagggttagaggcgtctttcgccagctcggctacggaaagcaggtggccacaactctggctctactatgcaccgagtcagcaaccgaaacggtgcaagttgacggagagacattccacgtagcccacggaccacgtgtgctccctcaaggggcaccgacatctcccgcattgacaaacatcctctgtcgccgccttgatgcaagattacagggcgctgcggctcggctagggtttcgttacaccaggtacgccgatgatttgacattcagtggcgacgagagtgtgcgtaagctggcagcaaaattgctgtggcgcgtgcggcagatagttatcgacgagggttttactccccatccagacaagcaacacgtaatgcgttctcacgcaaggcagtccgttaccggcattgtcgtgaacgagaagccggcagtagatcgagacacccttcgcagattcagagcggtcctgttccaggtcgagaaagacggacccgccgggaaacagtggaatgggaacgacaacgttctggccgccctggagggctatgcgcattttatacgcatggtggatgtggaaaagggggccccccttttggccagagtgagagccgctcgggctcgatggaatggtgatgctgctgctcccgatgccgtagctcgacgggctggtggacagttcagaatgttagccgctcaagggaaagcaccctggcctggcttctggcaagctgggactccacctgcccctgtgcttgagaagactcaggaacaggtgaagaccgaacgcacattagctagagaggaggcccgaccacgcaaggcagctgcatcaccagtgcctgcagacgacgcaattgcccggagggcagaaagaaccgctaggcgcaatccactcttaatcggaggcggccgaatgacctggtatgccgttgccctccagggagttgtcgcactgttgctgtccaggaagcttgactctaacactcccattctggccatgctggctctgtactggctaagcgtcagatataggcgtatgctgtgggtgcctttcatcgtggtgatgctgctgatatgggcggtgctggcccctcgctga

SEQ ID NO: 13345 - RNA, 1812 nt, unidentified
  source 1..1812: mol_type = other RNA; note = synthetic construct
atgtatgagcgggtacgtgcaagcagccgggaggaagtgacactcgccgagatgcagcgccttgggttctggcccgctaacgatcctgggcttgctgcggccgaagaactgattcgcagggaagctgagctctctcaggccctgcgggccttaggcacagatgtgaggatagccgaagacccagtgctggcattgaaggccatgagaaaagagcggatggccaaggcacgcgcgagaagagaggaaacccgccagcgaagagcacgagaacggttcgaacgcgcatccgcctggcaccgaagacaggcttgcgagattctgtacttgggggaaggtgtcagtgctggcctaaatgaatcaagatccaatgttgacaagttagcccgtgccgccttaccagccctcgacgatgcccaagacctggccagagcaatggggctgacacttcaagagctacgctttttggcattcgaccgtcgggtgtcacgtataacccactataggcggttcgccctgccaaaaaaaaccggaggcgagagaatcatttccgcaccaatgccccgtcttaagcgggcccagtactgggtactggataagctgttagcgcatgcccccgtgcatcctgcggctcatggcttcctgaggggacgatccatagtgtccaatgccgctccacacgtaggccaggccgtcgttatcaacctcgatttgaaggacttttttccgagtatcggcatgcccaggatcaggggtgtgtttactcagctcggttatagtaagcaggtggctacaacgctggcactcctctgtaccgaggctgccactgaggaggtgagcgtagatggggaaactttccacgtcgcacatggaccgcgggttctgccccaaggagctccatcttcacctgctctgactaacctgctgtgcaggaggctcgacgctagacttcagggagctgcggcgaaactgggattcgcctatactcggtacgccgacgacctcactttctcgggtggcgaggcaacgaggaagcttgccgggaaactcctgtggagagttaagcaaattgtgatcgatgagggatttaccccacaccccgacaaacagcatgtcatgcgggattcccagcgccaaagcgtgaccggactggtggtgaatgcgaagcctagcttggagcgcgataccctgaggcgctttagggccacactctttcaggtcgagaaagacggccctgatgggaaggcatggaacgggaacacaaacgtgttggcagctctggagggctacgccaattttgtgcgcatggtcgaccccgcaaaaggcactccgctattagcacgggtcagggccgccagagagagatggacaggtgtgccacaggcccacagagctccgtctctgagtaaaaggagctctgactttcgggctctttctgctcagggcaaggcgccctgggaaggtttctggcaagcagctgctcccccacccccagaactggagcgtaccgcagagcagctggcccaggataagaaagcagcgcgaagacaacgccccgcctcaccagctgctgaaccttctggcgacctgggggtggttgatgttcctgccacccctgggttgcctcccgttccttggtcggctatcggcgtccagttgggactggccctagcctacggcattgatcagggaaagctcctgcccctcgcattcacggtcggattggcttttatggcctggcgagacagggaccctcactggcttcgcttcgggggtgtaatcgtgctgatggtccttctcagcgtgctacgatga

SEQ ID NO: 13346 - RNA, 1929 nt, unidentified
  source 1..1929: mol_type = other RNA; note = synthetic construct
atgacctcacctaccccctcgccctccgaactaacacgggctcaactgtatgagcggatcagagcctccagcaaagaggaggtggtgcttactgagatgcagagacttggcttctggccagccgatagcggtaagccctcagtggaatccgcactgattaggagagaagctgaactgactcaggcgctgcagaggctcgggtctgagctccatcacctgcagaacccggaagctgccctgcgtatgctccgcaaagaacgtatggccaaggccaaggctcgcagagaggagacacgccagaagagagctctggttcgattcgagaaggctcaagcttggcgacagagacgggagcacgaggtgttgtaccttggcgccggtgtttctggaggtctgagtagggccgactcagatgctggcaaacttgcaggcttggccatgccagtcctccacaaagcagacgacctggctcaggccatgggaataaccctctccgaactgcggttccttgcatttgaacgcagagtgagccgcatctcacactacagacggtttgccatgccaaagaaaacaggcggggaacgtatcattagcgctcccatgcctaggcttaaacgcgcccagtattgggtcctcgacaatgtccttgctagggcaccgctacaccaggccgcacatgggtttgtgcctggccgttctattgtcagtaacgctgccccccacgttggccaagcggtagtgatcaacctggacttgaaggacttcttcccctccattggaatgccacgcattaagggcgtcttcgcccaattgggatactccgagcagctggccaccgtcttggccctactctgcaccgaagcccccacggataaagtgcggatagatggggagagatttttcgtcgcacacggatctagggctttaccccaaggagccccttcctcgcccgccttaactaacatactctgtcgtagactggacgcaagactccaggcctgtgcggccaagctcggcttcaagtatactcggtatgcagatgatctgactttctctggcgatgccgacgcgcggaagttagccggtaagctgctctggagggcgaagcagatcgtcattgacgaggggttcacgccccatccagataagcaacatgtgatgagggatgcccaacggcagatggtcaccggaatcgtggtgaaccagaaaccttccttggagcgcgagacactgaggcgctttagggctacattgtttcagctggagaaagatggtcctgagggcaaacaatggaatggtaatacgaatgtgatcgatgccctggaaggatacgcgcagtttatccgaatggtggacccagtcaaaggcctgccccttctggttcgagtacgcgccgctcgagcaagatggggagctgcaggaattgacatgaagctgatgcagagcaagcggtctagcgcttttcgagccctgtcagcacagggcaaagctccttgggatgggtggtggcaggctactctggccagtgcacctgttctggagaagaccgcggctcagctggccgtggaaaagaaggaacggaaggccgctgaggcaccaactgtacctcccgcaccagtgaatatgaaaaaaccggcagctgcacagacccccgttgccacacctgccgcagctgttcatgcacctccggccagtgacgccaccgcaaacccagcaccaggggctaaaccagacggggacaataacttccaggtagcgattgcggtacaggtggctctcatatgcgcattcgccttggccacccagagggttttaccgagtgcgtgcatggccgtgatcgtgttacaaagcgccatgctaaggaaacctcggtgggggtggtttctctttatcattcttatctggagcgctgtgacactgaagtggtga

SEQ ID NO: 13347 - RNA, 1896 nt, unidentified
  source 1..1896: mol_type = other RNA; note = synthetic construct
atgtcagccaccgaatcgaagcccatcacgacccgcgccgaactgatggagcgtctgaggtcgtcttcccgacaggaggtcgttttgggcgagatgcagagacttggtttttggcccgccaacaaaggggagcccactgagctcgaggaagttgtacgccgggaagcagagctgagttccaccctgaaccgtctttctcaagagctccggacaatccaggaccccgaagccgctctgaaagctatgaggaaggagaggctggcaaaagcaaggcagaggcgggaagagacacgactgcgcagggcacaggagagattcgatagggccactgcttggcaccgcaggcgatccaccgagctgctgtacctgggcgagggtgtgtcagcaggcctgaatcaggccgaaagtgatgccggaaagctcgctcgatggtctttaccagtgatgaacaacgcctcagaattagcagcggccatgggcgtgacactgcctgagcttcggttcttaagctttgaaaggcgagtgagcagaatctcccattaccgcagatttgcgatgcccaagaaaactggcggtgagaggataattagcgccccaatgccgcgggtaaaacggctccaatactgggtgcttgataacatcctcgctaaagtccctctgcacagcgccgcacatggcttcgttcctggtagatccatagtatcaaatgcgcagccacatgtggggaaagctgtggtgatcaacctcgacctgaagaattttttcccttcaattgccctgcctcggattaagggggtcttccgggaactgggatacagtgatcagttggctaccacactggggttgatttgtaccgagacgccaacagaggaggtatctgtggacggggaaaagttctttgtggctaccggagaacgcgctttgccccagggtgctccaagcagtcctgccctcacaaatatcctgtgccgccggttagacgcccgtgttcagtcctgcgccgccaagctcgggtttatatatacacgttacgccgacgacctaacattctctggcgatgcagcagcgagaaagctggccggaaagctgctctggcgagttaagcaaattatcgccgacgagggattcacgccccacccagaaaagcagcacgtcatgtcactttctcagtgccagagtgttactgggatcgttgtgaataaaaagctcagcctggatagggatactcttcggcgcttccgggccaccctctttcaagttgaaaaggatggccccgccgggaaacagtggaatgggaacgagaatgtgattgacgccctcgtgggatatgcccagttcataaaaatggtggatgcagagcgcggagctccattgcttcagaaggcccgcatggtcagacagaaatggaacactgaggctccggtggtgagcgaagctgcggcaagagccagttccgggtttaggaagctatccgcacaaggcaaagagccttgggccgggttttggcaagctgccggaagcccagctccggtcttggagaaaacccagcaacagctgaaggaagagaagctcgctaaaagagaaaagcctgcggaaaagcccaaagcagctgctcacgccgacggacaggcagctagacagcagggcgtgactgcatctcctggaacccaagcacctgcacaaggcggccgcggtatgttcgcaggacgaccatgggtgtccattatcattcaggtgtatttcgcctttaccctgtgtctgaatttccgtactccgttgccccttgtcgtcgccatcgtactgggctatcaggcgtggagagactacagcggtcattggctacggtattttggcgcgatggccgtcgctgtggtcttaggcttgtggctaagatga

SEQ ID NO: 13348 - RNA, 1878 nt, unidentified
  source 1..1878: mol_type = other RNA; note = synthetic construct
atgtccgccaccgagagcaagcccattactacgcgggccgagctgatggaacgcctgagaaatagcagcaggcaggaggtggtgctgggcgagatgcaacggctcggattttggcccgctaacactggccaaccgacagaattggaagaggtcgtgaagcgcgaggctgagctaagtggcgccttacagcggctggggcaggaactgagaactatccaggatcccgaacaggctctgaaggcaatgcgtaaggagcgactgtctaaggccaggcagcgtcgggaggaaacacgtctcaaacgggcccgggagagattcgaacgggcaacggcctggcataggcgacagtccactgagctcctttacctgggagagggtgtaagcgccggacttaaccacgcagagagcaatgcggaaaaattggccaggtggtctttgcctgccatgaataatgccagcgagctcgcaaccgctatgggaattacattgcctgagctcaggtttctgtcattcgagagacgcgtttcccggatctcccactacagacgcttcgcaatgcccaaaaagaccggcggcgaacgaataatctctgccccaatgccccgcgtaaagaggctgcagtactgggtgctagacaatatccttgctaaggtgccacttcatcctgcggctcatgggttcatcccagggcgcagtatagtctcaaacgctcagccacacgtcggaaaagctgtggtgattaacctggacctaaaaaacttctttccctccgttaacctgcctcggatcaaaggcgtattccgcgaactgggttattcagagcagctggcaagcacacttggcctgatttgtaccgaaacacccgtggaggaggtttcggttgatggcgaaaagttctttgtggccaccggagagcgcgcattgcctcaaggggctccctcctcacctgccctgactaatatcttatgccgcagattagacgcccgcgcgcagtcgtgtgccgctaaactgggttttacatacaccaggtacgcagacgatctgacattctccggcgatgccgctgctcgaaaactcgcgggcaaactcctgtggagggtgaagcaaatcattgcagacgagggctttaccccccaccccgagaaacagcacgtgatgtctgatgcgcattgccagagcgttactggaatcgtggtaaataagaagctcagtctcgatagaggtaccctccgtaggtttagggccactctttttcaggtggagaaggacggtcccgccggaaagcagtggaacgggaacgacaacgtcattgacgcgctggaagggtatgcccaattcattaaaatggtcgatgcggacaagggggcacctttgttacagcaagtgcgggccgcaagagccaagtggattagtccggctcctgcggcttcagtaaccgccgtgaggcgttcctctggcttccgagcgctgagtgcgcaggggaaggaaccgtgggctggattttggcaagctgctgccgctccagcccccatgttagaaaagacgcagcagcagctggcactcgaaaaagccggagctggccgaaaagcagctgccccagcctctgccccatcaagaccagcagctagagcagccgcagaagctccagctagcgcaccggtccaaggtggtagggggaccttcactgggcggccttgggttgctgtgataatacaggtctatttcgccatcacattgtgcctaaatttccggacccctctgccttttgtggtggccgtcgtccttgccgtgttggcatggcgcaactactctgccaaatggccaagatatttcggagccatgtttgcagcagttctcgccggcgtccttctgagatga

SEQ ID NO: 13349 - RNA, 1914 nt, unidentified
  source 1..1914: mol_type = other RNA; note = synthetic construct
atgtctgccacagagtcaaagccaatcaccacaagagcagagctgatggagcgcctcagaacatccagcagacaggaagttgtgctcgaagagatgcagcgactgggattctggcctagcggtaccggacagccctccgaactcgagcagctcgtgcaacgggaggcagagctctcctcagcgttgttaaagctcgggcaggaactgaggaccgttcaggatccagaagctgctctgaaagctatgcgcaaagagcgcttgacgaaggccagggcgagacgagaggaaacgcgccaaaggagggcccgggaaaggtttgagagagccactgcttggcaccagcgaaggagtactgagctgctgtacctgggagagggggtgtcagccggactgaatcaggcggaaggagatgcagagaaactggctcggtggtcccttcccgctctgcacaacgcccaggagttggcctctgctatgggtgtcaccctccccgaacttaggttcctatcctttgagaggagagtaagccggatttcacattatagacgttttgccatgcccaagaagagtgggggagaacgcatcatctcagcccccatgcctcgggtgaaacggctgcagtactgggtgcttgataatatcctggccaaggtgccacttcacccagccgcccatggctttgtacctggccggtccatcgtctctaacgcccagcctcatgtcgggaaagccgtggtggtcaatcttgacctgaagaacttcttcccgagcattggtctacctcgcataaaagggatattccgtgagctggggtatagcgagcaactggctactaccctaggcctgctgtgcactgaaaccccctctgaagaggtgagtgtggatggggagaagttcttcgttgccacaggcgagagggctttgccacaaggcgcaccctcttcgcctgctctcacaaacatcctgtgccggagattagacgcccgagtgcagagttgcgcggcgaagctgggcttcacatataccaggtacgccgacgaccttacctttagtggcgatgcggcagctcgtaaacttgcgggcaagttactatggcgggttaaacagattatcgccgatgagggctttacgccgcatcccgaaaagcagcacgttatgggtgccggccattgtcagtcggtgactggcatcgtggtcaatcaaaagctgtcccttgagcgggaaaccttgcgccgcttccgagcaaccctgtttcaggtagagaaggacggaccggccggtaagcagtggaacgggaatgccaatgtgattgatgctctggaaggctacgcccagttcattcgaatggtcgacgcagaaaaaggtgcacccttgctccaaagagtcagggcagcacgtgcaagatggattgcccaggcacaggacggaggcgaacaagccgcacggcgaagctccggatttcgcgctctcagcgcccaggggaaagagccttgggcaggtttttggcaagcccaagctcccgcagcccctgagttggaaaagactcagcagcaggtaaagcaggagaaattagaacaccgccaggcccagaaggctaaacccgcttcaggaaggccagctgttgcagcgggggctggaccttctgcaagagcgacaagacggcaagctcctgaggctccaccagccgaacaagaagagccctacaaatttagcgacagaccgtggttagggattctgatacagctgtatctggccttcagcctctgtcgtttgtaccacactccacttcctctcgtgttcgctgtgatgctggctataccagcctggcggaactatagggcatattggctgcgctacttttcttacatgtgtctggccgtcttactcggcatcgtcctcaggaagctattgtga

SEQ ID NO: 13350 - RNA, 1668 nt, unidentified
  source 1..1668: mol_type = other RNA; note = synthetic construct
atgagaaggcagcgcctccaagctgcccggcaacgaagggaggcaacacgccaagccagagcacaggcccggtacgaacgtgcacgatcctggcatgagcgcagacagcactcagtgctctatttaggtcagggcgtcagcggcgggcttcagcattctgataatcagccagagaggctggcacggtggcaactgcctcagccagccaacccacagcagctggcccagctgatgggcgtgtctgtcgccgagctacgctttctcgcctatgaccgggcagttgctcgggtgtcgcactacagatcctttgacctgcccaaaaagtctggggggttaaggcgcatctccgctcccatgccgagactcaaaaggctgcagtattggcttctggataatatccttagcaaggtgcctgtgcacgacgccgcacatggattcaggcccggtagatcgatctgcagtaatgcccagcctcacgtaggtaaggccgtggtcatcaatctcgatctgcaggacttcttcccctcaatagcttacccacgcatcaagggggtctttagggccctcggctactctgagcagctggccagtatcatgggactcctatgtacccagcggccaacgcaagcggtccaactcgatggccagacataccacattgcgactggcgctagacacctcccccagggagctccaagctcaccagctttaacaaacatcttatgccgtcgattggacaggcgcttgcatggcatggcagccaagctggggttcgcatataccagatacgccgatgatctgtctttctctgcggacgccccagcccagcacttagttggcaaactgctgtggcgagctcgtcagattattgccgatgagggctttacccttcaccctgataagttgcatgtgatgcgtagcgctcggagacagcaggtcaccgggttggtcgtaaatgccaagccttccattgaccggagcacttttaagagattccgggctaccgtgttccaggtggaaaaagacggcccccagggaaagagctggaacgggaacgacaacgtgctggacgccctgctgggatatgctcacttcctgcatatggtagatcctcaacgcggacagccctggctgcagagggttcaagccctcagggttgcggctcaggcacctgcacagagccagccaagtcccgaaccgcagcagatattggaactggaatccgccgcaaaagccagccaagccgggagaggtcgatccgcttttaggagggcatcagcccaaggacaggcaccgtgggcccattggtggcaacctgcccaaccacccgcacctgtgctggaacccacggaagcgcagcgacaggctcagaggcaagcgcagagacgacagcaagcccaggctgcgttacctactgctgcacagccacaacgccagggtgcgctagagcctcaacagcccccagaggaggcccagcacgctagtcagcgtaacccccgcatgcttctcgagcagacactcgctctgctcgttttgctttttatgcttcggaaaccgtccctgctgctactgggactgctgattcacctcgcataccatttgttgcaccggtcaagttggtggctttttctgcccctattgctggcttcccttctggtgcctttctga

SEQ ID NO: 13351 - RNA, 1884 nt, unidentified
  source 1..1884: mol_type = other RNA; note = synthetic construct
atgagccagcccagccagagcaacccaaatcagagcaactctgcccagccccccaattcaagggaggcgattctccaaaggatgaggaactctagtaaagatgaggtcatattagaagagatgcgccgacagggattctggccgaaggacgaacccagtccagaacaagccgctgcactcgcgctcatcgagcgcgaaggggagttggtacgtgccctgcatgacctttcgcagcagttacatcaggtggaggagccccaggctgcgttaaaggcaatgagaaaagagaggatgcgtctcgcacgggagaagcgggaggtaaccagaagacagcaggcccagcgccggtatgacagagctctggcctggcacactcagcagcaaaacgatataacatacctgggggaggatgtgagccagggtctggccgatcctcgctccgatgaggcgagactggctagcaagggactaccacatttctcctccgtggctgctctggctcaagccatgggagtaaccgttgccgaactccggttccttagtttcagccggaacgtcacaagaatctcccactacagacgctttacggtgcctaagaagactggcggtgttagactaatttccgcaccaatgccacgactgaagaggcttcagtactggatcctggagcagatactgttaaagctgccggtgcatgctgcagcacagggcttcgtggccggaaggtctatagtgtcaaatgctaccccccacacaggacaagctgtggtggtgaacttcgacctgcaagacttttttccctccatccactggcaacgggtttccgggttgtttcagtctatggggtacagtaaacagctcgctaccatcctcgccctgatttgtagcgaaacaccatgcgatgaagttgctgtcgacggcgcacactatttcgttcaaaccggtgtgaggaggctccctcagggagctccctcgagtcctgcgctcactaatctgctatgccgacgcctggacacacggttgagcgcgttagctcaacgactgggctttaggtataccaggtatgctgacgacatgaccttttccgccgctgatgactcacagcttcctcgtttgctctggcaggcgaagagagtgattcgggaagaaggcttcacgttgcatccagataagcagaaagtgatgcgccgccacgcccgtcaagaggttactggcattgtcgtcaaccagaggcccgccgtttgtcgagagacgctgcgacggttcagagccgtgttgttccaggtcgagcaaactggcccgactggcaagcattggaacgggaatgaaaacgtgctggcagccctggcaggctacgcacagttcattgtgatggtcgacgccgaaaaaggaagacctcttctcgccagagtccacgcagcacagctgaaatggtccgctccggaagctgccaggtcttcatattatcgggactttcggaccgcctcatcaaaaggtatcgcccctaagggtatcacccagatggcacaacgtgcgatcccaatcatcgagctaacacaggagcagcaccaacaagccaagcagagtgctcagcagcccaattctcagcgggccgtcattcctgccgatcccgatgtcgttctgttggaacagcagcaagcaccacctctcgccgcacacgcaaatacacctgtatctatttaccttcagattgccgccgcctttctggccctgatgctgattgggctgctgagctcaaattaccttcttagtgccgggtccatcgtgtgggtgtggtactgcatgcagaaacgcaaattttcttggtggggctttgtgctcgtgttgatcgtatgtcgctggctgtggcagcagatcgagtga

SEQ ID NO: 13352 - RNA, 1917 nt, unidentified
  source 1..1917: mol_type = other RNA; note = synthetic construct
atgagcaatgctacccagacctcacgcgaggctgtgttggcccggatacaggcttcttcaaaggacagtgtcatcctggaggagatgcaacggttgggcttctggcctgctgggtctgggactccagaccagcaacgagcaaccgaactgatctcgcaggaacaggccttgctctccgagctgagagaactaaaccaaaaactttctatagccaaggacccagtcgctgcactgaaggctctcaacaagcagcgcatggccgaggccaaagctagaagggagcagactcgcctggcagcagcccaaaggcgctatgaaaaggcggccgcatggcacgctcgaagagctctggacattgggtacctgggtgaaggtgtctcccagtccttgagcgatgctcgaactgatccacatcgtctcgccgctagggagttgcccgtgctcgactcacccaaggtgcttgctgacgccatgggcatcaccgtggaggaactgaggttccttacgtttcaccggtccgtgtctcggatctcgcactaccggagatttggtatccctaagaagaccggaggactgagaatgatctccgctccgatgcccagactgaaaagggcccaatactgggtgcttgacagggtgctcgcaaaactgcctgttcacgatgcagcgcacggtttcgtgcctggcaggagcatcgttagtaacgcaactcctcacgcaggccaggccgtggtcgtgaatttcgatctcaaagatttctttccatccatctcctatcagagggtacggggcctgttccaaacattcgggtactctaggcagctggcaactttgtttgccatgatctgcacagagctgccgactgacgaagtgtctattgacggccttcatttccacgtccagaacggcgagcgtcatttacctcaaggggccccctgcagccccaccattaccaatctgctgtgtcgaagattagatacgagattagctggactggccaaaaggctgggattcatatacaccaggtatgcagacgatatgacattcagcgccgatgccgcgagtgccgggaacttaccccgtctcctatggcaggtgaagcgcatcattgccgaggaggggttcacacttcatcccgacaaacaacgaataatgagaaactccgcgcgccaggaggtaacgggagtcgttgtaaaccaccatcccacagtctgtagagagactttaagacggtttcgtgccacactgtaccaggttgaaaaggacggcccccaaggaaaagcctggaacggaaacggcgacgtcttgaatgccctggctggatacgcacgctttgtgaagatggtggatcctgccaagggcggaccactttgcgctaaggtagctgctgttcaggccaagtggggggataatgcctcacagccacggggccagtattatcgcctctttcgcgaagcaagcgtggccggtaaagccctcccgagccatcaatggcaggctaagcggcagcctgcacctaccctcgagaaaaccgccacgcaactccagcaggagaaacaggcaactcgccaggctgagtctgatcaggctgccgcagttgcggcagaaaccattgccagcgcggcggcactaccaacaacacacacccagagtggggaactgattgaacggaatgctgtgagcgcggatgccattcccccaaacgttcatgaagacgtcccagcatcagtttacctacagctggctatgcagttcgtgttgatgctggtgtcaggacttttgacaggcaatgtgctcatggccatggccagtgtcggttggatgtggtttggctttaaaaggagacgggccaattggtggctgtggctgggggtatattttgcgtgtcgactgctatggcgtctcactacagcctga

SEQ ID NO: 13353 - RNA, 1875 nt, unidentified
  source 1..1875: mol_type = other RNA; note = synthetic construct
atgtccgatgctgcccaaacaagccgagaggccgtcattgcacggatcagaaacagttccaaggacgctgtggttctggaagagatgcgcaggcttggtttttggcctcaggggcaagccagtcccggtgaaggagaggttgccgccctcatcgaacaggaagccgccctcatccaggagctccagcagatcaaccgtaatctggcgagagtgagggacccgcaagcagccctcctggagatgaaaaaggagagaatggcggcggcaaaaaggcgacgcgaagaaactcgccagcggcacgcacagttacgctatcaacgggccactgcctggcacgcaaggatgcagcaggacattgtataccttggcgccggagtgagcgctggactcgatgacgcacggcacgacaccgctaggctagcctccaagcaactacccctccttgacggccctcaagctttggcagccgccatgggcgtacctcttgccgagcttcgtttcctggcctatcaccgatctgtgagccgcatcagccattaccgcagattcgggattgcgaaaaagaccggaggagtgcggctcatatcggcccccatgccacgcttaaagagagcccagtattgggtgttggacaggatcctcgcaagactccccttgcacgaggcagcccatgggtttgtccctgggagaagcattgtggggaacgctctgcctcatgtgggacgtgctgtcgtccttaacctggacttgcagaatttttttcccagtattgcataccccagagttaggggtctgttccagtcattcggctattcacgccagatggccaccctgctggccctgatatgtactgaaacccccagcgaggaagtggagctggacggaaataggtatcatgtgcagaccggtgaacgttgtctgccccaaggcgccccatctagtcccgcaatcacgaatctgctctgcaggcggttggataaacggctcacagcaacagcagccaagctagggttctcctacacccgctacgccgatgatatgaccttctctgccgatgccccacaggcagatgggctggctaggttgctgtggcgggtgaagagaatcattgctgatgaggggttcaccttgcaccccgataaacagaggatcatgagggctgcctctcgtcaggaggtgactggcgttgtggtgaaccggcagccggctatttgccgggatacattaagaagatttcgggccacaatgtttcaggtggaaaaggatgggccacttggcaaacagtggaacggaaattcgaacgtaatcgcagcactggagggatacgcccgctttattgctatggtagacccagccaaaggcgagccactgtgccagagagcggctctactccgagcgaagtggggttcagtcctcccagcgcctgcctctactggctatagaagggctttcagagctgcttccgctgaagggaggcagacccccggacgaatctggctgcctgctgagaggccggttccacagctggagcagacggaccaacagcagcgcgagcaacgagccgcagctcgagaagcagcccagccttccccagtccctcagacgacagcgtcacgggctaatgctactccgcccgcggcacaacctcaaggcgctaatcctgcagcaataggctgggtgcagcagtactatggtctgctagccgtcggccagtttatggcccttttggctatcggcgttcttggccgcttctggctcctgccactgtgtgggttagtcttgatgctgtacgccctgcggacacggcacattagcggctggcacttcgcgctggctttagtggtcggtatactgtttgacggagttctgcattga

SEQ ID NO: 13354 - RNA, 1908 nt, unidentified
  source 1..1908: mol_type = other RNA; note = synthetic construct
atgtcgtaccaggagactcccgagctgcaggccttaagggagcgtatacgcgcaagtaccaaagacgccgtcgtactggaggaaatgcgacgcctgggttactggcctaaagatgaggctatcccagactcaagagatgccgcatccgagattgggcaaatcatccaacgcgaaggcgagcttgtgggggaactgcacaagatggcacaggatctacacagactgtccgatccgcagcaggccctgcaggagatgcgcaagcaacgtatggccgccgcgagagctaaacgcgaggagactcggaggcggcatgccgaagaacgccaccaaagagctgccgcctggcacgctcaacgacagaagagtattgcctggctcggtgaagaagtcagcacaggattggccgatgttaggacagacgcggctcggcttcacgcaaaatcactgcctgttatcgagagtataggggagttagcccgcttaatgggcgtaccactggccgagttaagatttttggggtatcagagatcagtatctcgcattaaccactaccacaggtttggaattgccaaaaagacagggggcgtgcgagtgatctctgcccctatgcccaggatgaagcgagcccagtattgggtgctggataagctcctggtgtcccagcccgtgtccgctagtgcgcatggtttcgtgcctggcaaatccatagttgacaatgcccgggtgcatgccggacatgacgtcgttattaatttcgacctgaaggacttcttcccaagcatccattaccccagggtgaaaggcctgttttcctctttcggctattcagatagcgttgctacactactggccctgctgtgcaccgaggcacctacagaaaccgtcgagatggatgggcagcgctaccatgtccagaccggtcctagatgtcttccccagggggcacccacctctcctgcaattaccaaccttctgtgtcgtaagctcgatagacggctcgaggggagcgccaaaaaactcggcttcagctataccaggtatgctgatgatatgaccttcagcgcacccgcagaggccaggtccaaactcggacagatgctctggtgcgccaagcaaatcattgctgacgaggggttcattttgcatcccgacaaacagcgggtaatgcacgcaggtagacgccaggaggtgacaggactcgtcgttaatgaacggccggcggtcccgagggaaacattgcgtcggtttagggcgactctctttcaggtggaaaaggacggcccagagggcaaatcatggaacggaaatggaaatgtgatcgcagcacttgacggctatgcgaggtttatctacatggtggatgccgacaagggagccccgttgctggctagaatcgcccagctgaaggaaagatggtctggagcacccgtccgaaaggcacccggcttgctgtcaggacctgcatttcggcgagcagcaggtgaagggaaggctcctcgggagaactggtggactcccgctgaacaagcggccccagtcgttgagaagactgaccaacagagggctgaagaccgagcagcggccaaagccgcaatccggttgcagaaggctgaagcccaggccactgctgctccagcatccagcgaacaagcggaaacggctccaccacctgctagcctcgctccagaggaggccgctaaagctagagcccttagtgccagcgactctattcagatcctcatccagtcgattgtgatggtgctagctggtctggtgacgcacaactacctggtacttctaggcgccgtggtttggttctttctgtctatgagtaagcgtaagcggtacaactggcttatatgggccgtggtgtatatagcttgccgcatcctgggcggcgtccactga

SEQ ID NO: 13355 - RNA, 2004 nt, unidentified
  source 1..2004: mol_type = other RNA; note = synthetic construct
atgacacagaacaaacagtcggcgagcgtgacctctccacccttgtcccaaatgacacgcgacgaactgtatgcccacgtccggacaactaccaaggacgctgtagtgctgcaagaaatgagacggcttgggttctggccagccgataccgggaagcccagtgtgaccgaagagctaattcagagggaagcacagctgagttctatgcttcgcgaactgacctcccaattgcagcacgtccacgatccaaaggcggctctgagggatatgaggaaacagcgcatggctgctgcaaaagagaagagagagcagactcgacaaaagcacgctcagctccgtcatgcaaaggccctggcctggcaggagaaacgccagaacgacatcgggtacttgggcgaggcagtcagttcaggattaaactacaccactacagacatcgagaaactcgcccgttatcagctccccgtgctgcaaaaggctcccgaactcgccactgctcttggaatacccctggccgagctgaggtttatgtcatttcaacgtaaagtctcccaggtgtctcactaccagcggttctccatcccaaaaaagaccggtggactacggtacatttctgcccccatgccgagactgaagcgctgtcagtattgggttctggatcacatactctcaaaggtgccatgtcatccggccgcccatggcttcctgcctcaacactccatcctgagcaatgcccttcctcatgtcgggcaggccgtagtcataaacctggatttgaaggatttcttccctagtatcgagtatgctcgggtcaagggagtcttcaaaagtctgggatacggcgaccagatcgcaacacttctgggcctgctctgcacagaacaggcttccgaggaggttagagttgacactcagagatactttgtcgcgggtaaaaagaggtctttaccccaaggcgccccctcctcccctatgatcaccaatattctctgccacggtttggacaaacgactccatgccgccgccagtaagcttggatttgtatacaccaggtatgcggatgatctcacgttttcctctaaacaaaaggagaggccccctgtgggaaaactgctgtggagagtgaagcagataatcgccgacgaaggcttcacactccatcccgataagcagagaataatgagacacagccaaaagcaagaagtgaccggcattgttgtgaatcacagcccgactatcgacgccaggacactacatcgatttagggccactttgcacaaggtcgaaaaaaacggcccagctggctaccactggaacgggaataccgatgtacttagcgcattagaagggtatgctcgatacatctgtatggtcaaccccgccaaaggtcagccctggttgcagcgggtgaagcaactgcgggtggtttatgcagcacctacctcagtaccagctcatagcgcccggccacctcgcttatcgctacgacagcaggtggcagctggaaatacgccgctgagagccaatggcaaggactggtggcaggtgaaggaagctgccgtgcccgtgcttgagctgacggctcagcagcttgccgagcagaagcaggcagagaaacaggccgagaagcaggcgctcaaagaggcaaagcaggggaaagacacccaagctaaggcaccagtgagagagaatcaaacacagagctacgcacagcggcaggttgttactcctcagcctgtaagggcaaacgcttcaaaacgcaatcgtgacgatgccgcacctgtctccgacgaacagcctgtggtcttcaaactgcgaccaattccttggtggagcattttgctccagttcgtggcgtgcattatggttacaatcagcctgcgctcaatttttccagtgacgttaggtttgagcctgctcgcgatttctatcatcactcgccggtctatgatggtgtgggtgatggtggtgctggttctaagtgttctgctcattaactcatga

SEQ ID NO: 13356 - RNA, 1977 nt, unidentified
  source 1..1977: mol_type = other RNA; note = synthetic construct
atgacccagcaacagcagtctgcccccgttaaaccactgagccagatgacaagggatgaactgtacgcgcacttacgtactactaccaaggacgctgtcgtgttacaggagatgaggaggctcggattttggcctgccgataccggtaagccaacgctgactgatgaaataattacccgggaggcggaactctcaacaaccctcagagccctctcagaacagcttcacagagtgcaggatccgaaggccgcactgagggaaatgaggaggcagcggatggcggctgccaaagagaaacgcgaacaaactagacagaaacacgcccaactgcgctacgctaaggccctggcctggcaggagaaacgcaaaaccgacatagtgtacctgggggaaggtgtctccggaggactgaactatacagccaccaacactgacaagcttgcccgccatcagttgcccctgctgcaatccgcctcagagcttgccactgcaataggaatcccccttgcggagctgagattcatgtcgttccagcgacaagtgtcccaggtatcccactaccagcgttttgctattcccaaaaaaacagggggtcagaggatcataagtgctccaatgcccagattaaagcggtgtcagtactgggtattagaccatattctcgctaaggtcccctgtcaccccgccgctcatggattcttgccacaacattctattctgagtaatgccactccacacgtaggacaagccgtggtgatcaatcttgacctgaaggattttttcccgagcattgactatcagcgggtgaaaggcgtgttcaagagcctgggatatggggatcacatcgcaaccgtgttgggcctgttgtgcacagagcaggccagtgaagaggtgcgcgtggaccgtcagaagtattatgtcgccggcaagaagcgatccttgcctcaaggtgccccctccagcccaatgatcacgaatatactttgccatacccttgacaagcggcttcatgcagccgccactaagctcgggtttgtgtacaccagatatgcagacgacctcacctttagttctaaacagaaggagcgacctccagtggggaagctcctgtggagagttaagcaaatcattgccgacgagggttttaccctgcacccagacaagcaacggattatgcgctacagccagaagcaggaggtaacaggcatcgtggtcaaccactctccaaccattgatgcaaagacattacacaggttcagggccacggtccaccaggttgaaaaaaaaggccctgctggcctgcattggaatggaaacaccgacgtgctagcagctctggaaggctacgctcggtatatctgtatggtcaaccccgcaaagggccagccttggctgcagaaaatcaagcagctgcgggctcagcatgctgcacctgcagtgactagacccacacgaccctctctgcgccaacagctcgctgaagggaagactcctgagcgggccaacgggcaggattggtggcagattaaggagcccgccgcaccagtcctggagctaacgacacagcaggttgcggaagcaaaaaaagctttgaaacaagaggccgtacaagctacaaaagctgccaaggccagcagacagggtacagctacccctgattatggccgacagcagacagcgggcagaacagctccggtgaatttgaatgtttcagcagggaacaccaggcctggacaagcagatgatgggaatcagacttacaacgcaacggagcagagcaaactcaacaacaagcgtaatgctcgcctgttcgcaatcctatttcagctcttcctctgcgtcttcttcaccctgcagctgaaaagtctctacccggtcatcctaggcctacctttgcttgcgctctctattatctccggccgctcaaaatttatgtggatcatgttggtgctggttgcctgcgttctgtttcggtga

SEQ ID NO: 13357 - RNA, 1956 nt, unidentified
  source 1..1956: mol_type = other RNA; note = synthetic construct
atgacgcagcagcaacaacccagtgcccaatcagcttccgataagccgcttagccagatgacacgcgacgagctctatgcacatctacggaccacaaccaaggatgcagtcgttctccaagagatgagaaggctagggttctggcccgctgactccgggaagccttctgtcacagatgagcttatcacacgcgaaagccagctcattaacgaactgaacactttgacagacaagctgcgacgtgtccaagacccaaaggcagcccttcgagatatgcgaaaacagaggatggctgccgctaaggagaagcgggaattgaccaaacaaaagcacgcacaacttagacacgcccgagccctcgcctggcaggaaaaaagacagaatgacatcggttatctaggggaaggcgtctcaaccggcttaaactatactagtacaaataccgacaagttggcccggtatcagctgcctgctctgcagaagtccctggatctcgcaactgccatagggatccccctcgccgaactgcgctttatgtcttttcagaggaaagtatcgcaggtatcacattaccagcgctttgccattcctaagaaaactggcggacagcgcttcatatctgccccaatgccccggcttaagcgctgtcagtactgggtcctcgatcatattctagcaaaagtaccatgccatccagccgcccacgggtttttgccgcagcactccatccttagtaacgcgttacctcatgtaggtcaggccgttgtcatcaacttggacctcaaagacttttttccctctatcgaatacccacgagtgaaaggtgtgttcaagtcactgggctacggggatcaaatcgctactctgctgggcctgctctgcactgagcaggccacggaagaggtgagggttgacaaacaaaagtacttcgtggccggtaagaaaaggtcgcttccccagggcgctcctagtagccctatgatcaccaatattttgtgccacacactggataagagactccatacggcagccacaaagctgggatttgtgtacacgcgctacgccgatgatctgactttttccagcaaacagaaggaaagacctccagttggtaaattactgtggcgggtcaagcagataattgcagacgagggcttcatcctgcaccccgacaagcagcacattatgaggcacagccagaaacaggaggtgactggaatagttgtcaatcacagccctaccatcgacgctaaaacattgcatcggttccgtgccactctgcaccaggtcgagaagaatggaccggcgggataccactggaacggaaacaccgacgtgctcggcgccttggaaggatacgcacgttatgtgtgtatggtgaaccccgtgaaggggcagccatggctgcagagaattaaagccttacgggcgaggtatgctccacagtacgcgacccagtcagcaacacaccccgctaggcctaccctgagacagcaagtggcctctggcaagaccccccagagggctaatggaaaggattggtggcaagtgcaggaggctgcggcaccagttctcgagcaaacagcccagcagattgctgaggagaaaaaggtggtgcgccaggccgagaaagaagagaagaaggccgctgccatgccgcaatccgtgcaaccagacgttgctggaaataccggcaaccaggcggcaaataccgcgaatcccgcaaacaccgaaaacctgaccgccgctgagaaaaataaactgaacaaacggctttatgggacgctcgggagagtgttccaggtgctgttgtgtgcaatcttcagcgcttccctccattcactatatcctctgactttcggcatcgctctggtggcactgagcctgatttctggcagatccagtttagtatgggtgatggtcatgctggtcctgagcgtggttctgctttcttga

SEQ ID NO: 13358 - RNA, 1926 nt, unidentified
  source 1..1926: mol_type = other RNA; note = synthetic construct
atgactatgcagtctcccgcctcgtcatctagcattcctgacagcgcgctgacccgggaggagctttatgagaggataaggaaaagctcaaagcaagaggtcgtactggaagagatgcagagactcggattctggccgcgcgacgcagcacaacctaccgttgaggagcagttgatccggcgggaaggcgaacttcagaccgccctgtcaaagctgggatccgagctgcggggtatagaggatcgggatcgtgccctcaaaataatgagaaaagaacgcatggcccgcgcccgtgaaagaagggaggaaactcgtcagagagctgcccagggtagacatgctcgggccgttgcctggcacgaaaggaggcagcgagaactgctatacgtaggcgatggagtgagcggcggccttaacgacgcacattctgattcccaggcccttgcccgcaatgcactgcctgctctggatcacgtttccgacctggctcaggcaatggggattgggctgggagaattaagatttttggcctggcaccgggaggtgtcatccgtgtcgcattatcagcgttttaccatgcccaagaaaagtgggggtgaacgccacatcagcgcccccatgccaagactcaagagggcccagtattgggtcttggacaatatcctggccaagatgcctgttcacgaagctgcccacggcttcatgcccggaaggtccattcttacaaatgccgcgcctcacgttggcagggatgtggtgattaacttggacttgaaggactttttcccctctattggaatgagacgggtccgcggcgtctttcgacaactcggctacagttcccaggtcgcaagtctgctagcactcgtctgcacggaggccccaaccgatgaggtacagctggatggtaatagatatttcgtagcccgcggcgacagagtgttgcctcaaggcgccccgacttctccgatgatcacaaacctgctgtgtaggcgcctcgatgccaggttatcagctagtgccgccaaactcggcttccggtacacacgatacgcggatgaccttaccttcagcgccgggcctgagcactccagagataccgccaaattactgtggcgggctaaacagatcgtcgccagtgagggactgacactgcatcctgacaagcagcaagtcatgcgaaaacaccggcagcagcatgtcacggggatcgtggtgaacgataaactttccgtagacagagacactttgcgaaggtttcgtgctgtgctacaccaggctgagcgcaatggtctgcagggactgcagtggaatgggaactcagacgtgatcggggctctcaggggctacgcgaatttcattgccatgacggacgctgcacgcggggaaccttacttacagcgcgtgcgagccctcgcggccaaacatgaaggtggggctgcacccaagactcaggctagtcaacggaggctcggcgctggcgagtttaggaagcagagcgctgcagggaaggcaccatggccagcttggtggcaacccgcagaagcagcagctcccgtgcttgaaaagacagccgagcagatagctgaggagaaaaaggcacagagagaggccgctcgaccacagcccgttgctgcatctcccgctccagccagagcaccagccacagcacaaccggctgccgctccagcagctaagcaagcgccaggcgccctgagtcagatcggatgggtggcgtccatgatgctgcaggcgctatatgtggttagcgtcttcctgagcggcacctcacctctcatctggctgatgactggaggggtggcaatcggaaactttgtgcaacgcaagtctggttggctccggttcatcgtggccatttttattagctccgcgttagctagcttggtgcattctatgaagaactga

SEQ ID NO: 13359 - RNA, 1980 nt, unidentified
  source 1..1980: mol_type = other RNA; note = synthetic construct
atgcaaccacccgcgtcatcttcatcagtgcccgatagcgcacttaccagggagcagttgtatgaaagactgagggggagcagcaagcaggaggtcatccttgaagaaatgcagagactggggttttggcctcaggatgcagctcagcccacagtggagtctcagctgatccgccgggaaagtgagctccaaaccgcactgggcaaactaggggaggaactgaggggtataagcgaccgagataaggccttgaaaatgatgagaaaagaaagaatggccaaggcgcgcgaacgtagggaggagactcggcaaaggctcgcgcaagggcggcatgcaagagcattggcctggcatgagcggcaccagcgagaactactgtatgtaggcgatggtgtaagcggtgggctgaacgaggcccaatccgactctcaggcgctggcgagaaatgctctccctgccctgaatcatgctggcgaccttgccggcgccatgggaattgacctaggggagttacggtttcttgcatggcaccgcgaggtggccaacgtgtcccactaccagcgcttcactatcgccaaaaaatcaggaggcgagcggcatatctccgcccccatgcctaggttgaagcgggcacagtactgggtccttgacaacatcctcgcaaaaatgccggtccacgaggccgtccatgggttcctcccaggaaggtcaattctgacgaatgccgtgccccatgttggccaggatgtggtgattaacttggacctgaaagactttttcccttccataggaatgagacgagtgcgcggggtgttccgacagcttgggtacagcagccaggtggcttcgctcctggcccttgtgtgcacagaagcaccgacagacgaggtacagttggacggccgacggtattttgtcgctcgtggagaacgcgttttaccccagggagcccctacatcccctatgctgactaacctgttgtgtaggcgattagatgcgaggctcgccgcctctgccgccaaacttggcttccgctatactaggtacgccgatgatctcagttttagtgcagactctcagcactcacgggacacggggaagttgctgtggcgcgtaaagcagatcgtggcatccgagggtctgacagtccaccctgacaagcagcaagtgatgaggaaacatcagcagcagcacgttaccggtatagttgtaaacgataagctgagtttggaccgggacaccctcagacgctttagagctgtgctgcacctcgctgaaagacagggcccccaggggctgcaatggaatggcaatgtggatgtgattggcgctctgcgtggatatgccaacttcatcgcgatgaccgatgcagctaggggagccccgtacttacagagagtgagggcgctcgcagccaaacacaagggctctgccatgactaccccaatcgcccccgcaagccctgttgcctcacagcagccgcaacggcaagtggccccagaccagtttaggaaacagtctgctgcaggtcaggctccctggccagcttggtggcaacctgcccaagcttccgcccctgtcctcgaaaaaaccgccgaacagctggctgcagagaagaaggcaaagcgagatgccgagagagctgaggcagctgctaaggctgctgcagccacagccgctagtgctcctgtaccacgtgctgctgcggctccagctgttgcgccatcgtccccagaagcacccaccccagaggcacccaagcgtctggagagtcagttcgtcctgactgtgagcctcatgctgcagagcgcctacgttgttatgtctctccttacaagccgctcccttgtggtgctactgcccgtcggagccattgtcattggcaattggatccaacgcaagtccggttggatgagattcctgattgtgctgatcgccgcctctggactaagtggcctggtccggcacttaacgcagtga

SEQ ID NO: 13360 - RNA, 1941 nt, unidentified
  source 1..1941: mol_type = other RNA; note = synthetic construct
atgcagtcacccccagcatcttccatcccggattctgccctcactcgggaacagctgtacgagagaatccgaaaagggtccaagcaggaggtgatcctcgaggaaatgcagcggctgggtttttggccacaggaggctgcccagccaacagtggaggttcagctaattcggcgggagggcgaactccaggcagccttatccaaactgggagacgagttaaggggcattgaggatcgggacaaagctctcaaaaccatgcgtaaagaaaggatggccaaggcccgagagcgcagggaagaaacacggcagcgactcgcccaggacagacatgcacgggctatagcttggcatgagcggcgacagagagagctcctgtatgtgggtgaaggagtgtctggtggcctcggcgaggcccaaagtgatgccgaggtcctcgcacgcaatgcgctaccggctcttcatcacgctggcgatcttgcccaggccatgggaatcgggctgggagagctcagatttttggcctggcacagggacgtcgcaaacgtctcgcactaccagagattcaccatcgccaagaagtcgggcggcgagcgacacatttctgctcctatgccccgcatgaagcgcgcccagtactgggtcctggacaatatcttggcaaaaatgccagtgcacgatgctgtgcatggttttctgccggggaggagcattttaaccaacgccgctcctcatgttggccaggacgtggtcatcaacctggacctgaaggacttcttcccttccatcggcatgaggagagtccgtggcgtgttcagacagttggggtacagcagccaagtggccagtctcctggcgctcgtttgtacggaggcccctaccgatgaagtgcagctagacggccggagatacttcgtggcacgaggggaacgggtgttgccacaaggcgccccaacttcccccatgctaactaatttgctgtgccgcaggttagatgcgaggctggccgcgagtgcagctaaactgggctttaggtacacccgttatgcggacgacctttcttttagcgccggtcccgctcacagcagagatacagctaagttgttgtggagggtgaagcagatagttgcttctgaggggctgactgtccaccccgataagcagcaggtaatgaggcgccaccgccaacagcacgttacgggaatcgtggtaaacgataagcttagcctggaccgcgacacaatgcgcaggtttagggcagtgctgcatcaggccgaaagccgaggccctcaaggtctgcgttggaatggaaactccgatgttattggggcccttcgggggtatgctaattttattgcaatgactgacgcggcacgcggagccccatatgtagagcgcgtaagagccctggccgccaagcatggcgatgggaaggctacggctcccgcagtgcagcagacccaaccttcacagagaagtctgcccgcagggcagttccgcaaacagagtgcagcgggccaagcaccttggccagagtggtggcaacctgcacaagcccccgctcccattcttgagaaaaccgccgaacagatagccgaagaaaagaaagctcagagagaagcagcacgggctcaagcggcacctcctgctgtagcacgtcccgctcagacacagcaagctcccgccgctcaacctgctgccactacatccactccagccgcgccaggagcgctttcacacattggttggatcgccagcatgatgttccaggccctgtatgtggtgacaaccttcctggcagggtccagcccgctcatctggctgcttaccggaggagttttcataagtaacttcctgaggagaaagtctggatggggagggtttctggccgccgttgtcgtgtcatccgctgtcgcctcattagtccattcaatgcggaaatga

SEQ ID NO: 13361 - RNA, 1929 nt, unidentified
  source 1..1929: mol_type = other RNA; note = synthetic construct
atgaccccacccagtccgtcctctgtcccagactcggccctgactcgggagcagttgtacgaaaggatcagagccagctccaagcaggaggtggtacttgaagaaatgcagcgtctcggtttctggccccgtgacaccgcacagcctactgtggaagcccagctgattcggcgcgaaggggagctgcaaaccgcccttagggacctgggcgatgagctgcggggcattgaggacagggagacagcactgaaaagcatgcggaaagagcggatggctcgagctagagaaagaagggaggagactagacaacggttagctcagcagcgacatgctcgcgccctcgattggcatggtagacgccagagggagctgctatatctgggcgagggcgtgtctggcggccttaatgaggcgcgcagtgacgagcaatccctggccagacatgcactccctgctctccacgatgctaccgatttggcacgcgccatgggtctggaactaggggagttgcgctttctggcctggcaccgcgaagtcgccagggtatcgcattatcagcggttcaccgtccccaaaaaaacaggaggggagaggcgtatatctgccccaatgcctaggctcaagcgggcacagtactgggtgttggacaacgttctggcgaaagtgcccgttcacgaggctgtgcacggcttccttcccggacgtagcattctttccaacgcggcaccacacgttggccaggctgtggtcgttaatctggacctgcaggatttcttcccttcaattggcctcagacgggtgaggggcgtatttaggcagctcggatatagcccccaggtggcaactctgttcgctctcctagcgaccgaggccccaaccgatgaggtggaactggacggcgaaaggtacgtcgtagcgaggggggagcgagtccttcctcagggtgcacccacgtcaccaatgcttacaaatgtcctgtgtcggagacttgatgctcgcttggccgcctgcgctgctagactcggtttccggtacactagatacgccgatgacctctcattttcagcggatgctgagcatgggagagacgttggaaaactgttatggcgcgccaagcagatcgtggcatctgaagggtttgtggtccatccggacaagcagcaggtgatgcgccggcaccagcagcaacacgttacgggcatcgtggtgaacgacaagttatctacagaccgagacacactgcgtaggtttagagccgtcctgcaccaagctgaaagacacgggcctcaagggctgcactggaacggtcaacacgatctcgtggcggccttacgcgggtacgccaattttatcgccatggctgatccagccagggccgaaccatacttacggcgcgtaaaggccttggcagcgaaacatgctagtgctccggcaacagccgccacacccgcaagagctcccttgcctgccggacatttcagacgccagagtgccgctggactcgcacctctgccgacttggtggcaacctgccagagccccagagccagtcttggagaaaacccccgagcagattgcagctgaaaagaaggctaagcgagaggcagaacgagaacggcagcgggcccaggaagagccacaacgagtggagcaagcccctcccaggaccgcagaacctgcagcagcaccccagacagcgaagccccgatccactctgagcctgctaggcctatgggttagcatcgcaatacagggaacctatgtgctgggatttctcctgagcttgcgagatgcttggcttatcgggctgatgacgggagccatctgggttgccaacatctatcagaggaaggctggctggatgcgctttttcatagccctcattgccggttctggactgtccgccgtgttacgtaaaatgtggtcctga

SEQ ID NO: 13362 - RNA, 1908 nt, unidentified
  source 1..1908: mol_type = other RNA; note = synthetic construct
atgctgacaatgactgccaactcaacaacgccagcgaagcccctgagccaaatgacccgggacgagctctacgcccacgtacggtcacagggaaaggatctgatcgttctgagggaaatgcagaggctgggttattggccacaatcgaccgatatacccgcccccgaagaggagttgttggagcgtgagaaatttctgacacagagactcttggacatgcagtcagagctggctaagatttccgatccagagaaagcactccgcctgcttcagagagagcggatggatgctgcacgcgaaagaagggagcagacccgcagagaaaagatcaaacagagatacgagaaagcgcaagccttttggcaacgccgacagaccgggattgactatattggcgaagacctgagtgccgggttagttcagcagcagagcaacgtgcagagactgcagcagtacggacttcccgagttccacgatgctgcaggtttagcttctttcctgaatatcagcttgcctgagctccggtttttgtctttccagaggaaggtgagtcgctattcccattaccagtacttctcccttaagaaaaaaaccggcggactccgtgagatcgccgctcctatgccacgaattaagagagtacagtaccgaattctggacgccctgctccagaaggtccccgtgcacgatgcggcccatggattcgtcggcggtaagagcgtgctaagcaatgccatcccccacacgggccaggcaatcgtgattaacctggacgtcaaggacttttttcctagtgtaggctggaggcgagtgaaggggatcttccgtcagcttgggtactctgaacaggcagcaacactgctcagtatgctgtgcacagagctgccagtcagccccgttaaaatcgatggccaacagtggctggttgccagggctgacagaaggctgccacagggtgcgcctacctcacctgctctgactaacttgctgtgtttcgggatggacaagcgccttcagcagctcgcccaacggcttgggttccggtataccaggtatgctgacgacttaactttctcagctgcagagcctaaagcccctgtggggaagctgttgtggcgagtgtctaaacttatgacggccgaaggctttactttgcatcccgacaagcagagagtcatgcgtgcgcaccagcgccaagaagtcacgggcatagtggtgaatcagcatccctccctgaaccgagatacattgcaccgctttcgtagtctcctgaacaagctcgaaaaacagggacctgccggactccactggaatgggaacaccgatgtgctcagagctgccgaaggattcgctagatacttaatgatggtgcaaccctctaaaggtgctgtcgcactgcagagggtccaccggttgaaaaagcaatggtccggagctccagccttcaccggcggaaacgtgtggaggaagacagcagcggacgggggcgttccactacgcaaaaatggcgcccagtggtggaaagcaagcacaactccggctccggttcaggagaagacagatctacaacgcagagaacagcggatgcaagaaaaacacgcacagctggccccagacgcatctaatgatgctgccctgccagagaataggcaggcggcccctgtgaatcatactacccaaaacgccggagctaatcaatccgttagcaagctccccccggtgatatccgcagggacaatgattgccgatttaatcgcaggcctaaccctttccattctcatgggcgtagccactccgctgctgttaaccctgctgtcgttctatgccacttttcggtttcggcggaactttaggcctctgctcctcggtgtgttgatccttcttctaatactacatgtcatgaagtga

SEQ ID NO: 13363 - RNA, 1917 nt, unidentified
  source 1..1917: mol_type = other RNA; note = synthetic construct
atgactgctaattccacatcaagcgccaaacccctgtctcagatgactagagacgaactctacgcccacgtaagcgcccaaggaaaggacctggtggtgctccgcgaaatgcagcgactaggctattggccgcagcaacaggatatccctgccccggaacaggccctactggagagggaacaggtgctgaccaaacgcctgcgtgatatgcagagtgagcttgcccagatttctgatcccgaaaaagcgctcaggatgcttcagagagaaagaatgcaggcagcgcgggaacagcgagagcagacaaagcgccagcatgcacaaaggagatttgagaaagcccacgccgtctggcagaggcgacagactgacattgattacatcggggacaacctttcagctggtctgctccagcgaacaagcgacacgcaacgcctccagagacacgggttgccagaaatccatgatgcagccgggcttgctgctttcctggggattagcctgcacgagctgagatttttgtcattccaacgacgggtatcacggtactcgcactatcagtatttttccctgaagaagaagaccggcggacttcgcgaaatagccgccccaatgccccggatcaaacgtgttcagtatcgcattctggatgctcttttgcagaaggtccccgtccatgacgctgcccacggattcgtgtacgggaaaagcgtgttgtccaacgcacagccccacacgggaaaggcagtggtgataaacttggacgttaaagatttctttcctagcgtgggatggcgcagagtgaaaggaatcttcaggcagctgggctacagcgagcaggtcgctaccctgctatctatgctgtgtacagagctccctgtgtcaccggtggatatcgatggccaaagatggttagttgctcgtgccgataggagactcccacagggggctcctacctcccctgctctgactaatctgctgtgcttcggaatggaccaacgccttcagaagctggcacaacggttaggttttcagtatagtcgttacgccgacgacctgacattttccgctgcggaccccaaagcccctgtgggtaaactgctgtggcgggtccagcaaaggatgacagctgaagggttcacgctccatcctgaaaagcagcgagtcatgcgtgctcaccagcgccaagaagtcaccggcatagtggttaatcagcaccccgccctcaaccgggagacattgcatcggttccgggctctgctgaataaactcgagaagcatggcccagccggactgcactggaacgggaatagcgacgtacttagagcggcagaggggtttgcacgatacctgatgatggtccaacccagcaagggcgcaccagccctacagaggatccataggatgaagcagcaatggggagccgctgctgcaggaactgccaatgtcttgtggaggaagattgccgcggatggcggtgtacctccacggtcagagggtcaggcgtggtggagtgcagccttaccacctgagccggttcctgagctgactgacctgcagagaagggagcaaagacgccaacccgctggcaccgaaaaaatttctgagcccgtgtctcagtcccggtcaggcaccgactacgatgccggttctccagacgcagcccctgcacaggtgtttccagagaacgctgagcagacctctatgaacttgagtaagctcccaccaagtgtgtccgcgggcactatgctcaccgatttgattgccggcctggttctgtcgatccttttaaagggcgccctgcccctcatgatgagtctcctcagcttatatgcctccttcaggtggaagcgctccttccggcccctattggcactggcatttgtgctgctttggctctggcatttatctaggtga

SEQ ID NO: 13364 - RNA, 1821 nt, unidentified
  source 1..1821: mol_type = other RNA; note = synthetic construct
atgactgtccgtccaggatcgctcacccgccagcagctgtatgacagaattagggagtccagcaaagatgaggtggtgctcgaggaaatgattcgcctgggctattggcccgatggtgtcgaccagcctaatctgccggacgaccttatccgaagacgcggcgagattactagagaaatctcagatctgcatcgccgtgaagctctctggcgcgatcctgaagctgccctcaaggccatgcacaaacgaagaaaaaaggcggccctagtgcgaagagccgaaacgcggttaaggggcgcaagggaccggcatgagagagccttagcctggcacgagcggagaaagactgagatactctatttgggggaaggcgtgagtgccggactgtctgcccaagaggcagcacccgtgtctcctgctaacgggttaccacccttagctagcccagccgcattagcacgggcgatcggcattagcctgggtgaattgcgattcctggcctacgaccgggccctgacatcagtatcccattatcagcggttcacgattcccaagaagacaggaggcgtccgggcaatatctgctcccatgccgagacttaaacgcgcgcagtactgggtacttgacgtggtcctggctcaagtgcccgtgcatgaagccgcgcacggctttgtcccaggcaggagtatcctgaccaatgccgcagcccatgttgggagggacgtcgtggtaaacctcgatttgaaagatttttttccctctctggactaccgccgcattaagggtaagttcaggggcctcggctatgctgagccagtcgccacagtgctcgcgctgctgtgtaccgagcccgacgttgacgccgtcgaaatagatggtcagcagctctacgccgcccgtggacctcgaagactaccgcagggtgctccaacatcccccgcactgacaaacctcgtatgcacacggctcgatgcccgcctttcaggactggccaggagcctgggatttgcctacactcggtacgccgacgatatgaccttctccgccagtggcgaagccgctgccaaagtggggccgttgctgaagtacgtacacgagatcgttgcgaaggaagggtttaccgtccaccccgacaaaactagagtcatgcgtcggggaagacaccaggaggtgaccggactgaccgtgaatgagcgggtggctgttccccgggagacgcttaggagatttagggccctcctgcacggcatcgagcgacatggccccatcggaaggcgttggggtcgatccgcagatggggctgtgctaggggctgccttggggttcgcacgcttcgtgcgcatggtcactccggaagtggggacccctctagttgcccgagcaagaagcctggctgagaggcacgggacacaacccgaacaagctcgccccagggtagcagccttccgtgaacggtcagcgcaaggcgtcccacctcgagagggtggatgggtgccagctgagcctccagtgcctcatcctgatccattgctggttcaggctgaggctgctcaagcagaggcggctaggagggccgaaggagctgcagataggagagtggtgcctcctattggtaggcagcccccagcacctcaacctgtgagcggccaggcaaccgacgatgcagacgcagctggcatgcggccatggatggttgttgtgggcgtcttcgttctgttccaggcagcggccttgttgcacccaggactggggctgtttgtgcttgctgccgcccttactatcggacttagaagatggctgcgccggagacgcgggaagtga

SEQ ID NO: 13365 - RNA, 1809 nt, unidentified
  source 1..1809: mol_type = other RNA; note = synthetic construct
atgagtgtccaaccaggcagcttaaccagacagcagctctacgatcgcattcgggagtcctccaaagacgaggtcgtgctggaggaaatgattcgcctggggtactggcccgctggaaaagatcagcccaatctcccggaggaagtgattaggcgacggggcgaactagcccgggagttaacagagctccatagatctgctgctctctggacaaacccggatgcagctctcaaagccatgcacaagaggcggaagaaagcggccctggaacgccggagggaaaccaagctgaacggagcccgaggccgacacgaaagagccctcgcatggcatggccgccgtaatcgggaaatcctctacctgggcgaaggcgtatctgctggtctgtcgggcggtgatgctggcgcatctagagccgacgggctgccagagttggccagtccaggtgctgttgctgaggctatggggatcggcctgggcgaactgagatttcttgcctatgatagggcactggctaccgtgtcccattaccagaggttcaccatccccaagaagactggcggtcttcgcgccatctcagcccccatgcccagactaaagcgggcccagtactggatcctggacgcggtccttgctcacgctggaatccatgacgccgcccacggtttcgttcccggtaggagcattcttaccaacgccgcactgcacgtcggcagagacgttgttgtaaacctggacctcaaggacttctttccgaccctcgactaccgcaggatcaaaggcaagttccgcggattggggtatgccgagccagtagcaacagtcctcgccttgctgtgtacagagcctgacgttgatgaggtggagatcgacggacagcggttgtatgccgcaagagggccaaggcgacttccacaaggagcaccgacgtcccccgccctaaccaatctcgtatgcactcggctggacgcacgcttgactgggcttgccgccagcctaggcttcacctatacacggtatgccgatgatatgacgttttcagccagtggcgaggccgcgggtaaaactggggctctcctgaagtacgtgcacgagattgtcgctggagagggcttcacggtgcaccccgacaagactcgagtgatgcgcagggggaggcaccaagaggtgacaggactcaccgtgaatgagagggttgcagtgcccagagagactctgcggagattcagggctctgctgcacggcatcgaaggtcatggacctgctggccggcgatggggtagaagcgaaggacaggccgtgttaggagctgctctggggtttgccaggttcgtgcgaatggtgacaccagaagctggggctcctcttgtggcgcaggcacgtagactggccgagactcatggagcaccccagcagagtgctcaacctcgcattaccccctttcgcgcacaaagcgccagaggggttccccctcgagaaggctggtggtcacctgcggaacgccctcctcctcagccagaccctatactgttagaggcggaacggcccgcgatttctgcaccagggagaagcgggctgccttccataggacgtcgcccagcgcctcctccagatcagccaaggccaggatctccccctgggggtgatatcgaagaggatacaccattgaaaccctggatggcagtgttaggcgtctttgtcctgtttcaggccggagccattgtccatccggtgatcgggctgctggtacttgcagcagccttggtgatagccataaggcgttggttgagacgtaggcgtcggcggtga

SEQ ID NO: 13366 - RNA, 1821 nt, unidentified
  source 1..1821: mol_type = other RNA; note = synthetic construct
atgtcagcacagcccgggagcttgaccaggcagcagctctacgacagaattcgcgagagctcgaaggatgaggttgtgctggaagagatgatccggctgggatattggcctgagggcgccgatcagccaaacttacccgaggatttgattcgacgcagaggcgaaatcagtcgggccatcaccgatcttcataggcgcgaggccctgtggaggaatccagatgccgccctcaaggagatgcacagacggcgcaaaaaagcagctctcaaaagacgcagggaaaccaaattgcgtaatgcccagggacggcacgaacgagccctagcatggcacgccaggagggacgacgagctgctgtatttgggagaaggggtgagtgccggcttgtctcgaccggctcatcccgcacgcgaaccaacgccaggtcttccggcactggcgtctcctaaggtgctggctcaggcaatgggaatcagtctgaacgagctgagattcctcgcttacgatcgtgcactcgccacagtgagccactatcagaggtttactatcccaaagaaagccgggggcctccgtactatctctgcgccaatgccccgccttaagcgggctcagtattgggtgctagacgccctattagcgcgcgcccccgttcatgaagccgcacatggtttcgtgcccggtcggtcgatagtaaccaatgctggcgcccatgtcgggagagacgtggtcgttaacctcgaccttaaggatttctttccttcactcgactaccgtcggattaaggggaagttcagagggctaggctatgccgaaccggtggccacagtccttgcgctcatctgcacagagcccgacgtagacgctgtggagatagatggtcagaccctgtacgcagccagagggcctaggagactccctcaaggcgcccctacttctcccgcattgactaacctggtctgtacccggctggacgcccgattatccggactcgcgaggagcctggggtttacttacacccgctacgccgatgacctgacattctccgcctccggagaggcatccggtaaggtgggagcccttctgaaatacgttcacgagattgtggctgcggagggatttaccgttcatcctgacaaaacaagggtcatgaggcggggtcgtcatcaggaggtgacgggactgacagtgaacgagagagtcgccgtaccccgcgaaacgttacgccggtttcgcgccttactgcacggcctggaaagacacggccctacaggcaggaggtggggaggatcaggggagaatggcgtgttgcgagccgctctgggcttcgctcactttgttaggatggtgaccccagacgctggtgctcctctcgttgcccgggcacaagcccttgccgaacctaatggcgtgcaagttcctgcagcccgccccagaatgagcgagttcagagccagagctgcgaggggggtagagccacttcctcggtggtgggagtctgccgctcgacctgtgccagaacccgatcccattctggcgcaagctgcagctgaagctgccgctccagcaagacgagcaactccatccgggcggagtttcgtgccagtgattggccgctccagcgctcccagctcagtagacccggcaccagcaccccaagtggatccggaagccgcgcctatgaagccctggatggtggcactgggggtattcgtcctgtttcaggctggcgtcgtcatccacccagtcataggaatcctggtcctggctgctgctctcctgattggccttcgtcggtggttgaggagacggcgagatcagtga

SEQ ID NO: 13367 - RNA, 1899 nt, unidentified
  source 1..1899: mol_type = other RNA; note = synthetic construct
atgtctcagcagccaggcagtctaaccagacagcagctgtatgatcgaattcgggagtcatctaaggacgaggtgattctggaagagatgatcaggcttgggttctggccagacggagaggcccaacccaatcctcccgacgacctgatccgtcgaaggggcgaaattgcacgggccttagcggatctgcatcggcgcgaagcagcctggagagatccggaggccgcccttaaggagatgcatcggcgccggaaaactgccgccctggagagaaggcgcgaaacccgtctcagaaacgctcgcgatcgccatgctcgagcacaggcctggcacgcacggagagaagccgagattctgcacctaggtgatggggtaagcgccggcctgagcgctggtcttgcacatgccgcccctgatgccggaacgccagctagagggccagcaccaggcttacccccccttgctagcccgaaagccctcgcagaggccatgggaatcggcctgggggagctacgcttcctggcctacgacagggccctatcaacggtgtcacactacaggcgctttacaataccgaagaaagcggggggactccgtagaatcagcgccccaatgcctcgcttgaagcgcgctcagtactggattctggacgcccttctcgctcatgcaccggtgcatcccgccgcacacggtttcgtgcctggcagatccattgtgactaacgcggctgcgcacgttggcagagatgtggtcgtaaatctggacctgaaagacttttttcccagtttggactatagacggataaagggcaaattccggggactcggatacgctgaaccggtcgctaccgtgttagcgctcctgtgtacagaacccgacgtagacgcggtggagatcgacggggctcgtctatatgctgcccggggaccacgtcgattacctcagggggctcccacaagtcctgcgctcaccaacttggtctgcactcgcctggacgcaaggctctccggcttggcaggctccctgggatttacatatacgcggtacgccgacgacttgactttctcggccagcggggaggctgctggtaaagttggggccctcctcaagtacgttcacgctatcgttgccggcgaggggttcacagtgcacccggataagacccgggtcatgaggcgcggaaggcaccaagaagtgacaggcctgactgttaatgaacgggtgggtgtgccccgagagactctccgacgatttagagccctgctccacggactggagcgccatggtccagtcggtcgtaggtggggagccgcaggtgaagcgggagtcttacgggccgcagtcgggtttgcccagttcgtgcgcatggtcacccccgagacaggagctcctcttctggcaagggcacgcgctctcgcggatcgacatgcagatcgcccatctgccaggccaggtgccagaccactgccagattttagagccaggtccgcccggggtgaagtgcctttggctaggtggtgggcacctgctcctcgacctgctcctgagcccgatcccatcctggccgaggctgaagcagcagctgcgagagaggccgaggaggctgcagctagagctgcagctagggccgcagcacccgtaccaggaagatctggggtgcccgtatccggcagacctcgtttgggcgcgccagaacctaccgctagggcagaagttgcccccgataccggagcggaacccgacgatgcccccatgaagccttggaaggtgatcctgggcatattcgttctgttccaagccgctgccctcttgcatccagcccttgggttgctggtgcttgccgtcgccctgttactgggcctgcgaagactgcttcggcggtggaggaggcggaggtga

SEQ ID NO: 13368 - RNA, 1815 nt, unidentified
  source 1..1815: mol_type = other RNA; note = synthetic construct
atgtcgcctcagcccggatcactgacgcgccaacagctgtacgacaggatccgcgagagcagcaaagacgaagtcatcctggaagaaatgatccggctcgggttctggccggatggagcagagcagcccaatccgcccgaggacctgatccggagaagaggcgaaatcgcacgggctctggcagatctgcaccgcagggaggctgcttggagggatcccgaggctgccctgaaagagatgcaccgccggcgtaagaccgctgccttggaacgccggagggagacaaaactgcgcaatgctagagatcgccatgcccgtgcacaggcatggcacgcacgaagagaagctgaaattctgcaccttgggggaggcgtcagtgctgggttggccaatgctgatgccccagccaggggtccagcacctggacttcctgccctggccagcccaaaagcccttgccgaggccatggggattgggttgggagagctgcgcttcctcgcatacgacagagctctctctgctgtctcacactacagatgctttactattcccaagaaggctggcgggctaaggcgcattagcgctccgatgcccagactcaaacgagcgcagtactggattctggacgccctcttggcccacgtcccagtgcatggagccgcacatggcttcgtccctggcaggtccatagtaactaacgccgccgcgcacgttggacgggatgtagtcgtgaacctcgacctgaaagacttctttccatctttggactatcggcggatcaaggggaagttcagggggctgggttatgcagagcccgtggccacggtgttggcgcttctttgcactgagcccgacgttgacgccgttgagatcgacggagctaggctctatgccgctaggggtccccgtcggttaccccaaggagctccaacttcccccgccctgactaacttagtatgtaccagacttgacgcaaggcttacaggcttggccgcgtccctcgggtttacatacacgcgctatgcggatgatctgacattctccgccagtggcgctgccgcaggaaaagtgggtgccctgctgaagtacgtgcacgccatagtggccggcgagggtttcaccgtgcatccggacaagacccgtgtgatgcgtcgcgggagacaccaggaagtgaccggcctgaccgtgaacgagagagtaggcgtgccacgcgagactctgaggagattccgggctctgctccatggcctggatcggcatggacctgccggtaggagatggggagctgcaggggaaggagatgttctcagagccgcggtgggatttgcccagtttgtgcgaatggttacccctgagacaggcgccccattagtcgcccaagcaagggccctagccgataggcatggcttgcggcctgcagtgcgacctcagcctgactttcgtgcccgatctgctcggggggcaatgccattagcgcgatggtgggcacctgctccacgacctgctccagaacctgaccccatactcgccgaggcagaagcagctgcagctccagtgcccggtcgaagtggcgttcctgcatctggccggcctcgcttcggtacacccgaacctgttgccccagcgcaagctgcgccaggtaccgttgccgaagccgatgatgcgcccatgaagccctggaaggtggtcttaggggtgtttgtgctttttcaggccggcgctctacttcacccggcactaggcctcctggtcctcgtcgtggcgctggtactgggcctgaggagattgctgcgcaggtggcggagacgaagatga

SEQ ID NO: 13369 - RNA, 1806 nt, unidentified
  source 1..1806: mol_type = other RNA; note = synthetic construct
atgtccgctcagccgggaagcctgaccagacaacagctctacgatcggattcgcgaatcatcaaaggatgaggtggtgctggaagaaatgatccggttgggctattggcccgatggggcagaccagccaaatctgagcgacgatctcatcaggcgccgaggagagataacccgagctctcggggacctccataggcgtgaagcactgtggagggaccccgacgctgctctcaaggagatgcaccggcgccgcaagaaagccgctctggagagacggcgggaaactaagctatgcaatgcccgagataggcacgccagagcgctcgcttggcatgcaaggcgagatgacgagctgttgtatctcggagaggacgtgagcgccggactgagtgcagcagccgaaggtcgggagcctttggccggactgcctgtgctggcggatcccaaagccgtggcccaagcgatggggatctccatggccgagctgcggtttctcgcctacgaccgagctcttgccactgtcagccattacaggcgtttcaccatccctaagaaaaccggcggtctgcgcacgatatcggcgcctatgcctcggctgaagagagctcagtactgggtgctggacgcagtgttgacacacgctcccactcatgaggccgctcatggattcgtccccggcaggtccatcgtcactaacgcttctgcacacgtcggccaggacgtggtcgtgaacctggaccttaaagactttttcccgtctcttgactacagacgcatcaaggggaagttccgcgggctgggatatgcagagcctgttgcgaccgtgctggcgttaatttgcaccgagccggacgtggatgcagtggagctggatgggcagtctctttacgccgcaagaggtccacgcagactaccccaaggagcaccgtcctcccctgcgttaactaaccttatctgtaccagactagacgcacgtctgagcggtctgggcaggaatttaggcttcacatatacacggtatgccgatgacctaacattttcagcaagtggcgctgccgccgccaaagttggagctcttctggcccacgtccacgagattgtagccgccgaggggttcacagtgcaccctgacaaaacgcgtgtaatgcggagagggcggcaccaggaagtaaccggcttgactgtcaacgagagggtaggcgtcccaagggagactttgcgccgcttcagagccctccttcacggcttagagcggcatggacccgctggtagagcttggggaagaagcggggaagatggggtactccgagccgccttagggtttgcccgctttgttagaatggtgacacctgaggttggcgctcctctcgtcgctcgagccaaagccttggccgaacgtgatggtgtgcccgcgactgcaataaggcccagggtgtcaccattcagggagagggcagcaagaggggttgcaccacttcccaattggtgggaacctgcagcaaggccagctcccgaaccagatcccatcctggccgaagctgccgcacgtctcgcttctggcgctccaacaggccgcagtggagtccctgccattggccgaacaacggccgctcccgctaacgaacctgttccggccccaaaggacgatcccgatgccgctccaatgaaaccatggatggtcgtggtgggactgtttgtgttgttcaatgccggtgccgtgattcatccagctctgggctttaccaccctcgcggtggccctggttattggcctggttagatggctgaagcggaggcgcacccggtga

SEQ ID NO: 13370 - RNA, 1842 nt, unidentified
  source 1..1842: mol_type = other RNA; note = synthetic construct
atgacgctccgccctggaagcctgactagacagcagctgtatgatagaatccgggaggggagcaaggacgaggtcgtcctggaggagatgatccggttgggctactggccagatggcgcggaacaacccaaccccccagctgaactgattcggcgacggggggagataagtcgggccatcgccgacctgcacagaagggaagccctctggagagatcccgacgccgctctaaaagagatgcaccgccgacggaaaaaggccgcccttgagcggaggagagagacaaagctccgtggtgcacgaggccgccacgaaagagcccttgcatggcatgcgcggagggacgctgagattctgcatctgggagagggcgtctccgctggactgtctggcaccgacgctgatcctagagccctcaaagccggacttcccgccctagccaatcccaaggcggttgccgaagctatgggcatctcgctgggggagctgcgcttcttagcctacgacaggcccctctccaccgtgagccactatcgacggttcactatacccaagaagacaggcggcgaacgcactatttccgcgcccatgcccagactcaaaagggcacagtattgggtgttagacgccctgctggccagggctcctcttcacgaggctgcccacgggtttgtccctggacggtccattgtaacaaacgccgcagctcacgtgggacgcgatgttgtggtgaatttggaccttaaagacttttttccgaccttagactaccgcagaattaagggaaagtttcgtggcctgggctatgccgagcctgtggcaacagttctagctctgatctgtaccgaacctgatgtggacgcggtggagattgacggacagagactgtacgccgccaggggtccacgtagactccctcaaggtgcccccactagccctgccctgaccaatctcgtgtgcacaaggctggatgccaggctggcaggattggcagcatctctggggttcgcatatacccgctacgcagacgacctgactttctcagcctctggcgaggctgcagggaaggtaggtccgctcctgaagtacgtacacgccatcgtagccgccgaagggtttactgtgcatcccgataaaaccagggtgatgcgtcggggcaggcatcaggaggtaaccggccttaccgtgaacgaacgtgtcgcagtgccgcgcgagacgttacggcgtttccgagctctgctacatgggatcgaaagacatggtcccgcgggtaggaggtggggtaaagggggtgatggcacagtgttgcaggccgcgcttggctttgccagattcgttcgaatggtgacgcccgaggctggggcaccacttgttgctcaggtgagggccctcgctgaaagacatggagccagacaggctcctgctcaaccacggatcgctacattcagagcccgctcagcagacggtgttgctccactggcccgttggtggattccagcagccaggcctctcccggcacctgatcctatcatagccgaggcggaagcagctgaggcagaagctcgccggaaacgccaggatggacctggtcgagtccctggtcggagtggactacccgccgttggactcagaccagctccagcaccagaaccggctaggcaggctgatcccgtccaaggggatcgcgacggaactccaatgaagccatggatggcagtgctcggggtcttcgtgctgtttcaggccgcagcggtcttgcacccaggattggggctgttagtcttggtggcagctctggcgatcgggcttagacgctggttgcgaaggaggcgaggccggtga

SEQ ID NO: 13371 - RNA, 1806 nt, unidentified
  source 1..1806: mol_type = other RNA; note = synthetic construct
atgtctgcccagcccggaagccttacacggcagcagctgtacgatcgaatccgggagacttccaaagacgaagtcatcctcgaagagatggtgcgcctcggtttctggccagatggggccgaacggcccaatctcccagatgctctgattaggaggaggggggagatagtacggaccctgggcgaactacacctgagagaggccctctggtctgaccctgatgccgccttgaaggagatgcataggcggcgtaagaaggcagcgctcgaacgtaggcgggagacgaagctgcgaaatgctcgcggcagacacgagagggctcttgcttggcacgctcgcagagacgaggatctgtttcacctgggggagggcgtgtcagctgggctatcagcacctgatgcggcagggcacgctccagctccaggattaccagccctcgctagtcccaaagctctggccgacgcgatgggcatcggaatgggggagctgaggttcctggcatacgaccgcgccctgacagcggtgtcccattaccgacgctttactattccaaaaaaagccggcggagagcgactgatctccgcacctatgcctcggcttaagcgcgcgcagtattgggtgcttgacgctctcctggcacatgcccccgtgcatgaagccgcccaagggtttgtgcccggaaggagcatcttaaccaacgctcgagcgcacgttggacgggacgtagttgtgaacctggacctcaaagactttttccccacacttgactacaggcgggtgaagggaaagtttcgcgggctagggtatgcggaacctgtggcaaccgtgctggcgctgttatgcaccgaacccgacgttgatgcagtggaaatagatggccagcgcttgtatgccgcacgtggccctagaagactgccgcagggcgctcctacttctccagccttaacaaacctaatctgtacccgattggaccagagattgtcgggcctggggcggagccttggctttacttacaccagatacgcagatgatctgacattctctgccagtggcgaagccgctggtagggtgggacctctgttgaagtatgtcggtgagatcgtggcctccgaaggcttcacggtacatccagataaaacccgggttatgcgacgggggcgccatcaagaagtgacggggctgaccgttaatgagcaggtggccgtccccagggagacattaagaaggtttagagccctgctccacgccctcgaaaggcatggccccacaggtcgtagatggggaaggtctgccgatgccggcgtgcctagagctgctctcggcttcgcccggtttgtcgccatgatcaccccagaggcaggtgccccattggttgcgcaggcacgaaggctggctgagagacaccgtgccggagcagctatggcaaggccggtcatccccgtcttcagatcccgagccgcacaaggagctgcaccatgggaaccgtggtggaggcctgcaaaaccgcaggcccccactcctgaccccattctgatagaggcagaggccgaggccgccgctctaagagaaactgagggtgaccgcccacgccggagaacttcagctcggagttggttgccaagcattgggcgcagcaccgacacagctcttgccggtactggccgcgctcctatgaagccctggatgattgccctcggcgttttcgtactggtacaagcagccaccgtcattcaccccgccctgggaggtcttgtcttgattgctgcacttggagtggtcctctggagatggttccgtcggcgctga

SEQ ID NO: 13372 - RNA, 1836 nt, unidentified
  source 1..1836: mol_type = other RNA; note = synthetic construct
atgagcacccagccaggatccttgacccgccagcagctgtacgacaggattcgcgagagcagtaaggacgaagtaatcctggaagaaatgattaggctcgggttctggcctgatggcgcagatcgccccaacgtgccagctgatctgattcgccgcagaggggaaatctccagagagctcgcggaccttcatcgccgcgaagctctgtggagagatcctgaggcggcgttgaaggagatgcatcgacgtcgcaagaaggccgcactcgagcgaaggagggaaactaagttacggaacgccaggaccaggcatgaacgtgccctggcatggcatgccaggaggaacgaggacgtgctgcacctcggtgagggtgtttctgctggcctgctggcccctgacgagacaggtagagaacccggacccggccttcccagacttgcaaatccgaaggccctggcccaggcaatgggcatacccatgggggagctgcggtttctggcttacgacagggctttggccacagtgtcccactatcggcggttcaccatccctaaaaagacgggcggtactcggctgatttccgcaccaatgccgaggctgaagagagcccagtactgggtgcttgatgcgttgctagcccacgcccctgtgcacgaatctgctcacgggtttgtgcccgggcggtcaatcgttacaaacgcctctgctcacgtcggccgtgacgtggtagtgaatctggatctgaaagacttcttccctactctggactatcggcgggttaaaggaaaattccgaggccttggctatgccgaacccgtggcgacagtgcttgccctcctgtgtacggaacctgataccgacgatatcgagatcgacgggcagagactgcatgccgctagaggccctcgaaggttgcctcaaggtgcaccgacctcaccagcgctaacgaatcttatatgcatccgtctcgaccggcggctaactggtttggcccggaatctcggatttacatacactcgatatgccgacgacctgaccttttcggccagtgggacagcggcagaaaaagttgggccactgttaaaatacgtcggtgaaattgtagcggccgagggtttcaccgtgcaccccgataagactcgtgtcatgagacgggggcggcatcaggaagtcaccggactcactgtcaacgaaagagtggccgtgccacgcgagacactcagaaggttccgcgccctgttacacgccctcgatcgcaatggaccagccggcagaagttggggacgctctgccgatcacgctgtgctcagggccgcattgggcttcgcccattttgtacggatggttaccccagaggcaggggctcccttagtggcacaaacccgcagactggcagagaggcatggcgtcggcgtaggcgaggctagacctcgaatcccaagctttcgacagaggtcagctgagggagccgttccgcttgcacgctggtggagtcctgctgagcctagcgcacctaggcccgacccaatcctggcagaggctgaggctgaagccgcaaaagctgctgagcacgcacgtaggcccgctgctccaggaagatccggcctaccaagcataggcagagctgggccatctggagcagcccgacccttaggagatcccgagccccctagcggatcaggagctgatggcggcacaatgaagccgtggatggtggtgctcggggtcttcgttctgtttcaagctggggccgtggtccaccccgtgattggtctgctggttttggtcgccgccgtcgtgattggactcagacgctggtttcggcggcgaaggtga

SEQ ID NO: 13373 - RNA, 1797 nt, unidentified
  source 1..1797: mol_type = other RNA; note = synthetic construct
atgaccgcgcaaccaggggccttgacacgtcagcagctgtacgacagaattcgggagacgtccaaggatgaggtcatccttgaggagatgatccgcttgggcttctggccccaaggcgagactcagccatctcctcccgaagagctcattcgacggcggggcgaaatagcccgggaactggcagcgctccatacggcagaagccaggtggcgtgatccagaagcagcactcaaagaaatgcacaagcgcagaaagaaggccgccctagagcggcgcaaagaaaccaaacgcaggggggctgaacagagacatgccagagcattagcctggcacgagcgccgagccgaggagttagtttttctgggagacggggtgtccgctggattacgcgccgatgcagctgcacctccagctcctaggccagggcttcccgtccttgccacccctaaagcgctcgctgacgctatcggtatccccttggccgagctgaggttcctcgcctatgaccgcgcactgagtagaatcagccactactggcggtttacaatcccgaagaaggcagggggagtacggctcatcagcgcaccaatgccccgactgaagagagcccagtattggattctggacaacctgctcgcacacgccccagtgcatgatgcggcccatggctttgttcccgggcggagtatcgttacaaatgcggctgcccacgtaggacgggcagtagtcgtcaacttggatctgaaagatttcttccctactctttcattccgcagggtgaaaggaaagtttagaggactgggttacgccgaacccgtcgccacagtactggccctgctgtgcacagagccggatgttgacgaggtggaaatcgacggcgaacgactcttcgcagcaagaggaccccgacgtctaccccaaggtgctcccacttcaccgctctttaccaacctgatttgtgccagacttgatgccaggttgtccgggctggctcggtcaatgggcttcacctacaccagatatgcggatgacttgactttcagcggcgcagcggctgaaaagatcggtgccctgattggcctggtgggggagatagtggcagctgagggttttgtggttcaccctgataagacccggatcatgcggcgaggctctcggcaagaggtaaccggcctgactgtcaatgagcgtgtggccgtgcccagagacgtgcttcgcagattcagggctctcttgcatcagattgaggcgacgggccccgctggtaaaagttggggccagaccagagacgttatggccgccgcgaggggctttgcctgctttgtgagaatggtgactcctgaggctggagagccactcgtggccacagtgcgacgcttaggcgagaggcacgggttgacagggaccgctccagctcctgctgccttccgagcaaaagcagcagctggagaaccgcctctcgcccgttggtggattcctgccgctccacctgcgccagaacctgaggctgtcctaagggaacccgccccccctcaaccagccaaacctatgcgcagcgccctagacctggcttcccttagggcagacctgagggatagggctgcaccccctgctggaccagctcaagacccgggtgaacccgccatgaagccatgggttgccgtcattggggtgctggtgctgtggtcggccgcttctgccataaatccggctctgggaacaatcgtgctgatagcagctattgtcatcgccactcgctggcttattagacgttggaggcggaggagacgccggtga

SEQ ID NO: 13374 - RNA, 1821 nt, unidentified
  source 1..1821: mol_type = other RNA; note = synthetic construct
atgtcggcccaacccggagagctcaccagacagcagctgtacgataggatcagagagagcagtaaagacgaggtgatattggaggaaatgattcggcttggcttttggccccgaaacgcgaataagccagacgtacctgaagcacttatccgccggcggggcgagattgatcgcgaactcgctgcactgcacgcccaagaggcaaggtggcgtgaccctgacgcggctctgaaagagatgcataagcggagaaagaaggccgccatggagaggagaaaggagacgaagaggggacacgcccagacacgatatgagagggccgttgcttggcgggagaggagagccacagagatcttatatttgggcgaaggtgtgtctgggggccttggagggactgatccagctcggcctttgaaggcgggactccccgaaattactagcccaaaagccctcgcagatgcgatcggagtgcccctcgcagaactgcgctttctggcgtatgaccggaagctgagccgcatctcccactaccagcggttcgcaattgctaagaaaacaggcggtgtcagacagatctcagcccccatgcctagactgaaacgagcccagtactggatcctggatgcactgctagggcacgccgcagtgcatgatgccgcacatggtttcgtccggggcaggtctatcgtcaccaacgctgctcgacatgtgggccgggatgtggtcgttaatctcgatcttaaggacttttttcctacactcgacttccggcgagtgaaagggaagttccgcggactagggtatgccgagcccgttgctacagttcttgccctcatttgcacggaacctgacgtagacgagatcgagatagatggagaacgcctctttgccgcacggggtccacgcagattgcctcagggtgcccccacctccccgttgttaaccaacctgatctgcgctcgcctggatgcccgattaaccgggctggccgcctcacttggcttcgtatacactcgttacgccgacgatatgaccttctctgccagtggcgaagctgccgccaaagtgggcgccatgctgaagtttgtgaacgaaattgtggccgcggaagggttcgtggttcaccccgacaaaactagggtgatgcgacgtggagggcgacaggaggtaacaggactggtggtgaatgagagggtcgccgtgcctcgtgacgttttacgccggttccgggcattgctgcaccagatcgaagcaacagggccagcggggaaaaggtgggggaaggcacgcgacgtcatggatgcagccacgggtttcgcctgttttgtgagaatggttaccccagagattggcgaggagcttctcgctactgtcagacgcctggacgcgagacacggagctgcacgtgcaggagctgctccgtccaagtcaccacacggcgactttcgaggcaaagccgccgctggtgtcgctcctttagccagatggtggactcccgcagaacctccacccccagaaccagagccaatcctgagagaaccggaggcagcgcctgaaccagatcctccgaccagcccacaaaggccgaggagtgctctggacatcgccggactgcgcgctgaaatgagagacagggctgcatccgctcccgaacctcaacccgatgagactgagatgaaaccctgggtggctgccataggcatttttgtcttgctgaatgtcgctttcggcattcatcccctgcttggcctcatagccctggttgctaccgtagtgatggtgattagaagggctctacggcgcagaaggaggcgccgttga

SEQ ID NO: 13375 - RNA, 1833 nt, unidentified
  source 1..1833: mol_type = other RNA; note = synthetic construct
atgaccgtccaacccggaagcctgactaggcagcagctgtacgacaggataagggagtcgagcaaggatgaggtcattttagaggagatgatccggcttggcttctggcctggagacgaggcccaacccaacttgccagctgagttaattaagaggcggggcgatatccaccgggaaataagtgagctgcacaaaaaagagaggctttggtcagatcctgagactgccttgaaggaaatgcacaagcggagaaaaaaggaggccctggctcggaggaaggagacgaaattgaggaatgccagaggcaggcatgatcgcgccctagcgtggcacgaacggcgtaagagcgacgtgctctacctcggtgagggagtgagcgccggactgcattctgatggcgttgcgaagcctctaaagccgggactcccggccttagggtcaccgaaagccttggctgaggctatggggatcccccttgccgaactgagatttctggccttcgacagggcactgtccagaatttcccattatcagagattcactatcccaaagaagaccggcggtgaacgtctgatctccgcaccaatgcctcgactgaagcgtgctcagtactgggtcctcgatgcgatcttagacaaggtggctgtgcacgaagcggcccacggctttgttccaggccgaagcattttgacaaacgccggtgcacatgtagggcgcgaagtagttgtgaacctcgatctgaaagattttttcccctccctcacctttaaacgggtgaagggaaagttcagagggcttgggtaccccgagcctgtcgctaccgtactggccctgctgtgtactgaacccgacgtggacgaacttgagctcgacggggagagacttttcgcagccaaaggaccaagaaggctgccacagggtgcaccgaccagcccaatgctaacaaatctcgtgtgcattcggctggacaagagactcgccgctctcgccgcgtctcttggattcacttacactcgttacgccgacgacatgacattttcggccagtggcgaaggggccgcgaaagtgagtgccctgctcaaatatgtgggagagattgtaacggccgaagggttcacagttcaccccgacaaaacaagagtcatgcggaggggtcggcatcaagaggtcaccggcttgaccgtgaacgaacgcgtggccgtgccaagagaaacactgcgcaggtttagagcactgctgcaccagatcgggaaaaatggtcccgagggacgacactggggcaaagcacgcgatgtcttcgacgcggctctagggttctcattttttgtgagaatggtgtcacccgccattggagatccactcatcgcagaggtgcgtagcctggctgctaggcatggacatgcgcctaaagcagtccccgagcctacagccttccgagccaagtctgcacgcggcgaagcacctctggctcgatggtggatacccgctgagcgaccggcacctgaaccagaagccattcttattgaaccccctaagccagcaccccgaccagcacaggccaatgctcctcgctccgctatcggcgctgctgctggtatgcgcgctcggatgcagcaggagggaccttccggcgcatggaaccaagggtctggtcggcagacggtggaggatgggtctatcggcagtgcatttcgcaggttgccccgccgcacctataagatcctcggcatcctgatgctatttggcttggtcgcctctgtttccccacgcttagctgcactggggctgatattcctgattggctatgttatcgccgaaagaaagaaacggtga

SEQ ID NO: 13376 - RNA, 1800 nt, unidentified
  source 1..1800: mol_type = other RNA; note = synthetic construct
atgacagtcagaccaggctcactgacgaggcagcagctctatgatcggatccgggaatcctccaaagacgaggtcgtgcttgaggagatgatcagactcggcttctggcctggtgatgctgctcagcccgacttgccggcagcattaatcaagaggaggggagaaatccaccgagagatagcggatctgcacgctgaagaacggctctggcgtgaccccgagactgcattgaaggccatgcataagcgccggaagacagaggcactcgccaggagacgcgaaacgcgcttacgccacgcccaagggaggcatgacagagccctggcctggcatgctaggcgagggtctgaggtcctgttcctcggtcccgaggtgagtgcaggactacattctcacgcagccaggcggcctcttctgccaggattacccgatttggccacaccgaaagcactggccgatgctatgggcctgccgttggccgagctcaggttcttagcgtacgatagggccctcgcacggattagccactatcagcggttcacgattcccaaaaagaccggcggggaacgcctcatttctgctccaatgccgcggctcaagcgtgcccagtattgggtgctcgacgctatacttgcgaaagtgcccgtacacgaggccgctcatggcttcgttccagggcgcagcatcctgacgaatgccggagctcacgtgggtagagacgtggtagtgaacctggacctggaaaattttttccctaccctgaccttcaggcgcgttaaaggcaagttcagagggctgggatacccagagtccgtagctaccgtcttagctctgctgtgtactgaacctgacgtggatgagctggaactagatggcgaacgccttttcgccgctcgcggtcctcggagattgcctcagggtgcccccacatccccgatgcttaccaacctcgtttgcacccgcctggacagacgtctggcagctctggccgctagtctggggtttacttatacaaggtacgcggacgatatgaccttctctgcatcaggggagggagccgcgaaggtgagcgttctgctcaggggagttggcaccgtcgtagctgccgaggggtttacactacatcccgataagaccagagtgatgcgtagaggtcggcgccaggaggtgactggcctgacagttaacgaaagggtcgccgtaccccgagataccctaagaagatttcgtgcgttgcttcatcagattgatcggagcggaccagctggaaaacggtggggggttgcccgacacgtctttgacgccgcgttcgggttcgcctgctttgtgcggatggtgagtccagccactggcgaccctctggtgagcgaagtgagacgcctgtcagccagacacggcactgctcagagagcagtccctgaggcttccgcatttagagctcgcgcagctaggggtgagacaccccttgcccgttggtggtcgcctgctgaacgacccccacctacccctgagccaatccttctcgagagtcctgacccagccccatccactgtcccccaaagcgcaataggagcagcagctggcgcgcaaacagccgacagggatggggtgtggggacgaatgcccgacgacctgcctccaggaaaagccggcttaagccggattgtgtcaggcctccttactctagccgggggtctggtgctgtttgtcgccctcttgaggatctctcccccactggcgttgctgggagcccttgtgctggcaggcttgtacgcagccggcttttttcggcgacgatga

SEQ ID NO: 13377 - RNA, 1830 nt, unidentified
  source 1..1830: mol_type = other RNA; note = synthetic construct
atgacagtgcaacctggcagcctcacccggcagcagctttacgataggattcgggaatctagcaaagacgaggtggtattggaagagatgatccgactaggcttttggcctgggaatgagaagcagcctaacctgcccgccgacctcattaaaaggaggggagagatccaacgggaaatcggcgagctctaccgccaacaacgcctgtggagagatcccgagtctgccttaaaggagatgcataaacgccgaaagaaagaggcactgctgcggaggaaagagacgcgcagaagaaatgccgctgccagacatgaaagggcactcgcctggcacgaacgccggaagaccgaaatactttatctcggtgcaggggtgagtggcggacttggagctaacgaacctgagcttggacgatctccacgtgatgggctgcctgaagtcgcaacaccgaaagccttagccgacgctatgggaatccccctaggggagcttagatttctcgcgtatgatcgggccctgtcacgggtgtctcactaccagcggtttactatcccgaagaaaaccggcggtgagcgtctgatctcagccccgatgcccaggcttaagcgtgcccagtactgggtcctggataacctactggccaaggctcccctccacgaggcagcacatggctttgtccctgggagaagtatattaaccaatgccggtgttcacgtgggccgagaggtggttgtgaacctggaccttaaggactttttcccaagcctgacatttcgccgtgtgaaaggcaagttcagaggcctggggtaccccgaggctgttgccacagtgctggccctgctgtgcaccgaacctgatgttgacgagctggacctggacggtgaaaggctcttcgccgcacggggacctaggagattgccacagggcgctcccacatcgccagcactaactaacctggtgtgtattaggctggataaaaggctcactgccctggccggatcattgggcttcgcatatacaagatatgccgacgatatgaccttttccgcgtccggggagggtgctgcaaaagtggccgtcctgctcaagatggtgggggagatcgtggccgatgaggggttcaccgtacatcctgacaaaactcgggtcatgagacgaggacggcgccaggaagtgacgggattgacagttaatgagcgcgtcgctgtacccagggataccctccgccgattccgtgccctcctacacggtattgataagcagggccccgaagggaagagttggggcgtagctagggacgtgttcgacggcgccctgggatttgccttcttcgtgcggatggtcacccccgaaatcggcgaaccccttgtcgcgcaggtaagagctcttgccgctcgacacggaggtcgggacgttgcagctccagccataagcgcatttagagccaaggcggcacgcggggaagcaccattggatagatggtggcagccagcagagcgtccagccccaaagcccgagccagttttagcaggagcagcccccgcgcctgctccaaatggaattagatctgctcctggtgctgctgctggaactgggcggccaagtcccgaagctacgtccgtctggggcccaggacctgctagatctgctccggagtcaggctccccgtccgtgactggtagtctgtggcgcttgagcataggcttgctgaagctggcggccctgttgatgctcttcagcgccgggatggtgttcgcgcctaggttggctattctgggcgtgttcgccctcattggcgtcttagcgtaccgctttatcaggcgagggtga

SEQ ID NO: 13378 - RNA, 1788 nt, unidentified
  source 1..1788: mol_type = other RNA; note = synthetic construct
atgaccgaacccggaactcttacccgacagcagttgtacgaccggattcgcgaatcgtcaaaggacgaggttatccttgaggagatgattcgactcgggttttggcccccgggtgccgatcaaccggatgtaccagccgacttaattcgtagaagagcagatctgcagagagaaatcgccgatctacatagacaggaggccctttggagggaccctgaggctgccttgaaggaaatgcacaagcggaggaagaaagcggccctccagagacgcgcagaaaccaagttgcggaacgccaaaggacgccacgaacgagccctggcttggcacgagcggaggcaacaggagctgctttatctaggagacggcgtctccacagggttgcatcagaccggaacggccatggctccaaaggcaggactgccttccatagcttctcctaaagccctggctgaggcgattggagtttctctcagcgagctcagatttctggcctacgaccgcgcagtaactagggtaagtcactatcagcgattcacgatacccaaaaaggccggcggagagaggctgatatcagcgcccatgccccgccttaagcgagcacagtactgggttctggacaacctgttagcaaaggccgtggtgcatgatgcagcacatggcttcgtgccagggcggtccatcctgaccaatgcaaccccccacgttgggcgcgatgtggtagtgaacctcgacctgaaagactttttcccgacccttacattccgcagggtgaagggcaagttccggggactcggttacagcgaagccgtcgccacggttcttgctctcatctgtaccgagccagacgtggacgaactcgaagtggacggcgagagactgtttgccacacggggaccaaggagggtccctcaaggtgcccctacgtcacccgtcctaactaatgtgatctgctttaagctggatgcgcggctgagtgggttagctcgcgcgttaggatttacctatacacggtacgcagacgatatgactttcagcgccagcggcgaagctgccaaaaaagtgggggccctgcttaagtatgtgagagagattgtgaccgccgagggtttcgtggtgcaccccgacaagacacgcgtcatgcgccgtggtgcacaccaggaggtcactgggttgaccgtcaatgagagggtggccgttcctagggatacactccgcagatttcgggccctgctgcaccagattgagacaagcggccccgtgggtaaaacttggggcgctgctcgggatgtcctggatgctgctctcggcttcgcgtttttcgtgcgtatggtgaccccgtcctctggcgaggtgttggtcacccaggtcagggcattagcggctcgtcatggggctactccagttccagccgttgccccaagggactttagagtgaaagcagccaggggggaaacacccctgggtcgatggtggattcctagagagaggcctgcaccagcccctgaaccagttatcgtggcgcatgaagccgctgcacaagcagctgccgcaccaggtacatctcgggccacaagtgctggacaagcacagctaccccccgccttcacacctgctcctgctgctcctgccgctaaacgaggcgggaccctcgcaactatcggcaaatggatcttggggctgctggtctttatcgtactcatgggcatacaccccgtactgggcggactgttcatcgctgcggtggtcggctacatggctactcgtaagagagggggcagagattga

SEQ ID NO: 13379 - RNA, 1572 nt, unidentified
  source 1..1572: mol_type = other RNA; note = synthetic construct
atgacggaaactgtttcgcccggtactatgacaaggcaggaactgtacgacagaatacggcagtcaagcagagatgaagtgatactcgaggaaatgatccgtttaggcttctggcctgatgaaggagcacctgctcccgccgcagagacgattcgagagcgggcagaagccatgagagagctcagcgagctgcagagacagaatgccacactggccgaccctgttcgcgcgctaaaggaaatgcacaagcggcggaaagccgaggcgatggctagacgacaagaaacaaaacgacgtaatgcggaggctcggcagacccgtgctttcgcatggttcgagaggcgaaagcgcgacgtactctacttaggggaggatgtctcccccggtctacacagccgcaccacgaccatcccacttcacgacgggctgcccccattggctgacgctaaggcgctcgctgacgccataggagtcccgctcggagagttgaggtttctcgcttttaaccggaaggtggcgagtgtgaatcattatcagagatttaccatccccaagaaaagtggaggcgagcgcctgatttctgcaccgatgcctagactgaaaagggcccagtactgggtgttggacaacatcctggccagagtacccctgcacgatgccgcccacggttttgctccacaaaggtcaattctgacaaacgcccggaatcatgtgggtagggacgtagtgattaatctggatttaaaggacttcttccccaccctgacatacgcacgcgttaagggccttttcgaagccctggggtatgctgaggcggtcgctattcctcttgctctgttgtgtacagaacctgtggtggatgaggtgactctcgatggggagcgccatttcatcgccgacggacctaggctcctaccacaaggcgcaccgacctccccagccatcactaacctcatctgcagacgactggatcggagattgatgggccttgctcgcacactggggttcgtgtattctcgttacgccgacgatctgacctttagcgccagtggcgaggccgtgaagaagattgggacgctgctgaaagctgtgcacgggatcgtcgaggcagagggctttaaggtgcatccagataaaactcgcgtgatgagacggtcaaccaggcaggaggtaaccggccttactgtcaacgaggccctggccgttcccagagacttactgagacggtaccgagccgtgcttcagcaggtcgaaaggcatggaccagacggaaaacacttcggccctggcaaggatgtgattcggtcccttttgggttttggtcacttcgcggtcatggttgaccccgaatctggcactcccctcctgcagagggcacaacgcttggccgcccaatatgcacctacacgctctgaaaggctacccacccgtgcagcctttcgaaaagctgcttccgcagggcagacacctcccggaaggcagtggactccagcagagcgcccacctccagcaccagatccggttctcgtcgccctggctcggcaggaagaaaaaaccagggccgctcagtga

SEQ ID NO: 13380 - RNA, 1815 nt, unidentified
  source 1..1815: mol_type = other RNA; note = synthetic construct
atgaatgagacagtcgccccggggactctaacaagacaggagctctatgatcggattcgtcagtcttccaaggatgaagtgattctggaggaaatgattcggctgggcttctggcccgatggtgaagatgccccagcccctgcagccgacgcaatacgaggacgagccgaagccatgcgggagttaaccgagctgcagcgccagaatgccacccttgccgatcctgaaagggccctaaaggagatgcacaagagacggaaagccgaggccatggcacggagacaggagactaaacgtaggaacgcagaagctcgccaaagtagagctttcgcgtggtacgaccgccgcaaacgcgacgtgctctacctgggcgaggatgtgtctttggggctgcatacacgcacaactacaaccccactccgtgacggactgccacccttagcagatgccaaggccttagccgacgctatgggcgtccccctcggagaactgcggttcctcgccttcaaccgcaaggtcgccagcgtcaatcactaccagcggtttaccatccccaagaagtctggcggggaaagattgatctcggcgcccatgccacgactcaaacgggcacagtactgggtgctcgataacatcctggcacgcgtgccgttgcatgaagcagcgcacgggttcgctgcccagcgtagtattcttacgaacgcacgcaaccacgtcggcagagacgtcgtgatcaatttggacctgaaagacttctttcctaccctgacctatgcgagggtgaagggcctgtttgaggcccttggctatgccgaggctgtggccattcccctagccctgctgtgtacagaacccatggtggacgaggttgcactggacggggagaggcattttgtagccgatggacctaggcttctaccacaaggcgctcccacgagcccggctataactaacttgatctgccggaagctcgataggaggctggtgggactggcccgaacccttgggttcgtttactcacgatatgcggacgaccttacgttctccgggagcggcgaggcggtgagaaagatcggcactctgttgaaggccgtacacgggatagtggccgcagaggggttcacagtacaccctgataaaacaagggttatgcggaggagttcccgccaggaggttactggtctgactgtaaatgaagccgtggcggttcctagagacttgctgcggcggtacagagctgtactgcagcaagtggaacgccatggtcccgcgggaaagcactttgggcccggaaaagacgtcatcaggtcactgttgggttttggccactttgcagtgatggtggaccccgagtccggcgcacctctactgcagagggccttacggctcgcccctcagcatgcacctgcacgtagcgctcgcagacccacaagagctgcctttaggaaggctgcagctgctggacagaccccacctggaaggcagtggaccccagctgaaagaccacctccggctccagaccccgtgcttgtcgcactcgccaggcaagatgcaaaaaaacgagctgcccaagcacgagccgctgctccaagcccttcaaggcctccaaatgtgccacccccaccaccaggcgttaccagacctgatggccccccacctgcagcaagacccgctactgctccctctggaaagcgtccgtggtttgttaccgccctggtcattctgctcgccctcgctctgcttcctcttccgggtggacccgctatggcgggtgctttactcttcctgtatttctcccgatggtggaaacggtga

SEQ ID NO: 13381 - RNA, 1425 nt, unidentified
  source 1..1425: mol_type = other RNA; note = synthetic construct
atgattcggctgggcttctggccagatggcgaagatgcccccgcaccagctgcagatgtgattcgggcccgcgctgatgccatgcgagaactgacggaattgcagcgccaaaatgccatgctaggagatccccaacgtgccctgaaagaaatgcacaaacgacgaaaggcggaggctatggccagacggcaggagacaaagcggaggaacgctgaggctagacagtctagagcctttgcatggtatgaccggaggaaacgggatgtactatatcttggtgaggacgtctccaggggtcttcatgcgagaaccaccgccactctgctccgcgacggtcttccacccctggctgatgccaaggccctggctgatgctatgggcgttcctttgggagagttgagattcttagcctttaatcgaaaggtcgcaagtgtcaaccactatcagcgcttcaccatcccgaagaagagcggtggagaacgactcatttctgcccccatgccacggttaaaaagggcacagtactgggttctggagaatatcctcgcaagggttccccttcatgacgccgcccacgggttcgcacctcaacgttcgatcctgacaaacgcccgcaaccacgtggggagggatgtcgttatcaatctggacctcaaggatttcttccctactctcacgtatgcccgggtcaaggggctgttcgaggctctgggttacgcagaggctgtagccataccattggccctgctgtgtactgaaccgatggtggaccaggttgccctggacggagagagacactttatagccgacggaccaaggcttcttccacagggggcccccacttctcctgctattaccaacctgatttgcaggaaactcgacaagaggctagtcaggctcagcagagtcctcggcttcgtgtacagtagatgcgcagacgacttgacctttagtggctccggcgaggcggttaaaaagatcggcacattaatcaaagctgtgcacgggatcgtggcagcggagggattcaatgtgcatcccgacaaaaccagagtgatgcgcagatcctccagacaggaagtgacagggctgaccgtaaatgaggctgtggcggtgccccgcgatctcttagtggcactggcccgccaggacgaaaagaaacgtgctgcacatgcacgagtaaccgccccgattccctcacgggtccctaacgtgcccagcccacctgctgatgccactagggcagcgggccctcaagcagctcctgctacaggccctgccacagccccaagcaagaagcgccagccctggtttgtgactgcgctggtgatcttggtggccctcgcatttctgcctttgccgggagggccagctatagctggcgccatgctttttctgtacttttcacgttggtggcggcggtga

SEQ ID NO: 13382 - RNA, 1836 nt, unidentified
  source 1..1836: mol_type = other RNA; note = synthetic construct
atgaatcagacagttgcccccggtactctaacccggcaggagctctacgaccggattcgcgaatcctccaaggatgaggtgatccttgaggagatgatccggttgggcttttggccagacgggacagctgctccctctccagcagcagcagctatacgcgagcgcggcgaagccatgcgagaactgggcgagttgcagaggcagaacgcactgtggtccgatcctgagagagcaatcaaagaaatgcataaaaggcgtaaggccgaggccctcgcacaacggactgaaacaaggagaagacatgcacaggcccgacaggacagagctgaggcctggcacatcagacgtcaaagagaagtgctgtacttaggggaaggagtaagtgccggactgagcgccgacccaatccgacgaagtctgttgcccggtctgcccgatattgccgacgccaaggccctcgctgacggcattgggattccgttaagcgagctccgtttccttacctactctcgcaaggtgtcatctgtgagccactatcagagatttcgaattcctaagaaaaccggaggcgagaggcttatcagcgctcccatgccacgcctcaaaagggctcaatactgggtgctcgataatattcttgccagagtcggactgcacgaggccgcccatgggttcgtgcctcagagaagcatcctgacaaacgctcgcaaccatgtgggcaaggatgtggtggttaacctggaccttaaggattttttccccacactgacttacgcccgggtcaagggaatgttcagaagcctcggatatgcagagaaggctgccattcccctggcgcttctatgcactgaagctaaagtagacgaagtgcacctggacggtgaacggcacttcgtgggcgatggccgacgtttgcttccacagggtgcccccacctcacctacgatcaccaacctgatttgccgctatctggatcggcggctcgatggcctcgctaatgagctgggcttcacgtactcccgctacgccgacgatctcaccttcagcggatcaggggaggccgtcagaaaaatcgggacactgctgaaagcggttcagtcgatagtcactgccgaagggttcaccatacatccagacaagacccgcatcatgcgccggtccggacatcaagaggtgacgggcttaacagttaatgagcgggttgcagtcccacgtccactcttacggaggtatagggctgtactgcagcaggtagagaaacacggaccagctgggcgacactttggccctggcaaagacgtcgtgcggagcctcctggggtttggtcagttcgcggctatgattgatccggacaaaggtagggcactattagaacgagcaaggaggctggcctcacagtccacagccaattctaagttgagtcgcagtggaggacaagctgcctttcgggctgccgctgcagctggtagagcacctgccggatgtcactggacccctaccgaaaggactgctcccgcgttggatccggtgctagcagccctcgaacgcgaggaggcgaagaaggctgagcaggcccaaaggaaggcacacgcttctcagcaggcgatggcccagtctgcgcttaggcgtccttcagcagaacccgcagggcaagcgaggggtcaagcacaggggagttccgggcagcctgccagaaaaaaactgagatttacccctaagcggctgctgatgatcgcggccatcgtcatattcccgactttgattcccggcgttggcccatttatcgccggcctgcttctgtatttgtatctgaggtggatgtggaagcagggctga

SEQ ID NO: 13383 - RNA, 1635 nt, unidentified
  source 1..1635: mol_type = other RNA; note = synthetic construct
atgtccatcctgcctgagaacacgcagccccggactaggcaggaactgtatgatctcattagacagacttcacgggacgagttcgtgcttaatgaaatgatcaggcttgggttctggaagaagaacgaaggccagccgagcctccctgaacagctcattaggcaagagacacagctgcaccaagaattaaagacccttgtttctgagaaaaagagactcgatgaccagcagaagatgctcaaggaaatgagaaaaaagcggatgttagagagtcgtctgaaacgcgaagagacaaaaaaacggcgcgagttggagaggcaacaaaaagctgagaactggaagaataagaaaaccactgaaatcgggtacctcggagaaaatgtcagtagcggcctgaattttactgcctccaatccagagaaactgtctagatacaatatcccgttttttaccaacgcagtgtccctggcgcaagctctgaacatttccgttggagaactgagattcttagccttcagtagagaggtcagcaaggttaatcactaccaccgattccagattcctaagaagaccggagggcagaggctaatcagcgcgccaatgcctcgattaaaaaaggtgcaaacctggattctggagaacgtgctggaaaagattgagctacacacgagcgctcatgggttcgtggcatcacgcagtattgtgtcgaacgccattccccatttgaaggccgagacagtcgtgaaccttgacttgaaaaacttttttcctactctgacatacgcccgcatcaagggactgttcctgggcctggggtactctgaagccatggcaaccttgctgggtctgctctgtacggaacccgagacagacgcagttatcctggacaaggaaacatggttcgtagcctctggggaacgctttttgcctcagggatccccagcctctccagcgctgacaaatatcatctgcgccacccttgacaagcggttgcagggcctcgctcagaaactaggatttgtttacacacgatatgccgacgatcttactttttccgccaccggcgaaggcaccaagaacatccacaagataatttcactcacacagaaaatcgtcgaagatgaaggcttttcagtgcaccccgataaaaccagaatcatgaggaaaggaagcaaaaaggaggtgaccggtatcgtcgtgaacgagaaaccctcggtagataggacaactttgcgcaagttccgggctcttctgcatcagatggaaaaagaggggttcgctggtaagagctggggtcatacccccgatgtgctcgcagcagtggagggctatgctaattttgtcaagatggtggatgctgagaagggtgacaagtttaagcaacagatcaaaggcataattgcaaaatggggcgactccatacccactcctgtccgtaaggtatatcccaaaaaagagaaacagactgtcagtccagtattcgagacaatgacaatactgcctaccagcgaaacccagatctctgagaatcaggtggtgataccgcaggttacgattccagagactgccaataaggacacttcaaacgagaagccagaggagaaaaaaaccttctggaagacctggaaaaagtga

SEQ ID NO: 13384 - RNA, 1578 nt, unidentified
  source 1..1578: mol_type = other RNA; note = synthetic construct
atggccgaggagactccacctcagccacgcactcgacaggaactttacgatcaggtgcgccagagctccagagaagccgttacgcttagggaaatggctcgcatgggtttttggcctaaaggccaagggatccctcccattcctcaggctctcctcgagaagcagcaagccctgcaacaagagctgcagcccctggttgagcagagccgcaagatggaggaccgcgtgcggatgcttaaggaactgcggaaaaaacgcatggcagaatcaaggcagaagaggaaagagactaaagagcggcgtgagcgggaacgacaggccagacaagccgcctgggagcagcgtaaaacacatgagatactgtatttaggagagggtgtctctggcgggttgagtcagacggacgacgacgcccagaagctgcagcactatcagttgccgagatttgaaaatgcaaaagcactcgcggaagacatgggcatcactgtgaacgcactcaggttcctggcatataacagacctgtgtccacactgacccattaccagagattcaccatgccaaagaagactgggggccaacgcttgatttccgctccgatgccgagattgaaggatgcacaatactgggtcctccatcacctgctgcagctgctcccagtgcacgaggctgttcatgggttctgcgctgggcgatccattgtgtcgaatgctcggcctcacgtgggcaggcaggttgtcctaaacttcgatctgaaggacttttttcccacactcacgtacacacggatcaaagggctgttctgcgctctgggttatgcagaggccatagcgactcccctggcgctgctttgtaccgagccagataccgatgaagtgaccctggatggtcaaacgtattatgtagcaaatggagaacgataccttcctcagggcgctcccacctcacctgccttgaccaacctaatttgtttaaggctcgacagacgccttacaggactggccaccaaactgggcttcacttacacaaggtacgccgatgatctgacattcagcgccgacgccgaaggcatgaaacacattaataccttacgcgtcatgttgcacagaatcgtggaagaggagggctttcaggtgcaccccgacaagtcaagggtcatgcgtaagggctctaagcaggaagtaaccgggattgttgtcaatgagaaacccggtgtagacagggccaccctcagacgtttccgggctctattatttcagatcgagaaggacggaatcgcaggaaagcggtgggggacatctccagatgtagttgccgccatccatggatatgccaattttgtcgccatggtggatccggagaaaggcaaggctctccaagagagggtggctcggataattgcgacagtggcacctcactttaagaaaagaccccgaaagacctacccagcgcggagcggaaagtggcttcagacagcatctagtgaagccagcagctccgaagctagtactgactcaggaaacgtgaacgcgatcccagaaccccccgctgccaagaaaccatggtggaaattctggtga

SEQ ID NO: 13385 - RNA, 1629 nt, unidentified
  source 1..1629: mol_type = other RNA; note = synthetic construct
atggccgagcaaagcaatcttccagaaggcaccaggcctgccgaccggcaagaactgtacgacctgatcagacgaacgagcaaagacgactttattctcagggacatgaagagactaggattttggcccgacgacgccggccagcctactttacccgagcaggtcatatttcgggagactgatctgaacagggaactgagtgcacttctaaccgaaaaacgcagactcgaagaacaggaggccatgctgaaggagctgaggaagcagaggctggctgagagtcggctaaaaagagaagaaaccaagcagaaacgggaacaggcaaggaaggataaggcggccgattggcagcggaaaaaacaatctggaatcctgtacctgggtgaaggggtcagcggcggcttgaacgagacagcagctgacccaggcaaactcgccgggctgaatttacccgtgcttaccgatgctgccagcgtggctctcgctatgcaggtgcctgtgggtcagttgagatttttagcattctcgcgtcaggtgtctagaactacccactatcaaagattttatgtgccgaagaagacaggaggagagcggctgatttcagcccccatgcccaggctcaaggctgctcaggcctggatcttggctaatattttggatcgcgttccctcccacgaggcagttcacggcttcctgcccgggagatccatcgtgacgaacgctgcccctcatgtaggggcgggtgtggtgattaacctggatctgaaggacttcttcccttcaatcacctaccgcagagttaagggcgtgttccgcgccctcgggtattcagaatccgtcgcgacaatcctgggattattgtgtactgagccccaggttgatcaagccgagcttgatggggagacatggtatgtagccactggagagcgtcatcttccgcagggcagcccggcaagtcctgcaatcacaaacatactgtgcgccacacttgaccgacgactccagggcctcgcacgaaaaaggggatttagctacacacgctacgccgatgatctgaccttctctgcgtctggggagggaactaagaatatcaacattctcaagaacgccgtaaaagcaatcatcgaatccgaggacctcactctgcacccagacaagacccgcattatgaggatggggtcacgaaaagaagtcacgggcgtcgtggtgaatgataagcccggtgtagaccgcacaaccctgaggcgtttccgggctctgcttcatcagatagagttgaaaggcccacagggcaagaagtggggacactctgcagatctgctggctgctatagaaggctacgccaatttcgtgttgatggtggacgcggagaaagggaagaagctcaaagcacaggtcaaggctattgcccagaaatatggtgacgctatgccacgccggcctcggaaggtctaccccaagaaggagaaaccggccgcaccaacacctgccactgcaacggtggccgctttacccccaacccctcctcctccaccagttccagcccaaccgcccgttccaggtcctgatgccagtgctcccgagtccgcggagccaaaaaaaacctggtggaagctatggaaaaagtga

SEQ ID NO: 13386 - RNA, 1608 nt, unidentified
  source 1..1608: mol_type = other RNA; note = synthetic construct
atgagttctgacagcgagccactccggcccgcgactagacaagagctgtacgaccgcttgcgtcaagccggaacgcgggatgctttcttattggaggaaatgaaacgcctagggttttggccatcaaatcacgaagtcccaaacgtgtccgaacagtttattctgcgagaggctgatcttgcgagagagctgagagctctgtatagtgagcacagacgtctggaggatgaagccgccatgctgagagagctcaggaagcagcggttagccgagtccaggcagcgacgagaggtcaccaagctgcggcgcgagcgtgaaagaaaggaccgcgccgaccagagaaaaaaaaggcaggaaagcgagatcggctatctcggcgaaggcgtttctgggggcctaaaccatcctgaagccgatgaagcccggctcgcacggtttcatctccccgtccttaccgacgcacagtctgtggcaggctcactcggagtaagcgtgggcgaactgcgctttctggctttctccagagcagtgtccagaaccaaccactaccaacggttctacctgccaaaaaagaccggagggaggagactaataagtgcaccaatgccaagactgaaggccgcgcagtactggatcctggagaatatcctgcggctggtccccgtccatgatgcagcccacggttttgtcggaggtcggtctatagtcagtaatgctcgcccccacgtaggggcgcaagttgtgattaacctggaccttaaagatttctttcccacggtgacctaccctagggtgcgcggtgtgtttcgcaaattaggatactcggaagccgccgcaaccatactggccctactttgcacagagcccgatgtggaccaggccgagcttgacggcgagacttggttcattgctgacggggaacgacatctgccccaaggggctcctacatctcctgccctcaccaacttgctctgtaccaggctggataggcgcctcgctgggttggctgccaaacttggtttcgcttatacgcgatatgcagacgacttaacattcagcgcgagcggcgagaggactaaaaacgtgaataagttgaggtcattggtgcatctcatcgtggaaggcgaggatttccgtgttcaccccgataaaactcgggtgatgaggccaggctcccgtaaggaagttacagggataattgtgaatgacaagccgggtgtggatagaaccacacttcgaaagtttcgagccctcttgcaccagatcgaacaggagggtattgccggaaagcgctggggacacactgatgacgtgctggctgctatccagggatacgcgaggttcgtagcaatggttgacgcacagaaaggccaggtattaacagctagggttaaagccatcattgaccaaatcgaacctgctttcgccaaaaggccgcggaagacatatccgcagggcgcacgccggtggatcaagaagatggtcgtggccgagactcctactgcctcaggcgttcccgccaacccaagcgcacctacccccaatcctgagaaacctcagggaattgtctggaagctgctggggaagctggggggaaagaagaagtga

SEQ ID NO: 13387 - RNA, 1551 nt, unidentified
  source 1..1551: mol_type = other RNA; note = synthetic construct
atggcagaacaaagcaacctgccagatggagctaggcccactaccaggcaggaactctatgacttactccggcgtgatggattaaatcgcgacagctttgtcctccaagacatgaaacggctgggattttggccagacacaaaggatcagcctagtgttcccgaacaattcctgaacagggagtcccagctttaccgtgagctgaatgcattggtgactgaaaaacggcgcgttgaggatagggagcagctgctgaaggagcttcggaagcagcgcatggcagagtccagacggaaacgcgaggagactaaaaagcggcggatagaggctgcaagactccgcgcggagaactgggagaaaagaaaggaaaccgaaataaactacttgggcgaaggcgttagtggcggtctgaacgatactgccacagacactgagcgcctcgccctggcacagcttccagtcctcagcgaccctgcagccattgcagctgcgatgaatatacgagtgtcggagttacggtttctagcgttctcacgtgccgtatccaagacatctcattatagacgattcctgatccctaagaaaacaggaggcttccgacagatcagtgcgccaatgtacagactgaaggatgcccagtactggattcttcaacagatcctggataaagtgcctctgcacgaggccgctcatgggttcgtgcctgctcggtctatcgtcagcaatgccaggccccatgtgggagccggtgtagtgattaatgccgatctgcagaatttctttcctagcatcacatatcccagggtgaaaggtgtgtttaggaaacttggctattctgacgctgcagccagtaccctcgggctgctctgcactgaaccggctattgatgaagtagtgctggacggggagaattggtttgtggctgccggcgaacgttttttgccccaaggggcgcccacttctccagccattacgaacatcttgtgtagacagatggaccggcggctgcagggcttagctcagaagctcggcttcacgtatacccgatacgctgacgaccttaccttctcagcctccggcgaaggggagaagaaagttaacttgttgctcaagttcgttcgccagatcatcgagaacgaggggttcgtccttcacccagataagaccagagttatgcgaaccgggagaagaaaggaagtgacaggaattgtcgtgaacgaaaagcccggtgtggatagaaagaccctacgcaggtttcgagcattgctgcaccaactcgaaacggaaggccccgcgggtaaaacctggggacacactcccaacctgctggccgccattgaggggtatgccaattacgtctttatggtcgaccctgagaagggagccgccctaaaggcccaggtgagacaggtagccggcgctctaaccagggctcctaggaagaggtacccggcacgcaaaaagctggcaggatcagctcctctgccagaaacccccacagctgcaccgacagagcaggagtccgccaaaccatggtggaaattctggtga

SEQ ID NO: 13388 - RNA, 1404 nt, unidentified
  source 1..1404: mol_type = other RNA; note = synthetic construct
atgcctgatgagcaaccccagacccgacaggccctgtatgataggatcagggagtccagtaaatgggaagtgatactcgaggaaatgatccggtttggcttttggcccgctgagggtacccttccggatgaccctgccgacgaaattagacaaagaggcgaactggaacgggagttaaaagccctcagaacagagcaggcccggcttaagaatcaggctatgatgctcagggagatgaggagaagacgtctcgaagcaagccgccttaagcagaaggaaaatagagagaggagagaacgggaacggcaagagcgagcagcagcctggcaggaaagaaagagccgcgagatcggatacctcggcccaggagtctccggtggtttacaggctgtggagagcgacacagataggctggagtcttttggcctgcccgtcctccataccccagctcagctggcagaagctatgggcctaagagttggggctttgaggtttctcgcattcagtagggatgtgagcaggacttctcattacgtgagattcaagatgccgaagaaaactggcggggaaaggctgatttccgccttgatgccccgactgaaacaggcgcagcggtggattctagaccacctgctggtgcggcttacccctcacgatgcctctcacggattccgccacgggcggagtattgtttcaaacgcccggccacataccgggtgtgcagttgtggtcaacatggacatgaaggatttcttcccaacggttgactatcccagggtgaaaggcttttaccgcgccctcggatactctgaggccgtcagcaccgtattggctctgctgtgcaccgaggctgaaacagaggaagtggtgctggatggcataacttggtatgtcacgttaggcgagagacacctacctcaaggtgctcccacatcgcctgcgatatccaatcttatttgccgccgactggatcaacgcctgtcagggatcgcggggacactcggtctgacgtatacacgctatgccgatgacttgaccttttcagctgaagccgcagacgcccctatgatcggtaagttgctgcgtcagacccgctttgtcgtagaggccgaggggttcgagctgcatcccgctaaaactcgcgtgatgcgacggcaccagcgtcaggacgtaacaggggtcgttgtgaaccagcaacctgccgtggcgaggaagactctgaagagattccgcgcgttgctccaccagatcgagactactggcccagacggaaaacattggggcggaaacccgaacgtgctgcactcaattcagggattcgcaaattacgtatacatggtggacccagacaaaggagcagtgcttaagcagcgggttcagcgaatcttagcctcccaacgttga

SEQ ID NO: 13389 - RNA, 1404 nt, unidentified
  source 1..1404: mol_type = other RNA; note = synthetic construct
atgtcagaggaacagccacaaactcgccaggccctgtacgatcgcattagagaatctagccttggggaagtcattctgggcgaaatgatcagacacgggttctggcctgcggagaataaaataccggaggatcctccagaagaggcacagcagagaggggagctggagcgagaactaaaggccctgaggactgagcaggcccgactcaagaaccaggccgccatgctgagagagttacgcaggagacggcttcaagcctctaggttaaaacagcaggagaatcgggagcggcatgagagagagcgacaggctagagcagctgcctggcaggaaaggaaggcccgggatatcagttatctgggcagtggggtgagcggtggtctgcatggaaccgaatccccggccgcacgtctagagcagcttggtctgcccgttttccacaccccatctcagctcgctgaagccatgggtcttagggttgggaccctcagattcctggcattccatcgggacgtgagtcgcacaagccactatatacggttcaaactccctaagaagaccggaggtgagagattgatatccgcaccaatgccccgtctcaaacaggcccagcactgggtcttgtcaaaccttctggtcaagctcacctcacacgatgcctcacacgagttccgccatgcgaggtctttggtgaccaacgcgcaaccacatactggccaggctgttgtcatcaacatggacatgaaggactttttccccactgtgagttaccctagggttaaaggattttttcaggctctgggatactccgaggcagtcgggacagtcttagggctgatttgcacggaagccgagacggaggaagtggtcctggatgataccagctggtacgtggcactaggcgagcgacacttaccgcaaggcgcaccaacatctcctgccattagcaatctgatctgtcgacggctcgaccagaggctgcacggtattgctcgtaaatttggaatgatctacactcgctatgcggacgatctgacgttcagcgctgaagcagaggctcccgccgctatcggcaaactgctccggcagacacggtttgttgtggaagctgaaggatcccagttgcaccccacaaagacccgggtgatgaggcatcaccaacgccaagacgtaacagggggcgtggtaaaccaacagcctgccgtagcacgcaaaacccttaaaaggtttcgcgctttgctgcatcagattgaaacaactggacccgacggcaagcaatggggaggcaatcctaacgtgttgcattccatccagggctttgcgaattatgtgtacatggtggaccccgacaagggcactgccctcaagcagcgtgtgcagagaatcctggctatgcaatcgtga

SEQ ID NO: 13390 - RNA, 1044 nt, unidentified
  source 1..1044: mol_type = other RNA; note = synthetic construct
atggtagtgaagcatcaggcaacaatccctaggctcactgagggctccatcgagcaactcaggaaacgaggactgcccgaatgtaataccgatgaagagattgcattagccatggggatttcagtggaaaagctgcattttctggctggtgatagatccatcagttctactagtctgtattcccggttccagatcagcaaaaaaaccggcgctgcccgcacaatcaccgcacctactcccgagcttaaggctgcacaacgttggatcctgaagcacatcttggataagatcgagatccacgacgcggcccatggtttttgccgagacagatctattgtgactaacgccacgccgcacgtgggcagagatgttatcgtgaagctggacctgcaaaactttttccagctcatcacgtataaaagggtcaaagaactcttccatggctttggctactctgaaaccgctgctactatatttggcttgatttgcacaattgcaaccactaacaacagcaataaaacgagctgtaagaacattgagaagaggcacttaccagaaggggcgcccacatcacctgctataagcaaccttgtctgcgaccggctggatacacaccttaccaagcttgccaataatttagggttccgctacacaagatacgcagacgacctgacattctcttgttacggggccgctcacaaggtcgacaagctgattcaagaaagtaagtccatcgtgactcaggagtcgtttaccgtaaattccgataaaacacaggttttgagcaaatctgtgcagcagattgtgaccggaattgtcgtcaatcagcagttgaatctctcacgcaaaaccctgaaagccttccgggctactctatatcagatagagcgcgaaggactgagcggaaaaaagtgggggaacagcaacaacctcatcgccaccattaccggtttcgccaattatgttgccatggtgaacccatcaaaaggagccgagttcctagcgagtgttgagcgtataaagcagaagtgcgaccggtcctga

SEQ ID NO: 13391 - RNA, 1047 nt, unidentified
  source 1..1047: mol_type = other RNA; note = synthetic construct
atggttgtaaagcaccaggcaacaataccaagattgatcgagggaagtatcgaacaactgcgcaaaaaagggtttcccgagtgtaacaccgacgaagagattgctatggccatgcggataagcgtcgaaaaattgcgattcctggctggcgatcggaacttaagctcaaattccctgtattccaggtttcagatctttaagaaaactggcgaggctaggaccatctcggcccctaccccagaacttaaagccgcgcagcgatggatcctgaagcaaatcctggaaaaaatcgagattcatgatgcggcacacgggttctgtcgtgacaggtcaattgtgaccaacgcctccccacacgtcggtaaagatgtgatcgtcaagttagaccttcagaacttcttccagtccatcttgtacaaacgggtgaaggagttgttctgctcttttggatatagcgaaacagccgccaccatattctctctcatttgcacggtaacaaagatcgacattaatggaaagaacagctgcaacgatatcgagaaacgccatctgccccaaggctccccgacttctcccgctataagcaatctagtttgcgatagactggatactcacctaaccaagcttgcccacaacttcggcttctgttatacacgctacgctgacgacctgacattcagcagtttcgagaagaccagtaggcaggtcaacaacctgattcatggctctaagctcattatcactgaggaggggtttacggtgaatcctgacaagattaaagtgctttcaaagtccgtccagcaggagatcactggtataatcgttaatcagcagctcaatctgtctcgtaagacactcaaagcctttagagccactctgtaccagattgaacaggaaggtctgtcgggaaagaagtgggggaactctaataatctcattgcagccatcaccgggtttgctaattacgtggcgatggtgaaccctagtaaaggcgcagagtttctcgcatcagtggaaagaattaagcaaaagtgtgaccggagctga

SEQ ID NO: 13392 - RNA, 1047 nt, unidentified
  source 1..1047: mol_type = other RNA; note = synthetic construct
atgaatatacagccccaagtgacaatctcacgcctgactgagggatcgatcgaacaacttaggaaaagaggcctcccagaatgtaatacagatgaggagatcgctttagctatggggattggcgtggaaaagctgtatttcctgaccaacaagtatcccacatcctctaccagccactatttccggtttcagatttccaaaaagacaggtgaaacccgtaccattagtgccccctcacccgagctcaaagctatacagaagtggattttgaaacatatcctcgagaagatcgaaattcacgatgccgctcatggcttctgcaggaacagaagcatcgttacgaacgcccgaccacacgtcggcagggatgtcatcgtgaaacttgacctgcagaattttttccagagcatactctataagagggtcaaagaactgttctgctccttcggatacttcgaaaccgctgcaacaatttttagcctgatctgtaccgtggccgaaatcaacgtgaacaataagatcaactacaaggacacggagaaacggcatctgcctcagggatctccaactagtcctgctattagtaatctcgtatgcgatcggctggatacttatctaacaaagctggcaaataacctcggattctgctacactcgctacgccgacgatctaaccttttcaggcttcgagaatgcctctcacaagattaacaacttaattcacgagagccaattgataatcactgaagagggttttaccatcaatccggacaaaattaaagtcctgaataagtccgtgcagcaggaaataaccgggataatcgttaaccagcagttgaacctttcaagaaagaccttaaaggcgtttagaacgactctgtaccaaattgagcaggagggtttgtctgggaaaaagtggggaaatagcacagaccttattgcagcgatcactgggtttgcaaactacgttgccatggtaaatcctagtaaaggcgcagagtttctggcctccgtggagcgcatcaagcagaaatgtgaccgaccttga

SEQ ID NO: 13393 - RNA, 1065 nt, unidentified
  source 1..1065: mol_type = other RNA; note = synthetic construct
atgtccccatcagatgagggcgatctgaacagactttggagcaaaggactcccagaatgtaattctgaagcggaaattgctctcgtcatggagatgagtattgagaagcttcgttccctggcttttaattacccgacatcctccaccacaaattatcatcgctttcagatcctaaagaaacccggggagtcacgagccatttccgctccgatgagtgacctgaaagttgcccagaagtggattagcaccagaattttagaaaaaatccaggttcacgacgctgctcatggtttccggcggaaccgaagcatcgtcaccaatgcaaaaccacacgtgagtgccgatatcatcgtcaaaatagatctccaggactttttcagatccatcagttatcaacgtgttaagaagctgtttctcgatgtggactactccgaaactgccgctaggatttttggactgatctgcacagtcaacgaaactgaggagatcgaaattgacggcaagattaattacaagaccatcggcaaacgccaccttcctcagggatcacccgcctcacctgccatctcaaacataatatgctacgatctcgacaggagattatctcaggtggcccaggagttggggttctgttacactcggtatgctgatgacctgaccttctctggcagtcgggacgtgaaaagcaaaattagcaagctgataagcgagacaaggaccctgatcgagtctgagggattcacgataaacccaaacaagactcaaatcctgggcacttctgtgcaacaaaaggtgacgggggtcgtgattaacaagaagttgaacgtagcaaaaaagactctgaaggcattcagggcgaccctgtatcagatcgaacgcgaaggtcttgcaggcaagaggtggggtaactctaccgacatcatggccgccatcacagggttcgccaattatgtggcaatggtaaatcccaataaaggagtggagctattgacatcgataaaaagaattgagcagaagtacgcgcctcctgaaagcccccgctttaccattgaggaggaattctga

SEQ ID NO: 13394 - RNA, 954 nt, unidentified
  source 1..954: mol_type = other RNA; note = synthetic construct
atgtataatacggaggccgaattagctttgagtatgaacatctccgtgaagcaattaaggtggctggcatttaaacccttcacctacccagtgattcactactcccggtttcaaattgccaagaaaacaggagagactcggacgatttacgctccaaaaccttatctgaagacagcacagatctatatcctcaagaacatcctggataacctcgctgttcatgatgctgcacatggcttccgccgtcaccggtcaattatcactaatgcccagccgcacgtcggagccgacatcataattaagctggaccttgagaacttcttctcctcaattacttacaaacacgtgcagaagcttttcttgtctctgggttacagccagtctatcgggacacttctttctctcatctgtaccattaaggacgttgaaacttgtcacccacgatgcttacctagtggaagccccgcttctcccaccatcagcaacctagtgtgctacaatttggaccagaatctctcacagatagcctccgatctgggctttacctatacacgctatgctgatgacctgacattcagcggcaaaagagacagagcgaatataagcacactgatcaagcaactgctggccgtgattgcgcagttcgggtttaagatcaaccccaacaagatccagattctaccaaagtctgtcaggcaagaagtcaccggtattgtagtgaaccataaactgaacatcagtcagaccaaactcaaggcatttagggccaccctgcatcagattgagcaggatggactgtcggggaaaaaatggggcaactcacctaatctcatcgccagtatcaccggttttagcaattacgtggcaatgataaatcctgagaaagggggcgaactgcttgaatccgttgagagaattaagcagaagcacatattgaatactccggtactctga

SEQ ID NO: 13395 - RNA, 1065 nt, unidentified
  source 1..1065: mol_type = other RNA; note = synthetic construct
atggcctctaaagccacatacaagctgcacgtgacatccgtctctgcggagggccatccaaagaatcttcagcttcatggtcttgccgagtgtaacactgcagaggagatagccttggctatgggcattagtaggggcaaactgcgcttcctgaccctaaacagccccgctagcacaattacccactatacccggtttaagatcagtaagaagaccggggaagaacggagcatcgttgccccaggccccaacctgaagtccgcccaacggtggattctagacaatattctcgagaaacttgaggtgcactctgcagctcatggcttctgcaaaaaaagaagcactgtgactaatgctaagcctcacgtgggcgcggatatcctcgttaaaatcgatctgcagaattttttccagtccatatcgtacaaacgcgtaaagggactgttttcaggcctcggttattccgaaaccgccgcaaacatctttggtctgatatgtaccgctttcgaaatcaaggaaatcgagaaagagggacagataaactacacggccagtggggatcgtcacttgcctcaaggatcacccgccagtccggccatctcaaacttaatttgccgacatttagattccagaatcgcaatcgtagccaagaacctggggttctgttacacaagatacgccgacgacctgacatttagcgggtgcggagaagcagctcggaggatcagcaacctgatgaaagagattaagctcattatcgctgcagaaggattctcgatcaacagggacaaaaccaaaatcatgggacgatctgttcagcaggaagtcactggaatcgtcgtgaatacacagctcaatatttccaagaagactctcaaggctttccgcgcaaccctgtatcagattgaacaggaggggttgtcaggtaagaagtggggcaatagcacgaacctgattgcgtccatagctggctttgcgaattacgtctctatggtggacccttctaaaggggccgagttacaattgagagtggcaaggattaaacaaaagtatgaggggaagtga

SEQ ID NO: 13396 - RNA, 1074 nt, unidentified
  source 1..1074: mol_type = other RNA; note = synthetic construct
atgtacggcacgaacctgataaccatcccccttgcaatggatgggaatagtgagcggttggagacagataagtcggtagttctgcggtcccatggcctggctgagtataacaccgtgactgaaattgcctgcgccatgggaatcacacccggacagcttaggttcttaacctcttctttcagtgggtcgcaagtcaaacactacgtccatttccagatctctaaaaagacaggcggggagagactgataagtgccccgaagcctaatctcaaagcggcccaaaaatggattctgcagaatatcttggagaaactcgaagtccataatagtgcacatggcttttgcaaaaatcggagcatagtgacaaacgctcagccacacgtgggcaacgatgttattgtcaacatcgacctgcagaacttttttgaggctattacatacaagagggtgaaggaattgttcagcgggttcggatattctgaaactgccgctaagatctttgccgtcatctgtactacgtcagagatcgaaattcacggccaggctaatgacatcaccagcggcaatcgccacctccctcaaggatcccccgcctctcctgccatctcaaacctgatttgctaccacttagactctagaatcgctgcgatggcagaaaacctcgggttttgttatacccgctacgctgacgatctgactttctccgctagcggtcaggcctcacacaagatttacaacctgatcaagaacgttaagcttatcattaactccgaggggttcacagtgaattttcacaaaacgaacattctctccaaatcagtgcagcaggaggttactggtgtggtggtgaacaccaaactgaacataagcaagaaaaccctaaaggccttccgtgcgacactgtaccagattgaacaggaaggtctatccggtaagcattggggcaatagcaccaatattatcgcagccatcactggatttgcaaattatgtagccatgataaatccagacaaaggagcagaacttaggagcagagtggagcgaattaagcaaaagtatgagtgtcaggagtga

SEQ ID NO: 13397 - RNA, 1050 nt, unidentified
  source 1..1050: mol_type = other RNA; note = synthetic construct
atgtacgcgacaaaccttacaacgactccgctagctatcgagggcaattccgcagtgttgagatcacacggacttgctgagtatcactcagctgccgaaatagcgtgcgctatgggcattaatccaggtcagctgcgctttctgacgtcttccttccctggaagtgaggttaaacactatgtgcactttaagatctccaaaaagacaggtggagagcggttgatctctgcccccaaacctcacctaaaagcggcccagagatggatcctggaaaacattttagagaagctggaggtccatcacgccgctcatgggttttgtaaaaataggtccattgtgacaaacgcccagccccatgtgggtgccgacgtcatagtgcacatcgacctgcagaatttcttccagagcattacctacaagcgcgtgaaggaactgttctcagggtgtggctacagcggcatagcagccaacatcttcgctcttatctgcacaaccagtgaaattgaaattcatgagcaggcacataacatcagcattgagaatcgccatctgccccaagggtccccaacttctccagttatcagcaatctgatctgctatcacttagacaggagaatggtaaaaatggcggaaaatttggagttcagctatacccggtatgccgatgatcttaccttttcggcttctggacaagcttctgaacgtaggtacaagctcattaaaaacgccaagctgatcatcaatagcgaaggctttactgtgaattcccataaaaccaacattctgggaaagtcagtgcagcaacaggttaccggggtcgtggtcaacacccagctcaacatctcgaagaaaactctcaaggcatttagggcaacactgtaccagatagagcaagagggcctcagtgggaaacactggggtaacagccctaacatcattgccgcaattactggcttcgccaattacgtcgccatgataaaccccaataagggggcagaactccggagtcgagtagagcgaatcaaggaaaagtacgagtctcaggagtga

SEQ ID NO: 13398 - RNA, 1086 nt, unidentified
  source 1..1086: mol_type = other RNA; note = synthetic construct
atgtattcacaaaatctcacgactattcccctagccaccgaatcaaatttagagcgactggagacagataacctggcgcttctccggtcccacggattggcagaatataacacggccgaggaaatagcttttgccatggtaattagccttgagaagctccactttttaacaacatctacctccctgacacgtcactacctcccgtttaaaatcagtaaaaaaaccggcgggaagcggattatcagcgctcctaaacctgagctgaaagccgcccagagatggattttggagaacatcttggaaaagctggaggtgcacaacgctgcacatgggttctgtaagaacaggagcatagtaactaatgccaaaccacatgtgggggccaatgtcatagttaacatcgacctgcagaactttttccagtctatctcttacaagcgaattaaggaattgttttccggattcggttactccgaatccactgccaccatcttcgggcttatttgcacgactgccgaaattgcgatcaacggccaaataaatcataccgcttcagagaacagacatctgccccagggatcacctgcttccccagctatttctaatctcgtttgcaggaatctcgacatacggctggcggcgatcgctgagaatctgggcttctgttacactagatatgcagatgacctgacattcagtaccagcgaagatgcatcaagtaagatctccaatctgatcaagaataccaagttcattatccacggcgagaacttcaccgtgaacgacaacaaaacaaagatctcgtctaaaagcgtgcagcaggaagtcaccggtgtgatagtgaatacacagcttaacatctcgaaaaagactctgaaagcattcagggccaccctatatcagattgagcaagagggattatctggcaagagttggggcaagagcaccaatctgattgccgcaattacagggtttgctaattacgtcgccatgatcaaccccgacaaaggcgcagagtttaagagcagcgttgaacgcatcaaacaaaagtacggaggtagtcagactgatgaggtgcgcttttga

SEQ ID NO: 13399 - RNA, 1041 nt, unidentified
  source 1..1041: mol_type = other RNA; note = synthetic construct
atgtcctgccaaaactacacacagaacaacattgagcagctgaagaaatgcaatctcgacgtctataacaacgctgagcagattgctgccgccatggaaatctccatcgataaactgcgattcttaaccttcacttccaaaacatcacagatcagccactacatttactttaagaccgccaagaagttagccggagatcgtatcatcagcgcaccgatgcctgatctgaagagggcgcagtactggattctgcaaaatatcctgcagaaaatcgctatacacgatgctgcccacggcttctgtggggaccgctcaataataaccaatgcaaatccacatgtcggcgccgagatcatcatgaatatcgacctccaagattttttcagtgctataacttaccaacgagttaaggggctgtttcagtcatttggctatgcctcctctgtggctaccatattcggccttttgtgcacagcccccgtggtcgaagagagaaatctagacggaaaaactgatttcgtggagttcaaacaacgccatcttcctcagggaagtcccgcgtcacctgcaatcacgaacattatctgtagaaacctggaccagaggctatgtgctattgcagaaaagttcgggtttacatatactcgctacgtggacgaccttacatttagtgcgagcggcgagaatttgcagcacactaaaaacatcatcaagcaggtacagtctattatttctgatgagggtttcgcaattaatccagacaagacgaggatcctgcggaactctcagcagcaggaggttaccgggattatcgtgaatcagaagattaatatctcgcggaaaaagctcaagagctttagagccaccctgcaccagatcgaaaacgagggactcgaggggaaacattggggtaatagcagcaacttgatagcttccattaccggcttcgccaattttgtggcaatggtaaaccccgaaaaaggagccgaatttcaacagcaaattcagcggattcaggaaaaatatggtaagaacaagtga

SEQ ID NO: 13400 - RNA, 1041 nt, unidentified
  source 1..1041: mol_type = other RNA; note = synthetic construct
atgaacttccagaatcacaaccaaaacaatatcgagcagttgaagaagtataatctggacgtctacaacaatgcagaacaaatcgcagcttctatcgagataagcattgccaggcttcattttctggctttcaatagccagacaagccatatctctcactacatccatttcaaaactgccaagaaaattgcaggcacgaggatcatttcagctcctctgccagatctgaaacgtgcccagtactggatcctgcataacatactgcaaaagattgccatccacaatgccgcgcacggcttttgcggcgatcgatccatcataacgaacgctactccccacattggggcagaggtcatcattaatatcgacttgcaggacttctttagcgctattacctacccaagagttaaggggctctttcagagtttcggatacagctcttatgtggcgacaattttcggattactctgtactgcccccgttgtagaagaacgaaacgtggatggagaaattaactttgtagaactcaaacagcggcacttaccacagggttcgcctgcgtcacctgcaattaccaatatcatctgccggtcactagacgagaggctgtccgccatcgccacccagtttggcttcacatatacccgctacgttgacgatctgacattttctgcatccggtgagcagattaagcacaccagtagcttcataaaacaagcccagtccataataagtgacgaaggattcgccatcaatcccgataaaacccgcattcttcggaacagtcagcagcaaaaagtgactggcataatcgtcaaccagaaaatcaatatctccagaaaaaagctgaagagctttcgcgctacactccatcaaattgaaaatgagggattggaggggaagtattgggggaagtcttcaaaccttgtggcttccattactggttttgctaacttcgtggccatggtgaacccggagaagggcgcagagttccagcaacagatccagagaattcagaagaagtatgggaagaaaaattga

SEQ ID NO: 13401 - RNA, 1044 nt, unidentified
  source 1..1044: mol_type = other RNA; note = synthetic construct
atggaccttcagaacaatacacaggaaaacatcgagcagcttaaaaaatacggactcgatgcctacaataccgctgaggaaatagcggctgcgatggagatcagttttgacaggctaaggtttctcgtgttcaattccaagaactcaactgtttcacactacattcatttcaagacagccaaaaaaacagaaggagagaggatcatcagcgcacccttaccggacctgaagcgcactcaacactggatccttaagaacattctgcaaaagatcggaattcacgacgctgctcatgggttttgtcgtgatcgaagtatagtcactaacgccacccctcacgtaggcgccgaagttatcattaacattgacctccaggatttcttttccgccatcagttaccagagagtgaaaggcctgttccagtcctttggttattcttccagcattgcaaccatttttagcttgctgtgcacaaccccagcagtcgccgaacgcgatctggatggtaaggcagacttcgtcaagttgaaacagcggctgttacctcagggttctcccgccagccctgctataaccaatattatttgcgggagcctggacgatttgttgtctgccattgctcagaagtcaggcttcacctacactcggtatgtggatgacctgacgttctcaaccagtggggagtctatcaagtatatctcaaacatcatacagcaaacgcagtctattgtcagcgacgagggatttactattaattcggagaagaccagaatactgcggaattcccagcagcaagaggtgacgggcatcattgtgaacgagaagataaacatctccagaaaaaagctcaaaaacttccgagccactctgtaccaaatcgaacacgaaggcctggagggcaaacattggggaaatagtccaaaccttatcgcgtccatcacagggtttgcaaatttcgtagctgtttatcgcaggctcgtgacagggaagaatcctggcctaagcgcaacaaccccctctccctgggtgaaagccccatgttga

SEQ ID NO: 13402 - RNA, 1056 nt, unidentified
  source 1..1056: mol_type = other RNA; note = synthetic construct
atgggccttcagtcaaacaaacagggcaatatcgactaccttaacaattatggactggatgcatacaatacagctgaacagatcgctgctgccatggaaatctccgtggataaactgaggttcttagcctttaatggcaaaacctcaactgtgtcccattatatccacttcaaaaccgccaagaagaacgtaggacaaagaattatctcggcccctctaccagacctcaagcgggctcagcattggatcctgaagtccatcctgcagaaaattgagatccacgatgcggctcatggcttctgctgcgaccgtagtatcgtgacaaatgcaactccacatgtgggggctgaggtggtaattaagttcgacctgcaagacttcttcagcagaatatcctaccagagggtgaagggactgtttcaaagcttcggttactctcctgccgtggccgcaattttcggattgctctgtataacggctgccgtcgaagagcgggaactggatggcaagacatattttgttgagttgaagcaccgccagttaccccagggatcacccgcaagcccggcaattactaacattatttgtcgcaacctcgacaggagactgatggctattgcggacaaatacggttttacatacacacggtatgtcgatgacctgactttcagtgcctctgccgagaatgtgaagcacatatcaaacatcatcaaacaaacccagtctatcgtcgcagatgaagggtttgcaatcaatcaggagaagaccagaattctacgaaactctcagcagcaagaagtcaccggcattgtcgtgaacgagaagatcaatataagccgcaaaaccctcaagtcctttcgagcgacgttgtatcaaatcgagaacgagggttttgaggggaaacactgggggaacagcggcaaacttattgccagcatcactggtttcgcgaactacgttgccatggttaatccccagaaaggggccgaatttcaggaacagataaagaggattcagaagaagtatgagataaaacacagtagtgagaatcagtga

SEQ ID NO: 13403 - RNA, 1410 nt, unidentified
  source 1..1410: mol_type = other RNA; note = synthetic construct
atgtctgagcagccacgcacccggcaggaactgtatgagcaggtacgcaaagtgggaaaggaagagtttatcctggaggagatgattcggtatggcttctggtcaccacagggaacaattcccgaggatccagccgatgagattcgacgcgcctcacagatccggaaggaattgcaggagctccgtagagaatcttctcgactacacaacgagcagcagctgcgcaaagatgctctgaaaaggcggctggcagagagccggaagaagcagcaggagacaaaagagagaagggaaagagagagactggaaagagccgaggcctggaagcaacgcaaacagagggaaataatctatctgggcgaggaagtgtccgctgggcttaaccacgcagaatctaacctcgagagacttcgaaataacaatctgcctctctgtaacactgcggaagaaatcgctgtggctatgggcattaacataggcaagctgcgcttcctagcttttaatcgtaaaacatcgacagtcagccactacatcagatttaagatgcctaagaagactggtggtgagcgattcatctctgctccaatgcccaatttaaaacaagcgcagcactggatccttacaaatatcctggacaagctcaacgtgcacgaagccgcgcacgggttctgtcgtcagaggagcattattactaacgcaacccctcatgtagagaaggacgtggttatcaactttgacctcaaggatttctttccctccattagctataagcgcgtgaaaggtctttttcatagtttcggctacagcgaaaccgccgccacaatcttcgctttgttgtgcacctccgccgacgtcgaaaagctgcaattggacgccagaacgtattacgtggcggtgggagacaggtacttacctcaggggagtccggcatcaccggcaattagtaatcttctgtgcaggcggctggataaacgcctcaccggaatggctgagaagctggggtttacctacacgaggtacgccgacgacctcactttcagcgcagatggcgagtcccttcggcatatatgcaacattctaaagaggacggagtccatcgtcacccatgaggggctgcgaatcaatcaggataaaactagggtgctgcgcaatactagacaacaggaagtgacaggcattgttgtcaatgaaaagctctcagtttgtaggaaaaccttacgtaaatttcgggccactctcttccagatcgagaaggagggcctggaggggaagaagtggggaaacagtaccaatttgatagccgcaataaccggttatgccaactttgttgcaatggtaaatcccgaacggggacaagaattccaaaaacaggtcaagagaatcaaagctaaatacttgggcaactggtga

SEQ ID NO: 13404 - RNA, 1401 nt, unidentified
  source 1..1401: mol_type = other RNA; note = synthetic construct
atgtcagatcagccaagaactcggcaggaactttacgacagaattagacagactggtaaggatgagttcatcttagaggagatgatccgattcggattttgggcaccacaggggaccattcccgaagatccggctgacgaaataaggcgacagggagaaattagacgggagcttgagactctgaggcagcagtcctcccagctgagaaacgagaaggagctgcgaaaacagatgctaaaacagcggctggaagaaagccgccggaagcaaaaagagacaaaggaaaggcgtgagcaggaacgattagaaagggccgcagcgtggcaagagaagaggcagaaagacattatatatcttggggaggacgtgagcggcggactcaataacacagaggccaatattgaacggttgcaatcccataacctgcccctatgtaatacggcactcgaaatagctgaggccatgggcgtaactattgggaagttaagattcctcgcttttaatcggaaaaccagcacaatcagccactatatccggtttaaagtgcctaagaagacgggtggcgagcgtctcatcagtgcgcctatgcccaacttgaaacaggcgcagtactggatcctggagaatattctaaataagctggaggttcatgacgccgcccatgggttccgggaaaaccgctctattattactaatgctacccctcacgtgggggcagatgtaatcatcaacttcgatctcaaagatttcttcccttcaatctcgtacaaacgcgtcaagggactgtttcagagttttggctacagcgaggccgccgccactatttttggactcatttgcaccgctgcagatattgagcaagtggaactggacggcaaaacctactatgtcgccctggacgacagacacctgccccaaggttctccagcctctccggctataacaaatcttttgtgccggcgtttggaccgaaggctgcagggaatggccgagaacataggcttcacatattcccgctacgcagatgacctgacattctctgcaaagacagaaaatcgcaggcacatctgtaatattatgcgcagaaccgaatcaatcgtgacccacgagggatttaacatcaaccacgataaaaccagggtgctcaggaatactaaccagcaggaagtgacaggcataatcgtcaacaacaagctcaatatctccaagaaggtgcttaaaaagtttcgcgcgacgctgcatcaaatcgagcaggaaggcttgcaggggaagcactggggcaacagtcatgacaccctggctgccatcaccggtttcgccaacttcgttgctatggtcaatccagagaaaggggctgagtttcagcagcaagttcaacgcatcaagaagaagagaaaatga

SEQ ID NO: 13405 - RNA, 1410 nt, unidentified
  source 1..1410: mol_type = other RNA; note = synthetic construct
atgactgaccagcccagaacaaggcaggaactgtacgacagaatacgtaccatgggcagggaggagtttattcttgaagaaatgatccgctatggattctggccagctgaaggcaccatgcccgaagatcctgcagatgagatacggcacagaggcgagctggagagggaactccgcgagctgaggcaggagaataacagactgcacaacgagcaagctttcaagaaagagatgcttaaacagaggctggaggaatcccgacgaaaaaggcaagaaaccaaagaaaggcgtgaacgggaacgccaggagagggcagaagcctggaaacagaagaagcaaaaagagatcacttacttaggtgaggaggtttctgcaggcctgaataatactcagagcaacgaggagagactcagaagcaataagctccctctctgcaatacaagtgaggaactcgccaccttaatgggtatttccctgggcaagttgcggtttctggcctttaaccgaaaaacaagtactgtctctcactacattcgttttcggatgccgaagaagacaggcggagagcgaattatttctgctcccatgccctctctgaaagccgcgcagcactggatcttggagaatatccttcagaaattgcagatccacgatgccgcccatggtttcacaaaggagcggtctattgtgaccaacgccacaccacatgtcggggcggacgtgataatcaatctagaccttaaagacttcttcccatcgatctcctataaacgcgtcaaaggactatttacctcattcggatacagcgaagccactgccacgatactggccttgatctgcaccgctgctcaggtggaggagctggagttagatgggaagacttactatgtggcacttggcgatcgccaactgccacagggaagtcccgcatcaccggcgattaccaacctcctgtgcaggagactcgataaacggctgactacaatgtccgggcagctgggcttcacctacacgcgatacgcagacgatctgacctttagtgggtcaggggacagcttacgtcatatctgtaatattctccggcgcaccgagagcatcgtgacacacgaaggattcacggttaaccaggaaaaaactcgggtcctgcgcaagtcaaggcaacaggaagtgaccggggtggtcgtaaaccagaaattgagcgtatgtaagaagacactgaagcaattccgggctacgttgtatcagatcgagaaggaaggactagagggcaagcattggggtggttcccctgacctgcttgcagctattacaggctatgctaactttgtggccatggttaacccagagaaggggctcgaactccagaagcaggtgcaacagatcaagaagaagtatagaagacctcgctga

SEQ ID NO: 13406 - RNA, 1410 nt, unidentified
  source 1..1410: mol_type = other RNA; note = synthetic construct
atgagcgatcaaccaaggaatagggaggagctgtaccagtatatttcaaaggtcggcagggagaaatttatcctcgaggacatgcaaagatacgggttctggcagggtgatagtcctcagggctctgaagaagatacgcgcaggcagctggagatacagcgcgaaatcaacgagttaggaagacaatccagcaagttgcagaatgagaaactcctgagggagctgagcctcaagaaacgtttggaggaaagtcggagacgaaggcaggaaactaaggagcggcaggaaagagagagacaggaacgggccgaagcctggcgtcaacgcaaggaaaaagaaattctatacctgggcgaggacgtgagcggtgacctgaacaatacggaaggaaacgaagagagactaaactctctcagtctgcccgtctgcaacaccgccgagcagatcgcagcagccatggagataactgtgggaaaactgcggtttctggcttttaaccgaaaaacatctacagtgagccactacattagattcaagatgccaaagaagacaggcggcgagcgaatcattagtgcacccatgcctcagttaaaacaggcccaacactggatactcgcgtctatcctcgaaaagctcgaactgcacgatgccgcacatgggtttcggcgtgagcgatccatagtctccaatgcaacccctcatgttggcgcggaggtgatcattaacttcgaccttaaggacttcttcccctcaattagctataagagagtgaaggggctcttcaggagttttggctattccggcgccgctgctacaatcttcgctctgatttgtacggctgccgaggtagaggaactggagctggacggccagaattactatgtggccgtcggggatcggttccttccacagggatcaccagcttcgccggcgatctcaaaccttttgtgtaggcggttggatcggcgactgaccgagatggcggagaaattgggattcgcctataccagatatgctgatgaccttacttttagcgcatccggggactctctgaattctatctgcaacatccttcgccgtactgaaagcatcgtcacccacgaagggtttactattaatcaggacaaaacccggattcagcgcaaatacaaccagcaagaagttaccggagtggtagtgaatgagaagccctcggtgtgccgcaaaaccctgaatcgcttccgcgccaccctataccagatcgagaaatccgggatcgagggtaagcattggggtaatacatcaaacactattgccgcaatcacaggctttgccgatttcgttgctatggttaatcctgaaaaaggagctgaatttcaagagcaggtgaagaggataaaggagaagctgaagcagaacacattatcctga

SEQ ID NO: 13407 - RNA, 1410 nt, unidentified
  source 1..1410: mol_type = other RNA; note = synthetic construct
atgtccgatcaacggcgcagccgggaggagcttagtaagcttatacgcgaggtcggcaaagaagaattcatcctggaggagatgctgcgctacgggttctggaagggggaaagcttgagggagcttgatgctgagattcatagacaggaggaaatcaggcgcgaactagaaactctgcgtcagcagagcttgcagctccaagatgagcagctactccgacagcagtcattgaagaagaggcttgaggaatctcgcaggaaacgacaggagacgaaggagaggcgggaacgggaacgacaggaaagagccgaagcttggaaacaaaaaaaggagaaagagatcgtgtacttaggcgaggcggtttccgccgatcttaacaacacacagggtaatcaggagaaattgaatagcctaggcctgccagtgtgcaacaccgccgaggagattgctaccgctatgggggtgacagtgggaaaactgaggtttctggcgttcaatcggaatacttccacagtgtcccactacatccggtttaagatgcctaagaaaactgggggagagagaattatctttgcccccatgcctaaccttaaacaggcgcagcactggatcctggagaatattctgcaaaaactggagatacatgacgcagcacacggcttcaggagagagcggtctatcgtgactaatgccaccccgcatgtgggtgccgaggttatcattaacttcgacctgaaggacttcttcccctctatctcttataagagagtaaaaggactgttccgtagttttgggtatagcggggccgcagctacaatcttcgcactgctatgtaccgcggccgaggttgaagagctggagctcgacggccagaactactatgtcgcagttggcgaaagacatctgccacaaggttctcctgcaagtcccgctatttcgaatttactgtgcaggcgcctcgactcccgtttgacagctatggcagaaaaactcgaatttatctacaccagatatgctgacgatctcacattttccgtctcaggagaatctcgcagatatatttgtaacatcctgcgtaggaccgaaagcattgtcatccacgagggatttaccattaatcaggagaagacccggatactgcgaaaaagctcccagcaggaagtcacgggactcgtggtgaacaacaagttgtcaattagtaagaagacactgaacagattccgagccactctctaccaaatcgaaacggagggtttagaagggaaacactggggcaactcatcgaacctgattgctgccattactggctttgccaattttgtggccatggtaaatccagaaaagggcgccgagttcctcgagaggataaagagaatcaagaagaagtttcggcgcaacaatatagaatga

SEQ ID NO: 13408 - RNA, 1413 nt, unidentified
  source 1..1413: mol_type = other RNA; note = synthetic construct
atgacagatcagcctagaactcgggaggagctttacgacagaataaggaaaatggggagagaagaattcatcctcgaagagatgatacgctacggattctggccggcccaaggcactataccgcaggacccagccgatgagattcgcagggctggagagattcgcagggaactggaacagttgaggagagagagcagtcggttacagaacgagaaagcgctgcgaaaacaaatgctgaaacagcgcctcgaggagtctaggcgaaaacaacaggagactaaggagaggagggaacgtgagcgacaggagagagcccaggcctggaaccaaaagaagcagcaagaaattatctatctcggcgaaggcgtttccgctgggcttaacaacagtcaggggaacgaggaacgtctcaggtcattaggattgcctctgtgcaacaccgccgaagaaatagccgccgctatggagataagtgtggggaaactacgttttttagccttcgatcgcaaaaccgctacagtatcacattacatcagattcaagatccccaagaaaacgggcggggagagactgatttcggctcctatgccaaacctaaagcaggcacagcactggatccttgagaatattctgcagaaattgcaggtccacgatgccgctcacggcttccggatccagcgatccattgtgacaaatgcaacttctcatgtgggagccgacgttatcatcaatttcgacctgaaggacttttttccagccatctcctataaacgggtgaaaggactttttctctcattcggctatagtgaagccgccgctacaatttttggcttgctgtgcactgcggctgaggtcgaggagctggagctcgatggcaagacctattacgtcgcactgggtgagcggcatttgccccaaggcagccctgcaagcccagcaattaccaatctgctttgtcgcagactagatcgaaagctcaccaccatggcagaaagcctgggcttcaactacacgcggtacgctgatgacatcacgttttccgcgtctggagactctctgaggcacatctgtaatattataaagcggaccgaatccattgtaacatatgaagggtttgcaattaaccaggacaaaacacggatcctccgcaaaagcagacagcaggaagtgactggtgtcgtggttaacaataaactgaatgtgagcaagaagatcctgaaacaatttagggccaccctttatcagatcgaaaaggacggtctggaagggaagcactggggaaattctcccaacctgatcgcagccatctcaggtttcgctaacttcgtggccatggtgaatcccgagaagggtgcagagtttcagcagcaggtccaacggattaagaagaagtacgcgcgtcgcaagaattga

SEQ ID NO: 13409 - RNA, 1413 nt, unidentified
  source 1..1413: mol_type = other RNA; note = synthetic construct
atgacagaccagccgcggacccgggaggaactttatgaccggatccgaaagatggggcgtgaggagttcatcctggaagaaatgattaggtatggcttttggcctgcgcagggtagcatgccacaggatcctgccgatgagattaggcgtgctggggagatacggagagagctggagcaattgagacgcgaaagctcacgcctccagaacgaaaaagctctgaggaagcagatgctgaaacaaaggctggaggaaagcaggcgcaagcagcaagagacaaaggaacgaagagagcgcgaacgccaggaacgcgctcaagcttggaaccggaaaaagcagcaggaaatcatatacctgggagagggcgtgagcgccgggctaaataattcccagggaaacgaagagaggcttagactactcaatttgcccctctgtaacacagccgaggaaatcgccgccgccatggagatttctgttggaaaacttcgattcctggccttcgatagaaagacggcaaccgtgagtcattacattaggtttaagattccgaagaagactggcggtgagcgccttatctccgcacccatgccaaaccttaagcaggtgcaacattggattctcgagaatatcttacagaaactacaggtacacgatgcagcgcacggctttagaatccagcgctctatcgtcacaaatgccaccccacacgtcggagccgacgtgataattaacttcgacctgaaggacttctttcctgctatctcctacaaacgggtaaaaggactgtttctctctttcggctattccgaggctgctgcaaccatcttcagtctcctttgcacagcagccgaagttgaggagctggagctggatggcaaaacctactatgtggcgctcggggagaggcatctgcctcaaggaagccccgcttcacccgcgattactaacctgttatgtaggagactcgatagaaagttgactataatggccggctctttgggtttcaattacacgcgttatgccgacgacattactttttcgacttcaggcgacagtctgagacacatttgcaacttgctgaagcgaaccgagagtatcgttacctacgagggttttgccattaatcaggataaaacacggatcttgaggaaatctagacagcaggaggtgaccggggtcgttgtgaataacaagctgaatgtgagcaagaagatcctgaaacagttccgggctactttataccaaatcgaaaaagacgggctcgaagggaagcactggggaaactccccaaatctgattgctgccatctcaggcttcgcaaactttgtggcaatggtcaaccccgaaaaaggcgccgaatttcagcagcaagtccagcgaataaagaagaaatatgcacgtcggaaaaagtga

SEQ ID NO: 13410 - RNA, 1410 nt, unidentified
  source 1..1410: mol_type = other RNA; note = synthetic construct
atgaccgatcagcctcgaactcgccaagaactgtacgaacgtatcaggcagatcgggagagaggagtttattttagaggagatgattaggtacggcttctggccagccgaggggacaattccacaagatccagccgatgagataaggagagtcggcgaaattcgaagagagctagaggagctccggcaggagtcctctcgccttcataacgaaaaagaactccgcaaggaaatgcttaaacagaggcttgctgaatcacggagaaaacgtcaggagactaaggaacgcagggaaagggagcgacaggaacgggcagaagcttggaaacagaagaagcagcaagagattgtttatctgggtgaaggggtgtcagctggtcttaatgagacagagggcgattccgaacgcctgcagtcatacgggctgcctttgtgtaataccgccaacgagatcgccaccgcaatgggcatcaatgtcggaaaactgaggtttctcgccttcgaccgaaaaacctctacggtgagccactatattagattcaagatgcccaaaaagaccggtggcgagcgcctgatcagtgcacctctgccctcactgaagcaagcccaacactggatactggggaatatattgcagaaactcgaggtccacgaggcagcacacgggtttcggtgcgacaggagcatcgtgactaacgcgacaccccatgttggagctgatgtcattattaacttcgacctaaaggacttctttccgtccattagttataaaagagtgaagggcctgtttagatcgttcggatactctgaggctgctgctacaatcttttccttgttgtgcacggccgcggaggtggaagagttggagttagatggaaaaacttattatgtcgccctggaagaacggcatcttccacagggtagcccggcatctcctgcgatcaccaatctgctgtgtcgacggctcgataagagactcactgccatcgcccaggagctgggcttctcctacaccaggtacgcagacgacctgacatttagtgcgtccggcgattctctgcggcacatatgcaatcttctcaagagaactgagtcggccgtgatctatgaaggattcgccatcaaccaagagaagacacgtatcttacggaaaagtagccagcaggaagtaacaggggtggtggtgaacgacaagctaaacataagcaagaagaccctgaagcagttccgcgcaacgttgtaccagatcgaaaaggacggactcgagggaaaatcctggggcaatagcagcgacgtactcgccgctgtgtctggctttgctaactttgttgttatggtaaatcccgagaaaggtgccgaattccagcagcagatccagcgcattcggaaaaagtacaagcaaaaaaagtga

SEQ ID NO: 13411 - RNA, 1413 nt, unidentified
  source 1..1413: mol_type = other RNA; note = synthetic construct
atgagcgatcagcctcgaacccgtcaggagctctatgataggattcggcaggtgggaaccgaggaattcatacttgaggaaatgatccggtacggcttttggagtgcacagggcgaaatgcctcaggacccagctgatgagattcggagggcaggcgaaattcgccgtgagctgaatgagttaagacaagaatctcgcaaacttcaggacgaaaaggagctgagaaagaggcttctgaagcaaaggctggaagaatccaagcgaaagcggcaggaaactaaggagagaagggaacaggaaagaagatcccgagcggaggtttggaaacaaaagcagcagcaagacatcatatatttgggagaagacgttagtgctggactgaataacacccagggtaacgaagagcgtctccactcgtacaatctgcccctctgtaacaatgcagagcaaatcgccgccgctatgggcatcaccgtaggcaaactaaggttcttagcttttgatcggaaaacctccactgtcagccattacatccgctttagaatgcccaagaaaacaggtggcgagaggataatcagcgcacccatgcccaacttgaagcaggcccagcactggattctcgccaacattctggagaaactcgagctgcacgacgccgcgcatggtttcaggcgggatagatccatcgtgacgaatgcaacaccacacgtaggggctgatgttattattaacttcgacctgaaagacttcttcccaagtatttcatacaagcgggtcaagggtctattccatagctttgggtattctgaagcggcggctacaatatttgggctggtgagcacagctgcagaggtcgaatctcttgagatcgacggcaaaacatactacgtggctgtggacgagcgtcatctcccacagggctctcctgcctcacctgccattactaacctgctgtgccgcagactagatagacgactcactgccatggccgagaagcttgggtttacttacacccgctatgccgatgatttgaccttctctgccagcggggacagtctcagacacatttgcaacatcctgaagcgcacagaatcaatagtgacgcatgagggatttaccattaatcaggagaaaactcggatcttgcgcaaatcacgccagcaagaagtgaccggagtcgtggtgaacgataagccgaatgtggacaacaagacgttgaagcgcttcagggccacactgttccaaatcgagaaggacggcttagagggcaaacactggggaaacgcaaatctgatcgctgccatcgccggatttgcaaacttcgtcgccatggtaaatccggagaaaggggctgagtttcagcagcaggttcagcggatcaagaataaatatgtgaggaatgggcgatcctga

SEQ ID NO: 13412 - RNA, 1437 nt, unidentified
  source 1..1437: mol_type = other RNA; note = synthetic construct
atgaccgaccaaccccggacgaggcaggagctctacgacagagttcggcaggtgggcaaggaagagttcatcctagaagaaatgattcgctatggattctggttcgctcagggtgagctgccgcaggatcctgccgatgagatccgaagagcaggcgaaatccaacgcgaactccagcagctgcggcaggagaataataggctgcacaacgaaaaggccctccgtaaacagatgctcaaacagaggttggaggaaagtagacgtaaaagacaggagaacaaggagaggcgggagaagcagcgaaaagagaaatccgaggcttggaatcaaaagaagcagcacgagattatttacctgggagaaggagtgagcggtgggctgaataacacagaaggcaaccaagagagacttcagtcttacggcttgcctctgggggacacacccgagcagattgccgccatgatgggcattagcatggggaaacttagatttctcgcattcaaccgaaaggttagtacagtgagccactatataaggtttaagatccccaaaaagacggggggcgaacgcctgatctctgcacccatgccatccctgaagagggtgcaacactggattcttgaaaacatcctcaaccaactggaagtcgacgatgcagcccatggtttcagacgtgatcgatcaattgttactaatgccacaccacatgttggagcggatgtaatcatcaacttcgaccttaaagactttttccccagtatctcatataagagggtcaagggccttttccactcatttggctacagtgaggctgctgcaacaatttttgcgttactgtgcactaccgccgagttcgaggaggtcgaattggatggcaaaacatactacatcgccctggatgagcggcacctgccacaaggttcaccggcatcccctgctataactaacctgctatgccgccggctagacagacgcctgaccggaatggccaagaatctgggttttacgtacactcgatatgcggatgacttgactctcagcggctgcggcaattctctgcggcacatctgtaacatcttgcggcgcaccgactctatagtggcccatgaagggtttaccatcaaccaggaaaagacccggatcttacgcaattgtcatcagcaggaggtgaccggggtggtggtcaacgataaacctaacgtatccaagaagaccttaaaacaattcagggccactctgtatcagattgagaaagacggactcgaggggaaatcgtggggaaatagccatgacattatagctgccattacagggtttgcaaatttcgtagctatggtgaatccacaaaagggagctgagtttcagcagcaggtgaagaggataaaacagggcgtccgctcccagaacaccggagtgagaaatcaggaaagcgaatga

SEQ ID NO: 13413 - RNA, 1707 nt, unidentified
  source 1..1707: mol_type = other RNA; note = synthetic construct
atgagccagcaacctcgtacaagacaggaactttacgatctgatcagatctaggggggggaaaagagaattcgtgctggaagaaatgatcagactggggttctggccccaacagggtacactgcccgaggaccctgctgacgagatcaggcaggaaggtgagattaggagggaattatccgagctcagaagggagtcgtctaggctgcacagtgagaagcagctgcgcaaacaagccctcaaacagcgctggagtgagtctaggcggaagcagaaagagactagagagagacgggaacgcgaacggcaagagagagctgaagcctggcaacaacagaagcagagagagattatttatctgggcgaggaggtgagtggcggcctaaataatcaggatggcgaccgtgataggctccagagtcggggcctaccaatggtgaacaatgccgaggagatagcagctgcaatgggaattacggtcggtgagttgaggtttcttgcatttaaccgcaaggttagtagcctctcacattacatccggttcaagattcccaaaaagagggggggagagagactgataagtgctccaatgccgcgcctcaaacgagtgcaacactggattctgcgtgaagtgctggagaagattgaggtgcacgaggcagtccatggattccgacgggatcgcagtatcctgactaacgctcggccccatgtgggggcagatgttgcgatcaactttgacctcaaggatttcttcccgactatctcatacaagcgcgtaaaaggccttttccgctcattcgggtactccgaagccgccgccacaattctgggacttttgtccaccgaagctgaccttgaagaggtcgagctggacggaaagacatactttgtcgcctccggtgatcgtcacttgccgcagggcagccctgcatctcctgctatctctaatattatctgtagaagactggaccggaggctgagcgggatggcaacatcactgggatttacgtatactcgctacgccgacgacctcactttttctgcctccggggaaaacaacttaagatcactctgcaatttgctgcggaggaccgaaagcattgtgacccatgaaggctttatcatcaatgatgagaaaacccggatcatgcggcgaaagtcctcacagctcgaagtcaccggtatcattgttaatgagaggcctaccatcgactccaaaacgttgcgacgatttcgggccacactgtatcacttggaaaaggatggcatccagggaaaatattgggggaactctcgtgacgttggcataatgctggcggtacaggggttcgcgaatttcgtaaacatggtacacccagaaaagggaaaagtgttcttggaacagatagataggattcgcgagaaatggaccctgaaggagacaaaaaagtcatcgccaacccctagcattagcctaccagtgatagaggagaaaacccccgaggcgatcccagaacagtcccttcccgacggcataatcttagaatgctacaagcagggcagcaagctcaaggtccgcgtgatctcccaaggctataacagctcttggaatgtgcagattccccgcaacttaatggccgagggagcccgatatagagttgaggagctgcgagaaagcgctgtgggtggcttttaccggactgtcggatccatacagaagctttga

SEQ ID NO: 13414 - RNA, 1698 nt, unidentified
  source 1..1698: mol_type = other RNA; note = synthetic construct
atgtccgagcaaccacgcacccggcaggaactctacgatctcattagatctaaaggttccaagcctgcattcgtgatcgaagaaatgatccggcttggcttctggcccgctgaaggtaccttgcccgatgatccagccgacgagatccggagagaaggcgaactgcttcgggaactgagtgaactgagacgggagtctagtagactacactctgaaaagcagctgcgcaaagaagccctaaaacagaggctgcaagaatcccgaagaaagcaacaagagatcaaggagaggcgggagcaggaacgccgggataggacagaggcctggcagaaaagaaaagagagagagatcatttacctcggagagggcgtgtccggtggtttaaatcaccaggatgggaacattgagaggctccagtcatacggactgcctatcctaaatgacgcagagcagatagctgtcgcgatggggatctctgtaggggaactgcgcttcctggccttcgacagaaagacagccaccctcagccactatatccggtttaagatccctaagaagaccggaggcgagaggctcatctcagctccaatgccaaggctcaagaaggtgcagcattggctgctgcacgaaattctggacaaagttgaggttcatgaagctgtgcacggctttaggggagataggagcatacttactaatgcggtgccccacatcggagcagacgttgtcatcaattttgatctcaaggactttttcccaactatttcctataagcgtgtgaaagggttgttcagggctctcggatacagtgaggcggttggaactatattagcactgttgagtaccgaggccgacgtcgaggaagtggagctggacggcaaaacttatttcgtggcccttggggatcgccatcttccccagggctctcctgcttctcccgcccttagcaatatcatctgccggagattagacaaacgtttgagtggcatggccgcaaacttggggttcacatataccaggtatgccgacgacctaaccttcagcgcatcgggggaaaatctgcgctacatttgcaatcttctccgaaggacagagagcattatcgaacatgagggctttgctatcaatgctgaaaaaactcgtatactgcgacggaagtccagccagttggaggtgacggggatagtggtgaacgagtatcccaacattgatcgaaaaacaatgaagcgctttcgcgccacgctgtaccagattgaacaagaagggattcagggcaaacaatggggacagtcaaataacattatgttgagcgtacagggcttcgcgaactttgtcaagatggtcaaccctcagaaagggcaagtgtttctggaacagatcgatagaatccgcgagaagtggaggctgggtgaatctaaggctcgttccgtgagcccacccccgatttcacctcccattatcgagcaggagatatcccaggagatcctgttagactccataatcctggagtgttataaacagggatctaagctgaaagtacgagtcatcagtgagggctacaaccctacttggaacgtacaaataccgagaaacctcatggaggaaggtgcccgataccgggtcaccgagatttcggagagcgccgttggaggcttttaccgcattgcaggcacaattgagaagctgtcaccatcatga

SEQ ID NO: 13415 - RNA, 1629 nt, unidentified
  source 1..1629: mol_type = other RNA; note = synthetic construct
atgagcgatcagccacgcaccagacaggaactgtacgacagagtacgggccatggggaaggagcagtttatcctggaggagatgatcaggtttggcttttggccagccgagggagagatgccagaggatcccgctgatgaaatacgacgcaaagcgcagattcagcaagagctcacacaactccggcaacagaaccggtctttgcaggacgaagctgctgcccggaagcgactgcttcaagaacggttggcagagtcccgccggaaaaggcaggaaacgaaggagaggcgggagagagaacgtcaggagagggccgccgcatggcgtgaacgacagcaacaggacattggatacctcggggagggagtgtcagctggtctgaacgagcgtgactgtcgcgaagaacgactgcaggcccgcggactgcccatcttaaagaatgcggcacagatagctgaagcaatgggaatttccgttggccagctaaggttcctggcttttaaccgtaaaaccagcaagatttcccactacgtctgtttcaacataccgaaaaaaacaggcggtgtgaggagaatatccgcccccatgccaaaacttaaggcggcacaacactgggtgttcgtcaacattttggagcgagtggaggtcggtgaggccgctcatggctttttacgcgacagatcaattgtgaccaacgcccagcctcatgtgggcgcggaagtgattatcaactttgacctcaaggattttttcccctcaatcagttataagagagtaaaagggctttttagggccatcggatatagcgaggccgccgccaccatatttgcccttctctgtaccgaggcagatactgtagcagtggaattggacggcaccacgtattatgtcgccactggcgaccgccatctccctcaaggtagtccagcgagccctgcattgtcaaatgtgctgtgccgacgcctggataaaagactgtctgccatggctgcagaatgcggcttcacctacacgaggtatgctgacgacctgactttctctgctagtggcgaaagcttgaggcacctgtgcaatattatgagacgcacagaggccattgttacacatgaaggctttgccatcaatcctgagaagactcggatcctgcggagaaagtctagccaaatggaggttaccggggtggtggtaaacgagttccccaattgcgatcgggccactttaaaaagattcagagctacactcttccacatcgagagggatggtatcgaggggaagcactggggcaattcgaataatgttcttgctgccatccaggggttcgcatcctttgtggctatggtcaatccagagaaagggcgggaatttcaggcccagatccaaaggatcaaagcacagatccagcctcagtctgtcactccgacaggaattatcgttgaatgttacaagaagggttcgcagctaaaggtgcgcgtcgtgagtcctggatacaacagcgactggaacgttcagttcccccgtaatctgagagaagagggcgcacggttcattgtcgaggaattacaggaggatgtgagagggggcttctaccgcgctgggggaaagattgaaaggatgaactccgaactttga

SEQ ID NO: 13416 - RNA, 1623 nt, unidentified
  source 1..1623: mol_type = other RNA; note = synthetic construct
atgtcagactcccctcggaccaggcaggaactgtacgatcgggtgaggcaagtagggcgtgagcagttcgtgttagaggaaatgataaggttcggtttctggcccgcccagggggagattcccaatgaccccgcggatgaaatcagacggaaaagtgagctacggcaggagctcaacaagctgaggcaggaatcccgaaccttgcaggatgagcaggccgctagaaggcggcttctgaaacagcggttggccgaatcacgccgcaaacgacaagaggcaaaggaacgacgcgagcgcgaacggcaagaaagagcagaggcctggcaggaaagacaggaaagggagatagtctatcttggcgagggtgtttccgctggccttaacgattgcgaggaaaacagcgagcgactggcctcaagaggactgccttctctcccaacggccgagcatatcgccgctgctatgggcatttccatcggccagctgcggtttctggccttcaaccggaagacttctacccacacacattatatccgcttcaaaataccgaagaagaccgggggcgagagactgatttcctcccccatgccaaagctgaaggctgtgcaacactggattctgtctcacatcttagagcgcgtagaggtagacgatgccgctcacgggttccgtcgagacaggtctattgtgaccaatgcccaaccccatgtcggtgcggatgttgtcattaacagagatcttaaggatttcttccctactatcagctacaaaagagtcaaaggcatctttcgatcttttggctatgctgaggctaccgctacaattctggccctgctctgtacagaggcagacactactgccgtggaactggacggcaaaacttactacgtggcactgggtgaacgccacctaccgcagggaagccctgcctctccagcaatttccaacatattgtgtaggaggctcgacaagagactgcgcgcgatggcaaatgagctcgagttcacatacacccggtacgctgacgatctcacgtttagtgccagcggagaaagtctgcgctatatctgtaacgtgctcagacgtagtgagtcgatcgtaacccacgaaggcttcgccatccatcctgaaaagacaagggtgctcaggcggaaaagtagccagctcgaagtcactggaatcgtggtgaacgaattcttgaattgcgaccgggcgacacttaagaggtttagagctacgctttttcagatcgagcgagacggattcgaaggcaaacattggggtaatagcactgacgcattggcatcagttcaagggtttgcaaactttgtggccatggttaacccagagaaggggaagaagtttcaggagcagattcaacgtattaaaaccaaatggctgaccccagagcccagcacaaccactggtatcatagtcgagtgctataagcagggatcaaagttaaaagtgagggtcgtgagcccaggctataatcccgattggaatgttcagtttcctcggaatctacgcgaagaaggggcccgtttccgcgtggaagagatcagagagacagcaaagggaggattttacagagttgtgggggacattgagaaaatcgattga

SEQ ID NO: 13417 - RNA, 1404 nt, unidentified
  source 1..1404: mol_type = other RNA; note = synthetic construct
atgactgaacagcctagaaccaggcaagaactatatgatcgaatccggcaaacaggcaaggaggaattcatcctccaggagatgatacggtatggcttttggcccgctcagggagagattccccaagatccagcagacgagatacgtaggctgggtgagttgaatcgtgagctgcagcagctgcatcagcagaaccggcagctgcataatgaagccgccctcaggaagcaacttcttaaagagcgcctggcagagtctaagcgcaaacagcaggaaaccaaagagaggcgcgaacgagagcgcaaagaaagagctgaggcatggaaggcccgaaaggagcaggatatcctgttcctgggacagggcgtatcaggcggactggataggcgagagcccaacctggagaggttgcagaatcagaaactccccgtgtttactacgccggaatctctggctagtgcgatgggggtcaccatcggacagcttcggtttctggccttccaccgccaagtcgcgaaaacctgccattacatcaggttctacatttccaagaagactgggggtcagagattgatatccgcaccaatgccccggctgaaacagctccagcactggatccttagatacatactcaaccctatcgccgtgaatgacgctgcccacggatttcggcaggggcacagcatcctcaccaatgccacacctcatgttggtgccgacgtggtagtcaactttgatttaaaggacttcttcccgtccatatcatataagagagtgaaggggctttttcaggccctaggatacggcgaggcaatcgcgaccattttggggttactctgtacttaccctgacgtggaagaggtggaactggacggcagcacgtattacgtggcaactggggatcgccatttaccccaaggctcgccagccagccctgctatttctaatatcctgtgtcggagattggacaggcgactcctgcaaatggctcaggagctaggattcacatatactcgctacgctgacgacctgacatttagcgccagtggcgataacctgagaaacatttgcaacctccttaagagaacagaagccattgcattgcacgagggatttgccctgaaccctagtaaaacccggatcatgagaaaaaactcacagcaagaggtgacaggcatcgtcgtgaatcagttcccaaatatttccaagagcaccctgaagcggttcagggcgactttatttcaaattgaacgcgatgggattgctggtaaaaagtgggggaattctaccgacacaatggccgctattcagggctttgcccacttcgtcgcaatggttaacccagaagttggtacgaaattcgtggaacaggttaagcagatccaagctcagaaccgtaattga

SEQ ID NO: 13418 - RNA, 1410 nt, unidentified
  source 1..1410: mol_type = other RNA; note = synthetic construct
atgtccgatcagccaaggactcgacaggaactgtatgataggatacggaagatggggcgtgaagctttcatcctggaggaaatgatcaggtacggcttttggcccgagcaaggcgagttgcctcaggaccctgcggacgaaattcgcaggaggtctgagctctatcggcaattaaccgagttacgccaaaaaaaccggcaactgcaggatgaacaggctatcaggagacagctcagaaagcagcgattagcggagagtcggcgcaagcgtgaagaaacgaaacagcgcagagaggaggaaagacaggctagggcccaagcctggcaagagcgccagcaacaagagatcgtttatctgggggaggaagtgtcaggaggactcggagaacagcagtccaatccttccgagcttgataggcatggactgccacagctggcaacagctgctgatatagcccaggagatgggcatcactttgggcgagttgagattctttgctttcgatcgcaagacagccactgtctcccactacatacggttcaaaatgcccaagaagactggcggtgaacgcctcatttccgtgccaatgccgcgattgaagagagcacagtactggatcctgagccaaatcctggaaaagatcccagtgcacgaagcagcgcacgggttctgtcgggatcgatctatcattacgaacgcctctcatcatgtgggggctgaggtggtcatcaacctggacctgaaagacttcttccctagcattagttaccgccgtgttaagggacttttcagaagtctagggtattcagaggctgtcgccaccatcctcgcactcatttgtaccgcccctgacgttgaagaagtcagtcttgacgggcagacctactacattgcacttaatcagagacatctaccccagggaagccccgcatcacccgcaatatctaatctcatctgccggcgcctcgacaaacggctgacacagatggccgacgagctgggttttacttacacccggtatgccgacgacctgacatttagcgcctccggcgatgtcctgaggaacatttgccgaattctgagaagaacagaaagccttatcaattacgagagcttcaccttgcacccagagaaaacacgcatcctgagacggaagtcatgccagttggacgtgactggtattgtagtaaatgaaggactgaacatcgatcggaaaaccctgaagaaatttagggccacccttcaccagattgagacgcagggtctagagggcaaacattgggggcactcgcgaaatgtgctcgcgtctatacagggctttgctaattttgtggccatggttaacccggagaagggcgcccagtttcaggagcaggtgggtaggattcgtcaaaagtatggcaggaactga

SEQ ID NO: 13419 - RNA, 1416 nt, unidentified
  source 1..1416: mol_type = other RNA; note = synthetic construct
atgtcagacaggcctcgcacccgtcaggaactgtacgagcggatcagaactatggggagggaggcatttattctggaggagatgattcggtacgggttctggcctgcagaagggacaatcgccgatgatcccgccgacgagattagaaggcaaggcgagctccagcaagaactcgagagactgaggcaagaaaatagaaggctgtatgacgagaaagctctgcggagggaggctctgaagcaacggctcgcagaaagcagaaggaaacagcaggaaacacaggaacgcagagagagacagcgtctcgaacgggcgcaggcttggcaacagcgacagcaacaagaaatcgtgtatcttggggagggagtctccggcggcctgtctgaatcccaatcacaccaggagcgtctgcagtcatacggcttgccgatatacgagacagccgccgatctggctgcggctatgggtatgtctattggacagttgcgtttcttagcttttaatcggaagacgtccaaggtatgccactacattaggtttaccattcccaagaagactggtggcgagcgactgatctctgcacctatgccccgcctgaaacaggctcagagttggatataccagcagatactcgccaaaattcccctggaggccgccgctcatggatttcgctgtgaccgaagtattctgaccaacgcccaccctcaccttgaagcggacgttatcatcaacctcgacttgaaagatttcttccccagcatcagctacaagcgagtgaaaggactgttcagatcttttggctactgtgaagcagttgccacgttactaggtctgatctgcaccgaggccgatttgacatccgtcgaactagatggtgttacttattatgtagccaccaccgaacgccttcttccgcaaggatcgccagccagcccagcgatatctaatcttatttgccggcggctcgaccggagactgacccaaatggctcaggacttgggatttacttacactagatatgctgacgatctcacgttctccgcacacgagccatacctgcagggcatctgtaacatcttacggcgcacagaggcaatcgtggcccacgagggcttgaccatcaatgatcagaagacaaggattcttaggaagaagagttcacagctggacgtcactggaattgtggtgaacggtgatcgacctagtctcgacaggaagaccttaaaacgcttccgcgcaaccctacatcagatcgagcagaacgggccaactggccagcattggggccatacagaaaacgtgatgagcgccatagccgggtatgctaattatgtcgcaagcgtgctcccagaaaaaggggccaaattccaggagcaggtgcgacacatccatcagaagtggcagcgcctgccctga

SEQ ID NO: 13420 - RNA, 1620 nt, unidentified
  source 1..1620: mol_type = other RNA; note = synthetic construct
atgacgaaccagccaaggtcccgacaggaactgtacgatttagttcggcaggtgggtaaacaggaattcattttgcaggagatgatcaggtatggcttttggtcccccgagcaggagacacaggaggatgtatcagaggaactgcgccagcggaaacaacttcagcaggaattgtcacagttgcgccaggaaaacagactccgccaggacgaacaagccctgagaaaacacctcttgaagcagcggttagcagagtcaaggcgtaaacgtagagaaacaaaggaaagacgagagaaagagcgacgggaacgagccgaagcctggcaggagcaaaagaagcgtgatctggtttatctgggggagggtgtgtctgccggcctcaacaatactgaagcaaatctggccaggcttcaatctaacaaacttcccgtcctgtcgacagcggccgagatcgctactgctatggagatcaccgtcgggcaactccgatttcttgcattttctcggcgcacttcccaaatctcccactatatcaggttcaagattcccaagaaaaccggcggcgaacgcctgataagcgccccaatgccgagactcaagcaagcccaacactggattttgaccaagatacttgaaaaaatcgagccccatgcagctgcacatggtttccgccaggagcggagcattatgacaaacgcccaacctcacgttggggccgagattgtcattaacttcgatctgaaggacttttttcccagcatctcctacaaaagagtgaagggcctcttcaggagttttggatacagcgaggccgccgcaacaatcttcgctctgctgtgtacacagcctgaaattgaagaggttgagctggacgggaagacatactatgtggctcagacggagaggcatctaccacagggctcccctgcgagtccggcaataaccaatctgctgtgtaggcgcctggacagacggcttacccggatggcccaggagctagattttgtgtacactagatacgctgacgacctcacctttagctgcgggtcagataaccccagaatttgcaatctactgaggcgtgtggaaagcatcgtcgcccacgagggtctgacaattaaccaggaaaaaactaggattttgcggaagtctaggcaacaggaagtcaccggaatagtggtgaatgagtacccaaatatcgaccggaaaactctgaaacgcttcagagcaaccttatttcagatggagaaagatgggatcgcaggcaagaagtggggcaattctgatgacgtcctcctcgccatcgctggattcgccaattttgtgaaaatggtgaaccctgagaagggagctgcttttcaggcgcagatacaaagaattagacagaagtggctcggagagatccctgacaccactgacacctcgcctcagggtataatcgtggaatgcttcaagcaggggagtaagctgcgcatgcgggtgattagcccaggctataatccagattggaaggttcagttccccaaggctttacgagaggagggagcgaggttcctggtagaggaaatccaggagagtaacggattctatcgtacggtaggcgaaatccgcaaactttga

SEQ ID NO: 13421 - RNA, 1422 nt, unidentified
  source 1..1422: mol_type = other RNA; note = synthetic construct
atgactgaacaacagccccggacacggcaggagctttacgatcgcatccgtcagacctctcgcgaggaggttattctcgaggagatgattcgcctcgggttttggcctgcggagggtgaaatccccgctgaccccgctgacgagattcgcagaaggggggaaatagaaagagaactgagcgagctctacaggcagaacagacagctccacaatgaaacctacctcaaaaagcaggtgtacttgcagcgactggaggaatctaaaaggaagagacaagagaacaaggagcgacgtgagagagagcgacaggaacgagcagaggcatggcgtcagcggaaggagcaggagatagtctacttaggcgaccgcgtgagcgccggacttaacgatacggagtataaccaggagaggctggaaagctattcacttcctgcttataacacagcccaggagattgccgacgctatggggattagtatcggcgaattaagattcctggcattttctcggaagacttcccttatcactcactacgtcaggttcaagatcccaaaaaagaaaacaggggaccgcctgattagtgcgcccatgcctagactcaagaaagcccagcattggatcctgaacaacatcttggagaaaatccctctccacaacgccgcccacggctttagacctggacatagtatcgttacaaacgcccaaccccacataggtgcagaagtgattatcaacttcgacctgaaagactttttcccatccatctcctataagagagtgaaaggtctattccagtccctgggatacagcgacatcgctgctaccatctttggtctaatctgtacagagccagaggtagtggaagtggagctggatggcaaaaattattatgtagcactctccgagaggcatctgccacaaggggcgccgacctctccagctattactaatatcatgtgccgccggttggacaggcgattagaacagatggcccagaagttgggctttgtgtacactcgctacgccgatgatctgacgttctcaaccagcggcgagttcaggcggcatatttgcaatattcttaggcggacagagtcaatagttgatcacgaggggttcgtaatcaacgaagagaagaccagaatcatgcgtaataccaatcagcaggacgtgactggcgtggtcgtgaacagcaaactgaatgtcgataagaaaaccttgaagcggtttcgggcaacgttatatcaaattgaaaaggatggactggaaggcaagcactggggccattcggggaatctgctggcctcaattcaaggattcgtgaattacgttgccatgataaatccggaaaaaggcgcagaatttcaagctcagatagaacgcattaaagaaaagcacggaaggggaaagaagagtgtctga

SEQ ID NO: 13422 - RNA, 1401 nt, unidentified
  source 1..1401: mol_type = other RNA; note = synthetic construct
atgactgaccaaccccggaccagacaggaattatatgaccgtattcgcgaaacaagcagagaggaagtcatcctcgaagagatgatccgcctgggattttggccggctcaaggggaaattccccaagatcccgctgatgagattagacggagaggcgagctgcagaaagaactcaatgacctgtacaaacagaatcgccagctcaacgatgagaaccttctaaagaaacagctgtacaagcagcgcctcgccgagtcacgccgaaaaaggcaggagacaaaggaaaggagagagagggagaggctcgaacgcgcagaagcctggcgtcaaaaaaagcaacaggacatagtctaccttggcgatcgtgtgagtggaggacttaattacaccgattgcgacgaacagaggctacagagctatggcctgcccatctatgggaccgcggagcaaattgcaaccgcaatggggattaccatgggccagctgagattcctggcctttagtaggaaaacgtcaccaatttctcactatatccggttccggatacctaaaaagactggaggagatcgaatcatctctgctcctatgcctcgcctgaagaaggcacaacactggatccttaataatatcctggagaaggtagagttgcacaacgctgctcacggattccgcccaggtcggagcatcgtgagtaacgcccagccacatattggtgccgaggtggtgataaacttcgacctcaagaatttctttccttcaattagctaccagcgcgtgaagggcctgtttatttccttggggtactccgaagccgccgcgactatttttagcttgctgtccacggagcctgacatagaagaggtggaattagacggaaaaacatattacgtagccttgtcggatcggcatttgccacagggcgctcccacttctccagccatcacaaacatcctctgcagacgacttgataggaggctgacacagatggctgaaaatttaggtttcacgtatacccggtatgccgatgacctgactttttccgcgtccggtgataatagaaggcacatttgtaacgttctgcggagaaccgagtcaatcgttgagcatgaggggttcgtgataaacgaggaaaagactcgtatcctgcgaaactctcggcagcaggacgtcaccggggtcatcgtcaacgacaaaccgaacgttgacaaaaaaacactgaagcgatttcgggccacactataccagattgagaaagatgggctcgagggcaagaggtggggcaatagctctgacctgatcgcaagtatccagggctttgctaatttcgtggcaatggttaaccccgaattgggcgcagagttcaaggaacaggtgaagcgaataagagagaagtacaagtga

SEQ ID NO: 13423 - RNA, 1413 nt, unidentified
  source 1..1413: mol_type = other RNA; note = synthetic construct
atgtccgatttgccacagccgcggacccgccaagagctgtatgatcggattcggcagacttcacgggaagaggttatcctcgaggaaatgataagattgggcttttggcctgcagagggaactgtgccagaggatcccgccgatgaaataagactcaggggggagatttggagagagctgagcgatctatacaaacaaaatcgcacccttcataatgaagccgagctcaagaagcaggtctatcagcagcggcttgccgaaagtcgccgaaaaagacaggaaacaaaggaacgaagagagcgtgagcggctcctacgtggcgaagcctggaggcagaaaaagcagcaggatattgtttatctgggggatcgtgtgtccggaggcctgaattataccgagtgtgaccggcagcgactccagtcatacaacctccccgaatatggcaccgctgagcagatcgccgcagccatggggattaccataggccaactgaggtttcttgcattcgatcggaagacttccactgtgtctcattacgtgcgctttaagattcctaagaaaactggaggggacaggataatcagcgcccctatgccgaggttaaaacaagcacagtactggatcctgagcaatatcctcgaaaaggtcgagcttcacgacgccgcgcatggttttagaccaggacgctcgatagtttctaacgctcaacctcatgtcggagccgaggtggtgataaacttcgacttaaaggatttcttcccatccatttcttaccagaggattaagggtgtgtttagaagtttcggctattccgaggcggctgctacgattttcggactgttatgcactaaacccgacatcgaggaagttgaactggacggcaagacgtactacgtcgcgctctcagagaggcacctgccacagggagctcccaccagtcctgccatcacaaacatcctgtgccggcgcctggaccgtaggttgtctggtatggccgagaacattgggttcgtgtacacaagatatgctgatgacctgacatttagtgccagcggagataacctgcgccacatctgtaacattcttcgccgaacagaatctattgtggctcacgagggcctggcaatcaatgaggaaaaaaccaggatcctgcgcaaaagcgggcaacaggaggtcacgggggtagtagtcaacgaaaaacccaatgtagacaggaaaatcctaaagagatttcgagcgaccttgtaccaaatcgagaaggacgggttggagggcaagcactggggtaattcacccgacctgatcgctagcattcagggttttgccaatttcgtggctatgatcgaccctcagcagggcgcagcattccagcagcaagtgcggagaatccgagaaaaatacaggtccacatga

SEQ ID NO: 13424 - RNA, 1404 nt, unidentified
  source 1..1404: mol_type = other RNA; note = synthetic construct
atgagtgaccaaccacgaactcggcaggaattatacgaccgtatacgccagatgggaaaagaagagtttatcctcgaggaaatgataagatatggcttctggcctgcgcagggagagattccccaggatcccgccgacgacataagacggatgggtgagatccgccgcgagctagacgagctgcgacagcaatcctcaaggctccacaatgagaaggagttgcggaagcagctcctgaagcagagattggcagaatcaaggagaaagaggcaagaaacaaaggaaagacgagagcgagagcgccaagaaagagccgaagactggcggcagaggaaagaacgcgagattctttacctgggcgaagatgtaagcggtggcttgaattacaccgagtgcgatgaagagagactgcggtcgtacggcctgcctctgtgtggaaccccctacgagatcgcagccgccatgggtattaccgtggggcagctccgcttcctggctttctctcgtaaaacttctacgatctcccactacattaggtttaagattcccaaaaagacagggggcgagcggctgataagtgcccctatgccgaggctgaagcaggcccagcactggattcttggaaacattttggagaagctggaactgcatgatgccgcacatggtttccggcgcgaccgctctatcgtgtctaacgcacagccacacgttaagcgggatgtgatcatcaatttcgatctgaaagactttttcccttcaatctcctacaagcgggtcaagggattattccatagttttggttattctgaagctgctgccacaattttcggccttctctgcacgcagccagacatcgaggaggttgaactagatggcaaaacttattatgtcgctctgaccgaaagacacctgccacaagggtcacctgcttccccggctattacaaacctcatgtgtcgcagattggatcgccggctcacatccatggctgatgaactggggtttgtctacactcgttatgccgacgatttaacctttagtgcaagcggcgactcactaaggaatatctgcaacatccttaagagaacccagagcattgtcgcacatgagggcttcacaatcaacgagcagaaaacccggattctgcgtaaaaatagacagcaagaggtgactggcgtcgtggtgaacgattaccccaacatcagcaagaaagagctgaaaaggtttcgagcgaccctctttcagattgaaaaggacgggcttgagggaaagcactggggaaattccaataacgtgatgagcagcatacaagggtatgcgaacttcgttgccatggtaaatccacagaaaggggtggagtttcaggaacagatcaggaggatcagggacaaatatcgatgttga

SEQ ID NO: 13425 - RNA, 1413 nt, unidentified
  source 1..1413: mol_type = other RNA; note = synthetic construct
atgtctgaccaaccccgaactcgccaggagctgtatgaccgggtccggcaaattggtaaagaacagtttatcctggaggaaatgatcagatacgggttttggcccgcgcagggggaaatccctcaggatcccgctgatgaaatcaggaggcgcggagagttacagcaagagctgaacgccctgaagagcgaaaacagacagttgcacaatgaacaagccttgaggaaacaaatgctgaagcagcgacttgaagaaagccgacggaagaggcaagagacgaaggagcggagggagcgcgaaagaatcgcaagaaccgaggcttggcggcagaggaagcagcaagaaatcccctatctgggcgacggcgtctcaggtggactgaattacaccgactgtgatgaagagaggctacaggcctacgggctccctgtctgccagacaccagagcagattgcctctgccatgggaatttctgtgggtcagctgcgctttctggccttcagtagagatacttccactatctcgcattatatcagattcaagatcccaaagaagactggaggagaacggctcatctccgcaccgatgccccgtctgaaaaatgcgcagcactggatacttgttaacattttggaaaagcttgagctgcatgacgctgcacacggcttccggcgggataggagcatcgtgtccaatgcacagccgcacgtgggagccgacgtgattataaacttcgaccttaaggacttctttccatctatttcttacaaacgggtaaaaggcctcctacagtcctttggctacagtgaggctgccgccaccatcttcggactattatgcacacaggcacaggtggaagaggtggagctcgatggtaaaacctattacgtggctaccacagaccgccatttgccacaaggctcccctgccagccctgccatttctaacctcctgtgtagaagactcgatcgcaggcttatgggcatggctgagcagctcggctttgtttatactcgttacgctgacgatctgacattttcggcgagtggagaaagtctgtgcaatatctgtaatgtcctgcgaagaaccgagtcaattgtagcccacgaggggttcgctattaatgagcagaagaccagaattctgcgcgggaagtcatcccaactcgaggtgacaggtatcgtggttaatgaacgtccaaacataagcaaaaaagagttgaagaggttccgcgcaacgttataccagatagaaaaagacggccctgaaggcaagcattgggggaacagctcagatgtgatggccagcatacagggcttcgcaaactttgtcgctatggtaaaccccgagaagggggcggagttccaggagcaggttcagcggattaaagagaaatatgggcgtcgccgatga

SEQ ID NO: 13426 - RNA, 1410 nt, unidentified
  source 1..1410: mol_type = other RNA; note = synthetic construct
atgagtgatcaaccgcggacacgccaggagctgtatgatagaattcggcagataggccgggaggagttcatcttagaggagatgataaggtacggtttttggccagcccagggaaccattccagaggacccagcagacgagattagacgtcgtggggaacttcagcgggagctggggaagctcagggaagagagcaggattctgcacaatgaggaagccctgagaaaaaggttgctgcaggaaagactggcagagtcacgcagaaaaagacaggagactaaagagcgaagagagaaggaacggcagcaacgagccgatgcctggcgtgagaaaaaggcccaagaaatcacttacttgggcgagggggtgagcgggggactgaacaacacagacggggacgaggaacgacttcagtcttacggtctgccgatctgcggaaagactgcccagatagccacagctatgggtattactgttggggagctgaggtttttggcatttagcaggcaaacctctactatcacccactatatacgcttcaaaatacccaaaaagacagggggggaaagactgatctcagccccaatgcctaggctgaagaatgcccagcactggattctcaataatatcctcgagaaactagagctgcatgacaccgcgcatggcttccggcataaccggtctatcgtttccaatgctcagcctcatgtgggtagtgacgtgatcatcaacttcgacctaaaggatttcttcccttctatttcatacaaacgcgtaaaaggcctctttcattccttcggctacagtgaagccgctgcgacaatttttggtctgttgtgcaccgagcccgaaatcgcagctgtggaactagatggtaaaacgtattacgtcgcactcacacaccggcaccttcctcagggaagccctgctagtcccgctatcacaaacctcttatgtcgaaggctggaccggagacttagcgaaatggcggaaaatctgggctttgtgtacacgcgatacgcggatgatctcaccttttccgcctcaggcgactcgttacgtcacatttgtaatattcttcggagaacggagagcattgtcacccacgagggctttgcaattaatcccgaaaagactcgaatcctccgcaagaaccgccagcaagaagtgactggaatcgtggtcaacgagaagccaaccatcgccaagaaggaactgaagcgcttccgcgccaccttgtatcagattgaaaaggacggaatcgctggcaagcagtggggaaattccgatgatgtcatggcttctatccaaggctatgcaaacttcgttgctatggtaaaccccgaaaagggagccgagttccaggaaaaagtgaggaggataaaagagcgctatggcgcaaactcctga

SEQ ID NO: 13427 - RNA, 1401 nt, unidentified
  source 1..1401: mol_type = other RNA; note = synthetic construct
atgaccgaccagcctaggacaaggcaagaactttacgacagaatcagggagatcggcagagaagaattcattctggaagaaatgatcaggtacggcttttggcccgctcagggggagattcctcaggaccccgctgacgagatccgaagagagggagaaatccgacgcgagctcaacgagctacaacagcagagtcggcaactccagaacgaaaagactctacgtaagcaagccctgcagcagcggctggccgaatctcgacgcaagcagcaggagacaaaagagcgccgggagagagagagacaacagaaagcggaaaactggcagcagcggaagcagcaggagatcctctacctgggcgatggcatttcagggggtctgaacaactttaatgccgaaattgagaggttgcaatcttacgggttgccgatatgcaataccgccgagcagatcgccgcagctatcaacattaacattggcgagctccggtttctggccttcagccgtaaaactagcactatcagtcactatatccgtttcaagattccaaaaaagaccggcggagatcgcctcattagcgctcccatgccaagacttaaaaaagtgcagcattggatacttgacaacatcctggagaaaatggaattgcacaccgcagcccacggttttaggcctcatcattcgatcgtgacgaacgcgctcccccatgtgaaggcggaagttatcataaatttcgacctgaaggacttttttccgtctatctcatacaagagagtcaaggggttgtttcagtccttcggatacgcggaagctgccgctacaattttcggactgttatgcacggagcccgagattgaacaggtggagttggacggaaaaacctattttgtcgctttaacagagcggcacctgccacaaggttcccccgcatccccagccattactaatctgctgtgtcgccggctggataataggctgaccacaatggcagaagacatgggcttcgtatatacacggtatgccgatgatttaaccttttcagccagcggggacagtctccggtacatatgtaacatcctaaagcgaactgagtctattgtcgcacacgaggggttcaccattaatcagcagaaaacgaggatacttcgaaagaatagacagcaggaagtgactggtattgtggtaaacgatagacctagcatatcaaagaaggagcttaaacgcttcagggcaacactgtatcaaatcgagaaggatggacctgaggggaaacactggggcaattccagcgatgttatcgcatccatccagggctttgccaatttcgtggctatggttgatccagaaaagggacgcgagttccaaaaacaggtcaaacagataaaggaaaagctccgctga

SEQ ID NO: 13428 - RNA, 1398 nt, unidentified
  source 1..1398: mol_type = other RNA; note = synthetic construct
atgactgatcaaccgcggacccgccaggaactctacgaccgtatccgatcaactagcaaggaagaatttatactggaggagatgatcagatttggcttttggcccgcgcagggcgaaatacccgaagatccggcagacgagattcggcgtatgggcgaaatccgcagggagttagacgagctgagaagggagaactctctgctgcacaatgagcaggcccttcgaaaggagatgctgaagcagcgcctgattcagtcaaggcagaagcagcaggaaacaaaagaaagaagagagaaagagcggcaggagagagcggaaaattggcaacagagaaagcagcaagaaatatgctacctgggagatggggtatctgctggcctgaacaataccaactgcaacgaagaacgtctgcagaattaccaactaccactttgcaatactgccgcagagatcgccgccgcaatggagatcagcgttggccaattaaggttcctggcctttgaccgaaagacatctcatatctcgcactacatccggtttaagattcccaaaaagacaggcggcgaacgcctcatttcagcccctatgccaaggcttaaagcagcacagcactggatcctcgtgaacattctcgaaaaactggagctgcacaattgtgctcatggattcaggtcttcacacagcatcgttacgaatgcccagcctcatgtgggttccgaggtgattatcaactttgacttgaagaacttcttcccctctatttcctacaaacgggtgaaagggctctttcagtccttcggatatagtgaagcggcagccacaattttcggattgctgtgcacggagcccgagattgaggaagtggaactcgattccaagacctattttgttgccgtgaccgagaggcacctgccacaagggagtccagcttctcctgctatcactaacatcctatgtagaagactcgaccaacggttggatcgaatggcttcggagctcgggttcgtctataccagatatgctgacgacttgacattcagcgcttccggggactccttgcagaacatctgtaacattctgcgccataccgagagcatagttgcccatgagggatttgtcatcaacgaagaaaagacacgcattctaaggaagaatcgccagcaggaggtcactggcattgtggtgaacgaacacctgagtatcagcaaaaaagtccttaaacgcttccgggcaaccttattccagatagagaaggatgggcctgatggtaagcgatggggtaatagcgaggatgtcattgccagtatacagggattcgccaacttcgtggcgatggtgaatcctgagaaaggtgctgagtttcttgagcaagtacagaggatcaagaataaacggtga

SEQ ID NO: 13429 - RNA, 1404 nt, unidentified
  source 1..1404: mol_type = other RNA; note = synthetic construct
atgaccgatcagccccgcacacgccaggaactgtacgagaggatctggcagataggcagagaggaggtcatcctggaggagatgattcggtacggtttctggccagctcaaggtgagatcccacaggacccggccgacgagattagaagaaaaggcgagattcggcgggagttggatgaactgagacgcgagacgtcccgattacagaacgagcaagctttacgaaagcagatgctaaagcaacgcctagccgaatcaaggcggaaaagacaagagacaaaggaacgtcgagagagggaacggcaagaacgcgcccaggcctggagggaaaagaagcagaaagagattatttatctcggcgaggatgtcagcggaggcctgaatcggaccgaaggaaatctggagagacttcaatcaaacagtttgcctccctgccaaacagcagaagacatagccggcgcaatggggatctccgtaggtgaactgaggtttctcgcgtttgaccgaaagacatctaccacttcccactacatccgttttaagattcccaaaaaaaccgggggagagagattgattagcgcacctatgccccggttaaagcgcgctcagcattggatcctgtcaaacattctcgagaaactggagcttcacgacgccgcacacgggttcagaagggagcggtcaatactgactaatgcccagccgcatgttgctgccgatgttatcattaacttcgacctgaaggacttctttcccagcatttcttatcgccgagtgaagggcctcttccagagttttggctattctgaatccgcggggaccatctttgccctgctttgtacagagccagagatcgaagaagttgagctcgacggaaagacgtacttcgtggctattagtaataggcatctccctcaggggagcccagcatctcctgccattactaatttgctctgccgacgtctggatcggaggctggtccagatggcacaagagctggggtttacctacactcggtacgctgatgatctgacctttagtggcgctggtgaatcgctaaggcatatctgtaacatacttagaagaaccgaatccatcgtggcccacgaaggctttgctatcaacgaacagaaaacacgcatacttaggaagaaccggcagcaggaagtgacaggaatagtggtgaacagccaccccaacatctctcgcgagacgctgaagcgcttcagagccactctgtatcagatcgagagggacggactcgagggtaaacactgggggaatagcgatactctcctggcctccttgcagggattcgctaatttcgtggcaatggtaaatcctcagaaaggcgcggaattccttgaacagatccagcgtatcaaagagaagtatatgttgtga

SEQ ID NO: 13430 - RNA, 1416 nt, unidentified
  source 1..1416: mol_type = other RNA; note = synthetic construct
atgaccgaccagccgcgtacccgccaggaattatacgataggattcgccaggttggtcgagaagagtttatcctcgaggagatgattcggtacgggttctggcctgcccaaggcgagatgcccgaggatcctgccgatgaaatcaggcagaggggcgagatacagcgagagttgaatcaactaagataccagaatcgcaacttacacaatgaacaggccctgagaaagcagatgctcaaagaaagactagccgagagtaggaggaagcagcaagagacaaaggagagacgggagcgggagcgtcaagaaagagcagcggcgtggcagcagcggaaacaacaggaaatcctgttcctcggggagggggtcagtggagggctcaaccagaccgaagccaatcgggagagactgcagtcctacggcctgcctgcgtgggaaaccgtcgagcaaatggccgccgctatgggcgtgtcagtgggagaattgcgcttcctggccttctcaaggcccgctgccaaaatctcccactatattcgcttcaagattcccaaaaagaccgggggtgaaagactgattagcgcccccatgccacggctgaaaaaggtccagcacggaattctggaccggatcctttcgaagatcgagttgcatgacgccgtgcacggatttaggcgaactaggagcattgttagcaacgcccgaccccatgtgggcgcagaagctattgtgaactttgacctcaaggacttctttccttccatctcttaccaacgggtgaaaggcctttttcggagctttgggtacgcagaggccacagcaaccatcttggctctgctgtgcacacagccagagatcgaagaagtgcagttagatggccaaatctactgtgtcgcgattggtaatcgccacctgccacagggtagtcctgcttctcctgcgattagcaacctcctttgtagacggctggatcgcaggcttatgggcatggcaactggttttgggttcacgtatactcggtatgctgatgacttgacattcagtgcttctggagaaaatcttcgccatatatgccgaatactgcgccgaacagaatctatagtagctcacgagggatttactatcaacgccgagaagactagaataatgaggaaacaaaggcagcaggaggtaacgggcgtggttgtcaatagccagccaaacattgccaaggagacactgaagagatttcgtgctaccctctatcagatggagaaagacgggccggagggcaaacattggggcaactccaccgacgccatcgcatccatccagggattcgcaaacttcgttgctatggtgaatccatcaaaaggagcaaagctgcaggcacaggtgaaacgtatcaaggaaaagtatggtagaaagtcagctccctga

SEQ ID NO: 13431 - RNA, 1401 nt, unidentified
  source 1..1401: mol_type = other RNA; note = synthetic construct
atgtcagagcaacctcgcacgaggcaggagctatatgaccgacttcggcagtccagcaagcaggaatttatactggaggaaatgattcgtctcggcttctgggctactgccgaacagatcgctattgatccaaccgatgagatgaggaggctgggagagatcactagagagttgcagcagcttcggcaagaaaatgcaagactggggaatgagaagaaactccgacaggagttgctgaagcagcgccttgcagaatctaaacgaaagcagcaggagacaaaggaacgccgcgagagagagcggattgaaaaagcacagaagtggcaggaacagaagcagacagggatcagttacctgggagcggaagtcagcggcgggctgaacaacacagagtcgaacgctgagcggctgtctaactatgggctgcccagacttgaaaatgccggtcagatcgccgcagccatgggcatatcagttggccagctgcgctttctcgctttctcccggaagacctccaccatttgccactatatccgctttaccatccctaaaaagaccggcggatcacgcagcattagcgcaccgatgcccaagctcaaagagtctcagaaatggattttagtgaacatcctcaacaagctggagctacatgaggctgcccacggctttagacgtgaccggtccattgtgagcaatgcgctgccacacgtgaaacaagatgtgatcatcaatttcgacctcaaagactttttcccatcaatctcgtaccgcagggtaaaggggttatttcaatctttgggatatagtgaggccgccgcgaccatcttcggactgctgtgtacagaattggaagtcgaggccgtggaattagacgggaagacttactacgtggctaacagcgacaggcatttgccgcaaggcagtcctgctagtcccgccattactaacctgctgtgcaggagactggatcgtaggttaactttgatggccgaaaacctcggtttcacatacacacgatatgcggacgaccttacgttctccgcaaccgggtctaacctcagacacatatgtaatgttctcaaacggacagaagatatcgttaatcatgaggacctaaccataaatcagcagaaaacccggattattagaaaaagccgacagcaagaggtcaccggagtggtggtcaactcccaccccaatatcgctcgggagacgctgaagaggttcagggcaactctttaccaaattgaaaaggatggtctggagggcaagcactggggcaacactacagatgttatggccgctatccaaggatacgcaaatttcgtgaaaatggtaaatcctgccaagggtgccgagtttatcgcccaggtcgaaagaataaagcataaatatccatga

SEQ ID NO: 13432 - RNA, 1413 nt, unidentified
  source 1..1413: mol_type = other RNA; note = synthetic construct
atgagtgaccagccccgtacaaggcaggaattatatgatcgcattcgggagatcgggaaagaggagttcgtactggaggagatgattagatatggattttggccagccgagggcgaaatgccagaagaccctgccgatgagatcaggcgtagaggcgaactgcagcgggagttggcccagctacgacaggaatctcagaagcttcaaaatgagcaagcggttcgtaagagattgctcaaggagcgactggcccaatccagactcaagaggcaggaaaccaaggaacgtagggagcaacagcgacttgaaagggcccaggcttgggctattcggcagcagaaggagattctgtatctgggtgaacaggtcagtcctggccttaatcacacggaatccgaccgcattagactacagacctacaagctgcctctgctatcaaccgcacaagacatcgcacaagctatggggatcgcccttggacagctgaggtttctggccttcaatagaaagactgctactatttcacactatatccggttcaagatcccgaaaaaaacaggaggagagcgcctgattagcgcacctaagcccaaactcaagcaggcacagcactggatcttgtccaacatcttagaaaaactcgagctggataacgccgcacatggctttaggcgcgataggagcatagtgacgaacgcccaacctcatgtgggggccgatgtcatcatcaacatcgacctgaagaacttctttccaagcatcagctacccccgcgtcaaaggactcttcagatcttttggatactcggaagcagctgctacggtgttcggtcttttgtgtactgaggcagacatagaggaggtcgagcttgacagcaaaacctactacgttgctaccagcgatcggcatttaccccaaggctccccggcatctccagccataactaatatattgtgccgccgactcgaccacagactcactacagtggctaccgacttgggctttatttatacacgatacgccgatgatctgactttcagtgcctcgggcgaaagtctgaggttcattgggaaactgctcaagcgcacctcatctgtggtcgcacacgaagggtttacaataaaccagcagaaaacacggattttacggaagagccagcagcaggaagttacaggtattgtagtgaaccatcacctgaacatctcccggaaacagctgaaacgctttagagcgaccctgtatcaaattgagaaggacggccccgattctaagcattggggtaactcctctaatgtgattgccgcgatacaagggtacgccaatttcatcgctatggtgaatcccgagaaagcggccccattccaggctcagatccagcggatcaaggacaaatggctctcaaatcagcactga

SEQ ID NO: 13433 - RNA, 1758 nt, unidentified
  source 1..1758: mol_type = other RNA; note = synthetic construct
atgaatacgaaccacttaatcacgataggcatcagcctttatcaggagaacaagtatagtgaggcgattgactgttttaaccagataattgccaataatcccaactccgctaccgcttaccactataggggactggtgcgtcggagacaacgcgatgaccagggcgctatcgctgacttacagaaagccgatacccttgtggccgacaaagaatacactaagctgtgcgagaaaatacagaacctgatcggaagggactacccacacaaatacaacaatgatgacaatcaggagttcgattacatcgagtacgaggataactggtacgctgacgaggatgagatcgcagcggcagaccctaactatatcccttcatccgagtttctgtcatgtgctgaggaggtttaccagctgatctcctacgagcttaaccagttcgagaattttctgagtaaccggctcaagactatcgacttactcagaaagaaaagagcggagaatagtaggtttaaccaagagcgactagagagcaaaaaccttcccatctataacagtcatgaggaaattgcccaggccatgggtatctctgtgaaaggtcttagattcctgactttctcacgaaaagggtatcactacattcgatttcaaattccaaagaagcccagcggataccgccagatatccgcccccaagaaattgttgaagaaagcccaaaattggattctggataacatcctggaaaaattggagcttcatgatgctgcacacggatttcgtctgaaacattctattgttaccaatgcgcagatacatgttggcaaagaagtcattatcaatatcgacctaaaggactttttcccgtctatcagctataaaagggtaaagggcttgttcaaatctttcggatattctgagacagcaagtaccatttttgctctgatttgcactgagccgaagatcaaggaggtagaaatcaatgggcagatcaattccctgctgagctggacggataggtacttgcctcaaggcgccccttcttcgcctgcaattactaacatcctctgcaggcggctggatagacggctgaattttatggcaaagcaatatggcttcgattatacacgctacgccgacgacctgaccttttccgcatccggggaaagcctggtgaacgtcaataacatcctcaagctcaccaatctcattgtcaagaaggaagacttcgagatcaatgagaataaaacccgggtggtccgcaattaccgcaagcaggaggttaccggaatcatagtgaatgagaagctgaacatcagcagagataagttgaaaacatttcgggccgtactctataagatcgaaaaagacggcttacagaactatacatgggggcaatcacaggacataattgccgcaattgaagggtttgccaacttcgtggctatggtgaatccagaaaaggggggcaagttcattgaacagatacaccggattaaggagaaatatgtgcgtaaaagagaaaagatcgtgctggtccatcaggaattcttgacacagagcaacattataaagcagattaacgagaaactccgcgaagtgaggtttaacaagattgaaaagcgacaatacctccaggaaacctacaataagaaatacctacaggaactgactgccgaggaactcctagaattcctgcactatcttattacactccagcccgaacagttctcattcggtgatacagacgatctgccattctga

SEQ ID NO: 13434 - RNA, 1695 nt, unidentified
  source 1..1695: mol_type = other RNA; note = synthetic construct
atggacaactaccaactcatcactatcgggattagcctgtacaaggagaataaatatagcgaagccatcgattgcttcaaccagataatcgcgcaagaccagaattcatccacagcgtatcactaccggggccttatctgcagaaaacagcgcgatgatcaaggagctattaccgatcttcagaaagcagataccctggtggcagaccaggagtacactaacatctgtcagaagatccagaacctaattggtaaagactatagccacagttctaacaacaaaaataacgacgaattctctgatatcgaatatgaaggcacctggcatctcgaacaggaaatttatgatctcatttcctccgagctgaacaagtttgagaatttcctgagttcaagattagagactatcgaacttctgcgaaaaaaaaggggggaaaatagtcagtttaaccaggaaaaattggaatcgaagcatcttcctatatacaatagccacgaggagattgcccaagccatggggatttccgttaaagggttgcggttcctggcattctctaggaaggacaatcattacataaggtttcagatccccaagaagccttcaggttatcgacagattagtgctccaaaaaagttactgaaaaaggcccaaaactggatcctagacaacatcttagagaagcttgaactgcataacgctgctcatggcttccgactgaaatattctattgtgaccaatgcccagattcacgtcgggaaggaagtgataatcaacattgacttgaaggacttctttccttcaatctcctacaagcgcatcaaaggcttgttcaaatcatttggatactctgaaacagctagcacgattttcgccctgatttgtactgagccgaaaattaaagaagtcgagataaatgggcagatcaacagcttgctttcctggaccgatcgttatcttccccagggagcaccaagctctccagctatcaccaacatcctatgcaggcgcctggataggagactgaactttatggcaaagcagtacggctttgactacagcagatacgccgacgacctaaccttttcggcatccggagaatcactcgtgaacataaacaatatcctgaagctgacaaacttgatcgtcaagaaggaggattttgagatcaatgagaataaaaccagagtggtacggaattaccggcggcaggaggtgacaggactgattgttaatgagaagctcaacatatctcgcgataagctgaaaacattccgtgcagtactgtacaagattgagaaggatggcctgcagaattatacttggggtcaatcccaggatataatcgcggccattgaaggcttcgctaattttgtcgccatggtgaatcctgaaaaaggcggaaagtttatcgagcagattcacagaattaaggagaaatacgtgcggaagagggagaaggtggttctggtttatcaggagttcttgacacagagcaatattctcaagcaaatcaacgacaagctccgtgccgtccgcttcaataaaatcaagaagcgccagtacctccaggagacgtataacaaaaagtatctccaagagttagctgccgaggaactcctcgactttctgcacttcctgataaattggcagcccgagcaattcagtttcgatgacactgacgaccccccgttttga

SEQ ID NO: 13435 - RNA, 1800 nt, unidentified
  source 1..1800: mol_type = other RNA; note = synthetic construct
atggacctcttcaacgagcctaggaagaagagcaatgtgcttatttacaaccgcaagtatcacgttatcaatatccttctcattaacctgcaatccgtggccttcaccaacaacatgaacactaatcacctaattaccattggaatctctctgtaccaggagaataagtactccgaggccatcgactgctttaacaagatcatcagtacggatagcaattgttgccaggcgtatcattataggggcctggtcctgcgcaagcaacgagatgatcagggggcaatagcagaccttaaaaaagccgacacactcattgccgatcaggagtacaccaacatcttccaaaagcttcagaacctgataggcaaggactattctcactttagtaagaacaatgacaacgatgagttttcttatatcgagtataaggggacttggcatctagaacaggaaatctacgacctgatatcatccgaattgaataagctggagaacttcctgtcctctcgcctgcagactatagaactgttacgcaaaaagcgggctgaaaactcgcaattcaatcaggagagattggagaacaaaaatctgccaacatataactcccatgaggaaatagcccaggctatgggaattagtgtcaaaggtttacggtttctttcatttagtcggaaaaatgatcactacattcgtttccagatccctaagaagccgtctggatataggcagataagcgcaccaaaaaagctactgaagaaggcccaaaattggattctcgataatatcctcgaaaaacttgaactgcatgatgcggcacacggattccgattgaagcactccattgtcacgaacgcccagattcatgttgggaaggaggtcatcatcaacatcgacctgaaagatttctttccctctattagctacaaaagggtgaaagggttgtttaagagcttcggttattcagagactgcatccaccatattcgccctgatctgcactgaggcgaagattaaagaagtggaaattaatggcgagattaatagtctgctcagctggacagaccggtatttgccccagggcgctccttcatccccggctattaccaatattttgtgtagacgactcgatagaaaattaacctttatggccaaacagtacggctttgactataccagatatgcagacgatctgacgtttagcgcttcgggggaaagcctggtgaatgtgaacaatatcttaaagctgaccaacctgatcgtgaaaaaggaagacttcgagataaacgagaataagacaagagtggtacgcaactaccgtcgccaggaggttactggcgtgatcgtaaacgagaagctcaatattcccagggataaactgaagacattcagagccgtgctctacaaaatcgaaaaagacggactgcaaaattacacttgggggcaatctaaagatatcattgctgccatcgaaggattcgctaatttcgtgagtatggtaaatccagaaaaaggtggcaaatttatcgaacagatacaccggattaaggagaaatacggcatcaaaaaggataagatttccgactactctccagttatcaggacacagtcatacatcatcaaccagatatactacaagttgtcaaagcttagctactcaaagaccaaaaggagaatgtatctgaccaaaacctacaacaagcggagcctgcaggagctcacagaagagcaacttgtcgagttcctcaactatctcaagaatctacagagttcctttgacgacttagacgagccccctttttga

SEQ ID NO: 13436 - RNA, 1704 nt, unidentified
  source 1..1704: mol_type = other RNA; note = synthetic construct
atggactttaatgatatcctgaatcgaggaattgacctgtataagtcacaaaagtacatcgaggctctcgaatgctttaatcagatcatatcccaggaccctaacagctaccaagcctatcactacaggggcctgattagaagaaagcagcgcgacgatcaaggcgctatcgcggatctgaaaactgccaacacactgatcttcgacggggagtatacaaatatctttgagaagatccaggatttgataggaaaagactacccacatcacagcaacaatgagagtaatgataatgccgacttcatctatatcgaatatggcgggacatggtacattgagaaggaaatctatgagtggatctcggcagacttgaaaaagctcgaatcattcctcagtaaacgccttgagaagatagatctcctgagggaaaaacatcgtcaaaattctcagttcaaccagcagaagttggaaagcaagaatctgccgatttataactaccatgaagaaattgcgcaagccatgggcatttccattaaggggcttcgattcctggctttttcaagaaagcactaccactataaccgctttcagatcccgaagaaaccaagtgggtaccgtcaaatttccgcccctaagaagttattaaagaaagcccagaattggatcttacacaacatactcgagaaaatcgaattgcacgtcgctgctcacgggttctgtctccagcgttcgattgtgaccaacgcacagattcatgtgggtaaagaagtgatcattaatatggacctcaaggacttctttccctccatatcctacaaacgggtgaaaggactctttaagtctttcggctatagcgagactgcctctaccatatttgctcttatctgtacagaacccaagatcaaagaggtcgagatcaacgaagagcctaaatacatcttgtcctggactgatcggtaccttccccagggggcaccttcttctcccgccatcacaaacattctctgcaggaggctggaccggaggctgactttcatggctaaagaatatggctttgattacaccaggtacgcagacgacctcacatttagtgcggccggagagagcctggtgcacattaacaatatcctgaaattgacgaacctgatagtaaagaaggaagacttcgagataaacgagaataaaacgagagttgtccggaattatcatagacaggaggtcaccggtatcattattaacgaaaagctgaacatcagcaaggagaaactgaagacgttccgcgccgttctgtataagattgaaaaagacggtctgcagaactatacttggggtaagtcccaggatattatcgctgcaattgagggctttgcaaattttgtggtgatggtgaatccagagaagggagccaaattcatcgagctaataaagcggattaaagagaaatatctgcggaaacgcgagaagtctgtcctggtaaaccaagagttcataacccagtaccacatcgtgaagcagattaattacgaattgaaggaacttcgattcaacaagaccaaaaaaagacagcatctgcaggagaactaccacaaggcatcattacagcagctaactgaggccgaactgcttgaattccttcattacctaaccaactggcaacctgaggagttttgctttagcgataccgatgatccagttcccttctga

SEQ ID NO: 13437 - RNA, 1458 nt, unidentified
  source 1..1458: mol_type = other RNA; note = synthetic construct
atgagttcttgtgacattaactgcatcatacaagacatcgaaggcagcatagaaggagaatttgaacagctggagggcagactgtctagacgtctgaagcattcacaggttttgcaaaagaaacgaatcaataacgcaaagtttgatccagaaaggttgcaatctaataatctccctctttgcaacagtcacgaggccatcgcattagctatggagatttctgttaaagggctgcgctttctggcattctccagaaaaaaacaccactacatcaggtttcagatcccgaagaagaccgggggcaatcgaaagatcagcgctccaacacatctcctcaaaaaggctcagaagtggatccttgagaacattctcgagaatatccagctgcatgaggctgcgcacggtttcaggttgaagcatagcattgcgaccaacgccgagcaccatatcggaaaggaggtaatcattaatatcgacctcaaagacttcttcccttctatctcgtatatccgggtcaaagggctgtttaaaagcttcggatattctgagactgcctctaccatttttggattgatttgtaccgaacccaaaatgaaggaaattgaggcaaacggtaaaaccgcctttctgttgtcatggaccgaacggtaccttccccaaggagcccctaccagtccggccattactaatgtcctgtgtaggagacttgaccgccggttgcactcaatggccaagcaatacggcttcgattatacgaggtatgctgacgatttaactttctccacatccggcgaaagcctgagaaacatatgcaacatatttcagaacactcgtttcattgtggaacaggaagatttcgaaataaatgagcagaagactcgggtcattcggcgctatcagcagcaggaggtgacagggatcgtggtgaacgataaactaaacgtatcccgagagaagttaaagaacttccgcgctgtcctctaccagattgagaaagacggtcttgaaggtcacaattgggggcaaagtgaggacatcattgcctcaatagagggctttgcaaatttcgtgagcatggtccacccagaaaagggcgcaaagttcaaagaacagattgataggatcaaggagaaatacgggagaaaaaaaaacccaaaagtgcccaatgtgtcccagcctctactgtcgcgaagcgatattgttgccctcatagacacgaaatttcaggagctgaagttctccaagatctacacggatatctacctgaacaagatctacaagaagcagtcactgaagcaattaacagaagcggagctgcttgagctcctgcgggatctgacaagtagcccctccgaggacgatgatcgtactcagctgaatttcgtgaagagactcaaagccctaattgcccagcgcatcaggtattatacacgcgctaccaaggactccgacttttga

SEQ ID NO: 13438 - RNA, 1872 nt, unidentified
  source 1..1872: mol_type = other RNA; note = synthetic construct
atggctgaagcgaaaattgaggattcacgcaataatatggacatcaatgagctaatagtgcgtgggataagctattatatgcagggtaaatatggcgaggctctagagtgtttcaatcaggcaatttgccacgacttgaattgtgttcaagcttatcactacagaggcttaattcgccggagacaaaccgacaagcaggaagcaatagaagatctgcagcaggcggctcgactcctgaatgataaggaatacaccaccatcagcaacaacctgcagatatttatcgagcagaactgtttcaagaagactgagaatgtgaaatcagacgacagcgatcaaaacctgatctttcataatgagaactggtacgagtgctacgatgaccttgtggatgcctttcccgatgagtttatgtcatattgggagattgaaagtctgaggcaggagtgtgagagcatcgtggaggaagaattcgagaaactcgaaagatggctgagccggcagttgaaggattcacaggtccttcagaaaaagcgaatcaacaatgctaagtttgaccgggagaggttgcaatccaataatctgccactttgtaacagccacgaggcaatagcacaggccatgggagtatctgtaaaaggcctgcggtttctggcgttctcccggaagaagtcccactatattcgttttcagatcccaaagaagacgggcgggaacaggaagatttctgcccccacccaccttctgaaaaagacccagaaatggattctcgaaaatattttggagaagatccagttacacgacgccgctcacggttttcgacttaaacattctatcgtaaccaacgccgagcatcatgttgggaaggaggtcattataaacatcgacctcaaggacttcttcccttccattagttatatccgtgttaagggactgtttaagagctttggttatagcgagactgcatcgactatcttcggcctgatctgcacagagcctaagattaaagaaattgaggtcaacggaaaaatcgaattcctactcagttggacagaacgctacctgcctcaaggcgcaccaacttcaccggccataacaaatgtcctgtgcagtagactggacaggcgcttacacagcatggccaaacagtactctttcgattacactcggtatgccgacgacctcacgttctctgccagtggtgaatccttggataacatctgcaaaatttttcagaacacacggttaatcgtggaacaggaagatttcgagattaacgagcagaagactagggtgattagaagatatcaacagcaggacgtgaccgggattgtggtgaatgacaaactcaatgtgtctagggaaaaactgaagaacttccgggctgtcctgtaccaaatagagaaagacggcctcgaggacaggaattgggggcagtccgaagatatcattgcctcaatcgagggcttcgcaaatttcgtgtcgatggtgaatcctgaaaaaggggccaaatttaaggagcagattgaaaggatcaaggaaaaatacggaagaaaaaaggaggcgaagatcaacaatatttcacaacccattatgaaccagtccgatatcgtcgctctaatctatacaaagctgaaggaacttcgctgctctaaaaaggtgaaacagatctacctgaacaagatatacaacaagcaatctctgcagcaacttaccgatgaggagctgttggaagtcctccgagatttgacaacatggagctccggagaaagtggaaggcgccagatcaacttcgttaagaaatacagagccctctcctgtgagtacatccgacatgatacgcccgaccgcgaggacgttaacgaattttga

SEQ ID NO: 13439 - RNA, 1833 nt, unidentified
  source 1..1833: mol_type = other RNA; note = synthetic construct
atggatatcaacgaacttatcttccagggcgtcagctatttcaaacagcgtaactatgacgaagcgttagagtgcttcaatcaggccatatcctgcgacctgaactgtgtccaagcataccattaccggtgcctgattcacaggcgacaacaaaataaacaggaggccctggagaatctgcagcaggcaacaaaacttcttaacgacaaggagtacactaccatctccaataatctacagattctcatcgagcaagattgctttaaaactagcgagaatgttcagtctgataacagcgaccataatctcattttttacaacgagaactggtacgaatgctatgatgatctggtcgacgcgtttcccaatgaatttatgtcctactgggaaatcgagagtcttcgacaggagtgtgaaagcatcgtggaggatcagtttctcaggcgggagtgctggctgagtcgacaactaaaacagagccagattttgcaggagaaacgcattaataatgccaagtttgactcagagcggttacagtcccagaacttgcccctgtgtaactctcaggagtcaattgcccaagctatgggtgtgtcagtgaaaggcttaagattcctcgctttctcccgaaaaaaataccactatatccggttccagatccctaagaagacgggagggaatagaaaaatctccgctcccacgcacctgctgaaaaagacccagaaatggatcttagagaacatactggagaagatacaactgcatgacgcagctcacggcttccgtctgaaacattccatagttaccaacgctgagcctcacgtaggcaaggacgttatcatcaacatcgaccttaaagacttcttccctagtatcagctatcgtagagtgaaaggactgttcaaaagcttcgggtactccgagacagcatctaccatttttgggctgatttgtacagagccaaagattcaggaaattgaactgaacgggaaaaccgaactcttgctttcatggaccaagcgctacctcccccaaggggcaccaactagtccggccatcacaaacatcctctgtcacaagctggatcgcagactttatagtatggccaaacagtatggatttggctatactaggtatgctgacgatctaacgttctcagcctcgggggagtcactcggacatatcttcaatatctttcagaacacccgctgtatagttgagcaggaggatttcgacatcaacgaacagaagactagagtgatccgccggtatcagcagcaagaagtgacaggtattgtggtgaacgagaagttgaatgtctcgagggagaaattaaagaattttcgggccgtcttgtaccagattgaaaaggatgggctcgaaggtcacaactggggacactctggcgatattatagcctctatcgaaggcttcgcaaactttgtaagcatggtaaaccctgaaaagggtgcgaaattcaaggaacaaattgatcggataaaggagaagtatggcaggaagaatcaggctaaggtgccaaacgtgagccaaccgattctgaatcagtctgatattgttgcccagatccacacacaactaaaggagttcagatttagcaagcgcataaagcaaatttacctgaacaagatctacaataagcagtctctgcagcagttgactgacgaggaactgctggagctcctcagggacctgaccacctggagttcagtcggacatggcagaaagatggtgaattttcagctgaagtacataggattgtcctgcgaaattaggtctgacacaccaaatgaagaagacgtgaatcagttttga

SEQ ID NO: 13440 - RNA, 1731 nt, unidentified
  source 1..1731: mol_type = other RNA; note = synthetic construct
atggacataaacgaactgattgtcaagggagtctcctactatacacagagaaactatgacgaggcaattgaatgttttaaccaggctatctctcgagatattaactgcgtgcaggcttatcattacaggtgtcttattcatcggaggcagcaaaataagcaggaggctctggagaatcttcagcaagccgcccgcctgctgaacgacaaagaatataccacaattagcaataacctgcaaattttcatcggccaatactgcttcaagaaaactgaaaacatcaagagtgataactccgagcagaacatgtctagttgggaacgcgacctcgtgagagacgcagaaaattgcgccgaggcgtacatcgaggagaagttctacgagttagaaagatggctgtcaaagcgacttgagcactctcaaatcttacagaagaagagaatcaacaacgctaagtttgaacccgagcgcttgcagagcaacaatttacccttgtgtaatagtcacgaggatattgctcaggccatgggggttagcgtgaaaggattaaggttcttggccttctctaggaaaaaaagccactatatccggtttcagattcctaaaaaaacggggggcaatagaaagatcagcgcacccacccacctcctgaaaaagtcacagaaatggattctggaaaacatactcgagaatattcagctccacgaggcagctcacgggtttaggctaaagcatagtatcgttactaatgctgaacaccacgtgggcaaggaggtcataataaacatcgacctgaaggacttctttccgtctatcagctataggcgtgtcaaaggtctgttcaagtctttcggttacagcgagacagcgtcaacgatatttggactgatctgtactgagcctaagattaaggaggtggaggtgaacgggaagatagagttcctgctgagctggacagagcgctatctcccacagggtgcccctacgtccccagcaataacaaacattctctgctcaaggctggatcgcagattgcattccatggctaagcaatacggatttgactacactaggtacgcggatgatctgaccttttccgcctccggcgagtccctcgacaatatatgcaatatcttccagaacacacggtttatcgtggaacaggaagatttcgaaatcaacgaacagaaaactcgggttattagaaaatttcgccaacaggaggtgaccgggattgtggtgaatgaaaagctgaacattagtcgggagaaattgaagaatttccgcgccgtcctctaccaaattgaaaaagatggcctggagggccataattggggtcagagcgaagacattatcgcctcaatcgagggattcgcaaactttgtatcgatggtcaatcccgaaaaaggcgccaaatttaaagagcagatcgatcgtatcaaggagaagtatgggtgtaagaagaaggcagccgtaccaaatgtgagtcagcctcttctcgggcggagcgacattgtagcccaaatcaataccaaacttaaagaagtgggatgctcttccggctatacccagatctatctcaccaaaatctacaagaaacgatcgcttaaacagctgactgagacagaactactagaggttctgcgtgatttgacctcatcccaggctggagactctggccggaccgaaaccaatttcgttaagcgatggagagccctgatctactcatga

SEQ ID NO: 13441 - RNA, 1740 nt, unidentified
  source 1..1740: mol_type = other RNA; note = synthetic construct
atggacttggacgaaatcctgaagaacgggattgaatactactgggagaagagttacgaacaagccatcgagtgctttaaccagatcatttcctttaacccgaattacgcgaaggcttaccactaccgggctctggtgcgtagaagacagagggacgacaaaggcgcccgtgaagatctggtgcaagcggcctctctgcttggtgatcgggagtatacagctatgagtcagaaaatgttaaagcttatcggttgcgattatcgacacaagtcacccccacgcgaagacgattttgacttcatcttctatgacgagaattggtatagcgactatgacgagctcagtgaaatgtttcctgaggagttcccaccttcgtgggaatacgaggttgatattctagatggtattgcctatgctggcgaagagctggacaggttggagacatggctgttcaaaaagctcgaaagagcatgttacatccagaagaaacgagccattaatgccaaattcgacgagaagcgcctgcgcgagaacaatctgcctttgtgtaactctcatgaggagatagcagcagccatcggcatctctattgccggcctcaggtggctggcttactcgcaaaagaagtatcattatacccacttcaagattcctaagaaaacaggcggggagcgaaacataagcacacccatcccccttcttaaaaaagcacagaattggatcctgaacaatatcctgattaagatccaacctcacgatgcagcccatggattttgcaccgagaggagcatcgtgactaacgcacagttgcacctgggaaaggaggttataatcaacattgacctcaaggactttttcccctccatttcatataagagagtgaaaggtgtctttcagagtttcgggtactccaaaaccgcgtccattattttcggacttatatgcaccgctccaaagctaaaagaaatcaaactcgacgaaaaactgcaccaacttttgtcttggaaagaaagatatctgccccaaggaagtccttccagcccagcaatctcaaatctggtctgtaggcgcctggacagcagactcaccgaaattgccgtcaagtacggatttaattatacgaggtacgccgatgatctcaccttctccgcctctggcgactccttacggaatatcagccatattctgaaagatacacggttgatcgtgcggctccaggattttgagattaacgagaataagactaggattatgcgcaaatctagacggcaggaagtgactggcatcgtggttaattccgagctgaacatatcaagagagacactaaagcggtttcgcgccaccttatacaacctggaaaaagatgggctggagaatcgacactggcgcaactcacaggggggggacatcatcgctagcatagaaggcttcgccaacttcgtcagcatggtaaatccgcagaaaggcgcaaaattccaacagcaggtgactaggattaaggaaaagtacaagccaaagaaaacgcagaactccttagctccccagctaatcaccaaaagcgatatcattgccctgatcaacgacgatataaggaagctgcattggagtaatagagatcgacggatatacctccgtcaggtctatggaaagcagtcactccagcaatttactgaagaggagcttctgaaggtacagaatcacttttgtagcttcctcgatgctttgtctcagaagatatga

SEQ ID NO: 13442 - RNA, 1935 nt, unidentified
  source 1..1935: mol_type = other RNA; note = synthetic construct
atggacaatctggaccttcaacaaatcttgaatcgggggattgataattaccaggagaagaactacgaacaggcactggaggattttaaccaggtgatcagcatcaatccactgtttgcaaaagcgtaccattatcggggctggatttaccggatcctggagaagaaggaagaagctatccagaatttccagcaagccgcttcgctattcaaagatcgtgagtatagggttctctgcgaacagcttgccgaactcctggaatctctgttcccctcaaagttgaaaaaacagcagtccagcgaaataaacgatgatatctatagcgagtatcggaatttgttttggattgatgaggacggaaattggtatgacgatcctcctgactacgagtgtgacttctatgacattggagattgggaagattacatcaaccaaaaactcattaccatcaaaaaccgcctgttcaaacgcctggaaaagattgagtacctgcagattaagcgagagaaaaatgctcagttcgatcagcgcaagttagaggataacggcctgccgatttgtaacagtcatcaagacatagcaaagctaatgaaaattcgtgtgaagagactaaggttccttgccttttccagaaataaatcccactacacctgctttaagataccaaaaaagatcggaggcgacaggcacataagtgctcctatgccatttctcaagaaggcgcagctgtggattctccacaacattcttgagaagattaaaatccacgacgccgcccatggcttcattctgaatcactctatcgtgactaatgctcagccccacatcgggaaagacatcattatcaacttcgaccttaaagacttcttcccgagtatatcctatccccgggtgaaaggcttatttaagagtctcggttactccgaaaccgcttcaattatctggggcttattatgtactgagccaaccctaaaacagatcgagctggacggtgaaattcattccctgcgctcctggaccgagcgacatttgcctcaaggtgcgcccagctctcccgccatcactaatttgctgtgcagacgccttgaccaacggctgacacagatggcccagaagtacgggtttgtgtacacccggtatgcagatgacctgacatttagtgcatctgggaacagcctgacaaacctctctaacatttttaacgagactggctttatagtcaagacggaaggctttaacctgaatcaggacaagacccgaataatgagaaaatcacaacagcaggaggtaacgggcatgatcgtgaataacaaagtcaacattccccgcgaaacactcaagagattcagggccaccttgtaccaaatcgagaaggaaggactgatcgggaagcactggggcaattctaagaatcaagaattaatggtgtccctggaaggtttcgccaactttgttttcatggtgaatccagagaaggggtcccagtttcgtgatcaggtaaagcgcatcaaacacaagtattattgccagtcaaagaccaggagaagcatcatctctcaggagatattgaatcagtcaaacatcatcgggcttatctatgccgaactgaatagactctactgtaagaatggaaagagaaggtgttatctgatgcaaacatacggaaaaccttgcctacaggagctgactgaggaaaatctcttagagttcctcactgacctcaaaagccatgtcgagaacagtcccttcctggattcaaactttattcgggttctcgattttgtcaacaggctgtcgctgacacctaaccacctgaggcagtaccttataaaaacgtacggaaaacagtctcttctgcagattaaaaccgaggagctcaagaacttttatagcttgttcaagaagacaccaagcaaccgattcttgtggttctga

SEQ ID NO: 13443 - RNA, 1797 nt, unidentified
  source 1..1797: mol_type = other RNA; note = synthetic construct
atgaacattaatgacctccttaagaccggcattgaatgttataaagccaaggattatgagacagccctccttgcctttaactctgcaatatcagtgaacccaaatctcgcatcggcttaccattattgcggaagcatctaccttgccttgaaccagaaggaaaatgccatcaaaaatttcagaaaggccgaagctattctcaaggataaagagtactccaaattgtgcaataagttggaagagattctcgttgaactgtttccatccaaaacactggactgccctgagaaccataataacgacgcactggatttccgagagtaccagaatctgttttggatcgacgaggatggtaactggtacgatgacccccctgatcacgacctatacgtgggatacgacagcgacgccaacgactattactgcgacctgttaagtaagctgaccagcattaaggactatttgttctcaaggcttaagaaaatccaaaccctagagctgaagaggtcacagaacagcgagtttgatcgaaagaagctgctcagccagaacctgcccctgtgctcatcccacctggacattgccagactaatgggtttctctgtggggtacctgaggtgtctggccttctcacgcaacaaatatcattaccagagcttcgagataccaaaaaagatcggaggaaagcgaaaaatatccgcgcccaatcagatgctgaagaaagcacagaagtggatccaaaataacatactcgacaagatcaaggtacacgatgctgctcacgggttcaaaatagaacacagtattctgacaaacgctagacctcacgtcaatcaggacattatcattagctttgatctgaaggatttcttccctactatttcttatcggcgggtgaagaagttgtttaaatctctggggtatagtgaaacggcgagcattgtgttcggcctattgtgtaccgagcccattattaaaaacattgaactcgatggccaagcttatgagttagtatgctggactaagagatgtctgcctcaaggcgctccctcctctccaggcatcaccaatctgctttgctgtaacctggatcagcggctttctcaaatggccaataagtatgggttcatctacacaagatacgcagacgatctgagcttcagtgcctctggggagagcttggactacataacgaatatctttaagggtgtcaggtctatcgttaggtccgaaggatttacacttcatgagagtaaaactcgcgtcatgagaaaacaccagcagcagaaaatcaccggcatcgtcgtgaatcaaaaactgaacatctcccggaaaactctgaagaggtttcgcgcgctcctttatcagatcgaacaggagggttttttcggaaaacactgggggcactaccgcaattacgatctgttgcgtttcattgagggcttcagtaattttgtgtacatggtcaatccggacaagggcgtgttatttgttgagcaagtgaaacggatcaaagagaaacatcccgtaaacatcaataagatatcgcagagctccatcattacacttatctattccgaatttcagcggattgattgtagcccgtcaacccgtcgcaagtatttgaaagagacatatggcaagcagtctctccaggacctcactgaggaaaacctgttagaactgctcgatcatctgaaatccactgaagcagtgtactcactcaccaacaaggaaatcaactacttcgttaatatcaacgacccaacctccataagtaaggaggatttattttga

SEQ ID NO: 13444 - RNA, 2232 nt, unidentified
  source 1..2232: mol_type = other RNA; note = synthetic construct
atgttctctcagagtaaaaagctggacaagctaatcaaccagggcattgattactataaacagagccaatacgaggccgccctggaatgttttaaccaggccatcgctttaaacccgaattgcgctcgggcgtatcattatcggggttggctccatttggctaacaataacccaggtgagctactgaacgacttgcagaccgtatgcaggctcctgaacgataagtattatgagaggctcgtaaacaaaattgagaaaatcattccgcagctgttctacagggaggactctctcagctggatctactgtgaagaggacgattcttggtatgaatcttatagtgacatacctggcggcgatatttacatcgggataatcggggatatcgaagccgagttgatggaacaaagaagccaggagttctattggttgcgaaattggctcttcgcccgaattgaggagattaataacctacagctcaaacgaaataagaatgcaaagttcaaccaggaaaaactcatcaggtatcagctgcctctgtgcaatagccactcggaaatagctgcagcaatcggactctcagttaatgggcttcgctatctggcattcagtcggaataagctccattataccaggttcaacattcccaaaaaaactggagggaaacgcgaaatcagtgccccattgcccctgctgaagaaggctcagaattggatccttcataatatcctggaaaagctggagattcatccggcagcgcatggcttctgcagacagaagtcaatcgtgacaaacgctctgcctcacgtggggaaggatgtgatcatcaatatagacctcaaggatttcttccctagcatatcctatccacaagttaagggactatttaagtctttaggctattccgagacagctgccgtggtgttcggcttgatttgcaccgaacccagagttcagaaactggagatcgatggagaaagctgtctagtgaacttaaaagagcgcaggcttacacagggggctccctcatcccccgcgattagtaaccttctctgtaaaaaactggaccaccgcctatcaaacatggcaaaaaagatgggattcatgtacacccggtacgccgatgatctgacttttagcgggtctatagatagtcgggagaatattggccggctgtttaaggtgactaatctgatagttcaggaggaaggacttgctattaatcccgacaaaactaaggtccgttggaaaaaccgacaacaggatgtcacaggtctggtggtgaatcacaagatcaacatttccagaaagaccctgaagaaatttagggctacactgtaccacatcgagcaggacggatttagaggcaaacattggggccaaaccaacactaacgaccttatggcatcaattgaaggcttcgccaattttgtatgtatggtgaaccctgaaaagggtgccaagtttaagcagcaggtgcagcgcatcaaagacacttataagaaaacggatcagaaagcacaccaggccaaccacgaatcccccaagacatcagcccaaatatacgacgtcgtgttcttgatctttagcgcccttttctggcttggctggacgtacaagaagaagcttgagtacttgcgtcagacatatgggaacaccgctatcaaacaattaagacccaaccagcaatgggaattcctcaattacttgttggaagcgatcgtcagccaggagattaaaacccacttatctctggccgacctgcagtctaaggagattcacaatttcaaacaagttctgtgctgcctggactactacaaaggacggaagtgcaagtcctacgcaattccaagttttatcatcaataacacgcctatttgggaggacaagatggccgattatctcgattttctttgtcgcatataccgtgaatacctgagactgggttggaccgacaatcaaagggagaactctgccgccaaaacttatctgcaggaaatttaccacgtcctgagccccctcgcattaacactgaagcagctgcaagatttcctcgagtacctcaagctgcagccaacccctgaggtctgttccaattcccagccagactcctatgagtatgactttagcgactcctacgagtacgattttagcgactcatacgaatacgatttttcggactcttacgagtacgacttttccgattcgtgcgagtatgaaccaccttactga

SEQ ID NO: 13445 - RNA, 1548 nt, unidentified
  source 1..1548: mol_type = other RNA; note = synthetic construct
atgggagtgtatgatgactatgatgacaacgactacaccgatgatgcgaacgaagaatactatcaagagtatcttgagtgggccacatatttctcccagggcttagtagactcgtcggatcaggggtggttttcatccgacccatcttacgagtccaacggataccagaacatcgaccggatcgtagataaactgtatgagagcggggaggatttcgagtttgacgattgggacaaagaggacgagtaccctttggactttaatgctaaacgggaagaagacgagaagttcaagttggccgaagcgttaaagattcgtgaagagaagcagagattcaataaagaaaggttacaggagaatgggctacctctctgttgcagtcatagtgccattgcaaaagccatgggcatcagcgtcaacaaactcaggttcctggccttcagccggaagcgctatcattaccgaaattttcagatacccaaaaagaccggtgcaaagagagatatttctgctccaatgccatacctgcaacaggcacaatattggattcagcacaatattctcaagaagctggaactgcacaacgcagcccatgggttttgcagggaacggagcatcataacgaatgcccagccgcacgttggctcagaagtgatcatcaacatcgacttcaaggattttttccccacgatatcctataagagagtgaagggactgttcaaaagttttggttattcagaggaagcaagcataattttcgcccttatttgtaccgagcccatgctgaaagaggtggaactcaacgagaaaacaaatctctttctttcatggacagacagaaggctgcctcagggatcccccacttctcccaccatatctaaccttctctgtaggcgcctggatcgacgcctgacacaaatgacagagccgctgggctttatttacactagatacgccgacgatttaactttttccgctagcggcgagtcagtgcgcaatatctgcaatgtgtttaaccgcatgaggtccatcatcaagtacgaggggtttgagatcaacgaggataagactcgagtcatccgaaaaagtcgccagcaagaggtcaccggcgtcgtggtcaatagcaaattgaacgtttccaaggagactttgaagcgcttcagagctacactctatcggatcgagaaggatggctttcagggaaggtactggggccaatctaatgacctgatcgcgagcctacagggattcgctaacttcgtgtacatgataaaccctgaaaaaggggccaagttccaggaacagattaggcacattaagcagaagtacaaacagggtcctaaccagagtgttccagagagtaagttgctcaacctatcagacatcatcgctcttaccaatattgaactgcggagactgaattggtctattcaggaacgtagacgttatctgaagaaaacctacggtaaacaaagccggcagcaactcaaggacgaagaattgctggagttccttaattacctgaaatctctgcccaagccaaaatga

SEQ ID NO: 13446 - RNA, 1308 nt, unidentified
  source 1..1308: mol_type = other RNA; note = synthetic construct
atgtctgtcaaccagggcgagtcaagcgatgactcctacgagattgacgaagatattgagcagcaattaaaccgctggtggcgcgaggccaacgatttggagaatgactactggtatcgccaaaagcagctgcagggtaagaatacgaggaataagcaggggaaggaaaagctgcttgagaaatattatcttcctcagtgcaactcttttagggagatttccaagctcatcaacattgacttggccgacctacggcttctggtgttttcccccaaacaggatgccgcaactaaacaccactatatcttgttctacatcccgaaaaagaccggaggagagcgaatcattagtgcaccatcccaaaatctgaaaaatgtccagtactggatactgaaaaatatcctcaagaagctcgagcccagtctgcatgacgccgcccatgggttccggaacagcgagatcattaaggaaaaacacacaatcaacatcaagttcttcatcacacagattctcaaggccaagtatatcagcattttctataaattccggttgatcttgaagctcataatatacgctattgcactgccagagctgattcagtatccaaaatttggcaagaggaggtcaatcgtgaccaatgcagaaccccacgtcggcgctgatgtgatcataaacgtagacattaaggatttcttccactctatctcatataagagagtgaaaggcctttttaggtctttcggttactctgaaagcgcttcgaccatttttgccttactctgtacagtaacttttgtgaaccatcgctcgtacctgccacaaggcgcgcctactagtcccatgattaccaacctaatctgccggcggctggatagaagactgactcatatggcagaaagctttggattcaggtacactagatacgctgatgatttaacattttcctccagtgacgaatccgtctgcaacattggcaaagttctgcgtcatacagaagggatagtgaaacacgaagggttcgaaattaatcgagacaaaacccagatcatgagaaagagtaatcgacttgaggttacgggcatagttgtgaatagcaaaccttcaatcagcagagagaagctcaagcgtttccgtgcgaccctgtaccaaattgagaaggacggactggagggtaagttttggggaaacagcaccgacgtgatgtcatctatccagggttttgccaattttgtctatatggtggaccctcagaaaggggctaaattccgcgatcagatccggataatcaaagaaaagtacaaatgttga

SEQ ID NO: 13447 - RNA, 1308 nt, unidentified
  source 1..1308: mol_type = other RNA; note = synthetic construct
atgcccgtttaccagtccgagagctccgatgactcgtatgagatcgacgaggatgtcgaggcgcagctgtcccgaggttggcgtgaaaccaacaatttagagaataactactggtacgagcaaagacagctccaagggaaaacaaaacggaataagcaggggaataaggagcttctggaaaaatactgcctcccccagtgtaatagctttcgtgccatctctaacctcataaacatcaatctagaggagcttcgactgctggtgttctcacctaaacaggacgcggccaccaagcatcattacattcggttttacctgcctaaaaagactggaggggaacgaataatctccgcaccaaaccagcacttaaagaacgtgcagtactggatcctggagaatattctgaagaaactcgacccgagtatccacgatgccgctcatggctttaggaattccaggattatcgagatcgaaaataacaagctagacatcaacctgttgcctatcaagaccctgaacaccagatatagcatcttgtacaagttctggataatagtgaagcagatcatttacgtggatgcttctcatcggctcacccaatacccacgcttcggcaagcgccgctctattctcacgaatgccgaaccccacgtcggcgcagacattatcattaacgtagatcttaaggacttctttcactcgataagttataagcgtgtcaaaggattattcatcagcttcggctattccgagtcagcttctacaatcttcgctctgctttgcaccgtgacttttgtgaatcacagaagctatcttccgcaaggcgccccaacttcccccatgattacgaacctgatttgcagaagactagatcgccgcttgactgagatggctgaaaggttgggatttaggtacacaagatatgccgacgacctgaccttctcagcctctaatgaaaacggctgtaatattggtaaagtactgaggcacacccagggaattgttaaacatgagggcttcgaaataaaccaggacaaaacaaggataatgcggaaaagtaacagattggaagtcactgggattgtggttaacacaaagccaagcatctctcgggagaaactgaagcggtttagggccacactgtaccagattgaaaaggatggactcggtggaaagttttggggggagagtgaagatattatgagctcaatccaggggtttgcaaatttcgtctatatggtggatcctcagaagggcgcaaaattccgagagcaaatccgcatcattaaagaaaagtatcggtattga

SEQ ID NO: 13448 - RNA, 966 nt, unidentified
  source 1..966: mol_type = other RNA; note = synthetic construct
atgtctgccccaacaaggcgccttaaagatgcacagtactggatcctcaacaatatccttaaaaagctcgatagctctctgcacgacgccgcccacggatttagatcctcacgggtgattaaaactgagacgaatggcaagaatgatttcctgcgcagcctgcaacacttggagccccggcattttgggaatctttttaacttttggcgcagaattaagagtactatatacctgctcacgctgtctctcagtagcagcaagataaagttcggtaaacgacggtctattgtgaccaacgctgaaccacacgtgggtgccgacgtcttgatcaacatcgacatcaaagacttcttcccgagcatatcctatcgacgcgtgaaggggctgtttaagtcgtttggatattctgagtccgcaagcaccatctttggcctcttatgtactgtcactttcgtgaaccataggtcgtacttaccccagggggcccctacctcacctatgattacaaacctgatctgcaggcggctagatcgacgtctcacacagatgggagagcggttcggcttcagatacactaggtacgcggacgatctgacattttctgcttccaatgagtcattgtgcaacatctgcaacattcttagacaaaccgaaagtatcgttcggcacgagggttttgaaattaacaaggacaaaacacgcatcttaagaaagtgtaatagactggaggtcaccgggattgtggtaaatagcaagctgtccatctccaggcagaaactaaaaaggttccgcgctaccttgtatcagattgagaaggatgggctggaaggaaagcattggggcaagagtgaagacctgattgcatcaattcagggcttcgctaatttcgtatatatggttgaccccgaaaaaggagccaaattccgtgaacagatccgtatcataaaggagaaacatggctgttga

SEQ ID NO: 13449 - RNA, 1548 nt, unidentified
  source 1..1548: mol_type = other RNA; note = synthetic construct
atgagtgagaagagacgaactagggaggaaatctttcagcgcatgcgggagacatcaagagatgaggtgatcctggaagagatgatccggcacgggttttggccaagagaaggccggctggccgaggatcctgctgacgaaattagacgcaaaggggaaattgaacgggaactgcagcagcttagggcccagaatcgctctttacagaatgaagccgctttgctcagggaaatgaggaagcggcgctttgcagagtctcgcaaaaagaggcaggaaacaaaagagcgtagagagaagcagcggcaagagcgtgcagaggcctggcagcagaaaaaagccgaggaaattacatttctgggtacgggagtctctgtcggtctatccaacaaaaagtcaaacgaggaattgttgaaaaagtacaacctcccggtgtacagatccccggaggaaatcgctgccgcaatggcagtgacgatcagtacattgcgttttctggccttcagccggaagacttccaccgttagccattacatcaggtttaagatcccaaagaaaacgggcggacaacggttaatcagcgccccaatgccccgactgaaggaagcccagacctggatcctggcgaccattctcgagaaaatccccgttcatcaagccgcgcacggatttcgcgcaggccatagcattgtgaccaatgcagagccccaccttggtaaggaagtcatactcaatgtagaccttaaagacttcttcccttcggtatcctatcgacgagtgaagggcctgttttcaagctttggctactccgaggctgtagcgactctgttcgctctgctgtgtactgagcctgacattgaaaaggtggagctcgatgggaagacctactatgtcactcagacacgccgtcacctaccccaaggggctccaactagccctgcaattactaacctgctttgcaggaacttagactataaactctattgcttcgctgagaagcttggattcacctatacaaggtatgcggacgacttgaccttcagtgcctcgaatgaggccgtcaaaaaggtgggctacattttgaagaagctggaagagatagtcaaaaaagagggcttcgaggtgaatcaggaaaaaacaaggatactgcgctactcaagacagcaggaagttaccggtgtgattgtgaacgagaaactgaacgtgtctcgaaaagttcttaggaatttccgggccacactctaccagatagagaaggacggactagaagggaaacgctggggacaagcacaggatctggtagccgccttacaggggttcgctaactacgtttatatggtgaatccagagcagggcagcctgctcagaactagagtgcaagctatcatagaaaagaccaagtggaaggctgcagctagacctgtgaaacccagtaagatggaggaggttgcgaccctccagaccgaatctgccgtggaggaagtcgagatcgagcagaagaaacaagataaggattacgattcctctaagaaatggtggaagctgtggtga

SEQ ID NO: 13450 - RNA, 1449 nt, unidentified
  source 1..1449: mol_type = other RNA; note = synthetic construct
atgactgatcagccatcctctagaaaagaactatatgctcgtattcgcgagatcggcagggaggagtttctgctggaagaaatgacccgctatgggttttggccggagggcgaggaaatgcccttagatcctgtggatgaaatccaacgaagaggagaactggagcagcagctgaagaagttgcgacaagagaacgcccatctgttcaatttgaagaaactgggtcaggaagcgtacaaacagcggctcgtggagagcaggaggaaacagcaagagactaaggagcttagagagcgggagcggcaggaacgtgctaaagcctggcaggagaagaaagagaacgatatcatctacctgggcgaagaaatcagtggcggacttaacaatgtcgaagggaatatatttaggcttgagatctataacctgcccatactgaataccgctcaggatatcgctaatgcaatggacattaccgttggagagttacggttcctcgccttttcgcggccaacgtccacggtcagccactatatcaggttcaagatacccaaaaaaacaggcggcgagcgccaaattagcgcaccaatgccccgccttaagaacgttcagacctggatcttagacaatatcttgtgcaacgtccctctccatgaagcggttcatggatttcgcgccggtcatagtatcctgacaaacgccgagccccatgtggccaaggacgtcattattaatttcgacctgaagaacttcttccctagtatttgctacaagagggtgaagggacttttctttagcctgggctacagcgaggctgcagctaccatctttgcactcctgtgcactgaacctaatgtggtggtggtagaactggatgggcaagtgtactacgtggcccaatcagaccgccaccttccacagggatcccctgctagccccgccatcaccaacatcatgtgtagaagactcgacaaacgcctctcagaaatggccgctaaactcgatttcgtatacacaaggtatgcggacgacctgaccttttcttctagtggcgactctctaaggcacatttgtaacgtgttccggcgaactgaatccatagtatcccacgaggggttcacagtgaacagagagaagactagactactccgtggcaagtcatcacagctggaagttacgggggtggttgtaaatgagtttccgaacatatccagaaaagaattgaaaaggttcagggcaactttgtatcagattgagaaggatggtccacagggaaagcgatgggggcacagcgacaatgtcattgcagccatcgaggggttcgccaattttgtcgcaatggtgaaccctgagaaaggtcgtgagctggtgcggcgcgtcaagcagattaaagagaagtacacaggccggcgaagacggtctacaaagattctcgaacacgatggaacctga

SEQ ID NO: 13451 - RNA, 1401 nt, unidentified
  source 1..1401: mol_type = other RNA; note = synthetic construct
atgactgagcaaccacggacacggcaagaactgtatgaccggattcgccagacctctaaagatgagttcatattggaggagatgatcaggttagggttctggcctcgccaagggaccttacccgaggacccagcagaggagattaggcgacagggagagctgcagagggaattggaggccttacgaagcgagtctcggaagctgaacaacgaggaacatttgaggaaagctgcccgcaagctgcgactgcaggaatcgcggcaaaaacagcagcagaataaagaacggcgcgagcaggaaaggattgccagagcacaggtctgggaacagcggaagcaacacgaaatcctttatcttggtgaaggcgtctcaggggggctctccgcaacggaatgcgatcacgagagactagctagttacggcctacccgcccttgggtcagctgagcagatcgcgtcggcgatgggcatttccgtgggtcaactgcgtttcttggcattctccagaaggacatcaaaagttagccactacatccgttttacaatccccaagaagagcggcggggagaggttaatcagtgcacccctgcctcgcctgaagcatatccagcactggctcctcgctaacctgctgacaaacatcccgctgcacgaagccgcacatggattccgaacgggacatagcatagtgaccaatgccagaccccatgtaggcgctgacgtggtggttaacctggacctgaagaatttcttccctaccatcacctacaagagagtcaaggggctcttccgggcccttggttactccgaagcagccgctaccatttttggcctgctctgtacggaacccgaagtagccgcgctgtctctggaccagactacctattacgtgagtcagggtactagacacttgccacagggagctccgacaagtcctgccataaccaatctcctctgtaggcgcttcgatcgcagacttacagccatggcaactgccctgggaagccagtacactcgttatgccgatgatctgacctttagcgcttcaggcgagaacttgagacacatttgcactctacttagacgcattgaatctatcgtgactcacgagggttttgttattaatgaggctaagacaaggattcttcgcggcggctcccagcaagaggttaccggtatagtcgtgaacaacaagctgagcgtgtgccggaaaacactcaggcggtttcgagctctattgtttcagatcgaaagagatggcccttctggaaaacactgggagggagcgccaaatctgtttgcagccatgcaggggttcgccaattttgtctatatggtggacccagagaggggcctccctctcagacagaaagtgcgacatctccgttccctgcatggatga

SEQ ID NO: 13452 - RNA, 1437 nt, unidentified
  source 1..1437: mol_type = other RNA; note = synthetic construct
atgactaaccagcccaggactagacaggaactgtatgataggattagaaggagctcacgcgatgaggtgattttggaagagatgattcgtctgggattttggccggccgcaggggaaatgccaaaggatccagctgacgaaattcgaagaaaaggggagatcatgagggagctggaggatctgagagcccagaatcgacagttacacaatgaggaggctctcaagaaagaagccctggcacagcgactcgcagaatctaagagaaagcagcaggaaaccaaggagaggagagagagggaaagacaagagcggctcgaaatctgggaactcaagaaacagcaagagatcgttttcctcggtgagggcgtgtccgcgggccttaacaagactgaatgcgaccgtgatcggctgcagagttacgggttgcccgaatatggaacttctggagaaatcgccgctgccatggggataagcttgggcgaactgaggtttctggctttttcccgccgggcgtccaacgtcagtcactacatcaggtttaagattgccaagaaaacaggcggggagcgcctgatcagtgctccaatgcctcggctcaagcaagctcaaacctggattctctaccacatcctcgagaaggttaacctacatgaggcagcacacggcttctgtcgtggaagatctatcgtaaccaatgctgcaccgcatgtcggtgccgatgtcgtgataaatctggatcttcaggacttcttcccttccatctcatataaacgcgttaagggtctgtttatatctctgggctactctgaggctgccgctaccatcttcgggttgatttgtacggacgctgcggttgaagccgtcgagcttgacggaaaaacttattatgtgtcgcttggcgaccggcatttgccccaaggtgcccctagttcacccgccatcacaaacttaatctgccgcagactagacctgcggctgacaaagatggccgccagcctgggatttgtttacacaaggtacgcggacgacttgaccttctccgggagcggcgaaaatctccgccaaatttgcaatgtgctgaagcggaccgaggccatagcaactcacgagggcttcacaatacaccctcagaagacccgtgtgctgcaccgctcacagcaccaggaggtaaccggcattgtagtgaatgagaaattaaacgtggaccgggagacacttaaacgctttcgggcaacgttattccatatcgaaaaagatggcctagccgggaagcattggggaaactatcctgatctgatccagagcatcgagggtttcgccaattttgtggcaatggtgaacccagagaaaggaggtaaacttaaggaacaggtccagcgaattaaggctaaataccggcccaagagggtgaaacgcattcgaagaaaaagcaactga

SEQ ID NO: 13453 - RNA, 1419 nt, unidentified
  source 1..1419: mol_type = other RNA; note = synthetic construct
atgtccgagcctagtcccccaaggacacgtgaagagttgtgggaccgcattcggcagacaagccgggaagaaataattctggaagagatgatacggctgggattctggccagcgcagggcgaacttcctcaggatcccgccgatgaaatcagaaggcggggagagatccaccgagaattacgcgaactcaaaagagaggatcggagactgcaagacgagaagattctccggaagcagatgcttgagaagcgattggccgagtcccgaagaaagcaacaagagacaaaagagagaagagagagagagagacaggagcggagcgctgcttgggaacagcgacgccagcaggagatactttatctgggcgaaggggtgtccggtggtttaaaccagaccgaagggctgtccgacaggctgcagcaacatagactgcccctttgtctgactgccgagcagctggccacagccatgggcttgacgatagctgcccttcggtttctcgccttcgcacgtcgtacctctccgacctcgcattatgttaggtttcaaatccccaaaaagactgggggcctcaggttgatcagcgcaccaatgcctaggctcaaacaggtccagtattggattctcgacaacatcctggataggctaaccccccatgacgctgcccacggcttttgccggggaagaagcatcgtaaccaatgcgctgccacacttgggggcagatgtggtcataaacctcgacttacaggactttttcccaacgatctcctatcgccgagtgaagggcctgttccgcagttttggttactctgaagccgttgcaacaattcttgctctgctgtgcactgagcctgaagtagagactgtggacctggatggacaaacatactacgtggcgctaacagatcggcgtctgccccaaggtgctccgactagccctacaatcgctaatctcatctgtcgtagattggacaggcgactgactgaaatggccaccactctgggcttcacctacacgcggtacgccgatgacctcaccttttctggctcaggagacgctctgcgccagatctgcaatctgctacagcgcagtgtggcaattctcacccatgagggattcaccgtgcacgatcagaagactagggttttgcgaaactcaaggcagcaggaggttaccgggattgtggtcaatcacaagctgaacgtggaccgcgagacactcaaacgcttccgcgcgatcctttaccagattgaaaaagatggacctgcaggcaagcaatggggccattctcgggatctgatggcctcaattcacgggttcgcaaactatgtcgccatggtgaatccagagaaggggcagaaattactagctcaggtcaaaaggatcaagcagaagtacaagagaaaacgcaggtga

SEQ ID NO: 13454 - RNA, 1431 nt, unidentified
  source 1..1431: mol_type = other RNA; note = synthetic construct
atgacagaacccgcccagccaagaactaggcaggaactatgggatcgtattcggcaaacttctcgagacgaagttatcctcgaggaaatgattcggctcggattttggcctgcgcagggtcagattcctcaggacccagcagacgaaatcaggcgtcgcggcgagattgaccgcgaattgaaggaactccgtaaggaagacagacaactgcaggatgagaaggtcctgaaaaagaggctgttagagcagcggctcgctgagagccgccgaaaacagcaggaaaataaagagagaagagagagggagcggcaagccaagtcagaggcctggcaggcacggaagacacaggagatattattcctgggtgatggggtatctcagggactgcatcaccagcaaggggatgagcaacgcttgcgttctctcgatcttcccatatgccacactcccgcagagctggcagctgctatggagatctcgatcggagaactgagatttctggcattcgaccgccatgtgagctttgtttcacactacgtgaggttccagatcccaaaaaagacaggggggacgaggttaattagtgctcccatgcctcgacttaagaggagccagtattggatactgaaacacatcctgaccaggataagtccacacgatgcggcccacggattccggcaagagtttagtattgtaacaaacgctcagccccatgtaggcgctgatgtgatcattaatttcgacctgcaagactttttcccgagcatatcatacaagcgggtcaaagggctatttcgctccctcggctattccgaggccgtggcaaccatcctgggacttctgtgtaccgagccagaagtggaagccattgaaatggatggcaaaacttactacgtggctctgaccgaacggcatcttccacagggcgcccctacatcaccggctatttccaacctcctatgtcgacgcctggatagaagattgagcgagatggccgagaacgcggggttcatctacactcgctatgccgatgacctcaccttctcctctgcgggcgacgctcaacgccagatttgcaacgtcctgaagagaacggagagtatcgtcacccacgagggttttacgatcaatcctcagaagacaagggtgttgaggagctcccagcagcaggaagtgactggcattgtggtcaatgacaaactgaacgttgacaaggccaccttgaaacgattccgagccaccttgtatcaaatcgaaaaagatggccttgaggggaagcaatggggtaactcccagaatcttctgtctgccatccatggctttgccaattttgtggcaatggtgaaccctgagaggggaaagatcttcctcgagcaggttcagcggatcaagcagaaatacggaaaaaagaagcggagagacagaccctga

SEQ ID NO: 13455 - RNA, 1413 nt, unidentified
  source 1..1413: mol_type = other RNA; note = synthetic construct
atgaccgagcagcctcgtacacggcaggagctgtatgacttgataagacagaccagcaaacaggaattcatcttgagcgagatgattcgcctggggttctgggacgagaattctaacaatccagaggaccccgccgaggagataagaaggcagggagaactgcagagacaattacaagaactccagcagcagaatcgccaattgcacaatgaaaaagctctgaaaaagcagcttctgaaacagcggttggaggagtctaaaagaaaaaggcaggaaacaaaggaaaggaacgagcgtaagagacaagagcggtcacaggcatggcaggaaaagcaagcccatgaaattacatacctgggcgaagatgtcagttccggcctgaacaatctagagaacaactgcgatcgtctccagaagaacaacctgccagttttccagaccatcgaggagctagccgcagccatggggatgaccgtaggtcagctccgcttcttggcattcgaccggaagacatccacagtgtcgcattacatccgcttcaaaatagctaagaagactggtggcgagaggctgattagtgcccccatgcctcggatgaagagcactcaagattggatcttagaccgcatccttgagaagattcccatgcacagcgcggcacatgggtttcgcagagggaggtccattgtcacgaatgccactccccacgtgggaactgatgtggtggtgaacctggacctgcaggatttctttccttctatctcttacaagcgcgtcaagggcctctttcaggccctgggctactcagaagctatcgcgaccgtgctggcattagtgtgtaccgaagctacaacagaggaagtggagctcgatgggaaaagttatttcatcgccacttctgaccggcaccttccccaaggggcacctacctcaccggccataaccaatctgctatgtcggaggctggacaagcgacttgccaatatggctgtgtcccagggctttatatatactaggtatgccgatgacctgacgttttcaaccagcggggacgccattagaaatctgtgcaatatccttaaacacaccgaaaatattgtgagtcatgaaggttttacgatccacccaaacaaaaccagggtcttacgaaagagccagcagcaggaagtgacaggtattgttgtaaacgaaaaactcaacgtagatcgggctactctcaagaaattccgagctactttgcaccacattgagaaagatggactggcgggcaaacattggggatccggcaacgaccttatggcagagatcgagggatttgctaattacgtcatgatggttaacccggagaagggcgagccactggtcaaacaagttaagctcatcaagaagaagtacggactcagaaagcgatga

SEQ ID NO: 13456 - RNA, 1416 nt, unidentified
  source 1..1416: mol_type = other RNA; note = synthetic construct
atgaccgaacaaccccggacccgtcaagatctgtacgatcgcatcaggcagagctccaaagaggagttcatcctagacgagatgatccgacttggcttttggtcagccaatggggaaattcccaacgatcctgcagacgagattagaaggcgtggcgagattcagcgagagctcgagactctacgggctgaaaataggcggctgcacaacgaggaagcactgaagaaggaagccttgaagctccgtatggcagagtctcgacggaaacaacaggaaacacgcgaaagaagagagagagaacgccaggagagagcgatagcctggcagacacggcaggaacgggaaatcacatatctgggagccggggtcagtgcgggcttgaatctcacggagtctaatctggcaagactccagcagcataggctgccaatcttacacgcggctgccgacctagctaacgccatggggataactgtaggacagctcaggtttctggcattcagtaggcgcatcgctaccgtgagtcactacgtgcggttccagatccctaagaagactggtggctttcgcgctatcagcgcaccactgccgcgtcttaaacaggcccagcagtggattcttgataacatactcgagggtgtggtccttcacccaactgcacacggctttcgtcgcgggcggtcaatcgtcacaaatgctgagcctcatgttggagctcttgtggtgattaatatggacctccaagacttcttcccctccatctcatacgccagggtgaagggaatcttccgctccttgggttacagcgaagccatagcaaccattctgggtctgatttgcactgagtcggacgtgacagagatcgagttggacggcaggtcttactatatagcccaggagctcaggcatttgccccaaggggcacctactagcccagccctcactaacttactgtgtcgaagattggatagacggcttgataggatggccaagagcaggggatttatttacacccgatatgcggacgacctgaccttttccacgacagatcgcgagcgcctgcgggatataggcaacatcctcaaagggacgcacgggattgtcacacatgaaggactgaccatccatcccgacaagacccgggttctgcgccagtcacagcagcaggaggtaaccggcattgtggtgaaccagaaattaaacgttgacagaacaaccctgagacgatttagggctaccctgtaccaaattgaaaaggatggcctggccggcaaacagtgggggcaaggtgctgatctgttacagtccattgccggattcgccaattatgttgccatggtcgaccctcacaagggccgcgaattcctggcttctgtgcagcgaatccaaaaaaaatatggaagaagaaagcggtga

SEQ ID NO: 13457 - RNA, 1488 nt, unidentified
  source 1..1488: mol_type = other RNA; note = synthetic construct
atgacgagccagcctgagacgcggcaagccttgtatgatcgcatcaggcagtccagcaaggacgaggttatcctcaacgagatgatcagactgggattctggccaactgccgggacacttcccgaagatcccgcggaggagattagacgccaggccgaaatacaacaggaattggccgatctcaggaccgagtctaggaagctcaacgatgaaaaagcactgaagaagaaactgctgaagcagcgaatggaagcatccaaacaaaagcagcaggaaacaaagatccggagagacagggaaaggcaagagcgggccgctgcatggaagtctcgacaagcgcaggatactagactcccctgggaaggagtgtcagccggactgtcgcaaaccggctgcgatcgtgaccgcctgcagcagtatcacctgcccgagttagggaccgccgctgacatagctcaggcgatggggttgcctctcggtcagctgagatttctctcattctcccggagaatctctcatattagtcactacgtgcgatttcgtatcgcaaaaaaaaccggcggtgataggctgatttctgcccctatgccacggctgaaggcagcccagtactggattgtcgctaacattcttgagccgctgaaagtacacgacgcagcacatggcttttgcaggaataggagtattgtgaccaatgcgacacctcatgttggggccgacgttgtggtaaatcttgatctcaaagacttcttcccctccatctcatatgctcggatcaaaggactgttccgtgccttaggctacagtgaagccgctgctacaatatttgccttgctatgtaccgaggccgatgtcgaggaggtagagctggacgggcggacatactatgtggcacagagtgctcgccgcctgcctcaaggagctccaacatctcccggcctcactaacatcctgtgtagaaggttggaccgccgacttaccggactggcgcaggaactgggctacacctacactaggtacgccgatgacctaacattcagcgcaagcggtgcagctgccggacaagtcggtagactattgcgccaggttaaagacatcgtcactcatgaggggtttgaagtgcacccgaagaagacgcgagtgcttcggcaaagccgtcagcaggaggtcactggcgtggtggtgaatgagaagcttaacgtggaccggaaaaccttaaaacggtttcgcgccaccctgcaccatattgaaaaagacggattcaagggcaagacatggggtcaccagtccgacgttcagactaacgtgcaggctaatgtccaggcaaacgtacaagagtcagatattcagggctccaatctcttaagcgctgtgcaggggtttgccaattatgtgtatatggtcaaccctgaaaagggcgggccattcctcgaccaggttaagagaataaaacagaagtacaagctggatcgcaaaccaaagagatga

SEQ ID NO: 13458 - RNA, 1428 nt, unidentified
  source 1..1428: mol_type = other RNA; note = synthetic construct
atgaatcagcagcctcagacaaggcaagccctgtacgatcggatcaggcagtctagcaaggatgaagtgatcttgaccgaaatgatccggctgggattttggccatcaagcggcgaattgcccaatgatcctgctgaagagatccagaggcagggcgagatccagagagagctatcagagctgagggcagagaatcgcaaattaaacgacgaaaaggccttaaagaagaggctcctgaaggagcggcttgtggcctccctgcagaagcggcaggagacgaaagcccgaagagagcaagagcgccaggaacgcgcagccgcatggaaagctagacaggctcaggacattacctatctcggtgagggggtgtctagcggtctgaaccacgtagaatgcgatgtcgaacgactgcagcgccacaatctaccagagttaggcaccgctgccgcaattgccgccgctatgggcatttcggttggcgaactcagatggcttgctttctccagaagaacttcccaagtctctcattatattcgattccgcattcccaaaaagactggcggcgagagacttatatccgctcccgctccccggctgaagaaagctcaatattggatcgaggcaaacattttgcaactgatcgagattcacgatgcagcccacggcttctgtcggcagcgaagtatcgtgactaacgctcagccacacgtcggggccgatatcgttacaaacttggaccttcaggacttctttccctcagtctcctaccgccgtgtgaaggggatgttcagggcgctcgggtactctgaagcagccgcaaccattttcgccctgatatgtaccgaacctgaggttgagatggtagagctggacgggaggacatactacgtcgcacagagcgacaggcggctgccacaaggagctccgacatcacctagcattaccaatatcctctgccatcggcttgaccgtagactcacgggacttgcccaggagtttgattacgcctatactcgctacgcggatgacctgacatttagtgcctccggagccgcaactgaacaagttggccggctgctacgacaggtgactcagatagtaagtcacgaaggcttccaggtgcacccgcagaaaacacgtgtcctccgaaaaagccggcaacaggaagtcacgggtatcgttgtgaatgacaagctcaacgtggacagaaagaccctgaaacgctttcgcgcgaccttgtaccagattgagcaagacggactggccggaaaggtgtgggggcatagtgccgatctgatgggagctatcgagggtttcgcgaattatgtgtatatggtgaacccagataaagggagccattttctcgcgcagatcaagagaataaagcaaaagcaccgtcctaaaaggcatcagcccaggaaatcttga

SEQ ID NO: 13459 - RNA, 1431 nt, unidentified
  source 1..1431: mol_type = other RNA; note = synthetic construct
atgagcaaccaaccaaggactagacaagaactgtatgacagagtgaggcagtccagcagggacgaggtcattttggaggagatggttcgcttgggcttttggcccgcagagggggagatgccacaagaccccaccgatgaaataagacgaaaaggcgagatccagagggaactggccgcccttagggccgaaaaccgcaagctacacaacgaggccgcaatcaaaaaacagctttacaaagagcgcctggctgcatctaagaagaagcgacaggaaaccaaggaacgaagagagcaggaacggcaatctagggctgcggcctggcgtgatcggaaagccagagatattgtatacctgggcacaggcgttagcggtggcctgaatcaaactgaatgtgacagaactaggctccagcaatacggccttcccgcctacggaacggccgaagagatcgccaaggcgatgcagataagcgttggccagctgcgtttcctggctttctcaagacgaaccgcacagatatctcactatgtccgattcaaaatcccgaagaagacagggggggaacgccttattagtgctcccatgccgcggcttaaacaggcccagtattggatcgctgagaaactgctggcagctatccctttgcatgaagcagcgcacgggttctgctcagggaggtccatcgtgactaacgcaaccccacacttgggagccgacgtggtgattaatctcgatctccaggatttctttccctccatttcctatccccgcatcaagggtctgttcaggagctttgggtacagcgaggcagccgcaacaatttttgcgttgctgtgtactgagcctgatgtcgtggaggtagggctcgacggccaacactattatgtggctcagagtcaacggcacctccctcagggagcccccacatctcctatcctaacgaatttactgtgccgcagactcgacagacgtttaaccgcaatggcggccgaactgggctacaggtacacccgatacgctgatgatctcaccttctccgctactggacagccgcagcaacaggtgggaaagctgcttcggcggacacatgcaattgttacacatgaggggttcaccatccatccacagaaaacacgggtcctacgctcgggtagacaacaggaggtcaccggtgtagtggtgaacgagaaactgaacgtggaccgcaagacgctgaagcgtttcagggccttactccatcagatagagcagagtggttatgacgaccagcactggggcggacagccagtgtcatttgctcagattcagggatacgccaattttgtcgagatggtgaatcctgaacggggagcccagtttcaggcccaggttaagcggatcaagcggaagtaccctcctcgcgtccaagcttttaaaccagcttcatga

SEQ ID NO: 13460 - RNA, 1545 nt, unidentified
  source 1..1545: mol_type = other RNA; note = synthetic construct
atgtccaaccaacgcccacgaacccgtcaggaactgtatgagaggatcaggcagacgtccagagaggaatttatactggaggaaatgattcgttttggtttctggcctgcgcaaggagaaatcccccaggatcccgccgatgaaatccggcgcagaggtgagctgcagcgacagctgggggagttgaattcccaggagcgcaatctgcgcaatgaagagaagatgttgaaagagctaaggaagcgtcggatggaggaatcaaagcgaaaacggcaggaaactaaggagcgcagggagcggcagagacaagagagagccaaggcttggcaggagaagaagaagcaggacattacctatctgggagagggagtttctgcagggctaaataacaaagaagtgaactcatctcggcttaaccaacacaatctgttaagctactctaatgctagcgagatcgctagcgcaatgaacataagcattaacgccttgagattcctcgcattcactcgcaaaacctcaacgacatcccactatgtgaggtttaaaattcctaagaagacagggggcgaacgcatcataagcgcccccatgccaaggctaaaagcagcccagaattggatactccacaacattctcgaaaaagttacattgcacgacgcggcccatggcttttgtcagaaacatagtatcgtgactaatgctaagcaccatatcggcgcagaggtgatcgtgaacattgacttaaaggatttcttcccctcaatctcttataagagaatcaagggcctcttcctgtcgcttggctactctgaggcagctgctaccatcttcggcctgatctgcaccgaacccattgtcgagcaggtcattctcgatggcaagacttactacgtggccacgtcagaacgtcatttacctcagggggcccctaccagtccagcccttacaaatattctctgcagacgactggataagcggctgagtaaaatggcctcgaatctggggtttacgtacactaggtacgctgacgatctcacttttagcgccaaaagtgaggccagtagaaacgtctgtaatatccttgccaagaccgacaacatagtcaaacacgaggggctgacaatcaactccgaaaaaacacgggtacttaggaaaggtcggcagcaggaggtgaccggtatcgtggtcaacaagcaactgtccatttccaaaaagacactgaaaagattcagggcgacccttttccagatcgagaaggacggacctgacaacaaacactggggacatagcaaagacgtcattgcttctattcaaggattcgcgaactttgtttatatggttagcccagaaaaaggccgcctgctcaaaactaaggtaagggctatcatcaaaaagtacaattggaaagcagcacagcggaagcgattgccactcccgctgactaccgtaccacctacagtgcaggagattcaaaaggtgcccgagacagtgatagaaaagccgcaagaacagaagaccaataagaaatggtggaagttgttttga

SEQ ID NO: 13461 - RNA, 1557 nt, unidentified
  source 1..1557: mol_type = other RNA; note = synthetic construct
atgagtgaacggccaagaacccgccaggaactctatgagaggatacggaagacctctaaagaggagttcatcctggaggagatgattaggtttgggttctggcccgccgagggacaaatacctcaggatcccgcagacgaaatcagaaggcgcggcgaaatttccaggcaattaaatgagctgcacactcagaatcgacacctcggaaatgaggagaagatgcttaaagaactgcgtaaaaagcggatggaagagtcaaaacgcaagagacaggaaacgaaagagcggcatgaacgcgagaggaaggaacgtgctgaggcctggaaggagaaaaaaaagcaggacattatctatctcgggcagggggtgtcttcagggctgaacaataaagagtccaatgaagagcggctgaaaagctacaacctccctaagtattccaacgcgagcgaaatcgctacagcaatgtccattagtattggagccctgcgctttctcgcattttctcgaaaaacatcaactaagacacactacgttcggtttaaaattcctaagaagacaggcggtgagcgtaccatcagcgctccaatgccaaggctcaagtccgcacagaactggattctacacaacattctggagaaggtaaagctgcacgacgctgcgcatggcttctgtacccaacattctattgtgagcaatgccaaaccacacataggagccgaagtcttggtgaatatcgacctgaaagatttcttcccgtctatctcatataaacgcatcaaggggcttttcaagtccctgggctacagcgaacttgccgccaccattttcgctcttatctgtactgagcccactgtggaggaagtgtcgttggacaatcagacgtactacgtggcaacttccgccaggcatcttcctcaaggcgcccccacatcacctgccttgaccaatatactgtgccggagactagacaagagactgactgaagctgctaaggagttaggctttacctatacaagatatgccgacgatctgacctttagcactaaaggcgaattttctcgaaacatctgcaacatcttgaacaaagcgcatgatattgtgaaacacgaaggtctgacggtgaactcagaaaagacccgcgtcttaagaaagggtcggcagcaggaagtaacaggagtcgttgtgaacaaaaagctcaacatcagtaagaagactctgaaaaagttccgagctacactctaccagatcgagaaagatgggcccgagggaaagaggtggggtcacacccccgatgtcatagcagccattcagggcttcgcaaattttgtgttcatggttaaccccgagaaaggcagattgctgaaatcgaaagtgaagagcatcatccaaaagtacaattgggtaccagagtggaagcgaaagctcagtagcccgtccgaggttcagcctaatgtgtctacactaagcacccttccagtcaccagtacagagaacaaggtcgagactcagaaaacaaccgaaaataagacgaacaagaaatggtggaagctgttttga

SEQ ID NO: 13462 - RNA, 1575 nt, unidentified
  source 1..1575: mol_type = other RNA; note = synthetic construct
atggatagaccccgcactagacaggaactctacgagcagatccgcagaacttcacggcaggaatttatactagacgagatgattcggctcgggttctggcctgcagccggtgttatgccccacgaccccgctgatgaaatcagaagggaaaccgagatcaggcgggaaatcgctgaggtgcaccagcaaaaccgccacctatataatgaggaggccttgaagcgagagatgcgcaagcggaggattgaagagtccaggcgaaagcagctcgaaaataaacagagacgagagctggcacgtcagcagagagctgcggcgtggaacgaaaaaaagcaaaaggaaattggattcctgggggaaacagtaagcggggggctcaaccagaccgaatgcaaccaaggcaggttggagaagttttctttgccccgctttacaaccccggaggagatcgccaagggcatgaatctgtccgtccctcggctgaggttcctggcttttgataggaaaactagccgagtctctcattacgtccggttccagattccaaagaagacaggaggcgttagaatcatctccgctcctaaaccctacctcaaagcagcccaggagtgggtgctgcagactatcctggagagggtaccagttcacccagctgcccacggttttctcgccggacactcaatcgtgaccaacgcccagcctcatctgaaggcggacctcatcctgaacgtggacttgaaagactttttcccgagcgtgcattaccagagggttaaagggttgtttaagagcctggggtatagtgaggccgccgcaaccgtgttcggccttttatgtactgagcgcgatacgcaagaggtagagcttgatggagagcgatacttcgtgggtctttccgaacggcgattaccgcagggagcccccacaagtcccgcgataaccaatctactgtgtcgcaaactggatgcccggctgcataaactcgccatgaagcacggcttcgcatatactcgctatgctgatgaccttacatttagcgcatcaggtcctaatactcgtaacctttgcaatgtactgaaaggcctcgcagccatcgtcacccatgagggctttacaatcaacccatctaaaacccgcgtcctgagaaagggcgaccagcaagaggtgacgggaataattgtgaatgaaaagctgaacctggcaagagaggtcttgaaaaaatttcgggctattcttttccagattgagaaagacggccccgagggtaagagatgggggacatcgcccgatgtcattggaagcgtggtgggctttgctaactatgtgagaatggttaatcctgagaagggcgctcaattccaagcacaggtgaggcgtataattgaaaagtacgggtggaaacgtgtgcggatgacgccagccaagccagctgaaatcgccttcgaccccgccccaaccatgattttaacctccgcaccacctcctcccgaaccggaagaaaagcctcctgttgctccccaggcgccaccaagttctgccgacggaaagagtaaaaagtggtggaagatgttctga

SEQ ID NO: 13463 - RNA, 1554 nt, unidentified
  source 1..1554: mol_type = other RNA; note = synthetic construct
atgatggaccaaccacgaactcgacaggaactgtacgaacgcatcaggcggactagcagagaagaattcattttggaggagatgatccggctcggcttctggccaagagagggacaaactccttctgaccccgctgacgaaattcgccgcagaggagagctgagtcgtgagctgaccaaattgagaacggaaaatgcccggctgtacaatgagcaggcacttatccaggaaatgcgaaaacgccgcctcgcagagtccaggcagaaacagcaggaaaccaaagctcggcatgaacgtgaaagacaggagcgcgcacagaaatggagagaaaagaaacagcacgagatagtgtttctgggtgagaaagtttctggaggcctgaattacacggagtgtgatgaggctaggttgaaccagaacggcctgtcagccttcagcactgccgaggatatcgcggccgccatggggatcagcctctcagaccttcggtttctggctttcgacaggaagacctccacagtttcgcactacgtgcgtttcaaaattcctaagaaaacagggggggaacgactgatttcagctcctaaacctcacctgaaggccgcacaagaatggattttgcacaccatcctggaaaaagtcactctacacgaggccgcacacggttttcgaaccggccgttctatcgtcagcaacgccaggccccatcttaaggccgaggtgattataaacatcgacctgaaggacttctttccgagcatcgcataccccagggtgaaggggctcttccggagtctcggctatagcgaacaagcggccacgatttttggcctcatctgcacagaaccggatgtcgaggaggtcgaattagatggcaagacatacttcgtagcgctcagcaccaggcacctgccacagggtgcaccaacctctccagctctcacaaacatcttatgtagacggttggatcggcgccttacaaaactggccgagaaccgcggttttgtgtattcaagatatgctgatgatctaaccttctctgcctccggtaatgcaaagcagaatatatgcaatgtgcttaggggcgtagagtccatcaccgctcatgagggactggccattaacacagagaagactcgaatcttacggcattctcgccagcaagaggtgactggcgtggtggtgaacgagaaactaaacgtttccagagaggagctgaagaggttcagagccgtcctgtttcaaatagaaaaggacgggcccgaaggaaagaggtgggggaactcgaaggatgtgattgctagtattcagggattcgcgaattacgtggctatggtcaatccggagaaaggcgccgagtttcaggcgcaggtaaaggctatcatacagaagtatgggtggcaacggcccgcatcccatagaaggagcatggcctcaagcgagtcccagtatcctggacctgcttccgccccagagcccgaagttacctcacccgcaacacctgaaagtgagtctagtaagagtaatgacaagaaatggtggaagcttttttga

SEQ ID NO: 13464 - RNA, 1524 nt, unidentified
  source 1..1524: mol_type = other RNA; note = synthetic construct
atgacaactcagccaaggactagagaagaattgtaccagaggatccgacaaacgagcaggcaggaatttatcctcagcgacatgatcaggctgggattttggcccgacgctggtgtcatgcctgaggatccagcagacgagataagaagaagaggcgaactgcaacggcagctcgatgagttacgtgcccagaaccgaaagctgcacaatgagcaggctctgcttaaggagctgcgaaagaagcggctgctggagagtaagcagaagcaaaaagagacgaaggaacgccgtgaacgggaacgtctggagcgggctgaaaagtggcagcaaaggaaggccaaggaaatcggctacttaggaaaagaggtttcaattgggttgtcgtacgctgagtgcaacgccgaaaggctatctcagtacgggctcccacacttcgaaaatgccgaacagatagcagcagccatgggcattacagtctctgaactgagatttctcagcttctcccggaaaacctcaaacgtaaaccactacgttagattcaaactgcccaaaaaaactgggggcgagaggctgatttctgcgccaatgccccggctgaagcacgcacagcagtggattctgaccaacctcctagagaaggtgcagttacatgatgcggcacacggcttccgcgctgcccatagtatcgtcagcaatgcgaaaccccacctcggcgccgaggttattatcaatcgcgacctgaaggacttctttccctccatttcatataaacgcgtaaagggagtgttcaaaagtttgggttatagcgacgccgctgccactatctttggacttctttgcacagagcctgatgtcgagaaggtggagctggatggtagaatctattacgtggcgaccggcgaaaggcatcttcctcagggggcccccacatctcccgctattaccaacattctctgtcgaaggcttgataggcggatgcagaagatcgcagatgaatgcgggttcgtttataccagatacgctgacgatctgaccttttccacatccggggagagcaagcagaatatatgtaacgttctccggagatctgagtccgtggtggcccacgaaggcctggaactgcatccagacaagacccgtgtgctccggaagtcacgccaacaggaggtcaccggtatcgtagtgaatgagaaattgagtatagatcgcaaagagctgaaacgctttcgagccgtcttgttccaggtggagaaggacggacctgacgggaaacattggggcaagagccccgatgtcatcgcctcgcttaaaggattcgccaactatctccaaatggtggacccggagaaagctgccgagtaccaaaaacgggtgcacgcattgattgagaagcatggactacagccgtcccagtttacatatcgcaatcctgcagctccagtggatgcagctcctgccagacctgacttaccgaaagaagagactaagcctaaaccagaaaagaaacgctggaagctgtggtga

SEQ ID NO: 13465 - RNA, 1515 nt, unidentified
  source 1..1515: mol_type = other RNA; note = synthetic construct
atgtctaccgagcggccacagactcgagaggagctctacgagcgaattagggacgggcggaaggaggaattcgttctagaggacatgattcggcttggattttggcccgcccggggggaaatgccacatgatcctgctgatgaaatccggagacgggcggagctgcagcgtgaattgggcgagttgagggcacagcacagaaacctttataacgaggaggcgctgataaaggagcttcgtcgtagacgcctggaggagagtagaaggaagcgccaggaaacaaaggagagacgcgagagggagaggagggaacgtgccgaagcttggcggcagagacagggccaggaaatcgtttatctgggggaggccgtgtcaggcggattaaatcacaccgagtgtgacgcagccaggttgcaatcgtacgggttgcccccccttgggactgcagctgagattgccggtgcactgggtgtaagcgtcggggaactgagattcctcgcctttgatcgcaaaacatctactgtgtcccactatgtgaactttcaggtacctaaaaagacaggcggattgcggcagatcagcgcacctatgccgaggctcaaagcggctcagcactgggtccttagaaatgtactggaaaaggtggaggctcatgagtgcgcccatggcttcagggctggtcgcagcatcgtgtcaaacgctcgaccacacgtcggagcggaagcagtcgtgaatctggatctgcaagacttctttccgagtattggatacagacgggtcaaggggctgtttagggccttcggctactccgaagcggcagccaccatcttcggtctgctctgtacacaacctggtacagaggaggtggaattagacggacgccgctatttcgttgccaccggcgaacgccaccttcctcaaggcgctccaaccagtcccgccgtgaccaacatcctgtgccgacgactggataggaggttgctcaaggttgctgacgagcttggctttgtctatacgcgctacgcagatgacctgtctttttctgcttccggcgaaagcttaagacatctggggaacctgctcgagagagtgaaggcagtggtgcgccatgaagggttcaatgtccaccccgataaaaccagggtgctacggcgcagccgacagcaagaggttactggcgtcgttgtcaatgacaaacccaatgtgtcccgatccgaactaaagagatttcgcgccacgctgtaccaggtagaaaaggacggacccgcaggtaaacgatggggacggtcacccgacgtgatagccagcctgctcggatacgccaacttcgtgtatatggttaatcctgccaagggagccgaactgcagagaaggacacgtgccctcgcagataaatacggccacgagcctgtgaaagtggagcggccgtcaagacggcggcaaccagaacctcaggccgctgctccaagtccagaaccccagccaactcagaaaaaatggtggaagctctggtga

SEQ ID NO: 13466 - RNA, 1509 nt, unidentified
  source 1..1509: mol_type = other RNA; note = synthetic construct
atgtccgctctggctgtcaaaccactaactcggcaggaactttacgagagaatggcagaaaccagcagagatgaagtgatccttgaagagatgatccgcttcggcttctggccagcgcaaggcgaagtgcctttcgaccccgccgatgagatccgcagaaggggggagttgcacagggcactggacgaactgagagccgagcagcggaaactgggggacgaagccaagctgcgcaaggaggcccgtaaaaaacggctgcttgaatcacgtcggaagcagcaggagacgatcgtgagacgggaaactgaaagaattgaacgcgctacacagtggcaggagaaaaaatctaaagagatcggctacctaggggcaggggtttccgctggactagataataaggaggccaatgtcgagaggttacagcgatacaatctgccaagattcgacgacgctgcaagcttggcccaggccatgggcctgactgttggtgccctgaggtttctctccttcgcccgcaagactagtaagaccacccattacgtccggtttgcactccccaagaagaccgggggagtacgagtgatatccgccccaatgccccgtctgaaagccgcacagcattgggtcctgcagaacatcctgcagccagttgaattacacgaggcggcgcatggatttcggcctcagaggagtattgtgagcaacgcccgaccgcacgtagcttctagcgtggtgatcaatctcgacttgaaggacttttttccgacactcgattatcgccgcataaagggagtgttccgagctcttggctacgctgaggccacagcaaccattttgggcttactgtgtactgagcctgaggtcgagaaggtggagctcgatggagaaacttactatgttgctacatccgcaaggcacctcccacagggagcccctacctcacctgcgcttacaaatattttgtgccggaggttggataggcgactcctgaaagtggcagaggaaatggggtttgtgtatacccgatatgccgacgacatgacgttttcaacaaagcaggagcaggatagtaagcagattgggagacttctccatagagtagagagcatagtggcgcacgaaggtttctgcattcatcccacaaaaaccaggattatgcgtagcgcctcaaagcaggacgtgactggcatcatcgtcaacgacaagccttctatcgataaagccaccatgaaacgcttcagagctgtcctgtttcaagttgagaaggatggccccataggcaaacagtggaaccactctagggatgtgctggcctcgctgcgcggttttgctaacttcatcttcatggtcgaccctgctaagggagcagcctatcaacggcgggtgggtgctctgattgacaagtacgattggaagccccaacctctcccctatcaaaagaagacgaaaccagttgaacctcccgccccgcaacccgtagcacaaaggccatggtggaaattatggtga

SEQ ID NO: 13467 - RNA, 1506 nt, unidentified
  source 1..1506: mol_type = other RNA; note = synthetic construct
atgtcggaacagccccgaacacgccaggaactgtacgaagagatccgccggcaaggtggccgggatgtctacgttcttgaagaaatgattagactcggcttctggcgtgagagcacaggactgcccgacgatccggctgaagagatcaggagagccgctgagctgcaagccgaactggacagactgcgcgccgacaaccggaagctgtatgacgagcaagcgatgctgaatgaactcagaaagaagcgcttggccgaaagcagggagaaacaaaaagaaaccagggcgcgtagggaacgggagcgacaagagaaagcggagaactggcggcgaaggaaagaaaccgagatcctctaccttggagctgaggtgagcgggggcctgaataacaatgagactgatcgggagcgcttagagaggggcggactacctgtgttttctaacgtcgaagaactggcacgcgcaatgaacctgaccgtgggaaagattaggttcctcgcttatgataggcgaacctccgagacaacacactacgtaaacttcaagctgcctaagaaaactggggggcatcggctcatttccgcccccatgcccgcattaaaagccgcccagacttggatcttggagaatatcctgggccgtgtggcagtgagtgatgctgctcacgggtttctgcccgcaaaaaatatcgtctctaatgcaagactccatgtgggcgcacagaccctcgttaatctcgacctcgaaaattttttcccttcaatcgggtaccgcagagttaaaggtatttttagggccttcggttatggtgaagccctggcaacagtcttcgcgctgttaacaaccgctccagatactgaggagatcgaactggacgggaaaacttactttgtagccaccggcgaaaggcatctgccccagggtagtccagcctctcctgcgctgtcaaatattgccgccagacgactggacaagggactagccaagttggccgctgcccacggctgcaagtacacgagatatgcagatgaccttacgttcagcaccgaggaccgcgatgctgcaataggccggttactagcacaggtgaggtttgtggtggaaaaacagggattcaaggtcaacgaaaagaagactcgggtgctaaggcgggggagacagcaggaggtaacaggaatagtcgtgaacgacaagctttccatagatcgcaagaccttgagaaaattccgggccgtgctttttcaggctgagacgaagggcttggagaaccttagatggggaaactctcctgacctggtcgccgccttgaaagggtatgctaactttgtgtttatggtagacaaagagaagggctacgctttccagcagcaggttcgccgaattgccgagaagtatgattggcagccagctccccctcgtttcccgccaaaaaaaaaggttgagccagaggaacctgctccagagaagcccgcaaaggatgagaagccatggtggaaactctggtga

SEQ ID NO: 13468 - RNA, 1506 nt, unidentified
  source 1..1506: mol_type = other RNA; note = synthetic construct
atggaacagcccagaacacgccaggagctttatgaatatgtgagacagcatggggggagggacgcttttgttgcggaacagatgatccgtctgggcttttggaagtcctccgacctgccaaatgacccagtggaggaaattaagcggatacacgatctgcaagaggaactgaacaaagtccggaatgagaacagaaagctgttcaacgagcaggccttattgaaggagctgagacaaaggcgcttggctgaaagcaaacagaaacagaaggagacaaagttgaggcgtgaacaggagagaaaggagcgagccgaggcatggcagaaacggaaggagactgaaattgtttacctaggtgaaaaagtgtctgggggcctcaacaacttcgaagagaacgccgaacgtctcacagccaacgacctcccaagtttcgctaacattgagcagcttgctaaggctatgaacctgaccgtaggaaagctccgattcttggcgttcaataggcaaacatcagagacaaagcactatatccactttcagctgccgaaaaaaaccggcgggtttaggctgatttcggcccccatgccacagttgaagacagcacagcactggattcttcacaacatacttcagaaggtgagcgttcatgaagcagcccatggcttcctcccagagaaaaatattgtgtcaaatgcccaacctcatgtgggcgccaaaatcgtggttaactttgacctgaaagatttcttcccctctataaattttcctcgggtgaaaggtgtgttcagatcattcggatactccgaggccatcgcaaccattttttctctcatctgtactgcccccgagacagaagaagtggagatcgacgggaagacgtacttcgtcgctatcggcgagcgccatttaccgcagggtgctcctactagtcctttcctgactaatatcctctgcaagagactggataaagggctacagacgctggctaagaactacgattttacgtacaccaggtatgcagacgacctcactttctcaacaaaaaacgatggcgagaagctcactgatttcatcaataagatccgctacgtcgttgagaagcaagggctgaccatcaatgagagtaaaacccgaattctacgaaagggccggcagcaggaggtgaccggaattgtcgtcaatgacaaaatatccgtaaatcgcaagaccctgaggaagtttcgggccgtcttacaccaggccgagactaaaggactggagggacttagatggggtaatagcaatgacctgatcgcatcccttgacggatttgctaactttgtactgatggtggatgcagaaaagggcaagatgtataaagcccaagtaggccggatagcggaaaagcacggatggaaaagctctaggagcggtaaattcacccctcaagagttgcgcgaagtggtcgaaaagaaggaagagaagcccaacgataatcagggaaaagattggtggaaagtgttttga

SEQ ID NO: 13469 - RNA, 1587 nt, unidentified
  source 1..1587: mol_type = other RNA; note = synthetic construct
atgaatcaagcccgccaggccctgtatgataggatccgggagagctctaaagacgaagtcatactggaagagatgatagctctcggattctgggaccctgctcagcctggcaaagaggcagcagccgagctgatcgggaagaccgctgaactggagcgcgaaatgtccgcactgcggtccgagatggccaggatcgataaccaggaggccatgcttaaagccctccggaaacggaatatggagcaggcgaaagcaaggcgcgttgaaactaagaagcgcagagaggcagagcgccaagctagggctgaggcatggaggctgaaaaagcagcaggatattctctacctgggtgaaggttatagccatagtctaggggaacagggagcttgtgacgcagccgccctcgacgaaaacggtgctctgccggcatatgagaatgcggccgcccttgctgccgctatgggaattagtattggagaactccgatggctggcctttgggcgcaaggtgtcacagacaacacattatcagaggttccaggtacccaagaaatctggcggactacgacttatcagcgcaccaatgcctagactgaaggagatccagtcctggattctgagagaaattttagagaaggtgcccattcggtcagcggcccgtggctttgtgagaggcaagagtattgttgacaacgctcggcctcacgttggtgctgacgtggtgatcaacgtggacatcaaagacttcttcccaactgtcacatacccaagagtaaaaggtgtgttccgcaagttggggtatcgtggccaggttgccactatcctggctatgctgaccacagaaccagaaatggtcgctttggaaatggatgggcagcgctattggatggccaagggtgagagacggttacctcaaggcgcgccctcatcgcccgccttaaccaacattatctgcaggggcctggacgccgaattggaggagctcgcgctggttaatgagtacgagtacacacgctacgccgatgacatcactttcagcaccaggggccgagaagccaataggcggatcggaggagtattgagaaagattgaacagcacgtcggcgctcatgggttcaccttgcacccagataagacgaaagtgctgcgtaacaatgcccggcaagaagtgactggcatcgtggtcaacgagaaactttccgtagaccgaaagaccctacgaagatttagagccgtgatgttccaggtggagcaagacgggcctgagggcaaacattgggggcaagcagagcacgtgatagccggccttacggggtacgcccactttctcaagatggtggatcccgcccgagcacagccctttctcgagcagctggcacggatagttgaaaaacacggaaaccctgtctaccccgagagaagagccgcacgtgctcctagctggaggaggtaccagccggattctgatcaagcagaggcgacagatgctgcgccagcagctaatgaagcacccgcccatccgtcaggatctgagggcgaagctgccacccccgtcttggagaagaagccatggtggaagttttggtga

SEQ ID NO: 13470 - RNA, 1599 nt, unidentified
  source 1..1599: mol_type = other RNA; note = synthetic construct
atgaataacgcaaggcaggagctgtacgacagaattcgcgagtcttccaagaaagaggtgattctggaggaaatggtcagtctaggcttttggaatgaggccgacccagcctttcagaaggcccagggcgcgatagagaggactggagagctcgaacgcgagatgagggcgctgcataccgagctgagccgcttagagaacaaagaagccatgatcagagccatccgtaaacggaacatggcgcaggccaaggaaaggcgcgcagagacaaaggcgagaagactggccgccagaaaggcacgcgccgagaagtggcgcagggagaaacaacgggacatactgtacctcggagacggccattcgcaaactctgcaggacagggaatcagatgctgcccggttgggcagaaccggcgaccttcctgtcttgcatgatgctgctcagctagccagtgcaatggagatttccgtcggggaattacgatggctggcgttcggtaggaaggtgagcaaagtcgcccactaccagcggttctacgttccaaaaaaaacaggcggtttgaggctgatagccgcacccatgcctcgtctgaaagaaatgcagcgatgggtccttagggagatcctcgagaaggtgcccctacacgaggctgccaccgggtttcgcaatggtatctctatcgtggataacgcacggcggcacgtaggctccgatgttgtgatcaacatggaccttaaggactttttcccgacactgagctatagacgtgtgaagggtgtgtatagaaagctcggctactctgggcaggtggcgaccatcctggccatgctgacgactgagcccgaaatggatagggttgagatggatggaaccctttactgggtcgctcgcggcgaacgacgacttcctcagggggctcctagctccccagcactgactaatattgcttgcaggcgtctggataggcggctcgccgcattagcagaggagtggggctatagatattcacgatatgccgatgacttgacattttcagcaaatggggaagcagctagtagagccggaaaaatcctccggggggcccgattcatcgtagagcaggagggcttcgtggtccatcccgataagacaagggtgctgcgccgtggacgacggcaagaagtaactgggatagttgtaaacgataagctcagcgtggatcgcaaaacgttgcggcgcttccgcgcaacccttcaccaagtggagagacacggtccccaagggcggacttggggacactcccctgacgtgattgcggctctgaccggttacgccacattcgtgaagatggttgactctgaaagggctgaaccctttctcgctcagctcgagcggatcagagagaaatggggctatgagcccccagcttgggaccctggcccgattagagagccctcatggcagcggtaccagccggaaccagaaccagccgaatctgacattgctacggaagctaccgctgaagccgggggagcagcaggaagtgaggctgaagccagagcccctggagaagctgaaagcgccgagaatcataagaagccatggtggaaattctggtga

SEQ ID NO: 13471 - RNA, 1575 nt, unidentified
  source 1..1575: mol_type = other RNA; note = synthetic construct
atgtcaagaccagctgcccccagtcagccaacgcgtgagaatctctatcagcggattcgggagacttccaaggccgaagtggtgttagaggagatgattcggctgggtttctggcccgctggagaaggaattccaaaaggacccgaagctgaggacaggcgcacaggcgaattagaaaatgaactcgcagctttgagaactgaaatgagtaggctccaaaatgaagcggccatgcgtcgcgccctttatcagaaacgcctggaggaagcgcgacagaaacggcaggaaacccgaaggcgacaagaagaggctaggagggcaagggcagcagcatggaaacaggcaaaggaaagggagatcggatacttgggcgaggggatttccgcaggccttaaccaccagctatctgacgctacgcgcctcgctcaacatggcttgccattgctgtcgaccgccttggatgttgctagtgcgatggacatatccgtgggagaactccgtttcctcacctttgtgcgtcgcgtttccaaacatacccactatcgccggttcttcattcccaagaagaccggcggacagcgtctgatcagcactcccatgcctcgcctgaagcaggcccagtactgggtgctgggtaacatcctggagcggattccaatacacagctgtgcgcatgggttcgtagccaagcactccatcgtgaccaacgcctcgatgcacaccgggaccgacgttgtcgttaactgcgatctcgaaaacttttttccgacaatcagctaccgaagggttcgcggacttttccgggctctcggctacagtgagcaagtggccaccatcctggccctgctgtgtacagagccggaggtagacagagtggaatgtgatggagagacttatcacctgtgcacatctgagaggcacttacctcaaggggccccctcctcacccatgctgactaatatcctctgccggagactagatagacggctgtctaacctggccgagacgttgggcttttcttatagccgatacgctgatgatctgacattttcaggtagcggggaggccaggggcaaagtaggcaagctgcttaggaagacagaaggtatagtctcacatgagggatttcgcatcaacagagacaagaccagagtgcagaggagagggagacggcaggaggtcacagggatagtggtcaatgagcgccccgccgtcaatcgggagaatctgcgcagaatgagagccgtactattcagactcgagaaagacggcctgagaggccagcactggggtagagggggagaggtgatcagcgccttagagggctacgcacatttcgtcgcacaggtggatcctgccaaaggcgggcgattccttgaacaactggtggctattaaggcgaagctgggttggcagaggccaaagcatcttcggcgccctaaacgaactcctagctggaaacggtctgccactgctccagctgccactcctgcagacgtgatgccagctgtcgcacagcctgccaagccggaacctgcaacacctcccaaaaagccctggtggaagttttggtga

SEQ ID NO: 13472 - RNA, 1263 nt, unidentified
  source 1..1263: mol_type = other RNA; note = synthetic construct
atgccaaccgtcgatagccaggaccaggtcgtggaccgcgatttgtgtttggacccactgagaacggagctagagcagcgacttggcgacgaggcccggagaaggctgagaagggagaggaaccttgcagccagacgtaggagtagaacccccagaccaacaccgcctcgggttcctacccagaccctgacatatctcggcgatagattgtcaggagggctgcaagatcgcaggagtaggctggacaggctggctgatcacccccagctccctgtactccacgatgctgatgacctagccgccgccatgggcattgaaatctcagaactgcggtttctcgcatttgcccccacccacagtcgcgtgaaccactatcagcgcttcctgcttcctaagaaaacaggcggtcatcgacaaatttccgcccctatgccccggttaaaagcagcccagcattggatttaccagaggatactcgcacaagtcccggtccaccgtgcggctaagggattcctgcccggccattctattgtggacaatgcccgcccgcatgtaggagccgatgtggtaatcaacatggacctggagaattttttcccaacaatcacctttgcccgcgtgaaaggactcttcagaacactggggtactccgaacaggttgctactatcctaggtttgctctgcactgaacccgaggttgaaacatatgaatggctcggggagaggtatcatgtcgcacgagggcctcgatttttaccacaaggcgctccatctagccctccagtcactaatttgttatgccgacggttggaccgtcgcctcgatggtcttgcgcggtcactgggattccattacaccagatacgccgatgacctgaccttcagcggctccggggaagctactgacagggtggggaagttacttggaaaagcccgcgacatcatagagcacgagggtttccgccctcaccccaaaaagacgagggttctgcgggcaggtagacagcaggaggtgactggaatcgtggtcaatcggaaacttagcctggaccggaagactcttcgcaggttccgggctgttctgttccaggtggagctcgatggccccgcaggtaagcgatggggcaacggaggggatctgctggcatcgctggaggggtacgcgcactttgtgcacatggtggatgctgaaaagggcagagcttttttggaccgggtggaggccattaaggcgcgttacggctctgactccatagaactgtga

SEQ ID NO: 13473 - RNA, 1506 nt, unidentified
  source 1..1506: mol_type = other RNA; note = synthetic construct
atgtcagatcggaggcaggaaatttaccagcgcataagagaatcctccaaagacgaggtggtgctggatgagatggtcagacttgggttctggccccaacagggcgtcctccctgaagaccccgctgaggagattaagcggcaagcggccttgagggacgaattggcatcactgactgcccggttacagaagctgggaaatcaggaagctctgcgacaggagcttaagcgtcgcagactgttagagtcacgaagacgccgccaggagacaaagctgagacgcgttcatgcacgggagctgagagcctttgagtggaagcaaaaacagcgcgcatctatcacttatctgggtgaagaggtttcccggggcttgtcgaacacagcctccgatgaagctagactccgagccctgggccttcccgtattccatgaagcgtccgacatcgcacgggccgctcagattgaggttagccacctgcggcaccttgcttttcacagggtggtgtctagacgtagtcactatgttcggttctacctaccgaagaaaacaggcggcactcgcctgatcagcgctcctaaacccaaactcaaatggattcagcactggattttgaggcacgtccttgagccactgaaggcagaagacgtggcccatggcttcgttaaagcccgatctattgtgagtaacgcctcagcgcatgtcggccaggatatcgtgatcaacgtagacctgaaggattttttccctaccctgacataccgtagggtgtgggggttcttccgaaaactggggtattctgggcacgtggccacaatctttgcccttttgaccaccgagccagcagtcgacgagctggaactcgacgggagccgttactttgtcgcgacaggcgagcggtttctcccgcaaggagcaccaacgagtccagcactcaccaatgtaatatgcaggaaaatggaccgcaggttagctggcctcgccaggactttcggtttgacgtataccaggtacgccgacgatttcaccttcagcggtcccggagagacgaatgttggacgcttctttggggcactcactagagtagtgaccgaagagggtttcagcattcatccgggaaagaccaggatctttaggaggggaagacgacaggaagtgactggtctagtggtaaatagcggcaagcctaccgttccacgagccaccctcagacggtttcgggctctactgtttcagatcgagaaggatggcccagaagggaaagtctggaaacctggggtcgatgtcgtgcgtagcatccagggattcgcccgctttgtggctatggtggattccgagaagggccgcgctttagaagcccgggtgcagaagatagtggcagaaagggggcctgcctctctcgctagtactagaacagtggcgaaggccaagtcgcactggtaccccccactgaaacccctgggagagcagccccaactgaaccttcctcatgctcagcaagacacatga

SEQ ID NO: 13474 - RNA, 1563 nt, unidentified
  source 1..1563: mol_type = other RNA; note = synthetic construct
atgcagctgctggagaagaacaagaagatactcgaagaaatggtccgcctagggttttggcccgaatcccaaccgctgcccggactgaatcccgaagagcagacaagatacgagacactcagtaatgagctggccgctattcgtaccgagcttacaaggctgaaaaacagagaggctatgttgaaagccattcgcgcccaaaggctcgccgatgctaagcggaagaggctcgaaaccaaggctcggaacgaagagaagcggttggagcgggcccgaacatggaaacagattcaggcaaagcagatcacttacttggggatgggtgtgagcgccggattgagcgagcaggtcggccagtccgaacggctgaaaacccagggcctcccatcttggtccacgcctgcagagctggctaaggccatgaatatctccgtgggcgagctgcggtttttaacattccacagacgcgttgtgaaacattcccactacatccgcttccatatgccaaagaagaccggtggcactagattgatctcagcccctatgccgcgtctcaaagagcttcagcactgggtgctggaacatgtgctagagaagatccctatacacgactctgcgcatggctttaggaaacatcactcaatagtcacgaacgctcagccacacgtagggcaaccaatgttaattaacctagacctgaaggacttcttcccgactcttacatatcggcgagttaaaggccttttcagacagcttgggtatagcgagagcatcgcgactgtgctgggactgctgtgtactgagccagaaatggaccaggtaaagctggacggacagccctttttgattgccaagggcgataggcaccttccacaaggtgctcctagttctcctatgattactaatctgatatgcaggcggatggatcagagactggctaagctggctgcaagttttggatttatctattcgcgctacgcagacgatctctctttctcaggggccgagctggacagccgagaaacaggccggctgctgaagagaatccaaaacattgttaaccatgaagggtttgtggtacaccctcataaaacgaagatctgccgaagtggacagcgcaaagaggttaccggtattgtcgtgaactcgttctgttccgtcgatagaaagactagaaaaaagattcgcgcaatcttacaccacatcgaaaaggatggcccttcagggaaaaattttggtgctaaccccgacgtgttagaggcgctcctctcctacgcacagttcatggccatggttaaccccgaacagggacttcccgtcctgaataaggtgaaagccttggccaatcagatcggctacaaacgtaaaacctatcgacgcctggctagctcttctaaaaggttcaaaaggtttgtgcctgatccagcactcttcgccaaacccgaaccggcccctagcttgcagaaggaaaccgccgagcaaaggccaacccccctacccaagcaagacctcaaaaccaatgcggaggcaccagcaaaaaagccttggtggaagttctggtga

SEQ ID NO: 13475 - RNA, 1398 nt, unidentified
  source 1..1398: mol_type = other RNA; note = synthetic construct
atgaacacccaacccgctaccaggcaggaattatatgacagggtccgggcttcgtcactgcaggaagtcatcctggaggagatggtcagatacggctattggcccaaggaaggcgagataccagaggaccccgctgaggacatcaagcgagagggggaactggtgcgagagctaggcaaactcagaagtgagctcgagaaactgcacgacatggagaaactgatcaaggccgctcgccgcaaaaggatgctcgagagccgtgagaggcagaaggagaatcggctgcgtcgcatccgagaaagggaggaacgggcggccgcatggaaggagaggaagcagcacgagatcctgtacctgggcgagggtcactctggaaccctatcatcccaggtgtctgatgaagaaagactggccgcccaccacctccccatttttcatacccccgaagatttggcacttgccatgggactatccatcggtgccctccggttcctgtgcttctctagaaaggttagcaagactagccattatcagcggttttacctgcctaagaagtctggggggaaaaggctgatctccgccccaatgcagcgcctgaaaagtgctcaacactggcttctcgaacacgtgttggagcaagtagctatccacccaagtgctcatgggttcaggaaagaacacagcattgtgacaaacgcggaagcccacgttggagctcatgttgtggtgaacattgacattgaaaacttctttccaactttccattaccctcgggtatgggggtgttttcgagcgctgggctactcacctgccgtctctacatgtatgaccctcctgtgcacagagcctgagatcctggaaattgagttagacggagaattatggtttgtgcagcagggatcgagagctcttccccaaggcgcaccgacgtcacctaccctcacaaatatactgtgccgcagattggataagcgcctcgcaggtcttgcaagagtccacgagtttacatacagccgctatgccgatgacatgacattcagtggcaatgataacgtggatgtaggaaaactgctcgcctctcttaggtccgtgttgcatcaggagggtttgaagatacatcctaataaaaccgcggtttataggagagggcgtcgtcgcgaggtgacgggaattgtcgtgaacgaaaagttgagcgtgagccggaagactctgcgaagatttagagcaactctattccagattgagaaagacgggccagaagggaaaacttggggaaacggcggtgaccttttcgcctccatacaaggctacgccaatttcgtgcacatggtcgatccggaaaagggccgggcatttctgcagcgcgttcagcggattatcaatttacattcccggtga

SEQ ID NO: 13476 - RNA, 1077 nt, unidentified
  source 1..1077: mol_type = other RNA; note = synthetic construct
gtggaactgacgtatttgggacccagagtctcaggtggcctaggaccgactggcgatcggagaactagcgacggtgctcggttaagtgcggccggactgccagttgttcacacagcagctgaactcgctaccgcagccggcttggcattgggtcagctgcggttcctggcttttgcgcgagaggtgtctactacaacccactacaggcagtttaccattcccaaacggtccggaggagacagggtcatctccgccccaatggcacggctcaagaaattgcagcattggatcctggagcacatgctcaataagctgcctctcgccccccctgcacatggatttcgcccaggccggagcacggtgagtaatgctctgcctcatcttcaatctgccatcgtgataaacgtggacctgaaggagttcttccccacagtaacataccccagagtcaaggggctgtttcgtaagctcgggtatagtgaggaggtgagcactgtcctgggcctggtctgcactgagcctgacatcgtggagactgttctagacgggattacatactatgtggcacgtggccctaggcggttaccacaaggtgccccgacttcgccagccataaccaacgcactgtgccgccgtctggacaaaagaatcgccggttttgcagcaaagcacgccctgaccttcaccagatatgcggacgacctcaccctgtcaactaaagatcctgccgggcgcgtgggcgcttgtcttaagttccttaggaaggtcgccgtcgatgaaggcttcaccgttcaccccgaaaaagttagggtggtgaggacaggccgacgacaggaagtgaccggcgtggtcgtgaacgaaaaaccaggcgtcgttcgcgccgagcttagaaggtttcgcgctctcttattccagattgagaaggatggacctgccggaaaaaagtgggggacccccgggacagatgtactcacctctgctcttgggttcgcttcctacgtggccatggtagatccagtaaaaggggctgcgcttagaacacaggtgttggccctgcgcgcccgatttcccacgtga

SEQ ID NO: 13477 - RNA, 1440 nt, unidentified
  source 1..1440: mol_type = other RNA; note = synthetic construct
atgagcaacttgccccccccacgggatcggaaggaactgtacgagagaatcgcactcggggggaaggatgacgtgattgccgaggagatgacgagactggggttttggtcgggagaacaggctcaattggtggatcctccagtggaggcggccaggaaggctgaactccgggaacggctgggtaagcttagggagcaagccgctcgcatgaggaatctcgtgactttggaggcagacctaaagaagcagcgtatggcagccagccggaagaaacgtgaggagactaagcagcgaagactgggggagcgtgcagcagctaaggagcgaaccaaagccaccaaggcccgcgaacttggctatctcgggcctggagtaagtgctggcttgggcccggagcatagggcgtcagatgtagcacggctccaggcgcagaggttacccgtcgtgcacaccgcggcagaacttgctgccgcaatcggagtgagcctcggagagcttagattcctggcttttgcacgcgaagtgtccacaaccacgcattaccggcggttcactatccccaaaagatcaggcggagagcgggtgataagtgcccctagaaaacgcctgaagcgggtgcagcactgggtgcttgctaaagtcttagaacccctgctgggtgacccagccgctagtgacccagcccacggtttccgctctggtcggagcacagtttccaacgccgtgccacatgtcggagctgccgttctggtcaatgtggacctgcgcgacttttttcctactgtgacatataggcgtgtcaaaggtctgttcgccaagcttggctacggagaggaggtcgccacagttctagccctggcctgcactgaacctgatattgccgaaacccagttggatggcctcacttactatgttgcacgcgggccacgacgattacctcagggcgcacccacctctccggctatcacgaatgctttatgtaggcgattggacaggcgtgtgctgggctgggcagacaaacacggctttgcctacactcggtacgccgacgacctgacactgtcttccaaagatccagctgctagagtcggtgcctgcctgggcttcctgaggcaagtggcaggcgccgaagggtttacagtacatcctgaaaaggtcagagttgtcagaagaggggggaggcaggaggtgacaggcgttgttgttaacgagcgcccctcagtccctagggtggaactgcgcaaattcagggccctcctacaccacattgacatggatgggcccgcgggaaaaacctggggaagaaccgacggagcggatggcggagatgtactggctgcggctctggggttcgcatcctatgtggccatggtggatccggctaaaggtaccgccttgcgagcacgcgtactcgccctcagagccaagtatcccggctga

SEQ ID NO: 13478 - RNA, 1422 nt, unidentified
  source 1..1422: mol_type = other RNA; note = synthetic construct
atggcagatctgactccgcctaagaatcgtaaagagctctacgagagaatagcccgagggggcaaggaggaggtgattgtcgacgagatggtgcggctgggattttggccaaacactcaacccccccctggagatccccccgatgaaatccgccgcatggccgaactgagaacacgcttagcccaattgcgccagcaggctcagggtctacgtaacctcgcccagctagagattgacttaaaaaaacagcggctcgcagagagtaagcggaggagagagcttaacaaacagaagctcctgggtgagagagcggctgcaaaggccgcgacccaggagaaaaagaccagagaactgacgtacctgggaaaagatgtcagcgcaggcttgggccccactctggacagacggacttcagacgcacccaagctgacgacccaaaaacttccaattgccaacactgccgctgaactcgctgccgctatgaaggttagtctgggccagcttagattcctggccttctcacgggaagtgtccacaaccagccactatcaccggtttaccatacctaagaaaacgggaggggaaagggttatctccgcgcctcacaagagactcaaggccgtccaacattggatcctcgagcatgtgctggaaccacttgcactggccgagccagcccatggatttgttccgggccgaagcacagtgtctaatgccgttcctcatgtgggcgccgctatcgtggtcaacgtggatctgaaggatttctttcctaccgtgacctaccgacgcgttaaagggctgtacaagaagttgggctattcggaggaggtcgccacagtactgggcctactatgctccgaacctgacatcgcacagaccgagttggacgggaccacctactttgtggcaagggggcccaggcgattaccacaaggagctccaacttctcccgcgattacaaatgcattgtgtcgccggctggatcggaggatcaatggctgggcgaagaaacacggtttcatctacacaaggtacgccgacgacctgactgtcagcaccagggacagaaacgccccggtaggcaagatgctggcattcttacgaagggtggtgacagctgaggggtttgctgtgcaccctgacaaggtaagggtagtacgtaggggccgccgccaggaagtcacaggagttgtggtcaacgatcggccaggggtccccagagatgaccttcgacgtttccgggcactgctcttccagattgaaaaagatgggccagctgggaaacgctggggacacaatgaaggtaatgtgcttgaggctgctctcggttatgcatcttatgtggccatggtggaccctgccaagggcgaagttctgagggccaaagtgctcgctttgagagctaagtataaacagtga

SEQ ID NO: 13479 - RNA, 1425 nt, unidentified
  source 1..1425: mol_type = other RNA; note = synthetic construct
atgtcggaaaaagcacctgccaacaggaaggagctgtttgaacgcatcgcaagaggcagcaaggatgccataattctcgatgaaatgcagcggctcgggttctggccatcccagcagagcttgcctaacgaacccccggacgaagtcactcggttagctgccgctagagcccgtctggccgaactccatcgcaatgcctctcgcctaaggaacttggtggaactggagagagaggctaaaaagcagcgaatggctgaatcaagggcccggagagtggctaccaaacagaaacggctcggcgagcgcgcggtaaaaaggaccgcaactcagcaacgcaaaaccatagagttgcgttatcttggcgctacagtgtcagccggtctgcaaccaggtgtcggagcaattaccgacggagctgccgccaccatcgctcaactgggcttacctgcgtggcagacagcggcggacattgcgagggccatgcaggtttccattgggaccttgcgacacctggcatacgcaagagaggtgagtaccataaaccactaccatcgcttcagcatagctaagaagagcggaggggtaagggtcatctcagcgccccaggtcaagctcaaagccgcccagaggttcattctggatgaattactggctaaattcccactcagcaatgcagcccacggatttgcagctgggcgcagtattgtaagtaacgccgcacctcatgtagccgcggcaattttgatcaacgtggacctgcgagatttctttccaaccgttacttaccggcgcgtgaaggggctgtttcggacgatcggctacaacgaggaggtcgccatcgtgctagccctcctgtgtacagagcccgagatcacggaaacccagctggacggcgttacttactatgtcgcaaggggcgagcggaagctgcctcaaggagctccgacttctcccgctatcagcaatgccctgtgccgaagactcgatgccagacttgggggctggtgcgccaagcatgggtttgccttcacaagatatgctgacgatcttacactctcctcacacgatcggaatgccaatgttggggaggcactggccgttgctcgtcgattagtggctgcagagggattcgtggtccacgcagataaagttcgcgtagtgaggcagggtggacggcaggaggtgactggtgtggtggtgaatcaaaagctgtctgtgccaagagacgagcttagacgttttcgggccctgttgttccagcttgagcatgacggccccacggaaaagtcctggcacggcgtgggagctgacggaacaggtgacgtcgtgcagtctgctaggggctacgcatcctatgtccacatggttgaccccgctaagggcgccatcctacttgcaaggctggatgccctgacaaagcgatga

SEQ ID NO: 13480 - RNA, 1527 nt, unidentified
  source 1..1527: mol_type = other RNA; note = synthetic construct
atgtctaatcgcaggcaggagctgtatgatcgaataagaagcacatccaaagacgaggtggtgctggaggagatgattcgcttgggcttttggcccaggcagggttcaatgcctctcgaccctggagatgaagtcaggcggcggggggaaattgagcgggaattggctgcattacgcactgagcagactcgcctcggtaatctcgaggccctgaaaaaggaagccttgaagagacggctggccgagagcaaggaaaaacagaaagaaactaaggccaggagagagcgagaacgggttgcaagagcggccgcttgggcacaaaagaaagcgggagagattggctttctggggaccggtgtgtctggaggcctgggacacaccgaaacagatgagcctaagcttgtcgctcagagcctaccagcactccggagcggaaccgatattgctcgggccatggggatcacggttggggagttacggtttctagcctttgacagacgcacgagcgaaacgtcccactacgttagattcaccattccaaaaaaggccggtggggagagacttattagtgcccctatgccacgcctcaagtcagcccaggcgtggatcctggagaacttgctgggcaaagtggccttgcatgacgcagcacatggcttccgggcggcacgttcgatcgtgaccaacgctagaccgcacgtgggggctccactcgttattaacgtggatcttaaggatttcttccctacactgacactgggacgtatcaagggggccttcagagccttgggctatggggaccacgtcgctacagtgctcggtctgctgtgttcagagcccgatgtagatcaggtggtgttagatgggaaaacattttacgtggccaatggcaagaggaggctgcctcaaggagcccctactagtccagcaatcaccaatatcgtctgccggcgcctcgatagaaggctggcgagtgccgcgcaaaagcacggctttgtctatactcgctacgccgacgacctaactctctcctccatagaccccgccgctaacccagctagagtactgggcgtacttaggtggatcgtcgcaggtgagggatttgtggtccatcccaagaagacacgaatccttcgtaagggcgcgcgtagggaagtgaccggcgttgtagttaacgagaaactgagcgtgtcacgcgagcagcggaggaaattccgagccttcctgtttcagctggacaaagacggacctcagggcaagcaatggggagcctctccggacgtattcgcctctgctttaggctatgctgcatacctcgcaatggtcgaccccgaaaggggtaaacccgtccttgcccaggctcgagccatagcaaagaaacatggctggaaagggaaaccccgacccgtgaaggctgtgcaggctgcaccgatgcctcccgttgctccaccagtggccgaacccatggcacccacctccccagaagctccagccgagcctaaaaagaagtggtggaagctgttctga

SEQ ID NO: 13481 - RNA, 1584 nt, unidentified
  source 1..1584: mol_type = other RNA; note = synthetic construct
atgacttaccgcagatattcaacccagcccagtagccgccaggagctgtacgacagaattagggattcctctaaagatgaggtaattctcgaggagatgattcgtctggggttctggcctgctgcaggtacaatgcccgatgacccagcggacgaaatcagaaggaggggcgagctggaagcagaactcagagccctgcgaacggagaggagccgactccacaatatcgaggccttgaagaaggaagctcgcaaacgtcggatggctgagtcgcgacggaagagacaggagactaaggaacgtagactgcagcagcgtgtcgaacgggccgctgtttgggcggagagaaaaaaatccgagctgctgtatctgggggaagaggtcagtgccggtctaggagaggctgagcccgacgctcaacgactcgcacgccatgggctgcccagcttctctgatgctgcccagctagctcgagccatgggcctcagtctcggtgccctgaggcaaatgtgtttcgatagggcgacatctcgaaccaccaattatataagattcgtgatccctaagcggacaggtggtgtgagagagatatccgcccccaggccacgtttaaaagaggctcagcgctgggttctggacaacatcctttcaaagatagctctgcacgatgcagcacacggcttcagagataagaggagcatcgtaagcaatgcccacccacacgtgcagccagcagtgcttgtgaacgtggatttgaaagactttttccctacagtcacataccggcgggtcaagggaatgtttcggaagttagggtactctgagtccctgtccacggtccttggactcctgtgttccgaaccccgagctacagaactctcacttgacggagtgacctattacgtggccctgcaggagcgggccttaccacaaggcgcacccacttcgcccgctgtgacgaacatcatctgcagggggcttgacgcaaggctatgcgcgattgcctctaagctggggtttgtctatacccgctacgctgacgacctgaccttttcctctaaagataagactgttaacgtgggtcgcttgcttaggcagctccgcaagattgtggacgacgaaggatttgtggtgcatcctgacaagacaagggtcttgcgcgccggccgcagacaagaagttaccggcattgtggtaaatcatacccccaatgttacccgggatgtcttgcggaaattccgggctaccttgtaccaaatcgaaaaagacggaccgcaggggaaaacttggggccatagcgatgatgtgattgccgccgtggaggggtttgccaactatgtggccatggtcaaccctgataaaggccgccctttagttgaacgggcgagagccctggtaaaaaagcacggcaaaaagccaacccccccgaagaaagccaagaagccagcagcaagcactgcgccgcctcctcaggctaggagtgaagcaccagccgccactgcagcccagtcagaaccacctgagacagacggagatgacggcggaggcaagaaaaagaagaaaaaatggtggaagatcttctga

SEQ ID NO: 13482 - RNA, 1587 nt, unidentified
  source 1..1587: mol_type = other RNA; note = synthetic construct
atgtccagaccctcttccaggcaagagctgtacgaccggatccgcgagtcctcgaaagattctgtcattctggaggagatgatcagactggggttttggccccaggcaggcgtgcttcccgaagatcctgccgacgagatcaggcgccgtggggaactcgaggggaggttgaggtccctccgcaccgaacagtcgagactcagtaatgtggatgccttaaaacgggaggcccggaagcggaggatggtggaaagccgccgcaagcagaaggagacaaaggagagacgactgcgggagaggcgggaaagagcggaagcttggaaagagaggaagggccgcgaaatcgtttatctgggcgagggtattagcgccggcctgagcgatatcaagttagacgccacaaagctagcaggccaagggctccccagtttcgcagatgccgccgcagttgcgcagaccatgggtctgtctatgggagagctcagacggtttgccttcacgcggaccaccagcaaaaccactaactacatgagattctccatacctaagcgaacaggaggggaacggcacattagcgcgcctctgccgcgactcaaagaagcccagaggtggatccttgatcacgtgctcgccaaggtgccccttcatgaagctgcccacggtttcgtcgggggcaggagtatcgtctccaacgctacagggcacctgcagccaactgtgttggtaaacctggacttggaaaattttttcccgacagtgtcatacagacgggtcaagggcttgtttcgctctctcggctacagcgagcaggtggccaccatttttggtcttctgtgcactgaaccggaggtcactgagctggagctcgacggagccacttactatgttgccttggaggaaagactactgccccagggagcgccaacctctccagctattaccaatctaatatgtcgcgctctggatgctaggctgacttcaattgccacagctcttggctttcactacacccgatatgccgacgatctaagctttagtgcacagggcgccgacgctgatgctggacgtctgcttagaagggtgcgacatgtcgtagcagaagagggcttcgtggtgcatccaaagaaaacgcgcgttttacgccgggggagacgtcaagaggtcacaggcatcgtggtaaacggtgaccgtccttccttggccagggatgtgctgcgacgtttccgggctaccctgtttcagctggagaaagatggcccagcaggaaaaaggtggggccgagccgttgctgacgaaggtgacgacgtcattgctgcggtggaggggttcgcgaattatgtagtgatggttgaccctgagaaaggccagctcttacaggaaagaacccggaaactggtggccaggtatgggaagaagccaacacctccccgcggaggatctggaggctcaggaggaggtggagggccaagacccgctgctgaagcacctgccgcagcagcacaagcacccgtggttgaggctccccctacggcacctactgaagccccatcaaagaaaaagaaggagaagtggtggaaagtcttctga

SEQ ID NO: 13483 - RNA, 1635 nt, unidentified
  source 1..1635: mol_type = other RNA; note = synthetic construct
atggccgagcctccacggaccagacaggaactctacgagcggattgtcgccacttcaaaagacgaggtggtgctccaggagatgattagactggggttctggccagctgctgggaccttacccgaagacccagccgacgaggttagacgtcgggccgaactgcaacgacagctcgatcggctccacgagcaaaatagacatctttacaacgagcaggccctcataaaggaattaaggttacgccggctggcggagtccaagcgcaaacagcaggaaacaaaggagcgcagagagagggaaaggctagctcgagccgaggcatggaagcaggaaaaaacgaggagcattgtttacgtaggggagggggtcagtgcaggtctgggtaagcgggaagcaaagcccgaacgcctgaaggagcatggccttcccaactttacctcggccgccgatcttgcgtcagcaatgaaaattagcgttggcgccctgcggttcctttgctttgcacggaaaacatcatctgtgtctcactacgtgcgtttcaggatcccaaagaaaagcggaggcgaacgattgatatccgcacccatgccgaggctaaaggcagcgcagagttgggttctgcacgagatcctcgagaaattggcgctgcacactgcggctcatggattcgtcaggggacgtagcatcgtctccaacgctaggccccatgtggggcacgcattgatagtcaacgtcgacctgaagaactttttcccaacagtgggctatccaagagtgaaaggactgttcgccagcctgggatatagtgaagaggttgcgaccctgctgggattgttgtgcacagagcctgacgtggaggaactggtgctggacgggcagaggtatttcgtggcccgaagcgaaagacacttaccgcagggggcacccacatcccctgcaatcactaatcttttgtgtcgaagactcgaccgccggcttcagaagatggccgacgaactgggctttgtttatacgagatatgcagatgatctcaccttttcggctaagagcgaggatgtggggcaggccgccgaagtactacgaagactccggaatatcgtggctcatgagggctttgtggttcacccggaaaaaacacgcgtgttgagacgcggccggcgtcaagaagtgactggtgtcgtcgtgaatcacaagcctggcgtacctagggatgtcctgcatcgcttccgcgccaccctgtttcaaatcgagaaggatgggcctagcggcaaacgctggggagcctgtaaggatgtgctggcgagtatcagaggctttgcctcctacgttcgtatggtcgatcccgctaggggtactccgctctgcgctagggtcgacgctattgtggccaaatactctggaaaacctagtcccccagctccctccggtgcaccagcaaagaagcccgacgtaccaaaaccagacgccgcaaaacctggcgccgctggatcagtacctgccgctactaaaaccgccgaggctctggctaaagctgcccccacgcctgcttccgtggtgtctgatgcaaaggagccctcatctcctgcctctgacgccaagacaccaaccggcaagaagtggtggaaggtgttctga

SEQ ID NO: 13484 - RNA, 1677 nt, unidentified
  source 1..1677: mol_type = other RNA; note = synthetic construct
atgctggctccttgcggctctccaccgagtaagcgattagtgttcctgggagcctcacggaccctcgagcaatggcttgctgtgcggccgccccaaatgcacgccaatagacctgaaccaagccgcgcgatgtcgcagccttcttccagacaagcactgtacgaccggatcaggaagagcagtaaggatagcgtcattgtggaagagatgattaggttagggttttggcccgcagcaggtaccatgcccgaggatcctgctgacgaaatccggaggcgggcagagcttgaagcacagttacgagctctgcggacagagcagacccggctccacaatatcgaggccctcaaaagagaagtgagaaaacgcaggatggccgaggctcgtgaaaggcgcaaagagactaaggccaggaagctggcagaacggcaggcacgcgctgagacatggaaagcaaaaaaggagactgacatcgggttcttgggcgagggtgtttccgctgggcttgggcataagggatgtgatgcagaacggcttgctgaacatggcttgccggaactggccgatgctgctgccgttgcagcagctatggggatagatctgggaactttgcgcttcctcgcatacgcctgtacaacgagccgtgtctcgcattatgtccactttttcataccaaagcgcaccggaggcaagagagccatttccgcaccgatgcccaagctaaaacacgcgcagcattggattttagccaatgttctagatccagtcgccctggacgaacacgcgcatggtttccgccacgggcgttcaatcctgaccaatgctcagccccacttgggctctcgggttgtagtaaactgtgacctccagaacttttttcccaccgtgagttaccggagaacgaaaggcctcttccagtccttgggctatggcgagcaagtggcgtccatttttggcttgatctgcacagcccctgaaacccaggaggtggagctggacggccagaggtatttcgtggccctcggcgatcgtgttcttccccaggggtcaccagccagccctgcaatcaccaacctgatctgcagaggcctggatcgcgctctcgagaaaacagcgcgccagcttggcttcaggtacactcggtatgctgatgacctgagcttctccagcgatgacgccaatgccgacgtagggcgcctactgggaagggttagatggctggtccagagacatggatttgtcgtgcaccctgacaagacaagagtgctgcgccagagtagacgccaggaggtaaccgggattgtcgtgaatgagaggcctgccgtcccccgtgaaaccctgaggaggttcagagccactctgtttcaaattgaaaaggacggtccagccggaaagagatgggggcgagccaccggagataacggagtggacctcatggctgccatcgagggattcgccaactacgtggcgatggtggacccagcgaaaggtcgacccctcaaagcccaggtggccgctctgatagcccgataccccaaacaagcaacgccatttaagggccggcgaaggccttcacagtctactgactctcccacatctgagcctaagcgagatgccactgctccagaggtggtcgacggtacaaaaaaaaagaagaactggtggaagctgttttga

SEQ ID NO: 13485 - RNA, 1254 nt, unidentified
  source 1..1254: mol_type = other RNA; note = synthetic construct
atgtccggtgaccgtccccgcacaaggcaagaactatatgaccggattcgcgagacttcgaaagatgaagtgatcttggaggacatggtgagattgggtttttggccaaggaccggggagatcccccaagaccctgcagatgagatccgccgaaggggcgacctagagagacagatcgctgcacttaggacagaacaggccagactctccaatgttgaagcgctgcgaaaagaactcaagaggcgccggctgctggagtcaaaggagaagcaaaaggcgaccaaagaaagacgcgaacgggaacggttagcgcgggctgcagcatgggctgaggagaaaaagagggccatcgtgcatcttggggccggggtcagtggaggcctgagtaagggagctcctccaaatctggaaaagttgacagctctgggcctccccaggttagccacagccgcagaggttgccgcggcaatgggtattgctgtgcctgagcttaggtttcttgcctatgcacgcaaggtgtcacagaagacccattacgttagatttacaattcccaagaagacgggaggggcacgactgataagcgctccgatgcctcgactgaagagagcccagagatggatcctggatgccgtactggccaaggttgccttggagggtccagctcacgggttcgtcgttgatcgctccattgtcaccaacgcaaggcctcacctgggatcccaggtggtggtcaacctcgacttgcgtgattttttcccgtcacttggattcagaagggtgaaaggcatgtttgagggactcggctacggggaagaagtgtctactatattcgcgctgctcaccacagaaccagaaattgacgaggtcgagctggacggccagacttatttcgtagccaccactgctcggaaactcccccaaggttctcccgcatctcctgcaatcacgaacgtggtatgcaggcgtctggataaacggttagccggaatggcccgggctcttgggtttacctacacgcggtacgctgacgacctgaccttcagcagcaaagatcgcgccgctgatgtgggcaaactcctgagacgtgtgcgatggatagtcaaacaggaaggcttcgccgagcacgagaagaagactcgcgtgctccgaagaggccggtgtcaggaggtaactggcgtggtcgtgaatgataaaccaagcgttcccagagaggccttgaaacgcttccgggccctactgtttcagctgtga

SEQ ID NO: 13486 - RNA, 1560 nt, unidentified
  source 1..1560: mol_type = other RNA; note = synthetic construct
atgtcaaaacagcccacaacgcgcaaggccctttatgagagaattgctaagagtagcctggatgaggtcatactagaagaaatgatcaggcttggattctggccttctagcagcgatgctcccagcgatccggctgaggagatcaggcgcagagggcacttgcagaggcgcctcaatgaaatacgaacagagcagctcggtctgcagaacgaggccaaactgaaagaggaggcccgtaagaagcggatgtccgatgcaagagaacgcagattacagaatagggagaggcggctgagggagcgttcagagcggagagctcagtggcatcagaaaaagcaagaggagatcggttacctcggcgatggattttccgcaggcctgggtaagcgtgagtgtgatgacaagcggctccaggcccagggcattcccgttctcggtgacgcaatgtccctatccaatgcaatgggcatttcgctgggccagctgaggttcctggcattctcacggaaaacaagccgctattcccactatcagcggttctccatcccaaaaaaggatgggggggtgagaatgatcagtgcgccaatgccacggctgaaagctgcacagacttggatactagaaacgatccttaacccacttcccatgcatgacgctgcccatggtttcaggcctgggagaagtattgtgagcaatgcgaccccccacataggagcagacgtggtggtcaatttagacctcgaaaactttttcccttcagtgggctaccggcgagtaaaaggtttgttcgggcacttcggatacagcgaggaggtggctacaattctggccctgctgtccacagaacccgaattgactcagatcaagctggacggcgacacgtattacgtcgctaaaggcgaacgattcctcccccaaggagccccgtcttctccagcaattaccaatctgctctgccgtcggctggatagacggttagagggtatctgcaacaagcttgactttcgatacaccagatatgccgacgatctgtcattttctgcaagaggggaacctgcaaagcttgttggcaagttgttgtctcaagtggagtggctggttgccgaagaaggctttaaaatccaccctgacaagacccgcgtattccgcagaggaaggcggcaagaggtgaccgggcttgtcgtgaacgatggactgagtgttccgcgagccgtgttgcgcaggttcaggaccctgctgtttcaaattgaaaaggacgggacagatggcaagaggtggggcgccagcgacgatgtcttagcctccgctatgggatttgctaactttgtcgcgatggtacagccagagaagggagccagtttgcagacccaagtgcgcaaactcctgaagacttacggcaaggccaaagctcctcgcgcgcagtctgccgagtcaaaggggactgaatctaaaggagccgaaagcaaggggaccggccgaggacctaccccaacatcggacgaaactgacaaaaaaactgaggacctcgcccccaagaaaaagtggtggaaactattttga

SEQ ID NO: 13487 - RNA, 1578 nt, unidentified
  source 1..1578: mol_type = other RNA; note = synthetic construct
atggcccagcagcctcctcgtaatcgccaggagctgtatgagcgaattcagtcgatcagcaaggaggagtttgtcctggaggacatggtcagactgggcttttggccggcaagatccggcgtacctggcgatccccgggatgaagttcatcggaaggcagagctcgaaaaacagataagggctctgacaagcgagcaagccagactcggcaacctggaaaagctgaaaaaagagctccggaagaagcgtctcgctgaatctaaagccagacagaaggagacgaaggagcgccgcgagagagaacgagttgctcgggccgaagcatggaaggcccggaaagccagagagattttgttccttgggagaggggtgagcggcggactgaatcaccgcacccctgaggcccctaagctcgagagacagggcttaccccgtcttgaaacccccgaagctttagcccaggcgctcggactaagtgtcggtcagctgcgggccctgtgctacgctaggacagtgtccactaaaacgaactacgtgaggtttgccttgcccaaaaagaccgggggcttgcggcttatttctgccccccttccgaggctaaaagcggcccagcattgggtgctgaagaatctgctcgaaaaggtccccatgcatgaagctgcacacggtttccgcccggggaggtcaatcgtgtcaaatgcaaggccacatgtgggggccgcagtcgtggttaacctggatctgaaggacttcttcccaacagtagtatatccgcgcgtaaaggggttcttcgtgaagttgggatatagtgaggcaacagctactgccctatctctgctctgtaccgaacctgacatggaggaagtggaactcgacggccaaaggtacttcgtcgctcagggcggtcgtcgactacctcaaggcgctccaacttccccagcactgaccaatttgttgtgcaggcgcctggatcgacggcttaagggggcagcaggcaaactcggttttacctacactcgctacgcggatgatcttactttttccgtcccaagaggaggaacgggggacgtgggcaagatgttaagactggcaagatttgtcatcaggcacgagggattctttccccacccagaaaaaacccgggttctgaggcgcggtggacaacaggaggttactggagtcgtggtgaacgacaagccaggcgtggatcgggagacactcaggaggttccgggcgcttctgcaccagttagagaagtcaggacccgagggtaagaaatggaacgggagcaccgacgtgatcgcaagcgtggttgggtttgccaattatgttgccatggtggaccccaccaaaggtaaggccttccaggacaaggcccgcgcgttggaacgaaaatacggccgaaaaactgtgctgccccctagacctaaagccccagccgctgctcaacccggaacagctaccgtggcccccacaccaccttctagtgggacagctgctccaggcggacctcccaagccagaggaaccccaggaaccaaacgagccgcctaagaaaaaatggtggaaactgttttga

SEQ ID NO: 13488 - RNA, 1563 nt, unidentified
  source 1..1563: mol_type = other RNA; note = synthetic construct
atggcacagcagccccccagaaatagacaagagctgtacgatcgaatccgggagacgtccaaagaagaagtgattttcgaggaaatggtccgtttgggcttctggcctgcgcgtagtggggttcccggtgatccagctgacgagctccacagaaaggccgacctgagggcccaactgcgggcattaacaaccgagcagagcagattaggtaatctggaacggctaaaaaaggaactccgcaagaaacgcttggccgaaagcaggaggaagcagcaagagactaaagagaggcgggaaagggaacgcgtagctagggcagaggcttggaaagcccggaaggccaaagagctgctgttcctcggaaggggcgtttcgggagggctgagccacagaactcctgacgtggcgaaattagaacggcagggtttgcccaagcttgaaacacccgaggtcctagctcaagcgttggggatgaccgtgggacagcttcggggattatgtttcgccagaaccgtcagtaccagaactaattatgtgcggtttgccctccggaaaaagaccggcggcctgaggattatttccgccccgcttcctcgactcaaggcagcacagcactgggtcctcgagaacctgcttgagaagctgcctatgcatgaagccgcccacgggtttcgacctggacgctctatcgtgacaaacgctctcccccatgtcggtgcagctgccgtcgtaaacctggacctgaaggattttttccctacagtggtttatcctcgagtgaagggcttcttcgtaaagttaggctactcagaggccacagctaccgccctggcactgttgtgcaccgaacccgatctagaggaggtcgaactggatggccagaggtactatgtggctcagggtggaagacggctgcctcaaggtgccccaactagccccgccctcacgaacctgttgtgccagcgccttgaccgcagactaaagggcgtcgggcgaaaactggggtttacttacacccgatatgcggatgacttgacattctcactgcccccagggggaccaggcgatgtaggaaaacttctcaggctggtgagatttgttatccagaaggagggcttcgttccacaccctgagaaaacccgcgttctcaggagaggccgtcagcaggaggtgacggggatcgtagtgaatgacaagccgggagtcgaccgtgaaactctccgccgctttagagctcttctgcatcagctggagaaatctgggccagagggccggacatggaacggttccacagacgtgatagcatccgccgtgggctttgccaattacgtgatgatggtggatccgaccaaggggagggtgtttctcgaacaggcccgtgccctggagaaaaaatacggacggaaagcggtggttcctccgaggcgcaaggcagcaccaccagctcaagccggcactgctgccgctccaccttcaggtgcacgccttggcgaggagcccaagtctggggaacccgctagtcccggagcaccagctaagaaaaagtggtggaagctgttctga

SEQ ID NO: 13489 - RNA, 1602 nt, unidentified
  source 1..1602: mol_type = other RNA; note = synthetic construct
atgtcaagccagcccccccgcaatagacaggagctgtacgacagaatcagagccggctccaaggacgaggtcgtcctcgaagaaatggtgcggctgggcttttggccagcacgctcaggactgccaggtgatcccgccgatgtcgtgcaccgacgcaacgaactgcaaggcgagattagggcattgacgagcgagcagtcccggctagggaacctcgaggccatgaagcgagagctcagaaaacgccgcctggaagagagtcgaagaaaacagcaggaaacaaaggagcggagagaacgtgagaggctcgctagggctgccgcatggaaagaacggaaaggcaaagagctgttattcctcggcaggggggtcagcggaggtctttcagagcgaacccctgatgaagccaagctaaccaggctcgggttgcccgttttggccacgcctgaggtgttggcccagacccttgggttgtctgtgggcaaactgcgggccctgtgcttcacaagaacagccagcacaacctctaactacgtccgctttcagctccccaagaagacagggggcaccaggctgatatccgcaccgcttccccgattgaaggcagcgcagacctgggtccttgaaaacattctggaaaaggtacctgtccatgatgccgctcacggatttcgggccggtaggtccatcgtgactaatgctcggccacacgtaggggccggggtagttgtgaacttagatctgaaagacttcttcccgtctgttttatacccacgcgtgaagggcgtgttcgtcaagctgggctactccgaggctaccgcgactgtgctggcgttactgtgtactgagcctgatgtggaagaggtagagctggacggacagaggttcttcgttgctcagggaggcaggcgcttacctcaaggtgcccctacctcacccgccctcacaaatatcctgtgcagaagactagaccggaggctcgcaggtgctgcccgtaaactggggttcgtgtataccagatatgctgatgacctgacgttttctgcccatggacctggaccacatgacgccggcgaactactgcggtttgtgcgatggcttgttggggaagaggattttactccccacccagaaaaaaccagggtgttgcgacgcggccgtcaacaggaggtgactggcgttgtggtcaatgacaaacccggagtggacagggagactctgaaacgtttccgggcactcctgcaccagcttgagaagagtggaccagagggcaagcgctggggcaatagtggagacgttattgcgagcgccgtgggatacgccaactatgtggcgatggtggaccccgtcaaggggaaggccctgcaacagaaggccagagccctcgaggcccggtatggtagacgtcctagtccgccacctcgggccaaagcagccaagggtgctgctcaggcagggtctagcgcacctgtatcctcggctgctccgccagcacaagcacctgaaacaccagctgctgctccagcagcacctgctgcgactccagatagcggccagaaacccgcggaaccccccaaaaagaagtggtggaagcttttttga

SEQ ID NO: 13490 - RNA, 1548 nt, unidentified
  source 1..1548: mol_type = other RNA; note = synthetic construct
atgagctcacagcccccgaggacccgacaggaactgtatgatcggattcgcgccacatctagggaagaggtcatcctagaggacatggtgagactgggattttggccggcgcgcacagaacagccaggtgatcccgccgaggtgatccaccggagaaacgacctgatgggccagcttcgcgctctgacaaccgagcaacaccgcttaggcaatcttgaggcaatgaagagggagctcagaaaaaggcgccttgtggaatccaagcggaagcagcaggagactagggagcgaagggaacgtgagagagttgccaaagccgccgcttggcgggaaagaaaggggaaggagttgctgtttctgggcagaggcgtaagcggaggcctctctgccagagagactgatgaagcaagattgacaagacttggcctgcctgtgcttaccagcccagaggccctggctgaggcattagggctacgggtcggtcaattgagggccctctgttttacccgcacagcgagtaccacccatcactacgtgcggttcctgctgccaaagaagaccgggggaaccaggttaatctccgccccgttaccgcgccttaaagccgctcaggcttgggtcctgacccaagtcctcgaaaaggttcccgttcatgaggccgcccatgggttcagacctggcaggtcaatagtaaccaatgccagaccccatgtgggtgccgcagtggttgtgaatctcgatctgaaagacttctttcccagtgtggggtaccgacgagtgaaatttgccttcatgcacctgggatactcagaagccacagcaaccgttctggctcttttgtgcactgaacccgacgttgacgaggtagagctggacggccggaggtactacgtctcgcaaggaacaagacgactgccacagggggctccttcctctccagccattacgaaccttctctgccgcaggttggacgctcgtttgacaggaactgcacgcgccctgggtttcgtgtacacacgctatgcggatgacctgaccttttctgcaacggggcctggccatcacgatcctggaactctactcaggcgagtgaggtggctcgtgaaacaagaggacttcaccccccacccggacaagacacgtgtcttacgacggggccggcagcaggaagttacgggtgtggtggtcaacgataaacccggtgtcgatcgccagaccctaaaacgctttagagcattgctgcaccagctggacaagacgggcccagagggaaagcgttggggagcaggggcggatgtactgagctccgcagtcggctatgcgcacttcgtggctatggtggatcccctcaaaggccgggccctcgaactcaaagcacgggagctggaacggcggtatgggcgtaggccaccacctgctccacccactcctccacccgctgctacagccgcaccagctcctgaacccactccacctcctgctcctcccactgagcctactcccgccagtcctgaagcgcctaagaagaaatggtggaagctgttctga

SEQ ID NO: 13491 - RNA, 1629 nt, unidentified
  source 1..1629: mol_type = other RNA; note = synthetic construct
atggacaggaggcagcagctgtacgatagaattcgatccactagcaaggacgaggtcgtactcgaggagatgatacggttgggattctggcccgcaaggggcacactgccgtcagatccaggagatgaaatcagagacttagccgaggcccaaagggagctcgctgcactgcggactgagcagagtagactgcataacctggaggcactgaagaaggagctcttcaaacgtcggcttgcagagagcaaagcccgccaagccgaaactaaagcccgtcgggaaagggaaagggtggcgagggccgaagcctggaagaacgagaaaactcgcgctatcgtctttctgggacgcggagtctccgggggtctagctgatacgacctgcgacgaagccagactgcagaaacagggtcttcccgtcctgcggaccgctgaggatttggccagggcagccggtgttacggtgcctgagctccgcttcctcgcttatgctaggacaaccacagccgcccgcgtgagccactacagacgatttcagattcccaaaaagaccggcggcgtgcgaatcatttctgcacccatgcgccggttgaaggcccttcagcgctggcttcttgacgctgttttggccagagttgaggtgcacgatgcggcccacggttttagagccgagcgcagcatcgtcaccaatgctgggccccatgtgggcgcaagagtcgtggtgaatctggacctcaaggacttttttccgaccgttactctgccgaggataagaggggtatttcgaagtttaggctatggagagcacttggcaaccattttcgcactccttgcttcagagccggacacagtaagggtcgctctggacggggctgaatacgacgtagcccaaggaccacggaggctccctcaaggggcaccaacatctcccgctatcacaaacgtgctctgcaggcgcctggacaggagactgttccacgccgccaagaagctgggcttcgcgtactctcggtatgccgacgatctgacgttcagtagcacctctaaagaagagaacgccgggcagttactgaagcaggttcgatttatcgtggcagccgaaggcttcgtgccacacccggataagacccgggtcctgcgaaagggcagacagcaggaagtgacaggcgtcgtggtgaatgacaaactgggggtggatcgggtgactctacggcggttcagagctctccttcatgcgttggataaggacggggcgaatggaaaacgctggggctcctcccccgatgttttcgcgagcgcctgtgggtttgcttcgtatgtagccatggtggaccctgtgaagggcagagctctgttggcgcgtgctcgcgagattgcagcccgtcatggatggaagggaccaccccgaggcccagataggtcaggtggcccatcaggacctggtggtgcccctaaaccccctgccccagcaactcccagtgaacgtgctcccgccccagttgcaggcttaccaggggagccactagcggcaccccctacacctgaacctcccgctccagaacctcctgcaccagcctcccctcctacacccgaaacccccgctaagaaaaaatggtggaagctgttttga

SEQ ID NO: 13492 - RNA, 1587 nt, unidentified
  source 1..1587: mol_type = other RNA; note = synthetic construct
atggcacaggataagcgccaggcgttgtatgaccggattcgggctacatcccgtgatgaggtggtcctggaagagatgattaggctaggtttttggcccgctcgaggtgaagtgccacacgaccctgccgacgaaattcgcgcccgcactgagatgcaacgcgagctgagcgcgctgcgaaccgaacagagccgactcgggaacctggaggcgctcaaaaaggaactgtacaaacgtcgcctggctgccagtaaggcgaaacaggctgagacacgcgcacgcagggaaagagagaggctggctagagccgagggatggaaaatccgaaaggcaggcgacatcgtgttccttggcagggaagtaagcgggggcctgtctgacacgacctgtgacgaggcgaagttaacaaagcagggcctcccggtgctgagaaccgctgtagatgtggctcgggctgcaggcgttggtgtgcctgagttaaggttcctcagctatgcccgaacaactagcaggatatcacactaccgtcggttcgccatacccaaaaaagccgggggagtgagggtgatttctgctcccatgccaagactcaagcggctccaacgctggttgctggattcagtcttgtcccatgtcgaggttcatgatgccgcccatgggttcagggagggacggtctatcgtgtccaacgccaaagcccacgtgggagctagagtagttgtaaatatggatctttcagacttctttccgggggttctgtttcctagagtgaaaggaatgttccgggccttaggatacggcgactttgtggccagtgtactggcccttgtcgccacagagcctgatatgcagaaagtcgtcctggacggccggacctttcacgtcgcagaagggccacgtaggttaccacagggtgctcccacctcaccagcggtgaccaacgtgctttgcagaaggctcgatcgcaggttgtttctggccgcccgaaagctaggcttcgtttatactagatacgcagacgacctcacattttcggcccatgatgatgcaagtgccggcagaaccgggcaactcttggcacaggcgcggtttatcgtggaggaggaaggcttcacgccacacccgaagaagactagagtgcttagacgcggtcggcgccaagaagtcacgggcatcgtcgttaatgatggactgggggttgagagagagaaacttcggaagttccgggccctgttgcacagcatccgggcaactgggattgaaggcaagacctggggtgacagtccagacgtgctggctagcgctcgcggctttgcctcctacgtggccatggtgtctccggaaaaagggagagcactactcggacaggtggccgaactggaggccaggtatggagcagcaaggccccctcgagcctccaaggaaggcatgcatgcaaaagccgcccctacctccgcaggacacgctactcccgttgctacatctgaggcaccccgtcccgagaatgtcccacctgaagctcctaagcccgaagctcccaagccagaggcagaggctcctaagaaaaagtggtggaagctgttctga

SEQ ID NO: 13493 - RNA, 1407 nt, unidentified
  source 1..1407: mol_type = other RNA; note = synthetic construct
atgtcagaccgcagacaagcgttatatgacagaattagggcctcctctaaggatgaagtaatactggaggagatgatcaggtttggcttctggccagcagctgggttacctggcgatcccgccgaggaagtccgtcgacagggcgaactccagcaacgattgaccgccctgagggccgagcgagacaaactggccaatgttaacgaactgcgccgcgaagctaggaagcagcgtctgcgggcaagcaaggataaacggcgcgagacaaaagcccggagactacgggagagggcagctagagctgctgcatggcgcgccaggcaagcactggaactgacttttctaggggcagaggtgtcaggggggatgcaggacacaacctgtgatcgggccagacttgcggcccagggtcttccagcattcgcaacggcggccgaggtggctcaggcaatgggtataactgtgggggagctgagattcctggccttcgcccggagagctagccgtatctcccactacaggagatttacaatgccaaagaaatcgggaggcgttcgcgccatttctgcacccatgccgaggctcaaaagagctcagcactggctgctggcccagatcttggccaaggtcccgactcatgacgccgcccatggcttttgcgctggacgcagcattgtgacaaacgctcgccctcatgtcggagcggctgtggtggtcaatctggacctgcaggacttctttcctaccgtggaactgccccgagttaagggcctcttccgcgccctgggatatggcgagcaggttgcgaccgcctttgcccttttggctacagagcctgtgacagaggccgtggagctcgacggacaggtctggcatgtggctgcgagtgccgcagcacgcagacttccccaaggaagccccgcttccccagccattacgaacttgttgtgtcggaggttagacaggcggctccgtggcgctgctactgcattggggttcacatatacccggtacgctgatgacctgacctttagtgccactgcacctgcagcggtggagagagcaggcaagctcctgactcaggtacggtggctcgtgggccaagaagggtttgtggtccaccccgataaaaccagagtgctaagacgtggcaggaggcaggaggtgacgggtctggtcgtaaatgaacggctcggggtccctcgagatcagctgaggcgcttccgggcccttctccaccatctggacagacgtggcttagaaggagcccgatggggtgcctccggggatgtactcaccagtgcagctggtttcgcctcttacgttgctatgatcgatcctgttcggggagccccacttgtggcagaagtcgccaggttggctgcgcgacttgctccagcccgctga

SEQ ID NO: 13494 - RNA, 1647 nt, unidentified
  source 1..1647: mol_type = other RNA; note = synthetic construct
atgcctgataaacgccaagaactgtacgagcgtatcagagcgagctctaaagatgaggtgattctggaggagatgattagactggggttttggcccgcccagggccatttgccagacgatcctgccgatgagatcagacagcgggcagcattggagcagcagcttgccgcgctgagaaccgagcaagctcgcctgcacaatatagaagccctgaaaaaagccctgcggaagcagaggctcgaagccagcaaggccaaacagcgggagactaaggaacggcgggaacgcgaacgagtagctagggccgctgcctggcgggaacacaaccagagggccatcggatacctggggcgtggggtttcagggggactcaaccagacggccgctgaccgagccgctttaaccaggcatggcgcgccggtcctagaaacagcggcagagctcgcagcagcaatgggcctgacgataccccagctgcggttcctcgcattcgcaagggcaacttccacagtgaaccactatcagcgctttgcaattcccaagaaaaccgggggcttacgccgtatctcggcgcctatgcctcgattaaaggccgcgcagaggtggattctagatcacgtcttagctggcgttgccttgcatgacgccgcgcacggatttagacctgctcgtagcatcgtgactaatgccgcaccacacgtaggtcgggacgtcgtggtcaatctcgacctcaaagacttcttcccaactctgacatatccacggatcagaggcgtgttcaggggcctaggctacggacccgctgtagcaacaatcctcgcgctcctgacctccgagcccgacattgatacggtggagcttgacgggcagacctttcatgtggcctcaggggagcgcaaacttccacagggcgctcccacaagccccatgatcactaatatcgtctgccgccgctttgacgctaggttggccggtgcggccaggaagttgggcttcacatataccagatacgccgacgacctgacctttagcggaccccgcaccgctgatgctggtgcattgctgtcagccgtgcgcatgattgctacggccgagggctttgccgagcatccagacaagacacgggttctgcgcagggggcgtcaacaggaagtgactggagtggttgttaaccagagacttgccgtcgacagagctaccctgcggcgattcagagccctgcttttccagatcgataaggacggccccgcaggcaagacctggaacgatgctcccgacctgttcgcagctataataggctatgcacactttgtgcacatggtcgatgccacaaagggagccgccctcgtggcccaagcaaaagctcttgctgctcggcatgggtggcgaccagcaagaaggccccctcctaagactagaggaggttctggtggaggcggaggtgggcctggtggatctggaccaggtgggtctggttccaggcctggcgaggctgaacgaaccgccacaagtaccggacccacaccgtccactgaaccggctcaacccgctcaaccagggccaccagatgctcctagtccgcccgatgcaccgagtcctgatgccccacctcctgccaagaagaaaaagtggtggcagattttctga

SEQ ID NO: 13495 - RNA, 1545 nt, unidentified
  source 1..1545: mol_type = other RNA; note = synthetic construct
atggctgggcaacctacatcacgggaggccctgtacgagaggattcgaagcaccagcaaggaagaggtgatcttggaagagatgatccgcctcggattctggccagcccagggtacagttcctcatgaccccgcagaggaaattcggagaaggggagagctggaacgccagctggccgaactgcgcgagaagtcccggaagctctacaatgaaaaagtcttaatcgctgaacagaggaaagcgcgcctcgcggaaagtcgccggaaacagaaagagactaaggcaagaagggagcgggagcgtcaggagcgtgcacagaaatgggcggccagaaaagcgggcgagatcctgcacctgggggaagatgtgtcgggcgggatgtcccacaagacatccgaccccgagcttctgaagggagagggcttaccagtgctggcatccgccgaggaactggccaaagccatgggactggaggtgaatgcactgagattcttggcttataatcggaaagtatctagagtcagtcattaccaccggtttttgctaccgaagaagacgggaggattcagactaatatcagcccccatgccccgcttgaagagagcccagacatgggcccttgagcacattttcgctaaacttcgtgttgacagcgccgcacatggctttgtggccggtcgcagcattgttagtaatgcaaagccgcacgtaggggctgacgtcgtggtgaatttcgatctcaaggatttttttccaaccgtgacctttcctagggtgaagggagctatacgtcgcctcggctattccgagtctttggctacggccctcgccctcgtgtgtactgaacccgaccttgaagaagtggctttggacggcgttacatggttcgttgctagagggccccgtcatctgccacagggatctccctgtagccctgcgatcactaacctgctgtgccgacgactggaccggaggttaggaggactggcgcaggccctggggtttgtgtacaccaggtatgcagacgacctcaccttctcaggccgcggcgaagcagccgagtcaaaacgggtgggcaagcttctgagaggcgtcgccgatatcgtcgcccacgagggttttgtggttcacccagagaagaccagggttatgaggcgcgggagacggcaagaagtgactggcatcgtcgtgaacgataggccaagcgtccctcgagacgaacttaggaaattccgagctactctctttcagattgagaaagatgggccggctggcaaaagatggggtaacggtggcgatgtactcgccgccgtccatgggtatgcctgcttcgtggctatggtagatccggcccggggtcaaccattactggcgcgagcaagagctcttctagctaagcacggagggccctcaaagtctccaggtggctccgtccctagggtgccctctcctaacccccaaagcgtaaacgcccctgaggcaccaaaacctgctgcacctgccagtcccgcagctccagcaaagaaggggtggaagctgttctga

SEQ ID NO: 13496 - RNA, 1563 nt, unidentified
  source 1..1563: mol_type = other RNA; note = synthetic construct
atggcatctcagccgagcactagggaggccctgtatcaaaggattcgggaaagttctaaagacgaagtgatcctggaggagatgatccgcctgggcttctggcctgcagctggagatgttcccaatgatccagcagatgaaattcgtcgccgcggtgagctgcagaggcaactggacgagctgcgggagaaagggagaagattatacaatgagaaggctctgattaacgaagcccggaaggcacggatggctgagagccgaaggaaacaagcggagacaaaagcccggagggagagagagcgaggggaaaaggccagtgcctgggctaagagaaagtccggcgagatactgtacttaggggagggcgagtctggtggcttatcacagaagacttcagatccctcaaaactggcacacttcggtctgcccaaattggataccgccgaacagctagctgctgccatgggtattgagataaaagcgctgaggttcctggcctacaataggcggacatccaaggtgtcccattaccgtaggttttttatccccaagaaaaccgggggccagcggcttatcagtgcgccaatgcgccggctgaagaccgctcagacatgggttttgacgaacatcttggacaaggtgactctgcatgaagccgcacacggctttaggcaggggagatccattgtcaccaatgccagaccccacgtggggtcagccgttgtgttgaacctcgatctcaaggatttttttcctaccgtgaccgtccgccgaatcaagggagtatttcgcgcgcttggctatagcgaagcagtggccacagcattggccctcgtgtgcagcgaacccgaagtagacgaggtcgctctcgacggagagacttattatgtggctcgagggcccagacacctaccacagggatcccctgcatcgcccggaataacaaatcttctgtgtaggcggctcgaccgtcgaattgaaggattggctcagagccttgggttcgtttacacgcggtatgctgacgaccttacgttcagcgccagagccgatagggccggttctgtgaatgtagggaaactccttagagcagtgaaagacatcgtggaacatgaaggcttcaacgtgcatcctgataaaacccgtgtgatgcgcagaggacgcagacaagaggtcactggcgtcgttgtaaacgaccggatgggcgcgcctagagctatgctacgcaagttccgggccactctctaccagatcgagaaggatggcccgatgggcaagaagtggggaaacggcggcgatctcctggcagctatccacggctacgcctgcttcgtcgcccaggttgatgccgacaaggggaaagccctcatggcccaggtcgacaggattttcaacaagtatgggaaacctcgtcgcccaggcggtggtggaggcaaaggaccaggtgggggagggggaaaaacccccgacgctgcacgaccagctacaggagccaccacacaaaagccagctgagcctgcgccagaagccccgaaaaagaagcctgcatggaagctgttttga

SEQ ID NO: 13497 - RNA, 1587 nt, unidentified
  source 1..1587: mol_type = other RNA; note = synthetic construct
atggccgctggccagccttcgacgagagaagccctttacgagaggattagggcttcctcaaaagacgaatacatcctggaagagatgataaggcttggcttctggcctgcaagcggtgcagcacccaacgatccagccgacgaaatccgtagacggggcgagctgcagagacagctcgacgagctccgcgaaaagggtcggcgcctgtataacgagaaggcactcatagctgaggctcgcaaactgcgcatggccgagagcaagaggaagcagaaagagacaaaggagcgacgggaaggccagagaattgcgagggcccagctgtgggcacaacggaaggccaaggagctcctgtacctgggggaaggcgtatccggcgggctaagcgaccgggttagtgatgccgggaagctgaagacacatggccaaccccatatcgattctgtggagcagctggcacaggctatgggcgtcgaacttaaggcactgcgtttcttggcgtatagtagacggacctcacgagtcaatcattataggcggtttctgttgccgaagaaaacggggggccataggctcattagtgcgcctatgccacggttgaaaaaagctcagcggtgggtgttagaaagagtgctggacaaggtggctctgcacgatgccgctcatggttttcggaccggcagatctatagttagcaacgccagaccacacgtgggagccgacgtgctagtgaatctggatttaaaagacttcttccctactgtatccctgccgcgcgttaagggggtcttcaagtctctggggtactctgaagccgtcgctactgcattggctctcgtgtgcacagaacctgagatcgatgaggtcgtgctggacggaattacttattttgttgcccgcggtcaaaggcacctacctcagggcagtccagcaagccccgggattactaatcttctctgtagacgtctggaccgacgcttggccggactagcagccagcttgggcttcgtctacacccggtacgctgatgacctgtcgttttccgctcgccgacctgccgttggctcaatcaaggtggggaagctccttcgtgcggtggccgatatcattcggcacgagggcttcaccgtccacccagacaagactcgagtaatgcgcaagggctctaagcaggaggtgacaggggtggtggtgaacgataggcttagcgtcgacagagctacaatccgcaaatttagggcaaccttgtaccaggtagagaaagatggacccgccggaaaaaggtggggtgccccaggaggagatctgcttgcatccctccacgggtatgcatgcttcgtggcgcaggttgaccctcagagagccgctcccctcttagcccaagtgcgcagaatctttgaaaaacacggcaggccgttacgaggaggaccaggtcccggaaaacctccaggggggggtggaggaaaaccacccgaagctcaggtcgccggcaaaccgggtcctcaagcggaagctccccgtaccgagtccaaacccgaggccgagtcaaccgcccccaagaagaaacccttctggaagctgttttga

SEQ ID NO: 13498 - RNA, 1560 nt, unidentified
  source 1..1560: mol_type = other RNA; note = synthetic construct
atgagtgccaagccaaatcggcgccaggaactctatgatcggatacgcaacagttcaaaggacgaggtcatccttgaggagatgatcagactgggattttggccccgtgccggcgagattccagctgatccaggcgacgaaatcaggcgaaggggcgaactccagcggcaactcgatgagctgcgacgcaaggcgagtcggctgtacaacgaggcatctctgataagagaagctcggaaacagcgcttagccgacgcccggaggaaaaagcaagaaacccgagaaagaagagagcgggaacgtcaagagcgagccgccgcatgggcagcaaggaaacagcatgaggtcgtgtatttgggggaaggcgtgtcatccgggctagctgaacacacgtccgatgtggggcgtttgcaggctgctggactgcctctcttcgcagaccctggagctcttgcccaagccatgggcgtacccctgggcgaactgcgttttctagccttccaccgacgagtcgccaccttaacccactaccggcgatttcagattgccaagaaatctggtggcacaaggctcatttctgctcccatgccgagactcaaaagagcgcaggcctgggtgctccggaatgtcctcgacaaggtcgcactgcacgaggctgcgcatggctttagggggggcaggagcattgtaagcaacgcagctccgcatgtgggagcggatgtggtgataaatctcgacgtcgaaaacttctttcccaccatcacactgccccgggtaaagggggttttcagggcgttgggctacagcgaggccatcgctacgattcttgccttactgtgcaccgagcccgagacaactgaggttgagttagacgggcgcacctactatgtgggtcttggggatagagttctgccacagggtagccccgctagcccagctgtgactaacgccctgtgtcgccgcctggacagaagacttgatggtctggccgagcagctgggtttcgaatacacacgttatgccgatgacctcaccttctcacggagaggcgacatcaggtcgacagaggtaggggagctactggggaaggcagctgatattgttagacacgagggatttcgggtccatcctgacaagacgagggttatgagacgcggccggcagatggaggtgactggagtggtggtgaatgacaagctgagcgttgacaggaagaccctgagacgctttagggccgcactgttccaggtggagaaagacgggcccgctggaaaacggtggggagatggccccagattgcttgcgtctatgcacggctatgcctccttcgtgacaatggtcgatcgcgcaaggggggaacctttgttgaggcgagtgcaggcccttatcgagcgctacggagtcggagcctcaaatgcgtccgcagcccctggtgaaggtaaagccgccgcaccaactgccactggagaggcaccctccgctgcacagacagatgctccggaaccagaacctactcctccagctcctcaacctaagaaaaagaaatggcgcctgtggtga

SEQ ID NO: 13499 - RNA, 1527 nt, unidentified
  source 1..1527: mol_type = other RNA; note = synthetic construct
atgtctcagaggcctacaacaaggcaagagttgtacgagaggatcagggccagttcaaaagatgaggtgatcttggaggaaatgattagactgggcttctggccggcccagggagaaatgccaacagacccggcggaagacatacggcgacgaggcgaaatcgagcgccagctggaggagctgagacgcaaggcctccagattgtataatgagaaatccctgatacaggacgcgagaaagcgacggatggccgaaagcaagcggaagaaagaagagacacggctgaggagggagcaagcgcgtagggaaagggcagcagcctggagggaacgtaagcagaatgagttggtgtaccttggcgagggcgtgagtggaggactgggacagcatgaaggacatccagagcgtctggctgccgcaggactacctgctattgctgacgccagggagcttgcccgcttaatgggggtgagcgtgggcgatctgcggttcttagctttccaccgggcggtggcaacgatcactcattatcgccgctttcagatcccaaagaagtctgggggaaccaggctaatctcagcgcccatgcccagactcaaagcagctcagggctgggtcctgcgatctatactggatcgggtggacctccacgctgctgcccatggttttaggcctgggcggtccattgttagcaacgcccaaccgcatgtcggggcagcagtggttgtcaacctggacctgcagggtttcttccccactattacactgccccgcgtaaagggggttttcgcagccctcgggtactcagaatcagttgctaccattctcgccctcctctgtaccgaacccgaaacctttgaggtagagttggacggaagaacctaccacgtgggcctcggccctagagtgcttccacaaggcagtcccgcttcccccgccatcactaacgttctctgccgcagactggacagacgcctccaggggttggccgatcagcttgggtttacttacacccggtatgcagatgatctgacatttagccggaagaaaggcgcgagtagcgccgaagttggggagatgattaggaaagccgtagacatcgtaggccacgaggggttcacggtgcaccctgacaaaacccgcgtgatgaggcgggggaaccaccaagaggtcactggcgtcgtggtgaatgataaagctagcgtcgatcgtcggacgctgcggcgatttcgcgccacactattccaggtcgagaaagacggcttagcaggcaagagatggggagctggtggtgatttgctggcttcgatgcacggctatgcctcctttgtggccatggtcgatcgagagagaggggccccccttctggccagagtgaagagacttatggctctgcacggtcgaggcccatctggaggtggaggtggcggaggttctgcaggacctcgtcccgcagccactacccctgaaccagcccaggctccagctcctgcaccagaaaagaagaaacgctggaagttatggtga

SEQ ID NO: 13500 - RNA, 1572 nt, unidentified
  source 1..1572: mol_type = other RNA; note = synthetic construct
atgagccgtcagccctctacaagagaagagctctacgagcggatccgcaattccagcaaggacgaggtgattctagaagaaatggttcggttgggattttggccagccgcctctgggcaaccaggagatccgggagatgagatcagacgccgaggcgagttgcagagaaagttgaacgatttgcgtacgaaagtcagtcgactttacaatgaacagcagttgatcagcgatcagcgaaaacagaggctcgcggaaagtcggaggaaaagacaggagactaaggaacggagggaacgggagagacaacagaaggcagagctgtggaggcagcgcaaggagagggaggtgctctatctgggtgacggggtcagtggaggcctgctggaacgcaaaactgatcaggctagactcgtgggaggagggctgcctgttttagcggggcccgaagcggttgctgcctctatggggatcacagtgggcgctctccggttccttgcctactccagacgagtgtcaaggatctcgcattaccgcaggttctctatcccaaagaaaacaggtggacgacgtttaatttcagcccccatgcctcgtctgaaagccgcccagagatggattctggagaatatcctagaaagagtacccgtgcacgaggccgctcacggctttttagagcgccgctccattgtcactaatgcggttccacatgtgggcgccgatgtggtaataaacttggatcttaaggacttcttccccaccgtcacgtacgaaagagtcaaaggcttgtttgtatctctcggctattcggagtccgtggcaaccgttctggctctgctcagcactgagcctgaggtcgccgagctggagctggatggcaactcctactatgccgcacagggtccccggcaccttcctcaaggctcaccagcctctcctgcgattaccaaccttctgtgccggagactcgacaggcgactacaagggctggcacgaaaacacggctatcagtacaccagatatgctgacgacctgacctttagcgcacgggggatggtgagcacacggagcagtgaggtgggccgcttactgaggggtgtggccgacatagtaacgcatgagggtttcgaagttcacccggaaaagactagggtcatgagacgtgggcgtaggctcgaagtgacaggtatagtcatcaacgacaaactttccgtggaccgaaaaaccctccgccgctttagggccactctgtttcaggtcgaacgggacggcccagaggggaaaaggtggggagaatccaaggatctgatggccgctcttctgggctatgcctcattcgtggcaatggtggaccctcagagaggacggcccctgatttcccgcgttcgggcagtacatcgcgcacacgggtaccaaccggctgcaccaaagcggagggctgctcctcctacagccgcttcaactgcaccttctagtcccgccagagacaccaccgctagcgtgccaaccccagacagggatcccgatcccacacctcccccaggaaagaaaaagaagaagtggaagctgtggtga

SEQ ID NO: 13501 - RNA, 981 nt, unidentified
  source 1..981: mol_type = other RNA; note = synthetic construct
aagaaaacaggcggaatccgtaagatcagcgccccaatgccacgcctaaaaaggctgcaggagtggattctctcaaacatcttggaaaaggtgccgctccaggatgctgctcatggcttcaggcgggggaggtccatagtgaccaatgccgccccccatgtcggacaggacgtcgttctcaacatggacctggaaaacttcttccccacaattgattttccacggatccggggcgtgttccggaaactggggtactcgggacaaatcagcaccgttttcgccctgatttgcagtgagccagagattgaggaagtgcagcttgacgggcaggcatatttcgtggccaccacagacaggagacttccgcagggtgctcccacttctcctgccataaccaatatcatttgtcgagggctcgacgcacgcttaacaggcgtggctcagcggttcggatttacttataccagatacgccgatgacattacgttcagtgggagtggcggtgcgctgcaacagatcggtaagattctccgccagtgcaaatatatcatcgaacaggaggactttaaggtacaccctcagaagtcccgagtgtttagaaagtcatccagacaggaggtaacgggcctgagcgtcaacgaaaggctaggcatcaatcgccaacttctgagacgtttccgcgcattgttatttcagatagatagagatggaccttccggtaagcattggggacactcaactgacgtgatgacctctatagaaggcttcgcgaattttatcgctatggtgaatccagaccaggggcagatttttcagcaacgggtccgccaactgcacgagaagcacggccgagggcaaagaatgtacaaccagaggaataggtggaacgatcaggaggttgtcactcacttgcctgattctagcgaaaaacctgagctgcccgcagagatgaaaaagaaaccctggtggaaattttggtga

SEQ ID NO: 13502 - RNA, 1557 nt, unidentified
  source 1..1557: mol_type = other RNA; note = synthetic construct
atgcctactcgccaggagctgtacgacaggattcgagagtcctcgaggcaggaggtcatcctggaggaaatgatccagctgggcttctggccatctggttcacaggttccctacgaccctaaggaagacctgcgccgggaacgtgagctccaacaggagctccagcagctggcaaccaaggacaggaatcttcaaaacattgactatgtccgcgcccaggctaggaaacagagacttgcagaatccagacagaaacagaaggaaacaaaggagcggcgactgcgggagaagcaagaacgggcaagtgcctggcaggcaaggaaagtttctgagattttgtatctgggagaaggagtctctaatagcctcaaccagagagagtccaaccacgagaaacttagctctgccggtttgccaagatttgatggagtggaggacctggcacagctgatgggggtcacagtcggagagctgagattcctcgcctacgaccgcgctgcatcgcaggtcacgcattaccgacgctttggcctcaaaaagaagaccgggggcattcgggagatttctgcgccaatgccgagactgaagcgcgctcaggagtggatcctgaagcaaatcctcgaaaaggtcgaagtgcacgactcagcgcatggattcaggccggggcgctccattctgaccaatgccaggccccacgtaggccaagacgtggttatcaacttggacctcgagaacttctttccaactgtgacattccctaggatccgaggtgtgtttaggtcactggggtacagtggacaactcgctacacttctcgctctcatatgctccgaacctgagaaatcagaggtgatcctggatgggcaacactatcacgtggccagatccgagagacggttacctcagggcgcaccaagtagccccgccttaactaatataatatgtaggggccttgatgccagattggctgccttggccagtcgactagagatgacctacacgcgctacgccgacgatatcactttcagcggctctggcgaagccacccagactatcggtaaagtgctaagacaggctcgttatatcattgcctctgaggatttccgtattcatccgagcaagacccgcatattaaggaagggctcacgccaggaggtaacgggcctgatagttaatgagcagttaggcgtaaaccgggaactattgaggcgttttcgggctcttctgtaccagattgaagtgagcggtcccgcagggaagcattggggagggaagcacgatgttatgacaagtatcacaggcttcgccaattttgtacagatggtggatcctgataaaggccggcccctgcaggaaaaagtggcgtccctgcaaaagaaacatgggatcggacagagacggtatgctagccgtactccttggaacccaagcaccgtggcgcctgatcaacctagcaagcccggaggggaagaagtggcttatccagactccggtccacgggatagattccgaaatgggacccccgaacccaaaaaaccctggtggaagttttggtga

SEQ ID NO: 13503 - RNA, 1575 nt, unidentified
  source 1..1575: mol_type = other RNA; note = synthetic construct
atgaccaccagacaggagatttatgacaggatcagggaatctagtcgggacgaggtgatcttagaggagatgattcggttagggttttggagtcgcgacactgacaaaccggaggatcctgctgaagatatccgaaggcaaggggagttggagcgggagcaacggcggttaactcaagaggcggctcgcttgcgcaatatagaggccctccacgaggaagctaggaggaagagaatggaggaatttaggagaagacggcaggagacaaaggaaagacgagaacaggaaagggtccagcgcgccgcagcttggcaagagtccaagcagaaggagattgtctacttgggcgactcagtatcaacgaccctcaaccagcagacgactgatgaagaccgtttgcggtccaatgccctgcctaatcttcaatctatagttgaagtggccgaagcaatggagatttccgtcggggagctgaggtggctggcatttcacaggcgcaccgccgaaataactcattatcggaaattcgctgttccaaagaagacaggcggagtgcgagagatatccgcgcctaaaccccgactgaaacgcattcagcattggattctgcatcacatcctggaccaggtcgaggtacacgatgcggcccatgggtttcgtagagacaggtcaatcgtgactaacgcacagcagcacaccagcagcggagtggtggttaacgtggatatccaggacttttttccaaccgtcactttcagacgtattagaggcgtgttcaagagtctgggatattctgggcagatctccaccgtttttgccctcctttgctcagaacccgaacgtcgggaggttgcacttgatggccgcacgttccacgtagcccgaaccgagaggagacttccccagggtgctccaacatcgccagctctaacaaatgtgatttgtaggggcctcgacgcacgcctgcacactctgagccagaaaaacggtttcacctacacacggtacgctgacgatatgacattctccgcctcgggggaagcaacacagaatgtaggccgcgtgctgcgacaggtgaagcatgccgtcagtcaggaatcatttcaactgcatcctgacaagaccaggatccagcgcgcctctcggagacaggaagtgacgggcctcactgtcaacagcggagtgagcgtgccccgggaaacactgcggaggttcagagccgtactcttccagatcgatagagatggtccaggaggcaaacggtggggggctagccagaacgtgatggtgtctatcgagggcttcgccaatttcgtcgccatggttgatcccgagcgcggagcgaagctgcagcaaaccgttgctgagctccaggaccgccacggcagaggtagaggtacagtcactgtgaggcagcgttggaccttccagcgaccagaacccgtcagctctccgcctggaccaagcgagacagccgtgtccaaccctctacaagccgcagcatccccccctggagcggatcaaagtgctcctaaaccccgaaagccgtggtggatgtggtggaaattttggtga

SEQ ID NO: 13504 - RNA, 1599 nt, unidentified
  source 1..1599: mol_type = other RNA; note = synthetic construct
atgagaagcaggcaagaaattctggatcagatccgggaaactagtagggacgagtttatcctggacgagatgatacgccggggattctggccgaaggaaggcgagcttcccgaagatcccgcggacgaaattagacagagggaggagctgcggcggaaattacactcgcttactacggaggatcggaagctgtctgatgtggagaaactcaaacgcgaggccagacgacagcgactggccgaaagccgtctgaaaagacaggaaacaaaggaacggaggctgcgagagcgtgccgagaaagccgaggcttggagagagcagtatactagggatatcgtttatctcggctccgacgtaagcggtggcttgaaccagcagaagatcgaaatcgaggaactccagaagagaggtctgcccgagctacattccgtcgaggagctcgccgaggctatggaaaccacagtggccgaactcagattcttagctttcgaccgtagaacatccacgactactcactaccagcgatttgctatccccaagaagacaggaggcattaggaatataagtgccccgatgcctcggttgaagcgggctcaggagtggattctgtggaacattctcgacaaaattgaactgcatccagccgcacatggattccggaccggcagaagcatcgtgaccaacgcagaaccccacgtcaaggccgaagtggttatcaacgtggacctcgagaatttcttccccacagtgacctggcggagagttcgcgggcttttcaggaaatttggttacagtgaacaattggccacagtgttggcgctgatctgtagcgagcctgaggtaaccgaggtgcagttagaccagaaaacttattacgtacagcaatcagaacgcaggctcccccagggcgctccttcttcacctgcaataaccaatatcctttgccgcggccttgacgcccgtttaacagggctagccgagaagctgggattcacgtacacccgctacgccgacgatctgacattcagccatgcaggacagggttcagcggctgtgggtcggatgctgaggcaagtgagttatgttgtggagcaggagggatttcagctgcaccctgagaagactaggatcttccgcaaaggatctcgccaagaggtcactgggctggtcgtgaacgagcgtgtgaatataccacgcaagaagctacgccagtttcgggcaaccctgtatcagattgagaaagatggcccagaaggcaaacactggggcaatagcccaaatgttctggaagctattgaagggtacgcaaattttgtggctatggttgacccggagaaggggagagaatttcaacttcaggtcaggaccatcatcgagaaggaggggaggacacaacgaaatgatgtccaacgcgatagatggaaccctaacttggcatctgaggagatttccgaaattccagcgaccggggcagtgcctccttccgtatcctcattgctcacgacccaggaaatagaaccagtcgctcccgccgcaggagaggtctttgaatctaagagtaaaccatggtggatgttttgggcccgatggttcaactga

SEQ ID NO: 13505 - RNA, 1566 nt, unidentified
  source 1..1566: mol_type = other RNA; note = synthetic construct
atggattcccagccaacatcaagacaggagctgtatgaccgaattcgggagagcagcaaagatgaagtgatattggaggaaatgatccggctggggttttggcgcgacgctgaagctgtagagggagatccagcagacgagattaggcggaagggtgaacttgagcggcaactgaaggccctgagtacagagagggccaggctccagaacgtcgaagcccttaagcgagcactcagaaaacaaaggctggaagatagcagatctaatcgcaaggaaactaaagagaggcgcttgcgtgagaggcaagagcgcgccagagcctggcagcagagaaagaccagggaaatcgtgtacctcggtgatggcgtttcagccggcctggcagagcatgagctccaacgggagaaacttcaggctgcaggactgccagttgtggctaccccggacgaactagcccatgccatgggagtgtccctgggagaactgcgcttcctggcgtttagtagacgcaccagcactactacacactataagaggttctttgtccccaagaaaacaggcgggcagcggctgatttctgcacccatgccaagacttaaaaggtcgcaggagtggattttgcagaacatcctcgagaaggtacccctgcacgatgcagcccatggcttcagacgcggccgttcaatcgtgtccaacgcccgccctcatgtggagtccgacgtcgtggtgaatctcgacctgaaggacttctttcccacagtgacgtatcggagaatcaagggcatgtttcggaatcttggctattcagaggcgattgccgtggttttagctctcatctgtagcgagccagacgtggatgaagtggagctggacggccggacctactacgtggctagacagcagcgtttactccctcaaggagcacctaccagccctgccatcacgaatattatatgccggggtctagatggtagattggctagaaccgcagagatgctggggttctgctacacaaggtatgcggacgatatcacgttttctggctctggagacgccgccgctaatgttggaagggccctgaggcggattgggtacgctgtagagaaagagggcttcgaggttcacccagataagactcgcgtcttacgccgagggcggaggcaagaagtcactgggctggtagtgaacgacagacttaatgttagtaggaaactgctacgccggttccgagcgaccctctttcagatccaccgagatggtcctgcagggaagcgatggggcaacagcaacgatgtcatagctagtatagaggggttcgccaacttcgtcgccatggtggaccctgaaaagggcgcagggtttcagcgaaaagtccgcgaaatcattaaatcccacggacgtggcggaggtcgtgcttacccccagagatcccgttgggtgcccaagacacctccagccgaggggttggcgatggaagaagaacccttgaccgctgaaactgtgcagggaagggtttctcgagtccagaagccccgggagaagaaaccgtggtggaaattctggtga

SEQ ID NO: 13506 - RNA, 1530 nt, unidentified
  source 1..1530: mol_type = other RNA; note = synthetic construct
atggcatcccaaccaactacccgccaggagctttacgacagaatccgagaaagttctaagaacgaagtgatactggaggagatgattaggctcggcttctggccacgcggagacacaatacctgaagaccccgctgatgaaattagacggcgcggcgaactggagagacaacttcgatcactcgtgaccgagcgcgctaggctgggaaacgtggaggccctgaagaaggcgctccggaaacagcggctggaccaaagcaggcagaagcagaaggagactaaggaaaggcgccttcgtgaacgggccgagagagcagaggcttggaaaaagagaaaagcccacgagatcggttatctcggcgaaggggtaagcgccgggttagataaccaccaaggagatcatgaaaagctgaccgccgctgggttgccggtcttcgatacccccgagcagttagctcgagctatgggaattggcgtaggagaattgaggtttctggctttcaacaggcgcacgtctaccacatctcactatcgccggttcttgttgcctaaaaaaactgggggacatcgaaagatcagtgcccctatgccaaggctcaagagagcacaggaatgggtcctcgctactatcctggagaaggtggctctacatgatgccgcgcacggatttaggagaggccgcagcattgttacaaatgcccggccccacgttggtgccgatgtggttatgaatctggatctgaaagacttttttcccactgtagtctacagacgcatcaaaggggtctttcggaatttaggttactcagagtcagtggcaaccgtactggggctgctctgcagcgagcctgaagtggacgaggtgcgtctcgacgggagaacatactatacagcacgctcgaaacgttttctgccacagggcgcaccaacgtctcctgcactgaccaatataatctgcaggggattcgatgcccgcctttccagaaccgccgcggacctaggctttgcctatacccggtacgctgacgatgtcaccttctccggccccggtttgccggctgagaacattgggcgtgcccttcgccggattgaacatatcgcaggggcggaaggcttcgaggttcacccaggtaaaactcgtgtactgaggtcctgttctagacaggaggtgacaggcctagtggtgaatcagcgggttaatgtgagccgaaaaatgctgcgaaggtttagggccactctgttccagatcgagcgggatggcccggcaggcaaacattggggccacacggacgatgtgatcgctgccatagaaggtttcgctaactttgtcgccatggtggacgcagagaaagggaagggattcaagcggcaggtggaacgaatcattcaaaagcacggaaggggcggaggtagggtcagagttcagcggtccagatgggtcagttcacctcctccagtggccgccgtcgtggacacagttgagagccctcccgagcccgagaaaaagaagccctggtggaagttctggtga

SEQ ID NO: 13507 - RNA, 1530 nt, unidentified
  source 1..1530: mol_type = other RNA; note = synthetic construct
atgacagatcccccaaggacgcgacaagagttgtatgacctgattagggagacaagtagagaagagttcatcctggaggaaatgatcagactgggcttctggagtgagtcgaccgcgcccgaaaaccctgcaaacgagatcagacgtcaggccgaactgcagcgggaacttcagtctctgctcaccgagaatcgccgattggtagatctggacaaagctaagaaggccctccggagagaacgaatggccgagagcagaagacgccagaaagagacaaaggagcgccgtgaagccgagagacaagctcgtgcggccgcttggcaagccgagcaagaacgctctctggcctacttgggtgagggggtgtcagctggcttaatgcgttacgaagtagacgatcggcgccttgctcgcaatggactcgccggaaaccctttggcaacgccactcgcgctggcacaagctatgcagatctccctgggtgagttaaggtttcttgccttcagccgccggacctcccagactactcattatcagcggtttcagatacctaagaagacgggcggcctcaggtccattagtgctcccatgccacgactgaaacgggcccaggaatggattttgcgtaatgtgctcgagaatgtcccgatgcaccccgcggcccatggttttaggacaggcaggtcgatcataactaacgcacagccccacgtcggcgcagcaattgtcgcaaacgtggacctgcaggatttcttcccctcagtgggctaccctaggattaaggggctcttcaggaccctggggctaagcgaggcgactagcaccgtcctcgccctactgtgtagcgaacctgagatcgacgaagtggtcctggatggacagacatattacaccgcccgctccgagaggcgactaccacaaggagctccaacaagcccagctatcaccaacttactgtgccgaggccttgacgcccggctgcaatccaacgcagagaagttgggttttgtgtatacccgctacgccgacgatatcaccttctcctctcagaatgcccaggctgacgttgggcgggctctgagaagaatccgccacgtcgtggccagcgagggatttaccgttcatcctgataaaactcggatacttcggcgggggtccagacaggaggtaactggacttacagtgaatgatagactgggtgtgagccgggaactgctcagacgcttcagagccgttgttcactcagtggaaaaaaccggccctgccgggaaacgatggggggaatctcctcacctgatgagttctctagccggatttgcaaactttatagcgatggtggacccggaaaaaggaaaaccatggcaggctagggtggccgctctcattgagcagcatgggcgcggcccggacttaaggtcacagaggaagcggtgggtcagtccagttcccgcagctgcagcagctccctcaacagaaactgccagcaagccctctgagtcttccaataggccttggtggaagatttggtga

SEQ ID NO: 13508 - RNA, 1518 nt, unidentified
  source 1..1518: mol_type = other RNA; note = synthetic construct
atgtctaggcggccctctactagacaggagctgtacgatcgaatccggcagagtagtaaggatgaggtgattattgaagaaatgatccgctatggcttttggccaaaacaaagcaatctgcccaatgacccagccgaagagctccggcgaattggcgagctggaacgcaggatcagtgccctcgcaaccgaggcctccaggctgaacaacgtggacgccatgcggcgtgaagcgcggaaacgacgcatggctgaggcaagggcacgccgagaagagacaaagcggaggcatgaagcccagcgtagagctagggctgaagcgtgggccgctaaaaaacgggaggagatcgtgtacctgggagagggatttagcggcggtttgggccaacgagagggccagtctctccctgggctccctgatttacaaggggccggtgcccttgctagggcaatggaaatcgaagtgggacagctgcggtggttagctttccaccgccgcgtgagtgctaccacccactacgttcgttttcagataccgaagaagactggcggcgtgaggaacatttccgcccctatgccaaggttgaaacgggctcagagatggataaaggagcagattctggacaagatcgaactacacgaggctgcgcatggttttgtccccgggcggtccatagtgacaaatgcatccgcacacgtcggtcgtagggtggtcatcaatctggatctccaggacttcttccccaccctaagcttcagtcggatttatggcgtcttcaggtcttttggctatagccccgaagcttctacgttactcgctttgctgtgcaccgagcccgaggtagcagaggtcgaacttgacgggagaacctggtatgtgcacacaagcgaaagacgcctaccgcagggagcaccatccagtcccgcgttaacgaacatcgtggcacgccggcttgacaggagactcgctggcctggcggcccatctgagcttcacttacacccgctacgcagacgacctcactttctccagcgacgcggcagatgcctccatccatcgccttattcgcgccgtggaaggcatagtttccggagaaggattcgtggtgcaccctggcaagactagagtgatgcgtagagcctcgcgacaggaggtgaccgggcttgtcgtaaacgataggttgggggtacctagacggctggttagacgatggcgcgccacactgttccaagtcagaagagacgggcccggggggaaacgattcggattgggatcagatgtctttgcctcactgtcaggttttgcagcctttgttcacatggtggatgaagccaggggcgccagaatgctgtcggaggttgccgaggttgccgctgctcatggatgggctccgcctccaagaaggtctacagagacgcgggctacagaggccagctcagaggcctcttcagaggccccaggcgtaccagcatcacctagcgccggatggggtgggcctacttgggagtggcccctgtga

SEQ ID NO: 13509 - RNA, 1665 nt, unidentified
  source 1..1665: mol_type = other RNA; note = synthetic construct
atgtccgaacgcccgcaggatcggcaggaactctacgatcgtataagagagagctcaaaggacgaagtcatcctcgaggagatgattcgatacgggttttggacccaggaaggcaggcccgatgatcctgccgaagagatccagcgcaagggcgagctagaacggaccgtggctgcactggccacagaggcttcaagactcagagatgtcgacgccatgaagcgggccgctcggaaacagcggatgcaggaggcgaaagcgcgcaggatcgaaacaaaagaaaggcgggaggcacaacggcaggccaaggctaaggcatgggccgagagaaagaccagagagttgctgtatctgggcgccggcgtatctaatgggctcggccaacaggcagagcagatccagcccggactaccatccgtgccctcagctccggacttagccagtgcaatgggtatatctctgggggagctgaggtggttggcattccacagaaaggtgagtacaacctctcactatgctcggtttcagattcccaagaaaaccggaggaacacggctcattagcgcgcctatgccgcgtctgaagaaggcccagcattggattcgggccgagattttggaaagggttgaagtccatgaggcggcccatggcttcgttcgcgggagatcgatcgtgtccaacgctgccgcccacgtaggacagagggtcgtgatcaatcttgaccttcgagatttctttcccagcgtgcactacccccgagtgttcggcctgtttcgctcactaggattcagcccggagacgtctacagtgctgagcctgctgtgcacagaggccgaggtggaggaagttcagctggatggaaggagatggttcgtccacgccagtgagcggcgccttccacaagggtcaccttgttccccagcactgaccaacctcgtgtgcaggaggttagaccgacgcctcactgggcttgcaactcaactcgggttcacctacacgcgatatgcagacgacctgactttttccagtactcgtgacaatgcccaggtaaacagattgatcagagccgtcgaacacattgttgatgacgagtctttcactgtacatccggacaaaacgcgcattatgagaaggggacgacggcaagaagttaccggcctggttgtgaatgataggctgggtgtcccacgtcgtctgttgaaacagtggagggctactgttcatcaaatccggcgagatgggcccgccggaaaaagattcggtcttggtccagacgtgatggcaggcctcacaggctttgctgctttcgtgaacatggtcgacgccgcgaaaggtcaggcaatgttgcagcagatggctgagcttgctgtgtccagaccagcccctccagcgccacaacctcgtccaacacccccagcagctgctcctttgcctccacccatgccagtggcagaacccgcccctacggatgagcccgtccgattaactgagtccagcgcccccgttttaaggcgcacacgcaccctggacgaacctgagccccctctgacccaccaggaaactgctaaaaccctgatagacgagagtcgctctgaagtgcctgaagtggtgaggcctcgcaggagatggtggcaattttggaagtggtttagcagacggggctga

SEQ ID NO: 13510 - RNA, 1641 nt, unidentified
  source 1..1641: mol_type = other RNA; note = synthetic construct
atgactcagcccagaaccagacaggagctgtacgacatcatatcccagacatcgaaagctgagttcatcctggaggagatggtccggctggggttttggggagataggcccgtggatccagggggtgcccataagcgcaggggcgaaattctaaaacgactgagcgcccttcagtcagaggcagcccgtactcagaatcgggaggctgtgctaaaagctattagacgggagcgaatggcagagtctcgccggaagcgcgaggaaaataagcaggcaaggatcgaagccaaacgagccagagccgaagcttggagacagcgcaaagccaaagaaatcctgtatcttggcgagggagtcagctttgacctgagtaagaccgctaacaatatggacgcctggcttggagctgagcctgagcctgaggattaccgcgagcgcctggaaggcctcagtgcatccgccctcccgcaacttaagtccccccctgacttggcgagagccttggggatttccctcggggagttacgcttcctcgcttttcaacgggtggtgtcttcccagtctcactacaggcagtttcgcatcgctaaaaagactggcgggctccggacaatctcagcacctatgccgagactgaagagagtacagcggtggatcctcgacgagatcatcaacaagatagatgatatcgggttacacgacgctgcacacggtttccgagctggcaggggtattctgtcaaacgcggctccccatgtgggtcaagccgtagttataaacatggatcttgccgacttctttcctactataacctttagtcggacgagaggccttttcgccagcatgggctacagcccttctgtcgccgtcattctcgcattactgacgaccgaggccgatatcgaagcggtggaactggatggaaggacttggtatgtgcgtggcggcgaacggagactgccacaaggggctccctcgtctcccggaatcacaaatctgatttgtaggcgcctcgatgcgcgtctgagcggctatgcagcccagcacgggtggacctacaccagatatgccgacgatttgacgttcagcggagaggggcaagacttgaaccagttgttatgggtggcacggcggattatagaggatgagggtctgcgtattaatgaagacaaaacacggattctgcgcaggggaaggaggcaggaggtcacaggcttgatcgtaaacgatcagttaggtgtgcctcgacgagccctgagacggtttagggcactgttgcatcaagttcgtctcgacggcccaaaagggaagcgatggggacagggcgaggacctgttcgccagtatgatgggatttgcggacttcgtgtacatggttgacccggctaagggagcacccctacgcgctgaggttagggctcttcaggcgagatatccgtggagggccgctctcgatgaagcacccctctctctgtcaaagccaagcgcaccactgatcgccgcaacccctgaggacgcacctacaccagaagatgctccaactccccccgaagccgcccaggaaattgaagaggtggaagaagcctcccccacccaggaagcccaacctgacccaaatagaccatggtggcgcctgttctga

SEQ ID NO: 13511 - RNA, 1527 nt, unidentified
  source 1..1527: mol_type = other RNA; note = synthetic construct
atgaccaggcccagccgcgaagagctctaccggaggatcagggagtctagcaaagactccgtgattcttgatgagatgttgagattaggcttctgggacagcgaagagggtgcgaatgacgtgccagaggagctgatcaggcgagaggctgagctgcgccaggaattgcgcaagctcaccgctcaacagaggagatacgagaaccgagacgctgcacttaaagccatgcggaaagagagactgcgggagtctagagagaaaagagcagctaataaacagcggaggaaggaggaacgcctggcgagagcaatggcctgggacgagactcagaaaactcatattgtttatctgggggaggacgtgagcactcacctggaaaagcttgattacgatgccgagaagttagccaagcacgcccttccagactttcctgatcacgttgctctggcagacgccctcggcgtgtctatggccgagttgcgcttcttagcttatcatagggaggtgtcaaccgtaacacactatcggcgatttcagatgccaaagaaacgagggggtttccgcaatatctctgcacctatgccccggctcaaaagagcccaaacttggatactcgagaacattctggatcatgtgcctctgagggatgaagcccacggatttcggccttcgcgaagtattgtatcaaatgctcgtccccacgtgggacaggacgttgtgatcaacatggatgtcaaggactttttccctaccgtcacactgtggcgcgtgttcggtgtctttgaaagtttgggctatagcccatccgtggccacgattctggccctcctatgtactgaactcccagttgaagaattggaactcgacggcaagacatggtacgtggccacgggggaaaggtgcctacctcagggcggaccgacatcacccgcaatcaccaacatcctttgccggcgtatggatgcaagactcgcaggaatagccgataagcatgggtttgtatacacacgatacgccgacgatcttacattcagtgcctccggggaagcagctgaagccgtcaccaagctgctgtggcatgttaaaaccgtcgtgcaggaggagggattcgagctgcaccccgacaagcaacggatcatgcgcagcggaagacgtcaggaggtcactggcttggtggtgaacgacaggctatctgtgcccagagacgatgtccgggctttccgggctttactgcacagggtcaagaccgccgggctggagagagctcattggaagggtgagagtgataatctgctggatcgtatacacggcttcgcgtcattcgtccacatggtggacgccgaacgctatgccgaactgcgcgccgaagccaaagaggtactcgatgcacatgggtacgcgccgcagcctgttccacccaaacccaaatccgaaaggcaagatgcatccgcggaaggcgacggtgctgctaagccaaaaaagggcctgtgggcgaagattaagggcttttttgcaggagctgactga

SEQ ID NO: 13512 - RNA, 1257 nt, unidentified
  source 1..1257: mol_type = other RNA; note = synthetic construct
atgggggaaagggagaaacctggagctagacagggtgctgggaccccttccttggaagaccgggagcaggagtgcagggcgatagaacaagccgcgctggccgcacttgacagggatctagccgaaaaacgtctggacgagggactcaagcgagaacactggtatgagcacctcattgctgctcggcctcgtcggggaaagaggaggtttccctggaaacgaaaccggaagccaaggcccgttttttccgccgaagagcaccgcgttaagttcgattgcccaccactccctagactcgaggacgtggctcatctgctcgacatccccctggccgagttacagttcctggcctttggtgatcgaagactggaaatcagccattaccggcgctttgccatcagcaaaaagagtgggggccaaaggcagatcgctgccccgatgccacgcttgaagcgagtccagcgaatgttgtacgagcagctctttcagcagattcccttacaccctgtttgtatgggattccgccctgggcggtctattgtggataatgcaaggccacacgtgggtgccgacgtcgtggtaaacttggatcttcagaatttcttcccgggcattccttatgctcgcgtcaggggattcctgagagcaatggggtacaacgccgctgttgcaacatgcctggctagactggtcacagagcccagcgtttcgcgtctgcagtggcgtgggcggtcttttacggtggagactggtccgagacgcctaccccaaggtgcaccaacctcccctgccgtggctaatgcgattgcgtatcgtctcgactgtcggcttatgggcctggccaaagccatgggttggcggtactcaagatatgccgatgacttatctttctcagcagtaggcgaacccgccttcgtggtcggcgaccttctagcaagagtgagaagcatcatcggcgaggagggctttactgtgcatcccgataaaaccagaatacagcgcaagggacggcgccaagaagtcactggcctcgtggtgaaccgcgtagtctccgtgccaagggacgagctgcggaggtttcgcgcccttctgcaccagatcgaaaggagtggattcgaaggcaagcaatggggcagagggggggatctgcatgcagcaatcgagggatatttgaattacctggctatggtggatgaaataagagcggagccctacaagaagcagtggcgacggattaaaggcgcagccacagactga

SEQ ID NO: 13513 - RNA, 1179 nt, unidentified
  source 1..1179: mol_type = other RNA; note = synthetic construct
atggccgactcatcctataccaagcgccaagccctgtatgagaggatacgtcagagctctaaagatgaggtcattcttgaagagatgatacgcctcggcttttggaaggagaaaacccttcccggacagccgacgactgacctggaaagactccgggacctgcgagctgaactgagtactgttagccagaaactggcccgaactgctaacctagccgcacttcgccaggaggtccacgcaaggagattgcgtgaaagcagagagcgccagcagcaaaacaaggagcgccgtgagcgagagcggagggagaagacagaacgatggagagaacggtcaagacgcgagctactgtaccttggcgccggcgtgagtggcggattagggtcacccacaggcgacgaggcaaggttgagggaacgggggttgcccatctttacggatgccgctgatatggctagacagatgggcttgacactgggggaattgcgctttttagcattccaccggcaggtgtccaccgttcaccattacgtccggttcgccctccctaagaaggcaggaggtgagaggatgatcagcgcccctcgcccccgactgaaaaaagcgcaacactgggtgctcactgaactccttgacagagttccggtgcatgatgccgctcacgggttcagggctggtcgaagtatcgtctccaacgcggagcctcatctcaggtctgccgtggtaattaatctggatctgcaggacttttttccatcaatccactaccggaggatcagaggcctattcagatccctgggctatggcgaagctttcgctaccgtgctggctctcctgtgttctgaagccgacgtggacgcactggacctggacggtactacctattacgtggccaggggacccagacggttgccacaaggagccccaactagcccagccctcacaaatattctgtgctctcggctggatcggcgtcttacagccgtggcccatagatcggggtttaggtacacccgctacgccgacgatctcaccttctctgccccctccttaacaaccaatgcagtcgcggcggctcctgtggttggtgcagctgtggcaagcgctcctgctgctggagcagcagtagcgagtgcccctgtaacagccgccgcagatgcaacgccagatgtcgggtga

SEQ ID NO: 13514 - RNA, 1017 nt, unidentified
  source 1..1017: mol_type = other RNA; note = synthetic construct
atggcttcaaactcggatcagaataggcgcgaaaatattcggagggagatcgcccagacaagcaaagacgaattcattcttaaggagatgaagcggttggggttttggcccaacgaggaaggtaagccccgtgttgaggaaaacttgataaagcgacagggagagctcagtagagagatcgccgacctgtctaagaaggcacggatatatcaggatcgtgaggcactgctgaataaacacaggaaagagcgcatgcacaaaagccgagaaaaacaaaaggccaacaaagaaaagagggaagccgagcgcctgactaaaaaggaagcttggaaggagaaacaagccaaggatattatctatctgggggataagtacagtgccggccttaagaataagaccaacgatctggcattactcaaaaagcatcagttgccacagatccagaatgtcctagagcttgctaagtgtctcaaaacaaacgtttccgagctgagatacctcagctattaccgccccgtcactaaggtgtcccattatatcagatacgcgttgcctaaaaaaaacggtggcaatcgccaaatctccgcaccgatgcccagactgaaaaccgtacagagagccatcctggacgagctactggttaaggtgccaatttcacagtacgccaatggcttcgccccgggacggagcattgtgactaacgcttcccctcacgtgaacgccgatctgattgtgaatatggacctcaaggacttttttcccaccattagttacaaacgagtgtggggaatgtttaagaagctggggttctctgaccaaaacgcaacggtacttgctttaatttgcaccgaaccagtcgaggagaaggtggaagtggacggagaaatctattacatctcagagggcgaaagggtcttaccacagggggcgcctacatctcctgcaataaccaatatcatatgcagaaggatggaccagcggatggctggcatcgctaaaaaactcgatttcacatga

SEQ ID NO: 13515 - RNA, 1773 nt, unidentified
  source 1..1773: mol_type = other RNA; note = synthetic construct
atgagaagtaataggcgacaggaactgtatgaccggatccgggagtcctctatggatgaggtgacacttcaggagatgattagacatggattctgggctgaagacgatgccatgccctcgctccctgccgagatgattaagagacggggagaactgcggcgagagatttcagagctcgcccaggacgccagactgtaccggtcccaagagcaggctctgcgggccatcatgaagcagaagatgcgggaagccaaagaccgccgcattgaaacaaaaaaaagacagatccaggctcggaatgaccgtgccgcagcctggcacaggaaaaagacagaaggcatagtgcacctgggggacactgtttctggagctctgcagaaccgcgattccaacgcagaaaggttaatcagccagggcttgcccgacttcccagatctgggagatattgccgacgctatgggcatcaccctcggagagctgcgctttctggcatacgaccgggccgtcagtaaggttagccactatcatcgctttcagatccctaaaaaatccgggggaaccaggatattgtcagcccccatgccgcgactaaaacgcgcccagtattggctgctggataacatagtgaatcagatagaacctcatgacgcagcccacgggtttagagcagggcgctctattcttaccaatgcaaagccccacatgagacaggctgtggtcgtcaactacgacctgaaggactttttccccagcatcggctatcgtagggttaaggggttattcgccgccctcgggtatgctgaggctcaagcggctatatttgcgctgctcgcaaccgaagcagatagaactgaggtcgttctagacggtcaaacttggcacgtagcgggaggagagcgcgtattaccacagggcgcgcccactagcccagctattacaaatttgctgtgccgacagttggaccgtcgactgactgggaccgccaggaagctgggagctacctatactaggtacgccgatgatttgactttctccttcgcgacggacgatactaccgccctccgtagcttggactgggccgtaggcgagatcgtgctggatgaaggcttcaatctcaacgatgctaagacccgtactatgcgcaggcacacacggcaggaagtgacagggatcacagtgaatgatgggcttaccatcagtaggaaggagagaagacggttcagggcatacctgcataacgtcgagcagggccgcgacatggggtcatttggctccggtcacccaaagaactccgcattaggctacgcgcaattcctgacgatggttcatggggacggcgtgagcgatcttgtcgcccatgcccgcaccctgtttggtgaccagacgagtgtcccaccagaagatccgaatcacttcaggcaaatgagcgctcggggcgaagctccaaaggcggattggtggcagccagcagagcctgcccaacctgtgcctgaggctcttcctcagcctcccggtacggccgagggtagatctaccaacattccaacagtgggcaaacgccgagcaagagattggggtgcagcccgagctcagccctcgcaatctggacccgctagaccgaggcagggtaaaaaaggcctcgtgggctggtctggctttcaaaagacagcaattaccgtgctcgcccttatcgccctaatcccttttcctttctcacccgtgctcatgggagcaacaatttacttcatctggtttcataggtaccggaaatga

SEQ ID NO: 13516 - RNA, 1929 nt, unidentified
  source 1..1929: mol_type = other RNA; note = synthetic construct
atgagctcggtgtccaaccttcgttcccggatttcagatagtagtttagatcaggtcgttttagaggaaatgatcaggcatggtttttgggggcgtgatgcagaggtaggcgagatgcccgcagagtttttcgagcgacgggcggctctgcaggctgagatagcagacatcctggccagggacaggagattgagcgaccctgacaaggcccttcaggctgtaatgaaggagagaatgaggcgcgcccgtctgaaacgggtagaaaccaaaaggaaagccatagaggcacgcaatgccagagcggctgcgtttgatgcgcggaaacgcgcagaagtcatcagtctgggcgatgtttccagcgcgccattgcagtcccgggaggctaacaatgatcggttgaccgctcaggggctgccagtgattgagggagccatagccctgtctgaggcaatgggaatcggcctgcctgagctgaagtttctggcccatgacagaaaggtcgcccgcgtcacacattaccagagtttcgagatccctaaaaagaccggtggggtcagggtgataagcgccccaaagccacgcatgaaacgcgctcagtactgggttctcgacaacatcctggcctgcatcgaaccccacgatgcagcccacggcttccgcacaggaagaagcattctcaccaatgcagcccctcatgtgggccaagaactagtcatcaacatggacctgcaagacttcttccccacaattacttacgggagagtgaaaggattgtttgccgcaatgggctacgctgaagcagatgccgctgtgcttgccctcattgcaaccgaggcccccagagatacgatcaacgtggatggcactgtgtggcacgttgctacgggacccagagccactcctcagggtgctcctacatcccctgcaattgctaatctcgttgcaaggaaacttgacagacgcctgctcggactagcccggagatttggctttagctatacgaggtatgctgacgacatgaccttctcagggccattcccgggtgaccaggggctgaaaatctttcacgctgccgtgcgagctataactaccgaggaagggttcacattgcacagggataaaacaagattcatgcgtaggggcggccgacaggaagtcactggcctcacagtgaacgacaaggtgagcgtgccgagagcggaacgccgaaagttccgggcatggctccaccaggcagaacagtctggaacgccccagaggccatttaggactggcaatccggtgaccaccggccagggttatgcgtccttcctgtacatggtgggcggaaccgaagggctagctctcgccgaaagagcttggctgctgttaggacggcagacaggggcctcgtcagaaaacattgagcaagcccaggcgttcaggacagctagcgcagagggccgattgcccacacccgactggtggcaaccagccgaaccgccaccatttgaacccatccccctgcccgcctatgatcggaaggatcaggagactcgagacgtacaaacttctattcctaaggccggagagcggcaacttcggagagcccagattgagcgcccaggtgctgacgcacgatctagggctgccctgtcacgttctaatcgcgcctggggtggacaggcttctggcacttccccttctgggcaatcctcatgggccaagtggatcatgagtttctttgccttttttctgcaagtgctcccctacattggggtccctcttgctgtcttcgcattctatcatatctggaagcctcaggccggatacttaggggctaccaccgtttggcacaagttgctcgtggcagccaagttcttgttcgttcttctcggcattgattttgcgctggtgatgatcctggccgtatttagcggtatcgggtga

SEQ ID NO: 13517 - RNA, 1512 nt, unidentified
  source 1..1512: mol_type = other RNA; note = synthetic construct
atgtccgctaagaagtggaccagcatccccgacgactttgacattgtccgcgcttcacgcgaagaggtacgtaaattgcgctggagcccggtgtggcaggacttcctattgcgcgaggtggtgcggatgggtttttacgaaccggaggatgacacagaacagagctattacattaataggtcaaaggagctgagggcagagctccagaaactgaatattgagattgaagaactcaaggaagaagagtccagcttagtcgatcagcggaaggctatcgctaaagcaacacaacgccagaaggaagctcatagggttcgactggacgagtcgagagcccagcgccaggttagaaagcaacaacgaattgagcagagaaaagcaaagaaggagctctggagcataagaaagcaacaggagctgttgtatattggggccggcgtgtccaggatactcaaagaacgaaattcggacacagccaagctgaagtccctagggtgccctgtggtgctcacagatctggagttactgagcctgctccagcaacctgcgtctgaagacgattccatcgagctgtctatggcacacttgaggaggtttgccttcagaagacggatttcacagcacaccaactatacacaattcactatccctaagaagaccggaggagagcgcttaattactgctcccaccatggccctgaaaaccgtccagcggaggattgtcaaacacattctgagtacaatccctacgcacagcgcagcgcacggattcgtggaagggcggtccattcgaagtaacgcggagccacatacgcagagcgccatcgttgtaaacatggatctgaaagatttctttcccaccatcaccggccatcgagtccggggtcttttccagtcttttggctactcaccagctatctccgccatccttgccttcatatgtacgcgtcccgatgtgtccgtgtttgaattggatggccagaattggtacttttatgagggtaaagacgtgctcccccaaggcagcccagcatctccaatgataagtaacctgatctgccggaaactggacaggaggttggagggcctcgctcagagtacagggtttacttataccaggtacgccgatgatcttactttcagttcatctgaccccgatgctagcgtcggggcattacttcacgccactcgggccatcgtcgcggacgaacagtttgaggtgcacccttccaagactagaatcatgcgcaatgggtcttgtaaagaagttaccggagttgtggtgaacgagtacccaaacatctctagagccagactccggcgtttccgtgccctgcttcatcagctgaaaaccaaaggccttgagaatgcccattgggaggaaaccacaggccctgccctgctcaataaggctctgggattcgcagcccacattaagtcagtaagtcagccaaaaggagcagagatattcgaagagactctggaaatcatcaacgacctaaagggccagtga

SEQ ID NO: 13518 - RNA, 1389 nt, unidentified
  source 1..1389: mol_type = other RNA; note = synthetic construct
atggcagatactaaccaaacgaccaactggaggcaggaactgaagcaagtgggcaagcagtactttgagatccaggaaatgattaggatggggtttcttaaaatgcctcccgaagagctagaactgctgaagcagaagtatacagaactgaataaagttaacgcccagctgcggaaactgtcaaaggagctagaaggcttccaggacattacgcccttaattaaggagattcgaaaaaaccgcattgaacgtgttcgtgcggcccgggcaattaaaaaggccgagaaggctcagaaggagaaggcccgcaaggctgaaattgcacagcggaaaaaggatactccttattatctgggcgaaggggtgtcagctggcctcaagtttgagggaactgaggaggccaagctgcaagaggcaggacttccaattgtgcataacgtgaaggacctcgctgagcagatgaacatgcctcagagtgatatcctgtggctgagttaccatcgcaaggctgcatctatcgaccactacagccgctttcaaattcccaaaaggaagggtgggttcaggaccatcgcttcaccaaaacccaagatgcgcgttgcacagcaatggatccttgacaatgtcctgagcaaagtgccaacacatgaagccgcaatggcctttcaggcgggcaagtctattgcagacaacgccaacctccacctaaatgctgagatcctgatacgcatagatcttaaggatttcttcccgtccatcaaattcggcagggtaaaggggctctttaagtccttcggctacaatgagggaatcgccactgtgttaggcctcatttgtacagacgccttgagactcagcgcgaaattggagaataaacagtacttcgtcgcactgggagatcggtacctccctcagggggcctgcaccagtccaaccataactaatctgatctgccgaaaaatggacaatagattgtctaagctttctgataccctgtcctggaaatataccagatatgctgacgatatggtcttttcgaccccgcagaaagaggctgagttgaagcacgtgcttggcctgtccaaaaagatcataggcgaggaaaacttcgaaatccaccctgacaagacaatggtgatgcggggtcaccaaagacaaacagtaacaggagtcgtggttaataacgacgagatcagaatcagccgtcgggatatccgaaacttcagggcctttctgcatcagtacgaacagaatggggcggaagctatgaccaaaaaattggggaaagacgccactgcctatggaagaggatacctcgccttcgtccacatgataaatcccggtcaggccgctaagtttgtggagaaatatggttggttaaagaaatga

SEQ ID NO: 13519 - RNA, 1389 nt, unidentified
  source 1..1389: mol_type = other RNA; note = synthetic construct
atggccaatcagaccaccaccaattggagagcggagctgcggtcagtgggtaaacagtacttcgaaattcaggagatgattaggatggggtttctgaagctcgacccggcagagctggatatgctgaagcaacgatacacggagctgaataaagtgaacaaggagcttaacaaactctctaaggaactggaagggctggaagacatcacccccctgattaaggagatccggaaaaatagaatcgaaagagtcaaagcagcccgtgccatccgaaaggttgagaaggcacagaaggagaaagagagaaaggctgagattgcccagcgcaaaaaagacacaccatattatctcggcgatggcgtgtcagcaggcttgaagtttgagggtggcaatgaagcccagttgaaagaagccggattgcctgtggtcaacaatgtcagggatttaagcgaactgatggctatgcctcagagcgacatattgtggctgtcgtaccatcgcaaggcagcaagtatggaccactacagtcggttccaaattccaaagcgcaagggcggctttagatcaatagccagccccaaacccaaaacacggaaggcccagcagtggatcctagagaacatcctttccaaaatcgactgtcacgaggcggccatggctttccggcctggaaaaagcatcgctgataacgctcacttccacctgcaggctgaggtgctcattaggattgatcttaaagacttctttccatctctgaagtttggtagggtgaaaggcctgttcaagtcttttggttataatgaaggcgtggcaagcgttctggcattgatgtgcactgacgcgctgagactctccgccaaactggaagggaagcagtatttcgttgccctcggagagcgctatcttccccagggcgcgtgtacctccccagctataactaaccttatatgccgtaagctggataataggctaagtaagctcggagataaacttgactggaagtacactcgatacgcggacgacatggttttttctagctcaaataaggagacagatttgaaacatatcctcgggctgagtaagaaaattatcggggaggaaaacttcgtcattcaccctgataagactatggtgatgcgtgggcaccaacggcagacagtgacgggggtagtggtcaacaacgatgaaatccgcatatccagacgcgatatgaggaacttcagggcctttctccatcagtacgaacagaaaggcgcagctgagatgacaaagcagttaggaaaggacgctaccgcttacggaaagggttatctagccttcgtacaaatgatcaacccggcccaagctgagaagtttaaggccaaacatggatggttatcccaagcctga

SEQ ID NO: 13520 - RNA, 1386 nt, unidentified
  source 1..1386: mol_type = other RNA; note = synthetic construct
atggcaaattatgataagatccaagagctgcgccaggagatccagaccctgggaaaagaatactacatcatgcaggaaatgcttaggactgggtttctgaagatgtctgaggtcgacctggttagaatgaaagccaatttgaacgagttgtcaaaaattaaccaggaactgtctgtgcttagcaaggagcttaaagacatacccgatatcactcccataatcgccgagattcgaaagaatcgtatagaaaaggttaagtccgaaaggttgattagacggattgagaaggagaaactgatcatccaacgcaaggagaagctcaaggagaaaaaaaagaataccccgcattacttgggcgaaattgcacggggcctggaatttaaagcgagcgatgaggaaaagttaaagcagaaaaatatcccatctctgcccgacttgcaagccctcgcagacctctctggactcaccagggagcagctgctgtggctgtcataccataggaagaccgccaaaatagatcattatacgcgcttccagatccctaaacggagtgggggaatgaggactatcgcatccccaaaatcaaaactgcgggtgattcagcactggattcttgaaaacattctgcagaagctatccattcacgaggctgccaaggctttcgctcagggcgcaagtgtggtgaaaaacgccgtaccacacttgaacgcctatgtggtgattaaagtggatgtcaaggacttctttcctagcattaagtttaatcgcgtagtgggttttttcaagtcgttaggctattccagagggatgagctctgttctgggactcctgtgtaccgacgcgatgcgactgaatgctgaatttgagggtgaaaagttcttcgtggctatcggagaaagatacctcccccagggggctagcacttcacctatgctcacaaaccttatctgcaaaaagctggatgctcggctgagcaagttagccgagaaatacggctttcaatacacacgctacgcagatgacatgacgttttcccaccctgagaaagaagctaacgttaaagctatcctaggctggactaagaagatcctagcagaggagagcttcgagctcaaaaaggagaaaacctctgtaatgaagaaacaccagaggcagactgtcaccggggtcctcgtcaaccatcaggaaacaaaaatttcgagaaccgacatccgtaagttccgagccttcctccaccagtacacattaataggtgcggaaaagatgagtgagaagctgggaaaagacgccacatcctacggcaaaggttatttctcctatcttaagatggtgaatgagacacaagccgagaagtttaagaaggaatatgcctggctggccagttga

SEQ ID NO: 13521 - RNA, 1383 nt, unidentified
  source 1..1383: mol_type = other RNA; note = synthetic construct
atgaccaattacgataagatgcaagaaatccgtcaagaggtggcgatgctggggaaggagtattatatcatgcgggaaatgctgcggaccggctttttgaagatgtcagaagcggatctggccaccatgaaggcaaaccttggtgagctcacaaagatcaaccaggagctcaatgaactgagcaaagagctgaaggacatccctgacattactccgattatcgccgaaattagaaagaatcgcatcgagaaggtcaagaccgagcgactaatcaaaagggtcgagaaggagaaattactagcccagcggaaggaaaggttggctcagaaaaagaagaatactccccagtacttaggggacatagcaaaaggactcaaattccagaaccagaatgaagaaaagctgaaagagaagaacctccctctgctcaaggatttgcaggatctcagcactctttctcagctcacacgagagcagctacagtggttgtcctatcaccggaaaacagcaaaaattgatcattatacccgtttccagattcccaaacgcactggcgggctgaggactatcgccagccctaagcccaagctccgagtagcacagcagtggatactggagaatatccttgctaagttgtcaattcatgaagccgccatggccttcaacgtgggagcgtcagtggttaagaacgctactccacatctgaacagcgaggttgttattaagatcgacgtcaaagacttttttccctccattaaattcaaccgcgtagtcggattttttaagtctcttggatattcccaaggcatatcttcaatactcggacttttatgcaccgacagcatgagactgaatgtcagttttgagggtgaaaaatttttcgtggccataggcgagagatatctgccacaaggcgcttgcacaagtccaatgctcaccaatctgatttgtaaaaagttagatgccaggctgtccaaactggccgagaagtacggattcgcgtacacgaggtacgcagacgatatgaccttttcccacaagcagaaagatgctaacatcaaggccgttctggggtggaccaaaaagatcctggcagaggaaaatttcgagctgaagaaagagaaaacatcggtgatgcgcaagtaccaaagacagacggtgacgggcgtgcttgtgaaccacgaagaaactaagatcagcagaaaagacattaagaagttccgggcctttctgcaccagtacacattgatcggggcagaaaaaatgtctgaaaaattgggcaaggacgctacagcttatggcaaaggttacttcagttacctgaaaatggtgaacaaaacccaggctgagaagttcaaacaaacctacagttggcttgggtga

SEQ ID NO: 13522 - RNA, 1395 nt, unidentified
  source 1..1395: mol_type = other RNA; note = synthetic construct
atgtccgaggataaaaactggaaggaacgtataaaagaggttggcaaggaagccttcgaaattgaagatatgattcgcctgggatttctccagatggacaaggaaactatggctgaaatcctcgacaaacagaaggcctacaacaagctaagcaaccgattcttcaaaattaatagggaactggatagcgacatcgatattaccccctacatcaaaattattagggagaagagaatcaaggagtcccgcgaaaagagagcgttgagaaagattgaaaaggcaaaaaaggaggcagagcggaaacaaaaaatcgccgaaaagcaggagaagatgccttcttatctcggagatgagataagcgccggcctgaagtacgagggtaccaatgaggaaaggctaacgtcaacttccctgcccgtcatctctgacctgaaggagcttgaggtcaagtcgaatatcacagctaagcactggcagtggcttgcgttctacaagaaagtctctaatatcgaccactataacaggttcacaatccccaaaaagaacggggatgtacgtaagatctcagccccaaagaaaaggctccgcgttgctcaagagtggattcaaaatgagatactgtccaagatcgaattacatgagaaggcatatgcttaccggaagaacatctccattgtcgacaacgctaaactgcaccagaatgccaaagtggtcgttcgaatcgacttaaaggatttcttccctagcataaagtttaatagagtgaagggactgtttaagtcgtttggatattctgaagccttggctacaatatttgccagtgtgtgcaccgactctgtgatggtgaaggcgcagatgagtgagaaagtataccatgtgtcaatggggaacaaattcctgccacagggtgcttgcactagccccgcccttaccaacattatatgtaagaagatggacaagcggatcgagaattttaccaaaaaaaacggcatcaggtataccaggtatgcagatgacttggttttcagtacagaggacgagaatataaacctcaaaagcttcttttcctggatccatcggattattaaagaggaaggcttccaaatcaacaacgagaaaactagagtgatgcgccctaatcagcggcaggcagtgacggggattatcatcaatgaagggggtgacattagaattagccgcaaagatattcgcaaattccgggcttttatccacaattttaagctgaagggcgaggaagaagccagaaaacagattggaaaaaacccgaatcactacctggaaggctaccttagttttatacgaatggtgaacaaagatcagtttgagaagatgaaagcatatgccgagtcaaaattggagatggagatcatctga

SEQ ID NO: 13523 - RNA, 1386 nt, unidentified
  source 1..1386: mol_type = other RNA; note = synthetic construct
atggccaatcagaatgactccgaaaattggcgagaggagctgaaacgcctcgggaaggagtattttataattcaggagatgctgcggactggcttcttaaagctcaccccagaagatatcgcgctgtacaagaccaaaataaaggagctgaacgatgtaaatggggaaatctatcgtttatcgcacgaactgaggggcattgaagatatcacaccccttattgaggagattagaaagaacagaatcgctcgcgtgaaagccgagaggatcattaagaaggccgagcgggcaaaaactcttgaggaacataaaaggaccatcagtgagaaacagaaatcaaaacccaactttctgggcgaaaaattcgcttccaagctcaagttcgaaggcggtgatgcaggcaaactgcaggcctccggattgccaaccctcaacgacctgcatgacctgtcccaagctaccggcatctctcgagaaaggttgcagtggctgtgttatcatagacaggccgctacaatcgaccactatactcgctttcaaattcctaaacgcaagggaggaatgagatctataagttccccgaaacctcaaatgcggctggcacagagctgggtcctggataacattctgtctaagttgcccatacacgactcagccgtcgctttcagggagggaaagagcattgtcgataacgctaattttcatgcaggaaatgcactgctagttcggttggacttgaaggatttctttcctagcgttagattccaccgtatcaagggcctgttcacaagttttggctataactacggtatcgccaccgtgttcgccctcctctgtactgatgctgctaggatcggggcaaaattgaatgataagcaatacttcgtcgcgcttggagacaggtaccttcctcagggggcctgcaccagcccaatgctcacgaacctgatctgccgcggtctggataaccggttaactaagctgtgcgcgtctcttggatggcggtatacgcggtatgccgacgacctggtgttctcacacgaggatgaacaggccgaccttaagaagctgctaggcctagtgaagaagataatcaaggaggagacatttgaggtcaacgaggaaaagaccctagtgatgcgcccccaccagagacagacagtgacagggattgtgattaatgacgggaaactccgtttaagccgaagagatgtgaggaactttagagcttttcttcatcagtacacgctgaaaggtgccgaggccatgagtcagcgcttgggcaaggacgcaactcagtacgccaaagggtacctcgcgttcatgcgaatggttaatccagaacaagctgacaaatttgtacaggaatacgcatggctcgcctga

SEQ ID NO: 13524 - RNA, 1386 nt, unidentified
  source 1..1386: mol_type = other RNA; note = synthetic construct
atggctcaggaaaaccccgataattggagggaccagctgaaagccttggggaaggagtattataccctccaggaaatgctccgccttggattccttaagatgagcgagcaggatctagccttttaccaggctaaggttgccgatctgaacaaagtcagcacagaactccactcaatgaggaaaagcctggagggcgtaaaggatatcactccccttctcaaggagatcaggaagaataggattgagcgggtgcgcgttgcacggtcattgagaaagattgcaaaagagcaagcgttcgctgaggctaaaactaatcgaagagccagacagatggcaacaccaacctacctgggcaagggggtcagtaagcacctgaagttcgaaggcacacaagccgaacgactggcgttatttgacctgccgcgggtggaaaacatggcagagctagccgaagccatgcagctcacccctgaaaagctccactggctgtgctttcatcgagaggcttcaaagattgaccattatacaaggttccagatccccaagaggaaaggaggcttacggtctatcgcctccccaaaaagaacgttacgtgtagcacaacagtgggtcctagagaatattcttcgcaaaatagcccctcattctgccgcaaccgcctttgagcctagggcttccattgtcgagaacgcaaaaaagcacctgaatcaggccctatttatcaggatagatctgaaggatttcttcccctcgctgaaatttcaccgggtgaagggcttattccagtctctgggatacaatgctggcatggcgactgtgctcggcttgctttgcaccgactccgccagaattggggcgaaacttggtgaagaccagttcttcgtggcgcttggtgatcggtatctgccgcaaggggcttgtacatccccaactctgactaacctgatctgcagaaagctggataagcgtctggcccaattctgtgctaagcagggatggatatacacaagatacgccgatgacctgatgttcagccacgctgagagtcagacggacctgaaaccaatgatggggctggttaaaaagatcgtggcagaagaagggtttgtcatcaatcccgagaaaaccttggtgatgcgacctcaccaacgtcagatggtgactggcctcgtggtgaacgatggagagttgagagttagtaaacaggacctcaaacgctttcgcgcattcctccatcagtttgacttggacggcaaagacaaactctctgaacggttgggtaaggacgccgaggcttttggaaagggttactgggcatttattcgcatgatcaaccctacccaggccgaaaagttcaccgagaagtataagtggctggctcattga

SEQ ID NO: 13525 - RNA, 1404 nt, unidentified
  source 1..1404: mol_type = other RNA; note = synthetic construct
atgcaactcaccccctctacaactgagaattggcgggccagactccaacgactagggcgagactattttgtcattgaggagatgatacggctcggtttccttgacctttcgcagcagcagtacaagacattacaggatagctacacacgcttgaacgagattaatggcgaattacagaagttgaacatcgaactcaagggtaccgaggacataacacctctgctgaaggaaattcggaaaaatcgtatcgaaagggttcgggcaaagagggctataagaaaagtcgagaaagcccgggtcagccaggccaagaaggcagaaatcgcgctgcagaagcagaagaccccataccatcttggggagggcgtgagtaaagggctgagattcgatgaaactgataccgagaagttatcacaggcaggcctgcctgtgctgcacaccctagaagacctggcacagttcagcaaactggagatgaaacaatgggtgtggctgtcctaccatagacgtgtcgccggcattgaccattatactcgctttcagatccccaagaaaaaagggggcctgagaaatatcgcttctccaaagaagacgctgcggatcgctcagcagtggattcttgagaacatcctaaacaagaggcccatacatcccaatgccatggccttcctgccgggaaagaacatcaggcacaacgctgagaaacacacgggaaagcacaccgttgtgcgagtggacttaaaagatttttttcccagcgtgaaattccctagggttaagggcctctttaagagttggggctactccgaaggcatcgcaacagtgctggcgcttgtatgcacggacgcgactcgaattggagcatctttggacggaaaagcttatttcgtagccttgggagaacgcttcctgccgcagggggcttgtacttctccagccattacaaacattctgtgcggtgataccgggtacctcgatcatagactcaccagactcggtgaaaaattggattggacttatacccgttacgctgacgacctcgttttctcaaccaacatcacagaagataatctgaagagtctgctggggctcatgaataagatcatcaaggatgagggcttcgagatcaatcaagagaagacttcagtcatgcggcaacaccagcgccagacagtgactggagccgtggtgaatggcaccgaaccaagggtgtccagagaggatattcgcaggtttcgcgcttttttgcaccagatggagaaaaacggatccgccgctatgagccaaaaactgggtaaagacgccgaaaggtacgcacagggatattgggcctttattcacatggtacagcctacacaggccgagaagttccttaaccaatattcctggctgaaaaagaaatga

SEQ ID NO: 13526 - RNA, 1404 nt, unidentified
  source 1..1404: mol_type = other RNA; note = synthetic construct
atgcaacttcccgccactccaactgagagctggcagtcccgtctcaagcatctggggcgagaatactttattgtggaggaaatgatacgcttaggctttcttgaaatcaccccggaacaataccagttactggtcgacggatatgctaggctaaatgccataaacggagagctgcagcggttggggcaggagttgaagggtactgaggacattacacctttgctcaaggagatcagaaaaaatcggattgagagagtgcgcgccaagagagccctcaggagggttgagaaggctagggccaggcaatcgaggcgggaggaggtgatccgaagaaaaagacagaccccgttttatctcggcgaaggagtaagcgctggcttgcatttcacgggtaccgacgaagcgaaactggcagcagcagggctgcccgttctccacaccctcgatgacctggcccaggcctctggactagaggcacgccagtggatttggctttcttatcaccggcgggtagcccgaattgaccactacactcgcttcgagatcccaaaaaaaaaagggggcacacgcccaatcgcggctccaaaacgcactctcaggcaggctcagcaatggatcctcgagcacctgctgaacggtaggacaatccaccctaatgctatggccttcctgccggggaagaacatccggcataacgctgaaaagcatactgggaaggcagtcgttgtgcgagtggatctgaaagattttttcccctcagtgaaatacccaaggatcaagggcctgtttagacacttcgggtataatgaaggtatagcgacagtgctggccttagtgtgtaccgatgcactgagagtagccgcacgtttggacggacaagactactttgtggctctgagcgagcgctttctccctcagggagcatgcaccagtcccgcccttacgaacattctgtgtggagacgtcggctatttagatcaccggctgacatgcttggcagataagggaaactggcagtacagccgctacgcagacgatctggttttctccaccacagacccagccgccgatttgaagtctcttctcggccctgtgcggaagatagtggctgatgaaggctttgtcgtcaatcccgagaagacccgggtaatgcgacctcatcagcgtcaggccgtcacgggggtcctagtgaatgaggctcgtcccagagtgggcaggcaggaactgaggagattccgcgccttcctgcatcagatgggtcagattggcgttcctgcgatgtcagttaaactggggaaggacgccagacgatatgctcagggctactgggctttcgtgaaaatggtggaacctgatcaagcgtccagtctgcttggcaagcacccctggcttcgggcccagtga

SEQ ID NO: 13527 - RNA, 1413 nt, unidentified
  source 1..1413: mol_type = other RNA; note = synthetic construct
atggagacaacagaacagaacacttcttctagcaaaaacaatgcatggcgagaaaagctgaagaatctgggtaaggagaacttcataatatcagaaatgacccggttagggttcctgtctgttgcccctgaaaacctccaggtcctgcgtgacggtttcgatcgtctggaggtgatccagaaggagttggctgccatccgaaaggagctacagggaacggaagacatcactccactcctgaaggagattaggcagaatcgcattgagagggtacgcgcacagaggacgataaaaaaggctgaaagagccgaagctgcagccgcagcccgtaagaaattcttagcagaaaagcaaaccaaacctttttatctcggcgatggggtaagtaagggcttgaaatttgctgcaagcgacgcctccaaattatcggataatggtttgcccgtgctgcacaccctggacgatgtggctgctgcaagtggattggacgcgtctaaatggcagtggctggcgtatcatagaaaagccgctacccttgaccactacacccgatttcagattcctaaaaaaaaggggggcctacggtccattgcctccccgaaagcgactctgcgcaaggcccaggcttgggttcttgccgaaattttgagtaaaagagccgacgcttcatccagtgatgccagctttgcgttccagaagggcaaatcaatcgttcagaatgctgccaagcatctgaacaaggctgtagtggtgcggatggacttaaaggattttttcccctccattaagtttaggagagtgaagggtcttttcaacaaacttggatataacgaagggttggctaccgtctttgcgctcgtgtgtacagattccgtgcggatcgaggcagcactggacggcaagagatatttcgtcgcactgggagagcggtttgttccccaaggcgcgtgcactagcccagcccttacaaatatgctcgcccgggacctggatatgaggcttatgcgcttcagcgagaaatacctgtggacttacacccgctacgcagacgacctcacgttttcgacagatcatccaacacctgacctcaggcaactcctgggggtggctgccaagatcatacgcgatgaaggattcgagatcaatgctgcaaaaacactggtcatgagaagccaccaacgacaatctgtcaccggcgtggtcgttaacaacgcagaggccaaagtgtcaagaagggatgccaagaggtttcgggccgtgctccaccacattgagactgagggcgaggagactgtcagcaagaagctgggaaaatctgccaccgcctatgccaaggggtacatcgcttacctatccatgatcaatccccagcaggccgaaaagttcaaagctaaacataagtggctggcctga

SEQ ID NO: 13528 - RNA, 1014 nt, unidentified
  source 1..1014: mol_type = other RNA; note = synthetic construct
atgagcgacgagttaagtttgaatccacactggcgaaagagggtccaagagatcggacgcatgaacttctcaagggaagagattttgagactggggttcttcagcgatctggacgacgcggagagacaacagttaaagacttttcttgatgaggcttacccccgactcgcagaactgcgcaaggaactgaagaaagtcagcactaccatcgaggaggcagacgatctgcaatccctgctccgtgaggtaagacgcgcccgtatcgagcgcgtccgaagagagagggcacagaggaagaacaaaaaggagaggcaggaagttgagcgccagcaggcctgggccacaaagaaatctaagacaccgccttttctgggcgtgggggtatccggaagacttcagttttctggcgaggacgacaaacgcctgttgtcccaagggctacccgtcccaaaagacgctgaagaactggcttcgctcatgggaatcaaatcttccgaattactctggctttgttatgagcgagccgcggccagcgtggatcactatacccggttcgagatacctaagcagagcggcggtaaacggctcattagctcccccaaacctaaaatgcggtctgctcagagatggatcctggacgaagtgctagccaagctgtccccgagcaatgcagcaacagcctttaggccaggtgcctcaatcattaagaacgccgaacctcatttgaatgctgcgattctcgtgcggatcgactttaaggatttcttcccctcaataaccttcccccgtatcaggggattctttgaggctctcggctacaatccaggcgttagtaccctcctgagtttgatttcaacagatgcgcctcgggtgaaagccgttctggatgaaaagactaactttgtggctatggacgaaagaagtcttccacagggtgcatgcacgtctcccgctctggccaacctgattgcatggaaacttgatgcccggataggcgggctatgcaaggtgtga

SEQ ID NO: 13529 - RNA, 1074 nt, unidentified
  source 1..1074: mol_type = other RNA; note = synthetic construct
gccgcatggcttgaaaaaaaaagtaagaatcccccatttcttggcatcggggtcagttctcggctgaggttccaaggtggggacacgaagattctaacagccaacgagctgccgacacctaaggacgccgaggagctcgcattactgctcaatattagcacatcagagttgttttggctctcctatgaaagggctgctacctcccttgatcattacacacggtttgaaattccgaaacggtctggagggaagcgtctcatttcatcacccaagccaaagcttaggacagcccaaagatggatcgcagagaatatcctggataagttatcacccgcagcccaggctaccgcgtttaggagcggtgcgtccatcattaaaaatgcggagcctcacctgaacgctgccatcgttgttcgaattgatttccgcgatttcttccctagcataacctatcctcgcgttaggggatacttcgaaagcctcggtttcaatcccggagtggccactctgctggctctgatcagtaccgatgccccacgtgtgaaagtgtcgtttgacggcaagacccagtacgtagccatgggcggcagatctcttcctcagggagcatgcacgtccccagccttggccaacttgattactcggaagttagacgcccgaatagcaggcctgtgccaggcctccactgaccagtggacctacaccagatatgcagacgatttgactttctccacccaggctagagacgcgaacgtcggacgactactagggagcgtgcagaacatagtatctgacgaaggattccggattaacagagagaaaactgctgtcatgcgcgcccccggcagaaggatagtgacaggcctgatcgtggaggacgagatccgactgtctagacgcgatctccggcggctgagggcttttctgcataggtgtgataaagacgggctggcaagagtcagcgaagagatcgggaaggatgctctcgccgtcgctcacggtcgcttggcatacgtgcaaatggtgatgccagaacacgccggccgcatccgtggcaaatatagttggctgtga

SEQ ID NO: 13530 - RNA, 1410 nt, unidentified
  source 1..1410: mol_type = other RNA; note = synthetic construct
atggcctcacaggaccttgccttgaatcccgattggaaagagcgaatagctcagatcggtaaacaaaactttgtgcgggaggaaatgctgcgactagggttcgtgagcaaaaaattaggggaagaggagagagctaggatccaggggttcctggaccaagcctatcctcgtttgaaagagctgcgcaaggacttggccgaaattcgaagccagatagaaggcatcaatgacatagaaagtctgttaaaggaggtccgacgcgagagaattgagcgcgtcaagagggaacgcgaagagaggaaggtgcgcaaggcagaggagcaggaacggaggaggcaggctctagccgaagagatgcgtaagactcccaggttcctgggccacggcgtaagtgcccacctctcctttgccggaggcgacgcagttaatcttgcggccagaggtctaccccagcccgaagacgtggaacagctggctgaactgatgcaattggatccttccgaagtgctgtggctgtcttacgagagagccgccacgaccgtggatcattacacacggtttgagattccgaagaaatctgggggccgcagactcatttcctcgcctaaaccaaaaatgcgggtcgcacaaagttggattgcagagaacgtgcttgatctcctgtctccatctcggcacgccatggcattcagaccaggtacatcaatcgttgataacgcgagcccacacctgaacgcggccattgtggtgaaactggatttaaaagacttctttccaagcatcggcttcaccagggttcgtggctattttgaatacttaggatttaacccgggtattgcaactatactggctctgatctgtaccgacgctcccagggtaaaggttacgctcgacggcgccgcaaagtatgtcgccatgggagagcgtgggttaccacagggtgcttgcaccagccctgcgctcgcaaatttgatcgccacccctcttgactcaagactggccggactctgcactgctctcgagagtacctggacctacactcgctacgcggacgacctgactttctcctgtctggacgagagagctgacgtggggaggctgttgaaggctatcgagaggatcgtgggcgatgagggatttaggattaatgcagcaaagacagctgtaatgcgggcacctggcagacaggtagtgacaggactgcttgtcggcgatcagatcagactcagccggcgggatcttcggtgtcttcgcgccttcctccatcggtgcgataaggagggagtggaagctgtttcccgagccattgggaaggatgccctgtcagtggcacgaggacatctggcctatgtcacaatggtcatgcccgggcacgctgctgatatcaagcgcagatacgcctggctctga

SEQ ID NO: 13531 - RNA, 1704 nt, unidentified
  source 1..1704: mol_type = other RNA; note = synthetic construct
atgtccgagtcaggcttgcctgccgattggcggactagactggagcggctcgggcaacggaatttcgagattagggaaatgttgaggctgggctttctcagtgcagccgaccctctccgaccaggtgagacaaacgctgccctactcgccaagatagccgagttagagcagttgcaggctgaactggatgaagtggacgatgtggtcgccagcgcatctaggatcgagacactgctagaggaaattcgcagagagcgcctggcctcatcggcgttaaggaaagccgagcggaggagagcgcgtgaagagcaggctaggcagaagcagctggcctgggccacccaacgttgcgaaaggcccccatatcttggcgcgggggtgtctacccgactccagtatacggggggcgatgacgatgctctggcatctgcgggattgcctgaggtgcacacggtgttagagcttgccgacgatatggacaccaccaccagcgaggtccagtggctgagctaccacaggtctgtgacaacaatagatcactacaaccggtttaccaccccgaaacggtccggaggaaccaggacaatcagtagcccaaaaccccgcatgagacaggcacagacgtacatcaagactcacatccttgaccagctctcccctgcctctccagcaacaggcttccgtacaggtctgtccatcgtgagtaatgccgaacctcatgtcggcgccgctgtcgtcattcgaatggacatcaaggacttctttcccacgattactttcccgcgggttagaggatattacgaatcattagggtacaatcccggaatcgcaaccgtattggccctcctctgtaccgactccccgagaactgcattccggtttgaaggggacaggtattacgccgcttctggcccgcgagctcttcctcagggggcatgtacctctcctagcctcgcaaatctggtggccagagggctagacgagagactcatagcttgggccgccggacgccctgaatcatggacttatacccgctacgctgatgacatggtgttcagtagcaatgatgccaattcggacgtggcatccctgatcgcaactgtccacactattgtgcaggacgaaggattctccgtgaacgagcgaaagaccgcggttatgcgggcccctcatcgacagatggtgacaggacttgttgtgaacgatgtggtccggatttcaaggcgccaaatgcgccgcctgcgcgcatttctgcatcagtgcgaagttcgtggtttgaacgctatgaccgaaagcctaggcacagacgctagatgcgcagcaacaggccacctggcctatgttaacatggtaaaccatgatcaagcacttaagctgctgcaacggcatccctggatccagagagagcccctgtctccacccggcgtgagaagtcgcagcaggccaggtcgtactccatcaagcactcagtcagctgttaccccagtaacagccggggtcactcgcctggagcttgctgacccccctgatggtggtaaattctgggaagtatgggtcgatggcgctaccctgtaccggcgatatggacccctgggagctccaggcacaacgtccgagaaagcctttagtactcccgaagctgcgcaaagcgcggctgagcagctgattcagaataagttgtccgggggctacagacccgcctga

SEQ ID NO: 13532 - RNA, 1413 nt, unidentified
  source 1..1413: mol_type = other RNA; note = synthetic construct
atgtccaaagaagtcaaaaagctggatcccaattggagggaccggatcgagaaggtcggaaaatccacctttcaaaggcaggaaatgctaaggctggggttctgggagcccaaggatatccctacggacgaactcgcgtccctgcagaataagctcaatgaaacagttaacctgctgggtgagaaaagaacccagctgggagaggtgaacaagaaaataaaagaggcccaggacgtgaaaaagctactggccgagattcgaaagaggcgaatacagaaaagcctgaaagagagggagatacgcaaagctgagacaaaggagcggaaacaggataaaacaacccaggaccggcaaagacgaaaggttactccaccgtacttaggggagggcgtgagtggccgactaacgttcttagagggcgagcaggaaaaacttaaggaacttgaccttccccttctgaacaatctgacagacttgagcaagttgctcctgattgatgagggcaagatagcttggctcgcttaccacagggttgcgactaactgcgatcactaccatagatttttaatcccaaagcgtaccggagcccctaggcttatcgccagccccaaacctgagttgagagaagcacagggttgggtgaaacgggagatcttgtcaaagcttgaaccagaactggaagcaaaggcattcaagaaggaaactaacattaaggacaacgcacagattcactctgggaagggactcgtaattcgcgtggacctgtccgattttttcttctcaatcacattcccccgggtacggggtttctttatcagcctggggtataaccccggtatttcgaccgtgctggcacttctgtgtactgaatcagatcggactaaggtgacttataagaatgaggactggtttattgcccagggggaccgtaggcttcctcaaggcgcctgcacatcccctgctctcagcaatctcatagctcgccgcttggaccggcgcatcagaaactacctcgcttctatggatgaggagtggtcatacaccagatacgccgatgatttagctatctctcacagcaagagtgatgcagaagtgaaaaaagtcctgaaggccctgcagaaaattgacccggatgaaggctttagtatcaacgaaaagaaaaccgcgattatgagaagtcctcatagacagatgatcaccggactgattttgaatgaccaggagccacgcattccgcgcccctatctgaagaaagtccgtgccatggtgcaccaagccgaccaactctataagaggggagccattccagagaatctgtacgaaatcaaaggcaaattgtccttcatcaagatgatcatgcctcagcatgtcgagaagatcgttaacaagtattcttggctcaatccatcttga

SEQ ID NO: 13533 - RNA, 1422 nt, unidentified
  source 1..1422: mol_type = other RNA; note = synthetic construct
atggcaaacaccgatggagtgctggacccacgctggaggaagcggatcgatgaggtagggaagaatgcattcgagattgaagaaatggtcagattaggcttcctggacgctgacgagctcgagaaacgtctcaacgcgaatggacagtccttcaaggcatatcagtccgctctggccgatcttgccgaagcaagcgccgctctctctgcgacctcaagggagattgaggctttgggcactgtggaagcagccctggccgccattaggagcagaagaatcgcccgcgtcaaggaggtgcgagaagaaaggcgggtcaggaaacaggcagaacggcaacagcgtgaggaggcgatcaggagacagcggcgagaagtgcctacatttctgggtagaggcgtctccaatcgccttaactattctggcggcaatgatgatatgataagccagctggggttgccaagactgaactcatttaccgatattgcctcagctctatccttagagccgcagcaacttcaatggctggtttacgaacgcggagatagtagggttgaccactacatcagattcaccattcctaaacggtcaggggggagcagactcattagccgaccccgtccctcattgcagcaagcccagcagtggatgcacgactcgatactgcgacggcagccactgcatcccgctgcaatggcttttcggcccggcgtgtcgattgtagacaatgcacgccttcacgtgggtgcccggatcgtggtacggcttgacctaaaggagttttttccaaccataacattcgcccgggtgcggggcctgtttgaaagtttcggatataacccaggcgttgcgacagtgctagctctgctgtgtacagatagtcctagagtcatggttaggctggatgaaagaagtcatgtggtgcctgttggggagcgagccttaccgcagggtgcttgtacttctcccactctggccaatctcgtctcccgctccttggaccgcagaatacaagggtacgcctccaaggccggctggacctattctcgttacgccgacgacctggtcttctccactaatcaggagacagccagcccccacagccttatcaggggaatctgcgccgtgatcaccgatgaaggttttgtggtcaacggcgagaaaacgcgtgtgatgcgcgctcctaaccgccagacggttactggactcctggtgaaccgcgacgtaggtttgacaaggcgcgaccagcgacggatcagggcattcctgcataaatgtacctgccagggactcgaggtcgtttctgcagagatcggaaaagatgctgagtctgtggcgagggggtacttggcatacgtgcagatgattagtgccgaaactgctcagaagctcaggagcagatgcgcttggctcgaccaaatctga

SEQ ID NO: 13534 - RNA, 1419 nt, unidentified
  source 1..1419: mol_type = other RNA; note = synthetic construct
atggccaatcccgatggcgtcctggatccacgatggcggaagcggattaaggaggtgggaaagaacgcgttcgaaatcgaggagatggtgaggctggggttcttggagacagatgatctacagaaatatctgtccagcaatggattgtcatttaagagctaccagagtgctctcgcagagctcacggaggcgactgccgagctgactgcgacttcgctggagatcgagagcctcggtaccgtagaagccgcgcttgctgccattcgatcccggcgaattgctcgcgtgaaggaggagcggaatgagcgccgggccagaaaggaagccgaaaggttggtgcgtgaggaagccattcgccggcagagaagagaagaaccgacctttcttggaagaggcgtttcaaataggcttcactacaatgggggtaatgatgacatgctcaatcaactgggcttgccacagctgcacagtttctctgacatcgctagtgctctctgtcttgaaccccagcagctgcagtggctcgtgtacgagcgtggagactcacatgtagatcactacatccgtttcactatacctaaaagatccggcggctctagactgatctcacgcccccgtccaagcttacaacaggcccagcagtgggtgcagtctacaatactgcataaccagccccttcaccctgctgctatggcctttaggcgaggggtcagtatagtggataacgcaaggctgcactctggtaaaaagattgttgttaggctggacttgaaagactttttcccaagcatcacatttgctcgagtcaggggtctattcgagtcgtttggctataatcccggtgtgtccacagtcctgagcctactttgtacagattcaccgagagttcttctgtccctggacaaccagagccatgtggtccctgtgggggaacgcgcattaccccagggcgcatgcaccagtcctgcactggccaacttggtatctaggtccctcgatcgccgcattcaagggtatgccaacaaagctggatgggtctacacgcgctacgccgacgacctggtgctctccaccatccaggaaacagacagccctcatagactgatcagggggatctctgccgtcaccagagacgagggattcgtagtgaacgaagagaaaaccagggtgatgcgcgcaccaaacagacagaccgtcactggcctgttggttaaccatgatgtggggctcacccggaaagacctacggcgggtgcgagcattcctccacaggtgcagttcccaaggcctggaagttgtgtcagctgaaataggcaaggacgctgagtctgtggcacggggacacctggcctatgtccaaatgatcagcgccgcatcctttgagaagttaattagcaagcacgcctggttacaacattga

SEQ ID NO: 13535 - RNA, 1449 nt, unidentified
  source 1..1449: mol_type = other RNA; note = synthetic construct
atgtcagagcaagacgccgaccagagcaacagtttgaataatcagtggaagaagcgccttcaagaaattggtcagggtgcctttgagtttgaagaaatgttaaggctaggctttattgacctagatactatcaagaggttcgataaggagatgaccatagaagagtcaaaagaggttttcgagcagctgaccaaaacgtctgcaatcctgtctgaggttgataaggaaattaattccatcaaccgcatcgaggagttactcgctgagatccggtcaaggaggataaaacgggttaaagaagcggccaaagagaaaaagatcaaaaagcaggaggaaaagataaagcgaagtaaggagataaaggagaggaagataaactctcctacctttttgggacgaggcgtgtccaacagattgtctttcgaaaaggtcaagaaagtggacttcaagtccaataagatcccggagcttaattcattcgtcgatgtagccaacgccctggaagtgacaccgtctaaattacagtggctcatctacgaaagaggcgcatccaatatcgatcactaccttcgttatgaaatccctaaaaaaagtggtgggaaacgcctgatatcatcccccaagaaagatatgaagaaagctcagaagtggattctggagaacatacttatcaaccttgatgtggacaaagcggcaatggccttccagaagggactctccatcattgacaatgcgtcgctgcatgtcaagagcaaaattattgtaaggattgacatcaaggacttcttccccacaatcacatttccccgcgtgcgaggcttttttgaaagcctagggtacaatccaggggtggcaaccgtctttgctctgatctgtactgatagccctaaagtgattttgaagcaggaagctatcgatggagacaagaacaataaggattacccccacttcattgccatcagtgagagaagcctgccccaaggagcctgcaccagcccaagcctggcaaacctgatctgcagaaagatagactctcggctgaacggctactcctccaagtctgggtggaaatattccagatatgctgacgacttgattttcagtaccacctccgaagatagttacccacaccggctgattaagagcatttcttcgatcattagcgaggagggctttaaggtgaatcaatctaagactcgcctgatgcgtgctccaaacagacagactgtaactggtctggtcgtgaataacgaagtgacgctcagccggcgggacctcaaacgcatgagggctttcttccatcagtgttcgtctaaagggctcgattttatgtcagagaagatcggcaaagacgccctctccgttgcaagaggatatattagctatgtcgaaatggtgtcacctacaattgccgagaaatttctgagtacaaacagctggatcaaatga

SEQ ID NO: 13536 - RNA, 1419 nt, unidentified
  source 1..1419: mol_type = other RNA; note = synthetic construct
atgagcaaggaagaacggagcatcaatcagaactggcgcaagagactcgatgagattgggcaagccgcttacgagttcgaggagatgtctagattgggattcctgtctaataagaagatcgccaaaatgatcgaagcatccggtatctcactggaggagtacgagcaagctaagtcaaagctctctgacatctccaacttcatccgtgcaactaatgaggaaattgaatcgatcgactccgtcgaggtggcccttgagaagatccgtagtgagaggattaaacgcgttaaacagaaaaatgaggacaggaagcagaaaaaagaatcccagcggaaagaaagatcaaaattggcctacgaacagcgcataaagtctccgacatttctggggcgcgacgtctctaataggctgaactttacaggaggcaacactgaaaaactcgagctaaatggtttgcctgtgataaccacattcgctgaattgtcaagcaccctggagacaacgccgaactctctccagtggttgacctatgaaagagactcccaaaaaattgatcactacacccgatttgagattcccaagaagagtggtgggagccgactgatcagctcccctaagcctgcccttagaaatgcccagaagtggatactagaaagcattttgaataagctagacatccatagcgccgcaacagcttttaggcccggcaagtccattctggataacgcgaaattacacgccaacagcaaggttgtgcttagacttgacctgaaggatttttttcctagtattaccttcatccgcatcagggggctgtttgaatctctgggatacaacccaggcattagtaccgtgttttcactgctctgcaccgacagtccccggatcatcttaaaataccatggcgagacacacttcgtgaaagtaggacctaggaatttaccccagggcgcttgcacttcaccagcactcgccaatctgatagctcataagcttgatcgacgactgcagaagtatactgagaaaataggctggatttatagcaggtatgcggacgatctggttttctcctccaacgcagaggagatgcccgcatatcggctggtaaaggcagctagcaagatcgtggcctctgagggcttccggatcaataagcacaaaactaacattatgcggcatccacatcgccaaactgtcaccggactcgtggtcaacaaagatgtccgtattagccggaacgatctcaggaaatttagagcgttcctgcaccactgtgaaaccaaaggactggagttcgttagtaaggacatcgggaagaatgcgatcgccgtggctagaggttatctctcatacataaacatggtgagtccagaacttgccacgacattatcttccaaacacctgtggatttcgaagtga

SEQ ID NO: 13537 - RNA, 1428 nt, unidentified
  source 1..1428: mol_type = other RNA; note = synthetic construct
atgagcgaggaaacaacagagattcccgcggactggagggcgcgcatcaaagagcaaggcaaggaggcatttcagctcgacgaattaagaagattgggcttctggcctccctctgcgggccttcaagagcaggttgccagagctgaagaggaagtgaagcgcttggacagggagatggctccactgcgggcacagttacgcaaaattgagggcgacatctcacgggctgccgacgtacagtctgccctggacgaaatccggaaggcaagaatcggtcgagtgaaagccgctagggaggccaagaagattgccagggccatggagaagatcgaccgggagacgttatggaaagagaagagagctagcgaccctcagttcctgggaaggggtgtcagtgtggggctccagttcgaaggaggggacctggagaagctcaccaagaacgaagtgcctcagctgcagaccactgctgaaatagcccttgccataggcatcgaaacccgggaactgacctggctgtgttaccataggggagcttccacaattgatcactaccatagattccagattccaaagaagcgcggcggcatgcgaaatgtgtcagcaccaaaaactaaactgaggcgggcccagcggtttgttctcgagcaaatattggcaaacctccctgtacacgaggccgccatggccttctgcaccggagtcagcacattggataacgcgagaaaacacgctggtaaacgcatagtagcaaggctagacctgaaggatttctttcccagcattgattttagccgcgtcaagcgcttttttcagtctctgggatataacgaggggtgcgccacaatttttgcactcctgtgtactgaggccccaagggcgcaaatctcactggacggccagcgacgctatgtggcaatcggagaaagacgtctgccccaaggtgcttgtacctccccggcactgtccaatctcctgtgccggcgcttggatgctaggcttagtgggcttgcaggtaaacgggggtttaaatatactcgttacgctgacgatctggtgttctcaagcgatgaagcaaggccagacatcggcgccttgctggtcctatcgcagaagatcgttgaggatgaaaagtttgttgtcaactccgagaaaaccttagtcatgaaaactcagaatcggcaaagtgtgacgggactcgtggtgaatgctcagtctagagccacacctcgggtgagtcgcgatgacttgcgaagattccgtgcgttccttcacgggttcgagactctcggcagagaagccatgaccgaaaagctggggcaggatgcactcttttacgcccgaggatatctggcttacattgccatgtccgatcccctaagggctgggaagctgcgtgtgatgcatccgttccttgcccgagattga

SEQ ID NO: 13538 - RNA, 1464 nt, unidentified
  source 1..1464: mol_type = other RNA; note = synthetic construct
atggctaataagaacagcacaccagagcccgagccggaagtagccccaaaagactggagggcaagaatgagggcccaggggaaagaggcgtttcagctggaagagatgcgacggctaggtttctggcctcccgcagagggcgtcgaagcacagattgaagttgccgagcgggaagtggcccggatagatagggagctggctcctctgagagtcgagcttgccgccgttgaaacggaaattactcggcttggcgatgttcagtccgccatcgatgatgtgaggaagaatcgaattgcaagagtaaaaagggagaggggagagcgtcgagctcggcaagaactggaaaaggccaggcgcatcgaggccgctaaggtgagagccaagaacgagttaccctttctcggtcaccgcgtgtcttccgggctcgcaaaaactgaatctgatgtccagaaactcgctctgctagacctccctcttttccacagcgctttggatgtcgccgacgctatgggcatgtcagcccctcacctggcctttctgaccttccaccgtggtgccgccacagtagatcattaccatcgcttccagatccccaaacggaggggcgggatgaggaatgtttccgcacccaagacgaagctgagagctgcacagaatttcgtcctggaacaggtccttacaaaggtgccagtccatgaagccgtagcggcctttgccccagggacctctacagtgcagaacgctgcaaggcatatgggcgctcaggtggtggtgcgcttagatctgaaagactttttcccttccatcgactttgcccgggtccgaaatgctttcagttcgttgggatactctggcgcagtttcaaccgtgttgagtctgttgtgcaccgagtcaccccgtgttcagatgtccctggacggtgaaacacggcatgtggcgatcggagaacgcgttctgccccagggcgcatgcactagtccggctctgagtaactggatatgtagacgactagacgccagattgtccggcttagctaagagattcgggtggacctattcacgctatgcggatgatctcattttcagctcatccgagcttacgcccgacattaagactctcataagctgcgcacgcagcatcatccgggatgagaagcttgtggtgaacgacgagaaaactaggatcatgcggccaaacgcccgccaatgtgtgaccggactggtgattaatgcacaagacgcgaacgcgccacgtcctgcccgtactgaccaacggcgatttcgcgcatttctccacgcttacgaaacccacggaagagacgagatgacccaaaagatgggaagagacgcgctggctcatgccagaggcatgatcagttatctccacatgtctcagccagggaaggctagcgccctcattgagaaacacccttggttggcactggagtctgagacagccagctga

SEQ ID NO: 13539 - RNA, 906 nt, unidentified
  source 1..906: mol_type = other RNA; note = synthetic construct
tcctatcataggggtgctagcttcgtggaccactaccataggtttcaaataccgaagaaacggggggggcttcggaatgtgtcagcccctaaaacaaagttgagacgggctcagaactgggtcctcgctaatattctaacccccctacctgtacacgaggccgcggtagcgtttaggccaggcatctccacagcgcaaaacgccgcgcggcatgctggaaaggaggtagttgtgcgcttagacctgaaggatttctttccctcgatctcctttactcgagtgaagcgtcttttccagagttttgggtacaatgaaggctgtgctaccgtcttcgccctgttatgtacagaggcacctagagttgagctggcattggatgggcagaaacgacacgtggccgtgggcgatagagtcctcccccaaggcgcatgcacttctccagcaatcacgaacctcctctgcagacgccttgatgctagactgactggagtggccgccaaggaagggtttacctatagccgttacgctgacgatctgatctttagttcagacactaagcgcgctgacgtgggatggatttttaccttcgcccagcgcatagttaccgatgagaaattcgtcgtgaacgcagaaaagacaatggtcatgaaaccccagaatcgacagagcgtcaccggtctggttgtgaactcccaggatggcctgggcccaagggtgagtagggacgacctgcggaagttccgcgccttcctgcacggatatgagattaagggcagggaagcaatgacggaaaaaattggtcaggacgccttgcactatgcaaaaggatacctcgcctacatcaatatgtctgaccctgccaaggccgccaaactgagagctgcacattctttcctgggtagctga

SEQ ID NO: 13540 - RNA, 1530 nt, unidentified
  source 1..1530: mol_type = other RNA; note = synthetic construct
atggccgccgagactccaccatcagtgccagaaaacgaccttttcccgaaggattggcgacagcaggtcaaactctatggcggcagaaagggatttattcgtaaagaactcaaacgcctgggattctggcccccagcacctggtagtaaatacaagcacgtcacagctagcgaagaggctgaattggaacagttgtataatcagctgatcgaattgcgggcacccctcttggagcagctagacgcggtggatgctcggatcagagacgcgaagaagcaactcgggaatattggaaacgaagccatcctggccaaaaaaatagagactctgatagcggagattaggctgaagagaattgagagggttcgccaggagagagccgcacgaaaggcacagcgggccgaagcagctgccgctaaggctcaaaaagacaaagcatggcgcgccgccactcttcctcatttgggcagggcagtcagcgctggtctgtcctacgctggcggggatgaagataaactcggcgctcagggcctgcctaatctgtcctcagcaggggaggttgcagctgccatgggcattacaaccgcccaactggcctggttgacctatcacagaggcgcagcggccctcgaccactaccaacatttcactatcccgaagaaaagtggcgggagacgggccatttcatctcccaaggccaagctgagggaggcacagagttggctcttagagaatgttcttgaaaagatcgccgtacacgaggccgcgatggcctttagacccgcactgaatattgcccataacgccgctcgtcacgctggggctagcgtaattgtgcgtctggatcttaaggattttttcccttctatcaccttcaagagggtaaaaagaatgttccagcgcctcggattcaacgagggggtggccacactgtttgcactcctcgccaccgaagcccctcgagtgcagctaactctggacgggcagcagcatttcgtggcggttacggagagattcttaccacagggagcctgtacctctccagccataaccaacatactatgccgatccttagatgctcggttgagcggcgctgcttgcaaacttgggtttacctacaccaggtacgccgacgacctggtctttagcgctcggggtgacaagctgaagggcatcgcaatgagggagcttgccacaaaaatcatcgcggatgagaagttcgtggtgaacgaggctaagacagcagtcctgcgcccccacagtaggcaaaccgttacggggctggtggtgaatgcccagtccacaggtgagggtactggaactcctcgcgtctcgaggcgggacatccgcaactttcgagcatttcttcaccagtatgagttacggggacgcgaagccatgacagagcaacggggacaggatgcactgagctacgccaggggctacctgtcctttgtgcatatggtgtctcccgctcaagcggctgctctacagcagaaacacccctggctggaacgttatacgctctga

SEQ ID NO: 13541 - RNA, 1419 nt, unidentified
  source 1..1419: mol_type = other RNA; note = synthetic construct
atgaacgccgagcagaggacacggtttaaggaactgggtaaatcagcttttattcgcgaggagatgactcggttgggctattggcccccatcatcggaaattgctaaccaatctgcactggctgagagcaagctaaaaccactgtatgaggaactgatccgcgttcggaaggaattcgacactgtctcggctgagatagcggtgtctggcgacattcccaccctgctagccgaggtgaggaagcggcgaatcgaacgggtcagagccgagagggccgtcaaaaaggcagagagagagcaggcccgctccgaagccaaaaccgccgatgccgcttggagacgtaagacgctcccttaccttggcgtcggtgtgtcaggagggctggcttattctgatggggatagcgcgaagatcagcgagagagcccttccatcactgaccacagcggctcaggtggcagctgccatcggcataggggaaaatgagctcgccttcttatgctatgagcgcgccgtgtctggcgtcgatcactacgccaggttcgcaatccctaaaaagaagggtggagttcgagtgctcagtagccccaagcgtcgcttgcgtgtagcccagtcctggctgctaaaaaatgttcttgaacctcttccagtgcacagcgccgccatggccttcagacctggcaaaagtgtcgttgacaacgccgccccccatgcaggccaagctatagtagtgaaaacagacctcaaggattttttcccaagtcttggcctccgtcggattaaaggattgttcgagggtctggggtacaatgaaggcgtagcaaccctcttcgctttattggctactgagacaccgcgcattgccgttatgttcgacggaaagaggcgctttgtggcagtatctaaacagagagggctccctcaaggagcatgtacctctccggccttgaccaatctgttatgccgaaatttcgatgcgagattagctggggctgcagcagcatttggcttcagatacactcggtatgccgatgacctgacctttagtcatgcttccgacaaggcccctgtgggtgtgctgctggcccttataaggaaaattgtcgcagatgagaacctcacagtgaatgaagaaaagacgcaggtcctgaggctgtccgatagacagtccatcaccggcctggtggtgaacgggagcgaaactcccagggttagccgagaggacctgcgaaggtttcgggctatcctgcaccagtgtgagagagacggttttgaagcggtgacagcgaggctcggaaaagacgcgcaagcttacgcaggagggtacttgtcctttgtgcacatggcacggcccgacatcgcaggaaagattgccgctgctcatccatggctggccaagtggcgccaggccaacatctga

SEQ ID NO: 13542 - RNA, 1356 nt, unidentified
  source 1..1356: mol_type = other RNA; note = synthetic construct
atgactgccgccgagagacagcgtttgaaagagattggcaaagatgcattcatcagggaggaaatggtccggctaggtttttggccccccagtcctgaaatagcggagcagtctgcagaggccgagcggaaacttagaccattatacgatgaactggttggagttcgccgtgaactggacggagtggagaaggctataagggaatcaggcgacgtgcctgccctattggcagagattcggagaaagaggattgagagggtacgcgcggcacgcgtggtgaaaaaagtggaacgggaggcggctcgggttaagaagcaggagcaggatgccctgtggagacgaactgctttgccccaccttggacgcggcgtatcaggtgggctcacattcgttgaaggggagatcgagaaactgtgtgcagccatgggactgactgagagggaattagcctggctctgttaccaacgccctgcgtctaagaccggccattactccctgttcaccattccaaagaagcgagggggcaagagagtgttggcctcaccaaaaagcaagcttcgccaagcacagcgctggatcctctctgagatccttgccaatcaggctccccatgccgccgctatggcattttcaccaggggcctccgtggtcaagaatgcggaaccacatacggggaaatctgtggttgtgaaggttgatctccaagacttctttcctagtctaggagtaaagagggtgaagaactatttcgaacacctcggacatagtgaaggggtcgctactgttctcgctctcctctgtacagactgcccgcgggtagccgtcgaatttgacggtgaaaagaagttcgtggccgtaggaccgaggggtgttcctcaaggcgccctgacatcccccgcactgtcgaatctgctcgtcgagaaactggacaaaaggctgacgggcgcagctcagaagcttggctttgtgtacaccagatatgccgacgatctgacctttagccacgctgatggaagcgcccctgtgggtttgttgctgactctggtccgacagatagtggccgacgagaaattaacagtcaacgagaaaaagacacaggtcctgcgctccagcgatcgtcagatcatcaccggcctcgtcgtgaacggtgagcaaggcgtgcggctgagtagagacgacgtgagacgattccgagcaatccttcaccactgcgataccgaagggtttgataaagtgagcgaaagattaggccggtccgcacaggcttattgccaggggtatctggctttcattaaaatggtgaggcccgagcttgccgacaagctggtgaccgctcacagctggctggtccggtga

SEQ ID NO: 13543 - RNA, 1416 nt, unidentified
  source 1..1416: mol_type = other RNA; note = synthetic construct
atgaactcagagcagcggaagcaactcgcggccatcggcaaaagcgcgtttgtccgggaggagatggtgcgtctgggattttggccaccctccccagaagtcgccgagcttgctgcaggcgccgaaaaggaactccgtgtctattacgatgagatgattgctctccgcactgaactaaacggcgtcgaggcaaagatcgccgaagccggaaatataccagcactgctggccgaggtgcgaagaaagcgcatagagagagtccgcgcagagaggatagcccgacgtgagcgcagagctcaggagaagattgaaagtcatgctaaagacactgaatggcggaaacgcgcgctcccatatctggggcatggagtctctgacgctctcgtgtacaaaggaggagatcccgaaaaaaccgccaccctaggtttgcctgctctgacgaccgcatctgatgtggccgcggccatcgggatctctgagagcgatctggcctggctcacttatcacagaggcgccgccactattgaccattactccaggtttaccatcccgaagaaaaggggcggagtgcgggtaatcagctctccgaagaggagactgagaacagctcagagctgggtgctggagtccgtgttatcacccgtgccggttcacgacgctgcaatggcctttaggccagcccgctccgtcgcagacaatgctagacgtcatcagggccaggccgtcgttatccggatagatctgaaggatttctttcccagtatcaccctccccagggttcgcactctgttccggtccctagggtataacggcggggtagcaacactgctggccctgcttaccaccgaggcccctagggtggcagcaaccttggatggcgccagacggttcgtagccgtagggggtcggtcacttcctcaaggggcatgcacgagccccgcggttactaaccttttgtgccgcaagctggacgctcgattaacgggcgctgccgaagctatggggttcgtttacacaagatatgccgacgacttagtgttttcgcacgcaaaacctgatgccccagtgggaatgttgctcgatctgacaaggcgcattattgctgacgaaggcctcacagtgaatgaagaaaagacaagcgtgcagagaggccagcatagacagaccgtgacaggtctggtggttaacggtggcgcgcccaggcttagtcgagaaaatcttaggaggttccgggccatgttgcaccaatgtgagcgagacggtctgcctgccgtgtcagagcggttggggcagaatgcacaagcctacgcagctggatacgtcgcattcattcacatggtggaccctgagaaagctcggcagattgttgccgcgcacccttggatcgctcgctggaagcgagctggaggggcttga

SEQ ID NO: 13544 - RNA, 1326 nt, unidentified
  source 1..1326: mol_type = other RNA; note = synthetic construct
cctccaagccctgaggtcgcagccaagtccgttgaggccgaggcaatcctgaggcccatgtacgaggagctcgccatccttagaactgagcttacggggattgaaaaagagatcgctctgattggcgacattcctaacttgcttgccgaggtgcgccgaaagaggattgaaagggtgagagctgcaagggtggtcaaaaaagcagcgagagagaaggagcagggtgaacggaaagcatcagacatcgcgtggcgccggagtacactccctttcttgggccatgggatctctgccggccttcgctacgccggaggtgatccagctaagttgacggcaagtggcttgcccgtcctcgtcacagccggtgatctggctgccgggattggtatcgggaccagggacctggcttttctgacgtatcatcgcggagtcgccatgctcgatcactacagccggtttactattcctaaaaagcgcggaggcgtgagagtcatctcctccccaaagcgccggctgcgagttgcacagcagtacgtactcgaaaaagtgctagccctgctaccagtgcacgatgccgccgcagcctttaggccagggctgtcaatagtggataatgctgctaaacatgcagggaaacccgttgtgatcagaatagatttgaaggacttctttccgagcgtgcccttcccaagagtaaagaggctcttcgaatcgtttggctataaccctggcattgccacactctttggattactgtgtaccgaggcgccccgtgctgccgttacattggatgggtcagccaaacggttcgtagcagtgggagagcggtgcctgccgcaaggagcttgcacttcccccaccctgaccaatttactgtgtcggcgtctggacgcccgcctttctggactggctgatgcagcgggctttacttacacacggtacgctgacgacctggtgttcagccatgctgaggccggtgctgcagttggggctctcctacgagccgtgcgccagataatcaccgaaaccggattcgtggtaaatgaagaaaagactgtggtgctcaggccccatcacagacagtctgtgaccggcctggtcactaacaccgaaacacctagggtttctagacaggacctgcgtcgattcagagccttccttcaccaatttgagacaaagggcgcggaggccgtcacccagcaaatagggaaggacgctctggcttatgccggcggctatttaagcttcattcacatggtcagtcccgaacaggcagaaaaaatcgcggccaagcacccatggttgtcccgatggaagaagctgtga

SEQ ID NO: 13545 - RNA, 1416 nt, unidentified
  source 1..1416: mol_type = other RNA; note = synthetic construct
atgtcatccatctcaaagcgcgatctggaccaagtggacgaaatgatagctcggggcttttacaccccgagtggtgacgttcggcgcgcacttgacgccctccgtgagaaccaagggcagatagatcggattgagcaggagctggctaggctcagggcagagttagcagacggccccagtctcgcggagttaattaaacaggccagagccaggcgaattgaacgagtccgcgaggaaagggccaggagacgggctctgagagaagcagagcagagcgagagacgcgccgcgtttgctgctcggaaaagacgagccccccttttcctgggcgaaggagttagcgccggccttcgtttcgatggaggggacgcagccaggcttgctgagcgaggtctgccagcgctaactgatgcggctgccttggccacagccatcgggctaccagtaaagcctgcccgggggatgcccacctttactgaaggtgcagatcagctggcctggctatgctaccatcgaagggtagttgaccacgaccactattcaagatttcggattcccaagagaagtggtgggtatcggcagttagccagccctaagcctctgttgagaaaggcacaacagtgggtgttggaccacctcacatcccggcttgagccacatgcacgcattgccacggcctggcgcaagggaaggagtgtggtcgataacgctcgcccacatgtgggaaaggctgtggtgatccgggttgacatccaggatttttttcccagcatctcttggagacgtgtaagaagagtcttcatggacctggggtattccgaaggtgtgggaaccatgttggcgctgctgactaccgataccgacagagtcgcagtgaggctggatggagaactgagattcgttgcacggggaaaacggggcctgcctcaaggcgcatgtaccagcccttccctggccaacttcgtggccctgcgactcgacaaacgcgtcgatggcctttgcagatctctgggcttcgattacactcggtacgctgacgatctcacgtttagccacgcacaaccaagggccaatgtggcagtgctgctgcagcaggtgtatgccattctgagggacgagggcttcgagcccaatgagcggaagacagctgtaatgcgagcgggaggccgacagatggtgacaggtttgatggtgcaggacgctatccgtgtctctaggcgcgatgtccgccgcttccgtgctatagctcatcagtgtaaattacacgggttcgagacaatctcccagcgtctcgaaaaggatgctaggtcttacctcgacggctttttggcctgggttcgcatggccaatgaggagcaagcccagaaactcgaaatgtggctggaatcgcttgggctcccgaggagggatatgtga

SEQ ID NO: 13546 - RNA, 1581 nt, unidentified
  source 1..1581: mol_type = other RNA; note = synthetic construct
atgcacctgcggcatgtcagtgctcggaggcacgaccctcgagcactccatccccacagagggggcgaccatgtacacgctgtcgccggtactcggagaagaggtacccgcggtggtacatgtcgagcgggaaggggacctggaatacgggccatgagcggggatatcacgagtctccgagcaagagtggcaaaggtcgggcggggacaagccgtgtatgaggagatgatccgaagtggctggtggaccgtcaggcccgaagatacacagctgctggcagaggcatctaagcgcgtcactgatatcttggtggccctagatccattggtgctcgaaaggcagcgtattgacgaggaactcttaacactagctaacattgacgtcaaggccgtgcttgaagagattcgggccgagcgcatcgcagagagcagagctaggagggctgcggccaaagaggagcgaagacgccgaagagaagctgcagcagcggcccatgcagcccgagttagaaaaactccactgcatttgggccatggcgtttcaagccgtctggctttcaccgaggcacctaacccggaacttgatcgcgccggactgccacgggtttgcaatgcagaggaactggcggccgccataggaatagatgcggggcgcctccaatggctgtgctaccacaggcaggtgtctgctgtggaccactacaatagattcactatccccaagaggtcgggtggctctagacccatcgctgcccccaagaaatcactgcgcgtggcccagcgttgggtgttcgaacacattgttgagaaactggtccctaacatggccgtgacgatggctttccggcctggggtgtccatcgtagataacgcaagactgcatgccgggcgggccgtagtgatgaggatcgacattcggaatttttttccatcagtgacctttcccagagtgagggggctgtttgaaagcattggctactcaccaggcgtggcaacgttgctggggcttgtctgcaccgaagcacctcgcagggtagccgatttgcacggacgccgctatgctgtagctacaggcccccggggtttaccccaaggagcttgcacatccccgggcctggctaattttgcctgtaggaggctggacgcccgcattcgaggctacgccaggaagctcgggttccggtatacccgctacgcggatgacctagtcttctctcacgaggacgcagacgccccggttgacggtatgagaagggctgtctacaggattctcagggcggaaggattcgagccaaatgaagccaaaacatgtgtgatgcggcgtcaccagctgcaggtggtgactggaatagctgtgaataccgtgccccgtgtaagccgagaggccgttcgcagatttcgtgcgatcgcccatcagtgtcgcaccagaggcgttgaggccgtgactgccgacatcggcagagatgctcttgcttatttaaacggctatctgtccttcgttcggatggttaacccagctcaggcagatcggcttgccgcactcgtccctgaatccggctccgagaaggggcctcaggcctga

SEQ ID NO: 13547 - RNA, 1452 nt, unidentified
  source 1..1452: mol_type = other RNA; note = synthetic construct
atgtctaactggcaagatgagattaaacggctgggaaaaagggaattcgaactgcgggagatggaacgcttaggcttctggccacctgcgacagttggggatgtacctcagacttttgacgacatgcgagctaagattgcacctataaatcatgagcttcgcgacattgctgagcagacaagacccctgagactacggcagagcgaggtagaacgcgagttggctcagaccggggatatcgaagcccgactcacgctcatcaggcagcagagaattgagcgtgtgaaaattgcacgcgctgaaaggaaggagagacgcgccagagagagggaagaacgcctggcgaccgacaaggtgaggaggcgagagcttcttccgcatttggggcgcggagtgagtagccgtctgcacttctgcatcccttcagatgcagagaaattggcacggtttcagctacctgtttggaacgagccagccgaccttgcaaattcgctgggcataagtcgggaacaattggcttggctatgctaccatagggaggtggcccctatcgaccactatagccacttctctatcccaaaaaggtctggtggaacgcgggcaattagcgccccccgaccatatctcaaagccgcccaggcccagatccttaccggtgtgctgaaccaagtcgaggtacatgaagcagccgctgcctttctcccgggcaggaatatagctaataacgcgcagaagcatgctcactgcgccgaaggtggccccagcgtagtcctgagggtcgacctgaaggacttctttccctcaattacttttgcgagggtggctggagtcttcgcctccctcggctataatgctggcatttcaaccctgctggctttgatctgtaccgagtcccccaggatcgaagccacattcgatggccagaaatccttcgtcgcactgggggatcgttttgttccccaaggggcacctactagccccgctctcacaaatctcctgtgtcgacgtctcgatgccagactcactggactggccaagcactacaactttacatatacacgctacgccgatgatttagtttttagttcgccgcgctcagacgcacgggtgatatccctgcaacgggggatcttcaagatcctggactccgagcagtttaccgttaaccccgataaggtcgccatcatgcggcggggtagccgacagtctgtgactgggctcgtggtgaactctgatctgggcccaagactgtctagaagagacttacggagattcagagctatccttcacgatattgaaaccgacggagccgacaccgtctccgagaagatgggcaagagtgcgcttcactacgccagaggatacttggcattcgtgcacatggtgaatccagagacagccaccaagctgcgcttaaaacatacgtggctgaacactaatggcccagtgtga

SEQ ID NO: 13548 - RNA, 1446 nt, unidentified
  source 1..1446: mol_type = other RNA; note = synthetic construct
atgtctaactggagagacgagatcaagaagctggggaaacgggagttcgagagaagagaaatggagaggcttggtttttggccaccagcgtcctccggcgatgaagctcagaccgtggaagcactgcgtgctaagattgcacccctgaatgatgagctgagggagatcactgaaaagacacgtccgctgcgattgcggcagaccgaggtggaaagggaactcgcagccacaggggatatcgaggcccaactcgccgagatacgcaagcaaaggattgagcgggtcaaggctgctcgggttgagcgaaaagagcggcgcgcaagagaaagggaagctagactagccgctgatggcgagaggcggcacgctttgctgccacacctgggacggggagtctcaaggcgtttgcatttcgacgtggcgtctgacaacgagaagctcgccagattccagctgcctgcttggaatgaacctgcggacctggctgcctttctggagatcacccgcgaacagctggcatggttgtgctatcacagagaggttgcccccctggatcactactcacatttttccatcccgaaacgctcgggtggaactagagctattagtgccccgcgcccatatcttaagaccgcacaagctaaaatcctcgaaggcgtcttgaaacaggtagaggtccaccaggcagccgctgcatttctgcccggcttgaatatcggcgacaacgcccataagcatacgcatactgaagccggaggtcctgcggtggtgatgagaatcgatctgaaggactttttccctagcataaacttcaaccgcgtggccggggttttcgtgagcttaggttataatgccggcatctctactctcctggccctcatatgcacagagagtcctcggatcgaagctacattcgatgggcagaagagttttgtcgcactaggcgagaggtttgttccccaaggagctccaaccagccccgcccttaccaatttactttgtcgacgactcgactctcgcctgtccgggatggctaaacattatggcttcacatacactaggtacgcggatgaccttgtcttttctagcccccactcagacgccagggtaatttcacttcagcgaggggtgtttaaaattttggaagcagagcagttcattgtgaatccagacaaagtggccattatgcgtcggggagcacgacagtccgttaccgggctcgtagtcaacaacaatctgggtcctcgcatttcccgccgggatcttaagagatttagagccatcctccacgacatagagactaacggagccgagagcgtgagccagaaaatgggcaagagcgcattacactacgcacggggctacctggcgttcattcacatggtgaatcccgaaaccgccacaaagttcaggacgaaacatacgtggctagccgccagtgaatga

SEQ ID NO: 13549 - RNA, 1470 nt, unidentified
  source 1..1470: mol_type = other RNA; note = synthetic construct
atggccgaggaagatattaagcaggaagccgggccccttactagagaggaatggattgctaaggtccgctcgcagggacgggacaacaccataagagaagaaatgatccgtttgggcttttggagcaatgatgagttgagttcagaagagcaaaggcagcaagccacagaagatgaggaataccagcagctgctgaaagagctgaacaagttaaaagccgagtctgccaaacttagtaacctcaacgagcttctgaagattgcgcgcaagaaaagaatcgaggagagcaagaggaagcgagcagagagaaaagctcgccgcgagagagagcaagcagaagccgcccagcgatggcaagcccacaaacaaactcatgtgatccacgctggaaggggggtaagcggtggcctgcaatccacagtgtacgacgaagctaagcttatagagaataatttgccgctcattcggtcaagcctagagttggccgaagccatggagattcctgtagggcggctcaaatggctgacataccataggaagacggcaactctgaatcactatcagcggtttactattccaaaaaagagtgggggcaggagagagatctccgccccgaaaaagtctctccgagccgctcagcagtgggtgaaaacacacatcctcgacgccctgaccgtgcatcctgcagcaaggggctttgtttccgggaagtccacactggaccatgcagagccacacctccagcaggctgctgttgtgaagatggatcttaaagactttttccccaccatccggttccgccgcgtgaaagggttcttccattacttaggatactcagaagccgtcagcaccatcttcgccctgctgtgcaccgaacctcctagaaaagagatccagttcaatggaaccaggtactatgttgcgatggacgagcgccagcttcctcagggtgcgtgcacttctccagcactgagcaatctgatctgtcgacggctagaccaacgattacgcggtctggcagaaaagcacggctttcactacacaagatatgctgatgacctagcattctcctgcggtgaggatggcctcaacgaaatcggcgctattataaacacgagtcgtgacattataagattcgaaggctttgcggtcaatgaggaaaagaccaggatcctgcgtgcgtcaaacaggcagaacatcaccggcattgtcgtgaatcagaaaccaaacatacgacggaaggatctgcgggcttttagggccctgctctattctgtggagaaaaacggattggagcaggagaaccgccataatcacccacatttctgggattatatcaaggggtacgcctcttatatccggatggtgcggcccgacctcgaagagaagctggctccccgtttattgagaatttcccagaagcacggactgcacgcacccgattggtgtaagcaggtcgccgctaagtga

SEQ ID NO: 13550 - RNA, 1467 nt, unidentified
  source 1..1467: mol_type = other RNA; note = synthetic construct
atggcagaagaggaaaccaggccattgacgagggaggagtggcgaaagagggtccagagtgaaggtcgaatggagactatacgcaaagagatgattcggctggggttttggaacgacgcacagctgtcccccgaggagaagcaacaacaggccctggaagacgaagagtacgaaaggctgcagaaggaactgaacaagctgaagatggaatccgccaaactctctaacctgaagcagctcctgaaagaagcacggaagaaacgaattgaggaatcaaaacgtaagagggctgagcgcaaagcccagagagaaaaggagaaagcagaagccaaaaaacggtggcaggaatacaaggaaacccacgttattcacgccggagagggggtcagtggcggcttacaaaatactgagtacgaggaggcgaagctacgcaagaatgggcttccagtgatcggcagcgccctccagttggccgaggagatgaatattcccctacaaagacttaaatggcttacctatcaccgcaatacggccaccctctgccactatcaccggttcactattccaaagcgatcggggggtaaacgggaaatcagcgctccaaagcgcagcctgagacaggctcaggaatgggttaaacaccagctgttggatagactccctatccatcccgcagcctgtggcttcgtccctggtaagtccaccttagtaaacgctagacaacatctgggccaatcagtggtggtaaaaatggatctgaaggacttctttccctcaattacatttaggcgggttaagggcctgttccagtcttcatttgggtatagcgagagcgtgtccacactgttggccctgctctgtacagagcctcctcggaaagaagtggagttcgatgggacttactattacgtcgccatgggagacagacagctgccgcagggtgcatgcacctctccgacgctcaccaacatcttatgtcgacggcttgacagacgtctccagggactggcgtccaaattcggatttcagtacagcagatatgctgacgatcttactttctcttgctctaagcatgacgcagagaaactcggcgggttgatcaatggtgcgcgaagcattatccagtccgaaggattcaagacaaacgagaagaagactaggattttacgggatacaaatcgtcagaccgttacaggaatagtggtgaatcaaaagccaaacatcaggcgtaaggagctgcgcaggtttcgggccctcctgcatagagtggagataaacgggctgaacgaagagaatagagataatcaccctaacttttgggaatacatctcgggcacagccggctacatacgcatggtgaggcccgacttggaggctcgccttgctagtagtctaatcggcatcggagagaaatataacctacatatccccccttggtgcaaacaggctaccgtcgctgatcgctga

SEQ ID NO: 13551 - RNA, 1461 nt, unidentified
  source 1..1461: mol_type = other RNA; note = synthetic construct
atggccgaaggcgagaacagacccctcactcgcgaggaatggatcgcccgcgtgagggaggaaggacgagaggagacgatccgctccgaaatgataagacttggtttctggtcgaatgacagcctgcccgaggaagagagacggcagcaggccctggaagacgaggagtacagacggcttcgccagaaactggcagagctacagcgggaatctgcgaagttggaaaacatcgaccagctgttaaaggaggctcgcaggaaaaggatcgaagaaagcaagaaaaagagggctgagagaaaagagcgacgtgaacgggagagggctgaggccaagaaacgatgggagagttatagacaacatcatattgtgcatgccggggtgggcgtttctggaggcctgcaagagactgagtgggacgaggaaaagctgcgacagcaccagctcccactgatcagaactgccgaggaactcgcggaggcaatgggaattaccctgtcacgcctcaaatggctgacataccatcggcaaaccgccactgtgtgccactattacagatttacaatccccaagaagagcgggggcaggagggagatttctagtcccaagaaagcactccgtgaggctcagtcatggataaaggagcagatcttggatcgcattcctccgcacccggcagcttgcggattcgtgcctggcaaatctaccctggatcacgccaggcagcatctccggcagcacgtggtagtcaagatggacctaaaggacttctttccatctatcaccttttacagggtgaaaggccttttccagtccttcggttactccgagttaatttcaacattacttgctttgctgtgtacggagcctcccagaaaagaggtgaccttcgatggcaaggtctatcacgtggcaatcggagaacgtcaactgccacagggggcttgtacctccccagccataacaaatctgatctgtagaagtctggataggagattggaggggctggcaaaagccaaaggttttaggtatagcaggtatgcagacgacctggcattctcaggtggaattgatggggagcaacagatcggatccttgctgaatatggcccggcggattattcgggatgagcggttcgaggtgcaggaagaaaagacacgagtcatgaggagcagtaaccgtcagaagatcactggcattgtagttaatgaaaagcttaacctccgacgccgtgaattacgggcgtttcgggctctgttgcacagcgtcgaaaagaatggcctcgctcaggaaaaccgccaccaccatcctgacttttggggctacatcaagggtatggccaactacattcgcatggtccgcccagattgggaagcccgactagccaagcagcttgttagaatagggaaaaaacatgaactccccgtacctaaatggtgccaacaagctgttgttaaggggtga

SEQ ID NO: 13552 - RNA, 1464 nt, unidentified
  source 1..1464: mol_type = other RNA; note = synthetic construct
atgggaggcgaagcaatggccgaggagcaaaatcaccctttaacaagggaagagtggctggaacggctccagcaggagggaagaaccgaggtcatcaagaaagagatgatccgtctcggcttctggagcgaagaacccctgactccagaagaggaggaacagctagctatagagaaccgcgagcgtcagcaactcgaaaaggaactccagagattgaaagaggaatccgagaaactaccaaacattcaggagaagattaacgaggtgcgcaagaagagaattgaggagtcaaagcgaaaaagggccgaacggaaggcccaacgcgaattagcccgccaggaggctaaaaagcgttgggaagaacaccaggccacccacattgtgcatgttggagagggctactccgcaggcctgaccagtatccactacgacgaagagaagctgataacgcaccagttgcccttgattcggtctgccatggagcttgcggaggcaatggagatgccactgtcccgcctcaaatggctgacctatcaccgggataccgctacactatgccactacgcacgcttcactatccccaagaaaagcggtggggtacgggagataagtgcacctaagaaggagcttagacaagctcaggcctgggtgaaagaacatctgctggacccaatccctgttcattccgctgcatacggctttgtgcagggtagaagtacggttgataacgctaaacaacatctgcagcaggcggtcgtaatcaaaatggatctgaaggacttcttccctactattgacttctatagggtcagaggagtctttcagtcattcgggtattctgaagctatttcaactctgtttgggctgctgtgtactgagccgcctcggagtgaagtggaattcgatggacgctattattacgtggcgatgggcaagaggcagcttccgcaaggtgcctgtaccagccccgcgttaacaaatatcatctgcaggagattggaccaacgactgtcgcgccttgccgacacccatgggttttactatacaaggtatgccgatgacctgacattttcttgcaaagaggctagcatgtcccggattggtctgctgctcaaaaagattagagacatcgtgtcttccgagggcttcatgatcaatgaagctaagactcgtatcctcagagcctctcgaaggcagcgggtcacaggcatcgtggtcaatgagaagcccaacctttcaaggaaagagttaaaagcctttagagcattgctgcacaacgtagaaaagaatgggctcgaaaaggaaaatcggagcaaccatccccacttttgggagtacatcaagggctacgttaactacataaggatggtgcgaccagatctgggggagaagttcacccagcagctcgtgaggattgccggaaaataccgactgaatttgagccttcctgtgaataacctctga

SEQ ID NO: 13553 - RNA, 1446 nt, unidentified
  source 1..1446: mol_type = other RNA; note = synthetic construct
atgtccgaagagcagttccagcccatgacgcgcgaggagtggattgaacgaataaagaaggaggggcgagaggaagtgattaagaaagaaatgattcggctcggcttctggaaagaagagccagtcgacccagccactgctgaacagattgcaaaggaacaagaggaaagaaagcagctggttgaggagctgaatcaacttaagaaagagtccgaaaagctgccgaatatcaaagagaaactcaaggaagcaagggagaaaaggattgaagagtccaaacgcaagcgggccgagagaaaagccgagcgggagaaggagcgtcaagaagcgaagaaacggtgggaagaatataaagcgacgcatgtaatacacgtcggcgatagcttcagcgccggcctgcagaactttgatcatgatgaggagaagctgattaggttgggcttacccttgatcagatcagcgatggagatggccgaagtaatgcacctgcctctgagtcgcctgaaatggttaacctaccaccgtaacaccgctactctttgtcattatgcccggtttacaatacccaaaaagaacggtggagtgagagaaatcagcgccccaaagaaggaattacgacaagcccaggcatgggtgaaagagcggatcctggataggatacctgttcaccaggctgcctacggctttgtgcctggtagatctaccgtcgaccatgctaagcagcacctgaaacaggctgcagtgattaagatggatctgaaagacttcttccccacaattaatttttggcgcgtcaaaggagttttccggtcattcgggtactccgaggcaatctcgaccctgtttgccctcctctgcaccgaacctccgcggacagaggtggagttcgatggcaagtactattatatcgcaatgggagagcgccagctaccccaaggagcttgcactagtcctgccctaaccaacatcatttgtcgaaggctggaccacagactgtctcggcttgcagagactctcggtttcacttatacaagatacgccgacgaccttgcgttttcttgtgacgagagtgccttgtgcagaatcggggcactaatgacaaaggccagggacatcatcgactctgaggggtttatggtgaacgaggaaaaaacaagggtcttgagatcctcacaacgccagaaggtgaccgggatagtagtcaacgaaaagccaaatatcagccgtaaagagctgaagaagtttcgcgctctcctgcacaatgttgaacgtaacggtcttgagaaggaaaatagacagaatcatcccaggttctgggagtatatccagggatacgtgagctacattaggatggtgaggcctgatctcggcgaaaagttttcagaacagttggtgcgaatcgctcgcaagtaccagctccgcctgagtgctccagtgagcaaatga

SEQ ID NO: 13554 - RNA, 1422 nt, unidentified
  source 1..1422: mol_type = other RNA; note = synthetic construct
atgtctgaggaaacacaacccctgactaaggaagagtggagagaaaggatccagcgggagggcaaagaagagacaatcaagcaggagatgattagattgggattctggaccgataaaccactgacccccgaggaaatggcaagcgttgaggctgatgatcaggctgaagccgcacttaagagcgagctgaataagttgcggtctgagtcccgaaaatggtctgatacggaccagctgatcaaaaaagcccgtcagaagcgcatcgaggaatctaaacagcggagagcggaacgcaagaaggcgcgtgcaatcgagcgcaagcagcaagaggagaggtgggccgagtacagacaaaaccacctcgtgcatttgggtaacggtgtctccggtggactggaacagtccacaaccaatcaggaacggctcaagcaactggaccttcctctcatagaaacaccacagcagctcgcatccgaaatgggcatcaccctagggaggctgaaatggttgacctaccaccgcgatctggccaccctcagtcactactatccttttactatccccaaaaaaaacggagggatcagagagataagtgctcccaagaaagagttacgagccgcccaggcctgggtgaagcagtcactcctggaccagctttccacacatccagccgcatacgggtttgtgcagggaaggaatactgtggatcacgcaaagcagcatctgaatcaggccatcgtcgtgaagatggacttagcagacttcttcccgacaataaccttttatcgcgtacgcgggctgttcgcaagttttggctactcacaacaaatgagcactgtcttcgcccttctgtgtacggaacctccgaggaagagggttcgatttgacggaacatattattatgtagccatgggcgaacggcagctgccccaaggagcttccaccagcccagccattacgaatctaatatgccagaggttagatcagcgactgtcgggccttgccgaaaaagagaactttatttactcacgctatgctgatgatctcactttctctacatcagaccagcaagataggagagtgggggcactacttcagactgtgagacagattattcacttcgagggcttccagcctaatgaggctaagactagaattctgcgaaaaagtcggcggcagcgtgttaccgggatcgtcgtgaatgagaaggctaacttgagccggcaagatcagaggcggttcagggctattctgcacaatgtgggtaagaacggctttgacatcgagaaccgtgaccaccacgacgattttctcgcgtatctccagggctacattagctacgcccatatggtccgccctgacctggccgaaacctggcagaaccaattggacagagctattgctgcgcatctgaaagactga

SEQ ID NO: 13555 - RNA, 1464 nt, unidentified
  source 1..1464: mol_type = other RNA; note = synthetic construct
atgtccgaggagcaaagtcaggagacgcagcagctcactagagaggaatggatacagagaatccgggaagagactaagggggaagtcatcaagaaggagatgatcaggctggggttctggagcgaagaacctcttcccccggaggagaaggagcagcaagaacaggaagatcgcgaattcgccaggcttcagaaggaactccaggctctgcaacaggagagcgagaaactggaggataccgacaccctcatccgggaggctcgcaaaaaaagaatcgaggaaagtaaacgaaagagagccgagcggaaggctgaacgcgagcagcgtctagccgaggccaagaaacgttgggaagagtaccaggcgaaccacgtggtccacgctggaatcggcgtcagcgcaggcttgcagaaccacactatgaacggatatcagcttgaacaacttggtctgccaattttgacctcccccgctattatggctgcagagatgggtatagagctgtcacgccttaagtggctgacataccatagagacacagcggccctgtcacactatcacaggtttaccatacccaagaaaagcggcgggaggagaataatttctgcacccaaacccgaactgcggcatgctcaagagtgggtgaagacctacattgtggatcgagttccggtccatgaagccgcctacggctttatccccaaacgatcgaccgtggacaatgcacagcaccatctacagcgcgctgccgtgatcaagatggatcttaaagacttcttcccttccattacattccagcgcgtgaagggcttgtttcagtcctttggttattctgaggctgtctctactctgctagccttactgaccacagagccacctcgtgaaaaagtcagctttgacgggaagttctactacgttgcagtgggtaagcgccaactgccacagggggcatgtacaagtcctggaatcacgaatctcatttgcagacggctggacgccagactcacagagctggctgagaagatgggctttacctacactcggtatgcggacgatttaaccttctcatgcgaccaagacgggctcgaacagttgggagtgctgttacgaggagtaagggatattgtgcggttcgaaggactgcaagtaaacgagaagaagacacgtgtcctgagggcctctcgaagacagcgggtgacgggaatcgtggtaaacgataaaccttccttgccaaggcaggagctccgcacttttcgggccctcctccacaacgttgaaaaaaatggcctggaggccgagaatagagaaaataggccacatttctgggagtatattcagggctatgtgtcatacgttaggatggttcggcctgatctgggggaacaatttggcgaacagttacagcgcatcgccgcaaagtatggcttgaaactgaatgccgcgagggaacgagaggcaaaatga

SEQ ID NO: 13556 - RNA, 1443 nt, unidentified
  source 1..1443: mol_type = other RNA; note = synthetic construct
atggcagaagaggagaagcagccactaacgcgcgaagagtggattcagcgaatccaggaagagtcccgggatgaagttattaagaaggagatgatcaggctcggcttctggatcgagaagccactcgaccccgaggacgagaagcaacaggctcaggagaatgaagagtatgcccgccttcagaaagagcttaatcaactgaagcaagagtcagcaaagctctctaatgtggatgctctgattagagaagccagaaagaaaaggatcgaggagtctaaaaggaagcgcgccgagaggaaggcccagagagagagggaaagatcggaagccaagaaacgatgggagacttacagatcccagaatatcattcacgctggcataggggtttctggggggctgcagtaccacgaaagtgacgaagagaaacttaaatcactgcaattacctcttctcagttcccccgccgtcctggcagatgaaatgggaatggatctgtcccggctcagatggctcacttatcatagagacaacgcaaccttgtgtcactatcatcgctttacaatcccaaagaaggggggtggcgagcgacttatcagcgctcctaagcaggagttacggaaagcccaaaactgggtcaaagaacatatactggaccgaatccccttgcacgatgctgcatatgggttcgtgcccggacgatccaccgtggacaatgctagctgccatcttggccaggaagccgtcataaaaatggatctccaggatttcttccctagtattacattcaggcgtgtgaagggggtatttggatcctttggctacagtgaggcaatttctaccctcttagctctgctcacaactgaaccccctcgggaagaggtgatgttcgacggtaagtactactatgtggctattggagagagacagctgccacagggagcctgtacaagcccaggtattaccaacatcatctgccgccgcttggatcagaaattggaggaactggcgcggggtctgaacttttactacacacgttatgcagacgatctaactttttcatgcggtaaggaaagcactcaacacatcggcattttgctgaggggcgtcagggaacaggttcgctttgagggcctgcgcgtaaacgaagggaaaacgcgaatactgcgtagctcaagaagacagagagtgaccggaattgtggtgaacgaaaaaccgaatctgacccgcaaagagctacggcggttcagggccctgctgcacaacgtggaagccaatggcttggaggcggagaaccgggacgatcatcctcggttttggagcttcatccaaggatatgtctcgtacatacagatggttaggccggacgtagcggccaaaatgagcgaccagttaaatcgtatcgcggagaagcacggcctgcaccggacaatcaggacctcttga

SEQ ID NO: 13557 - RNA, 1461 nt, unidentified
  source 1..1461: mol_type = other RNA; note = synthetic construct
atggctgaggagaaccagcaggaaacacaacctctttcacgcgaggagtggatagagagggtcatgcaggaggggaaagacgaagtcattcgccaggagatgataagaatgggcttttggtcggaaaagcctattccacctgaagagaaagcaaaacaagaacaggaggatgaagagtatgcactcctgaccgaagaactgaatcggctcaagcaggagagcgagaagctcggcgacattgaaagtatgatacgggaacggagaaagcaaagaatcgaggagtccaagaggaagcgagccgagagaaaggcagaaagggagcgccttagagcggaggcacgcaaacgttgggaggaatacaagtctaagaacgtcatccatgtgggagccggatttagcaaggacttgcagtcttttgatatggacgaggagaagctgcgactgaacaaacttcccgttatcaggacggctgaggagctagcgggcaagatgggcatctctctgtctgaactcaaatggctgacatatcatagagacacggctaccatttgccactaccatcgtttcaccatcccgaaaaagagcggtggcatgcgggagatctcagctccaaaacccaaattacggcgcgcccaggagtgggtgaaaactcatatcttgggtgggagcgaagtgcacccaagcgcgtacggtttcattcccgggaggagcactgttgacaacgccaagtgccatctgaagagggcagccgttatcaagatggatttgaaggattttttcccctccatcactttctggcgtgtgaaaggtcttttccaatccttcgggtattcagcggccatttcaaccttactggccctgctatgcacagagccaccccgcaaacaggtgcagtttgatgggaaattctactatgtggccattggagagagacagctaccacagggggcctgtacaagtcctggcatcactaacctgttgtgtcggagactggatctccgcttaaccggattgggagaagctaatgggttcacctactctagatatgctgacgacctcaccttttcctgtgatgaagaaggcctgccgcagatgggcggagtcatcaatacagctcgccacatcattcgatttgaaggcttcagggtaaatgaggaaaagaccagggtacttcgaagtagccgtaggcagaaggtgactggtatcgtgctcaacgaaaaggtgaacataagtcggaaagaacttagagccttccgagccctgctgcacaatgtggaaaaaacagggcctgagaaacaaaatatctatcaccaccccgacttttggggatatataaagggatacgcatcctacattcgcatggttcggcctgatctcaatgagactctggaacagcaactgaaccggattaacaggaaatacaatctggagaagtccgcagtcgccgaggctaagggctga

SEQ ID NO: 13558 - RNA, 1464 nt, unidentified
  source 1..1464: mol_type = other RNA; note = synthetic construct
atgtcagccaataatccatcagaggaggttcaacctctgagtagggaagagtgggtccagaaaatgagggaagagggggggaagggcaatctggtgaggaaggagatgatccgcctgggattctggacagaaaagactctgacggtggaagagtaccagaagaagagagagctcgaccaggagtaccaggagttatcccaacagctcgaaaaatttcagcaagagaacgccaaactggaagatgtgaagaccctggtgaggcaggctcgggccaaacggattaaagaatctaaagagagaagggccaaacggaaggctgagagagaggaggccctggcacaaagacaacggaaatggcaggagtatcgtgatactcatattttgcatgtcggagagaatgtttcaagccacctcgaagatcaagaatacgaagaggagaagctgatatcccagcagctgccaatacttcggggcagccttcatctagccgaagagatgggtgtgtccctaagccgcctcaagtggcttacatatcaccgaaagaccgctactatatcccactaccacaggtttacgattccaaagaaaagtggaggaaaacgcgagatttcgagcccgaagagtgaattgcgtcaggcgcaatcctggatcaaacaggagatcctggaccacctgaaagtccactctcaggcatacgggtttgtgcccagtaaaagcacagtggacaacgcgcttccgcatgtggggaagcaggttgtggtcaagctggatctccaggacttcttcccctctatcactttccccagagtgcggggtttatttcgaagctttggctactcaggtgaggtatctaccgtgttagctctcctctgcaccgagccccctcatcgcgaaatcgagttccagggcaagaagtactatattagtattgaggaacgccagttgcctcagggcgcatgtacctctcccgctatcaccaacttgctctgcctgagactggatgaacgccttgctcagttggcctcaaaaagaggattcacatatagccggtatgccgacgacctcactttctcctgttctggcgattcggagcagcagatcgggaagatgctgggcacaatcaggaagattgtacaagcagaaggatttcaggtcaacgaaaaaaagacaagagtcctaaggtctagtggccggcaacgtgtaaccggagtcgttgtgaacgaaaagccttccctcgacagaaagcgcctgcgaaacttcagggccctgttgcacaacgtagagaagaagggtctggacgcggagaatcgagaaaaccacccaaatttttggcagtatatactggggaatgcttcatacatccagatggttcgacctgatttaaaagaagagattagccagaaacttgccaaaatcgcagaaaagtatggccagaactactccctgcaaagcgtgaataagtga

SEQ ID NO: 13559 - RNA, 1458 nt, unidentified
  source 1..1458: mol_type = other RNA; note = synthetic construct
atgagcaatgaaaccaactatgagcaacatcagcccctgaccaaggaggagttccaagctagaatgaaagaaatggggaaaagccagtttattcgagaagagatgctcagattgggcttctggacagaggaaaccttgacacccgaagaacaggcagaaagaagccaagatctgtcagagttgcagatagtccagaaggagcttgacgagttgcgcagtgaggcacgcaagctcggcgatattaaggaacagctgaagatcgcgcggcagaagcggattgaggagtccaagcgtaagcgagacgagaaaaaggcccagatggaacaggcctccgcagaggcccagaaacagtggacaaagtacaaaaagattcacattccccacgttggtaatagatactctatcggcctcgaacatacaggcatggataaggagaaactggaggcttggcgtctgccagtgctgcagactgccaaggaactcgcatgcgctatggagatcgaacttaaccggttacagtggctgacttatcaccgagacactgcgaccctgtgccactaccatcgattttctattccaaagaagagtggagggacccgcgagatctctgccccaaaaccagaactccgacaggcacaacagtgggtgaaagaacatatacttgacctgctgcctatacatcctacggcttacgggttcgtaaaaggcaaaagcactgtggataacgcccgggtgcatatccaaaagaggattgtggttaagatggatctgcaggacttttttcctactattaccttctggagggttcgtggactatttgagtggatgggctacagtagacagatctcaacactgctagccctgctgacgaccgaaccccctcaccagcaggtcaagtacgacggaaagtactattatatcgccatcggtgagcgccaactaccgcaaggcgcctgtacgtcacccgccatcaccaatctcattacttggggcatggaccagcaactccacgcttggactgaaaaaatgggttatgcctacagccggtatgctgacgatctgacctttagttctgagacactgtcaagctcccagcaagtgggggtgctcttgaaaagggttagatctacagtaaagcttcatggattccaggtgaacgaggagaaaaccaggatcttaaggcacacccggcggcagcgcgtaacaggtatcgtcgtgaatgaaaaaccaaacctgactaggcgcagattacggcagttcagggctttactgcatgacgtcgaactgcacgggcttgaggcagctaacaggcagaatcacccgaatctctgggcctacataaacggatatatctcctacatggcgatggtgcgccccgatctttcccacaagtataatgagcaggcaagcagaatttcccaaaaatatggattgtcgtacgtggggatccctgtctga

SEQ ID NO: 13560 - RNA, 1449 nt, unidentified
  source 1..1449: mol_type = other RNA; note = synthetic construct
atgtcagaagagaacaaagtgctgacccgcgaggagtggataaataaaatccgatcagagggcaaggccgagacaattagatccgaaatgatcaggcttggcttttgggaggcacccaatcttagcgaggaggagcgagagcagcaagctaaggaagacgaagagtataaggaagtgagaaaggaattacaggaattgcagaagaaaagcaagcagctaaaagacatcgatttcctgctgaaggaagcgcgcaaacgcaggatggaagagtcgaaaaagcggcgagccgagaggaaagcagtgcggaagaaagctcaggctgaggccaaagagaagtggcgcaaataccgacagaatcacgtaatccacgtaggagatggggtcagtgcggggctcgctagcacagagacgaacgagcagaagctgatgcaacaccaacttcccctgattcgttccgctttgcaactagcccatgacatgaacatcaccctctctgagctgaagtggctcacctatcatcgaaatacagcgacaatcaaccactatcaacacttcaccattcctaaaaagtctggcgggaagcgggaaatcagcgcccctaagagtaagttaaggagtgctcagagttggatcaaggcaaacattttagataagctggccgtccacgatgctgcgtacggcttcgttacgggtaaaagcactgtggataatgccaaacaccacataggtaaagatgccgtggtgaagttcgaccttaaagactttttcccatcaatatctttcgtacgggtgagaggtctgttcgaatctttggggtatagcagggctatttccacgctctttgcacttatctgcaccgagccccctcgccaggaagtggagttcaatggcaaaatgtactacgtggctatcaatgagagacagctaccacagggagcctgcacttcccccacactgacaaacctgctgtgtcggagacttgacgaaaagctcactcacctcgcaaaggagaaaggattcacctatactagatatgccgacgacctgactttttctggaaatgaggaagcactcaagcagatagggtcactgatgggctcggttcgcagcgtcgtggactttgaaggatttattattaacgaagccaagacccgtgtcttgaggaacggcagaaggcagcgggtgaccggaatcgtggtcaacgaaaagccgaacttgactcggaaagacattcgctccttcagagccctgctgcataacgttgaacatcacgggctggaacaagagaaccatcggaatcatccacatttttgggagtacattaatggttatgtctcctacgtccagatggttaggcctgatatcgggaagaaatttgccatccaggtgcagaggattgcagataagtacggcctcccaatccgtgtttacatagagaaactgggctga

SEQ ID NO: 13561 - RNA, 1449 nt, unidentified
  source 1..1449: mol_type = other RNA; note = synthetic construct
atgtcagaagagaacaagatgttgacccgagaggaatggattgcaaagattagaagcgagggcaagcacgaaaccatccggggcgagatgattaggctaggattctgggaagctccaaaccttacagacgaagagattgagcagcaggcaaaggaagacgaagaatacacggaggtgcggaaggagcttctcgctctgcaaaaggagagcaagcagctcaaagacatcgatttcctgctgaaagaagctcgcaagcgacggatcgaagaatccaaacagagacgcgccgaaaggaaggctcagagggagaaatcccaggcggaggcgaaggaaaaatggaaacagcacagggagacacacgtcatacatgtgggagatggtgtgtcagccggtctggcctcaaaagagacaaacgagacgaagctcatggagagacaacttcctctgattaggagcgcactccagctagcagaggagatgggcatcacgctgtccgagctgaagtggttgacttaccataggaataccgctaccattaatcactatacaagattcacgatccccaagaaaaacggaggacaacgggagatcagcgctccaaaggctaagttacgaaccgcacagacttggatcaaagaaactatcctggataacctcactgtgcacccagcagcgcatggattcgtaaccggcaaatccacagtcgataatgctaaacaccacataggcaaggatgctgttgtgaagtttgatcttaaagacttcttccctagtattagctttgtgagagtccgcggactttttgagagtttagggtattcccgcgccatatctaccctgtttgccttgatctgcactgaggcccccagaaaagaagtggagttcaacgggaaaatctactatgttgccatgaaggagaggcaactgccccaaggggcctgcacctctcctactattactaatctactgtgtcgacggctggacgaaaagctcacccagctggcccgtgacaaaggctttacatactcacggtatgccgacgatctgaccctgagtgggaatggggacacattgcagcagattgggagcatcatgaactctatccgcaatatagtgtcgtttgagggcttcgtcgtgaacgaagaaaagactcgcgttcttcgtgccggtcgacggcaacgcgtcacaggaatagtagtgaacgaaaagaccaacctcacaagaaaggatattcgtagttttagggcactgttgcataacgtggagcagaaaggtttagaggaggaaaatcacaagaatcatccttacttctgggagtatatcaatgggtatgtttcttacgttcagatggtccggccggacatcggccagaaatttgccacccaggtgctcaggattgcggaaaaatacggcctccccatcagagtacatgccaagaagctgggctga

SEQ ID NO: 13562 - RNA, 1458 nt, unidentified
  source 1..1458: mol_type = other RNA; note = synthetic construct
atgtctgaggactctaagcctttgacaagggcagagtggtatgaacggataaagcaggaggggaaatacgaaaccatccgatcggatatgctgaggttgggcttttatcaggaacccgaggtgagcccccagaagaaagagcagtggaagcaggaggacgaagcctaccaacagctgctccaagaattacaacaggtgcaactggaggccggaaaactgccaaaaatcaacgacctcctagcagaggcccggcaaaaacggattgcagccagcagacaaaagagggtcgaacgaaaggccgtgagacttaaagaaaaggaggagcagcaggcgcactggcagcagtacaaggcagaccacataattcatttgggaaggggggtttcagctggcctgcagcagcaggaaactgatgaaacacagctcaataagctggggctccccgtcctgacaagctcgaaacaaattgccacccaaattggcctctccctctcagagctgaagtggctgacgtaccaccgtaacaccgcgactattagccactaccatcatttcaccatcccgaaaaagaacggtgaaaagagagttatcagctctccaaaacctcttctcagaatcgcccagagttggatcaaagaggctattctggaccatattgatgtgtccccacatgctttgggtttcttaccacagaaaaatatcatggacaatgcaagacctcacgtaaaaaaagacctgatcgcaaagatggacttgaaggatttttttcccaccataaccttctggcgcgtccgcgggctgttccagtcttttggatattctgaggccattagtactcttctcgccctggtttgtacagagcccccccgcaaaaaggtgagctttgctggcaaggtatatcatgtggcgcttggggaaaggcagctaccacagggagcgtgcacctccccttccctcacgaacatcatctgccgtcggctggattcccgcatgaacggcttggccgacagtctgaatatgacctatactcgctatgccgatgatctgaccttctccggcactaaggtgaagaaccaccacattcggacactgttaagtaagtctagatcaattatcaccttcgaaggatttcacattaacgaagagaagacaaggatccttcgagccacacagcggcagaaagtaactggcatcgtggtcaataagaaactgaacataagcaggcaggagctacgttcattcagggctctgctccacaatgttaaacgctcaggccttgtcgaagagaatcgggaccagcatccgtacttctggggatacatcataggttacgctgggtacatcagaatggtgcgacctgatttaactcagagaattgctagcgagctgatcgagatagcacaaaagtatcagcaagaaattcctgcttgggtgcaccagacgtccaagagtgagtga

SEQ ID NO: 13563 - RNA, 1455 nt, unidentified
  source 1..1455: mol_type = other RNA; note = synthetic construct
atgactgaggagcagaaccaggaagaggttaaacaactgacacgcgaagagtggatcgagcgcattaaatcagaaggacgaaccgaggccatcaaaaaggagatgctgagactgggcttctggatagaaaaacccctcacaccagaagaaaaaagagagcaggcggaagatgagctcaaactgaaacaactgcaggccgagctccaggagctgcaaaaagaatctgccaagatctcgaatttgaacaaaatcctgaagcaggcacgcgctaagcggattgaagagtcgaagaagaagcgagctgatcggaaggccgccattgagaagcgcgaagctgacaggaaagcccgctggcaggactataaggaatcccacatagtacatgttggcgacggcctctccgccgggctacaaagttttgaaacggacgagaaaaagcttatggaacagcgactgcccctcattaggagcgctgtgcagtgcgcggatgaaatgggaatcaccctatctcagttgaagtggctgacataccatagagacaccgcgaccatcaaccactattatagatttacaatccccaagaagaacggcggggagcgagagatatcatccccaaagcccttacttcggcaggcacaggcatggatcaaagctcacatcctggaccaaattcaagttcattccgctgcctacggattcgtgccgcagattaacaccgtcgacaacgcgaagcagcacgtgaatcaggccgccgtcatcaaaatggatctgaaggactttttccctagcattactttctggcgcgtccgtgggctctttcatagcttcgggtactccgaggctatatccacactgttcgcatgtttatgtaccgagccgcctcggaaagaggctagctttaatggtaaaatttaccacgtggcccttggcgagaggcagcttccacagggggcatgcacgtcaccatctataactaacatcctgtgccggcgtttagatgaaaggctgacaggccttgcccagactaatggattcatctacaccaggtacgctgatgacctgacttttagctgtcaagaaagtagcttgtcaaagattggaaccttgttgaatagtgtgcgcaacattgttaagtttgaaggttttaccgtgaatgaggagaagaccagagtgctcagggccagccgaaggcaaagagtgactggtatcgtggtcaacgaaaaacctaaccttacaaggcaggatttgaggcgtttcagagcactcctgcacaatgtggaaaagaatggtctagaggcagagaaccggtctaatcatcccaatttctgggcctatatccaggggactacgagttacattagaatggtgcggcctgagctgggcgagaaactgggcgagcaggtagaacggattgctatcaagtatcacctcgcaggatctgtcgtatctaagtga

SEQ ID NO: 13564 - RNA, 1458 nt, unidentified
  source 1..1458: mol_type = other RNA; note = synthetic construct
atgcaaggaaagaacgacggcgaggtccagcccctgtcaagggaggagtggcttgaaagggtaatgcaggaaggccgtgacgaggtcatcaggcgtgaaatgatccgaatggggttctggtccgaggaaccgttacctccagaggagctggagaaacagaaacaggaggaaaaagagcttgcccagctcaaggaagagctggaatccctggaggaaaaaactagaaaattgggagacttagaagccatgatccggcgccgacggcaggagagaattgaagagtctagaaggaggagagctcagagaaaggaggagagaattcgtcgccgggccgaggctcaagccaaatggaaagaataccgagagcagcacgtggttcatgttggcgagggatttagtggcgatctggagcttctgaattccgatgaggaaaggctccgggaaagcggtctgcccttgattcataccccccaggaactggccgaagccatggagatccccttgggccggctgaaatggcttacgtaccaccgggataccgccacaattagccattatcaccatttcactatcccgaagaagaacggtggcaagcggattctcagcgccccaaagaagcacctccgccaggctcaggagtggattagggctcacctgttgaatcgagtcgaggttcacccatgtgcctatggattcgtgaggggaaagtcaatagtagataacgctgcgcaccatgtggggaaggcagcggtcatcaagatggacctgaaggatttttttccttctgtacattatccgcgagtcaagggcatgtatcagtcttttggctactcacccgcagtgagcaccctgcttgctttactgtgcacggaacctcccaggaggaaggtggaatttgacgggcgcatctatcacgtcgctgtgggcgacagacatctaccacaaggggcgccaacctcgcctgccattacaaatattctctgccgcagattggacgaacgcctactggggctggccgactctcacggtttcgcatacaccagatacgctgatgatctcactttcagttgttggcctagcggagaaaaacggattggcgccctactcggaactgcccgcggtatcgtgaggtacgagggttttgaggtgaatgaggaaaagacaagagtgctccggagatcccgccggcaagcagttacagggatcatagtgaatgagaagaccaacttgaatcgtggagaactgcgggcattccgagccctgctgcatcaggttgaacaaaaaggccttaaagggcagaacatacacaaccaccctaacttctgggagtatataaaaggctacacatcctacatcgagatggtgcgcggagaggctgcagctccatacagagaacaggtgaagaggatcgcacgcaaatatgggctcgaccccaaggtcgcaagtgatcacgcgtga

SEQ ID NO: 13565 - RNA, 1455 nt, unidentified
  source 1..1455: mol_type = other RNA; note = synthetic construct
atgagtgaagagaaacggccacttacacgggaagaatggatccagaaggtgtcggccaacgggagggaggctacgattcgcgaggaaatgatcagaatggggttctggagcaacgacagtttaacagaggaggagaagaaacagcagcaggcagaggatgaagagcgagccagactcgcagccgagctgcaaaggcttcagagcaaaggaatgtcaatgccgaaggtgcaacagctgctccaggaagtccgtcagaaacgcattgaggcctcccgcaaacgaagagaggagcagaaggcagagagggagcaaaagcgccgggaagccaaggcggcttgggaacagcacagggctcgccacgtagtgtacgcaggcgaaggcgtgtccggcggacttgagaataaggaaacgcagaccgagatgttgcggcaggccggactccccatcgtgactacagctgaagaattggcagaggccattggtatcagcgtgagcaagctcaaatggttaacgtatcataggaatactgccactctgtctcattactttaggttcactattcccaaacaaaacggtgaggagagagaaatcagtgcacctaagcagaccctgcgccaagcgcaggcgtggattaagacccacctcctggacaggctacctgtccactctgccgcccaagggtttgtccccggcaaatccattgtggacaacgcaaagcagcacgttgggcaagccgctgtaatcaagatggatctcagggatttcttccccagcatccacttctatcgggtgcgcggtctgttccagtcatttggttactccgaaatgatcagcacattgcttgctctgctgtgtaccgagccacctagaagagccgtcacactcgggggaagggtctatcatgttgcaataggagaacggcagctgcctcaaggcgcttgcacttccccagcaatcaccaacctgctgtgtagacggcttgacgaaaggttgtctggtctggcacagaagtacggctttcagtactcacgctatgccgatgatatgaccttttcatgcagtgaggctgggattggacaaataggcgcggtaatcaatcaggttagacgcatagtggctttcgaagggtttaccgtcaatgaagacaagacacgtgtcttaaagcgaaccaatcgtcagacagttactgggattgtagtgaatgagaagatcaacgttaaccggcgagagtggaaacagttcagagccctgctgcataatgtggagaagaatggactagaggccgagaacaggaagggccacccgcactactgggattatattaaaggctacgctaactttgtgcgaatggttcgtcccgacctggaagagaaactcatccgacagcttcgggccatagccgtgaaacatcggttgtctctgccaggctgggctagaaaaaccgtgcagtcttga

SEQ ID NO: 13566 - RNA, 1470 nt, unidentified
  source 1..1470: mol_type = other RNA; note = synthetic construct
atgagtgacgagcgcatggaagaaaaacggccacggacgctggaagagtgggtagagcaggtgaggaggcttggccgggaacacgccatcaggaccgagatgatacggcttgggatgtgggaagaaaaagagttgacccccgaggaaaaagcccaacagcaacgcgaagacgctgagtatcaaaagctggcagaggaatcgatgcggctgcagcgcgaactgacaaagctgggcaatctccagcacttattggcggaggcaaggaagaaaagaatcgaggaatctcggagacgccgcgaggagcgtaagaaagaaatcgccaagagagaagcagaacgcaaacgacgctgggctgagcacctggaaatgcacattgtccacgctggcgctggtgttagtgggggtctgaacgccttcgagcaccaggaggaaaagttgatggcagccggcttgcctctgatcaggtctgcccgtgagctcgcagagctaatggatatgccaatatcaaggttgagatggcttacttatcaccggaacgccgctacggtgtgtcattaccacaggttcacagtccccaagaggggaggggggttgcgagagattagctcacctaaaccagaactgcgccgagcccaggaatggatcaagcgggagatcctcgatcggttccccgtgcattcagctgctaccggctttctccctggcaagagcgtgctggacaatgccgcaccgcatctgggacaagccgccgttattaaactcgatcttaaagacttcttccctggcattaccttccatcgtgtgaagggactgtttcgctccttcggatattccgaggccatagccaccctgttagcattactgactaccgagcccccaagaaggcccgttgagtttgacggcaaaatgtaccatgtagctctgggggaacggcagctaccacagggtgcctgcacctccccagcaatcactaatctcttgtgcaggaagctggatgccaggctcgaagggcttgctcgaaagcacggctttcggtacagcaggtatgccgacgacctcacatttagctgtccggccgaacgcaccgatgcgatccctgtcctgctgggcactgccagagccgtgatccgccacgagggatttgaggtgaacgctgaaaaaacaagagtgttacggtccagtactcgacagcaagtgacaggagtagttgtgaacgagaagcccaacatctctagaaatgagctgcggcgattcagagcaattctacatagagtgtggcagaatggtccggaggctgagaacagggacggacatccccgtttttgggagttcatacaggggtacgcggcgtggattagaatggttagacctgatcttgaggggaagctcgcagtccagctcgctcgaattgctgagaaacatcgtctgcctgtggcgggatgggtcaaggaaacagcagtcagaggttga

SEQ ID NO: 13567 - RNA, 1395 nt, unidentified
  source 1..1395: mol_type = other RNA; note = synthetic construct
atgaatgaggacgagaaggcccgattgtaccgggaagtcaccagatctgcctctgagtcagctgtgctccggcgtatgcatgccctggggttttggccgcacggcgaaggactaccccctgatccaccagaagagcatgccgagcgcgccaggattgaggcagagctcgctgacctcaggagaacacatgcaagagtggaagatcccgaagccgctctcgtagaggaacgcagacggcggtgggaggaatccaaagcaagaagagctgaggcacgggctaggcgcttgcaggaacagcaggtccgtagagaggagtgggatcgccaccgttcctcaaccatggtacacgcggggataggcgtgtcagcggggcttcaggacgctcgaagtgacgaagaggccctgagtaggcgcgggttgcctgtgctacaccgagctgaagatctggccggacagatcggaatagagctcggtgccttacggtggctgacgtatcaccgcaggagcgcgtccgttgtgcattatcatcgttacgaaatcgcaaagaagaccgggggcgttaggtgtattagcgcccccaaaccagcacttgcattcgcacagcggtgggtgttcgaccagatcttgcggcggttagatcccgagccacaggcccatggtttcgttccggggagatctattgtcactaacgcatcgacccatgccggccgagcagtggtagtcaacttggacatgaaggattttttcccctctgtcacatttcgccgtgtcaaaggtctgtttcgagctattggttacagcgagcatctggcaaccgtactggcgcttctatgcacagagccccctcgcgttccagccactctggatggcaagacaactcacatcgctctgggcgaccgcgttctccctcaaggagcttgtactagtcctagcattaccaacgctctttgcaggaggctcgaccgacgactggatggcctcgctcggagacacgggttcacatatacaaggtacgccgatgacctgaccttctcaggtgacaggccagcggtggttggacggcttctccgttctgtgagatccatccttgccgccgaaggattcgtcgaacacccaagcaaaacgcggatcatgcggagaggaggaaggcaggaagtgactggcgtgactgtgaatgacagacccaatgtgtccagacgagaattgaggacgctgagggccatcctgcacaatgccgctcgcctggggctggagagccaaaaccgggaggatcaccccgattttgccagtcacctgcgcggcagagtggagtttgcttgcatggtggaccctagcagggccggcacctatagggacgcactgtcccgcgccttacaaggccctggagcaccgtga

SEQ ID NO: 13568 - RNA, 1395 nt, unidentified
  source 1..1395: mol_type = other RNA; note = synthetic construct
atgaaccaggatgagaaggccagactgtatcggcgggtacgacacttagcctctgattctgtagtcctgaggcggatgcagacactgggtttttggccgaaaggggagggcctaccccctgatccacccgaagaagccgctgagcgcgcacgaatcgaagctgaacttgccgacttgagacagaaatttgctaaggtgagcgaccccgaagctgccttagcggaagaacgcagacggaggtgggaggcctcaaaggcaaggagattggaggcaaagcggaggagggctgaagagcagcgtaacaggcgagccggctgggatcaaacaagatccgccacagtggttcacgctggtattggagttagcgcggggctgcagggacgccaatctgatagtgaggctttacgccggaggggactgccgatccttcatcaggccgaggacctggccgatcgcattggcatcgagcttaaagcactgaggtggctcacctaccatagacggggggccacagtcgtgcattatcgtcgatacgaaatcgctaaaaagagcgggggcgtccggtgtatttccgctcctaagccagctttggcctgggcgcagaggtggatcctggacgagattcttcggcgcttggagcctgagcctcaggctcacggctttgtgtccggtagatccatagtcagcaatgcggagccacactccgggaaagccgtggtgattaatctggacgtcaaagaattcttcccaactataacttttcgcagagtgaagggcctcttcggatcattgggatacggagagcatatcgctaccgtcctggcactcctgtgtacggagccaccacgcgttgccgcaactctggacggtaagacatatcacgtggctctcggggaccgtgttctgccccaaggcgcatgcaccagtcccgctctgactaatgcaatttgccggagcctcgatcgcaggcttgatggactggccagacggcatggttttacttacacgagatatgccgatgacctcaccttctcaggaaatcgtacggctgcctctggtagattgctgaggagtgtgcggataatcctagtagatgaaggactcattgagcaccccaccaagacccgagtgatgcgaagaggcggccgacaagaggtgaccggcctgactgtcaacgacaggcctgcggtgagcagagaggagctacgcacccttcgcgccatcctccatagcgcctcacggtttgggctggacagtcagaaccgcgacggccaccctgatttcgcatcccacctccgtgggcgggtggaattcgcatgcatggttgacccttcgcgaacaccagcactcagggaagcactggacagagccttaagggggccctcgggctcttga

SEQ ID NO: 13569 - RNA, 2343 nt, unidentified
  source 1..2343: mol_type = other RNA; note = synthetic construct
atgtctgacaacgaaaaggcccaactctataagaggctcattcaacagacgaacgactggtttgtgcttgagcgaatgcgcgagctgggcttctggcccgaggatcagccattgccaaccgtgccgcaggaggaagctgtggaacgtaccgaactagaggctgagatcgctaagctgagacaacagaatagcaaagtagcaaatcctgaggccgctttagccgaggaacgcaaacggcgttgggaggcctcaaaagcccgtcgtgcggaggctaaaatacagaaagaaaaggaaaggcaggcccgaagagaagctcatgaggcacataaggagactaccattgtgcatgccgggcttggggttagcggcggtctacaaggtactgggtcaaatccagtcgctctgaagtcccgatggttacccgtcctccacagggctgaagaactcgccgccgagatgggcatcgaactcaacaccctacgctggctgacctaccataggaggggggcggcagtcgtgcactaccatcgctacgaactgcctaaaaaaacaggtgggagcagagccatctccgcacctaaggcggctctggatcaggctcaacgatggatcctggtgaatatcctgaacaggctgaacgttgagagccaagctcatggctttgtctccggacggagtattgtcacgaacgcaactgagcacgttggcagggaagtagtgataaacctggacttaaaggactttttccccaccattacatttcgacgagtaaaggggctttttgtcgccttgggctacggcgagcacattgccacagtcctgggactgctgtgtaccgaaccaccccgcgttgcagctgaattcgcggggacaacttaccacgtcgccttgggggacagggtccttccgcaaggagcgtgtacgagccccgcgatcacaaacgctatctgccggcggctggatagaaggttagccggattggccaagaagcacgggttcaactatactcggtatgcagacgacctgacattctccggcgatgcaccacgaagggtgggcagattgctgaaatccgtgagagcaatcctagtggacgaggggctcactgaacacccaagtaagacccggataatgcgcaagtcttctcgacaggaggttacgggtgtgacagtgaacgaaaaaccatccctgtcacgcatggaattccgcaagctcagagcaattctgcacaatgccgccaaattcggcctcgagagtcagaatcacgagcagcaccccaattttgaaaaccatctcagaggaaaagtggcctttgcagctatggtcgaccctagcaaaagcgcggcactttgggacgcctttcacaaggcaatcactgaaccccagatgacattctccagtgtgcaggagggctcagtggatgacaggcggaggggaacgctgattggcctggcagtaggtgatgccctgggggctgccgttgagttcaaacctcctggaacctttgagcctgtgaccaattatagagctggagggccccaccgcttaaaccccggagagtggacagatgatacaagtatggccctcgcacttgctgactctattgctaaggcaggctgggatctggacgatcaggccagacggtattgcgattggtggcgggatggcaagtactccgtgaatgggcgctgtttcgacataggtattacttgccgctcttcacttggtcagtttcatctcaccggagatgcgagaaaagccgcaagcaccgacgagtactcaagcggcaacgggagtattatgcggctggccccagtgagcatccagttcgcttccctgttcccggacagaatcgatgaattggcacacctagctgaagaatcctctctcactacccatgcgagtgcacagtgcttgtccgcttgccgctacttcgccctgattttggcaggactgatctcgggccggtctagagaggaggttctgtctcctgattgggagcctctttcgcagcttcgggagctcaagccccttgccgagcctgtagaggatgtggccctcggctcttttaggcggctcaatccgcccgagatcaagggaagcggctatgtagtgaagtcattggaagcagctctctgggcttttcatgacgcccgggacttcgaagaggccgttctgaaagccgtcaatttgggagacgacgctgacactaccggcgccgtgtgtggtcagttagcgggtgcctactggggcgagagcggaatcccagcccgttggagaaattatctggccaggacagatttgctggaggctgccctgaaaggaatgatagaaaaggattga

SEQ ID NO: 13570 - RNA, 1386 nt, unidentified
  source 1..1386: mol_type = other RNA; note = synthetic construct
atggctacagaccataaggccgctctgtaccggaggctggtgcgagaggcatctgatgctgccgccattgagaggatgagggtaaatggcttctggccatggggccaaggtatccctagggatccgccagacgaactgaaggagagagcccaaatcgaggccgagatagcgaagatacaggctcagtctaccaagtccgtggacccagacaaggcccttgctcaagagaggaaacggcggtgggaggagagcaagaaacgacgcgccgccaagcgcttagagagggctagcctcctaaagaagcgtagagacgattttatccggtatcggaaagcaaacgtcctgcatcttggcgtgggggtgtcagcgggcttacaggacactcggccagataccggagagttaactcgccgggggctccccagcctgactaatggatccgatctcgctatgatgatgggagtcccgctggcttcactgcggtggctgtgttttcacagacgcggggcagccctaatgcattatcatcgtttcggcatacccaaaaagtcgggaggtaccagatcaatttcagcaccaaaaccccgacttgccaacgcccagcgatgggttctgcagaatattctcgagcgtctcgacaccgctcctcctgcacacggatttgtgaggcatagaagcattctcacaaatgccacaccgcacgcgagaagggcagtcgtgatgaacttcgacctcaaagactttttcccctctatcacctttaggagggtgaaaggactgttccgtaagctggggtacaacgaacacgtagcgacgatcctcgggttgctgtgcactgaaccccctcgggccagggtggaagttgatgggcgcgtcatttatcttgccctgggcgatcgcgtactgcctcagggtgcttgtacaagtccagctatcacaaacgcactgtgcaaacgcctggatgcccggttgctggctttggctagtcgccatggcttcacttacacccgctacgccgacgatcttacattcagcggcgatgacggtgccttggtggggagactgagacgctccgtggtttccgtcgtcagtagcgaaggatttacagaaaacaccgctaagaccaggatcatgagacaaggtagtcgtcaggaagttactggcctcacggtgaatgaccgacctactatgcctcgcgacgagttccggcagttgcgagccatgctacacaatgcagcaaaacacgggctcgaatcccagaacagaacccagcaccccgcctttgcacagcacttggcgggacgagtggaattcgcatgctgggcggatcccacgagagctgagaagctgagatctgcccttgccgccgcattagcacggggctga

SEQ ID NO: 13571 - RNA, 1386 nt, unidentified
  source 1..1386: mol_type = other RNA; note = synthetic construct
atgccagacaatgaaaaagcgcggctctataagcggattgtgcagcagaccaatgagcacacacttctggagcgtatgagaatccatggcttttggcccgccagagagggtctgcctcaaggacctgccgaggaagcagctgagcggacaaggatcgaggccgagctcgccgaactgagaaaggcccactcagccgtgaagaatccagaaaaggctctggcagacgagaggaaacgaagatgggaagagtccaaaaagcggagagccgctaacaaagccaagcgcgaagaggaggccaagcaacgccgggaagcatgggcagctgtgcgccaagaaagcgtggtgcatgctggggccggggtatcagatcggctgcaccagacaaccagcgacgtcgcagagctcacccgaaggcacctgcccattctgcaccaaagtgcagatgttgcgaagcagctgggaataggactcccggccctcaggtggctaacgtaccataggcgcggcgccactctggtacactaccaccgatactccatagctaagaagaccggcggagctagatgcatttcggcccccaaaccagccctcgccaaagctcagcattgggtgctggaaaacatcttagacagattagacgtggaccctgccgctcatgggtttatcagaggctgcagtattgtttctaacgcaatcccccacgcaaatagaggcgtggtggtaaaccttgacatgaaagacttcttcccctcaataaccttcaggcgcgtgcagggattgtttcgtaaactgggctactccggacatgtggctactctgttggccctcttgtgcacagaacctccccggattgctaccgagctagatgggaaggtctatcacgttgcacttggtgagcggatccttcctcagggagcctgtacgagccctgctatcaccaacgctctctgtcgtcggctggatagacgcctcgatggtttggcgcgaaagaatggctgcgcctatacccggtacgctgatgatctgacattctctggcgatgacccaggggtagtcggacacgtcctgcgaaacgttaggtatattctgaaaggcgaaggctttgtcccgcatcctaacaagactcgcgtgatgcagagggccagccgacaggaggtgacaggtgttactgtcaatgttcgtccaactctagcccgccaggaaatgaggactcttagggccatcttacataacgccgcgaaacacgggttagagtctcagaatcgcgacggtcggccaaatttcgccgcttacttgcgcgggagagtggcatttgcatgtatggtcgatcccacgagggcggaggctcttagagcggcattggctctggcactgaggccggtgtga

SEQ ID NO: 13572 - RNA, 1383 nt, unidentified
  source 1..1383: mol_type = other RNA; note = synthetic construct
atggccaacgacgagaaagcccagctctacagaaggatagtccagcagaactcagaacagcagctgctcgagcgcatgaggattcatggtttttggcctcagagagcggggttgcctcaagacccaccagccgaagccgcagagcgagctagaatcgaagccgagttggaggagttgcgccggacccaatccgccgtgaagaacccggagtcggccctacatgcagaacgtaagcgccggtgggaagagtctaaaaaacgcagggccgagagaaaggctcagaaactccaagaacagcataaacgcagagaggcatacgaagcactgcgacagactacaattgttcacgctggcgctggtgtgagcggacgactgcaagagacgatcagtaatgaggccgaattacgcaggcgtcagctgccggtgctccacattgcagcagatctggctagagaaatggggatgcccctttctaaactgcggtggctcacataccatcgacgaagcgccacgctggtgcattaccaccgttatgagatcgagaagaagacaggaggcgttaggtgtatctctgctcctcgccccgcccttaagcaagcccagggatgggtgttagagcacattctgggtaaattgactgtggaaccacaagcccacggcttcgtaccagggcggagcatcgttaccaatgcactgccccacgtcggaagagcggcagtgattaatctagatctcaaggacttctttccgaccataacctttaggagagtgcagggcctgttccggaagctgggttattccggtcatctggccactctcctggctctgctttgtaccgaaccccctcgtgtccccgctgagttagatgataaggtatatcacgtcgcacttgggcagcgggttctgccacagggagcatgcacttcacctgccataactaacgctctgtgcagacggttggaccgccgcttggacgcacttgctcggaggcacggcttcgcgtacacgagatatgcggacgacctgacattgagtggcgataatacagaaatgatcggacatgtgctacggaacgttaggtatatcctcaaggccgaaggcttcacactgcatcccaccaaatcccggcttatgcggagaggccagaggcaggaagtaaccggagtgactgtgaacgtgaggccaggcgtgagtcggcaggaggtaagaaccctccgcgccattctgcacaatgccgcccgtcacgggcttgagagccagaatagggagaaacgacctaactttgctgcttacctcaaggggagggttgagtttgtgcgcatggtcgatccccaaagagggagagtcctgagggccgcgttacaggctgtcctgcgaggctga

SEQ ID NO: 13573 - RNA, 1413 nt, unidentified
  source 1..1413: mol_type = other RNA; note = synthetic construct
atggctgacgatgaaaaggccaaactgtaccagcagattgtaagtcgcgccgacgagcagcggatagtggagcgaatgcgcctgcacggtttttggccggccgacaaacctcttcccaaggaccctcccgatgaagtacgagaacggcagcaggtcgaggccgagcttgctcacctgagaagagagcatagcacagttagagatcccgaaaaggctttggcgcaagagaggatccggcggtggcaggaatcaaaaaaaaggcgtgctgatagaaaggtacagaagctacaagagcaggtgcgcaggcgggaagcctggaagaaaaccagggacgccaacattgtgcatactggcgagggattttccgctggactgcagcagaagaactccgatgctgcagccttacaggcccgaggactccctgtggcaaacgatagcccagagctcgcgaacctgataggtatcaagctgagcaccctgagatggctgacatatcatcgcaagggagccaccgtggtgcactatcaccgctacagcatctctaagaaaactggcgggctgaggtatatatctgcgcctaaagccgcgttacgtcaggcccaggagtgggtcctgcagaatatcctcagccggctgccagtggagccacaagcccatggttttgtgctcgagcggtccgtggtgtccaatgcactgcctcacgtgaacaaaaacgtagtcatcaatctcgacctgaaagacttctttcccagtatcaccttccgccgtgtgaagggtttattcaggcaggttgggtacggggagcatgtcgcaacagtcctggctctcctgtgtacagagcctccgagggtcgcaactgaactcgacggcaaggtttatcacgtggctttgggacagagggttctaccacagggcgcatgcacgtcgcccgctattaccaacctgctttgcagacgtttggatcggaggcttgcgggactggctaagagacacgacttcgcctacacccgctacgcagacgatctcaccttctcaggcgagaatggcaaagctgtcggcaggctcctccgtagtgttaggtctattttaacttcagaggggtttgccgaacacccacgcaagaccaaagtcatgcgccgggccagcagacaggaagtaactggcttgacagttaacgtgcgccccactgtcagtaggaaggaagttcggcaactacgggcaattatccataatgtggcaagacacggtctggaatcccaaaatagatctgaccatcccgattttgaagggcacctgagaggcagagtgcaattcgtgcgaatggtggacccgcaacgaggggagccattgcttgcagctcttcatcgagccttggggacgtcagccggcgatggaacagccaatatttcttga

SEQ ID NO: 13574 - RNA, 1386 nt, unidentified
  source 1..1386: mol_type = other RNA; note = synthetic construct
atgaatgagaaagctagactctaccagcgcatcacaagtgagatgaacgaggagacagtcctagcccgcatgcgaatgcatgggttttggcccgctagcgcgggtgtacctccagatccccctgaagaggtgaaagatcggcagcgcattgagaaggagatcgcaaggttggccggcgaaaggaagaaagctgccgaccctgagaaggcactcgctcaggagaggaatagacggatcgaggagtcacggaagagacgggccgagcttaaagagaagcgtgcggctgagagggaagcccgccaaaaggaatgggccgcttttcgagaacgttccgtcgttcacgctggcaccggtgttagcgccgggttggaaacccccggcaggtcttccctggaagagctcgtaaggaggggcctgcccatgatgcatgacgggcaggatttagctcgctggctgggcatcactataggcaagctgcgctggctgacgtatcaccgtaatgcagccgcacttgtgcactaccaccggtttgggataccaaagaaaagcggtggtatcagggctatttctgccccaaaagcttccctcgccgtggcccaaagatggatactgaccagaatcctctcacggttgacgcccgatgatgctgcccacggattcgttcatgggcgtagtattgtctccaatgccgccccacatgccggacgaagagtggtaattaacatggacatgaaggacttctttccgacagtgacttttaggagagttaaagggctgttccgccgtctgggatacaatgagccagtagcagtgctcctggccctgctttgtaccgaacctcccagagtcgcagcggaattgggcggcaaggcttatttcatcgccctgagcagtcgaaccttacctcagggggcctgcacctctccggctattaccaacgcagtgtgtcaccgccttgataggcggttaacaggcctggcagcgcgacacggcttcacgtatactagatacgccgacgatctaacattttcgggagatgacgcaacagcagttggacgccttctgagatctattcaatccatcgcaggtagcgagggattcgtgccccacccagaaaagactagggttatgcggagaggggagcggcaggaagtgactggcgtgaccgtgaacgacaaagtgggcgtgtcacggcgcgaagtccgagagctaagggccattttgtgcaacgctgctcgcctgggactcgccactcagaaccgggaggcccatcctgacttcgcaggatatttacgggggagagtcgcgtacgtggccatggtcgacccgtcaaagaagagcaaactggaagctgccctcgcacgagcactggaagcgaggacatga

SEQ ID NO: 13575 - RNA, 1386 nt, unidentified
  source 1..1386: mol_type = other RNA; note = synthetic construct
atggacgagggtgagaagcgcaacctgtatcgcagaatcgtggcaagcgtaccggaggacatgctgctcgggcggatgcgtgtttacggttactggcctactggagtgccaatacccgcggatcccgccgacgaagtagcacagagaaaggaaatcgagcgcgaaatagcaaaactacaatctgctcatagcaccgccaaagatccagataaggctctcgctgaggagcgcaagagaagatgggacgaatccaaaaaacgccgagccgagaataagaagaaaagggaggcagagaacaaacagcgtcgtgaagcgtgggatatttaccgcaaaaaaactgtagttcatgccggcgaaggagtcagttcaggcctgcaggacgtgctctccgacacagacgccttagtcgctcgggggctgccagtcatgcactgtgccgcagatgtcgccgttatgttaggcctcccactgcccactctgagatggctgacttttcaccgccgggctaccgctctcgtccactatcacaggttcgatattcccaaaaagaccggcggacggagacttatcagcgcccccaaggccaccctaaaaaaagcccagcaggtcgtcctggataatatcctgagcaggctccccacagagcctgaagcgcacgggttcgtcgcacagcattctatagtgactaatgccgcttgccacgcaggaaaagccgtcgtgatcaatgtggatttgaaggattttttcccttcaatcggttttcggagggttaggggattattccagcggctgggatactccggtcaggtggcaacgatgcttggactgttgtgcaccgaacctccccgaattaaggctgaactggatggcaaagtgtttcatgtggcccttggagagcgagttcttccacaaggtgcctgtacgtccccagccattacaaatacaatttgcagaaggctggacagaaggctggtgggcctagcgagtaagcacgggttcacctatagtcgatacgcagacgacctgaccttctcagggaacgtaccgaagaaggctggccgattgttgcgctcggttcgggcaatccttgaaaacgaggggtttgctgagaacggcaagaagacacgggtgatgcgccaatcacggcggcaagaagtgaccgggctcacagtgaatgacaaacctagagtgtctagggaacagcgacgggagttacgcgccattcttcataacgccgctaagagcggcctggagtctcagaacagggagggccgtagtaattttgctagctatctgagggggagagtggcatacttgtccatggtggaacctgagagagcggccctcctcaaggccactctggagagggctttggccaagaggtga

SEQ ID NO: 13576 - RNA, 1383 nt, unidentified
  source 1..1383: mol_type = other RNA; note = synthetic construct
atgtccgatgataaagccaaactttacaaactgatcaccagccagttgtcagaacatcaggtactctggagaatgcgcgagttgggcttttggccagagggacagccaattccggacgaaccactcgacgctcaggaggagagggccaaattgacaaaggaactggaacaactaagaaaacagggcgccaagatcgctaaccccgagaaagctctcgcacaagagcgtatcaggcggtggcaggagtcaaagaagcgccgcgccatcgcaaaggccgaaagagccgcgtctgctaaagagagaagcgagaagtggaaagctcacaaagcggttgcactagttcacgccggggaagagcacagcgcaggcttacaagatcgggagtctgatgctgccaaactagcttccaggagcctgccagtgctgcatgatgctcctgatctcgctaaggccatggggatagaactgtcagcactgcgctggctgacttatcacagacgcgctgcagcactcgtacactaccaccggtacaccattccaaagaaagcgggtggaacgagagctatcagtgctcccaagcctgcacttgctaaggcacaagagtgggtcctgggagcaattctggatcggctggtgcctgaacccgaagcacatggctttgtggccgagcactctgtgctgactaatgccgcccctcatgccaagaagaagatagtcgtcaacctggacctgcgtgacttttttccctctctggggtttcgtcgggttaaaggcctgttccggaaactgggatacagtgaacacattgccacattactctcgcttctgtgcaccgaacctccaagggtggaggctgagctcgacggaaaggtgtggcacgtcgccttgggagagagagtgctacctcagggtgcctgtacctcccccgcgatcaccaatgccgtgtgcaggaggcttgaccggcgattgagaggactcgcaggccgccatggtttcgcctatactcggtatgcggatgaccttacattcagtggggacgataggaagaaggtggccagactgcttaaaagcgtgagggccatcctgcagagcgagggcttcgttgaacacccgaggaagactcgggttatgggctccgggtcccgacaggaggtaacaggcctgacggtgaacgcaggcgtgaagcttgggcgcggggataagcgccgattgcgagcaattctccacaatgccgctaagcatggtttagcgtctcagaaccgccgtgaccatagagacttcgccgcccatctcgctggtctggtcagttatgccagcatggtcgaacccgagcgagcggcagactggaaagctcggttggacagggccttatcatcgtcctga

SEQ ID NO: 13577 - RNA, 1386 nt, unidentified
  source 1..1386: mol_type = other RNA; note = synthetic construct
atggcagatgacgagaaggccaggctctacaaacgactcactaccacttggaatgaatttgaagtgctggcgagactgcggcataacggtttctggcccgctggggtagggataccccaagacccaccaaaggagctgaaggagcgggcaacgcttaccaaagaactggcctcattgagggcctctcagctggccgtgaaagatccagagaaagccctctcagaggagaggaccaggcgctttaaggcaagcttagagcggcgaaaagctgcccgcgccagacgtctggctgatgagaaaacaagaagggaacggtggttgaaggcacgcaaggatagcgtggtgaacttaggtgagggcgttagcgccggcctgcaggatgtgtcttgcgacaaggctcagctccaagctcgcggactgcccgttctgggcgatgctgtagccctggcaggagccctaggggtgaaactgtctgtgctgaggtggctaacctttcacagaaggggcgcgacgttggttcattatcaccggtatgccatccccaagaaaaccggagggcagagggcaattagtgctccgcgcaggaagcttgctggctgccagtgttgggtactgacacaggtcctggaaaaactgcacgctgagcctccggcccacggctttgttcggcatcggtcagtcgtgactaatgccaccccccacgttgggcggagagtcgttgtaaatctcgacttgcgagatttctttccaagtgtcaccttcaggcgagtgaaaggactgttcagaaaggtggggtacggagaacaggtcgccacagtccttgccctcctctgtactgagccccccagggtcccagtgacttttgacgataagaggttctacgtcgcccttggtcaacgagtcctcccccagggagcttccacttcccctgcaatcaccaatgctctgtgcagacgtctcgaccggcgccttcaaggcttagcgagacgccacgggttcacgtatacaagatacgccgatgatctgacattctctggcgacgaaccaccaagagttggccgacttctaaagtcggtgaaggctgtggtggttgacgaggggtttcaggtgcatcctaccaagacacgagtgatgcgttccacacgccggcaggaagtgaccggagtcgtagtgaaccacagggtcggcgtgcctagagacgaattacgggccttgcgtgcaactctgcacaactgcgcaagacatggattgcagagtcagaaccgggaacatcacgccgacttcgccgcacatctgcgcggtaaagtaagctgggtgtgtatggtggaccctgctagaggtcctgcgcttcgcgcagctttggagcgtgcactcgcgtccccttga

SEQ ID NO: 13578 - RNA, 1386 nt, unidentified
  source 1..1386: mol_type = other RNA; note = synthetic construct
atggcttatgatgacaaagcacgcctgtataggcgtttggtcaccgggacttccgatgcgactgttctggcgaggatgcgcctgcatgggttctggccacttggcagagggttacccgctgacccaccagatgaactgaagaagcgcctggatttggagcagaagctggttattttgcgggatgccgaagtggtggccacccagtctcctgagaaactgctggaggccgaacggaaaagacgctgggccgctctaaaacaacggcgagccgaaaagaaagccgcccgggctaaagcagtgcaggcacgacgagacgcctttgccaagctcaggaggtccagtgtcttgcacgccggaatcggtgtgagcaagctcttgaacgatactaagagcgaccatgccgcgttaagggcacgagggctgccggtattagacgctggccccgatttggctatgatgctgggcattccactgggggtgcttagatggttgacgttccaccggaggggcgccacactggttcactaccatcggttcagcctccctaagaagaccggaggccagagagcaatctcagcaccaaaacctcgcctgaaaacagcacaggcttgggtcggacaaaacgtgctaggtccgttagctctcagccctcacgcgcacggatttgtgcctggacggtcgaccgtgaccaatgcggctctacatgtggggaagaaggttgtcgtgaacctcgatgtacgggacttttttcccacattcggctttagacgggtgagaggtctttttcggcaccttggctacagtgggcaagtagcaacgcttctggcactgctttgtacggagcccccaaggcttgaggcctcagtcgatggaacacgcgtgtgggtggctctcggtcacagagtgctgcctcagggcgcctctacttctcccgcgctcaccaatctcctctgccaccgtttggaccagcgactcgccggattagcacgtcgccacggtttcgctttcagtagatatgctgacgacctgactttcagcggtgatcatcccgaacgcctgggaaggctactcaagtctgccagagccatactggcagccgagggactggtagaacatccggacaaaactaaagtcatgagggcatcacagcaacaggaggtgacagggatcgtcgttaatacacagctgggcctgcctcgtgacaccatgaggaggctgcgcgcaacccttcataattgcgcccgacacggcctcgactcccagaacagagagggacatcccaacttccggggctacctggagggcatggttgcttacgcctccatggtcaatccagaaaaggctgcccccctcagagctgccctgacactagccctgggcgggtga

SEQ ID NO: 13579 - RNA, 1392 nt, unidentified
  source 1..1392: mol_type = other RNA; note = synthetic construct
atgtcagatactaaggatgaccccctcaaaaagctgaaagctcaactatcagccttgccagacgccaccgtacgtgagcggatgattgcactgggcttctggcctccaggggaacctttgcccgccgatcctatcgacgaggccaatgccagagccgctctcgaaagtggtcgcgctcggcttctagcacaggcaggcacagctgagaaccccgaaaaagcgttgcgaagggaacgcatcaggcggcttcgagagtcccagaagcggcgcacgttacgtaagctggagcgagagaatgagaagaaagccagacgggcggcctgggatgcagaaaaggcgggtcgcatcgtggatgcaggggaaggtgtcagcgcagggctcgctcagaccggatctaacgctgatcagctgaccggactagggcttccggttgtccacgacgccagcgaactggcggagagattgggcctgagtctgagccagctcaggttcctgacctatcatcggcgcggcgcaactctggtgcactatcacagattcggcattccaaagaaaactggagggatacgggccatctcggctccgaagccagctcttgcgagagcccagagatgggtgttggctcaagtactggacaagctggaagttcgagccccagcccacgggttcgtccgacataggtcaatagtgactaacgcagctccccatgtgggaaggcgtgtggtcctcaacctcgatttggagtccttctttcccaccgtgggcttccgtagggtgaaagggctgttcaggaagctgggatacgccgaacaagtggccacactgctcgctctgctgtgtacagaacctccacgcgttgaggcccggttggacggaaaaagactgtggatcgctttaggacagcgagtattaccgcagggtgcatgcacctcccccgccattacaaatgccatttgccgaagacttgacgcacgcctgtctggactggcgaagcactttggctttacctacaccagatatgcagacgatcttactttttctggcgatgaccgcggcagagtgggtaggttactcgggtgtgtcaggaaagtcgtgacatccgaggggtttagggagcacggggacaagacgcatgttatgggcagcggccggagacaggaagtgactggagtggtggtaaatcaaaaactctctacagccagggatgagaggagagcactacgggctatgctccataacgtcgcccggcgcggcttagctgctgagaatcgggacggccacgccgacttcgccagttacctgcgcggaagggttgcatttgcctgcatggtggaccctagcctcgagcctgttcttcgtcccgctctggatcgcgcactggccagaggttga

SEQ ID NO: 13580 - RNA, 1407 nt, unidentified
  source 1..1407: mol_type = other RNA; note = synthetic construct
atgtccgatgagaaagacccacagaaagcagccctcgtcaaggctgtactggcaagtttagacgatgccaccgctctgagcagaatgaagacgctcggcttctggcctgttcatgagcccgtgcccggagatccaccaggcgaaattgtggagcgggccgagctagacgccgaattggcaactctggtcaaaatcgcttccgatggcgaaaagccagagaaagctctgcagcgagagaggataagacggtggaaggagagcagggaaagaagaaaggcgaaaaaggcagagagaattgcagaggccaaacagcgagctgacgcctggcgagctcaaagagctgagaggctggtctacgccggtctgggggtgtctgcaggtctgcacgacgtggagtcagatgtggccactctggaagcttgcggcctcccaatctggcgtgatgcgcgagatgtggctagtgccctgggaatctctatagcgaaactgcgttggttgacctttcaccgcaggggggctacactggtgcattatcaccggtacggcatacctaagaagacaggcgggattcgggctatcagtgcaccaaaacccgctctggctgaagcgcaacagaatgtacagagccttgtcctgcagcgcatcgccccttccgatgaagcacacggcttcgttcgtgagaggtcagtggtgtcaaacgccagaccgcatgttggacgggccgtggtggtgaatctggaccttagagacttttttcccacaattagtttcaggagagtgaaggggctcttcgccaagctcggctactccgagcaagtggctaccgttttggccctgctgtgcactgaaccgcccagagtccctgcagaactagacggacagcgttatcacgtcgccttaggcgcacgggtactccctcagggggcatgtacttcacccgccattaccaacctgatctgtcgtcggcttgacgcccgccttcgaggtatcgcacgagccttaggcttcacctatactcggtacgccgacgacttgacgtttagcggggacgatcctacaaagctcgcctctctgtttgggatggtgcgcaaggtaattgcctcggagggtttcgcagagcatgaagggaaaacccgcgtaatgcggaggggtgcgagacaggaggtcacaggagtggtcgttaacagggcagtccgcctccctcgggatgaaaagcgcgctctaagggccctcctctacaattgcgcgagatttggaatggagagccaaaaccgcgacggtaggccgtctttcgcgagctatttgaggggcagggtggcctgggccgttatggttgaacccgctttgggaccccgcttattcccagcccttgagcgcgctcttgaaggacggcggtccgatctgtga

SEQ ID NO: 13581 - RNA, 1404 nt, unidentified
  source 1..1404: mol_type = other RNA; note = synthetic construct
atgccggacgacgccaaaccaaagccagagaaatccgagaagcagaagctctgggagagaataagcgcgcgccctgactggattgttgtagagcgcatgcgagtgaacggcttctggcctgccggcgagactttgcccgaagacccacctgacgaggtgaaagagcgcgccgccttagaagttgagcgggctaggcttctgaaatcagccctggccgtacagcaccccgaacaagccctcaaggctgagaaccagaggcgtatcgaagtcagtagaaaaaagaaggcggaacggaaggtcctcagagaagctgccgctagagaacgtcgggaggcttttattaagaagaagagagccaccctcgtacatctcggccttggagtgtctggcggacttgaaaagacgggcgcggatgaagcacggctgcaagccttcgagctgcctgtgctacgagacgggaatgatgtggcagcagccatcgggatccctttaggggaattgagatggcttacctatcacaggcgcggtgcgccgctcgttcactatcaccggtacgatattcctaagaagacaggcggtgctcggcacatcagtgcaccaaagggcaagctggcccgggctcagcaatgggtgctggatgctgtactggacaaagttcccgccagcgctcacgcccatggatttgtcagagggagatccgtcgtgacaaatgcgcgcccccatgtgaaatgtaaatctgtggtcaacctggatctgaaagattttttccccacaattacctatcggagggctaaaggactttttgagcatctgggatacggtgagcatgtggcaactgttctggccttattgtgcactgagcctccgcgtgttcttgtggaacacgatgagcgacgcacccacgtggctataggggaacgcgttcttccacagggcgcctgcacttcgccagctattaccaatctgctgtgtaggcggctagatgctaggctcgccgggttggccagacgattaggtctagcctacacgcgatacgccgacgatctgactttctccggggacacagtggacgagagagcactgctgggcgcagtccgacgcgttatcgctgcagagggctttgtggtccaccccgataaaaccagggtcatgaggaagggtagacggcaggaagtcacaggggtcgtggtgaatgcgaaaccatcaatcgcacgcgagcagtggaggtctttgagggccgtactccataactgcgcaaaacatggcctggccagccagaaccgtgagcagcatcccgacttcgcaggacacctggcaggtaaggtggcttgggtgaggatggtggaccctcggaggggagcacagttgggactgctcctgcaacgcgctctcgccagaccctga

SEQ ID NO: 13582 - RNA, 1404 nt, unidentified
  source 1..1404: mol_type = other RNA; note = synthetic construct
atggccgacgatgcaaagacaaaaagcgagaagagcgaaaaacagaagctctgggagcgggttagctcgaggcctgactgggtggtggtcgaacgcatgcgcgtgaacggtttctggccacagggagagaaactgccagaggatcccccagacgaagtcaaagaacggacagctctcgaggctgatcgcacaaagctgctgaaaagtgcgcttgcagtgcaggaccccgagagggctctgaaggaggagaacgaacgtagaatactggaaagtcgcaagaagaaagctgaacgtaaggttcttcgggacaaggcccggagagagagacgggaagcctgggtcaaaaagaaacaagcagcactggtacatctgggattgggggtgtcagccggcctagaacacgtggagtctgacgtagcccggctccagaccctgggtctaccagtgctgaatgatgggactcagctcgcagcttccatgggtatcgccctggctgaactgcgctggttgtcatatcaccgccgcggggctccgttggtgcactatcacaggtacgacattcctaagaagactgggggcgcccgccatatctctgcacctaaggcaagactggccagggcccaacagtgggtgttggccaatattctcgacaagcttccagtttcagagcacgcccatggattcgtccgcgaccattccgtggtcaccaacgccaggccgcacgtcaaaagggcctgtgtggtcaatttggacctcaaggatttttttcccactatcagctttcgcagatgtaagggactgttcgggaaaatgggctatagcgagcacgtggccaccgtactcgccttgctctgcacggagcctcctagagtgctggtggaactggacgataagaggacccatgtagccctgggcgagcgagttttaccacagggcgcttgcacatctcccgcacttaccaaccttctctgcaggagactggacaaacggctcgcagggcttgcaagacggcacggtctggcttacacaaggtacgctgatgatctaactttctccggagactcactcgatgagtctgcactgttaggaagtgttagacgtgttgtggaagccgagggtttcagggtccatcccgacaaaacccgagtgatgcgaaagggacggcgacaagaagtgacgggcgtcgtagtgaacactaggccctccatcgcgagagaggattggcgacagcttagagctattctgcacaatgcggcgaaacagggcctgcagtcccagaatcgggatcaacggcccgactttgcggcccatttagctggccgtgtggcttgggtcagaatggttgatcctaggcgtggcgctcaacttgggctattactgcagcgagccttggcccggggctga

SEQ ID NO: 13583 - RNA, 1386 nt, unidentified
  source 1..1386: mol_type = other RNA; note = synthetic construct
atggccgacgacgagaaggcaaagttgtacaaggagatcgtccgaaggacatccgatgccttcctgcttgaccgcatgagaacacatggattctggccagagaaggagcccttgccaaaagatccccccgatgaactgtctgaaagagctaagatagaggccgagctgcagaagctgaagcagacgtctctcgcagtcaaggaccctgaaaaggccctggcagaggaacagaaacgtagatgggaggagtcgaagaagcgcaggaaggaagccaaagagaaaagggaggccgagcagaaggcaagaagtgaggcctgggcgaaagtgaggaaacagaaagtggttcatcttggacttggcgtgtccaagggactggaggatacgaaaagcgatgccgagaagctcctggaaaatggcctccctgttctgcacacctcagccgatgtggcctccatgttgggggtatcactgcctgtccttcggtggcttacctatcaccgcaagagcgtggctctggtgcattaccaccggtacggcattccaaaaaagactggagggatccgaaatatctctgcccccaagaagtcactgagcgctgcccaagagaaagtgttggttctaatactcgaaaaaatcgcccctgagcctcaggctcacggttttgttgctgggaggagcatcctgactaacgcagctccgcacgccggtcgaaaggtggtgatgaatttagacctgcgggacttcttcccaacaatcacatttaggcgggttaagggcctgttccataaactggggtattccgagcacgctgctaccgtcttagcccttttatgcaccgaaccagcccgagctaaggcggagctctctggccgagtgtaccacgtagcgctgggagaacggtttctaccccaaggaacctgtactagccccgcgatcaccaacctcttgtgccgaaggctggacaaacggctctccggtctggcacagaaagcaggctttttgtatacacggtatgcagacgatctgacctttagtggcgacgacactggtgaagtaggccgcctactacgcgctatacggaaagttattaccagtgagggcttcgaggaacacgctaagaaaacaagggtcatgcgcagagggagacgccaggaagtcactgggttaattgtaaattcaagaccagcggtgccgagagaggaaattcggcgcctccgcgcaattctccataacgccgcccgtagcggtctggatgctcaaaacagggaaaatgtgcctgatttcgcagcacatctccggggcagagtggcctttgtcgagatggtggacaaagaaaggggggaaaaactgagagcagctttgaaccgtgtgcttgccggacgttga

SEQ ID NO: 13584 - RNA, 1386 nt, unidentified
  source 1..1386: mol_type = other RNA; note = synthetic construct
atggcaaagcaggacgacaaagcgaggctgtatcaccgtatcactcaggtacaccacggcattgttttggatagaatgagggttaacgggttttggccaatgaatcaaggtctaccaccggatccagcgcccgaagcacaagagagaaagcttctagaggccgatctggccgtgttgaaacaggacgcagccatgtcccccggagatgtggagaaggctctcaaagccgagcggatgaggcggtgggaagagtcgaagaaaaaacgtgcggaaaagaagaaactgcgggaggcacgagctgctgctaggagagccgcatgggtggaaaggcgaaaggggcttgtatttcacgccggagaggggcattctggcggcctacagcatgctacatctgatgaggccgcgctgaccaaacgcgccttgcctgtgctccacaccgctcacgacctggctgttgcccttggaatcagtctcgcacggttacgatggctcacctaccatagagagggggccacactggtccattatcaccgttactccatccctaagaaaacaggggggattcggggaatcagcgcccccaaacctgcactggccaaggctcagaaatgggttttcgatagtgtcgtgcagaaactggtcattgaaccagaagctcatggcttcgtggtggatagatccattgtgactaacgccaagctgcacgtaggcaagagggtggtcacgaacatggacctgaaggactttttccccagcgtcacatacaagcggacaaaaggtcttttcgtgagtttcggatattctgagcaggtcgccaccctgatggctcttttatgcacagaaccccctcgcgttgcagcctccgtggatggaaagccagtcaacatagcaatcggagagcgacgccttcctcagggtgcatgtactagccccggactgactaacgccgtttgccgcgccttggacagacgcctaggaggtctggcccagaagctcgggtttacctacaccaggtacgctgacgacctgactttttcagggaatgacgacaagcgactgggcttattgttacgcagcgtgaggtcaatcgtcaaggatgagggtttcctggaacacccgaccaagacgagggtgatgcgtcgaggcaggcggcaagaggttaccggcgtggtggtgaatgatagacctactatagccagagaagaactgcgcgagctcagagctatcctccataatgcgatgcgccaaggcctggaagcccagaatcgcaaaggccatcccagatttattgaccacctccagggccgggtggcatatgtcgctatggtagatccagtacggggggagaaactggagcaggctttggcaagggtgctcggccggtga

SEQ ID NO: 13585 - RNA, 1386 nt, unidentified
  source 1..1386: mol_type = other RNA; note = synthetic construct
atggacgcggacgagaaggcaaagctatatcgtagaattagttcggccaatattcatcttgtactggaacgtatgagggttcatggtttttggccccagggacagggacttccaccagaccctgctgatgaagtagcggcacgcgccgctatcgaaaaggagatcggccagctgcaaggagcagctgtcgctggggggcttgctgcaattgaggaggctctgagagaggagcgaagacgcaggtgggaggccagcaagaaaaaacgcgcagagaggaaaaaaatccgccaggcccaggatgctgaaagacgggctcagtggcgcgaggaaaaaaagagcagggtcgtgcacgccggtgtcggagtttctgcaggtctggaagaccgtcagagcaacgaagaggagttacagaggcggggcttacctgttttgcacacagccgctgatgtagctgcatctgccggagtggcctttccgaaactccggtggctgacctttcacagacggggcgccgccttggtccactatcatagatacagtatccctaagaagacaggcggcatgcgagcaatatccgcccctaaatcagccctcgccgatctgcaattgtgggtgctctcaaggattcttacacccctccacgtcgaacctgaagcgcacgggttcgttcccgaaaggtccatcgtgaccaatgccaagcctcacgttcgccaaagagtggtggtcaatctggacctgaaagacttcttcccaagtgtgaccttccgccgggttaagggcctcttccagaaagtgggctattccgagcacgtggcgactctcctggcacttatctgtaccgagcccccccggatccccgttgagattgatggaaagaaattgtacgtggcactcggtgagaggatgctcccacaaggcgcctgcacttcaccagccatcacgaatctggtgtgcaggcggctcgaccgaagactggctggactggggcatcgatgggggtatacctacactcggtacgcagacgatctgacgttctccggcgacgggaaacagggcctagccctactgctgaagggcgtgcggggaattgtatctgatgagggttttgccgaacacccgacaaagacccgagtgatgaggccaggccgcaggcaagaagtgactggagtcgtagtgaatgataagttgggtgtggcaagaaaggatgtccgacagttacgcgctattctgcataacgctaaggtccacgggcttgccagccagaaccgggataaccatcccaactttgaggcccatctgcgtggcagaatagcttttgtgcacatgatagacgaggccaaggggaaaaagttgctggaccttctgaaagaagcgatccatgggtga

SEQ ID NO: 13586 - RNA, 1389 nt, unidentified
  source 1..1389: mol_type = other RNA; note = synthetic construct
atggccgacgaccctaaggaaaaaaagaaggccctctatcagcagctggtggagtccgctgacgaagaacttgtcctggcacgcatgcgagagctggggttctggccgtctagtgaacccctccctgaagaccccgacgatgaggtgaaggagacactggagctggaatacgaactagctcagttacggaagaaggcgaccgttgtagccgatccccagaaggctttggaacaggagagggtgcggagatggaaggagagcaaggaaagacgggcaaaagcaaagattgagagagaattggaggcaaaacaacgcagagaggcttgggaaacggcgaagaaagagcgggtatggcatgccggagagggtgtctctgccggattggaatcccataccccatcgcctgatggtgtgaggttcggagccccacctatcgccacccctaaagcactggccgaggccatgggcatcgatctcccaaagctgcgctggctaacttaccaccgcagagccgcagcactggtccactatcaccggtttagcgttcctaagaagactggcggactgaggcatatcagcgccccgaaaaaggatttaagaagggctcaggagtggattctggtgcatgttcttgagcgcgttggaccccaaccaaccgttcacggcttccagcgggggagatcagtgaaatctaatgctacaccccacgtgtcaaaacgcgtcgtggtcaatttggatctcgaggacttctttcctactctgggatttcgtcgcgtaaagggtgtttttcgaagtgttttcggctatcccgagtccgtagcaacagtgatggctctcctttgtaccgaacccccacgggtggaggcagaacttgacggaaaggtgttccatgtggctctgggggagcgtgtcttgccgcaaggcgcttgcacctcccctatgctgacgaatatagcctgctacgccctcgaccggcgattaggtggcttagctggcagcctagggttcgcttatactagatacgccgatgatctcacattttcttcagacgacccacggaaaacaggccgactgctgaaagcggtgagggacgtcgtcaagaacgaagggtttgtggtgaacgaggccaaaacccgagtgatgcgtcgaggcggaaggcaagaggtaactggggtgaccgtgaacaggaaagcaaacgtcagtcgcaaagaaaggagacgtctcagagctctgttgcacaatgccaagaaaactgggcttgcggcacagaacaggacaaaacacccaaggttcagagagcaccttcggggccgcattgcgtggatcgggatgctcgatgctgcccagggtgccaagctgagggccatgctggatgcctgtcccgactga

SEQ ID NO: 13587 - RNA, 1479 nt, unidentified
  source 1..1479: mol_type = other RNA; note = synthetic construct
atgatggaaaaccaggaaaacaatcgtaaggattatagagaagctgtgaatgctatgggtaagaaggaattcactctgataaaaatgcaggagtacggcttctggcctcagaatctgccgactccctatgaacgccaagaaaacgaaacctctgaacagtacgaaaataggaagaatctgctagagaagtatgagaaggtgatcgacgagattgccaatctatacgaggagaaagacaagataaattccaagctgatagagctccaaaaaaaatatgacgagacatgggattatgagaagatcagactcgatgtttcaaagaccataatggaggagagtatagcccgcagggctgagcggaagaagcagagggaactggaaaaaaggcagcgaagcgaggagtggaaaaaggagaaggaggataaaatcgtatttattggaaagggctactcaagtctcttgaaagacaaggagactcacaaagaaaagttacttgctcaagaccttcctatcatcaatgacgataaagagctcgctagtttcctcggaatcgagtacaagaaactgcggttcctggtgtaccaccgtgatgtcgtgtcggttgaccattactatcggtacacaataccaaaaaagagaggaggggtccgaaatatcgcagctccaaaatccgtgctgaaaaattcccaacgcaagattctggacgatatccttcttaagattcccacatcggatgaggcccatgggttcttgaaagggaaatccgtggttagcgcggccgagtctcactttaagcagcctgagttgctgatcaacattgatctcgaagacttttttccaactattaccttcgaacgggtgagaggcctctttaaatcatttgggtacagcgggtacatcgccagtatgctagcaatgatttgcacatactgtgaacgcatgaagattgagatcagaggcgaagaaaaatacattaaaacgtcaaaccggatccttcctcagggaagccccgcatcacccatgatcaccaatatcatttgcatcaagttggataaaaggctgaagggactgagcagcaagtataactttacctataccagatatgcggacgacatgtctttctccttcaatggtgatgactatgagttaaacattggcaggttcattggcttagtatccaagattgtgaaagaagagggcttcaatatcaacaaggacaagacgaagtttctgaaaaaaaacaactgccagtgtatcactggtatcgtcatcaacaacgaagagatcggggtgccaaagaaatgggtgaagaaattgcgcgccgcaatttataacgccaacaaggcacgaaacagtggagaagtcctgagctctaaagtcatcaatgagatttccggcatgacaagctggattaagtctgttaacgagaagcggtacaaagccataatcgattctgccatggaactgataaattcctga

SEQ ID NO: 13588 - RNA, 1488 nt, unidentified
  source 1..1488: mol_type = other RNA; note = synthetic construct
atgatggaaaatcaggaaaacaacatgaacaataggaaaaactaccgtgaagctgtgaataccatgggcaagaaggagtttacacttatcaagatgcaggagtacgggttttggcccaagaacctgcccacaccctatgagcgccaggagtctgagactgaggagcaatacaaggaaagaaagtgcttgcttgagaagtacgagaaggtcattgatgaaataagcaagctttacgaggagaaagataagattaacttgaaactgcgggagctgcagaaaaagtacgatgaaacctgggactatgaacggatccggctagatgtatccaaaactatcatgcaggagtcaattgaacgacgagcggaaaggaaaaggcagagagagcttgagaaagaacagcgctccgaagaatggaaaaaggagaaggagaacaaaattgtgtttatcgggaagggatacagttctttactttacgacaaagaaacggatgaaaacaagttgctcctgcaggaactacctatcatcaaggacgacaaagaattagccaatttcctggggatcgaatataaaaagctccgcttcttggtatatcatcgtgacgttatcagcgttgataactatcaccgttataccattcccaagaaaaaaggtggcgtcaggaacatcgctgcccctaagagcattctcaagaacagtcaacgcatcatcctcgaggaaatactgagcaagatcccaacctctaattatagccatgggttcctgaagggtaaatcagttgtttcagccgccaaggtgcacgtcaagaaaccggatctgctgattaacattgatctggaggactttttcccaacaattacttttgagagagtgaggggcatgttcaaatccttcgggtattccggctacgttgcatcaatgctcgctatgatctgtacctactgtgaacggatgaaggtggaggtgcgcggcgaggagaaatatgtgaaaatatccgatcggattctgccacagggctctcctgcctccccaatgattacgaatatcatctgcgtgaaactcgataagcggttgaatggactgagtacgaagtacgacttcatttatacaagatatgccgacgacatgagttttagtttcactggagacattaatgagctatccgtcggaagctttatgggcttagtgtcaaagatcgtcaaagaggagggcttcaacataaacaaggacaaaaccaagtttctccgaaaaaataacagacaatgcatcacaggaatcgtcataaacaatgaggagattggtgtgcctaaaaagtggataaagatcctgagagctgcaatttacaatgcaaacaaggtgaagaatagcggggagatactgagcaacaaggtaattaatgaaatctcgggaatgacctcttgggtgaaatctgtcaacgaagagaggtacaaagatatcataaatgacgcgatgaatctgatcaataattga

SEQ ID NO: 13589 - RNA, 1494 nt, unidentified
  source 1..1494: mol_type = other RNA; note = synthetic construct
atgatggaaaatcatgagaataacatgaacaaccgccagaattaccgggagacggttaacaaaatgggtaagaaagagtttactcttatcaagatgcaagagtatgggttctggccgaaaaatctccctacaccctatgaaaaacaggagaacgagacaaaggaacagtatgcccaaaggaaagatctgctggagaagtaccagaaaatcatagacgaaatcgccaatctatacgaggagaaggataagataaacgagcggctacgagagtttcagaagaagtacgacgagacatgggattacgagaagataagacttgatgtgtcgaagattatcatggaagagagtattgcacggcgtgctgagaggaaaaagcagcgcgaattcgaaaaacgtcagcgctctgaggcatgggaaaaggagaaggctgacaagatagtctttattggaaaggggtattctagcttgttgcaggacactgaaacagacgatgaaaaattgcttagccaggaacttcctctcatcaaagatgataaggaattagccaactttctgggaatagagtataagaaactcaggttcctggtttatcacagagatgtcgtatctgtcgaccactacaatcgctacaccatccccaaaaaaaaggggggcgtgaggaatatcgcggcaccgaagtcaattctcaagaattcccagcggaagatactggaagagattttgtccaagatcccaactagtaattatgctcatggctttctgaaagggcggagcgtcgtaagcggcgcaaaagcccacactaaacaaccagagctgctcataaacatggatcttgaagactttttcccaaccattacctttgagagggtgcgcggcatgttcaaaagcttcggatactccggttacgtagcttctatgatcgctatgatctgtacctactgcgaacgaatgaaggtggaggtgagaggggaggaaaaatatgtgaagaccagtaataggattctgccacaaggaagtcccgcttcccctatgatcacgaacatcatttgtgtgaagctcgacaaaagactgtctggactggcgtcaaagtattcatttgtgtacacaagatacgcagacgacatgagcttcagcttcatgaatgataacagtgacctgaacattggcaaatttatggggctggtttccaagatcattgaggaggaaggattcaacatcaacaagaacaaaaccaagttcttacggaagaataataggcagtgcattactggcatcgtgatcaacaacgaggaaattggcgttccccgcaaatggatcaagagactccgagccgccatctacaatgccaacaaagtcaaaaataacggcgatctgccttcaagcaaagtgattaatgaaatttccggtatgacctcatggatcaagtctgtgaacgcccgtagatatgaggacattattaacgacgccatggatctgatcaattcccagttatga

SEQ ID NO: 13590 - RNA, 1158 nt, unidentified
  source 1..1158: mol_type = other RNA; note = synthetic construct
atggaagagtccataaagagacgggctaagagaaagaaacagcgagaattcgagaagcagcagagatcagaagcctggaaaagaacaaaagaggacaagatcgtttttataggcaagggttattctggttctttgcaagacgtggagacaaatatagagaagctcaaagcccagaaattgccaatcattaaagatgacaaggagctggctaagttcctagggatcgaatacaagaagctgcgctttctggtctaccatcgagatgtagtgtcagtggataattatcacaggtacaccattcccaaaaagaaagggggggtgaggaatatcgcagcacctaaatctctgctgaaaaacgctcaacgtaaaatcctcgaagagatactctccaaactccctgtctccgagtatgcccacggattcctgaaagagaaatctgtcgtgagtggcgccaaggctcataagaataagcccgaattactgatcaacatcgacctggaggatttctttccaacgattaccttcgagagggtgcggggaatgtttaagggctttggttatagcggctatgttgcttcacttctgtcgatgatttgcacctactgcgaacgcatggaggtggaagtgagaggcgagatcaagtacgtcaaaacatctcaccggattctgcctcaaggatccccagcctcccccatgatcaccaacattatttgtaggaaactcgataaacgccttagtggcctagcatctaagtatagcttcacttacacaaggtacgccgacgacatgagctttagcttcattaacgaaaacacggacctgacttacggtcgcttgattggcttgataagcaaaatcgtgaaggaggaagggttcaacatcaacaagaacaaaaccaagtttcttcggcagaacaatcgtcagtgtattactggaatcgtaattaacaatgaggaaatcggggttcccaagaagtggataaagaacttacgggcagccatttataatgcgaacaagctgaagaacaatgagcagattccgtcgagtaaaactatcaatgaaatcagcggaatgaccagttggattaaatccgtcaatagcgaaaagtacaagaacatcatcgatgacgcgatgaatcttatcaattcactcgagtga

SEQ ID NO: 13591 - RNA, 1506 nt, unidentified
  source 1..1506: mol_type = other RNA; note = synthetic construct
atgatcgaatctcaagagaacagtaaaaacaatcgtcaggaatacaggaagcaagtgaatgagctcggtaagaaagagtttaccctaatcaagatgcaggaatatggtttttggccaaaaaatctccctacaccctatgaaaagcaggaaaacgaaactaaagaagagtatctggagaggaaaaatctcaccaaggaatacgaaaaaatcataaatgcgatcacagacttgtacgatgagaaagatgagatcaacgccaaattgcgcgacctgaataagaaatataacgaaacttgggactacgagaaaatccgccaagacgtcagcaaggccattatggaggaatctatcgctaggaggaaagaaagaaaggaaaagcgagagctcgagaaacggcagaagtctgaagcctggcagaaggaaaaggccgatagaattgtctttattggcagaggatacagcagtctgctgtatgacaaggaggacaatgaggagaagctcctgaaccagggccttcccgtcatcaaagacgaccgtgcactggctgatttcttcgggatcgagtacaagaagttaagattcttagtgtatcaccgcgatgtcgtgttggtggatcattataaccggtatacaattcccaagaaaaaggggggcgagcgcaacattgcagctcctaagctgattctaaagaacgtccagcgaaaaatcctcgaggagattctgtccaagatccaggtttctgactacacccatggcttcctgaagggaaaaagtgtggtgagtggggctaaaagccacattgccgacaaagcctcgggagaaaacacagctctgctgatcaacatggaccttgaggactttttcccgacgatcactttcgagcgggtgcggggcatgtttaaggccttcggttactccggatacatctcctcgctgcttgcaatgttgtgtacctactgcgagagaatgccaattgaagtgaagggaaaggtgaagtacgttaaaacctctgaccgcatattacctcagggctcaccagcaagccccatgatcacaaacataatatgcgtgaaactggataagagactcagcggcctgtccagcaagtacaattgtgtctatactcgttacgcagatgatatgtcattttcctttatggaagagtctagcgatttgaatcttgggaagttcatggggctgatttccaaaatagtaaacgaggagggctttaatatcaacaaaagcaagacccgattcctacggaaaaataacaggcaatcaattacaggagtggtaattaacaatgacgaaattggggtttcaaaaaagtggatcaaaactcttagggccgcgatttataatgccaataagctcaaaaactccggggaaaagatccctcagagcacgatcaatgagatatcaggtatggtgagttgggttcggtccgtaaacgagaagcgctatgctgatatcatagagtctggcatgaacctgattaatacctga

SEQ ID NO: 13592 - RNA, 1581 nt, unidentified
  source 1..1581: mol_type = other RNA; note = synthetic construct
atgatggaaaaccaggagacgtctaaaaataagcggcaggattacagagaaatcgtcaatcaaatgggcaaaaaagagttcaccctgcttaaaatgcaggagtatggattttggcctaaaaatttgcctaccccttacgagaggcaggagaacgagacacaagaagagtacgcgcaccgtaaatcgctgataaagaagtatgagaagatcattaagcagattagcgatctctacaacgagaaggacaagattaatcaaaaactacgcgaactgaagaagcgctacaacgagacatgggattatgaaaagatcaggagcgacgttgctaaggcaatcatggaggagtcaatcgccaggcggaaggaaagaaaagagaagcgagccttagagaaagaacagaagtctgaggactggaaaaaagaaaaggaacgtcgcattgtcttcattgggaaaggctacagtaactcactttttgacaaagaatctgataccgagcggctgctctctctcggccttccaataatcgaggacgataaagagctatctgagctgtttgagattgagtacactaaactgcggttcttagccttccacagggacgtggttactctagaccattatcacagatacacaattcccaaaaagaaggggggagagagaaatattgccgctcccaagagcattctgaagaatgtgcagcgcaaaatcctcgaaaaaatcctgtccaagattcccgtgagccactatgcacacggatttctcaggggacggtccgtggtgtctggcgcaaaggctcatgctatcgatgaaaaacacgttatcatagaggattcccgaatcagcaaaaacattgataccgaacgcagtgcccaagagcgggtaccgttgttgattaatatcgacatcgaagacttcttcggtaccatcacattcgagcgcgtccgaggcatgtttaagagctttgggtactccggatatgtaagctctttgctcgccatgttgtgtacgtattgtgaaaggatgcccatcgaagtccgtggggagatcaagtacgtgaaaacttccaataggatcttacctcagggttcaccagcttccccaatgataaccaacatcatatgcggcaaactggacaaaagactgagtggaatggccctgaagaacaactgcggctatacaagatacgcagacgatatgtcattttccttcaaacaggagatcaacaagcaggaactgagaaattttatagggctgacatcaaagattgtgatggaggaagggttcaagatcaaccataagaagactcatttcctgcggaataacaatagacagtgcatcaccgggattgtgattaataatcatgagatcggcgtgccaaaaaagtggattaagaccctgagggcggccatctacaatagtaagaaactcattaagtccggcgaaaaggttcccatgtcgaccattaacgaaatcagcggtatggtaagttggataaaaagcgtgaacgaagaacgatatgtcaacataattgaggagggtacaaaccttataaaggaacttacttacactccgtattcctga

SEQ ID NO: 13593 - RNA, 1563 nt, unidentified
  source 1..1563: mol_type = other RNA; note = synthetic construct
atgattgagaaccaggagacactgaaaaacaagcgccaggattaccgggagaaggtgaatcagatcgggaaaaaagagttcacgctgctgaagatgcaggagtacggattttggcccaaaaatctgccaacgccgtatgaaaaacaagaaaacgaaaccaaggaggaatacgcccagcgcaagaatctcataaaagagtacgagaagatcattaacgagatatcagatctctacggggaaaaggacaaaattaacgagaaactgcgtgagctcaagaagaagtatgacgagacttgggattacgaaaagatccggatagacgtgtctaagacaattatggaggagagcatcgcaagaagaaaggagagaaaagagcagcgagagctggagaaaaggcagaagtccgaagcctgggtgaaggaaaaggctaaggggatcgtatttatcgggaaaggttatagcaaccttctgtatgacaagcagaatgatgaggataaactattgtcccaggaactgcccctcatcgaggatgacaaggcactagccgagttcttaggaatcgagtataagaagttgaggtttttagtctaccatcgcgacgttgtgacagtggatcactatcatcgcttcagcatcccaaaaaagaaagggggcgagcggaatatcgccgcccctaagtctatccttaagaacgctcaacgtaagatcctcgaagagatcctatctaaggtcccggtgtcagactacgcccacgggtttcttaagggcaaaagtgtcgtgtcaggcgctaaggcccatgtcgctgctaaagcggacttgggggaaaaggcgagtggagtcgaaaagactcacgatgaggagaaagtaagcggtgaaaaaacccagctgctgattaacatggatctggagaattttttccccactattacattcgaaagagttcgaggaatgttcaaggccttcggctactccggctatatcgcatctttgttggcaatgatttgcacctactgcgaacgtatgccaatagaggttcgaggtgaaatcaagtacgttaaagcctcaaataggattctcccccaaggaagtccagctagccccatgatcaccaacatcatttgtgtgaaacttgataaacggctgtccggcctggcacctaagtacaattgtacctataccagatacgccgacgacatgtcttttagcttttgtgaagagaactcggacttaaacctgggcagattcatgggtctggtttcgaagattatcaatgaagaaggcctgaaggtcaacaagaaaaaaactcgcttccttcggaaaaataataggcaatgcatcacaggaattgtaataaataaccacgaagtgggggtgcctaaaaaatggattaaaactctcagggcagctatctataatgcgaacaagctcacccggaacggcgaagtcgtacctgccaaaacaattaatgaaattagcggcatggtgagttgggtgaagtccgtgaacggagagaggtattccggtattatagaggacggaatgaacctgattaataatatatga

SEQ ID NO: 13594 - RNA, 1578 nt, unidentified
  source 1..1578: mol_type = other RNA; note = synthetic construct
atgatagagaaccaggagaacactaagaataaacgacaagactaccgcgagattgttaatcagatgggcaagaaagagttcacccttctgaaaatgcaggagtacggattctggcctaagaacctccccaccccctatgaaaggcaggaaaacgagacgaaggaagaatatgctcaacggaaaagcctgattaaggagtacgagaagatcatcaaccagatttctgaactctacgagggaaaagacaagattaaccagaagctgcacgagttgaaaaaaaagtacgacgagacgtgggattacgagaaaattagggttgatgtcgctaaagccattatggcagagtcaatcgcaaggcgaaaagagagaaaagaaaagagggcacttgagaagcggcagaagggagaggcttgggaaaaaaggaaaagcgaaagtatcgtgttcataggtaagggctatagctccctattgaacgacaaggagaatgacaatgacaaactgctgctgcaaggtctaccaatcataaaagatgacaaagccctagccgaattcctcggaatcgagtacaaaaagttgcgcttccttatttaccatcgcgatgtggtcagcgtggaccactatcacagatttaccatcccgaagaagaaagggggagagagaaacatagccgctcctaagagcattctgaagaatgcacagcggaaggtcctggaggatatactttccaaaatgccagtgtctaactatgcccacgggtttttaaaaggcaagtctgtggtcagtggggccaaggctcatgtggcagagaaggggtatctgagtgaagagactgatatggtagaaaaagcgtttgtagtcgaaaaagtccatggcacagacaaagtttcatcagaaaatacacagctgctcatcaacatggacctcgagaattttttccccactatcaccttcgagagagtgcggggtatgtttaaggctttcggatattccgggtacatctcgagtctcctggctatgatctgtacctattgcgaacgcatggcgatagaagtgcgcggcgaaatcaaatacgtgaagacaagcaatcgaattctgcctcaaggctccccagcgagcccaatgataactaacattatttgcgccaagttggacaagaggctcagtggcctggcttacaagcacaactgtacatatacccggtacgcagatgatatgtccttttcctttaaggaggagagctcagatttgaatattgggcgttttatggggctcgtgtccaagatcgtgtctgaggaaggtctgaatatcaacaagaagaagactagattcctgcgcgagaacaatcgtcagtgcatcacaggcattgtaatcaataacgacgaaatcggagtgcccaaaaaatggattaagacattacgggccgccatctataatgccaacaagcttaagaataacggcaaagaggttcctgttaagaccattaatgaaatctctggtatggtatcttgggtgaaaggagtcaataccgaaagatacgccgggattatccgtgagggcatggaattaatcgattcatga

SEQ ID NO: 13595 - RNA, 1356 nt, unidentified
  source 1..1356: mol_type = other RNA; note = synthetic construct
atgatggataacaatgtgaacaatatagaccgcaaacaaaactatcgggaggcggtcagtgtaatggggaagaaagagttcacgctcttgaagatgcaagagtatggtttctggcccaaggacctgcccacgccttatgaaagacagaagtcagaaacccaggaggaatacgagaatcgcaaagccctactggaaaagtaccacaaggttataaatcagatcaatgacctatgcaaggacaaggaagatatcaacaacaagttaaaagggctgcagaaaaagtacgatgatacctgggactacgagaagatcaggaaagatgtggcccagacaatcatgaaggaatccattgagcgtagaaaggaggtcaaaatcctgagagagatcgaaaagaaagaaaagtctgatgcatggaagaagaataagagcgagaacatagtgtacatagggaaaggctactcaaagtggctttatctgaaagacactgacgaggagaagttgaaggaacatgagatcccaattataaaagatgacaaggagctggcacagtttctggggattgagtaccgacagctccgctttttaacttatcatcgagacgtggtgaaattcgataactataccaggtacaccattccaaaaaaaaaaggaggcgtgagaaacattgctgcccctaagaagattctgaaagacagtcagcgcaagatccttgatgaaatcctctgtaaaattgaggtgagtgaatctgctaatggatttattcagggcaaatccgtcgtgtctggtgccgagtcacacattgacaataaagttgaactcctcatcaatatggatctggagaattttttccctactatcacattcgaacgggtacggggaatgttccagaagcttgggtactcgggatatgtttcctccctgctggccatgatctgcacatattgtgagaggatggaaatggagatcaaaggtgaaaaagtgtacgttaagactacagatagaatattaccccaaggcgccccgtcttcccccatgatcacaaatataatttgcagcaagctcgacaaaaggttgaagggacttgcagataaatacggcctggtgtattcacggtatgctgatgacatgagctttagcttcggagaaggtaacattatcctgaacgctatcaacaagtacattaatctcaataccgataaggagaataaccaggacgacctgaatgtcggcaagataatcggcatcatcagcaagattatcaaagaggaggggtttaacatcaacaaccaaaaaaccaagttcttgaggaaaaacaaccgtcagagcattactggcattgtcattaataacgactga

SEQ ID NO: 13596 - RNA, 978 nt, unidentified
  source 1..978: mol_type = other RNA; note = synthetic construct
atgctgatttcttcaatcgaatataagcaacttcgatatctgacctatcatcgcgatgtcgttaaatttgacaactataatcgctacaccatccctaagaagaagggcggtgtgcggaacattgccgctcccaagaaagtgctgaagggcgttcagcggaagatcctggacgagattctcaagaataagattaagatcagcgactctgcaaacggctttatcaagggaaggtccatcgtcagcggcgcagagaagcacaaggattcaaatgtagaactcttgatcaacatggacttggaaaacttcttcccaactataacattcgagagagtgagaggaatgttcatgaagtttgggtattctgggtacgtgagctccctgttagccatgatttgtacttactgcgaacgtatggagatggaagtcaagggagaaaacgtctacgtgaaaacctctgagaggatccttccccagggcagtccagctagtcctatgattacgaatatcgtgtgctccaaactggacaacagattgaatggcctagcctccaaatacgagttcacctacagtaggtacgccgatgacatgagctttagctttaacaagggcaacaaagtgctggacgatgctaaagatagcctaaacgttggaaaaattctcgggattatatccaagatcattaaagaggagggtttctcgatcaatgaggagaagacaaaattcctgcggaaaaataaccggcaggcaataacagggatcgtgatcaataatggcgaaattggggttccgaagaaatgggtgaaaaatttacgcgcggccgtctttaacggatcaaaactcatcgaaaacggatctattcttccctgtgatctggtaagtgaaattaaaggtaagtccagctggctgtcatgtgtgaatcgagagaggtatctcaagataatagaggaatgcgagaagatcataagattcaaagggtga

SEQ ID NO: 13597 - RNA, 1509 nt, unidentified
  source 1..1509: mol_type = other RNA; note = synthetic construct
atgatagagaacaatcggaacaatatcgacaacaagcagaattataggagcgcagtgaatacaatgggcaaaaaagaattcacactgctgaagatgcaggagtatgggttttggcccgaaaatttacctacaccatatgaaaagcagagtaacgagtccccagaggaatttaaaaaacgtaaggaactgctggagaaatacgaaaagatcatcaacgacattaacgacttatacaaggagaaggacgtgattaataataagctgaccgagttgaaaaagaaatatgacgatacctgggattacgagaagattagaaaggatgtcagccaaatcattatgaaggagtcgattgagcggcgcaaggagatcaagaccttacgggccctcgagaagaaaaacaagtctgaggcctggcggaaaaagaaatctgagaacatcgtgtacatcgggaacggttacagtaaggggctgtacaagaaggataccaacgaagaaaagctgctgaaaattggactccccatcataaaagacgataaagagctgagcgaattgttgaatattgagtaccgacagcttcggtttctcacatatcacagagatgtggtgaagtttgataactacactaggtacacaattccaaaaaagaaaggtggcgaacgcaacatcgcagccccgaaaatgatcctaaagaacgcccaaagaaagattcttgaggagatcctgtacaaaatacaaatctctgaagatgctcacggctttgtcaagggcaaaagcatcgttagtggtgcttccgtgcataccaaaaatagcgacatcgagctccttattaacatggatctcgaaaatttcttcccaaccattaccttcgaaagggttaggggaatgtttcagaacttcggctattccggctacatagcgtccctgcttgcgatgatctgtacatattgcgagagaatggaaatgaaggtcaagggagaaactgtgtatgtaaaaacgtcagaccgtatcttgcctcaggggtcccctgcctcacctatgatcactaacatcatatgtagtaggctggacaaacgcctaaacggactggccctaaaatacgatttcatatactcccgatatgctgacgacatgtcattttcatttaacaaagggaacatggtgatggaggagaatgagcatattaacgttgacaagatactcggaattattagcaagatcattcgcgaagagggcttcgctgtgaataacaagaagacgaaattcctccgaaataataataggcagtccataactggtatcgtcataaatgggactgaaattggcgtccccaagaaatgggttaaaaacctgagagcagctatctataatgcatctaaattgaaggagtgcggcagcaatatcccctctgatgtgattaatgaaatcaaaggaatgaccgcctggctggagtgcgtaaataaggaccgctactataagatcattatgaagtctaaggagcttttcgaatga

SEQ ID NO: 13598 - RNA, 1467 nt, unidentified
  source 1..1467: mol_type = other RNA; note = synthetic construct
atggacaccaagtctgaataccggaagttaattaatgagatgggtaagaaagagttcactttcctaaaaatgcaagagtatggcttttggcccagtcatctgcctacgccgtatgagaggcagcagaacgagacagagcaggactttcagaatagaaaaaagctgctcgatgaatttcagaaactgagcgaacagattgcccaagcctataaggagaagcgagaaattgaaattaagctctctagcctacagaaacagtaccaggatacctgggactatgaaaagatccgcgctgttgtctcccaagagataatgaaggcaagtatcgcccgcagggctgagcgaaaggcagaacgtcagagacagaaacaactgaaaacagagcagtggcaaaaacgcaaatccgaaaatatactgttcattggccggggctacagcaacattttgcacaaaaaacagacagatatccaaaaactgaagcagaataaccttcctatcctcgaaactgacaaggacatcgcccagttactgcaaattgagtattcaacactgcgctacctcgcttaccacagggacgtcgttacctttgacaattactataggtttgatgtgcctaagaagtcgggcggaatgagacatattgctgctcctaaaacacagctgaagacagcccagaagcagatattggaaaaaatcttggagaagacagaaatatcggatgtggctcacgggttcatcaaatctaaatcagtgcttaccggagccaaagcacaccaaactagtccagaccttcttatcaacatcgatctagagaacttcttccccaccataactttcgaaagggtgcggggcctgtttcaatatctggggtatagcgggtacattagctccatcctcgccatgatctgtacctactgcgaacggatggcggtggagattaagggtgagactaagtatatcaagacctcagagagaatcttaccacagggatcccccgcctccccaatgattactaatatgatctgcaagcgtatggacaagcgaattaatggactctgtcagaagctgggcgtaatttacaccagatatgcagatgatatgtctttttcttacactggggaacttgagaattttgcaatcgggtctttcctcaatagcattcagaagattattgaagcagagggattccatataaacaaacagaaaacgcacattctgaggaaacataaccggcagtacatcaccggcatcgtgataaacaatgcggagatcggagtaacgcgcaactggatcaagattttgagagctagtatccacaacgcccaaaaattgaagaatgccggtgaagcgatacccaaacagaccaagcaagagatatcagggaaaatcgcctggctgaagtccgtcaacgagacacggtaccagaagatcatccagcagggcaagcagctcctgcagaacagctga

SEQ ID NO: 13599 - RNA, 1464 nt, unidentified
  source 1..1464: mol_type = other RNA; note = synthetic construct
atggacactcggagcgagtaccgaaaattagtctccgagaaaggaaagaaggaattcacatttctcaagatgcaggagtatggattctggcccagtcatctcccaaccccttatgaaaggcaacagaatgaaaccgaagaggacttcgagaaccgcaagaaacttctggatgagtttcaaaaactgtcggatgtcatctcaaaagcatatacagaaaagaacgagatagagaagaaactgttctctctgcaaaaggagtaccagaatacatgggactatgaaaaggtgcgcgccgtagttgctcaggaaattatgaaagaaagcattgcaagacgggccgaacgtaaggcggagagagagcgtcaaaagcagttgaagaccgaggcttggcagaaaagaaaggccgagaacatcctctttataggacggggttattccaacattctccacaaaaaggagacggacgtggctaagctggaacagcagaagcttcctatcatacagaccgacagggagttggcaaataccctgggcattgaatataatactctcaggtacctggcataccacagggatgttgtgacgtttgataattactatcggttcgacatccccaagaagtctggcggcactcgccatatagctgccccaaaaatccagctgaagatggcccagcggcaaatcctggagaagattctccagaaggttgagattagtgatgtggcacacggatttgttaagtcaaaatccgtgctcacaggagctaaagtacaccacacctctcccgatctgctgattaatatggatttggaaaacttcttccccacgatcacattcgagcgcgtgcgcggtctataccagcaccttggatacagcggttatattgcctccctactcgcaatgatctgcacctattgtgagaggatgccagtcgagattaaaggggaaaccaaatacattaagacttccgagcgaatactgccacaaggcagtcctgcgtcacctatgatcaccaatattatctgtcatcgtatggacaaacgcatttacgggttatgccagaaactgggtgtgacttatacaagatacgctgatgacatgtcattttcctacatcggggaattggaaaatttcgccatcggcagctttctgaacagcattcagaagatcattgagtctgaagggtttcacatcaataagcagaagactaacatccttcggaagcataacaggcagtacataactgggatcgtcatcaacaacgacgaaatcggcgtggcccgaaagtgggtgaaaatcctaagagccagtatacataacgctcagaagttaaagaacgcgggggaggctattccgcataaaacaaaaatggaaatcgccggcaaaattgcctggcttaaaagcgtcaatgagaagagataccacaaaatgatccagcaaggcatggagctgttgaaatcttga

SEQ ID NO: 13600 - RNA, 1470 nt, unidentified
  source 1..1470: mol_type = other RNA; note = synthetic construct
atggaccgaaaagctgagtatcgtaatttggtaaagaacatgggtaagaaggaattcaccttcctgaagatgcaggaatatggattctggcctgaaaaccttccaaccccatatgagcgccaacagaatgaaacagagcaggattttgagaatcgcaagaaactgttagacgaatttcagaagctctcagaaaagatcagcggagtgtatcaggagaaatcggagatcgagagaaagttaagccaactgaagaaggagtaccagggtacatgggattatgagaggatccgggccgccgtcgctcaggaaatcatgaaggagtcaattgctcgccgtgcggagaggaaagctgagcgggagaggcagaagcagctaaaatccgaggcctggaaaaagagaaaggccgaaaacattatattcataggaaaggggtacagcaatctgctgggcaaaaaggaaactgatgtccagaaactgaaagagaaccaaatgcctgtgatcgagacggaccgcgagctcgcacggtttctgcagattgaatacaatacactcaggtacctggtctaccaccgggacgtcgttacgttcgacaactactaccgatttgatattcccaaaaaaagtggcggcatgagacacattgccgcccctaagacacacctgaaaactgctcagagacaaatattggaccaaatactccagaaggcaggaatcagcgatttgagccacggtttcattaagtcacggtcagtgctaaccggagcgagagcgcatagtacatctcccgacctgctgattaacatcgacttggaagatttctttccaactataacattcgaacgagttagggggttataccagtcctttgggtattccggttatatcgcatcccttttggcaatgatttgcacttattgcgaacgcatgcctctggagatcaagggcgagactaagtatattaagacctctggaaggatactgccgcaaggttctccagccagccccatgattaccaatatcatctgtcggaacatggacaagagaataaatggcctttgcaaaaaacttgggatcacttacaccagatacgccgatgatatgagcttttcctacatcggagacacttctggatttgccatcggctccttcctgaattcaattaatacgattatcgaggccgaagggttccacatgaaaaaagagaaaacccatatcctacgacggaacaaccgccagtatattaccgggatcgttattaataacgaagaaattggggtgcccaagaagtgggtgaaaatcctcaaggcttctatacataacgcacagaagcttaaagctagtggcggctgtgtgagtaacaagacaatcaatgagattagtggcaaaatcgcctggctcaaatccgtaaacgcaaagaggtaccagaaagtgatcgatcagggcaccgagtttctcaagtctctgacctga

SEQ ID NO: 13601 - RNA, 1470 nt, unidentified
  source 1..1470: mol_type = other RNA; note = synthetic construct
atggacactaaggccgagtatcgggagctcgtgaacaatatggggaaaaaggaattcaccttccagaagatgcaggagtatggattctggcccagccacttacccactccctatgaacgccagcagcacgagacacaagaagattttgagaaacggcagaagctgttgggcgaatttcaggagctctctgagaagatcgccggcgcatatcgcgaaaagaccgagatcgagaagaagctttcacacctgaaaaaagcctacgaagggacctgggattatgaaaaaattcgggcagccgtggctcaggacattatgaaggagtccattgctaggcgtgcagagcggaaggctgagcgagagcgccaaaagcaactgaaatccgaggcttggaataagagaaaggcggaacagattctttttataggcaagggctactcgtctctactcggaaagaaagaaactgatactgagaagctcaaagcactccagatgccggtcatcgagacggaccgagagcttgcaaatgccctggggatcgaatacagtgcactgagatatctggcttaccatagggacgttgttgcattcgataactattacaggtttgagattcccaaaaaatccggtggcacaaggcaaatcgccgctccaaaaacccaactaaaagcagcccagaaacagatcttaacacaaattctgcagaaggccgagatctccgacaagagtcatggttttgtaccatctaggagcgttctgacttcagcgaaaacccactccacttcacctgatgtgctcatcaatatcgacttggaaaacttcttcccaactatcaccttcgcgagggtgcgggggctattccagtcgttcggctattctggttacaccgccagccttctggccatgatctgcacatactgcgagcgtatgcctctggaagtgaagggcgaaatgaagtacataaaaaccagcggcagaatattgcctcaggggagccccgcctctcctatgatcacgaacatcatttgtagaaacatggacaagcgcattagcggattatgtcaaaaattgggtgtgacatacacccgatatgccgatgacatgtcattcagttacaccggaagtgaagatgggctggccataggcagttttctgaactccctgacaaagatcatagaggctgagggatttcatatcaagcaggagaagactcatattcttcgtaaaaataaccgccagtatattacgggtattgtcattaacagcgaagaaattggcgtaccaagaaagtgggtcaaaatcctcaaagcgtccatacacaatgctcagaaattgaaggaatctggggggtcagtcccgaataagaccatctacgaaatctccggaaaaattgcttggctgaagagcgtgaatgctaagagatacgagaagatcatacggcagggaacagagtttctgaaaacactcgcctga

SEQ ID NO: 13602 - RNA, 1464 nt, unidentified
  source 1..1464: mol_type = other RNA; note = synthetic construct
atggacacaaagagtgaatatcgaaaacaggtgaatgagatggggaaaaaagagttcacctttttgaagatgcaagagtacggtttttggccctcacacctgcccacaccatatgagcggcagcaaaatgagtcggcagaagactttgaaaatcgaaagcaacttctggacgctttcgagaaactgtctgagcagattgcacaagcctaccagaagaaacaggaaatcgagaaaaagttgtcctcactcaaaaagcagtaccagaacacccttgactatgaaaagattaggagcatagtggcgcaagagatcatgaaacaatccatcgcaaaaagggcagagagaaaggccgagagagaaaagcagaaacaactgaagtctgaggcatggcagaagaagaaggcagaaaccatcgtgttcatcggcaaagagtactcttcactgctcgccaaaaaggaaactgatatccaaaagctggaaaaaaaccatctcccaataatccagacagataaggatttagctgatctactgcagattgagtacaaaacccttcggtacctggtctatcacagggacgtcattacttttgacaactactatagattcgacatcccgaagaaatcgggaggaacacgtcatatagctgctccgaaaacacatctgaaaactgcgcagagacaggtactagaacagatactgcagaaagtcgaagtgtctgatgcggcccacggattcatcaagagcaaaagtgttcttacgggagctaagatgcaccccacctccccagatctcttgattaatatcgatctcgaggacttctttccaaccataacctttgagcgggtacggggcatgtaccagtcactggggtatagcggctacattgccagcctcctcgctatgttatgtacatattgtgaacgcatgcctttagagattaagggggagataaagtatatcaagactagccagaggatcttgccccagggctctcccgccagtcctatgattaccaacatcatttgccagaagatggataagcgcattcacggcctttgcaagaagctcggtttcacttacacccgttacgccgatgacatgtccttcagctacacaggacagactgacaatctagccattgggagcttcctgaactccatccacaaaatcatcgaatccgagggatttcatatcaagaaagagaagacccatatcctgaagaaaaataaccgccagtacatcacaggtgttgtgattaatcacaaagaaattggtgtgcctcgcaagtgggtgaagattctgagggccagtatatataacgcacagaagctgaagaacgccggcacagctgttcctactaagacgaagcaggagatcgctgggaaaattgcctggctgaaaacggtgaatgaaactcggtatcaaaaaatgattcagcagggcaccgaactgttgaaacactga

SEQ ID NO: 13603 - RNA, 1464 nt, unidentified
  source 1..1464: mol_type = other RNA; note = synthetic construct
atggacaccagaacagagtacagagaacaagtcaacaaaatggggaagaaagagttcacattccagaagatgcaggaatatggtttttggccctcacacctccctactccatacgagcgacaacagaatgaaaccgaagaggactttgaaaatcgtaaaaagctcctggatgaatttaacaaactcagtgagcagatttctgaggtgtacaaggaaaagcgggagatagacattaagctctctagtctgaaaaaagagtatcaggacacctgggactacgagaaaatcagagccgttgtgtgtcaggaaataatgaaagagagtatcgctaggcgcgccgaacgcaaagccgaacgcgaaaggcagaagcagcttaaatcagaggcctggaacaagaagaaagcggagaatattatcttcattggacgcggctactccgggcttttaagccaaaaggaaacaaatatcgagaagttggagaagaacaatttaccgatcatcgagaatgacaaagatctcgccactctgctccaggtggaatataaaacactgcgttatctgacttaccatagagacgtggtgacctttgacaattattaccgttttgacatacctaagaagtctggcggtaaacggcacatcgctgcccccaaaaccgaactgaaaaaagcacaaagacaaatcctggaggagattttggagaaaattgaggtgagtgagtttgctcacggctttatcaaatcaaaaagcgtagtcacgggcgccaagttccataagtctgggccggatctcctgatcaacatggacttggagaattttttcccaacgatcacattcgaaagggtacgaggattgtttcagagcctgggttactcgggctatatttcctccctactggccatgatttgcacctactgcgagcggatacccgttgaaatcaagggagagactaagtacatcaaaacgtccgagcgcattctaccccagggatctccagcttcccctatgatcacaaacatcatatgcaacaagatggataagcgaatcaacgggctttgtaaaaagttgggattcacctatactaggtatgcagatgatatgtcattcagctatattggcgatacagaaaatctggctgttggtagcttcctgaacagcattaaaaagatcatcgaggatgaggggttcaacattaagaaggaaaagacccatattctgcggaagaataaccggcagtacatcactggcatagtcataaataatgaggagattggagtccctagaaagtgggtggatattctgcgggcgtcgatacacaacgcagaaaaactgaagaactccggggaatctatcccaaaagaaaccaagatggagatcaagggcaggattgcatggcttaagagcgtgaatgaggagaggtacaagaagatcattgacaagggccttaaattactagaaaactga

SEQ ID NO: 13604 - RNA, 1488 nt, unidentified
  source 1..1488: mol_type = other RNA; note = synthetic construct
atgatcgatcagactcactcacagaatcagcggcagagctaccgatccgaggtgtcccaaaaaggtaagaaggaattcactctcctgaagatgcaggagtatgggttctggcccaagaacctgcctaccccttatgagaaacaaaaggcagaaactaaggaggactacgaaaagcggaaggccctcctgaaggaatatgataaactgtccaatgacctagccaacctttatggcgaaaaggaagccatcaacctcaagttgcaagagctcaagaagaaatataccgcgacctgggactacgaaaaaatacggcaggacattgcgaaaacaatcatggccgagtctatcgccagacgagctgagcgcaaaaaagagcgggaagtggcacaggcagagaagtccgcagcctggcagaaggccaaaaccgagaacattgtattcatcggaaagggatatagcagtggtctgcaggataaactcacacacacctctaaattggagtcattaggactccccctgattgagacggatcatcaactggcatcatttcttggcctgacctacacagaactgaggttcctcacatatcaccgtgacgtcgtcacaagcgaccattactatcgatacgagatccctaaaaagaagggcggcttcagacagatagcagccccgaagccactgcttaaacaagtccagagaaagatacttgtggagattctggaaaagctacccattgccgaagaggctcacggctttatcaaaaataggtctgtggtttcgagtgcagaagcccacattaaggctccaaccctgctgatcacgatggatctggagaacttttttccgactttaactttcgagcgcgtgagggggatgtacaagtcctttggttactcgggatacatcgctagtcttctggctatgttgtgtacttactgcgaacgcatgaccatagaggtttctgggaccactaagtacgtgaagacctccccaagaatccttcctcagggcagtcctgcttcccccatgatcacgaatattatctgcaagaatttggaccataggctgaaagggctgagtgccacctaccagctcacatacagcaggtatgcggatgacatgtcattttcatataacgaagccgaggagaatcttaaactgggacagttcttagggctggtgagcttgatcgtggaggatgagggcttccacattaaagcctctaagacaaaaatcctaagaccccataaccggcagtgtttgactggaattgtaatcaacaacgaggaaattggggtccccaaaaagtgggtgaaaaatctgcgtgctgctatccatcacgctaagctcttgaatcaaacgggccagccaattcccacatccctcagccaggaaattcagggcaagaccagctggctgaaatctgttaacccagagcgctataaaacaataattgaagcgggtttaagcgtcatagcacacttttga

SEQ ID NO: 13605 - RNA, 1515 nt, unidentified
  source 1..1515: mol_type = other RNA; note = synthetic construct
atgatggacagttctagtgcaaaacgggagaactatagagacatggtcgggaagcttggtaagaaagagtttactctgctgaagatgcaagagtacggattctggcccaaggatctcccaactccgtatgaaatccagaaaaacgaaagtcctgaaagctacgcgaaacggaaaaaactccttaaggagtatgagaagattattgacaacatcgccaaggtatacgaagagaaggataccatcaacgacaaactgaaggaactgaagaagaaatacgatgagacatgggattatgagaagatcaggctggatgtggcccagcaaatcttcaaggagagcattgagcgccgcgagaatagaaaacgactgaaggaggaagagagaattaagcgcagcaacatatggaaacagaaaaagtccgaaaacattgtattcatcggcaaaggatactctaatctgcttaaggataaggagtccaacaaggataagctgctaaagaatggactcccaattattgaggatgataaggctctggccgaatttctccgacttgactactcccagctcagatttcttgcgtaccacagagacgtgaccacctgcgacaactattacaggtatatcgtccctaaaagaaatggaaaactgcgcaatatcgccgcccccaagtctgtgctgaagtttagtcagaagcgcattctcgaagatattctggggaagttagaggtgtcaaaaaatgcacacggttttctgaaggagaaaagtgttattacaggcgccttggctcatggcactgggattgacttgttgatcaatatggacctggaagatttcttccaaaccatcacgttcgaacgtgtgcggggcatgtttaagtcttttggatactcgggatacataagctcattactcgctatactctgtacatattgtgagcggatggagatcgaggtcaaaggcgaaaagaaatacgtggctacaagcaggagagttctgccacagggtagccctgcatctcctatgatcactaacatattatgcctccggctggacaaacgcttggagggtttggcctcaaaatacggatttctgtatacaaggtacgccgatgacatgtctttttccctggaagacaaaagcaaactactacttttcaaggaggaaaaagtcgacaaggagtccgaaaataaggaaattaacaagttcttgggcttggcatccaaaatcatcatagaggaggggttcaagattaacaaatcaaagaccaagttcctgcgtaagaataataggcagtatattacggggatcgttattaacaacaaggagatcggggtgcccaaaaaatgggtgcggaaccttagggcaaccatacataatgcctccaaactgaaaatcaatggcgacattcccgacgaactcgtgaatgaaatcagcggcaaggttgcgtggttaaggtcagtgaacggcgagcgatataaggctatcatagaaaaagctatggaagtcatcaaatga

SEQ ID NO: 13606 - RNA, 1491 nt, unidentified
  source 1..1491: mol_type = other RNA; note = synthetic construct
atgatcgagaatcgacatcagtctactgccaattacaggaaaagcattgagatcatgggtaagcgcgagttcactctcttgaagatgcaagaatatggattctggccaaaaaatctgcctaccccttacgaacgccaagctaacgagtccgaggaggaattcgaagcccgccagaagctgacaaaaaagtacgaaaaactgggggaggacatagccaaactgtacgaagagaaggagaagatcgaagaaaagctcagacagctgaaaaaggagtacaatgatacatgggaccttgataagattcggaaagatgttgctcgcaaaattatggaggagtcaaaggcccgtcgtgctgagagaaagagacaaagagagctggagaagaaacaaaggtcagaggcatggaataagcgtaagcaggaggaaatagtgtttatcggaaaaggttatagccagctgctgcagcagcgggaaagcgatgacgataaactctccaaacttacgctccccattgtcaagactgacagggagttagccgagctcttgggaattgaatacgcgcagctgcgcttcatcacctaccaccgggatgtggttacagaagaccactatcaccggtatgccgtgccgaaacggaagggcggatatagaaacatcgccgcacccaagccaattctgcgaaaggctcaacggaagatcttggacgaaatactttgcaagattcccgtttcagattgcgcccatggcttcatcaagggcaagtctgtcgtgtcaagcgcgagtgagcatatcgggagtccagcactggtgattaacatggacctggaagattttttcccgacaatcacctttgaacgagtgcggggaatgtttaagagtttcggatatagcggctatatagccagcctactcgcaatgatatgtacctactgcgagaggatgccaatggaggtgaagggggaaaaaaggtacgtacgaacatcccccagaattcttcctcaggggtcccctgcttcatcgatgattagcaacatcctctgcattaagctggataagagactgagtggcctggccaaaaagaacaactttacttataccaggtacgcggacgacatgtcgttttccttaaagggggaagaaaagattaaattaggcagtttctgtggtctggtgagcaaaatcgcctctgaggaagggttcaagatcaataaatctaagacgcggtttttgagggctaacaacaggcagtccattaccggcattgttgtgaacaacgaaaagctagctgtccctaagaagtgggtcaaagtcctccgcgcagcaatccacaacgctaaaaaagagaaagagaaaggcgagcttgctccccagactatcagaaaaatctctggtatggccgcctggttgaaatctgtgaatgaggaaaagtacaagaaaatcatctccgaggcaaatgagctaataaatcgctgtcagaaatccgacgtatga

SEQ ID NO: 13607 - RNA, 1482 nt, unidentified
  source 1..1482: mol_type = other RNA; note = synthetic construct
atgaccgaaaacaacgagctcctgcagaataaaaaggcagattaccgcgagtctgtcaataacatgggcaagaaggagttcacattgttaaagatgcaggaatacgggttttggccaaaagatcttccaacaccctacgaacggcaagacgatgagacgcccgaacagcataaggaacgtcagacactgctcaaggagtaccaaaaaatcatcgacaatattgccaaactctatgaacagaaggacgaaatcaacaagagattccaagagttgcgtaaagagtacgatgaaacatgggatgtcgacaaaattcggctggacatctccaagaagatcatggaggagtccatcactagacgatccgaaaggaaaaaaagaaaggaactggaaaagcagcaacaggcggagatctggcagaaaaaaagagccgaggagatactgttcattggtaagggctatagccagctgttacaggatcgatcaagcgatgacaacaaactctctacccaggggctgccactcataaaaaccgacaaagaattggccgagtttctgggggtggagtacaaacaacttaggtttctggtgtaccaccgcgacgtgatttctgtagaccactatcatcgatataccgtgccgaaaagacggggcggagtaaggaacatcgctgccccaaagcctatgctcaaaacgattcagaggaagatcctggaggagattcttagtaagcttactgtttcagagtacgcgcacgggttcttgaagggcaaatcagtcgttagcggcgcccaggctcacattggacagcataccctgctcattaatatggacctggaaaacttctttcccaccatcacttttgagcgagtaagggggatgttcatggctttcggttactccggctacattagctctctattagcaatgctgtgcacttattgcgaacgcatggcaatagaggttcggggcgagatccggtatgtgaaaactagtcctagaattctgccccaagggagccctgcttctcctatgataaccaacatcatctgcgtgaagctggaccggcgcttgagtggattggcagaaaggactggatacatctacacacgttatgcagatgatatgtccttcagcctgaaagaggaaaattatatggatgaaggtaagctatgtgggctcgtgagcaagatcgtcaacgaggagggatttaagctcaacaagacgaaaacccgcttcctaaggaagaataacagacagtgtatcacaggcattgtgataaattcagagcagcttggtgtgcccaggaagtggatacgggcctttcgcgcagctgttcacaatgctaataagcttaaactgaccggaacagtgccgtcgaaggtgaagaacgagatttccggcatggccgcctgggccaagagtgtcaatgctgaaagatataaagaggtcatcgcggccgctatcgccgtgattcaggactga

SEQ ID NO: 13608 - RNA, 1539 nt, unidentified
  source 1..1539: mol_type = other RNA; note = synthetic construct
atgatggacaacaatatcgaacgggaccgcagggctgagtatagagataatgtgcagtcaatggggaagaaggagtttaccatctacaaaatgatcgagtacggcttttggccaaaagggctgcccactccattcgaaaggcaggcgaacgagacacctgaacagtatcaagagcggcaacgactcttctctgagtacaagaaaattgcagatgaaatcgccaaagtctacaaagagaaaagcgagattgacacaaaactgagagagctcaagacccagtacaacggatcatgggatgaggaaaggattcggaaggatatagctcaacgcataatgaaggagagcaaggaaagacgggaacagagaaagaaacaattagagctggccaaagaacaaaagtcctctgcctggaaaaagaaaaaggaggactctatcgtttacattgggaacgggtattcgtcaatgctgcattataaatccggtaatcaggatcgtctggttgcaaatggcttgcccatcatcaacactgatcgcgagctagctgatttcctgggcgttgaatatagagcccttcgcttccttgtgtatcaccgggacgtagtgacgatggatcactaccaccattacaaagttccaaagaggaagggaggcacgcgaaacatagcggcgccgaagaaggtgttaaaaaacgtgcagaagaagatcctggaggggattctggaaaagctggcttgtcaggataatgactgcctcggaaataataggttttcgaatgcatgtagtgacaacgcgcacggctttataaagggacgttcagtggtcacgggcgccgacatccatgtgaaatcccccgctctcttgataaacatggacatagaggacttcttcccaactattactttccagcgagtgaggggtatgtttgtcggatttggctatagcggctacattgcaagcctgcttgcaatgctctgtacatattgtgagcgtatggaaatcgaagtgaatgggaagaggaagttcgtcgccaccaccggcagaattttgcctcagggaagccctgccagccccatgataactaacatcctctgcaggtccttagacaagagactgaatggtctggctagtaagtttggctttatctataccagatacgccgatgacatgtcttttagtacaaaggaaaccgtgctggccgatgctggcaaactatgcggacttgtgaccaagatcatcagtgatgagggattcaagctgaacttcaaaaagactcggttccttaaaaagaataactgccagagcattaccggtgtcgtagtgaattctcaccagttgggtgtctccaaaaaatgggttaagacattgcgcgcagccatttacaatgctcgcaaagcaatggccaaagggaaagtaccttacgaaatcgtctccgagatctccgggatggccgcttggctgaaatgcgtgaacgaggaacgatacaagtctattattacagacgcctatgacctcatccgggacatcaacaagattatttga

SEQ ID NO: 13609 - RNA, 1485 nt, unidentified
  source 1..1485: mol_type = other RNA; note = synthetic construct
atgatcgaaaacaatcgtgtacctaaggacaaaaaagctaattaccgtgagctggtgaatcagatgggaaagaaggagttcactctcctaaaaatgcaggagtacggcttttggcctaaggatctacccaccccatatgagatacagaaaaatgaaacaccggagcgctacgcaaaaagacaaggtcttcttaaggagtaccaaagactgatagaccagattgccaaactttacgaggagaaggacgatattaacaagaaactgtgggaactcaagaaggagtacgacgacacatgggacctggagaaaattcggttagatattagccagaagatcatgcgcgaatccatcgaacgcagagctgagagaaaaaaacagcgagagctcgaaaagcagaaaaggtcactggattggcaacagaagaaaagtgagcagattgtgttcattggacgtgggtattctagcctgatgaacgatacgcaaattgacgaggaaaagctgaagacgcaggagcttcctatcatcaagacagatcgggacttggcagaggtgcttgggatcgactacccatccttgcggtttctgacctatcatagggaagtcgtgtctgttgaccactatcaccattttaaaatcccaaagaagaagggcggcgaaaggtcaataagcgcacccaagtccaagctgaaaaccgctcagagagctatcctcgagaagatactctccaagctgaacatcagtgatcaagcgcacggattcttgaaggggcgctccgtcgtgtcaggagcccaaacacatatttctcagccagcgctcttgatcaatatggacctcgaggatttcttccccactttaactttcgaaagggtgctgggcatgttcagggcctttggctacagtggctatatctcttccttgattgcaatgctgtgcacctattgtgagaggatggaaatcgaagtaaaaggcaaaccgaagtatgtcgccacatccaagcgaattcttccccagggatctcccgcgtctcctatgatcaccaacatcatatgcagggatctggacaaaagactgaacgggctggctaagagctttggctttatctacacccggtacgccgatgacatgagctttagtattaatgaggtgagtgatctcaacgaaggtcgcttctgtggcctggtttcgaaaatcgtatcagaggaagggtttaagataaacaaggcaaagacccggtacctccggaaaaacaactgccagagcgtgactggtattgtcgttaataacgaccagttagccgtgcgcaaaaaatgggtcaagcgattccgggctgccatttataatgctagaaagcagaaagccgcaggggagctatcaaacgccactaagaatgagatcagcggaatggccgcctggctgaaaagcgtgaatgaagaaaaatatcgagacatgatcggtgctgtgatggatattgttaaagaagattga

SEQ ID NO: 13610 - RNA, 1461 nt, unidentified
  source 1..1461: mol_type = other RNA; note = synthetic construct
atgaccgaaaacactaaacaggactataggacgctaataaatcagatgggcaaaaaggagtttacaattatgaagatgcaggaatatggcttctggcctaaagatctccctacaccatacgaaaaacagctgaacgagactccggagcagtatagtaagcgaaaagcactcgttgaggattacaagtcaatcattgaaagaatctccaagctgtacaaagagaaacaggagattaatgacaaactgcgggatctgaggaagaaatacgacgagacatgggacattgaacggattaggaaggatattgcgcaaaccatcatgaaggagtctatagcgcgacggacagaaaagaagaaacaaagagaactcgagaaacatgctaaaagcgaagcatggaaaaagaaaaaggccgagcagatcattttcataggtaaaggctatagctcctttctgtacgataatgaaactgatcagcccaaactcgagttacagggtcttcccgtaatcaagtccgatattgatctggccaactttcttgagatcgactataagaagctccggtttttgtcataccacagggacgttgtcaccgtagaccactatcaccgttacaccatcccgaagcggaaggggggaatgcgtaacatcgccgcacccaagcccatcctgaaatccgtgcagcgcaagattctggaggacatattgaataaattcagtctgtcccagcaggcccacgggttcatcaaggagcgttcaatactgagcggcgccctggcacataatatccaacctgctttggtgataaacatggacatcgagaatttctttcctaccatttcattcgaacgggtgcgcggaatgttcaaatctgctgggtacagtggttttataagctctctgctcgcaatgctgtgtacgtactgcgagagagtgtccattgaggtcaaaaataaaacccgctttatcgctaccacgaagagaattcttcctcaaggaagcccagccagccccatgattaccaacattatctgccgacggttggatcaacgcctaaacgggctggccagcaagtttggtttcacatacactagatacgccgacgacatgagctttagtatcaatgatgaaacaaacgtgaaggtgggaagattctatggcctcgtttctaaaatcgtgaaggatgagggctttgagattaacaaggaaaagactcgcttcttacgcaagaacaatcggcagtctatcacaggagtcgtggtgaacaatgagaagcttggggtcaataggatgtggatgagaaggttcagggctgccatccataacgcctccaaattaagaagtaatggcgacctgccaatcgaagtgaagcgcgaattgtcaggaatggcttcttgggtccgatcggttaacccagaaaggtataaaaagcttattgaaactgcgatggaggtaatcaagtga

SEQ ID NO: 13611 - RNA, 1491 nt, unidentified
  source 1..1491: mol_type = other RNA; note = synthetic construct
atgaccgaaagcaacgacattcagaagaggaccaagtccgattatcgggaaatgatcaataagatgggtaagaaggagttcacgctcatgaaaatgcaggaatatggcttctggcctaaggatttgcctaccccttacgagagacaggagaatgagacaaaggagcattacgaggctcgcaagcaactacttaagaaatataagggaatcgtcgatcagattgcagacctgtaccaggaaaaggctgacattaacaagaaactgcgggacttgcagaaacagtacgacgaaacttgggatattgaaaaaattcgcaaagacgtagccaaacagatcctcaaggagtcagtgacaagaagggcagaacgtaaacggcagaaggaacttgagaagcaaaggcgatctgaggcctggaaaaagaaaaaagccgagacgatagtgtttctggggaagggatactcatcttttctgaatcactttgaaaccgatgaaagcgcgctgcagagttttcagttgcccatcataaaaaccgacaaggacctcgccgagttcctgaacatcgactacaaaaagttacggttcatcacctatcaccgagacgttgtcgacatcgatcactactttcgttacactatacccaaagcctccggggggaaaagactgatcgcagctcccaagaacatcctgaaatcggctcagagaacaatcctgaacgacattctcacaaatattccaatagacgagcacgcccatgggttccttcagggcaagagcatcataactggagcaaagtctcatccaatccaaccggagctgttaataaacatggacttggaggaattcttcccaagtatcacatttgaacgtgtccgaggcatgtttcattcttttggctattgcgggcatgtgagcactctgctggccatgatatgtacttactgtgaacgaattcctctcgaaatcaaggataaagagaagtatgtggccgttagtaagagaatactaccacaaggctcccctgctagccccatgattacaaacatcatttgctataagctcgatcggcgcctttcaggactggcaaaaacctttaatctgacttactcccgctatgcagatgatatgtcattcagccttaaggacaaaaacgaggcggaggtgaatatctctaggttcctcggcctggctatgattatcattaaggatgagggtttcaagattaatcacaataagacacggtttctgcgccagaacaatagacaggcaatcaccggaattgtgatcaacaaagataggatcggggttccaaggaaatggatcaaacagttcagagcggctatttataacgccgagcaactgcaaacgaatggtggcttgccgggcgaaattaagagggagatcgccggaatggcctcctgggtaaaatccgtgaatcccgaacggtacaagaaatacttaacccgcgctcacaacctcctaagtgagaaatga

SEQ ID NO: 13612 - RNA, 1350 nt, unidentified
  source 1..1350: mol_type = other RNA; note = synthetic construct
atggccatccagcgtcagaccgaccccagcgacttgtggagggccataatccaagcgggcggaatccagccctacattgatgctcagctcgctgagcgcggctttctggtggccagaagggagacagacggcctgagtgagcgggaactggccgactacaagaagtccctcaaagccgaggcccaggagagagcacgactgagacgggaagcatgggccgcataccgggcagagcatattgtccacctgggggatggagtgtactggaacgacgaaccgggccccgataagtgggacttgccaaacgcagaggaaagagccgccgagaatgagcttcctcctctagactctccgaggcaactggctgacgcccttgggttgaccattcctcaactgcggtggttggctttccaccgcgaagccgcgacgcgcatccactataggcgcttcaccattcctaaacgagacggaagtgaaagagccatttgggcaccaatgccccggctgaaaagggctcagcattggatcctacgcaacgtagcggaaaaactcccagtgcatggggccgtgcacggttttgtcgccgggagatccatcttatccaatgcaagcgcccatcacgatccaaaggttgctgtgcgaattgaccttaaggatttttttccaactgtcaccctgcgtcgggtaaagggtctgttcagaaaggccggctatcgggaacacgtagctacactcctggctcttatctgcaccgaatcacccagggaaatcgtgcagaacgagggggctacctattacgtggctctcgggccgaggtgtctcccacaaggagctcccacatctccagcactcacaaatgccttatgcctgcggctggatcggcgcttatcaggcttggcacgcaggcagggttggagatacacacggtatgcggatgatctgactttctcccgaccctctgactttggagggcctcctgctatcggaaaactcctgggctcggtgcgcagaattgtggaggcggagggcttcgcagtccacgatggaaagactgctatacgtaggcgcggcggtcgtcaggcaataactggccttgttgttaatggcgacagaccccctcgtgctactagggagttcaaaaggaacctacgagccgccatacataatctcgagtccggacgagcgacgccagaagccgaaccaccgcaggtgcttgttggtcgggccgcatttgtcgctatgagcgaccctgcactggggttgagcttactggacagactgagcagagccaccgagcgggatggaagtggcgatgattcaaggtctgagccccctcgccccgagtcatga

SEQ ID NO: 13613 - RNA, 1314 nt, unidentified
  source 1..1314: mol_type = other RNA; note = synthetic construct
atggccatgcaacggcagactaatcccttcgacctctggcggagcattgtccaggcgggaggaatccagccatacattaacgcccaattgtcagagagaggatttctggtcgcgcgtagagaaactgacgggatgagcgaaagagaactcgctgattataaaaaatccctgaaagctgaggctgccgagcggaggcgattacgacgtgaggcctgggccgctttcagagcagaacacatcgtgcacttgggcgacggcgtctactggagcgacgaacccggtcctgatagatgggatcagcctaacgccgaggtacgcgcagccgaaaacgagctgcccccacttgattcaccaagacagttggccgaagccctgggcctcacgatacctcagctgcgctggttagccttccatcgggacgctgcacgaaggatccattaccggcggtttacaattcccaagcgcgacggcagcgaaagagctatttgggcacccatgcccagacttaagagggcccagcattggatcctgcgcaatattgctgagaagttgcccgtgcacggagccgcccatggatttctgccagggcgctctatcctgagcaatgctgcgccgcactgtgacagtaaggttgtggtgcgcatcgacctcaaggatttctttcctacagtcactcttcgacgggtgaagggccttttccggaaggcaggctaccgagagcacgtggccaccctactggctttaatatgcacagagtcgcctagggaaatcgtggaacaggatggtgaaacatattatgtggccctgggtccaagatgtttgccacaaggagccccgacctcccctgcgatcactaatgcactatgcctgaggctcgatcagcgcctgtcaggcgtagcgaggtcccaaggttggagatacacaaggtatgcagacgacctcacctttagtaggcccgcagattccaaagaggccccagggatagggcggctcttgggaaccgtcaggcgcgttgttggggatgagggcttcaccattcacgacaaaaagaccgccgtggggcataacggaggcaggcagagggttacaggccttattgtgaacggggatcggacccctagagcacccagggagtttcggcgaaatctgcgtgctgctatccacaacctcgtcactgggaaagagtctccgagtgctgagcctccctctgtactagccggtcgtgctgccttcgtggcaatgacggacccttctctgggccgcgcaatgctggagcgcctgtcacaggctgtggagagatccccagaagcatga

SEQ ID NO: 13614 - RNA, 1305 nt, unidentified
  source 1..1305: mol_type = other RNA; note = synthetic construct
atgtcccggaccacatccagaacgaacgatcccatgactctgtggcgggccattgaacaggccgggggaacacaggcgtatgtggaggcacagcttgccgagcgcgggttcctcgtcaagaggagggagacagataaaatgtccgagagagaattggacgcatacaaaaagagcttgaaggccgaggctaaagagaagagagccttacaggcagacgcttggagagcttacaagaccagccatatagtgtacctgggcgaaggtatcttctggaaggatgacccaggcggtcccgataagtgggatctgcctcacgcagaagagcgggcagcggagaatgaactgccccctctagactcacctcgccagctcgccgaagccctagagctgagcctcagtgaattgcggtggctcgccttccacagagatgcagccactaggattcactaccggcgtttcactatcccgaagcgggatggctctgaaagagccatttgggcccccatgccaaagttaaaaagtgctcaacattggatcctgcgaaacattgcagagaagctcctggttcatgggagtgtgcacgggtttctgcctggcaggagcactctgaccaatgcggcagctcatgcgaaccccaaagtggtcgttaagatggacattaaggacttttttcctacggtgaccttgccaagggttcggggaattttcaggaaagccgggtatcgagaacaggtagccacccttctcgctctgatctgcaccgagtccccaagagaggtggtggaacacgacggacaaacctactatatcgcattgggccctcgttgtctgccacaaggagctcctacgtcccccgctcttacaaatactctttgcctgaggatggaccaacgcctgtcagctctggcgaaacgctttggatggcgatacacacggtatgctgacgatctgaccttctctctcccgcatgatcacaaagaccagcccagactgggggccttggttggcaccgtccgaagagtcgtggaagccgagggatttacaatccacccctctaagacacgcgtagctcgatcaggcgcccgtcagactataaccgggcttgtggtcaatggtgatcaggccccacgcgctccgaggaaatttcggcgcgaactcagggccgcaatccacaactcgcgcaacggcaaacctttacatgagggagagagcccaacaactctcgccggctctgcagcttacgtgtatatgaccgaccccgagctaggtgccaagctgcttgacgctataaaacaggaggcatga

SEQ ID NO: 13615 - RNA, 1320 nt, unidentified
  source 1..1320: mol_type = other RNA; note = synthetic construct
atgtcccgtgcaactgacctgctgtcactgtggcgggcaattgaacatgccggtgggatcgatgcgtacgtgaatactcagctcgctgagagggggtttttagtggcccggcgcgacgtcgatacgatgagcgaccgcgagagaactgcatacaagaagcagctcaaggaggaagccgcccaccggagagagcttaagcgtgaggcatggaaggcttatcgggcaagacacatcgtacacctgggagaagggatttattggaatgaccaggccacaaaggatccctgggacgcccctgatgcagaggagagagccgccgagaacgaactcccacctctagacagtcctcgcgatctcgctgaagctctgggactgaccattagccaattgcgatggcttgccttccatagagacgcggcgacaagtatccactatcgcaggttcacaataccaaaacgagatggatctgagcgtgccatctgggcaccactgcctaccctcaaggccgcacaacactggatcctgcgaaacattgcagagaaactgccagtccatggcgccgcccatggtttcttggccggaagatctatactcagtaatgctagcaatcacgtggactctgctttggtcgtgaaaatggacctgaaagacttttttccgtccgtcaccttccggcgcgtgaaagggattttccgaagggctggctaccgggaacaggttgcaactcttctagcactgatatgcactgaggctccccgcgaaatcgtggagcagggaaaaactacctactacgtcgccttgggtcctagagctcttccgcagggcgctcccacatcaccagctctcacgaacaccctgtgtctgcgcctcgacaggaggctggatggccttgctcagtcattgggatataggtacaccagatatgcggatgacctcacatttagcctgcccagatcccacgaaggggatccgaaactcggcaccttacttgggaaggcccggcgggtggtagaatcggagggctttaccgtgcggctggagaaaacaagagtggctaggcccggtgcgcgtcagcaagtgaccggtttagtagttaatggcgctgccagtcctcgcactcctaggacattacgacgccagttgagggccgcagttcataacctgcagacaggcaagcctaggcccgacgcggatactccagaacggttggccggcctgatctcatacgttgccatgacagaccccaccctgggacaagccctacaggcccagtggaccaacccctccaagccaacgagctctgatgatagcccctcctga

SEQ ID NO: 13616 - RNA, 1296 nt, unidentified
  source 1..1296: mol_type = other RNA; note = synthetic construct
atgtcgcggaccactgatctgacgtccttatggagagccattgaaagggcgggcggtatcgactcttatgtgaacggccagttgtcagagcggggatttctggtggagcggagagaaattgacacactctccgatagggagcgggaagcctataagaaacagctgaaggaagaggcagcacgcaggctggagttacgacgcgaagcgtggcaggcgtataaagccaggcatatcgtgcaccttggcgaagggattttctgggacgaccatgccaccgaagacaaatgggatgcgccagatgctgaagagcgggcagccgagaatgagctccccccactcgacgggcccagagatcttgctgaggctttgggactgacaatacctcagctccggtggctggctttccatcgagatgctgctacctccatccactacgcaaggttcactgtagccaagagagacgggtccgaacgagccatctgggctcccatgcctactctgaaggccgcccaacgctggatcctgcggaacatctcagaaaaactccccatacacggcgcaagccacggtttcttgccaggccgaagcatcaagagtaacgcacaggagcatgtagggtctaagctggtgctgaaaatggacctggctgatttttttcccagcgtcacctaccctcgcgtgagaggtattttcagaagggccgggtacagagagcaggtgtcaacgctgcttgccctcatttgcacagaggcacctcgcgaagtggtggaggaaggcgggaccacatactatgtggcccttggtccccgttgtctgccacaaggagcccccactagtccgtctttaaccaacactctctgcttgaggcttgaccgccgcctatccggactggccaggagtctgggctggagatacacacggtacgccgacgacctgacatttagcttgccggcttctcacggaggcgagcctagactaggggctctccttggcggagctcgtcgggtagtcgagagcgagggttttgccgtcaggttagataagactcgtgtggcacgagctggggctcgccaacaggttaccggcctggtcgttaatggtgaaggacctgcccgcgttccacgtcggttgagacgacagctaagggccgccgcccacaatctggaggttggcagagcgggccctgatgcagacccggttgatagactcgcaggactggccagcttcgtctgtatgaccgatccagcactcggagcggctctgcttggaaggttgcgtggcgggtcagcagggtga

SEQ ID NO: 13617 - RNA, 909 nt, unidentified
  source 1..909: mol_type = other RNA; note = synthetic construct
cggtggctcgcctaccatcgggatgctgccacaaagttgcactaccgccgcttcgtgatcccaaaacggggcggaggggaacgagctatttgggcccctatgccacttctcaaggccgctcagcactggatcctccggaacgtggcagagaggttacccgtccatggtgcagcccacggtttcctagcaggccggagcatactgtcaaatgcagccgctcacccggatgcgagaatcatcctgaaaatggacattaaggagttctttccaaccgtttctctgacccgagtcaaaggcattttcaggaaggccggctatagggagcaggtcgccacactcatggccctcatctgtacagaggccccccgtgaggtcgtggaaagagatgggaagacatggtacgtgtccttaggacctagatgcctgccccaaggggctcctacttcccctgctcttaccaacaccctttgcctccgattggacagacgactagcagggttggctgcgaaactgggttggaggtatacgcgctatgccgacgatttaacctttagcctgccagacggacacaaggatgaacccaagacagggcctttgatgggctttgtaaagcggatagtggccgctgaaggcttcgcggtacatcccgacaaaaccagtgtgaggagaaaaggaggcaggcaacaggtgacggggctggtggtgaacggaggaggtccaccgcgcgttactcgtgatctgaagagacggctgagggcagctgcccacaatctggctcgcggcaaaggcctgaaagagggcgagactcctgccagactggaaggttttgcagcctacgtccatatgactgacgagaagctggggggaaagctccttgcagcgtttcgtgggggagttcgccagggctga

SEQ ID NO: 13618 - RNA, 1401 nt, unidentified
  source 1..1401: mol_type = other RNA; note = synthetic construct
atgaatcaaaccaaccaagatcctcgtccatcagttgacctgggtgctttgtggagagccatcgagcaggctgggtccatccaggcttacgttaaccagcagctgtccgcacgaggttacctcatagagagaagggatacagcccggatgtcggcagctgaactcaaacgttacaaacagcagctgaaggatgaggcggtcgagaagcgcaggctgaaagcggaagcatgggccgcttacaaggccgcacatatcgtgcacctcggggaagggattttttttaacgaggagaatgacttcgacaggtttgatctgagggaacccgaagcccgagctgccgagaacgaactcccaacactggacaagcctgctcaactggcggaggcactgggtctgagcgtgagtgaactcagatggctgactttccatcgtgaggccgcagaaagcattcactaccagagatttaccatccccaaacgccgagggggagagagggagatttgggcccctatgcctaaactgaaggccgcccaacggtgggtgatgcgggagatcgtagagcacttaccagtgcatggggccgctcacggattcattgccggacgctcaatccttaccaacgcccaggtccatctgaatgcagaaatcttagtcaatttcgatctgcaggactttttcccgaccgtgacatggagacgggtgaaaggcgtctttagaaaagccggttatcgtgaacaggtagcgactctattggccctgctttgcactgagcccccacgcgaggttatcgagcacgaggggaagagatattatattgcactcggtcagcggtgtttgcctcagggagcgcccacgtctccggctataacaaatgctctgtgcttaaggttggatcggcggctctcaggacttgcccgcagtctgggctggagatacactcgctacgccgacgacctaaccttctccttgcctgccagcgaggcgaagccgaaagcaaagaagggcaaggctaagcccactaaagcaaagcccaccaaagcaaagaaggcccagggcgctcttaccggagaagcagcattggcacgccttatggggggcgtgaaggccattgtcgccgctgaagggttcgctctgaatccagacaaaacggcaataaaacgcccctctggacggcaaggcgttacaggactcgtggtaaacggcgatggaagcccacgcgttccccgagaggtgagaaggaggttgcgggcggccctacataacctcgaacgaggccagccactgagagagggtgaatcttatgctcacctggccggcttagccgcattcgtgtatatgacagaccctgctctgggcggcgctcttcttaagaggattggggccctcgccaggcagggctaa

SEQ ID NO: 13619 - RNA, 1302 nt, unidentified
  source 1..1302: mol_type = other RNA; note = synthetic construct
atggccacaaggccaaatcttgtgactcagtgggtggaactttggggagcaatcgctcgagcagggggcatcgatgcttacatcactgcccagctcacagagagagggtatctggccaaacggagatcgaccgatggtatgtcagctgctgagttaaagcgctacaaggcagagctcaaacgcgaggcagcggagaggcgcaaactcaaagctgatgcttggcaggcttatcgggccagccatattgtgcacttgggggaaggcgtcttcttcaacgacgacctggacttcgatgccttcgaccttgcagagccagaggccagagctgccgagaacgaactccccaagttagataaaccccagcaagtggcagatgccctggggatgacgctggccgagcttcgatggctgtctttccaccgagaagccgccaccggggtacactaccgaaggttcgagattcggaaaagatccggagggatgcgagcaatctgggcgcctctacccaggctgaaggcagctcagcggtggatactgagggagattgtcgaacatctcccggtacacggggcggcccatggttttcttgcaggccgttccattcttactaatgctcaagcccataccgggagcaagctgatcctgaacgtggatctgaaggacttttttccttcagttacatggagacgggtgaagggactgttcagaaaagctggctaccgcgaccaagtcgctacactgctagcattgctgtgcacagaagctccacgggaaatcgtggagcacgagggcgagaaactctttattgccttagggcctcgttgtttgccacagggagccccgacttctcccgccataaccaacgccctctgcatgcgcctggataggagactggcaggcctggcgagaagtctgggatggcggtacacgcgctatgccgacgacttaaccttctcccttcccgcagaccacaagggagcccctggattgagtaagctgctgggcgcattgcacgctgttgtggccgccgaaggctttgccgtcaatcccgccaagactagggtgtctcgtcccggagcacggcagaaggttaccggcctcgttgtcaacggtgacgccgctccaagagtccctcgtgcgctacgcaggaaactccgcgctgctgcgcacaatctcgctcagggtaagccactgcctgcaggtgaaagcgtggcccagttggctggctatgccgcatttgtgcatatgaccgatccggtactgggcgccgcgttgctaggaaagtttggcgaacataggtga

SEQ ID NO: 13620 - RNA, 1311 nt, unidentified
  source 1..1311: mol_type = other RNA; note = synthetic construct
atggccacaaggcccaacgatcggcaggccctttgggctgcaattgccagagccgggggcatcgatgcatacgttcaagctcagctggtagccggcgggttcgcagctgaacggaagccaactgacgggatgtcaaagagggagctggctagatacaaagccgaactgaaagccgaagccgccgagaagaaaaggctgaaagccgaggcctgggccgcatataaggctactcatatagtccatctgggcgagggagtgtacttcaatgacgctgatgacttcgatcgattcgatctcgccgagcctgaagcaaggctcgcggagaacggcttgccgaggatcgacgatcctcaggccctggctgaagctctagccctttccgtgcccactctgcgctggctcacgtttcaccgtgacgctgccacaatgctgcactatcggcgcttcaccatccccaaaaaatccggcggggaacgagcgatctgggctccaatggacacgctcaaaagcgcacagcgatgggtgctgagacacattgtcgagcctctacccgtccacggagcggctcatggcttcgtccctggaagaggtatcgtgtctaatgcacaagcccactcggaggctcgcatcttgataaatgtggacctcaaggacttttttccgactgtaactgttcggagagtgaagggagtttttcgaaaggctgggtaccgggagcaggtagcaaccctgttggcaatgctgtgtaccgaggcacctcgagaagtcgtgcgccacggcgaaaccgactactttattgctcttgggccccgttgccttccacaaggagcccctaccagtcccgccctgaccaacaccttatgcttacgtttggatcggaggctgtctggtctagcccggcaaaggggttggcgctatacacgttatgctgatgacctcaccttcagcctccccgttaaggcggctaagggagccgatggtaatgtgggcacactgctgggtgcagttagagccattgtcgaagcggaggggtttgccttaaacccaaagaaaacacggatttgtagaccaggggggcggcagaaggtgacaggactcattgtgaacggagctgaacctcctcgcgcaccaagggccctgaggagaatgttgagggccgccgtgcataacctggagcagggaaaaccgcttcccgaaggcgagactgtggctcgccttgcgggctacgcagctttcatctatcagacaaatccacaggagggcgcagagttgctcagacgctttgcagcgttcgccggcgagcaggcatga

SEQ ID NO: 13621 - RNA, 1302 nt, unidentified
  source 1..1302: mol_type = other RNA; note = synthetic construct
atgagtacccgcaccacagaccttgccgctctgtggctggccattgccgaagctggtggaatcgataactatgttcagaatcaactggtggaacatggattcctcgtggaaaggagggagacagacacaatgagcaaggccgagctgaagaggtataaggcacagctgaagagggaagcagccgagcggcgggagcttaggaaagccgcttgggctgcctacagagagacacatatcgttcacttgggggatggtgtatactataatgacgcagcgactatggaccgatgggacttagatgagccggaagcccgggcagctgcaaacgaactcccccgactggacggccccgatgatttggccaaggagctgggcattaccgtggcacagctgcgttggctggcggttcatcgcgacgcagcaactagaattcactacacccgcttcaccatcccaaagcgtgatggcagcgaacgcgcaatttgggcccctttgccgcgcctcaaagctgcacaacggtggatcctccggaacgtcgtggagcatttacccgttcacggggccgcgcacggctttttagctggcaggtccgtagttaccaatgctgcagctcacgtgggctcaaaattgattgttaacattgacctcaaggacttctttccaacgatcacatggcgcagagcccgggggatgttccggaaagcgggctatcgggagcaggtggcgactctcctggccatgatatgcacggaggccccaagggaagtggtggagtgggaaggtcagtcctactttgtagcccttggtccccgctgtctcccccaaggagcaccaacgagccctgccatcaccaacactatctgcctgcgtctggacagacgcttgtcagggctcgcgcgcagattcggatacacatacacccggtatgctgatgatctgactttttctctgcctcttgcccacactggagaaccccgagtgggagccctgataggcgctgtggggcacattgtcagggccgagggctttcaagtccacccatccaaaacaagagtgcagcatactgggagacgacagcaggtcaccgggctggtcgtcaatggcagagagcagcctagagtgcctagaagtctgaaacggcagcttcgagctgcagtgtacaatctacgacgtggaaggccccttcctgccggtgagaggttcgaaaggctgatcggttatgctgcttggatacatcaggctgagccggagttggggtctgaattactcgccgccctaggcggactaaacccaaccgcctga

SEQ ID NO: 13622 - RNA, 1113 nt, unidentified
  source 1..1113: mol_type = other RNA; note = synthetic construct
atggccgccttatggagagggatcgacgaagccggctcatgcgaaaactgggtgcaacagcagctcgtggagcacgggttcatagttagccggagggacacagataacatgtccaagagggagctcgcgaactataaaaaacaactgaaacgcgaagctgccgagaaaaaggcattgaagaagaaggcttgggaggcgtataaggccaatcacattctgcaccttggggaaggcgactggtggaatgatgcagcaacattcgacaagtgggacttgcccgagccagaagccagagccgctgagaatgagctgccgcaactcgatagtccagacgatctggctgaagcgctggggctgaccatcaaagaactgcgctggctatcttttcatcgggatgctgccaagacgattcattacaggcggtttaccatccccaagcgaaacggatctaaacgacccatttgggctcctctgccgaaactcaaagaagcccagcggtggatactgcacaatatcgtggaacatctccctgtgcatggggcagctcacggcttccttacagggaggggtatcgtgaccaacgcccgcccacatggaggctcagccttactgcttaacatcgaccttaaggagttctttccaactgtgacctggcgaagagtcagaggcgtgtttagaaaggcaggctatcgtgagcaggtagctaccctcctggctctgatatgtaccgaggcaccccgcgaggtggtagaattcaacggcgagacatggtatgtggcccttggtcctaggtgcttgccccagggtgcgcctaccagtccagctttgacaaataccatttgtctgcggctggaccgtagactaagcggcctcgccaaaaaaaatggatacacttacacacgttacgccgatgacttaacttttagcttgccccacggattcactgggccgccaaagacgggcatgctcattggtgcagtcaaaaagatcgtcgtggcagagggatttgccgttaaccctgataagactagggtactgagatccggcggacggcagcaggttactggacttgtcgtcaatggtcctcgcggaccccgcgttcctaggaagtga

SEQ ID NO: 13623 - RNA, 1320 nt, unidentified
  source 1..1320: mol_type = other RNA; note = synthetic construct
atgacaactgcacctgttgcccccgctcctagcgctgaccctcaggttctgtggcgcctaattgtgcaggccggtggtatgaaagcatacatcgacggccagctcaaggagaaagggttcctcgtaaccaggagggacgccgattctatgtcagacagggagaaggacggatataagaaggccctcaaacaggaagcggatgaacgacgaaaactgaggagagagacatggggagcatacaaggcaaaccacattgttcacctgggtgagggagtattttggagtgatgatctcgctcccgataaatgggacacccctaatagtgaagagcgagcggccgagaacgaactgcccgctatagatcggcccgagcagctcgccgagttactaggggtcacaatcccccagctgaagggcctggcatatcatagggacgccgctaccagcctgcactacgtccgcttcacgatcccgaaaagggatgggactgagcgaccaatctgggccccaaagaaaagactgaaagctgcccaaagatggatcctgcacaatatcgtagagcggttacctgttcacggcgctgctcagggcttcctggtgggtaggtctatcctatccaatgcggcggtgcatgctaacgccaaggccattctcaagatggacattaaggagtttttccccaccgtcaccgtgcgtagagtgaaaggggtatttcgacgcgccggctacagagatggaatatccacactcttggccttgatttgcaccgaggcaccacgggaggtggttgaagtcgagggcgagacatattacgtgtcactaggcccacgctgcttgcctcaaggggcacctacgtcgccatctttgactaacgcactgtgtatgcgccttgatcgtcggctcgaaggattagctaagaagctgggctggcgctacactaggtatgcagacgacctgactttctcccttcccgccgaacataaggggaagccgaggcttgggaccatgatcggatgtgtcactcggattgtcgcagctgaaggctttgaagtgaaagcggaaaagacaagagtgcatcgcacggggggacggcaaagcgtgactggactggtggtcaatggagatggcccccctcgtgtttcacggaccgtgagacggcagttgagatccgccgtgcacaaacttaagaccggcaagccactgaaagaaggcgagagcctggccagacttagtggttatgctgcctttgtgtacatgaccaatccagacctagggaaaaagctgctcgccgacataaacggcgccacaggggcaggttga

SEQ ID NO: 13624 - RNA, 1329 nt, unidentified
  source 1..1329: mol_type = other RNA; note = synthetic construct
atgtcaactacaacaccagcaccatcgcctgatgctcagaccctctggcgcctgattgtgcaggcaggaggcatgaaggcttatattgatggccagctgagggagcgggggtttttggtcactcggcgtgatgccgatgcgatgagcgaccgcgagaaagacgcatacaagaaagccctgaagcaagaagccgaggaacggagaaagctgcggcgagaaacttggggagcctatcgagccaaccatatcgtgcatctaggagaaggcgttttttggacggacgaacccaaagaggacaagtgggatacacctaattcagaagaacgggccgccgagaatgagctgcctgcattggataaagcggaacaactggctgaggcactcggcgtcactattccccaactgaaagggatggcttaccacagggacgccgccacaagcttgcactatgtccgcttcacgattcctaaacgcgatgggaccgagaggccgatttgggctcccaagaaacgcctcaaggctgcccagagatggatactccatcacatcgtggagaggctgccagtacacggtgcagcccagggctttctcgttggacggtccatcttatccaacgcgctggtccacgagaatccaaaaatactactgaagatggacatcaaggagttctttcctactgtgaccgttaaaagagtaaagggcgtgttccgcagggctgggtacagggacgggatcagcacactgctggcgcagatttgcaccgaagcacccagggagatcgtgaacgtggaaggtaagacttactacgtgtctcttggtcccaggtgcttgccccaaggtgcccctaccagtccggccataaccaatgccctttgtctgagacttgacagacggctcgcaggcttggcaaagcgctatgggtggcggtacacgagatacgctgacgacctgactttctctctcccaatggagcacaaaggccagcccaagcttgggtccatgttaggatgtgctagacgaatcgtcgaagctgagggatttgaggtgaagaccgagaaaaccagggtacatcgaactggcggaagacagagcgtgacaggcctggtcgtgaatggagacaacacaccgcgcaccccaagaaaactccgacgtcagctgcggtctgccctacataaactcaagaccggcaagcctctgaaggatggggaaagtctggcccgtcttacaggttatgctgccttcgtgtatatgaccaaccaggaattgggaaggaagatgcttgcggatttacacggcttcgaggataaacccgaggggccagcagtttga

SEQ ID NO: 13625 - RNA, 1314 nt, unidentified
  source 1..1314: mol_type = other RNA; note = synthetic construct
atgaccactgctgctcctgctccacctccaacggcccctgatctggccactctatggagactgatcgtgcaggccggaggcatgaaagcctatgtcgacgcccgcctggaagagcggggttttctggtcgtacggagggacgctgatgctatgagtgacagggaaaaagatgcttacaaaaaggagctgaaacaggaagcagaggagaggcgaaaactcaggcgtgaagcctgggcagcctataaggccaaccacgtggtgcatctgggtgagggagtcttttggaccgacgaggtcagagaggataaatgggatactccgaactctgaagagcgtgccgctgagaatgagctgcccgcattggataagccagaacagctcgccgaagctcttggagttaccgtgcctcagctgcgtgggatggcatatcaccgcgacgccgcaacctcactgcattacgtaagattcacaatacccaagagagacggcacagagcgtccaatttgggcacccaaaaaacgactgaaggccgcacagagatggatactgcaaaacatcgtggaacggctcccagtccacggtgctgctcaagggttccttgccggacgctctattctgacgaatgcggcagtgcacgtgaacgcaaagatcatccttaaaatggacatcaaggaattcttccccaccgtcacagttagaagagtgaagggcgtgtttaggagggcgggttaccgggatgggattgccacactattgtcgcagatctgtaccgaggcccctcgcgaggtagtggaactggatgggaagacctattacgtgagcctcgggccgaggtgtctaccacagggagcacccaccagccccgctttgacaaacgcgctgtgcctccgattggaccgcagactcgccggcttagctaagcggtatgggtggcggtacacccgctacgctgacgatatgactttctcccttcctgccgaacacgcaggccctcccaagttaggcgcggtcatggggtgcgttcgcaggattgtagcagccgaaggctttgaggtcaaagacgacaaaactcgagtgcatagaacgggcggaaggcaggccgttacaggactcgtggttaatggcgatggtgaaccccgagcctcacggaccttaaggcgccaattgcggtccgctattcacaagctgaagactggcaagccgctcaaagagggggagactgtggcgcggcttcatggctatgccgcctttgtttacatgacagatccaaagctgggtaagaagcttctcgcggacctgaatggagtggagtga

SEQ ID NO: 13626 - RNA, 1305 nt, unidentified
  source 1..1305: mol_type = other RNA; note = synthetic construct
atggccacaactaccaccgacccaattgccctttggcagagtatcctccaggcaggcggagtgcgagcctacatagatggacagctgaaggagcggggatttctcgtcgaacggcgtgacactgatgcaatgtctgaccgggagaaggatcagtataaaaaggcccttaagcaggaagcagctgagcggaaaaagctcaaaaaagaggcctgggccgcctacaaaactgctcacatcgttcatctaggggacggcgtctactggtccgacgagagcaaaccagacaagtgggacacaccgaattccgaggaacgagccgcggagaacgagctccctgcgcttgattctcccaaacagctggctgaagcgctggggctgactattcctcagctcaggggcatgtgtcaccatagggatgctgcaaccaagctccattatgtgagattcactattcccaaaagagacggaaagccacgccccatttgggctcctttaccgaagctcaaggccgctcagcggtggatcctccacaatatagtggagcgcttaccagttcacggcagcgcccagggcttccttgtaggtagaagtacgctgtccaacgcagcggtgcacaccaatgccaagatcctgctaaagatggatgtgaccgattttttcccaaccgtcacgtggagaagggtgcgaggagtttttcggagagctggatacagggagcaaattgcaacactgctggcactgatctgtacagaagctccccgcgaaatcgtgcaacacgatgggaagacatactatgtgtcgttgggagcacgatgcctgccacaaggtgcacccactagcccctcattgacaaacgcactgtgcttgaggctggacaggcgattgaccgctctggccgccaagttgggttggcgctacagccgctacgctgatgatatgacattctcattacctgcagatcacgcggggaagcctcagttgggcaaattactggggtgcgtgaagcgcgtagtcaccgccgagggcttcgaagtcaaggacgaaaaaaccagggtgcataggaaaggcgggaaccaatctgtaaccggcctggttgttaacggggacggcactcctcggacgcccagaaaagtgcggagagaactgagggccgccatccataatctagagaaaggaaagccgctgaaagaaggggagactctgcctcgtcttatgggtatggccgcctatgtctatatgacagacgctaagcgcggcaaagagctgcttaccgctctcagacgttttgctgccggtgaatcctga

SEQ ID NO: 13627 - RNA, 1296 nt, unidentified
  source 1..1296: mol_type = other RNA; note = synthetic construct
atgaactccacccgcccagatcctctgaccctttggagacagatcacccaggccggaggtacccaggcatatgtcacagagcagctaagggaacggggattcctcgtagagcggagagatgtcgaaggcatgagcgatcgagagaaagaccagtataaaaaagcccttaaacaggaagctatcgagactaaaaaactcagacgagaggcctgggctgcttataaggccgcacacgttgtacatctgggggagggtgtattctggactgatggcgccaagcccgacaagtgggatactccgaatggccccgagagagccgcagagaacgaactgcccccactcgacacgccggaacaactggctgaggctctggggatcacgctggcgcaactgagaggattatgctaccacagggacgctgcgaccagtattcactacgtgcgcttcgccattcctaaaagggacgggagtgaacgccctatttgggcccccctgcctagactgaaggcagctcagcggtggatcctccacaacatcgtcgaacgcttgccagtccatggtgccgcacatggctttcttgccgggcggtccattgccacaaatgctgccgctcacgctagcgcgaaaatgatactgaagatggacgtgaaggagtttttccccaccgtcacttggcgcagggttagaggcgtgtttcggcgggcagggtacaacgagtctattgctacacttctggcattgatctgcactgaggcgccgcgcgaagttgtggacctcgaaggaacaacttactacgtgagcctgggtcctcgatgtctgccccagggagctcctacatcccctgccctcactaatgcattgtgtttacgacttgatcggcgactaaccgggctcgcggcgaagttaggctggcgttatacaaggtatgccgacgatatgaccttttcactgccagctgcccatgccggacccccaaagttaggcgctctgttggggtgcgttaagcgtgtggttgaaggagagggcttcagggtgcatgcagacaaaacgcgcgtggcccgttctggtggacggcaaaccgtgaccggcttggtggtcaatggaacatcgcagcccagagtctctaggaagctcaaacgcgaaatgagggcagccgtgcacaacctagggaaggggaagccactgccagagggcgagtcagtggccagactcctgggctacgcagcctatatctacatgaccgatcctgagacaggcaggaagttgcttgccgatctgaatgcaatacccgactga

SEQ ID NO: 13628 - RNA, 1287 nt, unidentified
  source 1..1287: mol_type = other RNA; note = synthetic construct
atgaccactccaagaaccgatcctctgactctttggcgtcagattgatcaagccggtggagtccgggccttcgttgacgctcagctccgggagaggggcttcctggtggaacggagagatgctgataagatgtccgaccgtgaaaaggaccagtacaagactgcgctgaagcaggaagccgctgaacgcaagaccctcgcaagagaggcctggaaggcgtatcaggcagcacatatcgtgcatcttggagacggaatctactggagcgatgacgcgacccctgataaatgggatacgccaaactctgaagagcgcgctgctgagaatgagttgccacccttggatagcccagcccagctggccgaagcattaggcgtgactgtcgctcagctgagggggcttacctatcaccgggacgccgcaacctccctgcactattgccgctttgcaatacccaaaagggacgggagtgagcggcctatttgggccccattaccgagattgaaggccgcccaggcctgggtgctccataacgtggtggagagacttcctgttcacggggctgcccatggttttttggccggcagatctacattaacgaacgccgccgtgcacaccaatgctaacctggtcctgaagatggacgttaaggagttctttcccactgtgacatggcgtcgagtcaaaggggtgtttcgccgtgcaggttaccgggagcgagtagccacactgttggccctactgtgtacagagagtcctagggaagtggtgcagctggacgggacaacttactacgtgtcactcggccccaggtgtttaccccaaggcgcaccaaccagcccagctctgaccaatgccctatgcctgcgcctggacaggagacttacagggctggccgccaaactcggctggcgatacactagatatgctgatgacctcactttctcacttccggctgcacatgtcggtcccccaaggctcggagctatgattggctgcgtaacacgcgtggtagagacagaaggattccggatacaccccgaaaaaacccgggttgctaggcctggaggcaggcaagcagttacgggcctggtcgtcaatggagacgctgcgcccagggcacctagagcattgcgacgccaactacgggccgccctgcacaacagaaaggtgggtaaacctcgacccgacggcgatacagaggctcagctgcacgggctggcagcgtacatctatatgaccgatccggtactcgggcgcaaactcttggcggagatcgatggatga

SEQ ID NO: 13629 - RNA, 1305 nt, unidentified
  source 1..1305: mol_type = other RNA; note = synthetic construct
atgaccatgacacgaatcgcagatcctctcaccttgtggagaaatgtggttcaggccggcgggcgacaagcctatatcgctgcgcagctcgaacagcgcggattccttgtggctcgccgcgaaacggatgggatgagcgagcgggaactggcacagtataaacagtccctcaaggcagaggctgcggagcggagaaagctcagacaggaggcctggttggcttacagggctaaccatatagtacacctcggcgatggagtctactggcatgacgaggctaccaaggacaggtgggacctgccctacgccgaggagagagctgcagagaatgagttgcctgctctcgattcaccgcagcagcttgcggatgctttgggcttaaccgtggctcagctgcgctggctcgtcttccatcgggaagctgccacgaggattcactaccatagattcacaatcgccaaacgtgacggcagcgagcgacccatttgggccccatgcaagaaactcaaggctgcacagagatgggtgcttagaaacattgtggagaaactcctgattcacggagccgcccacggatttactgccgggtgttcggtgctgagcaatgctcgccagcacactaatagcaggatcgtggttaaattagacatccgcggtttctttcctacggtgactctgccaagggtacgaggggtctttaggcgcgcggggtatcgcgaccagttagccactctgcttgccctgctgtgcactgaagcccccagggaggttgtcgaacaaaacgggcagacctactacatcgccctaggcccaaggtgcttgccccaaggagcccctacttctccagctcttacaaacgcactgtgtctgcggctggatcggagacttaccggcctggcacaccagctgggatggcgatataccaggtacgccgacgatatgaccttctcattgccagcaggtcacacaggggctcctcgtctgggcacactcctgggaatagtgcaacggatcgtcgaagaggaaggctttcggctacatccggacaagacccacgttgcgcgggccagttctagacagaaggtgacaggtctggtggtcaacggtgatggggtgccccgcgtatcccgtaaactgcgtcgggaacttcgggccgcggcacataggctgaaacatggcaagccattaaaggagggagaatctttggccagactggctggctatgcagcatatattcacatgtccgaccctcaaaggggtgccgccctactggcagcatttaagagtgccgcccccgccacatga

SEQ ID NO: 13630 - RNA, 1308 nt, unidentified
  source 1..1308: mol_type = other RNA; note = synthetic construct
atgatgacaacccgaagcgattaccagaggttgttcgacctgtggagagctatcggacaggcggggggcgttaatgcttatgtgcagcagcagctgcgggaacggggcttcgtgctggagagaaaaaagacagatggtatgtcaaaagctgagctctccgcctataagaagagccttaaagaggaggccgcagaaagaagacgcttaaaaaaggaggcatggcaagcatatagggccacccacattgtgcacttgggagaagggatcttttggaacgatgagtctgaccttgacaagtgggaccatccgcatgccgctgagagggcagcggaaaacgaactcccacctatcgacagtccccagaagttagccgaggcaatgggcctgtccctgcctgacctccgctttctgtcttttcatcgggaggctgctgaaagcatccactaccgtaggtttaccatcccgaagcgtaacggctcagagcgagcaatatgggctccattgccaaagctgaaggcagcacagcactggattcttcgcaatgttgtggaacggctggccgtccatggcgcttcccatggtttcttggccgatagaagcatagcaacaaatgccgcagctcacactggggccaagattgtcgtcaaagtcgacctgaaagacttcttccctaccgtgacattgagacgcgtaaagggcatttttcggcgtgcgggctatcgggatcaaatagccaccctgttagccctcatctgcacagaggccccccgagaaattgtagaacacgaagggaagcagtattacgtggcattgggccccaggtgtttaccacagggagctcccacttcacctgccctcaccaacactctgtgccaacgcctggatagacggctcgccggactagcgaaacgactcgggtggaggtacacacgctacgcggacgacctaactttcagtcttccagagtcgcacaaagataaacccaagctaggcgtgctgctgggttctgttggcagaattgctaacgatgaaggctttcaagtgcatcccgataagacgaacgtggctcgaaagggatcccgccagaaagtcacgggtctggtggtaaatgggactggagctcctcgggttcccagggctctgaagaggcagatcagagccgccatccacaatgccggacgcgggaaaccactccaagcgggagagtctctgagtaggcttgccgggtacgctgcctacatccacatgaccgaccctaaacttggtgcaaagctgctccagcagctggccgccattgaggccaaatga

SEQ ID NO: 13631 - RNA, 1302 nt, unidentified
  source 1..1302: mol_type = other RNA; note = synthetic construct
atgactcgctcagagcaccagcggctggtcgatttgtggagggccattggaaacgccggtggggtggatgcctatgtgcgagggcagctcagggaaagagggttcgtactggagcggaaagacacagcccagatgtccaaggcccaactggcagcctataagaagtcactgaaggaagaggcagccgagcggaggcgcctcaagaaagaggcttgggttgcctatagagctacccacctcgtccaccttggagaaggcatccattggtccgatgaagctgacgtggatcgcttcgatcacccccgtgccgaggaaagggcagctgaaaatgagctgcccccgtttgacaagcctgagcaactcgctgaggccctcggcctgagtattcctgaactacgctggttagcgtttcatagagacgcggccgagaaaatccactacaggaggttcactatccccaagcgcgatggaagcgagcgtgctatctgggctccactgccaaaactgaaggcggcccagcggtggatactgcgtaatgtgctggaacccatacctattcacggagcgagccatggtttcgttccaaaccgaagcatcctctctaacgccagccgtcacacaggcgctaagctagtggtaaagattgacctcaaggacttttttccaactatttcgtttcggagagtgaagggggtcttcaggcaggccggctacagagacagaatcgcaaccctcctagctctgctgtgcacggaggcaccaagagagatcgtgcaggacggcgacaaagaactctttgtggcactgggacccaggtgccttcctcaaggagcccccacatcacctgctattacaaacatcgtgtgtttccggttggatcgcaggttgacgggcctggccaaaaagttaggctggagatacactcggtacgcagatgatctcaccttctccttgccagcagagcatgtgggcgcccccaagcttggccttctgttgggaagtgtcggccgcgttgtcgctgatgaaggtttccgggtgcatcctaggaaaaccagagtggcacggtctggtgggcgacaggctgtcaccggattagtggtaaatggggccgcatctccacgcgttccccgagaaatccgcagagagattcgggctgtgctgcacaacttgaaacatgggaaacctttacgagacggtgagaatcttcaccgaatagccggctacgtcgcgtatgtacatatgaccaatccggagctggggaaatccctgaggaaacagcttgaagccctggacgcagtttga

SEQ ID NO: 13632 - RNA, 1338 nt, unidentified
  source 1..1338: mol_type = other RNA; note = synthetic construct
atggctacgagcacagactactctcgcctggtcgacctgtggcagggcattgaccgagcgggagggatcgataactatgtgcagaagcagctgaaagaaaggggctacgtcgtggaacgcaaagccaccgatgagatgtcccgggttgaactgagccggtacaagaaagcactgaaagccgaggccgccgaacgtaggaacttgcaaaaagaatcatggttagcgtacagagccactcacatcgtacatctcggtgagggcatcttctggaatgatgatcttgacttcgacagatgggacctgcgtaatcctgaggagagggcccgagagaacgagctgccggaacttgaagacccgaaggcccttgcatccgcattagggctgtctatcgcagcattgcgctggtttgccttccatcgtgacgatgctacattcgtccactatcaccgcttcaccattcccaagcgcgacggttccgcacgggctatatgggcacccagtccccgcctaaaggctgtgcagagatggatcctcagacaaatcgtggagcgactgcctgtacatggagcttcgcacggttttatggccggtcgcagcattaagagcaatgcctcagtgcatactggcgctaagattgtggtcaaggtggatctgaaggacttttttccaacggttactctgccgagggttaaagggatctttagacgggccgggtatcgcgagcaggttgctactctgctcgccttactatgtaccgaggccccccgggaagtggtggagattaagggcaagacacactttgtcgcacttggcccccgatgcttaccacaaggggcgcctaccagccctgggttgactaatacactgtgcctgaggttggacaggcgtttggccggactcgccgcgaaactgggatggagatatacgagatacgccgatgatttgaccttcagtctcccaaaggccaagaagacaaggaaaaaaaagggcacaaaagctaaaaaggagcctccacacgtcggggcacttctgggaggcatcgcaaaaatagctgcgtccgagggcttcgtcgtacatcctaacaaaacccgggtggcccggagtggtggaagacaacagataacaggcctggtggttaatggcgatggaccccctagggtgccaagggctcttagacggcaggtgcgggcaaccttgcacaacctcgggcagggaaagccaatgaggtctggcgaaaccctctcacagctggccgggtacattgcctatattcagatggctgatcccaaactcggaactaagctgcgagctcagctcctagctctcgacctgtcttga

SEQ ID NO: 13633 - RNA, 1074 nt, unidentified
  source 1..1074: mol_type = other RNA; note = synthetic construct
atggcaacacagatcgattatactcgcctactggacctctggcgcgcgattgagcaagccggtggcactgacaaatacgtgcaacagcagctgcaggaacggggatacctggtcgagcgcaaggccactgatgacatgtccaaagctgacttagagaggtacaagaaagccctgaaggcagaagcagccgagcgcagaaagataaaaaaggatgcttggttagcgtatcgggcgagtcacatcgtgcatcttggtgaaggggtgttctggaacgatgacttagactttgaccgttgggaccttcgtaatcctgaagagcgcgctaacgagaacgaactgcccgccctggataatccaaaacagcttgccgaggccctgggagcctctattgccgaactgaggtggctggcatttcaccgggatgacgccacgttcgtgcattaccatgcctttacgataccgaagcgcgatgggtcaatgagacaaatctgggctcccaaccgaaagctcaaggcagctcagcgatggattaacagagagattgtggaacggttgcccgtgcacggtgcaagccacggttttttggccgggagaagcataaagtccaatgcagcagcacacaccggggctgagatcgtcgtgaagattgatctgaaggacttctttccgactgtcaccatgcccagggttaaaggcatcttcagaaaagccggctatcgggaacaggtcgcaaccctgctcgcgctgctctgcacagaggctcctcggcatgttgtagatattaaaggcaaagtgcactacctcgcgttgggcccacgatgcctaccacagggagctcctacatcaccaggcttgaccaatacactgtgtcttaggttggatagaaggctcgctggacttgctgccaagctcgggtggcgatacactagatatgctgacgatctgaccttctctaggaagaaaggcgccagtagcgccgaggtaggagaaatgatccggaaagccgttgacatcgttggacacgagggcttcacagtccatcctgacaagaccagggtgatgaggcgtgggtga

SEQ ID NO: 13634 - RNA, 1296 nt, unidentified
  source 1..1296: mol_type = other RNA; note = synthetic construct
atggccttcaggatcgacaccacccgactcctggacctgtggagatccattgaacaggcaggcgggcgtgacaggttcatccagcagcagctgacagaacgaggttttttagttgagcggaaacctactgaaggcatgagtaaggctgagctggaacgttacaaaaagagtctaaaggaagaagccgcagagagacgcaaactggccagagaggcctggcttgcctatcgagcctcacatttggtgcacctgggcgagggggtgttctggtctgacgatcatgactttgatcggtgggatctgcggaatccagaggagagggcagctgagaacgagttgccaaagctggaacaccccaaggcactggcagaagccctgggattgtcgattgctgagcttcggtggtacgctttccacagagaagatgctaccttccttcactaccacgcctttaccatccccaaacgcagcggcggtctgcggtccatatgggcaccaaaccgccggctgaaacagattcagcgctggatccaccgggaggtggtagagcgactaccagtgcacggcgcggctcatggatttttggccgggagatctataaaaagcaatgccgcggtgcatgctggtgccacaaccattgtgaaagtagacctgaaggactttttccctaccgtcacatatgcccgcgtcagaggcgtctttaggaaggctgggtatagggaacaggtggctacgctcctcgccttgttgtgcaccgaggcaccgcggagggtgcttgagatagacgggaagacacactacctggcacttggccccagatgtcttccgcaaggcgcacccacgtctccagggttaacgaatactctctgccagaggctcgataggcggctcgttgggctggcgaagaaatacggttggagatatactaggtatgccgatgacctgacattttcactgccagccactcatcagggaccccctcggttaggggcgcttctaggcggagtcgctatgatcgcagctggcgagggtttcgtggtccaccctgataagactcgcgtttcccgtgccggaggcaggcaacaagtgaccggactcgttgtgaacggagagcagggaccccgagtagccagagagacaaaacgccaaattcgcgcagccctgcataacttagcccgcgggaagcctctccaggaaggagaaactctgagccgaatcgccggcttcatcgcgtacattcaaatgagcgagcctgaactgggtaagagactccgtgcacagttggctgctctctga

SEQ ID NO: 13635 - RNA, 1308 nt, unidentified
  source 1..1308: mol_type = other RNA; note = synthetic construct
atggctactacgttccgcatcgactataccagactgctggacctctggcgtgcgatagaaactgctgggggccgtgacaaatacatctccgctcagttgaaggagaagggctatctcatcgaaagaaagcccacggatagcatgagcaaggccgagctggaccgctataagaaaacactcaaggaggaggctgcagagaggcggaagctggccaaggaagcctggcaggcgtacaaggccgcacatctcgtgcatctaggcgaaggcgtgttctggaacgacgatctggatcatgataaatgggatctgcctgacgctgaagaaaggcaggccgagaacgagttacccaaacttgacaagcccaaacaacttgcagaggccttaaaagtatcgatggctgaactcagggttttggcatatcacagggatgctgccaccaaactgaactactacagatttactattcccaagcgagacggatcaaagcgagccatctgggccccccacagacgactcaaggctgctcagagatggattctgcgcgaggtggttgagcgcctgccagtccatggtgcagcccatggctttatgcacggccggtctattgcttcaaacgccgcagctcacactaatgcatccaccgtgctgaaagtggaccttaaggactttttccccactgtgacattgacacgcgttaaaggagtgtttaggaaagctggctacagggagcagattgcaacacttctggccctgctctgcaccgaggccccaagacaggtgagtgaagtcgacgggaaggtgtattacctggcccttggtccgcgatgtctgccacaaggggccccaactagccctgggcttaccaatacgctgtgtatgcggcttgatcgaaggctgcagggagccgcccacaagctaggatggcggtataccaggtacgcagatgatctgacattctccttacctgttggtcacaaagggaaaccacagttgggcaaactactggggtgcatctctgctatagccgtgggcgaaggtttcgtggtgcaccctgataagaccaaggttagccgtagtgggggaaggcagcgggtcacaggcttggtagtcaatggacaaggagcgcctcgggtaccacgcgagttgaagagagaagtccgggcggccctgcacaatctctctaaaggtaaaccgttgcgcgacggtgagacactgtccagactcgccgggatggtcgcgtttatcaccatgaccgacagaaagttaggccaaaagctgcgggcagaactcgataaactaggagcatga

SEQ ID NO: 13636 - RNA, 1302 nt, unidentified
  source 1..1302: mol_type = other RNA; note = synthetic construct
atggctaccactaacagaattgattacaatcgaatgctcgaaacttggcgggcagtggaatctgccggaggtcgtgataagtacatcgaagctcagttgaaagaaaagggttatctggttgagcggaagcccacggagtcaatgagcaaagctgaattggagcgctataagaaaagcctgaaggatgaggccgcagaaaaacggcgcctggcgaaagagagctggcttgcatataaagcagcacacctcgtccacctcggcgaaggcgttttctggaatgaccagctagaccatgacaagtgggatctaccgggggcagaggagaggcaagctgaaaatgagctccctaaattggataagcctaaggagctcgccgaggcactgggtgtatccatcgccgagttgcgccgcctcgcttaccatagggacgcagctacaaaactgaactattaccgcttcgagattcccaaaagggacggatcgaaaagggccatttgggccccacaccgaaccctgaaagcagcgcagagatggattctgagagaagttgtggagaggttacccgtgcatggagccgcccacggcttcttgcatggcagaagtacagcctctaacgccgccgtacacagagacagccagatcctgctaaaggtcgacctgaaggattttttcccaaccgtgacacttccacgggtcaagggggtatttcggaaggcggggtatagggagcagatcgccaccctgctggctctgttatgcacagaagcccctcgacacgtcgccgaggtcgaaggtacaacttattaccttagtctggggcccagatgcctgccacaaggagctcctacttcccccgctatcacgaacaccctgtgtttgcgtctggatcgccggttacagggcctggcaaaaaagcacggctggaggtacacgcgctatgcggacgatctcactttctcactgccaaacgatcataagggcaaaccacacgtgggctcacttcttggtggcatttccatgatagccgctgcagagggctttactgttcaccccgacaagaccagagtccatcggtccgggggaaggcagcaagtgaccggacttgtggtgaatggagggcagggtcctagggctcctagagaatttaaacgggaggtgcgagccgctgtgcataatctcgcccacgggaaaccgttgaaggaaggcgagacactctctagtcttgccgggcgtatagcgtacatctacatgaccgacaagaagctcggaaagcagctgttagccgctctgtctcgagtgtga

SEQ ID NO: 13637 - RNA, 1377 nt, unidentified
  source 1..1377: mol_type = other RNA; note = synthetic construct
atgactcgagctagaccaacaagcagcgcgtcgccgagttcatccctgactggaacttggacccgcccaagaggtgaaccgatgaccacgcgatctgagcgcctcagggacctgtggcgaagcatagaacaggcagggggagccgagaagtacatccaggctcagctgcgggaacggggttttgtagttgaaaggaaacctaccgataagatggggaaagccgagctggctcgatataaacaacagctgaaggctgaagccgcggagagaaagcggttagccaaagaggcgtgggaagccaggagagagcaccgcgtgatccacctgggcgagggtgtcttctggaatgatcagacagacttcgatcgatgggacttagagggagcggaggaaagagccgctgaaaatgaactaccccagttagacaaccctgcacagctcgccgaggcactgggtgtgactattccccagcttcggtggttggcctttcatagggatgccgccactcacgtccactactaccggttcactattcctaaacggacaggcggcgaacgtgccatatgggcaccccatcgtaggctcaaaggcgctcagcgctggattctcagaaacatcgtcgagcgtcttcctgttcacggggcagcccacggttttctacccggcaggagtattgcttccaatgcagctcaccataccgacgcagcagctgtcgtgaagatcgatctgaaggactttttccccacagtgacactgcccagagtaaagggagtcttccggaaggcgggataccgcgagcaaatcgccaccctgctcgccttgctgtgcaccgaagcccccagagaggttgtggaacaagacgggaagacatactatttgtcccttggccctcgatgtcttccacagggggcccctacctctcctggactcaccaataccctgtgcatgcgcctcgatcggaggctactggggctgagcaggaagctcggctggaggtatacccggtatgcagatgacctcacgttctccctgccgaagacacatcagggcccaccaaaactgggcgcactgctctcaacggtggctcggatcgctgcagacgaggggtttacagtgcatccagagaagacaagaatagccaaacgcggcgctaggcagcgtgttactggactggtggtgaacgatgcccatggtccaagagtgcccagaacccttcgccgcagagtacgcgctatgattcacaacttggccaggggcaaacctctgagggagggggagactttggggcagttagcaggccaaatcgcctttatccacatgacggatcccgctttgggaaagcggctggcggcccaactttctgccattgacggatga

SEQ ID NO: 13638 - RNA, 1305 nt, unidentified
  source 1..1305: mol_type = other RNA; note = synthetic construct
atggccacagattcccaggcgacaaggctgcgtgacctctggagagccgttgagcaagcaggcggggtcgataagtacatccagagtcagctccaggagcggggattcctggtggagagacgagaaaccgacaaaatgagcaaagcggaactgcagcggtataaacagcaactgaaagctgaagctgccgaacgtagggccctcaaacgggacgcatgggcagcctaccgggaacagcacgtagtacacctgggcgagggagtattttggaatgaccaatctgatctggatagatgggatctcagagatgccgatgagcgagctgccgaaaacgagctcccccaactggagaatcctgggcaactggctgccgctctaggcctcgagataccccagttgaggtggatggcgtatcaccgcgatgccgcaactaaactacactactaccggttcaccatccctaagcggtctggcggagagcggccaatttgggcaccccataagcagctgaaggcagcgcagcgttggattctgcgaaacatcgttgaaagactccccgtgcacggagccgcacatgggttccttccgggcagaagcatagcttccaacgccgcacaacacgccgactctaagattatagtgaaggtggaccttaaggacttcttccccaccgtcactcttccaagggtcaaaggtgtgtttcgcaaggccggctaccgcgaacagatcgctacgcttctggccctgctctgcactgaagcgccgagggagattgtggaatcaggtgggcgcacgtactatctgagcctaggcccacgctgtcttcctcagggagcccctacctccccagggttgaccaacaccctgtgcctaagattagatcgccgcttacagggccttgcctcgaagctgggctggaggtacacacgatatgccgacgacctgactttttccctccctggcggacatagtggtgccccacgcgttgggacattactgggtagcatcgcccggattgcagctgatgaggggtttgcagtccatcccgataaaacccgagtggctagaaagggtgctcgtcagagggtgactgggttggtggttaatggcgacggaacccccagagtcccacggacaatcaagaggcagttgagggccgctatccataatctgtcacagggaaagccgttaaaagagggtgagacgctgtcaaagttgactggctggattgcttatgtgcacatgacagaccctaaactcggaaagcagttgcaggctcaactggacgcagtggggaggggctga

SEQ ID NO: 13639 - RNA, 1305 nt, unidentified
  source 1..1305: mol_type = other RNA; note = synthetic construct
atgagcactgacccaatcgccctatggcgagccatcgccaacgctggtgggatcgacgcatatgtttccgctcaattggttgagaaagggtttcttgtcaaacgaagacccacagacaatatgagtaaaagagatctcgccagatataagcagcaactgaaggacgaagctgccgaacggagaagactcaagaaagaggcttggctggcatataaggccaatcacatagtgcacctcggcgaaggagtgtattggaatgatgcagcggatgccgaccggttcgatcatccaaaggcagaggagaggttggcagaaaatgggcttccggtgctggataagccccagcagctggcagatgctctcgaggtcccgctaaccgagctccgctggttgacttggcatagggacgcagcggctagagtgcactaccgtcgcttcactattccaaaacggagcgggggcgagagagctatatgggcccctctgccgaaacttaaggctgcccagaggtgggtccttcgtgaaattgtggagaagctgcccgttcacggcgccgcacatggtttcgtagcgggtaggagtattgcgacaaatgccgccgtccatgctgatgccagggtcgtggtgaaagttgacctgaaggactttttcccaacggtcacactgcctcgcgtgaaaggggtgtttaggaaagcaggctaccgcgagcaagtggccacactgctggccctgctgtgcacggaatcacctcgggaagtggttgaggaagatggcaaaacctggttcctgtctttgggaccccggtgtttaccacagggagctccaacgagccctgccttaaccaacaccctctgcttgcgcctggatcgacgcctgaccgggttagctcaggccttaggttggcgatacactcggtacgccgatgacctcaccttttcgctccccagaccccagggaaggaaaaagccaaagccccctcagacagctaagttgctgggaggcatcaagactatcgtagcagacgagggctttaccgtccatccagacaagacacggttcgcccgctctggcggaaggcaacagattactggaatggtgatcaacgatgatcacggacctagggcacctcgggagttgcgtcgacaactccgtgcggcaattcacaacctgaaccagggtaagcctctgcccgagggggaatccatcgacagactgcggggctacgtagcttacatacgcatgacccagcccgaacttggcgagtccctatctgcccagctcgacgctgccctttcaggggcttga

SEQ ID NO: 13640 - RNA, 1395 nt, unidentified
  source 1..1395: mol_type = other RNA; note = synthetic construct
atgtcagacctaaccactctctggttggccgtgaggactgctggctccgtggacaactatgttaggcagcaacttgaagctaaaggcttcttggtgaagcgcaggcccaccgatgggatgtccccaaaagagctggagaaatataagcaagagctaaaacgcgaagccgctgaagcgcggtcgcttagggcagctgcctggaaggcacacaaggccaatcatattgtccatgtgggcgagggcgtctattggaacgacgccgacgacctggatagattcgatgttccgcagcctgaggagcggcaggcagaaaatgggctgccacctctggatagcccaaagaaactggccgaggcactgggcctttccattatagagttaagatggctgtcttggcaccgcgaccttgcaacaggcgtccactaccgacgttttaccatccccaagcggtctgggggagagagggccatatgggcccctatgcctaagctcaaaaaggcccagaggtggatcctacgggagatcgtggaaaagctgcccgttcacggcgccgctcatggcttcttagccggtcgaagcatcgctaccaacgccgcagcccacaatggagcgctggtcgtgctgaagctggacctcaaagatttttttcctaccctgacgctgcctagggttaagggactgttccgtagagccggttacagggaacaggtcgcaacactcctcgcgctcttgtgcacagagagtccccgggagatcgtggaacaggatgggaaacggttgttcgttgctttagggccgcgatgtttacctcagggagcgccaaccagccccgccataactaacgccgtgtgcatgagactggacagaagactcgcgggggcagctgctaaacttggctggcgatatacacgctacgctgacgatctgacttttagccgggtgcgtcctgcagaagccccagtagtagaggctgcagccccagcagctaagcccgcaaaaggtaagaaggctactgcggccgcagagacaacccctgcaccatctcaagctcccgccgctcgcctcagtaaactgctgggagtggtgcatgaggtggtgaaggatgaggggtttattgtccacccggacaaaacccgcgtagctcgctcaggaggcagacaagcggtgacagggcttatcattaatggggatcagggcccaagacctccaagagaattgaggcgtcgggttcgagctgccttgcaccatctcgcccagggaaagccgctgcccgaaggagagacggtcgaaagggtggccggtctgatcgcttacattcggatgacgatgccccaggagggtgaacgcctctacgccgaacttcagaaggtcactggcgcagtagcccccgcctga

SEQ ID NO: 13641 - RNA, 1299 nt, unidentified
  source 1..1299: mol_type = other RNA; note = synthetic construct
atggccgacgacttgatgactctctggcgcgctgtgaggtctgcagggggaagagacgcgtatgtccgcgcccagctggaggagaaaggctttctggtgcgccgcagagagactgatggcatgtccaagcgggagctggctaaatataagaaagagctcaaagctgaagcagccgagcggaaacgattggccaaggaagcctgggacgcctataaggcagcgcacatcgtgcatctgggggagggcgtctactggaacgatgccgcggatttcgacaggttcgatcacccaagagccgaggaacgtgtcgcagagttgggactgcccgcactggatgacccagacgctctggcggaagccctgggattaggcgtcgcagagttacgctggctcacttaccacagggacgccgctaaagccatacactatcgtcgctttacgataccaaagagctcgggtggagaaagggccatatgggcgccgctgcctaagctgaaggaagctcaacggtgggttctgcgggaaatcgtggaaaggctacccgtgcatggtgctgcccatgggttcgtccccgggagatccacagcgactaatgccgccgcacatgccgatgcagagatcctcgtcaaggttgatctcaaagatttttttcccacagtgacactcccccgtgtgcggggagtgtttaggcaggctgggtatcgcgaacaggtagctaccctgctggcccttctgtgtaccgaatcaccacgagaggttgttgagagaggcggcgagacatggtacctggctcttggacctcggtgccttccccagggagctccaacctctcctgccttaaccaacgccctgagtatgaggctcgacaggagactcactggtctagctaagaaactggggtggcggtacaccaggtacgccgacgacttatcattcagcctgcccgtgagtaagaagaagcgaaaagctgcacctaatattggcagcctgctgggtggcgtaaggattattgtagagtccgaagggttcacggtgaacgaaaaaaaaacacaagtggcccctcccggtgctcgtcagaaggttaccgggcttgtcatcaatgatggcttgggtccgcgggtgccaagagcagatagacgacggattcgcgccgcacttcaccgcctaagactcggcaagcctttgccagagggagagtctatcgaacggatcgaaggctggattgcatacatccagatgagccagcctgagctcggggaaagacttgctgccgagttggcagaggtgcgaggaggctga

SEQ ID NO: 13642 - RNA, 1299 nt, unidentified
  source 1..1299: mol_type = other RNA; note = synthetic construct
atggcaagacaacgtacagatattgccactctgctcaggggtatagaacaggcgggcggaattgacgcttacgtggacgcacaactccgcgagcacggtttcctagtgcagcgaaagcccactgacaatatgtcacaacgcgagctcgcccgatataagaaagagctcaaagacgaggcggccgaacgacgaaagctgagaaaagaggctcgcgaggcttatgagacacagcacatcgtgtacttgggggaaggggtcttctggaacgacgcgtatgattatgacaaatgggatcttgaagatgcagaagagcgagctgccgaaaacgagctgcctgcactagacaagcccgttcagttggcagacgccctgggaatcaccgttccccagctgaggcatctcgcctaccacagggattgcgctgagatggtgcattatcggcggtttactatccccaaaagaaacggaggggaacgcgctatttgggcacctctgcctaggctcaagggtgtgcagcggtgggtgcttagagcaattgtggagcgtctgcttattcacggtgccgcccatgggttcgtacctggaagaggaatccacaccaatgctaggatacatagagatgccagcatcgtgctgaagatggacatcaaagacttcttccccagcgtgacatttcctagggtcagaggggttttccggaaggcaggctaccgcgagcagatcgccaccctgttagccttaatttgtacagaggcacctcgggagattgtggaggaagacggcaagcgatggtttgtatccttaggcccaaggtgtttgccccagggcgcaccaacatcgccagccttgaccaatgtggtctgcctcaagcttgaccggaggctgactgggctggccgaaaaactggggtggcgctactctagatatgccgatgacatgacctttagtcgcccgcggggtgctaaaggacctccgaactttgcgactctgaggtccagggcccgccaaatcgtcatggatgaggggtttcgggtccacccagacaagacgcacgttgcccgccgtggtgcaagacagactgtgaccggccttgtcaccaacggcgacttgccaccgagagttccacgccggaatcggaggcagataagagctgctatacacaatctcggacagggcaagccccttcatgatggagaaacggtagataccctggccggctacatcgcttacatcgccatgacagatagggcggctgctgatcggctgcgtcaggaattatctgccgccctgggcggctga

SEQ ID NO: 13643 - RNA, 1293 nt, unidentified
  source 1..1293: mol_type = other RNA; note = synthetic construct
atggccacgactacccccaactacgatgacctctggagatccatcgcgcaggctggaggtatcgatgcatatgtcacacagcagctgaaagaaaggggcttcctgactgaacgtagcgacgccagccagatgtctaagaatgagctgaagaggtacaaggcctccctgaaggctgaggccgctgagaaactgcgcttaaagaaggaggcatggctggcgtaccggtcacagcatatcgtccatttaggcgagggcatgtattggaatgacgctgccgatatcgatgggttcgatctggcagaacctgaagcgcgggccagtgagaacgaattgcctcagctcgacaacccgaaacagctggccgacgccctctccctgactgttgccgacgtgaggtggctctcttatcaccgggacgccgctcgatcgctgcactatcggagatttaccatacctaaaaagtctgggggagaacggccaatctgggcgcccatgcctaagcttaaggcggctcagcgctggattgcccggcatattgtggaaagacttccggtgcacggccacgcccatgcatttcttccagctaggagcataaatacgaatgcaaagcaacacatcggaagcaaaatggtgttacagatggatttggtcgggttcttccccaccgtcacatttcccagggttaaggggattttccgaaaggccggctacagagagcaaattgccactttgttggcagccatttgcactgaagcaccgagagaggtgttggagcacgagggaaagacatggtttatcgccatgggaccaagggctctcccacagggagctcctacatccccaggtctaaccaacacactctgtctacgtctcgatcgtcgcttgacagccctggctgcaaagctggggtggaactacaccagatatgctgatgatctgactttcagtctactgaagtcacataaaggcaaacccaatctcggggcacttatgggctgcataaaaaaagtcgtgaccgacgaagggttcgtagtgaacgcagacaaaacccgcgtgtcaaggaagggaggtagacagaaagttaccggcctggtggtgaacggagtacaaccaccccgagttccccgcgaatttaaacgacgcctgcgcgctgcaattcacagactggagaatgggggtgccttatttgagggcgagacactggacaccctgaagggccaagctgcctacgtattcatgacggaccctgaacttggccggaagatgcttgagaggctcgccaaactcggttga

SEQ ID NO: 13644 - RNA, 1338 nt, unidentified
  source 1..1338: mol_type = other RNA; note = synthetic construct
atggccagaaagcgtacagacccagtgtacatatggagggccattctccaggctggcggcatcgatgcatatatcgaagcacaacttgccgagagaggggtgaaggtagagaaaaaagagactgccgggatgtcagcccgggaattggagcagtacaagaaacagctcagagcagaagccgaggagagaaaaaaactgaagaaggaggcttggaaagcctataaagctaaccatattgtgcatctgggagagggtgtctattggaacgacgagaaaaggcaggataaatgggacgtggctcacgcagaagagagagcagcggagaatgaactgccgcccctggacaccccacctcaacttgccgaggcgctgggactgaccgtaccacagctgcgctggttggcctaccaccgagaagccgccactaaagtgcactattaccgcttcaccatcccaaagcgcaatggatctgagcggcctatatgggctcctctgcctaaactgaaggcggcacagcagtggattcgggtccatatcgtggaaaagctcatcgttcatggggccgttcacgggtttttacccggccactcgacactgtccaacgccagcgtccataggaaccctaagatcgtcctcaagatggacattaaagagttctttcccaccgtgacattgccaagggtcaagggagtgttccgcaaggccggctatcgggaacaggtggccacgctcctggctttattgtgcacagaagcacccagagagatcgtccaccatggaggcaaagactattacgttgcactcggaccacgatgcttaccccaaggcgctcctactagtccgggcctcacgaatactctctgtttacgacttgaccaacggctggccggcctggcaaagaagtacggctggcggtacaccaggtacgccgacgatcttaccttcagcctgccgaaggcacacgatggcgatccccacgtggggactttgattgggctcgtgcgcagaattgtggaggatgaaggcttcgcggttcatccagataaaacccgcttggctaggtctggtgggcggcagaagatcactggcctggtggttaatggagatcttaagccccgtgtacctcgaaagctgcgcaggcagatgcgtgccgctctacacaacctacagtgtggtaagcccctaaaagaaggagagacatttgcgaggttggctggttacgcagcttatataaacatgtccgaccctaatctgggggccagaatgcttgaaacatttaagattggtctggctgctacagtcacgaccaatggagagcagaccgccgaagacaagtga

SEQ ID NO: 13645 - RNA, 1308 nt, unidentified
  source 1..1308: mol_type = other RNA; note = synthetic construct
atggcccgccgtagaacaaatgtggctgacctgtggcgcgcaattgagcaggctggtagcgtccaagcctatgtggatcagcagctccgggagcgaggcttcttcgtggagaggcgggatgccggccagatgtccaaacgagaactggcagcatataagaagcaactgaaagaagaagcagctgaaaaaaggaagctaaaagccgaggcctggcaggcgtacaaagccaaccacatagttcacctcggggagcacgtattttggaatgacggactcgattgggacaaatgggaccttgagcatgccgaggaaagggctgcagaaaacgaactgcccgccttggatagtcccggacagttagcaaaaaagttagacgtgagtgtagctgaactgagatggcttgcctaccatcgcgaggccgcaactatgctgcattatcgacggtttacaatcccaaagcgggacggatctgagagggccatctgggccccactgcctaaactgaagagtgcgcaacggtggatcctccgcaacattgtggagaagctggtcgtccacggtgccgcacacggattcctgcctgggagatcaatactgagcaatgcggctcagcatacagattcaaagattctcctgaagatggacctacagaatttctttccgaccatcaccctgcctcgggtcaagggcgtgtttcgcaaagctggctatagagagcaagtggccacgcttctggccctaatctgcactgagtctcctcgtgaaattgtggagcactcagataagacatacttcgttgccctcggccctagatgtttgcctcagggagcgcccacttccccagccttgactaacaccatctgcttgagactggataggaggctcgctggcctggctaaaaagcatggttggaggtacaccaggtacgccgacgacctgaccttttccctgccccaggaccacaagggtccacccaacctcggcaccgtaatgggaggagtcaaagttgtggttgctggcgaggggttccggattcacccagaaaagactagagtggctcgtgtgggggggcagcagaaggtgacaggtcttgtggtaaatgaagatcgcccgcccagagtctctcgcaaattgaagcgacagttacgagcggcaatacataacttacaacaagggaaaccgctccacgaaggcgagacgctggagtctcttaagggccatgccgcttacatcgcaatgagcgagcccgagctcgggcagtcgttgcttgaacagattgctgcagtcagcgagccagtttccaattga

SEQ ID NO: 13646 - RNA, 1299 nt, unidentified
  source 1..1299: mol_type = other RNA; note = synthetic construct
atgaccgaacgtactactgacctggccaccatcttcaggggcattgagcaggccggcaccatagatgcctacgtcgatggacagcttcgagaaaggggctttctggtggagaggcgagccacggatgatatgtctcagcgagagctggccaggtacaaaaaagagttgaagcaagaagctgcagaaaagaggaagctccgggctgtcgcgtggaaggcatacaagacccagaacatcgttttcctcggcgaaggagtgttttggaacgacgccctggactgggataaatgggacttggagaacgctgaggcacgcgctgcggaaaatgagctacctccattggacaaaccacagcagcttgccgaggcgcttcaattaaccatctcacagctgaggtggctggcctatcacagggacgtagccacgtctattcattaccgaaggtttacaataccaaaaagagatgggtccgagcgcgcgatttggtccccaagacccacattaaaggctgcacagcggtgggtcctgcgtaacatcgtggagcgcctcacagttcacggggcaacacacggctttctggccggaagaagcatagccagtaatgccgcagcccataccgacagccagatgattgtgaaaatggatctcaaggacttcttccccactgttacctaccctcgcgtgagagggattttccgtcacgctggatatcgggaacaaatcgccaccctgctggctctgctctgcacagaggcacctcgggagattgtggaagaagacggtcagaccctgtatgtgtcactcggcccccgctgtttgccacaaggagcacccacatctcccgccctgacaaatgtgatctgcgtgaaaatggatcgccggattagtggcttggcacagaaactggggtggagatatactagatacgccgacgatatgactttttccctcccgtcgaataccggtaaagctaagacgaagcaggatgctaatcctgccccactaatagggtgggtcaagcgtatcgtggcggatgaggggttccgggtccatcctgacaagactcgcgtaattaggaagggaggtcggcaagccgttaccggcctcatcgtgaacggaactggggccccgagagtacctcggaaaacaagacgaatgcttcgggccgcaatgcacaacctaagcaagggtatcccccttcgcgatgacgagacactggctactttacagggctatatcgcttttatcgctcagacggaccccgaacaggcacagagactgaaggaacaactggcttga

SEQ ID NO: 13647 - RNA, 1362 nt, unidentified
  source 1..1362: mol_type = other RNA; note = synthetic construct
atgtctacagagaaccagaaagccttagttgccctctggaacgagattcagcacgccggcggcagagaaagctatattcgcaatgaactcacaagaatggggattgaaatccccgctagagtgaaaatcactaacatccgcaataaagagaagaaagccgcgtacatcgctttgcggcagaaggaggaggaagcaaggggctttattaacaagaaagtgtgggccgcatatcgggccacccatatcgtggacctgggagatggaatattttggaaggacccaaccaaggatttctatgatacccacgaccgcgcccagagacgtgaggataatggtattccggagctagaaaccgttgaccagctggtcgaggctttatcagaggcttacgccaatggggattccaatattgaactcgatatccccactctcagatggctgtgttaccatcgcgaagtggctactaccacccactacaagtcatttagcataccaaagaagaccggtggaaacagacagatatgggcacctatgccccgcttgaagagcgtgcagaagtggatttctaggaacatcgcagagaaactggtcaaccacggcgcagctcacggatttatctccggtcggagtatactcagcaatgccagcgtacatacgaactctaaaatcgtggtatccatggacctgcaagacttctttccaacgttcacatttaatcgtgtgaaagggattttccgagcggccggctatcttgaagggatagcaacactgttggcgctgctttgcaccgaggctccacgaaagaagatcaaattccctgacgagaagaaccctggtaaagagaagtgggtgtatgtagcctccggcgatcggtgtctgccccaaggatcacctgcctccccctctctgacaaacgcagcctgcctgaggttggaccggcggttagccggatacgccactaagtacggttggcgctacactaggtatgcggatgaccttaccttcagtttcccggctgactctgctaaaagccctaagacagatctgttgatcaagagggtccaggagtttgttgtctccgagggcttcatcgtgcaccctaataaaacagacaaaatgggcactggggggcagcaaaaggttactgggctcattgtgaatggagtgggaaaaccccgagtcagtaagggctttcgtgataacctgagggcagccatccataatcaagaggaaggcaaggagctgatgtacgaagaagaatcacttgagacacttatgggctatgctagtttcatcttctcggctgacccaaccaaagggaccacgctaattgagaagctccaggcactggaagaggaatga

SEQ ID NO: 13648 - RNA, 1341 nt, unidentified
  source 1..1341: mol_type = other RNA; note = synthetic construct
atgagtactgaaaattccaacgagctcgtcgagctttggaatgagatccagcaagttggcgggaaggaagcctatatcaggagagagctcgcaaggatgggcatagaggtgccagaacgcgtaaagatcaccaatattcgagacaagacaaagaaagctgagtacatcagcctgcggcagaaggaggataaggcacgcgctataataaacaagaaaatctgggccgcatatcggaaaacgcacatcgtggacctcggggatggcatattttggaaggaccccagcaaggacttcttcgacgttcacgatagggaagaaagacgtaaagacaatggcattccagagctagaaaccgttgatcagctggtggaggccttacgttctgtagatagcgacatcgacgtgcccacaattcgatggatgtgctatcaccgcgaggttgcgaccactactcattaccgggctttcaaaattccgaaaaagaccggaggtgaacgccacatctgggccccaatgcccaggctcaaagccattcaaaaatggatcagtaggaacattgccgagaagttggcaacacatggggcagcccatgggtttatcgtcggcagaagcattgtgtctaatgcgatggtccacacagattccaaagtggtggtcagtatggacctgaaggacttcttcccaacctttacctttaaacgggtgaagggcatttttcgcgccgcgggttaccttgacgggattgcaaccttgttagccctgttctgtacggaggcacctcgggttcctatgtgtctgcctgacgagaacgacccgtcaaaggaaaaatgggtctacgtagcttccggagagcggtgcctgccacaaggatcacctgcctctcctgcgctgactaacagtgcttgcctacgcctggatcgtagattggccggttatgctcagaagtatgggtggaggtacactcgatacgctgacgatctgaccttcagctttccctcttccgattcccgatcagcaaatgtggatcttctgaagaaattcgtccacgatatcgtgacttccgagggctttgttgtgcatcccgacaaaaccgatgtaatgggaacaggaggccagcagaaggtgactggactgatagtcaatggtaccggctcacccagggtgcccagagaatttagagataagctgagagctgccatccataaccaggaacaggggcagcctctctttgaagacgaaacaatgagcacgctgcttggctacgcctctttcgtgttctcggctgatccagaacggggaaaaacacagttagagcaattgcagaagctcaacgagcagtga

SEQ ID NO: 13649 - RNA, 1326 nt, unidentified
  source 1..1326: mol_type = other RNA; note = synthetic construct
atgattgagcggcttagtgagaagcttagcggggttgagagagaggcactggaggcgaaggcggagttatggagcgcagtcgagcaggctggtggcgcaagacgctatgtggaggctgaactgcggcgacgtggggtgttcgtggaaagacaggatgtgctcgccatgggattcgacgaaaaaaaggcctacgtggaacgggtggcagccgagcaggaagtcaggaggccgctgcaaagcaaagtatgggccgcttacacagcgctgcacataacccaccttggagaggaagttttttggcaaggcgacgtgtctgtggacttcttcgacccggatcatttagccgcccgcctggaacagaagggtctgcctccactggagcgcccagaggacctgtgtgaggcgttaggtctaacactgtccgaattgcgctggctctgctatcatcgtgaagcggcaacctctctccactatcgcacctttgagatcccaaagaaaacgggaggcgtgaggaggatttgggcccccttacccaagctcaaagccgctcaggagtgggttctgcggtcgattgccgaaagactcgtcgtccatggcgcagctcacggcttcgttgcaggcaggtcaatctactcaaacgcactcgagcatctggactcccgccttgtggtaagtatggatttggctgacttcttcccttcttttacattcaagcgggtgaagggaatctttcgacaggccgggtacatggacggcatagccgctctgctggctctgttgtgcacggaagccccaagagaggtcacagagcacgagggccagcggtactatctggctctcggaccccggtgtctgccacaagggagtcctgcttctcccgccctcactaatgcagcctgccttaggctggatcgaaggctagcagggtgggccgcaaaagccggctggagatacactcgttacgctgatgatctcaccttttcagtccccgcctccgctgctgaggaaccttcagtatcccagttgcttggggtcgtgcacgctatcgttgccgaagaggggctggtggtcagagacgacaaaacccatgttatgcgacgcggtgccaggcatcaggtgactggactcgtagtcaatgatgccactcctcctcggcccccaagagaattgagacgccgagtacgcgccatggtgcacaacgtcgcgtccggaaggggtctaagagagggcgaaagcctgagccaattggttggctttgtggcatatttgcacatgtgtgatcccgtggaaggacggaggctgatggaggtgcttcgtggggcctga

SEQ ID NO: 13650 - RNA, 1329 nt, unidentified
  source 1..1329: mol_type = other RNA; note = synthetic construct
atgagtgagcacctaaacgaccgtacctcccatcaggaattctggaccgaaatcgtcgaggcaggcggcccacggaagtacgtggaaacccagcttagggagagaggggtgtgggtgaagcggcaggacgttttgagtatgggagctaaggccaaacaagcctacatcgagcagatcaaagctgaggacgccatcaggaagccgctgcaggaaaaggtctggaagacatacaccgccctgcacatagtgcatctcggggaagatattttttggcagtcagacgtgtctatagatttcttcgatcccgcccacaggcagtcccgccttaagcagcgccaactccaagatatcgaaagcgctgaggagctcagcgaccagatgggaattactctcggagaactgcgatggctctgttaccatagagaggcggcaaagtccattcactatcatcgcttctctatcccaaagaagtccgggggggaacgccaaatatgggcgccaatgcctaaactcaagacagcgcaaacttgggtgttacggaacatcgccgagcgactcacggtacacggtgctgctcatgggtttatggccggcagaagcatttattccaacgcattggagcacacaaatgcatcggtgatcgttagtatggacctggccgatttctttccctcatttacattcaagcgggtcaaagggatctttcgtcaagccggatacatggacggaattgcaaccattctggcacttctgtgcacagaggcacctcgggaagtagtagaggacgaaggcgagacttattatgtggcaatgggaccgaggtgcctgcctcaaggaagcccagcttcccccgctctaactaatgctgcctgtctgagactggaccggcgcttatctcagttcgccgagaagaaccagtggcgctacacacgatatgcagacgatctgactttctctgtgcctaaagctgaaagcaaactgtcagaggaggaactgagcgccaagattaaacagttgatcggcacggttcacgctgttgttgaagacgaggggcttcaggtccgttctgataaaacccatgtcatgaggcccggcaagagacagaaagtgaccggtttggtggtcaatggtcaggataccccaagaactcctagggagctgcgaaggcgggtcagagcgatgatacataatctcaaggtgggcaaaacgttacacgagggcgaaagtctaaaccacctgaccggtctgatcgcctttatttacatgtcagatccccagcagggccagaaacttttggagcagctgaaacaggccacagcccccagctga

SEQ ID NO: 13651 - RNA, 1314 nt, unidentified
  source 1..1314: mol_type = other RNA; note = synthetic construct
atgaataaagagcgagttcaggagctggagaagcgttggcagaagatccaagaccaaggcggtccccaggcttacctcgaacagcaacttagaaaggcaggggtgtggagaagatacaggcccaatatgatagagcctggtatcaacaagagtgacgaaatccgcgctagccggctggaacgcgaaaagaggctcgagctcaagaaatatatttgggaggcgtacaaagccactcatatcagccatctgggactggacgtctactggaacgatgaggtgggagaagactttttcgacgtgcatgaacggctgaagaggcaggaagagcagggccttcccagcattgagacagtggaggaactagtagaagccctgagtcaggcagtgccagaaatgaccatcccaatgctgcgctggttgtgttaccaccaggacgtcgcgacccatctgcactatagacactttgagattgagaaaaagaccggaggttttaggcagatctgggcacctcttcccaaactgaaggccatacagcactggatcttgcagaatatcgtagaacacatgccaatacacggcgccgcacacgggtttgtatcaggccgatccatattctcaaacgccgaggaacattgcaattcggatgttgtggtcgggctggatctgaaggatttcttcccttctttcacattcccccgggtcaagggaatcttccgtaactatggctacaagtctgagatttcaaccctcctcgctttactatgcaccgaggccccgcggagaattgtgcagattgagggcaagacagtctacgttgccacaggctctcgcgcactacctcagggaagtcctgtgagccctgctcttacgaatgtggcctcaatgagattggaccgacgcttatctggttatgccctgaaacacggctggcggtatactaggtatgctgatgatctgacgttttccgctccgaccggccaaggccgcaagaacattaaagcgcttttagagactgtcgacaccatcgtgacagaagagggactgaaggtgcatccaaagaaaactcacgttatgggaaaagggcgaaggcaggaggtgactggactggtcgtgaacgggtccgaaagcccacgggtgcccaaagagcggcgtaaaatgcttagggcagctctcaataatgcccaaaaagggaaggaagttgagttggggtatgcactccagcaactcatgggtcatgccgcctttgtttacgctgcccagccagagctggggagatccttgattgaggctttctccgaactgatgaacgaatga

SEQ ID NO: 13652 - RNA, 1290 nt, unidentified
  source 1..1290: mol_type = other RNA; note = synthetic construct
atgaccgacctcctcaagctttggcaggagattgaagccgccgggaatatagacaattatatcgagcagcagctggtgaagaacggctatctggttgagcggcgggatacagatgatatgtcaaaaaaggagctcgatagatacaagaaacagttgaaacaggaagctaaggctaagaaggagctgaaaaaaaaaacctggctcgcctacaaggcttcgcacatagtccatgttggtgaggggattttttggaatgatggagccaacttcgaccagtgggaccacttgagggcagaggagcagacctcagccaacgagctccctcctctagatagtccaaaggaattggcgaaaactatggggataacaatcgaagaactgaggtggttcacttaccatcgcgacgacgccaagaagatccattataggcggtttacaatccccaagagatctgggggagaacgcaacatctgggcgcctctcccaaagttgaaagagttacagaggtggattctgcgcgagatagccgaaaagcttcccatccacggagcctcccacggttttgtggctggacgtagcattctgtctaatgcagctgtgcataataactctcacattgtggtgagaatggacctgaaagacttcttccccacgttaaccttcccacgggtaaaaggtatctttcgccacgcgggttaccgagagcagattgctaccctgttagccctgatctgcaccgaggcaccacgcgaagtgattcagcacgagggggaactgcattatcttagccttggaccgaggtgtttaccccagggtgcacccacaagtcctgccctgagtaacgtcgctagcttgaagctggatcggcgcctatccggactcgctaagaagctgggctggcgatatacacggtacgcagacgaccttactttttcccttccagagaaatacaagaaaggcaactcacaactcggagccctgctaaaaagcgtgcctaacatcgtgagcgatgagggatttgagatcaataggaaaaagacttgggtcgcacgaaagggcggcagacaatgcgtcactggcctggtggttaacggcaaagagatgcctagagtcccccgtaagaaacagagggaaatcagatccgccatccacaatctgcagcaaggcaaggggctgagagaaggcgaaacgatagaacaaatcctcgggtacgtagcattcatttatatgtctcagccggataaaggcaagaaactgctggagaagattgggaatattaagttgcaatga

SEQ ID NO: 13653 - RNA, 1302 nt, unidentified
  source 1..1302: mol_type = other RNA; note = synthetic construct
atgtcagagcacaaggccaaccgttatgagcaaatctggcaggcaatcgagcaggcaggaagcgttaatgcttatgtgcgggagcagctgcagcaacatgggttcttggttacacgcagacccacagacgagatgagtaaagccgagttagaaaaatacaggcaggccctgaagaaggaggcggcagagcaaaaccgcctcagacagcaggcttggcaagcataccaggctaaacatattgtccacttaggtgaaggcatctactggaccgatgacagctcagaggatcagtgggatgcccccaatgccaaccagcggctactggaaaatcagcttcctgctatcacccaggtggctcaactctgtcaggctctccagttgtctgtgagcgagttgcgctggctgtgctaccagagggaagtttctactcattcacactacacccgatttgaaatccccaaacggagcggaggcattagagccatttgggccccgctccctaaactgaaacaggcacagcattggatattgcacgagattctggaacgcctcgtggtacacggcagcgcacatggttttattactggcaggtcgatagccactaatgccgcggaacacggggacagtcaggtccttgtgaagcttgacatagagaattttttccccacgattagttggaggagagtgaagggcgtatttaggaaagccggctatcccgaacagattgccacacttcttgccctgctctgcactgaatccccacggcagctggtcgagcatgagggcaagtccgtgtatgtggctctggccgagaggtgtctcccacaaggagcgccaacgtctcctgcactgaccaatgcgctgtgcttgagacttgatcggagactcacagggttcgcccacaaagccgggtggcgatacacacgatacgctgacgatttaagtttttccctcccagcaaccaaccaagcccccccagagttgtccaggctcctaggcaccgtgaagcgtgttctgggcgaagaagggttcgcgctgaacctgtccaagacccgcgttatccgtccggctgaagtgcaaactgtaaccggactggtggtcaatggagcacagccacctagagtcaagaggtctttaaagcgccagatgcgggctgccgtgcacaacctgaaccagggtaaggcactgcctgcaggagagtcactgagccggctaaaaggatatgccgcttatatcgctatgacagatcgagacttgggtttcgacctgcttaaccagctgcaacctgtcggggaaatctga

SEQ ID NO: 13654 - RNA, 1290 nt, unidentified
  source 1..1290: mol_type = other RNA; note = synthetic construct
atgtccgagctgagtagatatgagcaggtctggcaagcaattgaaaaggccgggtcagtaaatgcttatgtacgagagcagatgcagaaaaacggatttatggtggccagacggcccactgataacatgaataagaccgagctcgagaagtataggcaggaacttaagaaggaggcggccgaacagcggagacttaataaagaagcttggcaggcctacaaggccaagcatattgtccacctgggggaaggcatctactggactgatgatagttccgaggaccagtgggatgtaccgaacgctaacaaacgactgctcgaaaaccagttgcctgccattactaaggtgccacagctatgcgaggcgctcaaattgagcgttaatgagcttcgctggctgtgctaccaacgggaagtggcagataagagccactatacgcggttcgagatacctaagaggtccggaggtctgcgagcaatatgggccccgttgccaaaactgaaacaggctcagcattggattctccatgagatattggaccggcttgtggtccatggttctgcacacggtttcatcgcgggaagatcgattgcaaccaacgctgccgagcacacgaactcacaagtcctcgtgaaagtggacatcaaagactttttcccctcaatcagctggaagagggtgaagggcgtattcagaaaggcaggctacccagagcagatcgccacactgcttgctctcctgtgcaccgagagccctagggaagtggttgagcacgccgggaaacaggtttatgttgcattggctgataggtgtctacctcagggggcacccacaagtccagccttgacaaatgtgctgtgtctgcgactcgaccgtaggctcaccggctttgcccagaaagccggctggagatacaccaggtacgcggacgatctatctttcagcctgccagctacttctaagaatcctgctgaaatctcaagactcctggggaccctgaagagggtgctgggagaagaagggtttgacctgaatgacaagaagactcgcgtgattcgccaaggtgctgtgcagacagtgaccggcctggtggtcaacggcgaacaatctccccgggtttcccgtgtcttaaaacgccagatgcgcgctgccgtccacaatctgaaacagggaaaagttctgcccgagggcgaatccttacaacgtttacgcggctatgcagcctacatcgccatgacagaccgggagttaggacttgggctgctcggacaactgcagcaagagcagtga

SEQ ID NO: 13655 - RNA, 1287 nt, unidentified
  source 1..1287: mol_type = other RNA; note = synthetic construct
atggccaagcagaccaaactcgaaaagctatggaccgaaattgagaaagccggcagccgtgacgcctacattcaagagcagctgcgtaagaacggatttatggtccagaggcggagtaccgacaatttgagcaagtctgagctcgagaagtataaacaggagctgaagaaagaggccgctgagaaaagacgccttcaacaagctgcatgggcggcgtacaagacacagcatatcgtgcacctgggagaaggcatatactggacagacgacaccagcgcagatcagtgggaccttgataatgctcacaaaagactcttagccaatcagctccctcagctgacccgagtgaaacatctctccgacgctctcggtctgagcattgccgagttgcggtggctttgctaccagcgcgatgcggcactgaagactcactatacaagattcgaaataccaaagaggtcagggggagtgcgcgctatatgggcccccttgcctaaattaaaacaggcccaacgctggatcctggatcatatcttggaccgactgctcgtacacggagccgcccatggttttctcatgggcagatcgattgcatccaacgcagcagagcacagtgacagccagatcctggtgaaaatggacattgccgactttttcccctctatttcctggaagaggatcaaaggggtcttccggaaggcaggatatcctgaacaaatcgcaacgctgctggcgcttctgtgtactgaatccccgcgagagcaggtagagcacaatggtcagtcttattacatcgctatggccgatagatgcctgccacagggtacgcctacctctccggctctgactaacgcgctatgtctgaaacttgatagaaggctggctgggttcgcctcaaagaccgcttggcgatatactcggtatgccgatgacctgacttttagtttcccaaatcactccacaagcaaggcaaatatatcacaactgctgggcacagtgaagcggattcttggggatgaagggtttaagctgaacaactcaaaaacccgtgtgattaggcagaatactgttcatgaagtcacgggcctggtggttaacggcacacaggccccaagggttaagcgcaccttgaagcggcagttgcgcgctgctatccacaacttaaaacaaggcaagcccctccccgaaggcgagagtatccagagactaaaagggtacgcagcctacatcgccatgacagagagggaattaggactcaagatgcttgctgagttggataacgtctga

SEQ ID NO: 13656 - RNA, 1284 nt, unidentified
  source 1..1284: mol_type = other RNA; note = synthetic construct
atggccaccgagtgggaagaacgatgggccgagattgaaaaagccggtagcatcaatgcatacattcagcagcagctcgtcgccaaaggcttcttggtggaacgacgggctactgataaaatgacccctcgcgaactggagcaatataaaaagagtctgaagactgaagctacagaaaaggctcaactccgcaaagcggcttggcaggtgtacaaagcaaatcacatggtgtacttgggagaagggatctattggagcgatgactcctcagaggatgacttcgatttagcatctgccgagaagcggttactggataaccagcttcctgctatcaccaaagtgaaacagctggcggagcagctgaaactgacaattcctcagctgcgacagttgtgttaccacagagaggctgccaccgacctcaattacacaagatttgagatcccaaagcgaagtggagggatgcggccgatttgggcgcccagactcctcctgaagaatacccagaggtggatcctcgagcatatactggagcgactgctagttcacggagcagcccacggatttctgatgggcaggtctatcgccacgaacgccgcacagcacaataactccgaaatattgatcaagctcgacattaaggacttcttcccctctatatcctggagaagggttaagggagtgttccggaaggccggctatcgggaacaggtcgctactcttctggcactgctgtgcaccgaagctcccagggaagtggtcgagcgtcaggggaagaagcattacgttgcccttggcgctcggtgcctacctcaaggtgcgccaacttcaccggccctgacaaacgtgctttgtctcaggttagaccggagactgaccggcatcgccacaaagttcggttggcgctacagtcgctatgccgacgacatgacttttagcctccccgtagggcatgctggagatccacaaatcgccaaggtgcttggatcaattcagcgcgtaatgggtgaggagggctttgagctgaatcgcgccaaaacgcacattgttaggaggggtgcacgtcaggaggtcaccggcttggtggtgaacaacgaggggctgccacgcgtcaaaagatccacgaaacgtcaaatgagagccgcacttcataacttaaagacagggaagggcctgaaagagggggagtcgctaaataggctgaagggctatgctgcatatatggcaatgactgaacgggagttgggccttagactcctgtctgaattgagcgagtttgggtga

SEQ ID NO: 13657 - RNA, 915 nt, unidentified
  source 1..915: mol_type = other RNA; note = synthetic construct
atggcaaatcaacagcagaataagatcgagaagttgtgggcggctattgagaaagccgggagcatggatgcttacgtccgcggtcagttgcgggacaaggggttcctcgtggagcgtcgtgacaccgatgacatgtcgaaaagggctctgaacaaatataagcaggaactgaaggccgaggctgaagagaaaaggaaacttaccaagaaggcttggcaggcgtataaagccaaccacatcgtgcatcttggagaaggcatctattggacggatgatacgtccgaggaccgctgggatctcgataatgctcagaagaggctgctggaaaatcagctgcctaacatcactcgcgtaaaacagctcgcagaggccctggaactgagcatctcagagctgagatggctctgctaccatcgggaagctgcgacctctagccattacattcgattcgagataccaaaacggtctggcggccaacgcgcaatttgggcccccatgccaaagttgaaaaaggtacagaggtggattctgggagagatcttagacagattactcgtgcacgggagtgcccacggatttcttgccggtcggtccatagcaaccaatgcggctcagcatactgactcacgcctaatcgtcaagatggatattgaagacttttttcccagcgtttcctggaaaagggtgaagggcgtgttccgaaaggccggttataacgagcaaatagccacactcctggccctcctgtgtacagagtccccccgagaaatggtcgaacacaacgggagaacccactacgttgccttggcagagcggtgtcttcctcaaggcgcaccgacaagtcctgcactgacaaacgtgctgtgcttaaaactagacagaagaatttctggaactgccggcaagttcaattga

SEQ ID NO: 13658 - RNA, 1287 nt, unidentified
  source 1..1287: mol_type = other RNA; note = synthetic construct
atgggaaggaccagtaacaaagtcgagaaactgtgggctgacattgaaaaggctggttctattaaccgatatgtccggcaagagttagacaacaaaggctttcttgtcaagcgagtgaataccgataatttgtctgtgcgcgaactgaagcagtacaaagcagctctgaagaaggaatcagccgagaagcgtgccttgaataaggccgcttgggaggcatataaagcacaccatattgttcacttgggggacggcatatattggaccgacgacacatcgacagatcagtgggatcttgacaacgccacgaagagactccttgagaatcagctgcctcagattacccgggtgaaggccttagccgaggcgctaggactcacaatcagccagttgcggtggctgtgttaccatagggaggtggccacacaatcacattacacgcgcttcgaaattcccaagcgttctggtggggttaggaccatttgggcgcctcgacctaagctgaaaaaagtgcagaggtggatcctgaacaatattttagactccttgctggttcacggcagtgcacacggcttcttagctggcaggtccatcgccactaacgctatcgagcacactgatagtcaggtgctgatcaagatggacatcgaaaattttttcccgactatcagttggaagagagtcaaaggagtatttagaaaggccggttactccgagcagattgctacccttctggctcttctatgcacagagtccccaagagaagtgatcaacaaagatggacaagatctctatatagcattggctgacagatgcctcccccaaggtgctccaacaagccccgcgataaccaatgcgctctgtctgtcactagatcgcaggatgactagcatggccaataaggcagggctgcgatacactaggtacgccgacgatctgacgtttagctacgctgcgaagaaaaagaaagcccccgaaatcagccagctgatcggaggagtaaagcggatcctcggagacgagggcttcaaggtgaacactaaaaaaacccatgttatccgccagggcagcacacaggaagtgaccgggctcatagtcaacggcaagggcatgcctcgggtgtctcggaaactgaagagacagatgcgcgccgccatttataacctgaaacaagggcgtgagctgccagaaggtgaatcaatccagcgcctccgggggtatgcagcctacattgcaatgactgatagagccctgggccttgggatgctcgaggcactgtccgattga

SEQ ID NO: 13659 - RNA, 1278 nt, unidentified
  source 1..1278: mol_type = other RNA; note = synthetic construct
atgagctcaacactggagtctctgtggattgtaattgagcaggccggaggcatcgaccggtacgtcgataaggaactcaaggccaagggctatctggtcgaaaggtcagatacagcgagtatgagtaaacgagccttgggcatctataagaaagcactgaaacaagagagtgtagagaagaggactctgaaaaaacaggcttgggctgcttacaaacagacacatcttgtgcacctcggagagggcattttctggagcgacgcagaagacgaggacaagtgggacgtggagaatgcccataagcgcctgcttgaaaaccagctacccgctatcacgaaaagcaaacagctagccgaggccttggatatatctatcgctgagctgcgctggctgtgctaccacagagaggcctcgacttcaagtcattacacccgattcgaaataccaaaaagggatggctctagccgtgaaatctgggccccacgtccgttgttgaaaaaggtgcagacctggattctgcgggaaattctggagcggttgcttgtgcacggtgcagcacacggctttctggcaggcagaagcatcgcgactaatgcctcccagcacatcaactcgaagattttagtgaaaatggacattgaggatttctttccgtccatctcctggaaacgagtgcgcggagtgttccgcaaggccggatatcaaggtcacatcgcaaccctcctggctctcctgtgtaccgaagcgccaaggaagatcgttgaacaccgtgggaaaactacgtatgtcgccttgggggaaaggtgcctaccccaaggtgcgcctacttctcctgcattaagcaatgctctctgcctttctctggaccgaagactgacaggagttgccaccaagctgggatggcgctacagcagatacgctgacgatcttgctttttcacaggtggctaccaagaagcaggccccagagttaacccccctctttggctccataaagagaattctcggggaggaaggattcgtcgtgaatcagaagaaaacacatgttgtgcggcagggggcccggcaagaagttacagggctcatagtgaacggtaaaggggagcctcgggttccccgcaaactcaagaggcagctccgggcagccgtccataactttaagtgtgggaagcctctgagagatggcgtatccttaatggagctgaagggctatgccgcatacatcatgatgaccgacagaaggctgggagaggagatgaagtccgtgcttgtcgaatga

SEQ ID NO: 13660 - RNA, 1281 nt, unidentified
  source 1..1281: mol_type = other RNA; note = synthetic construct
atgtcggctaactgggagacactctgggacgaaatagagaaggcaggtaatgtggagcgatatgtgcagcagcagctcgagctgaagggcttcgttgtgaagcggcgcgctacagataccctcagcaccagggagctagagaactataaaaaagagctgaagacggaagcccttgaaaaaagaaaactgaaaaaggaggcatggcaagcttaccgcgctacccatattgtgcatcttggaacgtctatctattggtctgacgactcaagtcacgaccggtgggatctgcaggatgctgagaaacgtctcctggagaatcaactgcctcccctcactcaagtcaaacatctcaccacagcccttaatttatctataccacagcttaggagtctgtgttaccagagagacgctaccacagacactcattacaggcgcttcgaaatcccaaagcgatccggtgggctgagagcgatttgggcaccgaggcctcagctcaagaaggcccagagatggatattgcgcgagatcctggataggatgctggtgcacggcgccgctcacggatttttggcagggaggtccatcgttaccaatgccgcccagcacaccaactctcaggtgattgttaagctggatatcaaggactttttcccttcaatctcatggcggcgcgtgaaaggcgtgttccggaaggccggttacagagagcaaattgcgacacttctggccttgctgtgtacagaaagcccccgggaagtcgtttcccacgaggacaaaacctactatgtcgctctgggcgaacgatgcttgccccagggagctcccacaagcccagcactgactaacatcctatgcttacagctcgaccgaagattgactggtattgcccagaaattcgggtggtgctacagtcgctacgccgatgatctcacattttcatttccgcaagacaccgccgaaacttccaatataagtcacttactaggaagcatccagcgcgtaatgacggatgaggggttcagcgtaaacatgaagaagactcacgtgatcagagcgggaaacgtgcaggaggtcaccggcctgctggtaaatggccagcatgcccctcgggtcagcagaaccaagaagaggcagatgagggccgcgattcataacttacagcaacagaaacctctccccgaaggcgaatcccgtgaacggctgatgggatatgcagcatttattgctatgactgatcgtccattggggcaacagatgatccacgcacttatggccctgtga

SEQ ID NO: 13661 - RNA, 1458 nt, unidentified
  source 1..1458: mol_type = other RNA; note = synthetic construct
atgtccacagtgaatagtcagcagaccgattatattagcccggcccagacaatgactcccgccgagagacaatggcaacagctgtggcaagacatcgaggaagctgggggccggtatcagtatatccagcagcaaatgttgcagcacgggtttattgtagagaggaagccgattgataatatgaccgcaaaggaacgggagagatacaaaaagtctctgaagaaagaggccgccgaagagaaatccctaaaaaagcaggcttggcaggcctataaggcacagcacattgtgtacctgggaagacacatatactggagtgacgacacgtccatggacaagtgggatgttaaagacgccagtaacaggctgatcgagaacaagctccctctcatcagcaaacatactcagcttgccgaggcagtgaatctgactgtgccacaactgaagggcttatgctatcagcgcgacgtcgccacaaacatcccttacactcacttcaccatcaataaaagaaacggtacacccagacacatttggagccccattcctagactcaagttcgtgcagcgctggatactcgagaatatcctgaataacctcatgactcatggggctgcgcatggcttcgtccgcggaaagagcattgttacaaacgccgctgtacactccaattctgccctactgattaagctggatgtgaaagacttttttcctagcgttcattggcgcagagtgaagggtgtgttccgacacgccggttacccagaaaagatcgcaattctcctcgctttattgtgtacagagtccccaaggcaggtcgtccaacagaacggcacaacctattacgtagcgctatcagatcgggcactcccacagggagctccaacctcccccgcacttacaaacatcgtctgcctgaacctggataggcgactcactggattagccgacaaagttggattgcgttattcacgctacgcggatgatctgacgtttagcttgccagtcagttcaacctcagccgagaacaatgtgcaggcaaacgtgcaggcaaatgtgcaacctgcagaccataaccaactcatcggtcagctgctggggtccgtccaaaaaatcttgcgtgaggaaggcttcacacttaataatgacaagacccgcgtgattcggactggcaatcagcacaacgtgaccggcatggtaataaatggggagggagtgcctagggttcccaggcatataaaacgaatgttacgggctgccctgcacaatctggcctcaggccagccccttagggaggatgaaaccctggaaacccttagtggctacgcttcttggatcgcttctgctgagcaggaacttgggcagaactacttggctaagatcgacactctgcgggaacaggcgaaagtggttgaaaccaagagctctgccgagtctacgtcgctgctgaacgaatga

SEQ ID NO: 13662 - RNA, 1440 nt, unidentified
  source 1..1440: mol_type = other RNA; note = synthetic construct
atgaccacccatacagcaaatcacaacgactatatttctcctgaacctgttccaacctccttcgaaaggcaatggcagcagctgtggcaggatatagaattggctgggggacgataccagtacgtgcagcagcaacttgtttcccaaggtttcatggtggagaggcagcctgtggacaacatgtcacccaaagagcgagacaggtataagaaagcgctcaaaaaggaggccgccgaggaaaaatccctgaagaaggctgcttggcaggcctacaaggctcatcatatggtatacttaggccggcacgtatattggactgacgataccagcactgacaaatgggatatcaaggatgcagccaaccgcctgatcgagaacaagctgccgttgctaagaaagcacaatgagctcgcagaggcggtcaacctgactattccccagctaaaagggctgtgctatcagcgggaggtagccactaacctttcgtattcccacttcacgattgccaagagaaacggaacagcaaggcagatttggtcccccataccaagattaaagttcgtgcagagatggatactgcacaatattctcaacaaccttacgactcacggcgctgcacacggctttgttaggggaaaatctattgtgacgaacgccgccgtccatagtaactccgaactgatcattaagctggacgttaaagactttttcccatctgtgagctggcggcgtgttaagggcgtttttcgtcacgccggctacccagaacagatcgctactctcctggcactgctctgcaccgaaagtccccggcaagtggtccagcaggatggcattacctactatgtcgcattgggagacagggcattacctcaaggagcgcccactagccccgcattaactaacatcgtgtgtctcaatctggaccgccgcctcacaggtctggctgagaaactaggcctgcgatatagccgctacgccgatgacctgacctttagcgtcccaactatcgaagacaccaagcctaagcttaaagtgaaaacgaccataaaagccacaacatcaaccgctaagaagcaggccgatacacagcataataagctcatcggtcagctgctcggctcagtgcataagattcttcgggaggagggttttgccctgaataatgataaaacccgcgtgatccgtaaggggaatcagcagcaagtcacagggatggtggtgaatggccaaggggtcccgagagtgagtagacaaatcaaacggatgctgagggcggccgtgcataatctggaggccggagggaccttgagagccgatgagacacttaatacactgagtgggtacgctgcgtggatcgcttctgctgaacctgagctcggacactcatacttggatcgcatcgaacgattgcaggtccagcaggaaacaagcgtatga

SEQ ID NO: 13663 - RNA, 1338 nt, unidentified
  source 1..1338: mol_type = other RNA; note = synthetic construct
atgagttccacatctacacagaacttgagggagcattggcagactctatggcaggacatcgagcaagctgggggccggtaccagtacgtgcagcagcagcttgtgacccagggattcgtggttgagcgcagacctattgacaatatgtccaaggccgagagacagaggtacaaaaccatgcttaaaaaggaggcggccgaagaaaaaaacctcaagaaggatgcctggcaagcctataagtcacaacatatggtctatctgggaaggcacgtgtattggagcgatgaccacagcgccgacaagtgggacgtcactgacggcgaacgcagacgtgtgagcaatcagttgcctactttaactcagccgaaagagctcgcagctgcactcaacctttcaatagcccaactgaaaggcctgtgctatcaacgcgaggtggctacctgcgttccttacacccatttctccatccagaagcgcaggggaggtacccgggaaatctggtcgccaatccccacgctcaagacggcccagcgttggatcctgcaccacatcttggatcaactgccaacccacggcgcagctcatggatttgtcagcggacggtccattgtcaccaatgctgaagttcatcgagactctgctgtccttattaagctggacctgaagaacttttttcccacaatccactggcgccgtgccaagggcgtatttaggcaggcggggtatccagaatctatagcaacattgctggcactgctatgttcagagtccccccgccagatggtccaacagaacggggtgacatattacgtagccctggctgatagagcgctcccacagggtgcccccacttcacctgccctttccaatattgtgtgtgtgaatatggaccgacggctgacaggcctcgcggataagcacgggctccggtactctagatacgcagatgatctaactttcagtatcccctccagctctgcggccaattcagacgcccagaacgcattaattggtttgctgctggggagcgtgtacaaaatagttaaagaggaagggttcgttctcaacaccgataaaaccagtatagtgaggactggacagcagcagaatgtaacaggtatggtggtgaatggcgagagtgctccaagagtcccgcgaagaattaagcggatgctgagggctgcaatccataacctgcagcagggacgagctctgcctgaaggcgaatctttggccaccttaagcgggtacgccgcttggattacgagtgcagaacccgagctcggccggcactatcttgagcaaatcgaggcactggctaaagccacacctgcctga

SEQ ID NO: 13664 - RNA, 1521 nt, unidentified
  source 1..1521: mol_type = other RNA; note = synthetic construct
atgagcaaccggaacaataattcaaacaatccgaataacgctcagcagctctcccagtatatccataacaaccaggcgcaccacggaaacctgataaaccctaatggaaacgaaaagctgaacgaattacagcaactgtggcaggacatagagcaagcaggcgggcgctatcaatatgtccagcagcaactcgttaagcaaggcttcctggtggagaggcaacctatagacaatatgtcacccaaagagcgggaccgatacaagaagcagttaaagcaggaggcccttgaagccaagaaactgaagcaacaagcatggcaggcatacaaagcccagcatatcgtatacttgggaagggatatttattggacagatgatacctccccggatcaatgggacgtgaaggatgcgagtaaccggttgatcgaaaaccagctgcccctgatagataagcctcagaaattggccagcagtctcaatctgacaattccacagcttaaaggcctctgctaccagagggacgtagcaaccaatcttacttacaatcatttcaccatcgcaaaaagaaatggcaccccaaggcagatttggtcgccgattcccagactgaagtatgctcagagatggatccttgacaacatactgaataacctgccaatccatggttccgcccacggcttcgtgcagggcaagagcattgtgtctaatgcctgcgtccatacggattctgagctccttattaaactcgatatcaaggacttctttccctccgtccactggcgacgtgtgaaaggcgtgtttcgccacgccggataccacgaacagatcgcaaccctgttagctctgctatgcacagaatccccaaggcagatcgtacgccagaatggtgttacttattacgtggccctggccgaccgatgtctacctcagggggctcccaccagccctgctttgaccaacattgtttgtctgaatctcgacagacggctgacggggctcgctgacaaactgggtcttcggtacagccgctatgcggatgatctgacctttagtctccccaaaacagacaccacaactggaaagccatctaagaagcccaatactaagaccgctaagaccgcaaatgataactctaccaacaacaacaatgagcagaatcaactaatcgggcagctgctgggctcagtgtcaaaaattctgacggaggaaggcttcgccatcaacagtgacaagaccaaaatcattagaacaggtaaccagcagaacgtcactgggctcgtcgtgaatggtgacggaacacctcgggtgccacgtaaaactaaaagaatgctccgcgcagttatccacaacttgcagaatggggggaaattgagggccgacgagaattttaacactttaatgggctacgccagctggattgcgatgacagatcctgaacttggagcttcttacttgcagcaactgggggaactatccaaggagtttgccaagaaggctgagaaggaggacaaaactgagtga

SEQ ID NO: 13665 - RNA, 1356 nt, unidentified
  source 1..1356: mol_type = other RNA; note = synthetic construct
atgacgaataacaagcacacaagccttccccagcaatgggaacagagatggcacgcaatcgagcaggcgggcggtcgttaccagtatatcatgcaacagatgaaagaacacgggtttctggtcgaaaggaaacctattgacaacatgtcccccacagagagagagagatataagaaacaacttaagcaggaggctgcagagcagcataagatcaagaaagacgcttggcaggcctacaaggccaatcacatcgtgtatttgggccacggcatctactggagcgacgacacgagcgaggacaagtgggacgctaccgatggagcgaaacgccttctcgagaatcagctgcctaccttcaagaatgtcaaagctctcgcagagcaactgaatcttaccatttcccagctgaaaggtctatgctttcacagggaagtggcaactaggattccctattcccatttcaccatcgtgaaaagatctggaggcgagcggcagatctgggctccagttcctaggctcaagtacgcacagaggtggatcctggataacgtgctgaatccgatgctcatccacggggccgctcacggttttgtgaggggcaagtctattgtcaccaacgcagagaatcatactaacagccagttgattattaagatggacattaaggacttcttccccagtatagggtggcgcagagtgaagggggtcttccgacaagctggatatcctgagcagatcgccacactttttgccatgctgtgtacagaatcaccacggcagctggtaaaacagggcaacgtaatttactatgtggcactagccgatcggtgcctcccacaaggggcaccaacaagtccagccttgactaacatcatatccctgaacctggatcgccggctcacgggcttagctgagaaacacggcctgcgatactctcgatacgcggatgatctgactttttcattgcccgccgaagccaccatcgataccaaggccaaaaatactctgattagcactttgctgggaagtgtaaccaagatactcacagaagaaggcttcgccatcaacgctaagaaaacccatatcatacatcaaggaggggttcaacgtatcacaggtctagtggttaacggagattctgtgccccgggttcctcgcaatattaaacgtatgctgcgcgccgctattcataacctggaacagggtaagccgttcaaggagggagagtcatttaatactctgcaggggtacgccgcgtggattgccatggcagaacccgacgtcggcgaagccctcttaaaaaagctccggcagttaaaaaacagacctcttcagatagagccagtgtcggactga

SEQ ID NO: 13666 - RNA, 1287 nt, unidentified
  source 1..1287: mol_type = other RNA; note = synthetic construct
atgacagatttccagcagctctggcaggatatccagcacgccgggtcaattgacgcgtacgttaataaacagctgcagaaaaagggctatttggtgaaaagattagacgctaagcaactgtccgcaaaggagctggcacgttacaagcagcaactgaagcaggaggcggaggccaagcagaaactgaatcaggaggcctggcaggtgtacaaacagaacaacatcgtgtatcttggcgaccaggtgtattggcatgataatgacgattgggataaatacgatcgggagaatgcagataaggccttagtcgggtaccagctccctgtgattcacactccggctgagctagctgaacaactacagctgactatcaaagagctgaggtggttcacctatcaccgcaacgccgctgaatattcccattatcagcagttctctattcccaagcggagcggtggggaaagatccatttgggctccaaaacccaagctgaaagccgctcagcgatggattctgctcaacatagtggaacgaatgctcatccacggcgcggcacatggattcgtcggaggtcgctctatactgacaaacgcacagcaacacacacaatctgaactggtagttaagtttgacttggcggacttcttccctagcattagttggcgcagagtgaagggcatctttcggaaagcaggatacaaagagcaggtcgccacccttctggccctcctctgtaccgaagcccctagggagcggattgagcatgaacacaaaacctattttatcgctcttgctgaccgctgtctgccacagggtgccccaacctctcctagcctgaccaatatcctttgcaaatcaatggaccgcagattgactgccttcgccgaaaagaacgggtggaggtactcaaggtacgctgatgacctaacatttagctggtctggttcccaaagtaaatccaacattaagcaactgattggcatagtgcatcaagtggtaaaggatgagggccttaatatcaattccaagaagacgagaatcctgcggccggggagctgtcagcagataacgggcttggtcgttaacgagcatgcccagcccagagtaccaagggcaactaaacgagaggttcgtgcaatgctccacaacctcagtaagggaaagtcgcttcacgaagacgaaactttgagtcagttacaaggaaagatcaattttatcaggatggtggagcccgaactcggggccagctttctgacacagttccagcaaatcgtccagtcagcttga

SEQ ID NO: 13667 - RNA, 1299 nt, unidentified
  source 1..1299: mol_type = other RNA; note = synthetic construct
atgaaacagcaatccaagatcaatcagctctggaatgcgattgagaaagccggaagcatgaacgcctacatagacggacagctacgcgagcacggatttctggtcaagcgccgcgatactgacaacatgtcaaagcgggaactggatcgttataaaaaagagctcaaggctgaggcagcagagaagaagcggctgaaacaggtggcttggcaggcatacaaggccaaccacatagtacatctcggggatggaatctattggaatgatcatgatgatttcgacaggtgggatctaaataacgccgaagagagagccgccgaaaatgaactgcctcccctggacaaaccacaacaactggcccatgcactcggcattaccattccgcagttaaggtggctggcattccatagagacgcagccacagaacttcactataggcgattcactatccctaagaaggacggtagtgatcgcgccatctgggctccaaaaacactgctcaagcaggctcagtattggatcaacgacaacattacccgaaagctgattgtccatggtgccgcccatggatttatccctggcagatcaatactttccaacgcagaagtccacacgaattctaagattatcctgaagatggatcttgaaaacttctttcccacaatcactttgaaaagggtgaaggggctgttccgcaaagctggctacagggagcagatagccaccctgttggcactgcttgtgacagaagcgcctcgggaagtggttgaggaccagaataagacttatttcgtgtctatggggcctcgttgtttaccacagggcgcccccacaagccccatgatcacaaatgctttatgcctgaagttggatcgcagactgaccgggattgcagaaaaatacgggtggagatacagcagatacgccgacgacttgacctttagtttgccagacggaaaagataaacagcccaacctcggcaagctcatgcacgttattaagcagatcgtcaaggacgaggggtttataatccacccagaaaagacgcgaatcactagaaaggggggtcggcagaaaattaccggcctggttgtgaacggccaaggcacccctcgggtaccccaaaaaaccaaaagggagctcagggcggccattcacaacctaaagaacggaaagccgcttcgggagggtgagacattagctcacctggagggcctggctgcgtttatctgcatgacggagcccgccttgggccacaaaatgctcaatcagctgaaagctgtggctaatactctttga

SEQ ID NO: 13668 - RNA, 1299 nt, unidentified
  source 1..1299: mol_type = other RNA; note = synthetic construct
atggcccagcggtccgaaattgacaagctgtggaatgctatcgaaaaggcaggctcaatggatgcttatatagatggtcagctgagagagcatggattccttgtgaagagaagggccacagacaacatgtcccgacgcgagttagacaagtataagaaggagctgaaaggggaggcggccgagaggaagcgcgtaaaaaacacagcctggcaggcgtataaagccaaacacatagtccatctaggtgacggggtgtactggaatgacaatgatgatttcgaccggtgggacctggacaacgcagaggagcgtgccgcagaaaatgaattgccgacattggacaagccccaggatctcgccctcgcactgggcattacgatacctcaactgaggtggctcgcttatcatagagacgccgcaacggagctccattacactcgtttcaccattcctaaaagagacggaagtgaccgggccatatgggctccaaagaccctgcttaaaaaagcccaatactggatcaatgacaatatcgtgtcgcagcttattgtccacggggcagctcacggttttatggccggtcgctccatcctgactaacgctaccgtacataccgattcaaagaccgtgcttaaaatggatttaaggaactttttccccaccgtgacatttagacgggtcaaaggcttgtttcgcaaagctggctatcgcgaacaaattagcacactcttggccctgctggtgacagaggcgcctagagaggtagttgaggagaataacaagacctacttcgtgtctctcggccctcgctgtttaccccaaggtgcgcctacctctcccatgattacgaacgtgctgtgccttcagctggatcggcggctgacaggcattgcggaaaagtacggatggaggtatactcgttacgctgacgatcttacctttagcttacctaacgggccggataaagaaccaaaattgggagctctgatgcacgttgttaagcagatcgtcacagacgaagggtttgtggtgcacccagaaaaaactagagtcactcgaaagggcgctcggcagaaggttaccggcctcgtggtgaatgataagggcgcccccagggtcccacagaaaaggaaaagacagctaagggcagccatccacaacctccagaacggaaagccattgcgagaggacgagactctggcccagctggaagggctagctgcattcatctacatgactgatcccaagctgggaagtagcatgctggcagatctccgaaatatcgccaacaagatctga

SEQ ID NO: 13669 - RNA, 1305 nt, unidentified
  source 1..1305: mol_type = other RNA; note = synthetic construct
atgactaagtcaatcaagcaactcgctcttgaaattgagaaagccgggtcaccggaggcatacgtgaagcagcagatgcagaagcaggggtttactgtgaccaggaaaaacgtagctgacttgtctaaaaaggagctgtctgcgtacaagcaggctttgaagaaggaggcatccgagaaacataaactgcagcaggaagcttggcagggatacaaagcctacaatatcgtccatctaggcgatgatatctactggaacgaccaagacgtttgtgataaattcgattgtgacgatagacacgtcagaatgcaggaaaatgcaatacccgatttcaaaaatccccaggctctggctgcatggctcggcgtatctatgccacagctacgcggattgacttaccaccgggaatgcgcggagagtatcaagtatcggcatttcacaattgaaaaacgcagcggagggatgcgttccatctgggctcctaaccacgaactgaagcaagtgcagagacaaattctggatgaaatactctcctcgttactagttcacgatgcttcacacggatttatgcaggggagatccatcttcagcaacgcactccgccacacggatgccaaaatcgtggtcaagatggacttaaaggacttctttcctaccattagtttcaagagagtcaagggtttgttcaggaaggccggctatcaagagcagattgcgaccttgttagcactgctctgcacagaggctccacggaaaatcattgaacgcgacgggaaaaagtatttcattgcactcggagaaaggtgccttcctcaaggcgcgcctacatcacccgctatcagcaatgtggtgtgtcttcgactcgaccgaaggcttcaggggcttgccgaaagcctgggttatcgctatacccggtacgccgacgatctgacttttagtcagctgaacgactgtaaaaaacctatgtctattggcgccctcaaggccgccatcaaaaatattatcgagtctgagggttttgtgctgcacacagaaaaaacccgtataacatatccccatcggtcccagcaggttactgggctggtggtgaacggtaagggactgccaagggttccgagaaagacgaagaggcatctgcgagccgccatacacaatttgcagcaaggcaagcccctgcaggacggcgagagccttgagcagctgaaaggctacgcagcctttatcgccatgtccgaccccaagaccggccaagagatgctcgccaagctgaacgagtgccagctgagcctgccagagagtacctga

SEQ ID NO: 13670 - RNA, 1344 nt, unidentified
  source 1..1344: mol_type = other RNA; note = synthetic construct
atgtctcaagccgattataccttacctccaatcgagacgtcagaggagaggagggaactgtggagtcacattgacgaagcaggcggtgtgagggcgtacattcggcaggaaattcacaggcaagatctcgctgcgactggcaacccagagcacatgaacgcctcccaacgtcagcggtataagcaggcgaaaaaactagaggctgaatttagaaccgctctgcggaagagaacttgggcagcatacagggagacacacctcgtgcatttaggggacgacattttctataacgaccttatcgacatcgatgcctttgatattgataacagagagcagaggcgcgaggctaatgacattccctccattgagacagtggacgagcttgccactttcctgggcctgaccatccccgagctgagatggctcagctaccaccgaaatgccgaagcatcccctcactacgtccagttcagtataccgaaggccgacggtagccgccgtgttatatctgcccctaagcccaagctgaaagcttgccagaccaaaatatatcatgagatactgtctctgctgcccgtacatggagccgcgcatggcttcgtacctggcagatcaatcgcaacccacgccagcttgcacgctggagggaacatcatcgtcaagatggacatccgccacttttttccaacaatcgtgttcccgagggtcaaaggcttcttccgaaagattggctacccagaacaggttgccacagtgatggcactgctttgtacagaatcgccgcggcaggagatggaacacaagggacaagtcttgcatgtggcccttcaggaacgctgtttaccccaaggcgcgcccacatctcctaccctgacgaatctgatgtgcgtgcgtctcgatagaagagttctcggattggcccgaaaactgggatggacttacagccgatatgccgacgacctcgccttttcatggcatcaggatagtgagcccgatctggcccagctacttggatgtacgaaggccatcgcaggagacgaggggttcaaaattcatccaaagaagactcaggttatgcgggccaagagccgccagatggtgactggcttggtgctcaatgctaccggtggggatgaacctaaccacccccgcccagtgcgaaggctagtacgccagattcgggccgctatccataatcggaaaaatggtaagcctggcaaagctggggagtcccttctccagctccaagggctggctgcatttgtctgccagaccgatccaagaaggggggaacctttgatggaggatatccgggcactgatcgcagctgaactggctgaatga

SEQ ID NO: 13671 - RNA, 1341 nt, unidentified
  source 1..1341: mol_type = other RNA; note = synthetic construct
atgtctaaaatcaaggtgcctccaaccgaaacacatgagcagcgcgttgaactttgggaagagatcaagaaggccggcgggattgaaccttatatacagcagaccctgtcagcccagggactcgctgtgcacaataacgacacctctcggatgaaccaaaaacaaaaaagcgcctacaagaaatccaagagggctgaagcagaagcggaaaaggtcgtcaggaaagccacatggaaggcatactgtgccactcacttggtgcacctgggcaatggtgtattttacaatgacctggtagatgccgataagtttgacatcgagaaccgcgaacagcggatcagtaataacgatcttcctaacattgaacatgttgacgccctggctgaatttctaagtctgacgttgccagaaatgcgctggcttgcttaccacagagatgccacaaagaatcctcactacaaacagtttacaataccgaaatccgacgggagtgagcgtgtgatcagcgctccccgacctaagttgaaaaaggcacagcacactatactccataaaatactcgacaggatgcccattcacggcgcagcccatggattcgtgcctggaagatctattgcctcgcacgctgacaaacatgccgggcgtaagatcgtggtcaaaatggatttaaaggacttcttcccgaccctgactttcccccgagtgaaaggcctgtttcggaagattggatacccagagcaggtagccacggtgatggcattgatttgcactgagccaaagcggaaggaggtcgaacacgatggcgagatgtatcacgtctcactgagccacagatcattgccacagggtgcgcccacaagtccaaccatcaccaacatcgtttgtatgcgactggaccggagaatgtccggccttgcaaaaaagctgggatggtcctattctagatatgcagatgacctggtgttctccaccaatgatactgacatcaatattggcgccctcttacgcctctctgagaaagtgatcagagcggagggatttcggaggcatcccaagaagactcatgttatgcgccagtgcaataggcaaaaagtcactggcttaattgtaaaccccacacccagcgaggagaaaacaacctcacgggttcctagaaaagtcgtgcgacaagtgaaggctgggatctataaccgtctgaatgggaaaccacataagagcggtgagagcctcgagcaactgaggggtctggctgctttcatcaaccagaccaaccccacgcttgggaggaagttcctagatcagataaagaccctcgtggagcgcgaggaaaacgagatttga

SEQ ID NO: 13672 - RNA, 1296 nt, unidentified
  source 1..1296: mol_type = other RNA; note = synthetic construct
atgaccgagcccgctctgacttgggctgatgttgcagccgctggcggaatccgagaatgggtggatgcagaagttgctagacagggccttgcaagtactggcgtgcctcctaacatgactgatgccgagaagaagctttttaaggctagaagagacgaggaaaggcgcgtgcgcaaagaactttacaagcgggcctggtcggcttataagcgggctcatattgtgcacctgggtccaggcgttttttggcacgatacagccgacgtggaccgcttcgatgcagacgaccccgaaaaaaaacggcaggataacgccctgcctaaactggccgatgtcgaagccttcgcaaaagccgtcggtgtagacattccacgtctcagatggctgtcttaccaccgggaagttgactccgggactcattaccgccgttggacggtcccgaagagagacggcacagcccgacttattagcgcccctaagcccgacttgaagcgcattcagcggtggatcacaacggaggtcaccgagcatttacccgtgcatggagctgcacacggcttcattaccgggcggagcatcgtgagtaacgcgagagtacacgctggtgctcatgtcgtggttaaactcgatataagagggttttaccctactgtgactatgcggagggtcaaagggctacttagacgagcaggcctaggggaacaggtagctacactcatggcgctgctggcaaccgaatccccaagggaggaggtggagacacacggaaaagttcactatgtggccatcgggccacgctcattgccacaaggggcacccacctccccgtctattaccaatgcgctgtgtctccgtctggattgcaggctcgcaggcttagctcggaagctcggatgcaggtatacccgatatgccgacgacctgaccttcagctggcacggcgatggaaaggccgccataggctctctgttgagggccacgaccatgattgtcagggccgaaggttttgagatccatactaagaagaccagagtgatgcgcaagggtgcgagacagaaagtcacagggttggtggtgaatgaggcacaagggaggccaacagctcgggtgcctcgcacaactcagcgagagctccgagccgccatccgtaatagggagttaggcaggcccggaaaaggcgaatcactggaggagctgaagggaatggccgcattcataatgatgaccgatcgggagaggggacgcgcctttatggaacggatcgacaaactgatcgcggctagagaggtaaagtga

SEQ ID NO: 13673 - RNA, 1197 nt, unidentified
  source 1..1197: mol_type = other RNA; note = synthetic construct
atgaccgacgctgagaataagctctacaaagccaggcgggatgaggagcgcaaagtgcgaagggagctgtacagaagggcctggcaagcctaccgaagggctcacgtggttcacttaggcgctggcgtgttctggcacgacacggcagatgtagatcgcttcgacgccgatgatccagaaaaacggcgccaagactctgccctgccctccttggacgatgttgctgcactggctggcgcgctaggattgtcaatcccacgcttacggtggctggcctatcaccgggacgtggacaccggtacacactatcatcgctggtgggtgccgaaaagagacgggagcaagagattgatctcggcaccaaaaccggagctgaaggccgtgcaacggtggattactcgggaggtgactgaacatcttcccgtccacggggcagcacatggctttctggtggggcgcagcatcgtgagtaatgcccgcgtgcacgccggtgcacgagtgatagttaaactggatattcggggattttatcctaccatctctatgaggcgggtcaagggcctgttaagacgcgctgggttgggagagcaggtagccaccgtcatggcccttctggctacagaaagcccccgagagcaggtagccacccatgggaagacctacttcgttgccactggtcctcggtccttgccccagggagctcctacttctccaagcattacgaacgcactgtgcctgcgtctggactgcaggctcagtgggctcgccaggaagctgggttgtcggtatacccggtacgcagacgaccttacattttcatggcatggtgatgccagaccacaggtcggcgcgttactcagaggggtggccatgatcgtcagggctgaaggctttgaagtgcacgccaagaaaacgagagtgatgcgcgcaggagcgaggcagaaggttacaggcctcgtggtaaaccaggcacccgcggaaaggcctactacccgcgtccctcgtgttacacagagagccctacgagcagccataaagaacagagaacttggcagatccggaaaaggcgagacactcgagcagctgaagggaatggctgccttcgtcatgatgactgacgctgctcgtgggagggcacttatggcgagactggatcgtctcattgccgctcgagatcaggctggcggacaaccctga

SEQ ID NO: 13674 - RNA, 1305 nt, unidentified
  source 1..1305: mol_type = other RNA; note = synthetic construct
atgtctgagcctgtgcgtccgcccgttcgatgggcagatattgccgccactgggggcattcgtgagtgggttgacgccgaaatcactaggcagggtctgtctgaccctggcgccggaaatctgagcgatgcggagaaaaaagtctataaagcacgtagggaggaggagcggagggtgagacgagagctgtacaaacaagcctgggcagcttatagacagactcatattgtgcacttggggagaggcgtcttctggcacgacaccgccgacgtggatcgatttgatgccgatgaccctgaaaagaaacgaagggacaatgcccttcccgaactaaaagatgtcgaagctctttcccaagctctgggccttagcgtggcgcgtctcaggtggctggcctatcaccgcgaagtggacacagggacgcactatcacagatggcggatccccaagagggacggaaccccacggctgataagtgcgcccaagccccagctcaaagaggctcagagatggataacacgggaaatcacggagcatctgccagtgcactccgcagcccacggcttccttgtcggtcgctcgatcgttagcaatgcccgggtacatgctggggcacgcgtgattgtaaagatggacatagagggtttttaccctaccgtgaccttcccacgggtgaaaggtttgctgcggaaggcaggactgggagaacaggtagcaacactcctggcattgctcgccacagagagcccccgcgaagagcttgtgttagagggaaagacagtctttgtagcaaccggcccacgctctttaccccaaggagcccctacatcccctagtattaccaacgctctttgcctgaggctcgattgtcggctatttgggctggctagagctctcggggccaggtacaccagatacgcggacgatttaaccttcagtttccatggcccggctggagaggtcgaccatgtgggaactctactgaaggcagtgacccggatcgtggctgcggaaggctttgccatcaagcctaagaagacgcgggtcatgcgatcaggtgccaggcagcgggttactggcctcgtggttaacgccgctcccggacgaccgttggcaagagtctcaagacagcagttgagggagctgcgcgcagctatcaagaacagagaactcggccgcccaggcaaaggggaatccctggatcagctgagggggatggctgccttcgttatgatgactgaccgcgagcgcggccgcatgttactcgataggattaacagactggccgccccaacagaaccatga

SEQ ID NO: 13675 - RNA, 1344 nt, unidentified
  source 1..1344: mol_type = other RNA; note = synthetic construct
atgacagcaggcgcgaaactggccgctgtgccatgggcagaagtggctgcagcaggaggcatcaggccctgggtcgatgctgcgttagcccgtcagggattagccgaccccggcgtaccgtcttccatgagcgacggcgagaaaaaggcttacaaagccaggcgagaggaggagaggcgggttagacgcgaactgttcagagtggcttgggccgcatacaaggcagtgcacattgtgcatgtaggtgccggcgtgtggtggcacgacacaccagatgtcgaccgttttgacgcggcagaacccgagcggaaacgggctgatgccgatctgccagctttgcctgatgtcgaagccctggccaaagccctcgggttgtctatcgcccgccttcggtggttgagctaccaccgcgaggtggatacgggcacacactatcagagatggacggtgcccaagagagacggaggcgtgcgtcccatcaccgcaccaaaacctactctaaaggctgcacagcgatggatcgcacgctccattaccgaacatctccccgttcacggtgcagcccatgggtttctgccaggccggagtatcgccacaaatgccgtagttcatgcaggggccaagatcatagtcaagcttgacatcgaggggttttaccctactgtaacctatcggcgagttaaagggctcctgaggaagggggcagggttaggcgagcaagtggctaccctgctggctttgatggctacagaggctcctagggaggagttgctcgtgaggggccggacctgttatgtcgcaactggccctagggccttaccacagggggctccaacctcaccctccattaccaacgccctgtgcctcaggctcgacgggagactaaccggtcttgccaggtcgctgggatgccgctatacacgctacgctgatgatatgaccttcagttggcacggaggtgctgctggccaggcagatcggactaatgctataggcaagcttctgcgggctgtggagatgatcgtggccgccgagggctttacgattaagcggactaaaacccgggtgatgcgcggagggggtagacaacaggtcacagggctggttgtcaatcaagccgacggacgaccgcctgccagagttccacgagcgactcagcgcaacctcagggctgccataaagaacagagaactgggccgacccggacgcggtgaaagcattgaagccctgcgtggcatggccgccttcgtgatgatgactgacccggccagaggaagggcgttcatggcgagaattgacagacttgcggaaagggcaggaggtgcacctgccggatcagaatga

SEQ ID NO: 13676 - RNA, 1221 nt, unidentified
  source 1..1221: mol_type = other RNA; note = synthetic construct
atgtccgatgccgaaaagaaagcttataaggcgcggcgcgatgaagaaaggcgagtgcggcgcgaactctttcgtgtggcctgggccgcttacaaggccgctcacatagtgcacctgggacccggggtatggtggcacgataccgctgacgtcgatcgcttcgacgctgccgacccagcaaaaaagcagcaggataacgcactccctgcactccccgatgtcgaggcactggctaaagccttaggcctgtcaattgcccggctgcgctggctttcgtaccatcgcgaggtcgacactggcacacactatcatagatggactgttcccaaacgggacggcggcctcagacccattagcgcacctaaacctgagttgaaggccgcccagcgttggatcgccagacaggtgaccgaacacctgcccgtacacggagccgctcatggctttcttccaggcagaagtattgcgacaaacgccggagtacatgccggcgccaagataatcgtgaagcttgacatcgagggattttacccgacagtgacgtggaggcgcgtcaaagggctgctgcggaaagccggactgggggaacaagtggccactatcatggcgctagttgcaaccgaggccccacgcgaagaactggtggtgcgtggcagaccatgcttcgtggccacaggacctcgagccttacctcaaggggcccccacatctccgtccatcaccaatgcattgtgcctcagacttgactgtcgcttgactgggcttgcgaggaagctaggagctaggtacacccggtatgccgacgacctgacctttagctggcacggcgatgctgctagagcagcggatgcaggcaatgcaatcggaaaactcttgcgggcagtcactgagattgtggcagcggaggggttcaccattaagcggaccaaaacgagggtcatgcgggcagggggtaggcaacaggttactggactggtggttaaccaggccgatggtaggccggcagctcgagttccccgtgctacacagcgaaagctgagggctgccctgaagaatcgcgagttgggtcgacctggccatggcgagacactggaggctttaagagggatggcagcgttcatcatgatgacggacccagagagggggagagcattcatggcccggatagaccgactcgctcagagggctggtgaagccccagctggttctgagagagcctga

SEQ ID NO: 13677 - RNA, 1332 nt, unidentified
  source 1..1332: mol_type = other RNA; note = synthetic construct
atggctaacgatacgcagacacccccagttagcgcggtaccggctgacctacccaagtgggccgatatcgaagccgccgggaatattaggtcttgggtggacgctgaactgaccagactcggtctgtttgagccgggagttgatacatctactctgagcgacaaacagcggaaggcctacaaggcaaagagagaacaggagcgcaaggtgagaagggaactgatggcaaaggcttggttcgtctacaggcagcaccatctggtgcacgtgggggtcggcgtttggtaccatgataccgccgacatagatcgctgggacatacccgatttggagggccgcagacagctcaacgaactccccgaactcgagaatgttcacgcactcgccaaatctctcggccttgcgatcccccggttgagatggctggtgtatcatcgagaggtggataccgggactcattaccaccgctggacagtgcccaagaggtcgggcaagggggtacgccttatcagtgccccaaaacctgacctgaaaagagtgcagagctggattgcccgaaacattacagagcatctgccggtgcatggagcagcccatggttttcttgcaggcaggagtacactatccaatgctcgtgtccacgctggcgcaagagtcattgtgaaattcgacgtacgggatttctatcctacggtcgtgttgcgtcgtgtgaaagggttgttcagaaaggctggatacggtgaacaggtcgccacagtcctcgcattgctgtgcaccgagtgtcccagggaggagatcgagctgggcggtaggcctcactatgtggccactggaccacgctccctaccccaaggagccccaacttcacccagcatcacgaataccctgtgcctgaacttagacgctaggctgacaggcctcgcagccaagcttggcttccggtacactcggtatgccgacgacctgaccttctcatttcacggccctgcgggccacaagattgcggttggacggctgcaaaaggccgtagtggatatcgtcgcagacgaagggtttatagtgcaccctcacaaaacccgggtgatgcgaagtgggggccgacagaaggtgaccggtcttgtagtcaataccgcacctgaaggagagcctgtggcgagagtgccacggaaagtcgttagggaattacgcgctgctattcacaaccgagcacagggaaagccagggaaaggcgagactttagagcaactgcgcggtatggctgcctatgttcatatgtgtgatcctgccaaaggagctgcctttatgcaacagatcaactccctgccagggtga

SEQ ID NO: 13678 - RNA, 1308 nt, unidentified
  source 1..1308: mol_type = other RNA; note = synthetic construct
atggccaatgacaacgccaccactaccactgcaggaccagcatggagcgagattgaggccgccggcaacctgaggaattgggtggatgccgaactggaacggagggggttacgagatcccggcgtcgacacatcacggctgaacgataaacagagaaaggcctacaagactaaaagggaagaagagagaaaggtaaggcgtgagctcatggctcaggcgtggaaggtttaccgccagcaccatttggttcatattggcgtaggcgtctggtaccacgatacagctgacatcgatagatgggacatcgcagatctcgaggggagacgggctataaatgaactgcctgaattgaaggacgtgcacgcactggccaaaatactggaactgccaatcccacgacttcgctggcttatttatcatcgagaggtggacacgggcacccactatcacaggtggactgtccctaaacgatccggtaaggggcggcggctgatttctgctcctaagcctgacttgaaacggtgccagacgtgggtcgcgaggaacatctccgagcatctcccggtgcatggggctgcacacggatttctcgcaggcaggagtacactctctaacgccaaagtgcacgccggggccaaggtagtggtaaaattcgacgtgcgtgatttctaccccaccgtttcttacagaagggtgaagggactgtttaggaaggccgggtacggagagcaggttgctacggtgctggcactgctctgcacagagtgcccccgcgaagaaatcgaaattggggggagagtccattacgtggccacaggcgtgcgttcattaccccagggtgccccaactagtcccagcctaacaaacgcactgtgtgtccggctagacgcgaggcttaccggactggcaagcaagttgggctttaggtatactcgctatgccgacgacttaaccttctcgttccacggcgagggtaaagttccagtggctcgcttgcgacgagccgttgtggatattgtggctgcggaggggtttgaggtgcaccccgataagacccgggtcatgagatccggtggacgccaaaaagtgaccggactagtgatcaatggcgcccctgagggaagacctgaggcacgtgtcccgcgcaaggtcatacgcgaactgagagctgctatccataatcgggagcaaggtaaagccggcaagggagagagccttgatcagctgagaggtcttgcagcttatgttcacatgtgtgatccagaaaaaggccgcgcgttcatggcccggatcgacaagctcgcttga

SEQ ID NO: 13679 - RNA, 1347 nt, unidentified
  source 1..1347: mol_type = other RNA; note = synthetic construct
atggcaaatgacacaagttcgactaccgccaccacagctgatggaccggagtgggctgacattgaagcagcagggagcatccggaactgggtcgacgccgaactggacagaaggggcctgctcgacgatggagccgatacgtctcgtatgagcgacaaacaacggaaggcttacaagacaaaaagagaagaagaacgggtcttgagaagaaaactgatggcccagggctgggcctgctacaggcagaataaactggtccacgtgggggtgggagtctggtaccacgacactgcggacatagataggtgggatattgccgatctagacggtaggcggcagctcaatgagctgcccgaactgaaagatgtgcatgccctcgccaaggtacttgagctggccatgccacggctccgctggcttgtgtatcatagagaggtggattccggcacccactaccaccgttggacagtccctaagagatcaggcaagggggtgcgactcatctccgcaccgaaaccagaattgaagaggtgtcaaacttggatcgcacggaacatcagtgagcatctgcctgtgcacggagcagctcacggtttcctcgcgggtcgctcaacccttacaaacgctgccgctcatgctggggcggaggttgtggtgaaatttgatgtgcgagacttctatccaactgtgactttcaggcgagtgaaagggctcttccgaaaggcaggctatggggagcaggtagcgattgtgctggccctactgtgtaccgaatgcccccgggagactatcgagatcgggggtcggacctaccacgtagcaaccggaccccgatctttacctcagggcgcccccacgtctcccagcataacaaacgctttatgcatgagactggacgctagactgaccgggttggcccgcaagctggggtttcggtatactcgttacgccgatgatcttacgttctcatatcatcgcggagagggcggtgaaggcgaacaggagacaggtaagattcctgttgcccgtctgaggaaggctgtgaccgaaatcgtcgccagtgagggctttagagttcatgaaggcaagacccgcgttatgcggagcggcggaaggcagaaggtgacagggctggttgtgaacggggcaggagagggagtaccaaccgccagggttccccgcaaactagtcagggagctccgagccgcgataagaaatcgcgagttgggcaagcctggcaaaggagaatcccttgagcaattacgcggttgggcagcttacgtccacatgtgtgacccatccaagggcagggcatttattgcccgcctggagaaattggctgagtga

SEQ ID NO: 13680 - RNA, 1314 nt, unidentified
  source 1..1314: mol_type = other RNA; note = synthetic construct
atggctaacgataccacagccgaggtggaaggcacacctcctaaatgggccgatattgaggcggcaggtaatatccgcaactgggtggatgctgaactcgagcgaagaggcctgcgagatcccggggtggataccagcagactgtccgataaacagaggaaagcatacaaggctaaacgcgaggaggagaggcgtgtgcgacgggttctgcaaggtcaagcctggcaggtttacagacagaatcacctggttcatgtcggtgtgggcgtctggtatcacgatactgctgacattgatagatgggatatcgctggaatagacgaaagaagggaattaaacgaacttcccgagctcaaggacgtccacgccctagccaaggctctggagctgcctatcccaaagctccgttggcttgtatatcaccgggaggttgacaccgggactcattatcagcgttggactgtaccaaagcgcagtggcaaaggcgtgcggctgattagtgctccgaagccgaccctgaagcggtgtcagacttgggtggccaggaatattacagaacacctgcccgtgcatggggcagctcacggatttctcacaggacgcagcacggtcactaacgcagcggtacatgctggcgcacgcgtggtcgtgaagttcgacgtgaaggacttctacccaactgtctcatttagaagggtgaaggggatgatgcgaaaggccgggtacggtgaacaggtggccactgtgttagcgctgcttaccacggagtgtcctcgggagagcatcgaactccatgggagaacccattatgtcgccacaggcccaaggtcattaccccagggggctcccacatctccttccatcaccaatgctctgtgcttgaggcttgactcgcgcctcaccggcctagcacgcaaattgggattccgctacacgagatatgcggatgaccttaccttcagcttccacggagccggaaagatcccagtaggccggttgcagaaggccgttgccgacattgtgaaagacgaagggtttatcatacacccccacaaaacaagagtgatgcggaagggaggacgccagaaggtcaccggcctcgttattaatggcgcacctgagggtgctgccaaggcaagagtgcccaggaaagtcgttcgtgagttgcgggccgccatcaggaaccgagagttgggaaaaccagggaaaggcgaatctctggaacaactgaggggtatggccgcctacattcatatgtgcgacccggcaaagggcaaagcatttctggaccggataaacgcgctgtcttcctga

SEQ ID NO: 13681 - RNA, 1329 nt, unidentified
  source 1..1329: mol_type = other RNA; note = synthetic construct
atggcagacagccatgatagcaccgaggtgtcacttccggagtggaaaggcattgcagaggccggaggaattgagtcgtggatccaccgcgaactggaaaggcgccagctgatcgaagaagtcgattacgcttccctcagcaaggctgagaagaaggcatacaaggccagacgggatgaagaacggcgcgttaggcgactccttagaaaacacgcatggcaggcgtataaaaaagcacatgtggtccatctgggccgtggcgttttctaccacgacacacctgactacgatcggtatgatattgatgggcgggaggagaggttagccgacaacgccctccccgaaattgccgatgccagcgctctggcagaagccctggggatcacggttcccacaatgcgttggctggcctaccacagggaggtcgattccggcacccactacaggcgatggacagtcccaaagagggatgggcgtcgacgcttgatctctgagccaaaaccccagctgaaggaagcacaacgctggatcgctcgcgagattaccgatcatctccctgtgcacggagcggcgcacggttttttagccggcagatctaccgtgaccaacgctgctgtacatgccggcgcgcggattgttgtcaagctagacctcaaagactattatcctacgatcactacacccagggtgaagggtatgttcagaaaagctggctatggcgagcaggtagccacattgctggctatgctgtgcactgaaagtcccagagaggagatcgaactcgacgggaagacctggtatgtggcgactggaccccggtccttgccacaaggagccccaacgagcccctcaataaccaacgcaatatccctgagactggacctcaggctagccgggctggctaggaaaatgggttttagatacaccagatatgccgacgacttgacattctcacaccaccagcgttccgaagctcctatcggttctctgttccgccttgtgggccagatagtggtggaggaggggtttgaagtgcatcctaagaagactcgagtcatgaggagtggaagccgacagaaggtgactggcctggtggttaatggggcagacggagctcctgcagcacgggtaccaagatctgtccggagaaaactgcgggccgctattaagaatcgcgagttaggccgaccgggcgaaggtgagtcattggctcaactgcgcggatgggccgcctacgtgtacatgactgatccagccaaaggaagggcactccttgaccggcttgccgccttggggggtgagagtgatgagggaggcacagacgggtga

SEQ ID NO: 13682 - RNA, 1302 nt, unidentified
  source 1..1302: mol_type = other RNA; note = synthetic construct
atgacgactgccgccgaggataaactaccagactgggcaggaatcgcagccgagggagggattgatgcctgggtcaggagtgagctgatgcgccgagacttgatcgacgatagggataccacacagctttctgagcgcgagaagaaacagtataaagcccggcgtgaggaagagaggagagtgcgtcggctgctccagaaacacgcgtggggggcatatcgggccgcacatgtcgtgcatgtgggagtcggggtgttctaccatgacacacccgacattgatcgcttcgatatcgacgaccccggggccaggagggttttaaatgatttacctgagttggcagacgctacgacactggccgctagactggaactgactatccctcgcatgcgatggttggcctaccatcgggaagtggattctgggacgcactaccacagatggaaagtgccaaagcggtccggaggagagcgcctcatttcagcacccaagcccgaactcaagagagtgcagcattggatagccgagcacatcactgagcaccttccagttcatgccgccgcccatggctttatggcaggaagatctaccgtgagcaatgctgccgcccatgctggtgctaggtgcgtggtgaaaatggatctagaagacttctacccaaccataaccaccccgagagtgaagggcatgttccggaaggctgggtacggcgaacaggtcgctaccttgctcgcgctgctggtgactgaaagcccacgagaagaggtgcctattgacggcaagacatttcacgtagccgttggagcccgatccttgcctcagggtgcccctacctccccgtccattaccaatgccatctgtctgcgtctggatacaagactgatggcactctgccgtgtactgggctttacatatactcggtacgcggacgacttgaccttcagttggcaccaagagggcgacgctcctgtaggccaccttctgcgagctgttggtggcatagtgaccgatgagggctttcgggtgcacagaaagaagactagggtcatgcgccaaggaaggaggcagaagatcacaggactggtcgttaacggggcacacgatgttcccgcaagggtccccaggctggtaatccgccaacttagagctgccattaaaaaccgagagctcggccgcgaaggtagaggcgagtcgcttgctgaactgcgggggatggctgcatatgtcaacatgagcgacccaactaaaggccgggcttttttacagagactcgcggcgctcagcaagcgcggtgaatcatga

SEQ ID NO: 13683 - RNA, 1338 nt, unidentified
  source 1..1338: mol_type = other RNA; note = synthetic construct
atgtccgactctaccgccgataagcaaagaaccgagtggcgctccattgccgaagccggtggaactgatgcttgggtgcatcaggagctgcttcggcaaggcctgatagacgaaggcgttgacaccgctagcatgggtgataaggagcgtaaagcctacaaggccagacgtgaggaagagaggcgcgtccggaagatcctgagaaaggatgcatgggccgcatatcggcgggcccaccttgttcatgttgggacaggtgtgttttatcatgacactgccgatatagatcggtttgacatcgatgaccccgagcagcgacgccagcaaaatgacttgcccgccctggctacagcgcaggacttagcccaggccctggatctgcctatgccacgacttagatggctcgtgtatcaccgagaggtcgacacgggctctcattatcacttctggacggtgcccaagagaagcggcggagaacggctcatttctgcaccgaagccggacctcaagaaagcacagcgttggattgctgagcacatctcagaaaggttgcctattcacggggcggctcatgggtttgtggctggcaggtccactgttactaacgccagactccacgctggagcggctgtagttgtgaaattcgatctggaagccttctacccaaccatcacattccctagggtgaaagggctgtttcgaaaggccggctacggggaacaagtcgccaccgtgcttgcccttctgtgtacagagagtcctcgagagcaggtcgctctcaagggcaaactctattacgtcgccgtagggcctagatcattgccccagggggccccaacaagcccatccataaccaacgccatttgccttcgcctggacgccagattggctggcctagctagggcagcaggatggcggtactctaggtacgctgatgatctgactttttcatggcacagaagagacgcagcggctccagtaggtcggctgatgcgcatgttggggcgaatcggatcagacgagggcttcgcactgcaccgcaagaaaacccgggtgttacgcagtggacgcaggcagaaagtatgcggcctggtggtgaacgctgcaggagatggacagcctagggcccgtgtgcccaggaaaattgtccgcgaactgcgggccgccatcaggaatcgcgaactgggccgggaagggtgggatgagagcctagcagagctcgcaggtatggcgtcctacgtgcatatggcggaccccaagaaaggaagggctttcctcgacagaatcgcagccttacaggctgcaggccagcaatcgggtggcgaggtcagtagctga

SEQ ID NO: 13684 - RNA, 1353 nt, unidentified
  source 1..1353: mol_type = other RNA; note = synthetic construct
atgacggagtcaagtaccccacctagctctgagtatatcgatctacccgaatggactgccatagccgcaaaaggcggaattcactattggatccaagaggaacttgctaagaaaggtctgctcgacgaccaggcgccctcttccccatctgttagagagaagaagcagtacagagcgcggcgggatgaagaaagacgggtgcggcgaagactcgctcagcatgcctgggcagcttatcgacgtgcccacctagtgcacgtagggctggacgttttttaccatgataccccagacattgaccgctacgatgtggtggatccacctgctcggcgcgccacaaattctgtccccgagattccggatgcccgtcgtctggctgagatactcgaccttcccatgcctcgcctgcgctggctggtcttccacagagaggtcgactctgggacgcactaccacaggtggaccatccctaaacgcgacggcagtgaacggctcattagcgcccccaagccagagcttaaaagagtgcagaaatggatatcacaacagatcactgagcacctaccagtgcatggcgcagcccatggatttctggccgctagaagtactgtgacctgtgcccaggtgcatgcaggggcaagggtactcgtgaaaaccgatttgaaggacttctatcctacaatcactttcccccgggtgaaaggcatcttccgcaaggccggctacggcgaacaggttgcgacactgctcgccttactctgcaccgaatgccctagggataagatagtgagggcaaacaaaacgtactatgtggctgtcggtcctcgctccttaccccagggagctccgacatcccccagcttgaccaacgtgacatgtttcagattggacgaccgcctgacagggttggccaagaagtttggggtttgctacacacgatacgctgatgatttgacttttagttggcacactcccggagaggcctcagtgggtctgcttctcggcattatcagggggatcgtgaccgacgagggattcgagctgcaccctaataaaacccagattttatcgagcggtaggagacaaaaagtcactggactggtcgttaaccgctccgacgcagatgtaagcgtgagggtaccgcggaaggtcgtcaggcagctgcgaagcgctattaagaatcgtgaaaacgacagagatggaccagaatccctggctcagctgaagggcatggcagcctatatccatatggccgatccagttaagggcaggcaatttcttgagaggatcgcgcagctggaagcacggcaaaccgttgccgtggggtcagaaatggcagaccgagtcgagtga

SEQ ID NO: 13685 - RNA, 1371 nt, unidentified
  source 1..1371: mol_type = other RNA; note = synthetic construct
atgaccgagcccaaccagtcgacccagaatcccacaggatccgtcggcggaggctcatctgagctgtccgttcgggttccggattgggctgccgtggtagaagctggaggacgggacgcctttattgaaagggagctgctccgcttagggctggtggatgaatcaaccgagcccgggaagcttagtgattccgaaaagaaagctttcaaagctaggcgagaggaggagcgtagagtaaggcgggaattggataaagctacatgggcttcttacagggccgctcatattctccacctgggagcaggagtcttctactccgaaggaattgatatagacagattcgatctcgacgatcccaaggctaggcgcgacgccaatggcctgccagacatcgcaaacgcacaggccctggcgaagctcctggggatatctatgtttcgccttcgacagttgacgtatcaccgggacgtggatagcggtagcaactatatccgctggatgattccaaagcgtagcggtgggctacggttaatcagcgccccaaagaaggaacttaaacgcattcagcgtttcgtggccaaagaaatcgtcgagcatttacccatgcatggcagtagccacggttttgtaagaggacggtccactcggagcaatgccattaagcatgcaaaagccgaagtgattattaagctggacttgtcttcattctacccaactatcacattccctcgagtgaagggccttttcaggaaagcgggctatcaggagaagatagccaccctgctggcactccttgtcactgagtcccccagagaggaacgccacgtggagaacaggacatactatgtcgccaacggcccaaggtcactccctcaaggcgcacccacgtctcctgcgataactaatactctttgtctgagactggatagtcggctcgacgggctgtgcgcaaagtggggtctggtgtacactaggtacgccgatgacctcacatttagtgccaaaaaggggagcaaagtccacgtggggaaggccatcggcgcagttaagagaatcgtgtcggaggaggggtttgtggtccacccagccaaaacaagaatcatgcggggcggtcgccgtcaaaaggtaaccgggctggtggttaatgccgcacctggcgcccctctagctcgagttcctcggaagctggtgagaagactgagggcggcaatcaccaaccgcgaaagaaataaacctctcagggagggagctgaaacgatcgagcagctaagaggctatgcggcttacgtggccatgaccgacccaccgaaaggaaaagcatttttggaccgaatcaaccgcttggctgagcgagaacccaccgctggttga

SEQ ID NO: 13686 - RNA, 1332 nt, unidentified
  source 1..1332: mol_type = other RNA; note = synthetic construct
atgtcacagacgaacgatcctttgacggggcaagcactggttgcccctctggactggggggcagtgaaggaggcaggtggaagggaaaactttattgataaagagctcgcaagacgaggcctgactgactccagcgatccaagcgtgctgggggattccgaaaaaaaaagttttaaggctagacgcgaggaggaacggcgggtacggaaggagctcgagaaagccgtctgggccgcctacagagctgctcatattgttcatcttggctctggcgttttcttcaatgacgctatcgacatcgacaagtatgacctggaggatcctaaaggtcggcgtgaggctaacgaccttccagacatcccatcccccgcagaactggccaaagtcctgggcattagtatgcggaggttgaggcagctgaccttccacagagatgtggattcaggcaccaattacgtccgttggactattccgaagcgcaccggggccctgcgtctcattagtgccccaaagaaagaactgaaacgtgcccagcggtggataaacagagagatcgttgaacacctacccgtccacggtgccgcacatggattcgtgcggggtcggtcaacccttactaacgcgacaccgcacgcgagagccgaggtaatcgtgaaactggacctcagcgacttctaccctaccatcacatttccccgggtgaagggcctcttccggaaagcagggtaccaggagcgcatcgctacactgctggcactgctggtgacagaatctcctagggacacacgagtgctaagcgggcgcacatattatgtcgccaatggacccagatctctcccacagggagcccccacatctccagcaataactaatgccttgtgccttcgattggatgccaggcttgacgggcttgctagaaagttcaaggtggaatatactagatacgccgacgatctgaccttttccgcgcagcgtggcacgactcccgatttaggccgcttcctgggagcggtgaaacgagttgtgcgcgaggaaggttttctcgtgcacccaaagaaaacccgaattatgaggggcggcaggcgacaaaaggtgaccggactagtggtaaacgcagccaagggaaggcccgtagctagagctcctaggaagttggtccgggcattgagggctgctatcactaatcgcgaacgcggcaagcaagccggacccgaaaccctcgagcagctcagagggtatgctgcctacgtctcgatgaccgatcctgctagagggaaggcgtttttagagcgcatactgaggttagccgatcgcggaggcgccgagaggtga

SEQ ID NO: 13687 - RNA, 1410 nt, unidentified
  source 1..1410: mol_type = other RNA; note = synthetic construct
atgagcgagcaacctcagacccatacacccgatggagccgaggcagcagcaccacctcctccaccaccaccagcaccagccgcatctccacctgaagcggctcccaggctgacttgggatgtgatcgccgaggacggaggcatacgcggctggatagatgccgagcttcgccggagggacctggttgatgacggggtcgatacccagtcgatgtcagacaaacagaggaagcggtacaaggcacgccgcgagcaggaacgtcgggttagacgagaactgcgcaagcaagcttgggcatgttacagagaagcccacctcgtgcacttaggagccagtgtgttctaccacgacacaccggacgtcgacagatatgacatcgccgaacccgaagaacggctgcgcgagaacgatctgcctcttttgaaagatgccagagccttggctgatgctctgcatctcagcgtcccccgattacgctggctaacctttcacagagaggtggattctggctcacactatgttcggtggaccatcccgaagaggagcggtgggacaaggctgattagcagtccgaagcgtgatttgaaggacgcgcaacggttcatcgctaggaaaatctccgaacacctccctgtgcactccgcggcacatggctttctcggagggcgtagtaccgtgacgaatgcccgagcgcatgctggagcggaggtggttatcaagctggatatcaaagacttctatcccacagtcaccatgcccagagtgaaggggatgtttcgcaaagccggatacggggagcaggtggccactgtactagctctgctgtgcacggatgcacctagggaggccatgctgctccgtggccagacacggtacgtagctacaggaccacgtagcctaccgcagggcgcacctacatcaccatccattactaacgctatttgccttcggatggactctcgcctctcaggcttggcccgaaaactcgggtttaggtatacccgatacgccgacgatctgaccttcagctggcatgacggaaaaaagcccgctcccgtaggtatgctgcttggcggcgttcggaagattgtctccagtgaaggtttcgtggtgcatcccaacaaaactagagtcatgcggaaaggtagggctcagcgggtaacggggttagtggtcaatgctgcgggtgaaggagctgcacccgccagagtgcctcgcaagcttgtgcgcaggcttagggctgccatacacaatcgggagagagggaaggccagagagggcgaaactctggcacaattggccggctgggccgcctatctgaacatgactgaccctgagagagcccagcccatgctcgctcgaattcacaggctgatgcgaggcgagagagactcttcttccggggagtga

SEQ ID NO: 13688 - RNA, 1308 nt, unidentified
  source 1..1308: mol_type = other RNA; note = synthetic construct
atgagcgcagagattcagaccaccacaccggccacagctgaacccatccccccatgggcatcggtaagagaggccggaggtatcagggagtgggtcgaggccgagcttgctcgaagagggctcatagaatcagtggacaccagcgcactgagtgcagagcagaagaagcagtttaaggcccgcagggatgaagaacgccgagtgcggcgtctgttgaggaaggccgcatgggcttcctataagagagcccacctagttcacctcggggcaggcatctttcatcacgataccgctgacctggatcggtttgacgccgatgatcccgaagccagacgcaaagataacgacctacccgaactggccgatgcgcaggctttggcagccgctctcggcttgccaatccccacccttcgctggctggccttccatcgggaagtggacaccggtacccactatcatagatggacagtgcctaagaggtccggaggagcgaggctcataagtgctcctaaaaagactctgaaaaccgcgcagaagtggattgctacaaacattgtggagcatctgccagtccatggagctgcccacggattccttccgggacggtctacgaagacaaatgccgaggttcatgtcggcgcccggttggtcgtgaagctggaccttagtgacttctaccccactatcactttagagagagtgaaagggctgttccggaaagcgggttatggcgaacaggtggcaacggtgctcgccctgctctgcaccgagtctccaagggaggccatttcactgcgtggcaggacgtgctacgtggcacttggcccacgatctttgcctcagggggcccctacatccccatccattactaacgctttatgtctgagaatggactcacgcctcagcggcctcgcccgtaaatttgggtttaggtatagccgttacgctgatgaccttgctttctcttggcacggagagggggaagggcctgtaggagaattgttaggagcagtccatagaatcgttcgcggcgaaggctttgtcgtgcatccaaagaagactcggatactgaggtgcggcagacgccagaaggtgactggtctggtcgtgaatggccaagggccccctagagtacctcgagccctggttcgcaaactgagggctgcaatccaccaccgggagcacggtaaacaagggaagggagagacactcgctcaactacggggctgggccgcatacgttcacatgtgtgacccccagaaaggccgcgcattcctggagcgactggcgaaattaggtgaggcctga

SEQ ID NO: 13689 - RNA, 1350 nt, unidentified
  source 1..1350: mol_type = other RNA; note = synthetic construct
atgtccgacccctctcagcagacagcaaccggcaccgctacgggtacagacccagtgccgcctgaatggccccagattgccgaggcagggggaattcacaactgggtccaggccgacctacgaagaagaggactgattgaggaggtagacaccgcatctctgagtgataagcagcggaaagctttccgggctaggagagacgaggaacgtagagtgcggaagctgctgtatgctcaagcctgggcggcttacaagcgcgcccatcttgtgcatgtgggcgtgggcgtattctaccacgatgtggccgattacgataggttcgacatcgccgaacccgagcagcgaagacaggaaaacgaccttcccgccttggctgataccaccgccctggcagaagctttggagctgccaatcccacgcctgcggtggttagtttatcatcgggaagtggataggcacactcattatcaccgttggacagtccctaagcggtccgggggtgagaggctcatctcagctcctaaaccagaacttaagcgagctcagagatggatcgcccgaaacatcaccgagcacctgcctgttcatggtgctgcccacgggtttttgcccggcaggtctactgcaactaatgccgcagtgcacgcaggcgcacgcgtaattataaaattcgacatccgcgacttttatccctcggtgaccttgccgcgggttaagggggtattcagaaaagcaggatacggcgaacaggtcgccacagttatggcgctcctctgtaccgaacctccaagggaggagatggttctgagggataagaagtactacgtcgcggtcggaccgcgttccttacctcaaggcgcccctactagccccagcataacaaatgccctggccctaggccttgacagtcgcttggccggcctcgctagaagcctggcatgcagatatacaaggtatgctgacgacttaacgttttcctggcacggagatagtgaggccccaattcaacgactgaagaatgccgtcgcgagaatcgtgcatggagaggggtttagggtgcacgaggggaaaactaggatcatgcgggcgggtggccggcaaaaagtcactgggctggtggttaacgctgcagctggggaaggcgcaatgccaccagccagggtgcctagggatgtcgtgcgacgggtgcgtgctgcgattcataaccgcgagcggggcaaacccggaggtgaagaaacactcgagcagcttcgcggatgggccgcctacatatacatgaccaatcccgagagagggcgccagtttctcgagcgcctggacgcactcgccgatgatggaagctcatcatga

SEQ ID NO: 13690 - RNA, 1428 nt, unidentified
  source 1..1428: mol_type = other RNA; note = synthetic construct
atgaccgcctctgacacaaatcagaacccccagacagcgaaaccgcagagcgctaagccacagtccgaaagccctcaagcccactccacatctgaacgcgtcgagtggacagtgatcgcagaggccggcggaatccacacctgggtctatagcgagctagagcgccagggcctgattgacaatgtcgacacttctaccctgacagccgctgagaggaagagatatcgcaaaaagcgcgatgaggagcgtgtggtgcgaaaaatcctgcagaagaaggcctggaagtcttaccgcgaagctcacatcgtccatgtcggccgcggtgtgttctaccacgatacccccgacgtggacgtctacgatgtcgaagatcccaaggggcgtttggaatccaatgaccttccaccgattgcagatgcgctgggcttggctaagcggctcggaatcggcattcctaaacttcggtggctcgttttcaatagggaagtggatactgggtgtcattaccactactggaccgtgcctaaacgggatggtggcagacgattgattagtgcaccaaaacctgaactaaagaaagcgcaagcctggattgctaggactatttctgagcacctcccaatccatggcgccgctcacggctttgttcctggacggagcaccgtgactaacgcagcggtgcatgctggcgctagcgtagttttcaagttcgacataaaggacttttttccctccgtgactacgaaccgagtgaaggggcttcttcgtaaagccggttacggcgagcaggtagctaccttaatggcactcctgtgcaccgagtttcccagagaagagctgatgttgagaggtagaaaacactatgtagcgatcggtgcaagaggactgcctcagggagccccaacttctccaagtctgaccaacgctctgtgtatgcgtttagactgcagactcacaggactggccaatagcatcgggctgaagtactcccgatacgccgacgatctgacattttcctggcatggagaaggaaaggaagcacccgttatgaggctaaggcatgcagtgcggaaaatagtgtccgctgagggcttcgtcatcaaggattcaaagacaaggatattgaggagtggccggcggcaaagagttaccgggctggtggtaaacaaggccgagtcagccgaggatgcaagggtgcccaggttcatgctccggcaaattcgaacggccatttataaactggaacgggggcaggaggccaaggaatcattagagcagctccgcggatgggcagcttatgtttatatgactgacaaaaaacgcggggccgacatgctttcaagactggccgccataagcagtgcaaccacagccactacgacatcatcggctagcaacagttcgacgactaccggggccaaaatctga

SEQ ID NO: 13691 - RNA, 1329 nt, unidentified
  source 1..1329: mol_type = other RNA; note = synthetic construct
atgtctgaagacacgcttgagagtgaggaggctcctgctgcagtagacccagccgcacctcctactgctaggtggccagatattgccgctgctggaggtatccagccatgggtgttggcggaactgcgaagaagggatcttgtggatgaaggtgttgacacatctcggctcagtgccaaagagaaaaagcgttttaaggcaaggagagaggaagagcgacgggtccgccgactgctgaaaaaacatgcctgggccgaatatcgccgggcacacttggtccatgttggcgtcggcgtgttccaccatgacaccgccgatgtggacaaatacgacttgcccgaccccgacgcacgtagagctgagaatgatctacctccgctcaaagatcagcacgccctcgcagaggcacttgcgattgacattcctactctgcggtggctgtgctaccaccgggaagtcgatacgggcactcactaccggcggtggactatccctaaacgaagcggaggagaacgcttaatctccgctcccaagcctaccctcatgagatgtcagagatggatcgcccagcatgttacagaaaggctgccaatccatggagctgctcatggtttcgtccccgggcgtggcacactgactaacgctgccgcacacgccggtgcaaagacagtggttaagctcgatctgaaggacttttatccaacattgacgcttccgagagtaaagggccttttccgcaaggccggctacggcgaacagacagcgacactgctggccctgctttgtaccgaggccccaagggaggagatggtgattcgcggagagcgacgctatgtggccataggagacaggagcctgccccaaggggctccaactagcccctccatcactaacgcgatatgcctgaggctagacgcgaggctcaccgggttggccaagaagctcggcttcacctacaccaggtacgctgatgacttagctttttcctcagatcggcggaaggctgccgtgggaaagctggtcgatgccgtctatagaattaccgccgacgaagggtttagggttcaccccaagaagacccgggtgatgagagaggggcgcaggcaacagatcaccgggctggtggtgaatggccaaggtgaggggccgcctgcaagagtaccccgtaaattggtgcggcagctacgcgcagccatacaccaccgtgagaacggcagaccaggaaaaggcgaatcactcgagcagctgcgagggtgggcggcatatgtgtacatgtgcgatcccgataaaggtagagccttcttagaccgcctcgccaaactgcagtga

SEQ ID NO: 13692 - RNA, 1338 nt, unidentified
  source 1..1338: mol_type = other RNA; note = synthetic construct
atgaccgatgcttcaccggaacgcgcattgcccccttgggcagaaatcgctgaggctgggggcatcgacgcatgggttgtggccgagcttaaggctcgcgggctatgggaggagggtgtggatacgagctccttaggcgacagagaaaggaagaaattcaaggctcgccgcgaagaagagagacgagtgcgtaaacagctccggagacatgcctggagtgagtttaggcggaatcacctggtgcacgttggggcaggcgtgttctatcacgacaccgccgatgttgaccggtatgatataggggaccctgaaactcggagacaggacaatgcgctgccaaagctggctcatgctggcgatcttgccaaggagattggcctcactgtgcccaggctgaggtggctcgtgttccacagagaagtggatacgggaacccactatcatcgctggcacgtgccaaaacgggatggttccctgagattgattagtgcccccaagcctcaactcaaggcggcccagcggtggatagcgcgtaatatcaccgagcacttgccggtacatggagccgcccacggctttgtacctggcaggtctacggtcactaacgctgcagttcacgcaggcgccgaggtggtcatcaaattggatctgcaagggttttacccaaccatcaccatgccgcgtgtgaaaggacttatgcgcaaggctgggtacggcgagcaggtagctactattcttgccctgctgtgtacagagtcacctcgggagatcattgagctgaacggtaaagcccatcatgtcgccataggtccccggtcccttccacaaggagcgccaacatctccctctatcactaacgccctctgcttaaggctggacaggcggatgcagggtctagccacaaagctcgggttcagatactcgaggtatgctgacgatctgaccttttcatggcatcaagctgacgctgacgcccccgtcggaaaactgctgcaccgagttcgcagcattgtcggtgcggagggctttgcagttcaccccgcgaagacacgggtaatgcgctccgggcgtagacagaaagtgactggattggtcgtgaacggagtcagcgcagccgaaggagcccctgaagtacctcccgcccgagtgccacgcaaactgaggaggatgctgagagccgccctccacaatagaacacaggggaaggacggccctgaaagcctcgaccgactgcatggattcgctgcatacgtgtacatgacagatccaaggcagggacaggcactactggagcgagccgctgcattacgagaaggcgccgcaggcgggaccacatga

SEQ ID NO: 13693 - RNA, 1017 nt, unidentified
  source 1..1017: mol_type = other RNA; note = synthetic construct
atgacagatccagcggctacacgcccgcttcctccttggagcgaaattgcagaagccgggggcgtagacgcttggattgtggctgaactgcgggcaagggggctatgggaagagggggtggacacttctactctgagtgaccgggacaggaaaaagtataaggcacgacgggaagaggagagacgcgttcggagagaattacgcagacacgcgtgggccgagtttcgtaggaacaacttagtccatataggagcaggcatcttctatcacgacacggccgacgttgatcgctttgatattaaagatcctgatgcacgtcggcaggacaacgctctgcccaaactccccgacaccgcagcacttgccaaagcccttgggctggggatgcctagactgcgctggctggtctttcatagacaagtggatcgcggcacacattaccacaggtggcacgtgccgaagagggatggaggattgaggctcatatcagctccaaaaccagatctcaaggccgcccagcgatggattgccagaaatattaccgagcacctgcccgttcatggtgcggctcatggatttgtaccggggcggtcaactgtcacaaatgcccaggttcatgcaggcgctcgagtcgtgatcaagctggacttgcagaatttctacccaaccatcacccagcccagagtgaagggcctgttgcgtaaagccggatatggcgagcaggtggctacggtgctgtccatgctctgcaccgagagccctcgagaggtgatcgagttgagaggtactccacaccacgtagccatcggccccaggagtctccctcaaggtgctcccaccagcccctcgatcactaacgccctgtgtcttcgcctcgatcgaaggatgcagggtctagcgggcacactgggattccggtactcccggtacgccgacgacctgaccttctcttggcacgccgatggagaagctccagtcgggaagctcttacacagggtgagatccatcgtgggctga

SEQ ID NO: 13694 - RNA, 1458 nt, unidentified
  source 1..1458: mol_type = other RNA; note = synthetic construct
atgactgcaaaactagaatcatttgttcctgccgcccccccccaagctgtaccagaagtacctcccgctgctgctgctagcaataccgcaatcgcatctaagagagaggccaggcgcgccgcacacgatgtgttgctggctagatggaaggccataaccgaggccggcggaaccgaagaatgggtccaggcccagctgctcagcaaaggagccctcgcagatgaagttgacttcagtagtctgaaggagaaagaaaagaatgcctggaaagagaaaaaaaaggccgaggcagtagagcgccgagccttaggacgccaggcccatgaggcgtggaaggctacgcacatcaaccatcttggcgtaggcattcactggagtgaagcgcctggtcccgaccgatttgacttggaacaccgggaagaaagagcccgtgtgaatggccttccagccctggacaccgccgaagcacttgcaaaagcattggatatctctgttagcaaactgcggggattcgccttccacagagatgtggacaccggatccaactatgtctcatggcggatcccgaaaagagacggtagcgagaggactataacctctccaaaaccagagcttaaggaagcccaacggtgggtgctctcgaacgtggtggagcggctacctgtgcatggcgctgcgcatggcttcgttgcaggcagatccattctgacaaacgccctggctcaccagggtgcagatgtggtggtcaaggtggacttgaaggacttctttcccacagtgacgtggcgtcgcgtgaaggggctgctcagaaaaggagggctgccggagggaacttccacactactggcactgatgtccacggaagcccctcgcgagctccttagtttccgggggaaaaccctgcacgtggcaaagggacccagggctttaccgcaaggggcacctacatcacccggcattactaatgctctctgcctgcgcatggacaagaggttgagcgccttatcacggaagctgggctttacatacacacggtatgcggatgatctcactttcagctggaccaaagccaaggccccaagggctaggagagctcagggtgctcccgtggctgtgctgctagcgagggttaaggatgtcgtcgaggccgaagggtttactgttcaccccaataagacccgagtggcaaggaaggggtctaggcagcgtgtcaccggccttgtggtcaacgaggcgaaggatggtacacctgccgcccgagtacctcgagatgtcgtcaggcgcctccgcgctgctatccataacagacagaaaggcaagccaggcagagagggggagtccctggagcagcttaaggggatggccgcctttctgtacatgactgacccagttaaaggtcgggcgtacctcgaccaattggcaaagctggaggccaccgagacaccagctcaggcttga

SEQ ID NO: 13695 - RNA, 1461 nt, unidentified
  source 1..1461: mol_type = other RNA; note = synthetic construct
atgaccgcacggctagagtcctttgttccagccgctgcaccacaggcagttgctaccccagcacctcaggcacccagtgccaatacagtggcccaacgcgaggctagacgggctgctcacgaggctctgcttgccagatggaaagctattgtcgaggctggaggcgccgatgaatgggcccaagcccaactcgtctctagggggcttgccgtgggcgagctcgacttctctagcgcctctgagaaggagaaaaccgcatggaaggaaaagaaaaaggccgaagcagcagaacggcgcgctcttggtaggcaggcgcacgaagcctggaaagcgacgcacgttggccatctgggcgcaggagtccattgggaagaagagggaggatcagacaagttcgatatagctcatagggaagagcgagcccgggccaacggattgcctgagctgggttctgcggaagtgctggcaaaggccttgggtctatccgtgtctaaactccgatggtttgcttttcacagggaggtggacactggaagccattatatctcatggggcattccaaagagagacggggggacacgcactatcacttctccgaagcccgaactgaaggaagcgcagcgctgggtcctcagtaacgtcgtggaaagactccctgtacacggcgctgcacatggcttcgtggctggcaggtccattctcaccaatgcgctggcccaccatagcgccgatgtcgtagtcaaggtggacctgaaagacttctttccctcagtgacttggaggcgggtcaaagggttgttgagaaagggggggttacccgaaaacactagtacactgctcgccttgatgagcactgaggcaccccgggaggctgttcagttccgtgggaagaccctttatgtcgccaaaggaccgagaagccttccacagggcgctccaacaagcccaggcatcaccaatgccctgtgcctgaagctggataagcgcctgtcggccctttcaaaaaaactggggtttgtatacacgcgttacgccgacgacctgaccttttcctggacaaagacaaaacagcccaaagcacggagggcacaaggtgcccctgttgccgtgctgttagctcgcgtgaaagacgtcgtggaaagtgagggtttccgtgtacaccctgagaaaacacgagtgagccgaaaagggacccgacagcaggtaaccggactagtggtgaacagggccagagatggcgtggctagtgctagggtgccccgggatgttgttcgcagactccgggccgccatccacaatcgtcagaagggcaagcccggcagagagggtgagtccttggagcagttaaagggaatggcagcgttcgtgtacatgacggatgagactaaggggcgcgcgttcctgaaatccctggagcagctcgaagccagggaaaaggaggctgcacctaaggccccttga

SEQ ID NO: 13696 - RNA, 1455 nt, unidentified
  source 1..1455: mol_type = other RNA; note = synthetic construct
atgaccgctcggctggatccattcgtgcccgcagctagtccccaagccgtaccaactcctgaaccaactccgcctgctcccgatgctgctgcaaagcgcgaggcaaggaggctggcacatgaagccctgctcgccagagccaaagccattgacgaggcaggaggcgccgatgactgggtgcaagctcagctggtggccaaaggcctatccgtcgacgaccttgacttctctagtgcgagcgaaaaagataaaaaggcctggaaggagaagaaaaaagctgaggcggtcgagaggcgggccctcaaacgacaggcgcacgaagcctggaaggcaactcacgtggggcatctgggtgcaggggtacactggaccgaagacagacccgcagatgctttcgacgttcctaaccgtgaggagcgagcccgcgcaaatggcctcactgaactcgattctacggaggcccttgctaaggcgctgaagctgagtgtgccaaaactgaggtggttcgcctttcatcgcgaagtggacacagctactcactatgttagttggaccatacccaaacgggacggctcaaagcggactatcaccagccctaagccagagcttaaagaggcacagagatgggtgctgagcaatatcgtcgagcgattgcccgtgcacagcgcagcccatgggttcgtcgcagggagatccattttaacgaacgccctcgcccatcagggggctgatgtggtggtcaaggtggatctaaaggatttctttcccagcgtgacttggcgtagggttaaaggtctgctccggaaaggagggctggcagaaggctccgctaccttgctgtccctgatgtcgacagaggccccaagggaggccgttcaatttcgcggaaagctcctttacgtcgccaagggccccagaagcttaccgcagggagcaccaacctcacctggcatcaccaatgccctgtgcttgaagctggataaacgcttatctgccctggcgaagagaatgggatttacctacacgaggtatgctgacgatctcacattttcttggaccaaggccaaacaacctaaggctcggcgaacacagcgcccacctgtagccatgttgctgtcaagggtgcaggaagttgtggaagccgaggggttccgagtacacccggacaagacacgggtggctcgtaagggtacacgccagcgggtcaccggattggttgtcaacaccgctggaaaaaatgccccagccgctagagtcccgagagacgtggtgcgccagttgcgtgcggctatccacaacaggaaaaagggtaagcctggcagagaggatgaatccctagaacagcttaagggcatggccgcctttattcacatgacagaccccgctaaaggccgggctttcctggcccagcttgcagagctcgagtcagcagcacccgcgacacctgcgcagtga

SEQ ID NO: 13697 - RNA, 1458 nt, unidentified
  source 1..1458: mol_type = other RNA; note = synthetic construct
atgacggcacggttagaaagctttgtccccgcagcctctccccagaccgtcagtactcccgcgccagctgcaccagcagctaatgcagcctctcagagagaagcacgccgcgctgcccatgaggccttgcttacacgttggaaggctattgtagagtctggcggcgcggacagttgggttcagggacaactcgtttcccgcggtctggctgtaggggacttggacttcgcgagggcttctgacaaagaaaaaacagcctggaaggagaaaaagaaggctgaggcagccgaacgacgggcattagagaggcaggcccacgaagcatggaaggccacacatgtggcgcacctaggagccggtgtgcattgggaggaggacgctgctggggataagtttgacatcgcagccagagaggagagagcccgggcgaatggccttccggagcttgatagcacagatgccctggccaaagctcttggtctttccgtttccaagctccgttggttcgcgttccaccgcgaggtagacactggcagccactatgtcagctggaaaatcccaaaaagggatggcggcagtcgaaccatcacgtcgcctaaacctgaactgaaggaagctcaacggtgggtcctggccaacgtggttgagaaactgccggtacacggagctgcacacggattcgtggccggcagatcaatcctgactaatgccctggctcaccagggagctgacgtcgtggtgaaagtcgacctcaaagatttttttcccagcgtcacatggcgcagggttaagggtctactgcgaaaaggtggattacccgagtctgcctcaactctgctggcactcatggccaccgaagcacctcgagaggctgtccagttccgtggcaagcttctgtatgtggcaaagggaccaagaagcctcccccagggagcacctacttccccaggcattacgaacgcactctgcttgaggctggacaagcgtctgtctgccctgtccaagcggctggggttcacctacaccagatacgccgatgatctcactttctcgtggaccaaggctaagcagcctaaagctaagcgatcccaacggccgcccgttgcggtgttgctaagtcgggtgcagtcagtggtcgaagcagaagggtttagggtgcatcctgataagacacgcgttgcccggaagggcaccagacagagggtgaccgggttggtggtgaacgaggccgccaatgggaaaccagctgccagggtgcctcgcgatgtggtacgcaggctcagagcggccatacataaccgggaacaggggaaacccggcagagagggcgagagcctggatcaactcaagggaatggccgcctttattcacatgacagacccagtgaaggggagggccttcctggaacagttagccaaactggaggccaaggaacagcaatcacctcccgctgcttga

SEQ ID NO: 13698 - RNA, 1461 nt, unidentified
  source 1..1461: mol_type = other RNA; note = synthetic construct
atgactgggcggttggagagctttgttccagccgccgcccctcagacagtgcctactcctgcccctcaagctgcgacagccacggctctggtgcaaagggaggcccgtcgagtggcatatgaagccctggtaacccgttggaaggctatagtcgaagcaggcggcgctgatgcttgggtacaggctcagcttgtctctcggggactggctgtgggggatctggagtcaggggttacagagaaagaaaagacagcatggaaagagaagaagaaagcagaggccacggagcgcagggcattgctacgccagacgcacgaagcctggaaagcaacacacgtcggacatcttggtcctaacatccattgggaggaaaaggacgggggctcagacaaattcgacatcccccatagagaggagcgagctcgcgccaatggtatgccggaactcggctcggcagaagcgctagcgaaggccttggggctgagtatatccaaactgagagggttcgcctttcaccgcgaggtcgataccggaagcaactacgtgagctgggggatcccaaagagagatggcggaacacgaacaatcacttcaccaaagccagagctgaaagaggcacagaggtgggtgctcgccaatgtggtcgaacggttgccagtacacggcgccgctcatggctttgtggcgggtagatccattctcacgaatgccctagctcaccagggcgctgatgtcgtggtgaaggtggacgttaaagacttcttcccctccgtaacatggaggagggtgaaaggcctcttacggaaaggcggtctgccagagaacgcctctactctgctcgccctgatgtctaccgaggcccctcgcgaaaccgtgcagttcagggggaagacactccacgtcgcaaagggacccagagcgctgcctcaaggagcaccaaccagcccgggcattaccaatgccttgtgcctgaaacttgacaagcggctcagcgccctcagtaaacggctggggttcacctacacccggtatgcagacgatcttaccttctcctggactaaggctaagcagcccaaggcaagacgcgctcagggagctcccgttgctgtcttactgacccgggtgaaggacgttgttgaggcagagggctttcgactccaccccgaaaagacccgtgtgagtagaaaaggtactcgacagcaggttaccggtcttgtggtcaatcaagccaggaacggagtgcccgctgccagggtacctagagacgtagtccgccgtctgagggctgccattcataacagagaacaaggaaagcccggccgcgagggggaatccttggaacagttaaagggcatggccgcatttgtgtttatgacagatgctgccaaaggaagggcgttcctggattctctggcgagacttgaagcacgggagactcccgaggccccgaaagtgacttga

SEQ ID NO: 13699 - RNA, 1452 nt, unidentified
  source 1..1452: mol_type = other RNA; note = synthetic construct
atgactgccaaactggaatcttttgttccggccgctcccccccaagcaattgctacgccaacacccgtcacccctacagcacaggcactggtgcagagagagactagacaagcagcccgagccgcggtactagcaaggtggaaggcaatcacagaggcgggaggacaggacgagtgggtgcaccagcagcttgtggctcgtggcgcactggctgaagaggtcgatttcagctcactcaaagagaaggaaaagacggcttggaaagagaaaaagaaggcagaagcgactgaacgccgtgctctgaagcgcctcgcttacgaggcttggaaggccactcatataggtcatcttggcgctggaatccactggaatgaagaaggcggggccgacgcctttgacatcccacaccgggaggagagggcaaagtccaatggcctgcccgagtttaccagtgccgaagacgtggccaaagctctgggtttgggggtgtctaagctgcgctggtttgccttccacagggaggtggatacagccactcactacaccagctggagaatccccaaaagggacggcgggagtaggaccattacgagcccaaaaacagaacttaaagccgcccagcggtgggtgctgagcaatatagttgaacggctgcccgtgcatggtgccgcacatggattcgtcgcgggcaggtccatcctgaccaacgctttagcacaccggggggccgatgtggttgtgaaagtggatgtcaaggatttcttcccatcggtgacctggcccagggtgaaaggactcctgcggaagggcggactgcctgagaacattgcaacgctgctcgccctactcgctacagaggcacctcgggaagccgtgtcctttcggggcaagacactgtatgtggcacaaggtccacgagcactccctcaaggggccccaaccagtccgggaattactaacgctttgtgcctccgcctggacaagagactgagcgctttgtcaaggaagcttggcttcgtctatactcgctacgccgatgacctaacattctcttggaccaaggctaaagccccgaaagctaggagggcgcagggagctcctgtagccgtgttattggcccgcgtgcaggaagtagtcgaggcggagggctttcgtctgcatcctgataagactagagttgcccgtaagggatcacgacagagagtcaccgggttggtcgttaacgacgccggtcctaaggtacctgccgctcgagttccacgcgacgttgtcagacgactcagagccgcccttcacaatagagaacagggcaaaccagggaaagagggggagtcccttgagcagctccagggcatggccgcttttatccacatgaccgatcccgctaaggggcgggcgttcatggaacggttagagaaattgtctgcacgccccgcaacaaccgccgcgtaa

SEQ ID NO: 13700 - RNA, 1425 nt, unidentified
  source 1..1425: mol_type = other RNA; note = synthetic construct
atgactgctaagctggagacttttgttcctgcggcagcacctgtggtagtaccagctccagctcctgccgctcccagtgcaaatgtcgtggctcgccgggaagtcagccagagggaggaacaggcaagattagcacgctggaaagctatagaggaggcagggggacaggaggcatgggttgaggccgagctgaaggcgagaggactggctcccgaacatgaagatccctccggcctgtcggaaaaagagaagacagcctggaaggaaaaaaagaaggccgaagccgccgagcgaagagccctcaaacgccttgcctgggaggcttggcgtacagcccatatcaaccacttaggagcgggagttcactgggaggaagctgggggcccagacacttttgatctgaaggatcgtgaagaacgagccagggcaaatgggctgcctgagctcgaaagcgcccagaccctcgccaaggcactaggtctttccgtctctagactgcgatggtttgcctatcatagagaggtggataccgggacccactacagaagctgggaaatccctaagcgggatggtggcaaacgaacaattacctcccctaaaaaagagctgaaggaggcccagcgctgggttctggcgaacgtggttgaacgcctgccagtccacggagctgctcatgggtttgttgccggtcggagcatcgtcacaaacgccatggcgcacaagggagcagacgtggtggtgaagatggacattaaggattttttcccgtcagtcacctggcagcgggtcaagggactcctgcggaaaggcggtcttgccgaaggtaccgctaccctcctagccctgatggctacagaagcaccccgggaagttgtacagttcaggggcaaaactctgtacgtagctaaaggcccaagagctctcccccaaggagcgcctacttctcccggcatcacgaacgccttgtgcttgcggttggataaaaggctgtctgccttgtccagacgccttggattcgcctacacgaggtatgcagacgacatgaccttctcatggaaaaaaagtagggggaagacagaagctccggtggctgtcctgatagctcgcgtggagaaggtcttggaggcagaggggtttagagtgcacccagacaaaacccgtgtgatgcgtccgggcaatcggcaagtggtgacgggcctggtggtgaatgaggcggccaaaggtcaaccaggcgcacgagtgccaagggaggtagtgcgccagcttagggcagcactccataacagagaaaaaggcaagcccgggaaggagggcgagactctggaccagcttaagggcatggccgctttcattcacatgacagaccccgccaaggggagggccttcttagagaggctatcagccctcgagaagcgggaggcctga

SEQ ID NO: 13701 - RNA, 1446 nt, unidentified
  source 1..1446: mol_type = other RNA; note = synthetic construct
atgacgtccaagctcgagagctacgttcctgccgctccacctcaaccggctacagctcctgcacccggctcaccatctcccgcaacacttgcccagcgtgaggcacggagacagcagcatgaggcacttctgactaggtggaaagctattcaggaggctggtggcgctgacgaatgggtgagagctcaactagtcgccaagggcgccgccgctgaagaagtcgactttgaggagttatcagagaagcagaaaagtgcctggaaggagaagaaaaaggcagaggccgtggagagacgagcgctggaaaggcaggcgtgggaagcttggaaggcaactcacattaaccatttgggcaccggggtccattgggacgaacagggaggccccgacaagttcgatgtgccaaaccgcgaagagcgcgccaaagctaatggtatgcccgagttggattctcctgaggcacttgccaaagccctgggcgtgactgtgtccagactgagatggttcgcatttcaccgcgaggtcgataccggaactcattaccaaagctggcgcatccctaagcgagatggcgggcagcgcactataaccgccccaaaaaaggagctgaaagccgctcagcggtgggttctcgccaacgtggtcgaacgactaccggtccacggtgctgcgcatgggtttgtggctggccggtccatcttgaccaatgcacttgcccaccgcggcgcagaagtgctggtgaaggtggacgtgaaggacttcttcccttccgtaacgtggcagagggtcaagggactgctgcgtaaaggaggccttcccgaaggcgccgctacgttgctgagcatgttgtctaccgaagcccccagggaggttatggagttccgggggaaaacactctacgtagccaaaggccctagggctctgccacaaggtgccccaaccagccccgcactgactaatgctctctgccttaaactggataaacgagtatctgccatggcgaaacggttggggtttacatatacaaggtatgccgacgacctgaccttctcgtggcgaagggctaagggagcgaaggggaaggcacaagccgatgcacctgtggcagtgctgttagcccgcgtaaagagtattctggaggcggagggattcacaatgcacccagaaaagacccgggtcctcaggaaagggacccagcagagagttaccggactagtcgtgaatgaggcaccagatggggtgcccgctgcacgtgttcctagggacgttgtgcggagactcagagctgccatccacaacagagaaaaggggaaaccaggtaaagaaggagaaactctcgagcagctgaagggaatggccgcctttatccacatgacagatcccgcgaaaggtcgggcctttctccagcgcttagaggccctggaaaagctcgagccgcccaagtga

SEQ ID NO: 13702 - RNA, 1428 nt, unidentified
  source 1..1428: mol_type = other RNA; note = synthetic construct
atgactgctaagttggagccacacgtgcctgctgcaccaccagtcccaggggaagcaccagcacctacgaggcctgaccctgccaaacaggaggcccgaagagcacaccacgaggctctgcgacttaggtggaaggctatcgaggaggcgggaggcacagatgcctgggttcgtcagcaactggtggcaaagggcgtcgcggccgatgaggtggactttgaatctcttacagataaacagaaagcggcctggaaggagaaaaagaaagcagaagccacggagagacgcgcacagaagaggctggcttgggaggcctggaaagcaacacatatccaccacttgggagttggagtacactgggatgaagccgggggaccagacacttttgacgtggaaaaccgggaagagcgggctaaggcaaatgggcttcccgaaacactagacagcgccgaggctctggccaaggccttaggcatatccctgtctcgccttcgatggttctcgtttcatcgggaagtggacaccgggactcattaccagacttgggaaattccgaagcgggatggcggcaagagaaccttgacatctcccaaacgagaactgaaagccgtacagcgctgggtgctcgccaatgtcgtggagagactgcccgtacacggtgcggcacatgggttcgtagccggacgctcaatcctcaccaacgccctcgcacataggggcgctgacgtggtcgtgaaagtggatatgaaggacttcttccccagcgtgacctggcgcagagtgaagggactgctcaggaaaggtggactgaccgagaacctggcgactttactgtccctcctggcgaccgaagccccacgtgaagtggttagatttaggggccagactttgtatgtcgctcaggggccgcgggctttacctcaaggagctcccaccagtcccgcccttacaaacgccctgtgccttcgcctagacaagagagtcagcgccctgtcaaaacggttgggtttcacctatacaaggtacgccgatgatctgactttctcctggcgtagaacaaaagctcctggccaagctgatgcccccgttgccctgctcctggctagggttaagggcgtcctcgaggctgagggttttaccctgcaccccgataagaccagggtgcaacgcaaggggagtcgacagcgggttaccgggctcgtcgtgaatgaagcaccagaaggggctcccggtgccagagttccgagagacgtggtccgcaagttgcgcgcagcgattcacaatcgtgagcagggaaaacctggtcctgaaggcgagacgctagagcagctcaaaggcctggctgcctttgtgcatatgactgacgcagagaagggccgggcattcctgaggcggttagaggccctcgagcaacggcaggcccgatga

SEQ ID NO: 13703 - RNA, 1404 nt, unidentified
  source 1..1404: mol_type = other RNA; note = synthetic construct
atgaccaatcggatcgacgatcatgtgtttgctgcaccccctgttctgaccacgagggctccaccgcgggtcaaacttacagccgccgaacgtgccgagagagagaggcaaaggactgcggccgaagccagatggctcgagattgaggccaaggggggcgttgacggttgggtacgcgcaaagttgatcgaggcgggacaccatcccgatgtggctggaccggcatctgaggacgaaaagaagactttcaaagagaaaaagacagctgagcgggccgaacgaaaagccctgagggctctcgcaaacgaagcaagacgattcggaaccgtcggctttctcgggaataccgtgcattgggatgacctgaagggccccgacgatttcgatctgaaggacagagcggcccgagctgaacgaaacgggctgcctccatgggagacggctacggaactggccgctgcaatggatctctccttgagtgagctgcggtggctaaccttccacagagaggtgtccacatcaacccactaccatagctggaaggtccctaaacgttccggcggtgaacgtactatcactgccccactgccaaagcttaaagcgctacagaggtgggcacttgaacactacttcgaaaagctgcccgtgcatgcggctgcccatggctttctgccagctcgcagcgtcttaacaaatgcccttgcccacgtaggtgccgacgtcgtcgtgaaattagatgtgaaagacttctttcctactgtgtcgtggaagcgcgttaagggcctattaaggaaagctggagctacggagcaggtcgcaacactgctggctctcctgtgcaccgaagccccgaggcagctcatcgagtttcgcgagcagacacttcacgtggccacaggtccaagagttttaccccaaggcgccccaaccagccctgcgataaccaatgcgctttgtctacgactggatcagcggctttctgcactggccagggccttgggctgcacctatacacgctatgcagacgacctcactttctctttcaaaaagactcccgagcggaagagactggccctggggattttggtggagacaaccaaggatatactgaaaagcgaaggctttgctctgcacgctaagaagacccaggttctcagacggggagcagcccagagggtaacagggctgactgttaacgaagcaggaccccaagtggcaaaggctagggtggcacgcgatgtggtacgcagactccgggctgccattcacaaccgtgctaaaggaaagccttaccgcgagggcgagagtcacgcccatctccaggggttggccgcatgggtgtttatgtcagaccccaaacggggggcccaactgttggagcaggtggctaaattgcctcagtga

SEQ ID NO: 13704 - RNA, 1437 nt, unidentified
  source 1..1437: mol_type = other RNA; note = synthetic construct
atgaccgccagaatagatacttatgtcaaagccagtccagttagtgcagcgcagcccagacaggggcagctaagcgcagccgaaagggcacagagggagcaagaacgtgcagatcggcaggctcgctggttggccattagagaggccggcggcatcgacaagtggatagaccagcagctggcaagtcggggactggcgtctgatggcggtgacgaatcagccttgatcgagagggacaaagctgggtataaggccaaaaagaaagccgaggcggaggctcgtagggcattaaggcagaaagcgtggcaggcgtatcacgcgactcacattaatcatcttggagccggcattcactgggaggacgatccagatgtggacaggttcgacgtcgaaaaccgcagcgagagagcacgggataacgggcttcccgagatctcaacaccagagcagttagcgaaggctatgggcctctccatacccaagcttcggcagctgacataccaccgggaaaccgatacagggtcaaattattacagctttactatcccgaagagggatggctcccctagatccatctttgccccgaagcgagatctcaaggctgctcaaaggtggatgttacggcaagtggctgagcggcttcctgttcactccgctgcccatgggttcttacccgacagaagcatcctcacaaacgctctgcagcatgtgggagctcacaccctcgtgaaggtagacattagagatttctttcctactgtgacttggcgccgagttcgggggctgctgagaaaaggagggctgtccgaacaggcagccaccctcctgtctctactggccacggaggccccgagagaagtcgtacagttccggggaaagaccctgcatgtcgccaccggacctcgtgctctacctcaaggagcccccacctctcctgcactgacgaatgccctatgcatgagacttgacaggcggatgtctggcttggcacggctgctcggttgtcgctacacccgctacgccgacgacctgacgttctcgttttgccacgccgacggtcataccggtacaggccgagctccagtgggggcattgctgcgaggagtgggacaaatcttgacagcagaaggctttaaactgcaccctgacaaaactcgcgtcgtacgcgttggcgaacgccagcgtgtgactggactggtcattaatcaggtgccaaagggcgttacagctcccggtgctagggtgcccagggatgtgctccgaagactccgcgccgcactgcataaccgcgagcaaggcaagccaggtaaacctggggaaaccctcgatcagttgagcgggatggctgccttcgtccacatgaccgatccagccaggggccgagtgctccttgacagactggccgcactgaaagctaagcagcccgaggccacatga

SEQ ID NO: 13705 - RNA, 1440 nt, unidentified
  source 1..1440: mol_type = other RNA; note = synthetic construct
atgaccgcaaagatcgaccccatcgtgcaagctgcccagcctgcaatcctgccggtaactaccgcgccttctgtgaaacctgccggcacacctgaagaacggcagcgagcccatgaggagagagtagctcggtggaaggctatcactgaggccggcggcatagatgcttgggtgcaggcggaattgaccagcaggggcctactcgtctcaggggaccctgctcggatgagtgagcgtgaacggagccagtggaaagagagaaaaaaggctgaagtcaaggagcgccggacactgagacggctagcctggaaggcatacctgggcacacatatcgcccacttagggcagggtgtgcattgggaggacaagaagggcgccgataaattcgatgtcccacagcgtgaggaaagggccaaagcattggggttgccccagcttgccggtgcggaagatctggcagccgggatggagttaagcgtggcccgactgaggtggctcgcattccatagagaagtggatacaggatcccactacagacgctggacgatccccaaacgggatgggtccgagagactgattactgcccccaagaaggagctcaagagggctcagcggtgggcgttgcgcaacgtattcgaaaaactcccagtgcacgggtccgctcacggatttctgtctgctagatccattgtcaccaatgcggccgtgcatgctggtgccgacgttgtgatcaagattgacatcaaggatttcttcccgaccgtaacgtggcgcagagtcaggggcctactgcgcaaagcagggcttgcagaaggccctgccaccctgcttgccctcatttctaccgaggctccccgtgaggtggttcagtttaggggaaaaaccctttacgttgcctcgggaccacgcgtgctgccacaaggagctcctaccagtccagcaattaccaacgctttatgcctgaggctcgacaggcggatggctggtctggcacgcaagttggggttgaggtatactcgctatgccgacgacctgacctttagttggaaaagcccagccacaggagaaacttcaagagaagttcccagggccagggcgcctattggaccccttctgcacggaacgcgagaaatactgggcgctgaggggttccggttgcacccaactaagactgcagttatgcgccgaggagatcagcaaaaagtcacaggcctggtggtgaatgctgccggtccgtcagtccctcccgtgagagtgccccgagagaaggtcagagagcttagagctgccatacgtaaccgagagctgggacgggagggcaaaggcgaaacactcgcccaactgaagggcctcgcagcatttgtgtttatggcggacccagttcgcgggcgggcctttttagaccgtctggcagccctcgagacaagggcaggtggctga

SEQ ID NO: 13706 - RNA, 1479 nt, unidentified
  source 1..1479: mol_type = other RNA; note = synthetic construct
atgacagcaaagattgaccccatcgtgcaagctgccgcccctgttgttctgcccgtgactactgcccccgcggtgaaaccaactgagacggccgaggaaagacagcgcgcactggaagagagggtggctagatggaaggccattacggaggccgggggtatcgacagctgggttcaggccgaactgtcttctcgaggcctcctcgtgtccggggatcctgctaggatgtccgacagagagcgctctcaatggaaagagcggaagaaagccgaggttaaagagaggcggacattacggcggcaggcatggagtgcctacctgagcagccacatcgctcatctggggcagggcgtgcattgggaagagaagactggtgtggacaagtttgacgtggcccagagagaggagagagccagggctctcggcttgccagcaatcgcgagcgctgaagaactggccgccaagctggaaattcccgtcgctcggcttcggtggttggcctttcaccgtgaagtggacaccgggtcacactataaacgctggttcatcccaaaaagggatggaacccagagactgatcacatccccgaagcgtgatctgaagcgtgcccagcgctgggcccttaggcatgtgtttgagaagctaccggttcatggaacagcgcatgggttcctgagtgcaagatccattgtgaccaatgccgaagctcacgccggagccgacgtcgttgtcaaggttgatataaaagatttcttccccactgtgacgtggcgccgtgtacgaggtttgctaagaaaggctggcctcgctgaaggccccgctactttgttgtcattgttaagcaccgaagcccccagagacgtcgtccaatttaggggaaaaaccctgtacgtggcaaacggccccagggtattaccacagggcgcacctacctcaccagcaatcaccaatgctctatgcctgcggcttgacaggagaatgagtggactcgcccgcaagctgggtatgagatacacacggtatgccgatgatctcacctttagctggagggcacctgcagcggcggtagcttctgagacaggaaagaagggcaaaggcaaagccgatgctaaagcagctgagcctcgtcctcaagcccctgtgggggcacttctccgagcagcaagagacatactgggcggagagggatttcgcctgcacccgacaaagaccactgtgatgaggcggggggatcagcagaaggtgacaggccttgttgtcaacgccgctggatcgagtgtcccagcagtccgagtcccacgcgagagagtacgcgagctgagggctgccattcgaaaccgggagttaggccgcgaaggtaagggggaaaccctcgatcagctgaaagggcttgcggcattcgtgcacatggctgacccagtgcgaggcagggctttcctggagcggatagcggccctcgaatctcggtcctcaggttga

SEQ ID NO: 13707 - RNA, 1503 nt, unidentified
  source 1..1503: mol_type = other RNA; note = synthetic construct
atgaccgccaagatagacgcaactgtgcaggcccgcgcaccagtggtcttacctattacaactcctcctgctcccggtggggctgctgcaagatttcacgcagccgctggggctgaagctaggagactagcgcatgaagagcgagtagcccggtggaaggctatcgacgaggctggcggcatcgatgcctgggtgtctgctgagctcacatcaaagggcgccctggccaccggagatccaaaagctatgtctgacagggagagggcccagtggaaggaacgtaaaaaagtcgaagcccgtgaacgccggagcttgcgcagacttgcctgggaagcatatgtggccactcacgttaaccacttaggcgccggagtgcattggtcggaccgggtagggcccgatagattggacgtccccggtctgagtgagcgagccagagcgcacggccttccagacttacctggggccgccgaacttgcttcagcgttgggactgtctattcctaggctgcgttggctggcctatcaccgggaggtggacaccgggacccattatcgccggtggcacatcccgaagcgggatggatcagccagaacgatcagctcccccaaaagggatctaaaaagggcacaacggtgggccctgaggaatcttttcgaaaaactcccggtccacgcagcagcccacggtttcttagcgtcccggagcattgtgactaacgcggctgcccatgccggagccgacacaatagttaaggtcgacattaaggatttcttcccaacgattacttggaggcgcgtacgcggtctgctccgcaaagctggcgtcgcagagggacctgccacccttgtggcactccttagcaccgaggcgccaagagatgtggtgcagttccgaggccagactctctacgtggccacaggccccagagtgttgcctcaaggggcccctaccagccctgcaatcacaaacgcaatttgcctgcgtctggatcgcagagcatcaggactggctcggaagctcggcctgcggtacaccagatacgcggacgatctcacattttccttccgagccaccgaggctcccggattagcaggtgcggctagacctagagcaccggttggcgctctgctcagaggcttgagggagatcctgtcctctgaggggtttcgcctgcaccccagtaaaaccgtggtgatgcggaaggggagtcgccagaaggttacaggcctggttgtgaatcatgcgtccgaaggtgctccagctgcccgagtgccaagggaaagggtacgagcactgcgtgctgcaatccggaatcgcgaactagggaggcccggcaagggtgagacgttggctcagttgaaggggctggccgcctttgtctacatgactgaccccgccaaaggacgcgcctttctgggacggatagaggccctcgagcgaaaccagccagctccagttggagaggctggcccgcatgatgcaaggcccgtcctgacatga

SEQ ID NO: 13708 - RNA, 1359 nt, unidentified
  source 1..1359: mol_type = other RNA; note = synthetic construct
atgacggaggccgggggcatagatgcttgggtgtctgcgcagcttgctgccaaaggcctggccgtgacaggcgatccagcatctatgagcgatcgcgagagagggcagtacaaagaaaggaagaaggccgaagcgaaggaaagacgggcgctgcggaagcttgcatgggaggcttatcttgaaacccatgtgacacacctaggagcaggcgtgcactgggaggacgacgcaggtccagaccggttcgatgctcctaatagggaggagcgagcccgcctgattggcttgcctgccctggagacggccgatgctttggcaggagccctggaagtgcccgttgccaaactgcgctggctcgcgtatcacagggaggtggacaccggcagccattaccgtcggtggcagattcccaagagagatggcaccgcccggacaatcaccgcccctaagagagatctgaagcgggcacagaggtgggccctgcgtcatgtgtttgataaacttcccgtgcacggggccgcacacggctttttggcagaccgaagtattgtgactaacgcagttgcacatgctggcgcagatgtcgtggtcaaggtagacatcaaagactttttccccaccattacttggcgaagggtgcgaggcctgctcaggaaggctggtgtggccgaggctccagccacattgatcgcccgcctcagtactgagcccccgagagaagtggttcagttcagggggaagacgttacacgtcgcaaccgggccgagagtgctaccacagggagctcccacttcaccagccatcacaaatgcgatctgcctgaggctggaccggagaatgtccggcctcgccagaaagcttggattccgctacacacggtacgctgacgacctcacactctcctggagagctggtgggccaccagctgcacctccagctgctgctgctcctggacctggttctcctggaggtgcccggtcacaacgtcctcccatcggtagcttactgcgagggatcaaacagatactactgtcggagggatttcgcctgcatcccagcaagactgtggttatgcggcgcggcgatcgccagaaagtaaccggacttgtcgtaaaaggagctggcgattgggtcccacctgcccgtgttccgagggaaagagtacgcgagttgcgagccgcgattaaaaacagagagctgggaaggcccggcaagggcgaaaccctccaacagctgaaagggctcgcagcgttcgtttatatgaccgaccccgtccgcgggagggcctttttagaccggttggccgcactcgaagccctgcaagtcaagtccgggggagccggtgaacctactgggtga

SEQ ID NO: 13709 - RNA, 1455 nt, unidentified
  source 1..1455: mol_type = other RNA; note = synthetic construct
atgacagcaaagattgacactagcgtgagggcagcccctcccgttgtccttcctatcacgacaacaccaccttctcctccgcgcgttagcgccgaagaacgggcacgagtgctggaagagagattgagcagatggaaagcgatctctgaagggggaggaatagatcagtgggtgagcgctcaactcactgccaagggcgcattggtcactggcgatcccagcaggatgagcgacaaggagcgggctcagtacaaagaaaggaaaaaggtagaggcgaaagaacgaaggtctttacgtaaactagcttgggaggcctacgctgcaacccacatctcccacctcggcgctggcatccattgggaggactcgactgacgccgacaagttcgatatagcaaatcgtgaagagcgcgcgaagaccattggccttccacctctggtcggggccgtggatctggctaaagcgctggatatacccataaccagactgaggtggatggcatttcaccgcgaggtggacaccggatcccactaccgacgatggctcatccctaaacgcgacgggtccagtcgtacaatcacagctccgaaacgggacctgaagagggctcagaggtgggcactacggaacgtgttcgatagactgcccgttcatggcgccgcgcatgggtttttgtctgcccgcagcattgtaactaatgccaaggctcacgctggtgccgatacagtggttaaggtggatatcaaagactttttcccaacagtcacttggcgtcgcgtgaggggccttctgcggaaagctgggatggccgagggtccagccaccttactcgcactactgtcaacggaggcccccagagaaatcgtgcagtttcggggaaagacactctatgtggccactggcccgagagtgctcccacaaggtgcccctaccagtcccgccattaccaatgctatttgccttcggctggaccgcagagtctccggactggctaagaagctcggcttccgctacacgcggtatgccgacgatctgacgctgtcatggcgtgcccccgttaagccggatgctggcacatccccaagagcccctatcggaactttattgcgggggctgaaggaaatcttgcagtcagagggtttcaggatgcatccaagtaaaaccgcaattatgagggctggaatgaggcagaaggtaaccgggcttgtgattaacaaggccggggagaacatcccagacgcgcgagttccccgcgacaccttaaggcggctgagagccgccattaagaaccgcgagttgggtagacccggtaaaggcgagtctctggcacagctgaaagggctggccgcttttgtctatatgacagatcccgtccggggaagatcacttctcgatcgaattgacatgctcgaggcaagaagtgaaggcggcggatcccctaccccagcaacctga

SEQ ID NO: 13710 - RNA, 1431 nt, unidentified
  source 1..1431: mol_type = other RNA; note = synthetic construct
atggatccgtggataacggcccagctgaaggctaagggcctgcttacagaagatttgtcagatgaggaagatgaggacgaggatgagagtgatgatgacgacgacgaggacagcgatgatgaggattcaaatgacgaggacagcgacgacgaggactccgacgaggatgcacctccccggaaggcagctgctaagaaagctgtcgctaaagcagccccaaaggtgaagtctgacctcgggaagagagagtataaagaaaaaaaacaggcggaagccgtcgaacgtcgagtcctaaagaggctcgccagacaggcatataccgcagcccatatcgcacatctcggggctggcatcttttggcgcgatgacacaaggcgacccgacgccttcgaccaccctcagagggagacgagggctcaggagctgaaacttgagcttactgatgcaaagcaattagctggcgcactcggactgactatccctgccctgcggtggctctcctttcatcgggaggttgataccggcacccactaccgaagttggcaaatacccaaacgtgatggcaagtctacccgcaccattagctccccaaagaagcagctaaagaccgcacagagatggttgttaagaaacgtcttagaaaagctgcccgtgcacggtgctgcccacggattcctatccgcccggagcattgtcacaaacgcccaggtacacgccggtgcggaagtggtgattaaagtggacatcaaggatttcttcccctccattacctggaaaagggtgaaaggtctgctgcgcaaacacggactgccagaaggggtggctactctgttgtctctcctctcaactgaggccccgcgagacgtagtgcagttcaggggcaagacactgtacgttgcaaagggacctagggctctgccacaaggtgccccaactagtccggcgcttacaaatgccatctgcctgagacttgaccgccgactctctggcctggctaggagcttgggctttcgctacacacgctatgccgacgacctcaccttcagctggcatccagaacctgttttacccggtacttcgccccaaccaggaacgggggccttgctgagagggattggccagattctggaaggggaaggcttttcactcaaccaagcaaaaacccgcataatgcgggacggaactcggcaggccattacagggctgatcgtgaacggagcccctggcaaagccaccgctagagtgcctcgggagacacttcgtcagctgcgggccgcaatccacaatcgcgaagcgggtaaacccggaaggcctggcgagggactggaacagctgagaggcatggctgcctttgttcatatgaccgatgcggccagggggaaggcattgttggctcggatcgacgctcttgcggccagagataaggggtga

SEQ ID NO: 13711 - RNA, 1413 nt, unidentified
  source 1..1413: mol_type = other RNA; note = synthetic construct
atgacggccccgttcgatccccatcttcctgccgacagtcccgtaagggcggaacccaggtctactacccgacgctcccccgaggaaactgcaaagcttgccgccgttagagctgagagagtggccctctggaaggccatcgaggaagcaggcgggatagcagcctgggtcagggctgaaattgcgaaaaaaggaatcagtacagacggggtggacccctcaacattgagcgatcggcagaaatcatccttcaaagacaagaaacgggcggagagcgaggcaagacgtacctttaagcgcctggcatgggacgcctacaaggagacgcacatcacacacctgggtggaatttactgggatgaagacgcttcccccgataaatttgatatagacgggcgggaggaaagggcaaaagacaacatactcacagatatccagtcaccaggtgctcttgctcaggccttaggcctgaccgtggccaagctgcgctggcttacatttcatcgcgatgtggacagcggaacacactataggcgttggcagataccaaaacgggacggaagtatgcgcactattaccgcccccaaactgcacatgaagactgcccagagatgggccctacgtaacgtattcgataagctgccggtccatggcgctgcacacggatttctcgccgcaaggtctattgttacaaacgcctccgtgcatgccggggccgatgttgtcgtaaaaatcgacatcgaggagttcttccctactatcacctttaggcgggtgaagggcctcctacgcaaagcgggcctctcagagcaggctgctaccttgatcgccctgctgtgtaccgagccacccagggagtcggtcaactttcggggcaaaacggtgtacgttgcttctggtccacgtgcactccctcagggagcaccaacttctcctgctattaccaatgctctgtgccgaagaatggatctgcgattgagcgggctggcaagactgctaggcctgaagtacaccagatatgctgacgatctgactttttcttggaagtgcccaacaccgggagctaaggctcctctgggggtgctgctgaggggtgtgaccacaattcttaagagcgaagggttcagaattcacaagaaaaagacctccattatgagaaaaggggcacggcaagccgtcactggcttgatcatcaatagcgaagttggcgccgcgagtgctcgagtgccacgagatgtgatcagaaatttacgggccgccattaagaatcgggaactcggcaggcctggaaaggagggcgaaacgctcgcccaactccagggtttggcggccttcgtctatatgtccgaccctgtgaaaggtcgcactttcttagaccgcatcgcaaagttgcaagctcctacaaagacctga

SEQ ID NO: 13712 - RNA, 1407 nt, unidentified
  source 1..1407: mol_type = other RNA; note = synthetic construct
atggcctctaagctcgaaacaatggtgagtgcagctgctccagtggaaaaggaacagccagctcccaagtcggctcccactgaagagcagcttgctgcgagggcaaaagcacacgaggagcgggttctgaggtggaaacaggtccaggaagcgggcggagcggatgaatggatcagaggggagttgcgcaagaagggactgctggttgaatcagacccctcccgactcggcgatcgagaaaagggatctttcaaggagcaaaaaaaagccgaagcagcggagcgcagggctctaaaaaagcttgtgtgggatgcttatagagctacccatgtcgtgcacctgggtgtcggcgtccattggagcgaccacttcgaggctgaccgattcgatatcgagaggagggaagaccggctgaaggccaatgatttaccagagtataaggacgcggagggtttggccaaggcgatggggattgatgttcctacactgagatggttcagctaccaccgtgatgtggacgcagggactcattaccgccgctggcagatacccaaaagaaccggcgggtccagaacgattacggcacccaaacgaggtctgaaggcagcccagaggtgggtgctccgcaatatcgccgagaagctgcctgtgcacggagctgcacacggcttcctctctgcccgctcaatagtgacaaatgcccaagtgcatgccggcgctgacgttgtagtaaaagttgacgtcaaggatttttttccaactgtcacctggcgccgtgtgaagggcctcttcaggaaggcaggtttaaacgaggcaaccgccacaatgctggccatggtgtgcactgaagccccgagagatgtggttgagttccggggccggaccttgtatgttgccagcggccctcgtgccttacctcaaggagcccctacctccccagcaatcactaacgctatctgtctgaggctggatagaagactgagcggcctggctcgggtgctagggatggtatacacccgttacgcagacgatctcacattctcctggcggaagagtgacgatagggccaaggctcctgtgggggctttgctcggcggagtcaagaaaattctgagagcagagggatttgtgttgcatcccgacaaaactacggtgatgcgggatggcgacaggcagaaagtcacagggctagtcgtgaacaaagccgaaggtcaaccagctgcacgcgtaccgagagagacactgcgcaaacttcgggccgccatcaagaaccgggagctcggtcgacccggaaaaggcgacgaaaccattgaccagcttaagggaatggccgcctttgtatttatgtgcgacgccaaaaaagggcaggcctttcttgaccgaattgccaagctggaggggaaatga

SEQ ID NO: 13713 - RNA, 1305 nt, unidentified
  source 1..1305: mol_type = other RNA; note = synthetic construct
atgtccgagacaccacctacatgggaggagatagcccaggtgggagatatcgaaagatgggttgttgcacagttgcaacaacgcgggctgcttgacgaagtggcggatcccgccaagctgtctggcaatgctctgcggcagtttaaggcccgacgtgaagaggaacgaaaagtccgaaaactcttaaggcagcaggcctgggcagcatatcggaaggcccacctggtgcaccttggcgctgacgtgttccaccacgacacccctgaccaggaccggtacgacctgccagaccccgaaacacgcagggagacaaatggcttgccagctctgaaggatgtgcaagctctggcgaaagctctcgacctcactatccctcagctgcgttggcttgccttccatagggaggtggactccgggagccactaccagtattggaccattccaaaacgcgatggaggccagagattgatctccagtcctaaaccgacactgaaaaagacccagcgctggatccttcggcagatggcggagagattgccggttcatggcgctgcacacggatttctcccaggaaggagcattttttccaacgcagctgtccatgccggcgcacgtctgttagtcaagctcgatattcgcaacttctacccaaccgtgacctggcggagagtcaagggtctatttcgaaagggaggttacggggagcaggttgcgactgtactggccctcctttgtaccgaagccccaagagagctactgcagttggacgggaagccctaccatgtcgcaagcgggcctagagcacttcctcaaggtgcccccacttctcctgccctctcgaataccgtatgcctgcggctggattgtagattatctggcttaagtcaaaaactgggattccggtatacgagatatgcagacgacctgactttctcatggcatgaacacagccctccgcccctgggtaggttactcaggtgcgccaggctgatcctgcagacggagggttttgtgccacaccccgaaaaaacgcgcattctcaggcggtcacgaagacaaactgtgaccgggctagtggtaaacgctgcccccgatcatagttcaccagcgcgcgttccccgcctcaagatacgcgaactcagggctgccctgcataatagactgcggggcaaacccggaaaggctggggagactcttgcccagctgaggggctgggtggcctacctacacatgacagatcccgataaggcaaagcctttcttggcccagttgaaccagctggaggctcgtggcgctgatgagtga

SEQ ID NO: 13714 - RNA, 1302 nt, unidentified
  source 1..1302: mol_type = other RNA; note = synthetic construct
atgagtgagactccacctacatgggaggatatcgcacaggttggtgacattgagcgatgggtcgtaacgcgacttaggcaactggacctcttggatgaagtaaccgaccccggcaagctgacctcggcagcattgcatcaatacaaagccagaagagaggaggaacggcgcgtgaggaagcagttgaggcagcagggatgggcagcgttcaggcaggcacacctggtctacctaggcgccgatgtcttccaccacgacacccctgaccaggaccgctacgacttaccagatccagaaacacgcagagaagtgaacgcactgccggcccttaaggatgtgcaggcccttgccaaggcgttggacctgagcatccctcgactgcggtggctcgccttccacagagaggtcgatagtgggagtcattatcaatattggacaattcccaagcgcgatggtggggcccggcttatctcagcccctaaaccaaccctcaaaaaaacccagcggtggattctcagacagatcgctgagcgccttccggttcacggtgctgcgcatggcttcctgcctgggagatctattttttctaatgccgctgtccacgccggggcacatacgatcgtgaagctggacatccggcacttttaccccactgtcacctggcgcagggtaaagggcctgttcagaaaagggggatatggcgagcaagtggccaccgtgcttgccctcctatgtaccgaggctccccgggagttactcccactcgatggccagcatgtgcacgtggcgagcggaccacgtgccttacctcagggcgcaccaacatcacccgctctgtcaaacacagtgtgtctgcggctggactgccgcctttccggattatcccagaagttgggctttaggtatactcgatacgctgatgacctaactttttcttggcacgactcctccccacctcctctgggacgactgctgcgctgcgtgcatgctatactgaaagccgaaggttttgttccacaccccaagaaaacgcggatactcaggcgtggtcgcaggcaaaccgtcactggactggtggtgaacgagacacccgcaggaagccccgctagagttcctcgggcccaggttagaagactccgggccgctctgcacaataggctgcatgggaagcccggaaaagaaggggaaagcctggcacagctgaggggctgggtggcttttctacatatgacagatcccgaacgtgccaaaccgttcttggctcaattgaagcagctcgaagagcgtggcactgatgagtga

SEQ ID NO: 13715 - RNA, 1587 nt, unidentified
  source 1..1587: mol_type = other RNA; note = synthetic construct
atgggtctgttcgactggatgttcaggcgaggtcgtaagagcgaccccgagccgattgctccttcgcctgtgtctcccccccctccatctgaggcacctggacgtcctgcccccaaagccgaacctcagccagaggcaacaggcgatccctatgccgccactgaatttttgcccgtaagtaggcaggaaatcgtggatgcagctaaggggggaaacctcctgagtacagcctttcagttcggacgtcagagcataattccacccgctagtgatccaagaacacagctcatcgacagggcaatggttacacacggcttactatccccagaagaactcaatgagattcaccgcgtcggggaggagtacgaccgcgtaaagcctactgatgccaatctagctgctgccgcaggacttgcgggtgcagctgctgtcaaagcatacagggaatccaaggaacgcgaaaaggagagaaaaaaggcagaatccgcggcgcggaaaaaagccagggccgatgccatccgccacagaagagcctcagatattatttttctcggcaggggggtatcgggcagactgcacttgaggatgtcagaccaacagcgcctcgccgcccacgaattacccgtgatgcataccccggctgatgtggcaggggcacttggtctgagcatcaaacagctacggtggttggcctatcacagcgaggccgctacgcgtacgcactacgtgaagttccaggttccaaagaaatcaggaggtatgcggacgttagctgccccgcataagacactgaagggggcacagcattgggtgcttgccaatgtcctgaataaattacctgtcactgaggctgcccatggtttcgttgccggcaggggcatcgtcagtaacgccaaccctcacgtgggcaaggctgttgtggtcaatctggacctcagcgacttttttcctacaataacctttcatcgcgtgcgggccgttttcgagcggtacggttatagcgggtccgtggcatctgtactggcccttctgtgcactgaatgtccacgggcaaccgttacctatgctggcactaagtatgaagctgctaccggaccacgaggattgccgcaaggagcccccacttctcccggactttccaaccaggttgcccggaaactggataaacgcttgctgggcgtggcagccaaactggggctcacctacacacgctacgccgacgacctgaccttctcaggcggaccagaattggcggggaagattggctggcttctggcgaaagtccggaacatagcccgggaggagggcttcgcagtgaacgagaaaaagacacgagtgatgcgccgatctaccgctcaaaccgtaactggcgtggtggtgaacgataagccctccgtcagcagagaggagctgagacgactgagggctatcctgcatcgagctaagaccgagggcctggaggctcaaaatagagagggcagacccaactttcggtcttggctggcgggaaaaatcgccttcgtcaatatggtgaggccagacgcaggggcgaagctcaaggcagcgtttgacgccctcgggagatga

SEQ ID NO: 13716 - RNA, 1572 nt, unidentified
  source 1..1572: mol_type = other RNA; note = synthetic construct
atgggcctcttcgattggatgttccgccggggtagaaaggtcgaacctgacccggtagccccaccttccactgacgctagtctgaggggagccgccaagcctgctgaacctgcaccacctcccccacctgcggatcaatacgcggctacagactttctgcccataacgcgcgaggagatcgtggacgctgcaaaggaacacggccgattgttatggaccgcatttcagttcgggaggccctcccaaattcctccgacatctgatcctaggactcagatcatcgatagagcactggttacacacggcctgctgacccctgaagatctgacggagattcataccgtgggagctgagtatgacgaggttaaacccacagagatggctatcgccgcagccgcaggtttagcggggaatgccgcagtccaggagtatcgagaagccaaagaacgagagaaggctcgtaaaaaggctgagtctgccgcccgaaaaaaggctagagcggccgaggtgaagagaagacgcgacacagacataatttttttggggcgtggcgtctccggcagactgcatatgagactttcggatgaggctagccttactgcacgggggcttccagtgctgcatgctccagccgacgtcgcgaaggctttgggcctaacaatcaagcagctccggtggctggcttaccacacagaggcagcgacgcgaacccactacgtgaagtttgaaatcccaaaaaaatccggaggaatgagaacccttgccgcaccccataaacggctcaaagccgcccagcactgggtgctcgcaaacgtagtgaataagctcccgacgaccgatgctgcacatggattcgtgccagggcggggcattgtgtctaatgccaacccccacgttggcaaggccgtggttgtgaatctcgacctgagtgatttcttccccactattacctttttccgggtccgggcagttttcgaacgctatgggtacagcggcagcgttgctagcgtattagccctgctggccacagaatgtcccagggcctcagtgacttacgccggcaccaagtacgaggcggcaacaggaccgcgtggtctaccccagggtgctccaactagccccggcctatctaaccaggtggcgaggaaattggataagcgcctgcttggcgtggctaccaaactgggactgacttatactcgttatgccgatgacctcactttttcaggtgggccagagctggccggtaagatcgggtggctcctcgccaaagttcggcacgtcgccaaagaagaagggttcgctgtgaatgagaagaaaaccagggtaatgagacgctcagctgcccaaatggtaacaggagtcgtggtcaatgataagcctagtgtgtccagggacgagttacgcaggctgcgggccatactgcacagggctaagagcgaaggacttgacgcccagaaccgcgaaaaccgccccaactttaccgagtggttgagaggcaagattgcatttgtgtcaatggtcaggcctgacaccggggccaaactgaaagccgcattcgatgcattgtga

SEQ ID NO: 13717 - RNA, 1569 nt, unidentified
  source 1..1569: mol_type = other RNA; note = synthetic construct
atgtctgcgttcgactggctcttcaggagaacccggaagccggatccagaaccgccagcacctccacccccattgcctcctccagtggccgatgctcctggttccccgagtccaccccctcctgtcgctgatccgtatggaagcgaattcctccccgtcactcggggggagatagtggctgccgcaaagtccggaaacctgctgagtacagcattccagtttggcagaccctcagtgataccccctaccagcgacccccgcacacagcttattgatcgcgccatggtgactgccggcctgctctctccagaggagctagccgaaatccatagagtgggcgaagagtacgaaaaggccaagccaacagaggcaaacttggctgccgctgcaggtttggccggagatgcagcagtccgggcctatcgggctgagaaggaaaggcgaaaggctcaaaaaaaggcggagagcgctgcccgcaaaaaagaccgtgccgaggctgtagccactagacgggctacagacatcatcttcctggggagatgcgtgagcggaaagctccatttacgcctcagcgacgagacaagactggcggagttcggccttccagtcctccatacccccgctgacgtggccaaagccctaggactcaccattacccagctgaggtggctggcctttcataccgatgtagccaccaggacgcactacgtgaaattccaagtgagcaaaaagtcgggcggtacacgaaccttggctgctccccacaagacgctcaaagcggctcagcgatgggtcctggccaacgtagccgcgaagttcccagttactgaagcggcacacggttttgtggcgggaaggggcattgtgtccaatgcagggcctcacgtgggcaaagccgttgtagtcaacttagacctctctgatttttttccgtcagtcgtgtttgccagagtcagggccgttttcgaacggtacggctattctggtgcagttgcgacggtgctggccctgctgtgtacggagtgcccaagagcagccgttacttatgccggcactaaatacgaggccgcaacaggtccccgagctcttcctcagggagcccctacatcacctgctctgagtaatcaagtagcccggaagcttgaccgacggctgttaggagtggcccggaaactaggcctgacttacaccaggtacgcagatgacctgacattttcaggggggcccgagcttaatgaaaaagtggggtggctgctggcaaaggtccgcaacgtcgctagagaggagggcttcgccgttaatgagcccaagacccgtgtgatgcgacgctccgcagctcagactgtcaccggggtggtggttaatgacaagccctccgtggatagggcagaacttagacgtctgcgcgctatcttgcaccgcgcaaaggcagaaggactggcggctcagaaccgcgatgggaggcctgactttcgggcttggctcgtggggaaaatcgcctttgtacgtatggttaggcccgacgctggcgcaaagctgaaagccgccttggatgccttaccaggatga

SEQ ID NO: 13718 - RNA, 1599 nt, unidentified
  source 1..1599: mol_type = other RNA; note = synthetic construct
atgtctatgttcgattggatctttcgtcggaaaagggacgtcaccccttcagccgaatcagcacccccctctgttcctccaccccctgacccaaggccgcaacagcaggcaccgaaagctgaacctcaggctgaggctgttggcgacccctacagcgcctctgaatttcttccgatctccagacaagagatcgtggacgccgctcagaagcacgggaggctactcgctactgcttttcagttcgggagacagagcataatcccccccgtatccgaccctaggactgaaataatcgatcgcgccctcgtgaccaatgggctgctgagccctgaggagcttaatgagatacatagagttggagaggagtatgagaaggtccgacctaccgaacagggtatggctgcggcagcgggtctagcagggaatgcagctgtgaaggcttaccgcgaagcgaaggagcgggctaaagcaagaaagaaagcggagagtgccgagaggaaaaaggcccgggcagaagcagtgcgaagacgaagggccaccgacgtgatctttctggggcggggtgtctctggccgacttcacctccgcatgtccgatgaggcaaagctgaccgcactcggcctacccgtgttacacgctcctgccgatgtggccaaagccctcggactcacaatcaaacaactgcggtggctctctttccacaccgaagtggccactcgcactcactacgttaagttccaggttcccaagaaatcggggggcgttagaacgcttgccgcacctcataaaaagctgaaggccgcccagcactggattctgggaaacgtgattaacaagttcccagtgacagaagccgcccatggttttgtagccggccgcggaattgtgaccaatgctaatccgcatgtcaataaagcagtagtggtaaaccttgacctgagtgattttttccccagcatcgctttcttccgggtgagagccgtgtatgagagatacggatacagcggctccgtagccactgtcctggcactgctgtgcacagaatgcccacggaccgccgtgacgtatgctgggacaaagtatgaagccgccactggtccacgtgggttgccacaaggcgcaccaaccagtcccggattgtccaaccaggtcgctcggaagctggataaacgtctgttgggcgtggcggctaagctgggactcacctacacacgatatgctgacgacttaacgttctctggcggagctgagctggcgggcaagattggctggctgttggcgaaagtccgcaacatctgtcgagaggagggttttgccgttaacgaaaaaaagacaagggtgatgcgtaggagtgccgcccaggtggtcacaggagtcgtggtcaatgataagccatccgtgtcaagagacgaaattcgcagactcagggcaattctgcatcgcgccaaaagcgaggggctggatgcccagaacagagaggggcgggagaatttcagggaatggttagcgggaaagattgcctttgtgaacatggttcgcccagacgtcggcgctaaacttaagactgcattggattcattgggcgagcggcctgcctga

SEQ ID NO: 13719 - RNA, 1611 nt, unidentified
  source 1..1611: mol_type = other RNA; note = synthetic construct
atgagcttgttcgactgggtgttcaggaggaagagagacgcagatactccccctgctccaccacctgctgcacccactgctccagcctcatcagataaagcgccctctggtaacacaacgtcaggtaccccaggggctaacgcccctcggagttctgaagggtccgaggaccagtacgcagccaatgactttctccccatcagtcggcaggaaattgtcgatgccgccaagaagcacgggcgactgctcgcaaccgcctttcagtttgggcgtcagagcattatccctccagtatcggaccctaggacggaaatcatcgatagggcgctggtgactcacggactgttgacaccagaggagctgaatgagatccatagggtaggggaggagtatgaaaaggtccggccaactgaacagggcattgctgctgccgctggcttagctggcacagccgctgtacaagcatatcgcgccgcaaaggaagccgagaaggagagaaaaaagcgtgaggccgaactccggaagaaagttcgggcggaagctgtgtggcgacggcgaacaactgacataattttcctcggccgcggtgtgagtggcagattacatctaaggctctctgacgagggtaggctgacggagctcggactgcctgtgatgcacacccccgcagatgttgccaatgccctggggctcactgttccgcgccttcgttggttggcgtttcacacagatgtggcgacaaggacccattatgtgaagttcagcgtccctaagaagtctggcggaacaagacagctggctgccccccataaatccctgaaagccgcccagcactggatcctcgccaacgtggtcaataaattacctgtgacagaggccgcacacgggttcgtagccgatcgtgggatcgttactaacgccaacccgcatgtgtgcaaagctttcgtggtgaaccttgatctgtccgacttctttcccagcattgcgttcccacgcgtaaggtccgcctttgaacgatacggatactcgggctgcgtggcgaccatattagcccttctgtgcaccgagtgtcctagggctgccgtgacctacgcaggcaccaagtatgaagctgcaactggaccccgaggcttgccgcaaggagcacctaccagccccggactgtctaaccaagtggcccgcaaattggataagcggcttctgggcgtggccacaaagctcggcctgacctacacaagatacgccgatgacctcacgttttccggagatgcagacgctgctgccaagatcggctggttgctgaccaaggtgcgacacattgcctctgaggaaggtttcgctgtcaacgagaaaaaaactagagttatgagacggagcgcagcacagatggtgaccggagtcgtcgtcaatgacaaacccagcgtctgtagagacgagcttagacgccttcgggcaattctgcaccgcgctaagagtgagggtctggatgcacaaaatagagaaaaactaccgaatttccgcgaatggctacgggggaagatagcttttgtttccatggtccgcccagacgcgggcgcaaaactgaaagctcagctggacgccgtttcatga

SEQ ID NO: 13720 - RNA, 1587 nt, unidentified
  source 1..1587: mol_type = other RNA; note = synthetic construct
atgagcttattcgattggatgttcagacgccggcgtacttccgaacctgagccagtgcagcccccggtaccagtggaacctcccgttcccgcagttccaccagttacagccgctcccgagacgacaaagacagaaccagcaggcgacccctacgccagcgctgaatttcttccggtgtctcgccaggaaatagtcgacgcggccaggggcggaaatctgctgagtacggcattccagttcggccgatcctctactatacccccagcatctgatcctcggacacaactgattgaccgcgccatggtcacccatggcctgctgtcacccgaggagctcaatgaaatccatagggtcggcgatgagtatgatactgtgaagcccacagatcagtccatggcggcagctgcaggattggctggagcagccgctgtgagggcgtttagggaagccaaagagcgtgagaaagcccgcaagaaagccgaaagcgctgctaggcaaaaagctcgtgccgaggccgtcaaaagacgacgggccaccgagatcattttcctagggagaggcgtctcaggcaggctgcacttgaagcttagcgacgaactgaggctggtggcaaacggacttccggtactgcactctcccacggacgtggctcatgccctgggcttgaccatcaaacagctcagatggctggcatttcacaccgaggttgcaaccaagacccactacgtgacatttcaggttcccaagaagtcaggtgggatgcgaaccctggcagctccacataaagccttaaaggccgctcagcatcgcttgctcgagacagtggtggcgagactgcctgtgacagaagctgcccatggctttgttgccgggcgaggtatcgtcactaacgccggacctcacgtggggaaggaggtagtggtgaatttggacttgtctgattttttcccatccattactttcccccgcgtcagggctgtgttcgagcgctatgggtactcagggagcgtagctacggtcctggccctcctctgcaccgagtgtcctcggcaggcagtgacctacgcaggtactaagtatgagagtgctactggtccacggggactacctcagggagcaccgacatcccctgggctcagcaaccaggtagcccgtaagcttgacaagcgcctactcggcgtggccgctaagttagggctgacttacacccggtatgccgacgacttaaccttctcgggcggtcccgagcttgccagcaagattggttggctcctggctaaggttcggcacgtcgcacaagaggagggctttgccgtgaacgaaaaaaagactcgggtcatgcgccggagtatggcccaaaccgtaaccggggtggtggtcaatgataaaccttccatcgatagagacgaactgagaaggctccgagcgatcctgcacagagccaaaacagagggacttgatgctcagaatcacgaagggaggccaaactttagagcctggctcgccggaaaaattgcgttcgtgcacatggttagacctgacgccggcgcaaagctgaaagcggcgcttgacgctctggatagttga

SEQ ID NO: 13721 - RNA, 1587 nt, unidentified
  source 1..1587: mol_type = other RNA; note = synthetic construct
atgtctgctttcgactggttatttcgcaggaagagaactccggagtcagaacctcccgcacaggctcctccagcagctcctgcaccagctaccccagtggcaacccctccagctgcctctgcacctgctcctcccaaggctccagcagccgatcccatgagctcagagttcctgcctgtgacccgagccgagatcgtggatgctgccgggaaaggcaacctgctttccaccgcattccagttcggcagaccctccattatccctccggcctctgatcccaggacgcaactcatagatagagccctggtcacaaatggcctcctcagtagtgaagagctgactgaaattcacagggtcggggatgaatacgaagccgtcaaaccaactgaggctggaatggccgccgctgcaggacttgctggagaagccgccgtgaaggcgtatagagaggataagggacgcagaaaagcgcaaaagaaagctgaaagtgccgaacgaaaaaagcagcgcgcggaagccgtaaaactgcggcgcgagacggatattatctttctcgggcggggggtcagcggcaagttgcatctcagactgagtgacgagtccaaactggctgagcggggcctcccagtgatgcatacacccgcggacgtcgctaagtttctgaacctgaccattaagcagttgcggtggctggcctttcataccgacgtggccacacggacacactacgtaaagttccaggtgcccaaaaaaagcggcggtgtgcgtaccttagcagcccctcatcagaagttgaaggctgcccagcacgcgatcctggcaaatatcgcgtcacgtttccccgttacagaggccgctcacggtttcgtggctggacgaggcatagtgaccaacgcttcgccccacgtagggaaggtggcagttgtgaacctcgacctggaaaactttttcccaaccgtggtttttcctagagtgcgcgccgttttcgaacgttatggctactccggatctgtggccactgtgctggcactcctgtgcaccgaaagcccacgcgcctccgttacgtatgcgggtgtcaagtacgaggcagcaactggtccgcgcggacttccgcaaggagcaccaacaagccccgcactctcaaatcaggtcgccaggaagttggatagacgactgcttggcgtcgccgccaagctagggcttacttacacgaggtatgccgacgatctaacattttccggcggggaggagttaactagcaaaaccggctggctcctggccagagtgaggcatgtagctcaggaagagggcttcacagtgaacgagaaaaaaacacgggttatgaggcgtggtgccgcccagatggtcactggagtggtggttaatgacaaaccctctattgacagggatgagctgcgaaggttgcgggcgatcctacaccgggcaaaaaccgaggggttagacgcccaaaatcgggagggccgccccaattttagagcttggctggtcgggaagatcgcttttgttcgcatggtaaggcctgacgcgggtgcaaagcttatggccgccttggacgccctggggtga

SEQ ID NO: 13722 - RNA, 1575 nt, unidentified
  source 1..1575: mol_type = other RNA; note = synthetic construct
atgagcatgttcgattggctatttcgtcgcaaccgcaagaccgaaaatgtgccgcttgttcctccaccagctccagcccccgttgccgatgtaccaagggccgaagccaagccacaggccgctacaccctcaccagtggacccctacggttctgaattcctcccaatcacccggggcgaaattatagacgccagtaagaaagggaatctgctctctaccgcattccagttcggacgcccttccgtcattcctccggcagcagaccccagaacacacctcattgatagagcacttgtcaccaacggcttgctgactcccgaagacctgaccgaaatacatagagtaggggacgagtatgagaaagtgaaacccaccgagatcggaatggcagccgccgcaggtttggcaggagatgccgctgtgaaggcatataaggccgacaaagaaagacgaaaagctcagaagaaggcagagtccgccgccaggaaggctgcaagaatcgaggctgtcaaggctagacgggctacggatatcatttttttaggaaggggtgtttcaggcaagctgcacctgaggctgtcagatgaagcccggctagccgagcgcgagctacctgtaatgcacacacctgcggacgtggccaaattgctcgggctgtcgatcaaagaactgcgatggctagcctttcacacagaagtggccacacgcacacactatgtgaaatttcagatcccaaagaagtccggcggaatgagaactttggctgcgccccacaaaaaactcaaggccgcccagcattcaatattatccaacatcgtcagccgcttaccggtcactgaggctgcacatggatttgtggccggccgaggaatcgtgagcaatgctaacccccacgtggggaagaccgttgtggtgaatctggacctggaaaattttttccctactgtcgtatttccccgtgtgaggagcgtgttcgagagatatgggtacagcggcagtgttgccacgatcttggctctcctttgcactgagtgtccgcgggccacagtcacctacgctggtgtgcagtacgaggcctctaccgggccaaggggacttcctcaaggtgcccctacaagccctggcattagcaaccaagtggctcgaaagctggataaacggctgctcggcgtagcagcgaaactgggcctgacgtacacaaggtacgctgatgacttaactttcagtggcggcgaggccctgaactccaaaaccggctggcttctcgcgaaggtgcgccatatcgcacaagaggagggattcgcggtgaatgagaagaaaactagagtcatgcgtcgttctgccgcgcagctggtcactggtgttgtggttaacgagaagccctctatatcgcgggatgaactgaggcggctgagggctattctccatcgcgcaaagaccgaggggctggaagcacagaaccgggagggaaggcctaattttcgagattggctgattggcaagattgccttcgttagtatggtgcggcccgacgtcggggggaaacttaaggcggctctcgacgctttgtcctga

SEQ ID NO: 13723 - RNA, 1644 nt, unidentified
  source 1..1644: mol_type = other RNA; note = synthetic construct
atgtccctatacgactggctgttccgacgcacccccaaacctgatcctgagccgacccctgaagccagaggtgccgatgcccctaggagtcctagtcctcctccacccccccaacccgcacaacagggtgtcaatgcaccaagatctcctcagcccccaacaactcccgagccgcaaccggtgactgatccgtatgccgcctcggactttttaccaatcactcggggcgaattgctcaagagtgcccaggctgatggcaatctcatgaggaacgcatggcagaccggccgaaccagcattattcctgatgctaacgaccctagaacgaagctgatagatagggccctggtcgcacacgggctgttaacacctgagcagctgatcgaaattcatcgagttggcgatgaatatgctcgcgctaagccggaaggcgaccccatcgctaggttcgcggggatggctggagaggcagcagtacaggcctaccgagaggccaaggccagactcaaagagcagaagaaagccgaagctaaggcacgcgaagaacgccgggccgaagaggttaaacaccggcgcgcaactgacatagtgtttctgggtcgaggagtgagcgggcggttgcaccttcgcctctctgacgaggcccgtcttgccgactttgggctgcccgtcctgcataccccagcagacgtggcttctgcactgggcctttctatccagcagctgcgttggttggctttccacacagaggctgctaccaggacccactatgtgaagtttgaagtgccaaagcgttccggaggcatgcgcgttctctctgcacctcacaaaaccttgaaggccgcccaacggtggattctagccaacgtggtaagcagattcccagtgcccgtcgcagcccatggttttgtagccggtaggggaatagtttcaaacgctggaccacacgtggggaaggcggtggtgctcaacatggacctggaaaacttttttccctcaatcccattcccaagagtaagggcggctttcgaacgacatggatattccgggagcgttgccaccgtctttgccctgttatgtaccgagtgcccccggacgactgcgacatacgcaggtgtgaaatacgaggtggcaacagggccacgtggactgccacaaggagcccctacttcaccagccctgtcaaatcaggtcgcgagaaagcttgatgctaggctgctcggcctcgcagccaaacttggccttgcctacactagatatgccgatgacctcacattctctgggggccccgagttccaggagaaagtgggctacttgatggcacgggtcagacacctggctgcggatgaggggtttacagtgaacgagaaaaagtcccgggtgatgaggagaagtattgcgcagtccgtcacgggagtagtcgtgaatgacaagcccagcatctgcagggacgaactgaggcgcctgagggctgtgttgcatcgcgccaaagctgagggcctagacgctcagaatcgggatggccgggagaatttccgggcttggctcgagggcatgattgcgtacgttagcatggttagacccgacgtcggagccaaattaaaggccgagttcgatcgcctgatcggggcatccaagacatga

SEQ ID NO: 13724 - RNA, 1473 nt, unidentified
  source 1..1473: mol_type = other RNA; note = synthetic construct
atgcagcccttgccccctgccgatccatatgcagccccagattttctgcccatcgctagaggggaaattgtgtccgccgccgcaggtaaaaacctcatggccaatgcctggcaaaccggccgcacttccataatcccccccgcagatgaccctcgaacacgtttgatcgacagggcattggtgacccacgggctgctcactccggaggatcttgctgaaattcacagggtgggcgccgagtacgcacggctaaaaccttcactggagaatgtcgccctgcaagccggtttcgccggagaagcggccgtacaagcctatagagaggccaaggaacggctgaagcagcttaagcgggaggaggcagcccgacgcaagaatgaaagggctgaggccgtgcagaggaggcgcgataccgacgtcatatttttgggacgcggcgtctctgggcggctacacttacggctgagcgaccctgacagactcgccgagtatgggctgcccgtcttgcatgccccagctgaggtggctgcagcgttgggactgtctattaagcagctcaggtggcttgcttttcatacggaagcagccaccagaacccattacgtaaaattccaggtgcctaagcgtagtgggggtgtacgaacgctggccgcacctcacgccacactcaaaagagttcagcactggatcctggaacatgtggtgtcgaaattcccagtcacagagcctgcccacggatttgttccaggccgaggcatcttaagcaatgcgacaccccacgtgggaaaagctgttgttgtgaatctcgacctgagcgacttttttccaagcgtgacctttcccagagtgagagcagtattcgagaggcatggctatagtggtagtgttgctaccgtattcgctctgctctgcactgaatgtccaaggacttcagctacttacgctgggactccgtacgaggtggctattggcccacgaggactgccacagggagcacctacaagcccgggcctgtctaaccaggttgctcggagactcgacaagcggctgactggccttgcggcgaagttaggcttcgccttcacaaggtacgctgacgatttaaccttctccggagatcccgaacaggccgagaaagtcggttatctgctgtccagagtgcggcatctcgccgcagaagaagggttcaccgtgaacgagaagaagacccgcgtcatgaggcggaacgcagcccagacggtgacagggatcgtggtcaacgacaaaccttctgtgtcccgcgagctactccgtcagcttcgcgctattcttcaccgagcaagagctgaaggcctggatgcacaaaatcgcgcgggaagggaaaacttccgcgcctggctggacgggacaatctcatttgtcgctatggttcggcccgatgtcggcgcgaagcttcgtgctgagtacaacgctctgagtgagagaagctcatga

SEQ ID NO: 13725 - RNA, 1602 nt, unidentified
  source 1..1602: mol_type = other RNA; note = synthetic construct
atggggctcttcgactggctcttcgggaggcccggtgctaaacaaccacctgctcccgctccagcccctcaagcagcagcttccgcagcagcccctggagcagctaaacctcaaaccaccgaaacaaagggtccgaagccccagccagctaaggcaccaaacctgtctgcctcggattttctgcctatcactaggattgacctgaaggagagcgcggagcagattgagagatggggaccctggttcggacggcgagatctgataccccccgccgataaccccaggacgaaactgattgatcgtggcctggtcacacagggactgatgacacctgaacagcttgtagaaatccacgaagttggagccgcaatggacagagtgcggcccatacagttccagatccaggctcagatagcgcaatcaggccaggccgcaatcgaagccaatcggcaaagaaaagccgagattaaggcccagaagaaagcggcaagtgccgaacggaagaaaaaacggtctgaggccattgcgcagcgtcgtgccaccgatatcttttttcttggcaggggcgtcagcggtagactgggtgagcgcaccagcgacgaaacgaagttgacccaattgggtctaccggtactggcaactccagccgatctcgcgcaggcccttggcttacctatccccaaactgcgctggctagcctttcacactgaagtcgccagcagggtccattacgtttgtttcactgtccccaagaaatctggagggacccgactgctgagcgcacctcacaggacactggccgctgctcagcagtggatcttcgctaatatcgtggggaaactgccggtggagccacctgcccatgggtttactccaggaaggtcaattctgacaaatgcacagccccacgtcgggaagaatgtggttgtcaatctcgacctcgagggcttcttcccgtccatcacttttccacgaattaggtccgtgtttttccggctcgggtatagtcctgcggttgctaccattctcgccttactttgcacggagtgcccgcgcaaacaagtaacatataacggcaagatctaccatgtagcgttaggtcccaggggacttccacagggcgcttgtacatcaccaggcttatctaaccaggctaccagaagactggacaagagattggcagggctcgccaagaagctgggcctgacatacaccagatatgccgacgacatcacctttagtggcaacgaggaactcaaagacaaggtggggtacttgatggcccgcatcagacacatagctgaggctgaagggttcgctattaatgaaaacaaatcacgcgtgctgcgtcgaaacgcagcccagactgtgaccggcatagtggttaatgatcgacctggagtgtcccggaaggatctccggcgcttgagggccattctacaccgcgctcgccatgagggtttggaggcccagaaccgcgccaagcggccaaattttcgagcctggcttgagggcatgatcgcttatgtgtccatggtgaggcccgaggtgggcaagagattgcgggaccagcttgctgccctggcacctaaaggagcatga

SEQ ID NO: 13726 - RNA, 1599 nt, unidentified
  source 1..1599: mol_type = other RNA; note = synthetic construct
atgaatcccttagagcgtctgttggagtttctgggctttacaaagactgaggccgacacatccaagcctgctaaggggaaacccgcacctgctgatgccaaatctgccgcaggaggcagcgatgcttcgggtgctaaaaaaccgagcggacccgccgttgccaaaaccttcaatcttgatgcaagtgatctgctgccgataacctctgaagagctgaagtccggtttacgcaagttactgagatctggtggattcaggttcgtgggtcgtggcatgattccccacggagacgagcgaacccggctgatcaatagagcactcctctcagaggggttcctaaccgcagaacagcttgaggcaatcacccaggtggcggtggaatttgaagagttgcagaaggccttggcgagaatcgagggccaggtgaacaagtccgccaagaaagccgttgaggctgacaaggaggagaaggcccgaatcaaggcacaaaaaaaggctgaggctctggccaaaaagcaaaaacacgctgccgacgtcgcccaccggagagaaacggacataatatttctcggcagaaaagtcagtgccaagctgaacgaccggaagggcaacgcggaactacttgctgggtatggactgccagctatcagtactcctgccgaattagcagccgctttagggctctctgtggccaagctgcgctggctggccttccatacggaagtcgccacaagaatgcactacgtgcagtttcaaattccaaagaaatcaggcggtacacggctcctaagcgcacctcatcagtcccttgccgctgcccaagagtggatctatcgagagattattcagaagattccagtggagactcctgcacatgggttcgttaccggaaggtctatcgtgactaatgcccaaccccacgtgggtaatcctgtgctcatcaacatggatctggaggcatttttccccacaattacgtggcagagggtccggagtgtcttccaccgagctggctactccccatcagtcgcaacaattctggctctgatctgtacagagtgcccccgcgataccgtagagtacgcgggaaaaacttactacgttgctaccggaccaagaggactgccgcagggcgcttgtacttcacctggcctgagcaatctggtggcccgtcggctcgacaaaagactaggcggcttgtgcgggaaactgggactcacatataccaggtatgctgacgatctctccgtaagcgggcccgccgaaatcaacgaaaaggttgggtacttgatggcccgcattcgccacatcgcggaagcagagggtttccaagtaaatccaaagaaaacccgagttttgaggcccaacaccgcgcagcttgtgactggcatagtagtcaacgcaaaacctagcctgccaaaaaaagaactgaggcgcctgagggccattttgcatcaggctcagaagaatgggctggacgcgcagaaccgggaacagatcccacattttcgcgcatggctcgccgggaagataagcttcgtgcggatggtgaggcctgaacttggcgctaagctccaggcccagtttgatgcactttga

SEQ ID NO: 13727 - RNA, 1611 nt, unidentified
  source 1..1611: mol_type = other RNA; note = synthetic construct
atggggttctgggacttcctgcccaagttgtttaagccagtgccctcggaaagtccaccgccgtccccttccccaatccctgctgagcccgtggcagaaacatttgtgcctgtgcctccaatgcctgtggctgaacctccagctgcaccccctccaggtcccatagcagtcgcaccaccaccagccgccccttctttccttccgatcacccgcgatgatctcctgaaacaaggtgaggaggtcaggagaacaactggatggatgttctttggccggcgcgacttgattccccctacttcagatcctcgcaccttgctgatcgatcgcgggatggtcactcagggactgctgacacccgatgagctcgcagagatgcaccgggtaggagacgaacatgctaagcacgccgataggtttaggcagatcactatcaaagctgggcagacggctgaccaagccgtagaggcagacagagccgctcgagttgccattaaagcccagaagaaggcagccgccgcagcgttcaaacagacccgcgctgatgcagtcgctgtcaggagggccaccgacattatctttgtgggccgcgacgtgtctgcgatgatgaacgatcgctccagcgatgccgagcgcctgaaagcagccggactacccgtcctgcatacgccaagtgatctcgccgccgccttggggttagcgattccacagcttcgatggttatgtttccacaccgaggttgccaccagacctcattatgtgcaatttgaagtgcccaaaaaggcaggaggcacacggacattggctgcaccacacgccaagcttgctgccgcgcaggagtgggtgcttgccaacgtattagctaaactccccactgaggaaccagcacatggcttcgtcccgggccgctctacagtcacgaatgccctcccccacgccggaagagacgtggttgtaaatgtggaccttgaaggctttttccccgcggtgcggtttccgagggtaaggcacctgttcagaaggctcgggtatagcggtgctgttgccacactgctcgctctgctgggcactgagtgcagccgaaaacgggttgtgtacgacaagcagacctatttcgtagccatcgggccacgttcattgccccagggggcttgcacctcacctgcagtgtccaaccagatagcacggaggctcgacagacgtcttgccggtttagctaagaaactggactgggcatacacccggtacgctgacgatctgacatttagcgcacctcctggccatcgagaacaggtgggctacctactagctcgggtgcgtcacatggccgccgctgaaggatttgctctgaacgcgaaaaagactagggtgcagcggcccgaaagtaggcaagccgtgaccggcctggtggttaatgccgctcctgcggttccgcgtgacgtggttagacgggtcagagccattctgcaccgagcaaagcacgagggtctggatgcgcagaacagaacaggacatcccaatttccgaggctgggtcgaggggatgatagcctacgttgctatggtcaagcccacccagggtgaggccctgagaaagcaatatactgctctctga

SEQ ID NO: 13728 - RNA, 1062 nt, unidentified
  source 1..1062: mol_type = other RNA; note = synthetic construct
aaggcgacagatatcatgttcgctgggaagggcgtgtcagccttgctcggcgatagagcctctgacgccgacaaactcgctgccgcaggattgccggtcctgcatacaccttcggaccttgccgcagtgctcggcctgactatcccaatgctccgctggctgtgcttccataccgaagccgccacgaggatccactacatacaatttgaggtcccaaagaaaagtggggggaccaggaccttatcagccccccaccgtactcttgcagcagcacaggagtgggtcctaactaacatactgagcaaactgcctgcagaggaaccagcccatgggttcgtacccggaaggagcaccttgactaatgctgccccccacgctgttcgggacgttgtggtcaatttggacctggaagggttctttccgagcattggctttgcaagaatcaggcacgtgtttaggcgagtaggctattccggtgctgttgccacactgctggcactgctctgtactgagtgcccccgcaagcgggtagtttacgcaggaacgccctacttcgtggctaccggacctaggggcttaccacagggcgcgtgtaccagtccagccctatctaatcaggtggctagaaaactagaccggcgactcgccgggttagctcggaaactgggcctgacctatacgagatacgcggatgaccttaccctgtcctcaggccccgggtttcgcgatcgtgtcgcctatcttattgcccgcgtccgacacattgctgctgatgagggatttgtagtgaacgctaagaagactagagtcctgcggcccgagtctagacagctggtgacaggactggtggtgaacgccgctcctgcggtgcctagacatgtggttcggcgtctgagagcgatcttgcatagggctcgcacagaaggcctggccgcccaaaacagggatggacaccctaatttccgcggttgggtggagggtatgattgcatatattgccatggcacggccagacacaggtcgcatccttcgggccgctctcgaggaactccctcgatcctga

SEQ ID NO: 13729 - RNA, 1632 nt, unidentified
  source 1..1632: mol_type = other RNA; note = synthetic construct
atgaatattttgagaaggctactggggtggattctgggacatacaattccacctgcgccaccatggccaaaggtgccagctccacctccgcctccatcaccagcatcgcctgaacggccttcagggccagagcctgagatgttaggggccgctggtccagccaaaccagtggagaaaaaggatcggccctatgggtctatccccgaggactaccgtccgatcagcagggaggaaatcctggaagcagccgcaggaagaagtctgttctccaacgtctggtttggccgcagagacagaatacctcccgctgacgatccgcgaacagcattgatcgatagagccatggctacccagggattcttgtcccccgaacagttggtggagattcacactgtcggtcacgagatggagagatttcggcccaccgtcgaggggatttcccaccaggctggattggctggagcagccgcagtggaagctgaccgagcagagagagctcgaataaaagctaggaaaaaagccgaagcggaggaaaggaaacgcctgagggccgaagggatcgcccttagaaagcgtgaggacatcacatttctcgggagacgggtgagtggtcggttaggtgagcggacctctcgcgtagaagatctcgaacgctcaggcctgcctatcctcgccactcctgcggaagtagcccgtgccatgggcctgagtgtgtctcgtcttagatggctcgccttccatgccgaggtggcttcacgcgtgcattatgtccagttcagagttccaaaaaaaagcgggggcgagaggatcttgagtgctccccataggagcctacgccttgcacaggaatggatccagctggaaatcctccgcaaactgcctgttggtcccgaggcccacggcttcgttccaggacgtagcatcctgaccaatgccacacctcacgccggaaaggcgctagtcgtcaacctagacctggaggggttttttccctccattggcttccccagggttcgcaaggtgttcgagcatctggggtattccggctccgtcgctaccattctggcacttctgtgcacggagtgccccaggaaggccgtgactctggatggagaaatgcttcacgttgccaccggccccaggggattacctcaaggtgcctgtacttctccagcgctgagcaaccaagtggctatacggctcgatcgccggcttgcaggaataagcgcaaagctgggatttacctttacgcggtacgccgacgacctcacattctctggcgatgcagaggtggaagcgaaggtgggctaccttcttgcccgagctaggcacattgccgagggcgaggggttcgcagtaaacgaaaagaagactcggatactcaggagaaacaatcgacaggaggtcacaggcctggtggtcaatgaacggccgggcgtgcccagagacgaagtacgtcgcctcagggcaatcctccaccatgctcgggccgaaggcctggatgcccaaaatcgggagaaccgacccgacttcagggcttggctgctcggcaagattgcctttgtgcgcatggtgcgacccgaggttggtgatcgcctgttggcggagctgagacagttagacgctagctga

SEQ ID NO: 13730 - RNA, 1611 nt, unidentified
  source 1..1611: mol_type = other RNA; note = synthetic construct
atgaatgtttttaggcggctgttcggctggttgctcggcagacggttaaaacccgcccccagtcttcccgcaagtaggccagctgcacctggctccccacagtcacctatgaccgtggcacctacccccgctgaagtggtggcgaaaaaaggacgctcgtacgggctcgatgccggggattacctgccaatctctcgggaggagataaaggaagccgcccgaggacgctctctgttcgcaaacgcctggttcggcagacgggaccggattccccctgcagacgaccctcgtaccgctacgatcgatcgcgctatggctacacagggattcttgagcccggaagagctggctgagatccacgccgtgggcgaggaaatggaaagactaagaccaacagcagagcacgtcggtcaccaggcagcattggccggagttgctgccgtcgaggctgatagggctgagagagctcgaatcaaagctcagaggaaggcagaggccgccgaaaggaaaagactgcgggccgaagccattgccttacggagacgcgaagacatcgtattcctggggcgcaaagtgagcgctaggctgggtgagcgtgcttctcgtgtggacgatttacagcgggcaggcctgccagttctttctacgcctgccgagctggcgttggccatgagagtctcaatacctagacttcggtggctagcgtttcacgcagaggtggccactcgggtgcattatgtgcaatttagagtccctaagaagagcggaggcgagcgagtattgtccgctccgcgatcatccctgagacgtgtgcagcgctggattctggatcaggttctaaaaaacattccagccgggccccacgctcatgggtttgtagcggggcgcagcattctcacaaatgccactccccatgcggggaaagccgtggtggtcaatctggatctcgaagacttcttcccatctatcggctttccacgggttaggaaggtctttgagcaggccggatattcaggcgcggtcagtactatcctcgcgctcttatgcaccgaatgcccccgtaagaccgtgacatatcaaggagaaaccctccacgtagcaactggtccccgaggtctgccacaaggcgcctgtacctccccggtgctgagcaaccatgtcgccataaggctggacagaaggcttgctggggtggccacgaagctgggattcgcatacacccgatatgccgacgatcttacattctccggccctagcgaggtggatgctaaagtgggctacttgctcgccaaggttcgccacatcgcacaggaagaggggtttgctatcaacgccaagaagactagggtcttgcggaggaatgcacggcaggaggtgacaggcctcgttgtcaatgacagacccggagtgcggagagacgaaattcgcaggctccgagctattctgcaccgcgcacgcactgaaggcctggcttcccaaaaccgagaaggaaggccggactttagagcctggctgctgggtaagatagccttcgtaaggatggcgcgccctgaggttggtgagcgtcttcttgccgagtttcatgagatcgatagggggcgcagtgcatga

SEQ ID NO: 13731 - RNA, 1671 nt, unidentified
  source 1..1671: mol_type = other RNA; note = synthetic construct
atgtccatttggcaacgcttcctgcagtttatctttggtgagagatccttcaggcccgccgagcctccacccactttttcccccgccgttcctccctcactggctgaacgtcccactacagccgaagctccgcggctcaccatccctgaagcttctgccgacccggatttcgcagcggatgctggaacccataaagatgggcaaccaaagctcgcaggaaaagccgttgatccactggatgcaggagcttatcttcctatttctagagaggagatcaaaagggaagcaaaggggaagaatttgtttaacaactttgccttcggcaataggagcataattcctcccgccgacgacctgagaactaaactgatcgaccgagcgatggtgacacatgggcttctgagcccggagcagctacacgaaattcacgcagtgggggcccgcatggatgagttgaggccaacgatggcagctgtggagcacaaagcagccaaggcaggagaagccgccgttgaggccgacagagaggcaagggcccgcttaaaggcacagaagaaggcggaggctatcgagcgaaaacggctcagagcagagggcatcgcataccgcagggctactgacattgtgttcctcggaaggggcgtgagcggccgtttaggtgaccggacctgcgacgcaagtaaactggaggctgccgacctccctgtgatcgcgacaccaaccgaactcgccgctgctctgggggtaagtgtcccacgcctgcgttggctggcctttcataacgaggccgcaactcgggttcattacgtccagttcacagtgccaaagaaatctggcggaacacggactctgtcagcccctcatcggagtttggcagaggctcaggactggatttttcgagaaatactggctagactgcccgtggaaccaccggctcacggatttgtgacagggaggtcgatcttgaccaacgcgtcaccccactgtggcaagagaatagtggtcaatatggatctggagggctttttcccttccattggcttcgcccgggtccgaagcgtgttccaaaggttggggtactctcctgccgccgccaccatcctgggacttctttgcaccgagagccctcggagatccgtagtgtatgacggggtggcataccacgtcgcaactggccccagaggcttaccccagggtgcctctacctcccccgctttgagcaatcaggttgctcgacgccttgatcggaggctgagcggcttatcgacccgtcttggactggcttatacgagatacgctgatgatctgacattcagtggtgatgaagcctttgaagggcgcgtcggctatctgatggccagggtacgccacttcgccgctgaggaggggttcgctgtcaacgaggccaagtcacggattctgcgccagggtactgcccaaaccgtcacgggacttgtggtgaatgacagaccaggcgttcgacgagaggaagtacggagactcagggctatattgcacagagcccgtaccgaagggctcgaagcccagaaccgcgaaggtcgccccgactttcttgcatggctcaggggcaaaatcgcgttcgtggccatggctcggccagagacaggtgcgctactcaaggcggaactcgaggcgctactggccggatga

SEQ ID NO: 13732 - RNA, 1536 nt, unidentified
  source 1..1536: mol_type = other RNA; note = synthetic construct
atggcagccccacctcccacgcctgaagcatcgacagatccgtatttctccgcccgaaccgatcctacgaaggaagcgagccctaagaaagttgatcccctggacgccggggactatctgccaataactagggaggagattaaggaggaagccaaagggaagaatctgtttaatagcttcgctttcggccttagatcagtgattccacctgccgatgatctgcggaccaagctgatcgatcgtgccctagtcacccacggcctgctgtcacctgagcagcttcgggagatccacgacgttggggcccggatggaggctatgaagccaacaatggcggcagtggaacacagggctgctagggctggtgaggcagctgtcgctgcagatcgtgaggctcgagcgcggttaaaagcccagatgaaggccgaaagcgcagagcgcaaacgcattagggatgaggccatctctcagagaaaagctaccgacatcctttttttggggagaggcgtttcgtccagattgggagatcggactggtgacgcgtcaaagctggctgaggccgggttaccggtggtatctactcccgcagagctcgctgcagccttggggataagcgtgcccaagctcaggtggctcgccttccacaacgaggccgctacccgtgttcattacgttcagttcactgttccaaaaaagagcggtggcacaagaaccctttctgccccccatcgctctcttgccgaagcccagggctggatactccgggaagttctcgctaaactcccagtggaacccacagcccatggctttgtcacgggccgttctattctgaccaacgcctctccccactgccggaaacggttagtggtgaatatggacctcgagggatttttccctagcatcgggtttaggcgggtgcgcagtgtgttcggacgattgggctattcacctgccgtcgccactatcctagctctgctctgcaccgagtgtcctagaaggtccgtcgtctacgcgggcgaaacctatcacgtggctactggtccccgtggactgccccaaggagcatgtacatccccggcactctccaaccaagtaacccgcagactggatcgccgactgggcggtttggccagtaggctaggccttacatacagtcggtacgccgacgatctgacctttagcggagacgaggtgctcgaaggacgcgtcggctacttgatggcacgcgtgcggcatttggcaggtgacgagggcttcgccgtgaacgaggcaaaatccagggtcctgaggagggggactgcccagactgtgacagggctggtggtaaatgaccgcccaggagtccgcagaacagaggtgcgacgccttagagcgattctgcacagagcaagaagtgaaggactggcggcacagaacagagaaggccatcccgactttctggcttggctccgaggaaagatcgccttcgtagccatggcacgaccagacgtaggggctgctttaagggctgaactagaatccctgctggtgcggtga

SEQ ID NO: 13733 - RNA, 1938 nt, unidentified
  source 1..1938: mol_type = other RNA; note = synthetic construct
atgctacgcagaagcgctgtggtggattctgctcctgagactgctagccccagagtgctgttcttttggcctggagcagtagccgttcgccgagctgagtccacagtggtgccaggagtgaggttacagccccgcgccagcgtcaatacgttgggacggcgctttgaggttggtcagcgccctgtccccgttctgccaacccctaaccctagcgcaggcgatatgaatctgtttcaccgactgcttcggttcctctttggatatgaaccccccgccagaagcgcttcccagcctagacctacaccagccccagcacctgcacccgaaccaccaacaacaccagacgccattgcagcgactctgactgaggccttcgggaaaactgctgaaaccacggcgcctgcattgcttcctgacgccacggccgatccatacttcgcagtgacagccgatgtgcagagtaccgcaactaaccagggtaagggcaatgggaagtcttctcttggcctagaagctaacgcatacctgcccatctccagggaggaaattaagaaaacggcgaagggtattgatcgttttgggaacccatggttcggaagacgtgacctgatccccccgaccgacgatccgaggacaaatctgatcgacagagcaatggttacacagggcctgctttccccgacccagttgcatgagatccacgacgtcggcgcaaggatggatcaaatacgtccctccttggcggcgatagaaagcagggccgctgtagatggagcagctgccgtagctgccgacagagaggccagggtgctgctcaaggccagaaaaaaagccgaagcagcccagcgaaagcaggagcgcattgaccaagtggctcaccgcaaggctaccgatattgtgttcttaggccggggggtcagtgccggcctgaatgatcgacaatcagatctcgatgcactgaccggagctggcctgcctttgttgtctaccccagcagatctggccgctgccctctctctctcaatctccaaactgaggtggctggcttttcacactgaggccgccaccagaacacattatgtgcagtttactgtcccgaagaaaagtggtggcctgcgaactctcagtgctccccacaggaccctagccgaagcccagcgatggatcttccaggagatcgtcgcaaaactgccagtggagtccgctgcccatggctttgtagccggccgtagcatcgtctcaaatgcggaggctcactgtcggagggcagttgttgtgaatatggacctcgaagcctttttcccgtcgataggatttcccagagtccggcgggtattccggaaattagggtacagccccgccgttgccacaatccttgcgctgctgacaaccgagtgcccccgcagaacagtggtgtacggtgggactacataccatgtggcgaccgggcctagaggactcccacaaggagcgtgcacctcaccagggctctctaatcaggtcgccatcaggctagacaggaggctcagcgggttggcccgcaagttcgacctctcatacactcgctatgcggacgatctgactctgtctggcgacgctaccttggaggccaaagtcggttatctgatggcacggcttaggcatattgccggcgaggagggcttcgctgtgaacgaagccaagagtcgcgtgcttcgacaagcaaccgcccagaccgtgacgggcctggttgtgaacgacagacccggtgtaagacgggcagaagtccggcggttacgcgccatattgcaccgtgccaagtcggaagggctcgcatcccagaaccgggacggacaccctaactttctggcttggcttcatgggaagattgctttcgtggctatggccaggcccgaattaggcgctgcactccgggctgagctggactcacttctgtga

SEQ ID NO: 13734 - RNA, 1575 nt, unidentified
  source 1..1575: mol_type = other RNA; note = synthetic construct
atgggatttttctcacggctcatcgagcgcttgttcggcaagacagataccggagttattgtgcccaagcaggcagccccaggtgcaactgctggtgcagcacctcaagctgcgcctcctctggctaggcccctgaatctctctgcggataatttcctccccattgctcgggacgaactgaaggaagccgccaaggacgttaccagatgggggccctggttcggtagacgggacgtgataccacctgccgatgacccccggactaggctgatagatcggggtatggtggctaatggactcttgacccaggagcagctcgtcgaaatccaccaagtgggagcagagatggagaggctcagaccattacagtttggggtgtctaatctggctgctcaggccggagagtccgccgtacaagctgaacgcgctcgtcgcacggaaataaaaaaacagaagaaagccgaagccgcggacagaaagaagcgcagggccgaggcaatcgtacagcgccacgccaccgatattgtgttcttgggacggggcgtttctgctcggctgggagaacgcactagtgacggcgagaagctgaaaagcctggaccttccgatgcttcagacccccgctgaactggcgtccgccttagggattggcgtaccaagactgcgatggctggccttccatgcagaggtggccaggcgcgtgcactacgttggatttaccgtcccaaaaaagtcaggcggcacacggacactttctgccccgcacagaagcttagccgcagcgcaggagtggatccttcgaaatatcctggatagattgccagtagaggccagtgcgcatggttttgtgatcgggcgaggaaccttaacaaacgcaaacctccatgtgggccgagctattcttgtcaacatggacttgcaggacttctttcccagcatcggctttccacgagtccgtagcgtcttccagcgcctagggtactcccctgctgtggccaccgtactcgctctgctctgcactgagtgcccccgaagacctgtggagtacgatggccagtcgtatcatgttgctattgggcctagggggcttcctcagggtgcctgtacatccccagccttgtcaaaccaagtggcacgacgcctggatcgtaggctccatgggcttgctctgactctaggggtcacatatactagatatgcagatgacctgacgttttccggagctgcggaatttaatgcacgggtgggctatctgatggccagaatacggcacatcgcagaagacgagtgtttcgccgttaatgccaggaagagccgcgtcctgcggaggaacaccgcacagagggtcacgggtctggtggtgaacgacaaaccgggaatcggccggcaagaggtgaggagattgcgcgccatcctgcaccgtgccgctaaagaggggctcgaacagcagaacagagagggccgtcccaacttcacagcctggctgcacggcaagattgcatacgttagtatggtcaggcctgatctaggggcaaggtttcaagcccagcttcacgccattctgcagggcaaatga

SEQ ID NO: 13735 - RNA, 1938 nt, unidentified
  source 1..1938: mol_type = other RNA; note = synthetic construct
atggctgataaggccacaactgagaagttcgagctgtacgtggtggaccttgttaagtcagggcaaacatttactgcatcagatgtggtcatcggagcccgagcccggggaattgacgttaggcacaacgagagcagagacattattcacgatttgcatcgaagaggggttcttggtcccgcttacagccgtaccaccgtgccccttactgactcaacccgtcccttcgtgtaccacccaacaaacatcaacccgagcgagtaccgaagcagcttcactgacgtctctagctccctgagatccgggcataggtcccagcctaagagaggcttcttagggcggctgatccagtccctgtttggcggaggcgatgatgagtccaagagtggtcgaaaacagcgctctggtgatcagcctgcaccagcggacctgtcatcaaacccgtccgtgccacctaagagcagtcgtaggatgccacagcggcgcaagaatgtaacccttgaccttgatgccaagagctttcttcccatagatagagatgaactgctgtcttctgctaagaaggtcaacctgtgggcttccccatggtttggcagacgggacctcattcctcctctggatgatccccgcacaaatctcattgatcgggggatggtcgcagaaggactcttaacctcagacgagttgagacgcattcacgaagtgggcgcggagatggacttctatcgccccgatgatctcctgctgaggcatcaagcccaacgcagcgccagtggagccatagaggctcagagacaggccagtgcagaacgaaaggccctgaaaaaggcggaagcagccgaacgtcggcaacagagagagaaggagattcagtatagacgggcaaatcagatcgattatctaggcaggcgggtcagtactcagctgcacctgtgccaatctgatgccgacaaactccaagctgtgaatctgccagtcttacatacgaccaaagacctcgcagacgccatgggcatcgaaattagtaggctcaggtggctggcctttcacgaagatgtagcaagccgcatacactacgtgtccttctctatacctaaacggtcggggggcaccaggacattatctgcccccttgcctagactcgcagccgcacagaggtggatttacgcgcagatcctacgagacttgccggtaggcgattgtgtccatggctttgttccagggaggggtatcgtctcaggtgcccagccgcatatcggtcaagaggttttgctcaacatggacttggaggacttctttcccactatcggcttcgctagagttcggcatgcttttcactggttggggtattcgcccgctgtgtccactgtgctcgctctactttgcacagaagcaccacgcagggaagtgtcctaccagggtacagcgtaccaggtagccacggggcctagggttcttccacagggcgcctgtacctctcctgccatttctaatctcgtgaccgagcgcttagaccgccgcgtgattgggtttgcgaataagttcggactgacctacacaaggtatgctgacgatatgacgctgagcggcggaactgacttcgccggacagatcggatatgccatcgctaaaatccggcacatagctgaagaggagggcttccgggtcaaaacatccaagacgcgggtactgaggcgaaatgccgcccagcgagtgactagtctggtcgtgaatgacaaagcaggagtggggaggagaaaactaagacaggtgcgtgcaatcctgcacaacgcttcgaaaaccggactgcaggctcagaaccgcgacaaccatcccaactaccgggcgagcctcgagggcatgattgcttatatcgctatgaccagacctgaccaagccgcaacaatgcgcgccaaactggacgccatcgcagattga

SEQ ID NO: 13736 - RNA, 1644 nt, unidentified
  source 1..1644: mol_type = other RNA; note = synthetic construct
atgtcaatggctgataaggccacaaccgaggccgttgaaagattcgtgatcgaactggtgaactgcgatgaggcctttaccgcagccgacgtgacattaggggctcgggccgcaggaatacaggtccactattctgatagcagaaatatcttgcacgacctgcaccgacggggtatccttggaaccagctaccagagatcctccgtgcaactgactgacggcacgaagcccttcgtgtatcacccggtaggtttcacagctaatcattataggagcaaccagtcttcgctgatggcttccgatcacccagatcaggtaagccaacccaagcccgggctactggccaggttaaaacagttcttgttgggcaggggagactctgatcggagcgactccagcaaggatgctaggagtctggccaaccaggctcctgcaactcaggcaaccagagccgcacagagaaagaacgtcactctgaatctaaatgcaccatctctgctccctatctcccgcaaagagcttcttgcgggcgcaaaatccattaatctctggtcatcaccctggtttggacgccgggacgtgatacctcccatcgacgaccccaggacactcctcatcgaccgcgctatgatcaccgccgggctcataactccagaagagctggcacgcattcatgaggtcggcgctcagatggacaggtacagacccgacgagctgctgatgagacatcaggccaatcgagccggccgtgatgccgttgcagaggatagacgcgctaaggccgaacgaaaagccgctaagaaagccgagagcgaagccaagcggcaacggcgacgcgaagaaattgagatcagaagggccactcggatcgatttcttggggcggcgcgtgtccacgaaactccatctgtgcgagagtgatgaagaacgccttaatgcagccggacttcctattctccataccaccacagagctcgcggatgcgatggggattcagctcagccaactgaggtggctggccttccacgacgacgtcgcttcgtcaacgcactacgttgagtttgacatccctaagagagcgggcggcgtgagacgtctatctgccccattacctcgtctggccgaggcgcagcgatggatttactctcaaatcctgcggggaatgccagtggacgattgtgtgcacgggtttgtgccgggtcgtggtacagcaactggagccgctccacatgtggggcaggacgttatcttgaacatggaccttgaagacttctttccttctatcggattcgcacgtattaggcacacgtttgaaaggctgggctactccccagctgtgtcaacagtacttggtctgatttgcaccgaggcacctcgccggaaagtcagttttcagggcgccacctattatgtcgcaaccggtcagcgggtcttgccccaaggagcttgtacaagtccggcactctctaacctagttgcgggcaagctggaccggcgcatcttaggcttcgctaaatgtataggggccacttatacaaggtacgccgatgatctgactctgagtgggggtcaggatttggccaaccgaattggctacaccatagctaggtttgtaattagcgcgagaaccaaggctagtggctga

SEQ ID NO: 13737 - RNA, 1635 nt, unidentified
  source 1..1635: mol_type = other RNA; note = synthetic construct
atggccgaccagtcccccaatcaagcttccaaccaacagcccgccagcccaaatcctaagctgggatggctgggtcggattttccggtccctattcggaggcccaaccagacgccccgacagaagctctgacagtttcgccgccatggcccaacagccaagaccccttcctcccaggcgtagggagaaggttacgctggacctggatgccaaagcattcttacccattgatcgcgacgaactgcttagcgatgcgaagcagataaatttgtgggcgtcaccctggtttggccggagggatctgatacccccagccgacgatccgcgaacctcgttgatcgatcgcggcatggtgacagaaggcctgttgacacctgacgagctgacacgcatccacgaagtaggggcggagatggactattataggccagccgaactgttcctcaggcatcaggctaggcaggcgggtcgtgatgctgtcgagctggatcgccaaacgagggccgagcggaaagcaaggaagcaggccgaggccgaagctaagagaatccggcggagagaacgagttgaaagacgctttgcaactcagatcgactttctcggacgcggcgtgagcacccagttacacttgtgcgagtcagatgtggatcgtctcaaggaggcaggcctccctgtgatccagaccactactgagttagcagacgcaatgggaattgaaattccacggcttagatggctcgcttttcactctcacgtcgccgaacgaagtcactacatatcattccgtattccaaagaaatcaggcggtacaaggactctgtccgcaccgcttcctcgccttgctgctgcacagcggtggatttactctcagatcctccgagagaggcctcatccagagtgtgtgagcgggtttgttccgggccgaagtatcttgaccggagcagcccctcacgtcggatctcagaccgtactgaatctcgatctggaggacttctttccgtcaatcggattcgcccgcatcagacacgccttccagtttatcggttattctccagcggtcgctactgtcctggctctcctgtgcagcgaagctccccgacgtaaagtacggttcaacggtggggagtactacgtggctactggccctagggtgctaccccagggcgcatgtacgtccccagccttatccaacctgattgccgcaaaactcgacagaagaattagcgggctcgcttctaagctgggagccacctatacccggtacgcggacgacctgacccttagtggcgacagagattttgatgataaagcagcattcgctatggcgtgcgtgcgccatattgccgaggatgaagggtttcgcgtcaaactgtccaaaacaagggtgctgagacaaaacgcagctcaacgggtgactgggcttgtggtcaatgacaaggccggagttgggaggaagaagctgcggttgataagagccatcctacacaatgctgagaaaacaggcctaaacgctcagaatcgagatcatcatcccaacttcagagccagcctggaagggacaatcgcctttgtggctatgagtaaccctgagcgcgcagccaagttgaggcggcagctcgacgccgttcctgactga

SEQ ID NO: 13738 - RNA, 1962 nt, unidentified
  source 1..1962: mol_type = other RNA; note = synthetic construct
atggctgattcaaacgcgcagaagattgtcacggacattactcgcaggagagctgccgcgggtgagagcttttcagcttttgacatcaccacggaagctcgcagccagggagcctttattcggcacggagaggcccgcgaccttgtgcaagctctcttccagaacggatctatgggggccgattatcggagaactgtgctcgacctaggcggcggtgctagacccttcgtgtaccataggtttgacgctgatttgacaacatatcgatcgaccgcatctggagcagcacccgtatctcctccagcgaatcgaccaggacaggctacacctccggcggttggtcaggggagcacaagtgggagaagcggcggcctgattcgtagggtttggaacttcctgggcgggggcaccacatctgatgctggtaaccccactacggacgatgccacacactctggttctaagacccccagccctgccaatcctgacaatccaaagaccacggggactatccgcaaagtgcttaacttgacagcatccgcattcctgcctatccagcgcgatgacttaatacgccaggcaagtggactgagcctgtggagtaatatctggttcggtcggagagatatgataccgccagtcaacgaccctcggaccctgctgatagaccggggtatgctgtcagccggcatgctgtctgcagaggagctcgccgagatgcaccgtatcggagatttgtatgcaaagcattccggcgaggtaacaaggattaggtccgaaggggcactagcagggcaagccgctgtcgacgcagacagacaggccagagctgaagccaaagccaagaaaaaagccgaggccgctgagagaaaggctaagaggagggctgaaatcgagcatagacgtgcgaatgacattctcttcttggggaggggcgtatcccaaggccttgccgatcgaacaagtgatttggccaaattagagaagctggagctacccctggcatccaccccagccgaactggctgccgttatgggaactactgtttccaacctcaggtggctagcctttcatgccgatgtggcaactcgcacccattacgtgtcatttgagatcgccaaacgatccggcggagtgcggaaactcagtgctcctcacgtgagactggcagcagcccagcgctggatttacagtagcattctgaggggcgtgaaggtacatgatgccgcccatgggtttgtcccagagagaagcatagtgacctcggcaaagttacacgttggacaggccgtcctcatcaatgcagatctggaaaacttcttcccaagtatccactggacccggattcggaaagtcttccgttgcctcggatactcacccgctgtggccactatcctggctctcatctgcactgaatgtcctcgacgggaagtcgtgtacgacggtcagacctattacgtagcgacaggcccaagaggattgccgcaaggcgcttgtacttcccccgcgctgagcaatctggtggcaatgaggttagataggcgcctgtccggcctggccacaaaatttgacatcaggtacacccgctatgctgacgacattaccctttcaggaggcgacgagcttggccggcgattagggtacgtgatggctcgtttgcgccacattacggccgatgaggggttcgcgatcaacgaaaagaagacccgcgtgcaacgaaggcaccaagcccaggtggttaccgggctgatagtcaatgatcgggtgagcgtcacacggaaagagctgcggagacttcgttctatcctgcaccacgccgctaccgaaggcctcgactctcagaacaaacaccatcaccccaattttagggcgtatatgtccgggatgatcgcctatgttgctgcaactagacccgccctcgcccgagaaatgaagaagcagcttagccaggtgcggtcatga

SEQ ID NO: 13739 - RNA, 1932 nt, unidentified
  source 1..1932: mol_type = other RNA; note = synthetic construct
atggacaacaacgcccggcagatagtaacgactatcactcgccgaagagcggccgctggggaatctttcaccgcctttgatattacaactgaggccaggggccaaggcgccttcgttccacatggggaagcacgggaccttgtccaagcactttttcagggaggcgaaatgggggctgcctaccgtcgcaccgttatcgacttgggtggcggcgctaggcctttcgtttaccaccgctttgacgtggacgcgaggacctatcagacgccttccggatcaagacctatcgtgccaactcccacacctgctgccccggttccaaatgctcctacagccgatacaagttcatctagcccccccacgaatcagggcggactgatccggcgtgtgatgaattttctcggtggatctgctcgaagcgatgttgccgccaacaaccccagtgcatccacatttggcggggctgcagccccaccaagtagaaggaagactctgaatctggatgcatcagctttcctgccgatcaccagggacgaaatgatgagagagtcccggacaagcctgttctggagcggggcttggtttggtcgtcttgatctgatccctccaaccacagaccgacgtactctgctcatcgaccgcgggatgatgtcggcgggcttactgtccgcggaacagctggccgagattcacaggataggggaactgtattccaaatatgcgaaggatctgcaggtgatccaacatgcagggcaggtggctggtcaagccgcggtagacgccgacagaaaggcccgagcggaagcacgccaaaagaaaaaagccgaggcccaggaaaagcgcgagaagcgacgagcggaaatagagcaccgcaaacgtaatgatatcgtctttctaggcagaagagtgtcaggcgggctcgccgacagagagtctgacgtgggtaagctccggagcctcgagcttccggtactctccacgcccgccgagttagcagccgctatggatctcgctattagtgacctgaggtggctggcatatcacgctgatgttgctacacggagtcactatgtatccttcgatatccagaaaaagagtggaggccttaggcggttgtccgcaccccataaacggttgaaagcagcccagtcttggattctcgagaatgtgctgggttctgctgttgtgcatgatgccgcacatgggtttgtgcccggaagatctaccataactggcgccaaggagcacattggacaagccattgtgttgaacgctgacttagagaattttttccccagcatccactggaccagagtgagaaaagtgttccagaccctgggatattcacccgctgtggcaacaattctggcactcgtctgcaccgagtgccctcggagagaggtgcagttcaacggtcaggctatgtacgtggcaacaggacccaggggattgccacaaggcgcttgtaccagtccaatgctcagcaacatggtcgccctgcgtttggatcgccggttagccgggctggcaaacaagttcgaaatgaagtacaccagatacgccgatgacctcacacttagcggcggcgatgaacttggacggcggctaggatacgtgatggctaggctgaggcacattgccgtcgatgaaggtttcgcaatcaatgagtcaaagacccgcgtccagcggagacaccaggcacagagcgtgaccggcctgattgtcaatgaccgagtaagcgtctctcgctccgagctaaggaggttgcgggccatcctgcattcagctaagtcgcagggactggaatcccagaacagggacgatcatcctgactaccgcgggtacctgactggcctactcgcctatgtcgcagccactcgccctgctttagccgcggagatgaaacgagagcttgacagcattaggaactga

SEQ ID NO: 13740 - RNA, 1935 nt, unidentified
  source 1..1935: mol_type = other RNA; note = synthetic construct
atggccgacgcccagacaaacaatgcagtgcagcaggctgtcctggattttgtgcgctctatgactatgtttaccgcctacgacgttaccctggccgttcggaaccagggagttgtggcccggcacggtgaagtgcgagacgtcgtgcattccatgtttcaggacggcatactcggggcagcatggcaacggaccgctgtggatataggcacagatactcgccccctggtctatcaccacttcaatcaggaccctcgcacgtataaaagccctagcacagggtcagccgcaaaacccgcaactaactcgggccagtcaggttccccctctccaggctctgctgccagtggcagtgggaaggggtttttccagcgaattgtcggcgcattcttcggccaaggtagtagccctgtgactccgtctaatcatcccgcgagcggaggtgcgcaagtaccatcccaaccgctgagaaccccaaagcaaaggccccccattaccattgacctggacgcatcagcctatctccccattagccgaagtgatctactctccgaggcaaagaaaacgaacctgtggggatctccatggttcggaaggcgggatctcattcctcccgttgaagacgataggacaaaattgatcgacagggccatgctgacccaaggcttactgacgccggagcagctaacagaaatccaccgggtcggagcggagatggacaagtacagacccgatcagctactcatcaaccaaaaatcccaaaaggctgggcaggctgctgtggatgaggaacgtcagtcaaaggctgctctgaagaagcaaaagaaggaagaggctgccttacgtaagcagttgcatcggcaggctgtagcggacagaaaagccaatgacatcgtttttcttggtaggggcgtgagctccaggctgggagacaggacaagcgatgacaccaaactgcaggccgcagggttgccagtcatgagcacaccatctgatttggccaatgcattgagcatcactgtgccccagcttagatggctggccttccactccgatgtggcgtcacgcacgcactacgtgaacttcaccatccccagaaagtccgggggagtccgcattctctctgccccacatcagaggattgccgccgtgcaacagtggatacttgctgaggttgttagtcggttgcctgtggagggctgcgcccatggattcgttccaaatcgtagtatcctgactaacgctcgacctcacgtaggccagcaggtcgttctgaatatggatcttgagaacttcttccccggaattacctatccacgggtaaggaagatgttccagactatcggttattctggctccgtcgccacaatcctcgcactgctgtgtaccgaatgtccaaggagaactgtaacctggtcaggtgaggtgtttcacgtggcgtgtgggccgagaggactccctcaaggagcttgcacctcacctgcaatatctaatcaggtggtgaagcgccttgatcgccggcttcagggcctagcgcgcaaacacaacctggtgtttacacggtacgccgacgatttaacattttccggggggagtgactttgacactaatgtggcctgggtgatggcatgcgtgagacatatcgccgaagatgagggcttagtggtcaatgaaaaaaagaaccgcgtgctgagacgaaataccgcacagattgtcacagggttggtagtcaacgataaaccttcggtcagcaggaaaaagctgcggcagatacgcgccatcctccatcgagcccagcaggaaggccttgagtcccagaaccgtgacggccaccctaatttcagagcttacctcgacggatacattagctttatcagcatgaccagacctgagatcgccgctaggctgaaagagcagctggctaacgtttcgtga

SEQ ID NO: 13741 - RNA, 1941 nt, unidentified
  source 1..1941: mol_type = other RNA; note = synthetic construct
atgaccgacagtactacccggcaggtagtgtctcagttagtgctcaatcaggtggccgccggggccatgttcactgcttatgacattaccctccaggctagaggccggggaatgcaactgaggcacggtgaaggccgcgacttagtccatgaactgttcaacaccgggagaatgggcacggactacacccgcacagtggtggatcttgggacggatgcaaatcccatggtatatcacaggcgaggggactctccccgtacataccaaagcggatctacaggagcaactgcggccagtgcaccaccaggtgccttacccacacagccttttccaccagccgctgcaccacctgccaacactccgggtctaattggacggctggtgaagggactgtttggaggagggaaagaccagcctatcgtcggcagagttgtcggagacgggggtaacgcggcctcaggtgatgatgtcggcgcattagcattgcggcccccagcgagcctggatcttgatgcctccgactttcttcctatctccagagatgacctaatgtccgctgctaaaaccaccactctctggggcaatccatggtttggtagacgtgacatcatccctcccatcggcgatcctagaactaaactcatagatagggccatggtggctcgaggaatcttgacacccgatcagctggctgagatacataggattggggctgacatggaccattacaggcccacccagattttgattgagagccaagctcattctgcaggcaggtccgcaatcgaggtggatgataagcgtaaggcggaagaaaaggcgaagaagaaggccgaagcgaaagagcggaaggagaaacgacaaagcgacatagctgaacggaaggccaccgacatcgtcttcctgggacggggcgtttcggggcagcttcacctgagagattcggatgcagagaaactggcagcagcagacctcccaattttgtctacaccagccgagctcgcctcagccttgggattaactatatccaagttgcggtggctcgccttccataacgatgtagccacaagaacccactatgtcaggttcgagatcccgaaacgcagtgggggcactcggcagctttcatctccacacaagctgctggctgagaagcagcggtggattctgaaagagatcctgaataaactgcccgtggaagattccgctcacggcttcgtcagggatcgggatattctaacaaatgccatacctcatgtgggcaaggacgtggttctgaatatggacttggagaacttcttccccagcatcgggtttccccgcgttaggcaggtttttaaaggactgggctactcaccggcggtggcaaccattctcgccctcctctgcactgaatctccccgtagagcggtgacgtatgccggccagccttacctggtggccagtggacctcgcggtctacctcagggggcctgtacaagccctgccatttccaatcaggtcgccaaacgacttgaccgcagggtgcaaggcctggccaccaagttcggcgtggcctttacgcgctacgctgacgacatgacagtgagtggcggagcagaaatgactaccaggataggctatatgatggctaagctccgccatatcgctgaggacgaggggtttgtcatcaacaggagcaagacaagagtactccggagaaacactgcacaaatcgtcacgggtcttgtagtgaatgacaagccgacagtgagccgcacccagctgcgaagaattcgagccatcctgcatcacgctcaccacgatgggctgtccgctcagaaccgtgaacagcacgctaactttcgagcctggatgcagggtatgattgccttcgttgctatgacccgccccgagctggcaaaagatttcctggcacagcttcaatcagttcgcgactga

SEQ ID NO: 13742 - RNA, 1569 nt, unidentified
  source 1..1569: mol_type = other RNA; note = synthetic construct
atggccaacgggatgttgcagcaattgatagcacggatgggaagaatcttcggcagcattttttgctcatacaagaggagtccaggcactcagtcgagggccacgactgcacctgcacaagggcaggcggttaggcctgcgtcaaggccagaggctccacctttacctcccagggccaataagaccctcgatctcgcagctagccaatttctcccgataagccggagcgagttgctcgtggccgctaaaggtactcgactgtggggtaatgtgtggttcggaaggcgcgacttaatccccccagctgatgatgccaggacactgttggttgatagaggcatggtgaccgaggggctgattacccctgaagaactggccgagattcacagggttggcgccgagatggatctacatcggcctgcgcaggctgccatacagcatcagactcagaaggccggccaggctgccatcgacgaattgcgagctgaaaaggcccgcatcaaagctgaaaagaaggtcgaatctgcggcaaggaaagcagcacgccagagtgccattgatcagcgcagagctaacgacattgtgttcctcggcagaagagtttctggtaaactgggccaccgggaatccgaccctcaacgtctgcaacagcttaatctccccgtgcttcagacaccagcagacgtggccgtcgctctgcagatctccatcagccagctacggtggctggcctttcacgccgaagtggccgagagaactcattacgtctacttcgatgtcccgaagaaaacaggggggtttcgccggctttcctcaccgcacgccaagctcgccgctgtacaaagatggatcttagagcaagtccttaataaactgcctacacagccagcagcccacggattcatagcgggccggaacattttgtccaacgcaatgccccacgtgaaccagagcgtcctgatcaacatggatctcgagaatttttttcccaatatcacattcccccgtgtacgtgagatgttcgccagacttggctactccggggcagtgtctacagtgctggccctgctgtgtaccgaatgcccacggagagctgtgatctttcatggtgctacgtaccaggttgctaccggaccaaggggactgccccagggagcatgtactagtcctgctatctcaaaccaagtggctgtgaaactggacagacgactacagggactcgccagtaagatggagctgaattatacgcgatatgccgacgacctgaccctctctggaggggacgccttacgcgagagagtgggctatgtaatggctcgagtccgccactttgcggaggaagagggtttcagggtaaacaaccagaaatctcgcgtccagaggcggaattccgcacagattgtgaccggcctggtggtcaacgaacgtcccaccgttagccgagagaagattcgccgcattcgggcaatccttcaccgtgcccaaacagagggtctggaggcacagaatcggcagaaccatccctatttcagagcgtggctggaagggtacattgccttcatcgcttga

SEQ ID NO: 13743 - RNA, 1545 nt, unidentified
  source 1..1545: mol_type = other RNA; note = synthetic construct
atggatgtggtgagtctccccgaccatcgcccagggagatcaccggtgagttcagtcgacaccagtaaaagccgtcgcagtgctccccctgccccattcagcttccttcccaagattaagagcgagcggaattttcttgacctgcgcggggccgccgatctttgggatagaggatgtgtcgttgggttctggggtcgattactgcggctgatattgggtcagaatgcagggagcggcttgaccgagcagctccaggcatcaggcactgctaagtcccggaacagatctagcgttttctttcccgcccaatccctgcaggctcctcagctgctcccaccagcttctgtcgccgagacagttgtaggtcccgttggcgcagaagggtcgcgcattaggagcaccctttccgtcgtggctcgcagggaggcacagcaacgtgccagagacaacgaacgacgtcgattacgtgaaattcgacggaccgatcggctgagtcgggacatcacatacctggggcgcggagtctccggatggctgaatgaacggattagcgatgtggcgcgcctccaatctgcgggtttgcctgtgctctccggacctgcggatgtggccaaagcactggggatatcgctgcagagcctgcgtggtctggcctttcacgccgaagtgacaagactgacgaactatctccgatttactgtgcccaaacggtccgggggccagagagagctgtctgtccctcataggcgactcgccgctgcccaacgatggattttgaggactatcctggaccgactcatcgtctctgagcaggcccacggcttcgtgtccggaagaggagtgctgacaaatgcccaacagcattgcggccaggcggtgctactgaacctggacgtgcagaacttcttcccatctatcagtttcgcaagggtgcggagggtttttatggctgctggatactcaaagtgcgtggccactatcttggctctcgtgtgcacggaatgtccccgcagggaggtggtatttgagggtagaagactctgggttgccacaggcatcaggggcctaccacagggtgcctgtacttcccccgccctgagcaatctcgtgtgtttaaggcttgatcggaggctacagggattggctatgaagttgggccttgtatactcccggtatgcagatgacttaaccttttctgggggcgcagatcttagacagagagcaggcgccgtgctgaagtcagtaggcgcgatccttggaagcgagggcctgcaggtacacccgtggaaaacacgcgtccagcctcgctctaccgcacaagtcgtaaccggactggttgtcaacgaccgtcctggcgtgtgcagaagagaggtgaggagggttagagcaatactgcacagggccgctaccgagggactagagcgccaaaatcgggacggccacccaaatttcgtcgcttggttgaacgggaggattgggtggatcggacagtcacgccctgaattaggccggaaactgatggaagaactgagggggctccggtga

SEQ ID NO: 13744 - RNA, 1407 nt, unidentified
  source 1..1407: mol_type = other RNA; note = synthetic construct
atggccaccggattttgggggaggatcctgcgcgcgctgttaaaaagcgatgattctgaccagagtgcctctgcagccagcccaaacgtgacagccgccgactcagtggtaggtgaatccaccgttgcggctgccgcgggtttaaccaggcgagcattcgaagccccccacctgctccctgtcggcaagcaaagcgagtccgcagggagtggccgccaaacacagagcgacgatgcaagtggcagcagttcaggccgtacctccctggcagttgccgccagacgtgaagctaggcggagggctcgcgaaaacgaaaggttgcggcttcaagccattcgccggaccgaccgactgaaccgcgatataacctatctcggacagggggtgagcgggtggctaaatgagcgggtcagcgatgaagagaggctgcgacagtctggcctaccagtgctggccacaccggcagacgtagccagagctcttggaatttccttgcgctccttgcggggccttgcttttcatgctgaggtgactaggctgaataattacgtgcgcttcactatccccaagcgctctggcggcgttagagttctgcaggcaccacagcgacggctcgctgcagtacagcagtggatcctgagggaaatactggaccgtctgcccgtgtctgctcaggcacagggcttcgtacggggcagatcagtggtgacgaatgctgctctgcattgcggacaggccgtggtccttaacttagatgtgcaggagttctttccatccatccctttcgcgcgggtccgaagagtgttcatctcggctggctatagcaagtgcgtcgctacaatactggccctcgtctgcacagagtgtccccggcaagaacttacgtttgagggaagaagactctgggtggctagcggaccgaggggtcttcctcagggtgcctgtacctcaccagccctctccaatctcgtgtgcctgaggttagaccgtagactccaggggctctctgcaaggctggggctggtctactcccggtacgcagacgacctgacttttagtggaccagccgagctaagacagcgggtgggtgccgtgcttaaatcagtaacagggatcttgcaggcggagggcctgcaagttcaccctgggaaaacccgagtgcagcctcggtctactgcccaactggttactggcctagtcgtgaacgatagacccggagtcagacgcgatgaggttcggagaattagagctattttgcatagggccgcgagggagggtttgcaagcccagaaccgcgagggacaccccaacttccgcgcatggctctgtgggcgtattggctggatcggacagtcgcgacctgaactggggcagcagtttttgcagcaactgaatgccctccagtga

SEQ ID NO: 13745 - RNA, 1620 nt, unidentified
  source 1..1620: mol_type = other RNA; note = synthetic construct
atgagtactcaggattccagggggttctttggctggctgcgccgtcttttatttggggacccgattcccgcccccaaacaggctgctgcctctgctgctacatctacacacgggacagccaagccggtgacaacggcccagaacccagcgcaacagcagaacgcaccttctctcaaggctggactggatgcgagttcttttttgccaattacgagagatgagatcatttcctccacccgtaccagatggctatggtccggggcattctggggcaggagggacttgatacctccagtttcagacactagaaccaagctgatagatcgcggcatgctgactcagggcatgctaaccgccgaacagctggctgaaatccatcgtgtaggcctggaaatggatgccgtgcgaccaagcatgaccctcatccggtcagaagcagaaaaagccggagccgaagcagtggttgcctctcgcgaggaacgcaagaagataaaagctcaaaaaaaggaggaggctgccagaagaaaagagcagcgtgcaagggatattgcggctcgattcgccactgacattacctacctcggacgaagagtctccggccggctcaatgaccggacatcagatgtggccaagcttgaggccgccgctctacccgtcctccaaacaccagctgatgtcgctggggcgttaggcctgacaatcccccagttgcgtgggctggcatttcacagcgaagtaactagcagatcgcactatatccagtttagtatccctaaaaagagtggcggtgtcaggttgctgtccgcccctcacagaaggctggccaactgccagagatggatccatacccagatcctttcaaagctggaggttgctgcacaagctcatggattcgtagtggcccggtcaaccgtaactaatgccactcctcattgtgggaaggcagtggtcttcaatacagatctggaaggcttctttccttccatcacgttcccccgagtgaggaaggtgttccaaaggctcgggtatagccccgcggtggcaaccattcttgctctcctgtgcacagaatgtccacggcggaccgtggaatttggtggccagacactgtttgtggcaactggtccccgagcattaccgcagggtgcatgcaccagccccgccttatcgaatcaggccgcgctccgcctggacagaaggtttcaaggactcgctacaaggatggggttgacgtacactcgctacgccgacgacattaccttctctggaaatgaggagctgaagagccggaccggctatctgatggcgcggatccggcatgtggtccaggacgagggattcagggtcaacgaggccaaaaccagagttcagcggcagagcacagcccagagtgtgaccggtctgatcgttaacgagaggcctggcgtgttgagaagcaaagtgcgacgccttcgcgcaattcttcaccaagccaaatcttccggactggaggctcagaaccgcgacaagcaccctaatttccgggcttgggtcgagggaatgattgcctatatagcaatgagcaggccagacactgcagaggttcttcgccagcagtacgcccaaatcagagagacgtga

SEQ ID NO: 13746 - RNA, 1614 nt, unidentified
  source 1..1614: mol_type = other RNA; note = synthetic construct
atgctttttggaggttcaccccgaccgaggcctgctgcaaggactccagccagacctgcccctggaagggcagcatctcccggtggtagtcaaccgacagtgcagcccacagtgagtagcgcctccccacctaggcctagcggtcttggcaagcgactgcaagctcctgacttaaccccgctcgccgggtccgagttaaagcggtccctcagacagagaggtcagtcatcgtggtccatatttggaggggcctcctggtggggaaggagggatctggtgccacctagcactgatgaacgcaccaacctgatcgaccgagggatgatcggtcggggactcacctctgccgacgaggtagccgaactgcacagggtgggcgacgagatgctgcagagggaccccagaagagatggaggtgctgccgccggcgaaatagctgtgcaaaaagaccgggccgagagagcgcagcagaaacagcagaagagagaagctgctgcacagcggcgtgccgaacgagcagctgcagtagccgcgcgtagagctaatgatatcatttttttaggacgcggggtgtccaaagggcttgcggacaggacaggcgacgcgactagactcgtgggagcaggcctcccagttctggctactcccgcagatgttgccaccgctctggagctgcctattccaagactgcggtggctggcattccacgccgatgctaccgctcagccccattacgttcgcttctctgttcctaagcgctcaggcgggacacgcgacttagcagcgcctatgccccggctcaaggctacccaggactggatccttgctaacctactggccaaagtgcctacccacgccgcggctcatggatttgtcccaggccggtccacagtcagtaacgccgtgccccacctgcaagcactggcagtcattaattgcgacttgaaagatttcttccccaccatccatgtgcatagggtccgcgggtgctttgaggagttggggtatagcccggctgccgccactatccttgcactgctctgcactgaagccccacgacgcctggtggagtacgcaggaagacccttgcacgtcgccacaggcttgcgctgtcttcctcaaggggctccaacgtctcccgcgttgagcaacctaattgcccggaggctggatgcacgttgtctcggcatcgcccgtaagttggggttcacgtatagccggtacgccgacgatctcagcttttctacccatgaaccggcggccctcgctcgaatcggctatctacttgctcggattcgccacatagccagagatgaaggcttcgccgtgaatgagaaaaagacgagggtgttgcgaccctcaagttctcagagagtcaccgggatcgtggttaatggagccgagccccggattccacgcgctactgtaagacggctgcgcgcgattctgcaccaagccgaaaagacaggcctggaggctcagaaccgtgatggccacccagacttcgccaattacctcgcaggcatgctggcttgggtaaggatggtcagtccacagcaggctgagccactgctagccgcttggcgtcgcgttaggcggtcagcagcagattga

SEQ ID NO: 13747 - RNA, 1611 nt, unidentified
  source 1..1611: mol_type = other RNA; note = synthetic construct
atgcaactcctctttggagctcccccacgacctaggccagctgcaagacctccagcacgaccagcccctgctgctcctaacgctgccgctcctacttcagcaagaccagaaccccgacctgctccgcccagacctgctgatgtgggccacaggctggaggcacccaacctcacacctctggccgcctccgagctgaaaaggtccctgcggcagcggggacagagttcttgggccatcttcggcggggcatcttggtggggacgtagggatctggttccgccatctacagacgagagaaccaacctgattgatcggggaatggtcgggcgggggttgactactgtcgacgagctggccgccatgcaccgtgtaggcgatgaaatgctgcggttggaccccagacgagatggaggtgccgcagcaggggaagcagccgtacaggctgacagagccgaacgcgcccgtgtcaaacagcagaagaaggaagaggctgcccgaaggagagcagaacgtgcagcagctgtagctgcccggagagcgaatgacatcgggtttctcggccggggagtgtccaagggtcttgccgacagaagcgctgatgccgctaggcttggcggagctggcctacctgtattggctaccccggctgacgtcgcagccgctttgcaactgccaatccctcagctgcgctggttagcattccacgcagaggccaccgagcggccacattatgtgcgctttaccgtgcccaagagatcaggtgggacacgggaccttgccgctccgatgcctagactacgcgcgacccaagactggattcttgccaatgttcttgccaaagtgcccacccatgccgcggcccatggctttgttcccggaaggagcactgtgtctaatgccgcaccccacttgaggccactagcggtggtgaactgtgaccttcaggacttcttcccgactatacacgttcaccgcgtgcgcgggtgtctggaagagctaggctactcatccgcggcggcaacgatcctggctctcctgtgtaccgaagctccccgccgcctcgtcgagtatgcaggacgacccttacacgttgccaccggcccacgttgcttaccacaaggcgctcctacgagccccgccttgagcaatctcatcgctcgaaggcttgacgccaggtgcctgggcattgcccgtaagctgggcttcacgtacacacggtacgccgacgatctgacttttagtaccacagatcctgaggccctggccaggattgggtatctgctggcgagaataaggcatatcgcccaggatgaagggtttgctctcaacgagaaaaaaacacgcgtgttacggcccagttgcagccagcgggttaccggtattgtcgtgaatggcgaccagcctcgcatacccagggcaacagtccgcagactgcgcgcaatcttgcatcaggcggagaagactgggctcgaggcccagaaccgggatggtcacccagatttcgcaaaccatgtggcgggtatgctcgcctgggtgagaatggtgtcgccccaacaggccgaaccattagtggcagcgtggcggagggcccgaaggaatgatgccggatga

SEQ ID NO: 13748 - RNA, 1731 nt, unidentified
  source 1..1731: mol_type = other RNA; note = synthetic construct
atgcctttggcagtgggtggagtcggaatggggtggtttgattggctgaagccacggaaaacgcctgacgagggtcctccagctcctagccctggcctgacgcatggcgacctgtctgggctggtcgcacaacctggacctccgaccccaggaactgtccccacggatccacgggtggtgactacccgcgtcccaaccacacaggagccagcgacacctaccgtagcctccgctggaacacccgcatctgcatcacgggccgctaggcgaagtccctcatctcctccaccagagtcgctggactacgacctggggccatttgctccgatttcacagtccgacctgagagcccaggccggcaaactcactaatgcttggcgcaccctgtatctgttcggacgaacatcgcgaattccgcccgcaaatgatcccaggaccaacttaatcgacagggccatggtgagcggtggcctcctgacacctgaggaactggcagagattcacgccgtgggcgaagcctatgatcgcgcaagacccgatttacaggtggagctcgccaaggctgaactctccgccgtactacccgaacaggagagagccgaacggaaagcccgcaaaagggcggaagcagcagaaaggaaaagactgcgcgcagaagctgttgccgagagaagggcaaccgacgtggtgtttctgggtcggggcgttagcacccaactccacgaccgcacttcagatgccgaggccttggcgaagctaggactccccgtcctctcaacccccgcagatgtagctgctgccctgtccgttacaataccccagttacgatggctcgccttccacagcgaggcttccactgtgtctcactacgtgagatttgaagtccccaagaggagcggagggactcgccagcttgctgcaccacaaccgcacctggctgctgcccaagcctgggttttggctaatgtactgtcccgggtgccaccccatgatgccgcacatggattcgtgcctgggcgaagtactgtcactaacgccgcccctcatgttggcagggcagtggtggtcggcgctgatctgaccgatttctttcccacagtcacttttgcccgcgttaggggcgtgttccgccagttgggttacagtcccgccgtggcgacagtgcttgcgttgctatgtactgagagtcctcgacgcaccgtgacctatgctaacagaccatttcacgtggcgacaggtcctagggctttaccacaaggggcgtgcacgagtcccgccctttctaacctagccgcgcggagactggacagccgtctttccggtatcgggaggaagcttggcttcgcttacacaaggtacgcagatgacctgaccttcagcggcggggccgaacaactggctaaggtgggatatctccttgcccggttgcggcacatcgcccaagacgaggggttcgcggtcaatgagaaaaagacaagagtgctgcgtcagagcgcatctcagcaggttaccggggtggtcgttaatcagcggccaggcgttcctcgcgatgtagtgcgtagactccgggctatcctccatagagcacagttcgaggggcttcccgcccagaatcgtgaaaaccatccccactttgaggcctgggtacgtggcatggtcgcttacgtccagatggtgaacccagaccaggccagacctttgcgggaggccttagacgctctgccgggctaa

SEQ ID NO: 13749 - RNA, 1797 nt, unidentified
  source 1..1797: mol_type = other RNA; note = synthetic construct
atgggcctgctgaattggattaagaagctagtgtctggaaagtcaccaggaaggccttccgggggccagagtgcaagcgacttagccagagaattcggacagaccattgaccctggtcttctggccggtcaggggtcacaaccccccgttaatcaaccacctaccgtgccccctcaacgccccactgtggtgaaagtgccggcaaactggatcagcacaggacaggctccttcctccgccactaacacacctaatagtgccgccgcctccaccatcccatacgcttcactggccttgagggctgctgttccacctgctcctgcaaatagactatcgccaagccccgctgagagtttcgattatgatctcgggccttttgcccccatctccgctgatgatctgcgcaccggagcagacagactgaaaaacaattggaacaatctgtggttgttcggccggtcaaaccggataccccctgctgatgacccccgtaccaaactcatagacagagccatgattaccgaggggcttctgacgcctcaggagctcgcagaaatccacgctgtgggccaggcatatgacgcagcccgcccagatctgcaggttgagctcgccaaggcgcaggtcgcagttactctcccagagcaggagagggccgaacgaaaagctagaaaacaagccgaagccgccgaaaggaagcgcaagcacgcagaggcggttgccctacgcaaacaggcggacatcatttttttgggccggggtgtgtccaatcagcttcacgatcgggtcagtgatgtggccaagctgaccgccattggacttccggccctgtctacccctgccgacgttgcagccgctatggacctcccagtctcgaggctgaggtggctggcgtatcacagcgatgcagccaccgtgtctcattatgtaaggtttactgtgccaaagcgctctggcggcacccgacaattagctgcgccgcacgattctctggcggaaacccagcagtggatcctggctaacgtcttatccagggtgccaacacacgacgcggcccatggtttcgtccctggaaggagcactgtaacgaacgccatgcctcatgtggggaaacccctcgtcatcaactgtgacctgagagactttttccccactatctccttcggacgggttcggggcatttttaagcagctcgggtacagcccagccgtagcaacgattttcgctctgctttgcactgaaagcccccgccaggaagtggtgtacgctggaaagacatttcacgttgctacaggcccccgagcgttgccacaaggtgcgtgtacatctcccgctgtcagtaacttggcatcaagacgccttgacagccgattggctggaatctgccgaaaactagggtttacatacaccagatatgctgacgacctgacattctctggcgacgctgcactcaacgataaggtcggctacctgttggctcgggtgaggcacatcgcagacgatgagggctttgcagtgaacgagaagaaaactcgggtgcagaggccgcacgtagcccagaaggtcacggggattgtggtgaacgatcgggccggggtcccgagagatgtagtgcgtcgtctgcgggccatacttcataaggccggtaaagagggcctggccgcccaaaatcgcgagaatattccccatttcgaggcatggttacgtggcatgatagcctacgttcatatggtcaatcccaaacaggcaaagccactcgccgaagcaatggggagaatcgctccaacaacaacttga

SEQ ID NO: 13750 - RNA, 1557 nt, unidentified
  source 1..1557: mol_type = other RNA; note = synthetic construct
atgggattctttgactggctgatagagctgctcgtgggtggcccctcaaccgatcgcttttcgtctccccaacctcccccaaggaggcctccaggagccagacagtctagaagactggatctcgatatcgaacagttcacccctctgtctgactcagaagtcaagaagcaagcccggactctgggtcgggcttggagcaatccctggttcggacgcagggacttgatcccaccccccgaagacccgcgtactctgctgattgatagagcgatggtggggcatggcttgctcacaccggaggagctggtccgcatccacgaaattgggctggaaatggacaaagtacgtcctgatctggccatggctaaagtggaggctcaggcagccgttgccaggaccgttgaagaacggcgcgcgcgaaagctcgctagacagcaggaatccgcgcggctcaaaaaacttggtgcagaggctgtagcccagcgccgtgctaccgacattgtctacctcggccctggagtcagtaggggtctggcagaccgaagaagtaacgtggaaaagcttgccgctgcctcacttcctgtgttagcaagccctgccgacgtagcacaagcactgggcctggcagtccccagattgaggtggctcgccttccatagcgacgctgcgagcaggctgcattatgttcgctttactgtaccgaagaagagcggagggacccgcgagttgtcctctccacaccgtgccttagctgcggcacagcgctgggtccttacttccgtgctcgacaaggtgccaactctgcctgccgcccacgggttcgttaagggacgctccacagtgacaaatgcttccgtccatgttaaccgagccgtagtagtgaacctggatctggtggattttttccccagcatcacctttccacgggtcaggggcgtcttccaaagactgggttattcccccgccgctgccacagtgcttgccttactcgcaaccgaggcccctagacgaaccgtcgcttatgccgggaaaacatttcatgtcgctacggggccacgggctcttccacaaggagcctgcacgagtcctgccttgagcaatctggtggctcggggcctagacgcaaggctctctggcattgcggctaaactggggtttgcatacactcggtacgccgatgacctcacatttagtggcccagatgaggtgcagaatctagtggggtacttgatggcccgtgtgaggcacatagccggcgatgaaggcttcgctgtgaatgaggcgaaaactagggtgcagcggagaaacaccgcccagcaggtgacagggattgtggtgaaccaaaggccgaacgtgccacgaacggaggtgagacgcctgagagcaatcttgcaccgagctgcaaccgagggactagccgctcagaatcggcagaaccacccccggttcgcagagtgggttcagggaatggttgcatatatctcaatggttaatcccgctcagggcaagcctttggcagaggcccttgcccggttagatgctaagaaaggcccctga

SEQ ID NO: 13751 - RNA, 1557 nt, unidentified
  source 1..1557: mol_type = other RNA; note = synthetic construct
atgggctttttcgattttctcagacgcctctttggcggaggggaagctggagatccaccaccccctctggcgtttcctgcaaaggctttaccacctaaaccagccccaccactgccccccaagaaaagagccccgcctacctcctatgaggcagactttctgccgattagtgacaaggagctgcacgccaaggcagcgacagaggaagtcagaacttctccctggtggggtcggactgatactattcctccggccgacgatgcgaggactaaactcattgacagggccctggtcaccagggggtatttgacccccgagcagctggaggagatccatcaggtaggtgatcttatgctgctgaaaaaaggagacgaagctatggtccggcaggaggcaaagagagccgttgaacggcggaaggaggagcgagctgctagaaaggctgagatgaagagattagcagaggaacgacgacgcgcccatgccgctgaagtcgctagtaggagagcgacagacatcctgtttctgggacgggacgtttctggcggactggctgaccgccgctcagatgtggagaaactcagaaccgcagggttgcctatcctagcgtcacccgcagaagtggccgcagcgatgggtctgactattcctcaactccggggaatggccttccacattgatgccgccaccgtgacacactacgtgactttccgtatccctaagaagtccggcggcatgcgcgatatcagcgctcccaaacctcgactggcaaccgcacagcgatggctgctagagaacgtgctctcaaaaatcccagtcgaacccccagcacatggattcctgaccggccgctctacagttaccaacgcagcccctcatgtgagacgagccgtggtggtcaacatggacctcaaggacttcttcccatctataactttcccccgtgtgcggggcatattcgagaaaatgggttacagtccggccgcaagcaccatttttgccctccttacaacggaagcacccaggcgggtggccgaatatgagggcaagagatactatgttgccattggccccaggggtttgccacaaggggcttgcagctccccagctctttccaatttggctgccggccgtcttgacagacgcttaggcggtctggccgcgaaactcgggtggacatacacaagatacgccgatgatttaaccttctcgggagacacgataatccccaaagggacgaaagatccgaagagcgtcgcctggttgctagctaggacacggcacatcatctccgaggaaagttttgaggtgaacgaaaagaagttgcgcgtacagcggcggaataccgcccaggtggtcactggcatagtggtaaatgacaagcccgctgttcctcgtgccgaaaggaggcgactgcgcgctgctcttcacagggccaggttcgtggggcttaaggagcctgcaagggttcgcggggaggtagcttacgtgagcatggtgaatgccgaacacggagggcggcttaaggtccgtctcgacgccctgctgaaacgctga

SEQ ID NO: 13752 - RNA, 1497 nt, unidentified
  source 1..1497: mol_type = other RNA; note = synthetic construct
atggggttctttgactggctgcgaaatctacttttcggcggcatgccgcaaaagaaggcagtgatcgtgcggccagcccagccagtattccccctcagacccgcgccagcaagactacctgccgcagcaccaaaggctccaccccctgctcctcgtccaactgccgactatgcagccgaggatttcgcacctatctcagataaggagttgcggcagaagagcaagtcgagtgaagtagccaccagcccttggtgggggaggaccgatacgattccgcccggagatgacgcgcgcactaagctcattgatcgggccctggtgacccggggatatttaacccccgagcagcttgcggaaatccaccgcgtcggagacttgatgctccttaaaaaaggcgacgaggccattctgagggttcaggctcaagccgccgtagcgcgaagtaaggaagagcgtgccgctctgaaggccgaaaagaagaggcaggcagaggagcgcaaaaaagcacatgccgaggcagtagcacgacgcaaggccgctgacataatctttctcgggagaggagtctctgggggtttggccggccggacatctgacgaggggaaactacgcaagtttggattgccaagtctggcgacccctgatcaggtagccgcagcactgtctatcccgattctgaggctccgctggctggccttccactccgaagcttcaacagtgagccactacgtgcgctttcagattcccaaaaaaagtggcggcctccgtgatatctgggctccccagccaaaactggctgccgcacaggcttggatcctcgagaatatcttatctaaagtccccgccggccctgttgctcacggttttgtgccgggaaggtcaactgtcaccaacgcggctcctcatgtgaagcgcactattgtcgtgaacgtggacctgcgggattttttccccacaataacattccccagagtcagaggtctgtttgagtccctggggtatagccctgcggtggcaacagtttttgccctcctgtgcactgaagccccccgaagggaagtggaatactccgggagaaagtacttcgtcgccacaggaccaagagcccttccccaaggtgcttgtactagccctgcactgtcaaatctggctgcctggaccttagacaggcgactcggaggcgttgctgccaaattaggctggacgtacactagatatgctgacgatctgacattcagcggagacacccttgtgccaaagggcgagaagaaccctaaatccgttgggtggctgttggcaaggacgcggcatctgtgcgaggccgaaggttttgaagtgaatgagaagaaagtgcgcgtgcaaagacggaatgccgctcagacagttaccggcatagtcgtgaacgagaaaccatccacctctagggctgagcgtaggaaattgcgggctattcttcaccatgccagattcgaaggcatcgaaaagcagaaccggtga

SEQ ID NO: 13753 - RNA, 1611 nt, unidentified
  source 1..1611: mol_type = other RNA; note = synthetic construct
atgctgctccgcctgctgcggtttttctttggtcttgtacggcccaaatctagtgctgagaggggtacccaccctggcgctctaccctctagcctgaccggtcgggacttaacccctcctcgcacggttcaatctgccactgcatcaaatcccgaaaccgggtcaagtagcccaggcccgtctgggttgaatgggttggacacagataagttcgcccctagcactgttgaggaggcatggaccgccacaggcagagcagattggcgctcagtattcttggatagccgcggggctattccccctagtgaggtgccaagggtccagaggattgataggaccatggtcggtatggggctcatctcagagagtgagcttgctgaaattcatgacattggcgaccgaatgagccaataccaaagtgacgcagcatttgtggccagcagcggcgaaagtgctgttgcgcagtcacgggaggagagaaggcgacagcgcgaagagaaacaagctgccgccgaagcaagaagaaaacagaggcgggagcaaatcgctcagaggcgggccaatgacatcgtctttctgggtcgaggcgtgtcccgtggattagccgaccgacgctccaacattgaacagcttcaggaacagtgcctgcccgtgctgtcttctccagcggatctggcacagtccatgggcatgtctattagcctgctgcggtggcttacctttcattccgatgcaccaactagggtccactacgtgtcctttgatgttccaaaaaagtcgggaggcatgagacggctatcggcgcctcacagaaagctggccgaagctcaacactgggtgttgactaacatactgaatctcctccccgtccatgcctgtgcccatggcttcgtcgctcgtcactcagttgtcacgaatgctgaactgcatgttggcgcttctgtggtgatcaacgccgaccttagcaacttcttcccagccattacattcgctcgggtggatggaatgttccagaaactgggttatagtccggccatcgcgacaatactcgcactcctgtgcactgagtgcccccgtcagccattacagttcggcgagacaatgtattacgccgcaaccggacctaggtccttgccgcagggagcctgtacatcccccgccatttctaaccagatcgcagggaagctcgaccgcagaatgtccctgctggccgaaaagctcgggtggcgctataccagatacgccgacgatttaacttggtccgtatgtggcgaggcgatcccatcaataggatatgtcctagccaggatacgtcacatcgtggaggacgaaggctttgagctcaatcatgctaagacaagagtgcagaggcgaagccagcagcagtccgtgacaggagtcgtggtgaacgatcgcatgaacgtgcctagacccacgatcagacgcatcagggcaattctgcataacgccaagcggactggactcgatgcccagaatcgaaatagccacccccactttagagactggctgaccgggatgatcgggtgggtgcacatggtaaaccctgagcaaggacgtcggcttatgagcgctttggcggaactgtcctga

SEQ ID NO: 13754 - RNA, 1611 nt, unidentified
  source 1..1611: mol_type = other RNA; note = synthetic construct
atgctgatcaggctgctgaggttcctctttggctggagtaagcctgccgctcccgctgaagttgcatctccacgcgagccagctccctcctccttgaccggacgtgatctgtcccaaccagcaagcgtgcagagtgcaaccgtccctaaggcagatagcagggctgccgcccctcctagatctaacctgtctggcctcgacactgacaaattcgcacccattaccgtggacgaggcactagccgcgaccgctaaggcggactggaagagcgcgtattttgatagccgcggggtgatccctcacccatcccttccccgcgtacaagtcatcgaccggacaatggttggaatgggcctaatatcagaacaggagctggccgagatccacgacattggggatcgtatgggtcagtttagatccgacgccgagttcattgccattgcgggtgaacgagccgtcgtggaatcgagagaagagagacagcggcgcaaggagttgcggaaagcggaagccgaggcacgacgcaatttaagacgggaacaggtggttcagaggcgcgccacagacatcgtcttcctgggtaggggtgtttcaaggggattagcagatcgtagatcaaacgtggaactgctgcagaataacggactgcccgtgctttcaagtccagcggagctggcccaagctatgggagtgagtatcagcttgctccggtggcttgccttccattctgacgccccaacgagggtccattatgtgtcttttgatgtgcccaaaaaatccggcgggatccgaagactttctgctcctcatcgcaagctctccgtggcccaccattggatcctcaccaacattctgaatctgttgcctgtacacacgtgtgcacacgggtttgtggcccagcactcagtgttgactaatgctgagcctcatgtcgcagctagcgtagtaatcaatgcggacctgagcaacttctttccaactataacattcagtcgggtggatgggatgtttcgcaaactgggatattcgcccgctgtggcaaccattctggccctcctgtgcaccgagtgtccccgacaggcccttaagttctccgatactatctattacgccgctacagggccacgtgctttgccccaaggcgcttgcacctctcccgccataagtaaccaaatcgcagccaagttggatagacggatgagcgccatggcatctaaactcgactggaaatacactagatacgctgatgatctcacatggtcaaccacgggggaggttacaccgagcgtcggctacgtgctagcacgcatgcggcatattgtgaatgatgaaggctttgagcttaatcacgctaagacacgggtccagaggcgaagtcagcagcagtcagtgactggtgtagttgtcaacgacagaatgagcgtccctagacagactatccgccaggtgcgggccatactgcacaacgccaaaaggaccggattagacggccagaaccgagacgctcagccgcacttcagggactggcttacaggcatgattgggtggattcaaatggttaatccggaacagggcaggaagttacggtccgagctggccgagctctcctga

SEQ ID NO: 13755 - RNA, 1608 nt, unidentified
  source 1..1608: mol_type = other RNA; note = synthetic construct
atgctcctgagactgctgcgttttcttttcggcatctcaccaccaacggcgccgcgagacgttcgttccagccttcaggaaagagacttgtcaggcgtccccgggtccactaaaagcactagcgggagtagtgcgactagcctaactacaggtgcaggacgttccgccccagcaggtctaagtggcttggatacggaccgctttcgacctcaaccgggaaccgatctgacatcactgggccggatgactgactggcagttctccgccgctgatactcgcaatctgataccctcagaagaatccccccaggtgcgggccatagaccgagctatggtgggcatgggactgattacagaaacagaactcgtcaggattcatgatatcggacggcagatggccccactgctctctgctgcctcttttatccagagcgccggggcctctgccgtgaaagagtctagggaggagcgccagcggcgaaaggcagagaagaaggagacagccaggctcaagcagatcgctcacttagaacaagtacagcacagaaaggcaaccgatatcgtattcctcgggagaggcgtttcccgcggtctagctgatagacgcgcaaatatcgagaagctgcaggatgccgggctgcccgtaatgtccagcccatctgacgttgccaacgctatgggacttaccgtctcccggctccgatggttggcattccacagcgaggcacctactagagtacactacgtgtccttcgagattccaaagaagtccgggggcacaagacgcctttcagctccccatagacagctcgctgccgctcaacattggattctgactagggtcctgaatttggtgcctgtgcacgagaacgcacacggttttatcactcagaggagtgtcgtgaccaatgccgtgccccatgtcaacagcagtattgtgattaacgcagaccttaaagacttcttcccctctataaccctggcaagggttgacggtttgttcaggtccctgggatactcaccggcggtcgcaaccatttttgcccttttatgcacggagtgtcctagacagaccgtccaaatgcacggcaccacctactttgccgctaccggacctcgtgcgttaccccagggcgcttgcaccagtcctgccatctctaatcgcatcacacacaaactggatcggcggatgagcgccatggctgccaagcttggctatcggtacacacgatatgccgacgatatcacctggtcgaccagcgatgaatcagccgtcgcagtgggctatgtgctggccagaattaggcacatagccgaagacgagggatttgagctgaatcatgcgaaaacaagggtgcaacgcaggtcgcagcagcagagtgttactggcgtggtggtgaacgatcagctgggtgttgctagggagacagtgcggaccataagagcgatcctccacaatgcagaacggacgggcctcgcttctcagaacaggaaccaacatcctcagttcgagagctggctgacagggatgattgggtggatctctatggtgaacccagaacaagggcaaaaattgcgccagcattttgacaaagttcggggaagctga

SEQ ID NO: 13756 - RNA, 1620 nt, unidentified
  source 1..1620: mol_type = other RNA; note = synthetic construct
atgctcattaggttgcttaggttcctgatccgcttagcccttcctaccccccaaccacccagagacaccccctcatccctcgcaggccgagatctcagtggccaaccgggttctgctagccggacagtgtcttccgtcgccaacactactgtgtctagctccggccctgctgcccctaaaggttcctcgctttctggcctctccaccgacaaattcgctccaatgtccgtagctgacgccttgtcagccacagccgcggcagattggaggagtgccaacttcgattcgaggtccgttatcccacctgctgacctgccacgcattcaggtgatcgacaggaccatggtggggatggggcttatttcagaacaggaactggcagagatccacgacatcggcagggagatgacccagttccagagcgatgccgcattcatccatcaggcgggagagagggcagtggccatttcacgcgaggaaaggcagcgcctgaaggagcagaagaaggctgaggccgaacagcgtcgtgtgcttcggcgccagcaagtagcccatcgtcgagccactgacataatgtttctagggcggggcgtaagccgaggccttgctgatcggcgaagcaacatcgagaaactccaggctgggggactgcctctgttgagcagtccggcggacctagcaaacgccatggggttgacaattagtaaactgcgatggctggccttccactcagatgcgcctaccagagtccattatgtctctttcaacatacctaagaagagcggcggtacgcgcagattgtctgccccacaccagcaattagccgccgcccaacattggatcctcacaaacatcttgaatctaattcccgttcaccagaatgcacacggctttgtggcccagcatagtgtagtcactaatgccgctccacacgtcggctctagcgtggtgataaatgctgacctgaaggatttttttccctcgattaccctggcaagagtcgatgggctgtttcgaagaattgggtactccccagccattgcaacaatcctggctctgttgtgcactgagtgcccccgcgatactgttacattttgtggaaccacctatcacgcagctataggacctcgggcattacctcagggggcatgtactagccccgcgatttctaatctggtggcacataaactcgaccggcgtatgagcgctatggctgataagctcggatggcgctattcacgctacgccgatgaccttacgtggtctattgaagcggaaccatctccctcagtggggtacgttctggctaggataaggcatatcgtggacgatgagggatttagtgttaaccacgagaagacacgggtgcagagacggtcccagcagcaatccgttacgggcgtcgtggtcaacgaccggctgagtgtgagcagagacaccataagagagattagagcgatcctccataatgccaaatccacaggcctggccgcacagaatcggaatgagcacccgcacttcgaaagctggctggccggtatgatcggatggatcgacatggtgaacccccaacagggaggtaagctcagagctgaattaatcgaactgctgaggaaatga

SEQ ID NO: 13757 - RNA, 927 nt, unidentified
  source 1..927: mol_type = other RNA; note = synthetic construct
atgggtgtggccatccccaaactgcgctggctggcctttcacagcgaagcaccaacgaggacccattacgtgtatttcaaagtccctaagaagtctggtggcgaacggcgacttgcagccccatataaacagctcgccgctgttcagaggtggatcctggatagcattctgaatcagttgccagtgcacgacgccgctcacggctttgtccgtgaaagatccactgtaacaaatgctgatctacatgtgggtgccgatgtggtcattaacgctgacctctgtgacttcttccccacaattaccttctatagggtcgaagggttgttccggagctttggctactccccagcagtggccactatcttggccttagtgtgcacggaatgcccccgcgacgcagttaccttttccggggagacatattatcctgcgactggacatagagggctaccccagggcgcgtgtactagtccggcaatctcatcgctgatatgcagaaacctggatgtaaggtttgctggcatcgccaatcgtatgcactggcgctacacacggtacgcggatgacctgacattctcaacctctactgagcatggagacaaaattgggtacttactggctcggattcgtcacatcagcgaggacgaggggtttagaattaacgccaagaagactcgagttcaacgcaaccacacacgccagagtgtgaccggaatcgtggtcaacgacaagaggtctattgataggaacaccatacggcgccttcgagcgatcctgcacaacgcaaagagaaccggattcgccgcccagaataccgagcaacgacctcatttcgagaattggctcaggggcatgatagcatacgttgctatggtgaatcctgagcggggacacgagctcagagagcagtacgaagctcttagatga

SEQ ID NO: 13758 - RNA, 1578 nt, unidentified
  source 1..1578: mol_type = other RNA; note = synthetic construct
atggggctatttaactggctgtccaacctgctgggtaagtcccccgctggaaacaagtctagcgtagatcgcgggagtgtagtgattccggaactcagcgagccaaggccagagtctaaaaaacggggccctattcggctgaatggcttggacgcacagcagttcgcccccctcgaggataacgaagcacgggagctcgccaagagtctcggacgctccatctggaacgacaccttcttcgggaggagggacctgatcccaccaacctccgacgctcgcacattgttagtggatcgaatgatgattgccgatggtatcactacagccgacgaactagcagagattcatgcagtgggactggagatggataggctgaggccacaactcgcccatgccgctgccagagccgatagagcagtggcttcaaaccgccaggccagagccgaaagaaaggctcggaagaagtcagaagccgcggaccggttgcgtttacgggccgaagccatcgctgagcggaaactcaattctattgactttctggggcgtggagtctctagagggttgccccacaggcagagcgatgcgcagctgttggaacagcgtagtcttcccgtgctgcatacgccggctgatctggcacaggccatgcagttaacaatcagcgagttacggtggcttgcctttcacagcgaggccaccgagaggatacattatgtgcagtttgctattaggaagaaaagcggtggagtccgtctcctcgcatctccccatctcaaattgagaacaactcaccgctggatcctcgccaacatcctgtcaaagattccgctggacaacgctgcacacgggttcgtggtaggcaggggcatagtctcgaatgctcaaccccacgtggggaaatccgtggtggtcaatgtggacctggcggacttcttcccttcaatcaccttccctagagtcgcgggcctgtttcgaggcctaggttacagcggcgcagtcgccactattctgggcttgcttgtgacggaatgccctagacagcgagtgcggtatgcaggacgcgagctgtgggttgccagtggtcctagatctctgccacaaggagcctgtacatcccccgctatttcaaacgcaatcgcatggcgactggatcacaggctggctgcaatcgcctccaagctcgactggacttacacccgctacgcggacgacctgacctttagtactagcggcgacaatgctgagaagatcggctacttacttgccaggcttcgacacatatgtgaaaacgaaggcttcaggcttaatcataataaaacacgcgttcagagaagaaacatgcaacagtccgtaaccggggttgtggtcaatgaccggtgcggcgtctcgcgcaaggttgttcgacaattgcgcgccatactccataatgctaaacagaccggtctagcggcccagaatcgggatggacaccctgatttccaaaactggctgcagggaatgatcgcttatgtgcacatggttaatccagatcaggctctgccccttaagcagaaatttgagcagatcattgggccttga

SEQ ID NO: 13759 - RNA, 1602 nt, unidentified
  source 1..1602: mol_type = other RNA; note = synthetic construct
atgggcatgtttgactggctgtcaggcttgtttgggcgagcctccagtgggaggcctacagcacccgctgcaggtgctgcatcacccgctccaccaccagtgagaagctctgccccagagcagcaaccccgtcctagacaatctgggccgaagcggctggagggtcttgatgctagccagtttgcacctctcgaaatcgatgatgctagggggcaagctaagcgcctcagcagatctttcgggagactcgtatggggcaaccgcactgatcggattccccccgccaacgatgcccgtactttgcttattgaccggatgatggtggcggaggggctggtgaccccagaagagctggcggacattcacagggtgggagctgagatggacagactccggcctgattacgatgcagcccatcgcgcgggtgctaaagccgcagagcaagctgctgcctcatcccggcaggaaagggagcagcggaaagccgagaaaaaagccgcagccgctgagcggaagagagaacgagccgagcagatcgccgaacgccggagaagtgacatagtctttcttggcagaggcgtttcacgcgggctggccgatcgtcagagttacccggatctgctgggatctttcggcctacctgtcatggcaacccccgctgacgtagtcaaggcaatgggcttcctcgacatagccgaactcaggtggctagcctttcacacagaggcagccactagaacccactacgtgcagtttactaccaggaagaagtctggcggagttagagtcctcgcctccccccatcagaagttgcgacgagcccaaggctgggtcctggagaatatcatcgccaaaattcgggtggacgacgcggcgcatggattcgtggcaggtcggagcacagtctcgaatgccacaccgcatgtcggccagcaggtggtagtgaacgctgaccttaaagacttcttcccttctataacgttctatcgggttgaaggatttttccgcaggctgggctactccggagctgttgctactattctggctctcttaacgaccgagtgtccaaggcagcaagtgacctatgccggccagactttatgggtagctaccggtcctcgctgcttacctcagggggcatgcacatcccccggtctgtccaacgccatcgcttggaaactggacaggcgattgggcggcatggcacgaggtctgggatggacatacacacgttatgcagacgacgtgaccttcagtgcctcgggagaacccgcggcaaaggtgggatggctgttggccagacttcgtcacctggcccaggaggaggggtttgaactgaaccataagaagactcgcgtgcagcggcagaatgcccaacagagcgtcaccgggttagttgtgaatgatagggttggagtcagcaggaaaacagtgaggcgcctgcgcgctatcctgcacaatgcgaagcagacggggcttgaagcccagaatagagataatcacccaaacttcaccggctgggtgcaaggcatgatcgcatatgtggccatggcgaacgccgagcagggagctagcctacaggcagcctttgatgaactctga

SEQ ID NO: 13760 - RNA, 1626 nt, unidentified
  source 1..1626: mol_type = other RNA; note = synthetic construct
atggggctgtttgactggatttccaaccttttcggtggctccagctctacagcaaacccaccaaaacccgaatcgagcgactcagcaggtccccaaggccctgcttcaacatcatcttcctcaagtccggcacctaccccaccgcaacctccaaggcctggtccacctgctccccctaaaagtaaaaggttagagggcctggatgcatcccagttcgcacccatcgaggaagctgccgctctgcggcaggcgaaatcaatgcgcttaagattttggacctctacctggtttggcttgcgggatagaattccacccgcctctgacgaaaggactaaattggtcgaccgattaatggtcgccgatgggctggccacccctgaagagctcgctgagattcatgaggtcggcgccgagatggataggttacggcccgccctagatgatgccgccaaacaagccgggcaggcggtttccaggaataaggaagacagagccaaactcaaggcacagaagaaggccgaagctgcggaaagaaagcgactgagagcggacgctatagccgagcgtaagaggaatgacatagtgtttctgggccgcggagttagccgaggactagccgacagagagtccaatgcggagaagctggaaggaagggggcttccggtgctgcacaccccatctgagctcgcgacagctattgatcttcccctttccactctgcggtggctggcctatcacaacgaggcagccgagcaggtgcattatgtgcaattccaggtcagaaagaaaagtggagggatccgtgtcctagcttccccgcacaagaaaatgcgccgggcccagcagtggatcctcgacaatattctgactaagatagacatacacgaagccgcccacggatttgtggctggccggtcaaccgttactaacgcagcaatgcacgtgggacagcaggtagtggtcaatgtggacctgcaagatttcttcccctctgtgacctttcccagagtggaagggttcttccgaagcctggggtactccggcgcagtagctaccatcctcgctctcctggtcacggagagccctcgccaacgtgtgcgctacgctggaaaagaattgtgggttgctacagggcctaggtcgctgcctcaaggcgcttgcacgtctccagccctgagcaacgccatcagctggacaatggacacccgcctcactgctatctccagtaagcttggctggagctacagccgatacgcagacgatctcacgtttagtaccgctggcgaggccagtcagcaggttggctatctgttggctcgaattcgccatattactcaggaggagggattcggtctgaataggaagaaaacccgggtacaaaggcggagcgcgcagcagtcagtgactgggatcgttgtgaacgatagggccggagtagcacgtaagactgtgcggcagctcagagccatcctccataacgcaaagacaacaggtttggccgcacagaatcgcgaaggtcggcccgatttcgaagcatggttgcagggcatgatcgcctatgtgcgcatggtcaacccagagcaggccgcctctctgacagatgcatacgagcagcttagatactga

SEQ ID NO: 13761 - RNA, 1623 nt, unidentified
  source 1..1623: mol_type = other RNA; note = synthetic construct
atgaattttttccgtcgacttaaacaatggtttgcccccggacaggaaaggagtgcccagcagacaccttcccaactgcctgcgtccgtggaaaatagggattacactagcccgagtcctggaaccccccctgcttctcagcccactactcccaatcggagcacctctccacctagcagcccccagcctagaccagaaagcacactgagcggcctggatgcttcacggttccaaccactgacccaagacgaggcgatggagagcacctctcaacctggctggaggactgcctactgggaccctctgaacgtcatcccgtctgcctcactccccaggatccgcgtgattgaccaaacaatggtaggcatgggactgatagatgccgaggagttggctgagattcacgacataggggaacagatggcccaatttaggacagattatcacgtgatccagcatgctggtcaagcagcagtgcaggccgcccgtaacgctagagatgctcgcaaggccgagatgaaaaggctggccgctgagcgtaagcagcagaggcaacaggccgtcgcacagagaaaagctacagatatcgtttttctcggccgcggtgtgtctagaggcctggcagacaggcgcagcaatatcgaaagactgcaggccagtgggctgcccgtgttgagctcaccagcagagctggctgaggcaattggcatcagcgttggtaccctccgctggctctcctaccaccatcctgcatctaaaaccacccactaccactcctggaagattgcgaagcggagtgggggcgagcggacaatctctcgcccacataaaaaactagaacacgctcagaggtgggtcctagaccatttacttagcaagctgccaacacatgacgcagctcatggctttgtgccaggtcggtcaacattgtctggcgccgttccccatgtaggcgcctcagtccttgtcaacgtggacctgcaggatttctttcccactattgatttcgcgcgggtggcaggactttttcggggcttcggttattccccggcagtggcaactattctcgcactgctgacgacagaagctcctcggcgcatgatccggtcggggtctgaaacccttcacgtggcggtggggaatagatcacttccccagggggcctgtacgtccccagcaatatccaatctgatctgccagcgaatggacaagcgattaagtgggatggcggcctccattggatggtgctacacgcgatatgccgacgatttgagtttctcctccgtcgaacaggccgacaaggtggcctacctgctcgccagagttcgtcactttactgacgaggagggtttccagatcaaagcctccaagaccagagtgttacgccggagtaaccagcagtcggttaccggaattgtcgttaacgataggccgagcatcgatcgaaaaaccataaggcagttgagagccatcctccaccgcgctaagtcagaagggctcgagcgccagaacagaattggccacacgaatttcagagggtgggtagctggaatgatcgcttatgtagagatggtgaacccacagcagggacggaagctacgagaagccttcggaactatttga

SEQ ID NO: 13762 - RNA, 1518 nt, unidentified
  source 1..1518: mol_type = other RNA; note = synthetic construct
atgtctcccccttcagaatccggacaggctagcgagttttcaccagcggcgtcacggcccactactagctccccaagcccacctccggaatccgagctttctgggttggacgcctctcggtttcagcctattagtcacgacgacgccctcgaggcgacctctgatcctagctggaaaacagcatacttcgacccactaaacgtcatcccatcagtgtctctccccaggattcgggttatcgatcaaactatggtgggcatgggattgatcacagcagaggagctggccgagatccatgacgttggggagcagatgtctcaattccgcacggactattatgcaatacaggcggctggccagcaagccgtgcagtctagccgagatgcccaggctgccaggaaggctgaactgaaacgtctcgccgagcagagaaagcaggcccatgaagaggccgtcgctaagaggaaggcaaccgatattgtctttcttggacggggggtgtcaaagggcttggcagatcgacggtcaaatatagaacgtctgcaagcctgtaggctgcctttactgtcctcgccagccgatctggccgatgctttggacgtgtccatcggcacgctgaggtggctggcatttcaccaccccgctagtcgaaccacccattatcattggtggaagattcagaagtcttccggcggtgaaagaacaatctgctgtccgcatagcaaacttgcaaatgcacagcggtggatactcaacaacattctggggaaagtgcccctccacgacgcagctcacgggttcgtaccttcccgctccacactgacgggtgcaaaaccacacataggaagtagagtcctggtcaatgttgacttgaaagattttttccctaccatagatttcgcaagggtggctgggctgtttcgagggctaggatactcccccgcggtagccactatcctggctttattgacaactgagagcccgcgcatgagactccgatcaggaaaaacaaccctctacgtagccgtgggtaaccggtctttacctcaaggcgcttgcaccagtcccgccatcagcaatctcattagcagaaggatggacaagcgtcttttcggtatcgccaactcaattggctggaggtatacacgctacgccgacgacctgagtttcagttgcagtgatagggaagataaagtggcttatttactcgctcgcgtgagacacgtcaccagcgaggagggctttcagattaaggaatctaaaaccagagttctgagaaagaatagccagcagagtgttactggaattatcgtcaacgacaaagcttccattgatcgcaagactatccgcaagctgcgctccatcctgcatcgggccaaattcgaaggcctggagaagcaaaatcggctaggacaccccaatttcagcgcctggctcgccggcatgatcgcatacgtggaaatggtgaaccccgaacaggggaacaagcttagacttgcctacgagtcgctgggttga

SEQ ID NO: 13763 - RNA, 1605 nt, unidentified
  source 1..1605: mol_type = other RNA; note = synthetic construct
atgaacttctttcgaagactgaccaaatggattacatccgggcgcgacagctcagccgatcaaccagtgccttcacagatgccggcctcggtggagaatagggactatacagtccctaatacgcctcagaccccttccgcacccgcaagtaatccaagcccaccagaacagccacagactagcaacctcgccggtctggatgcttctcgttttcagcccctgagtcaggacgaagccttagatgcaacatcccagcctgggtggcaatccgcttactgggaccccctcaacgtaattcccagcacatcactgcctagaatccgcgtcatcgatcagactatggtgggtatggggctgatcgacgcggaggaactcgccgacattcatcatattggcgaggaaatggctaagtaccgaaccgactaccacgtcatccagcatgcgggacacgccgctgttcaggctgccagagacgctcgggctgccagaaaggccgaaatgaagcaaagggccgcacagcgaaaacaggagcgcgaggccgcaatagccgaacgtaaggcaacagacatcgtgtttctgggtcgcggagtcagtcggggactcgcagataggcgttcaaacgtcgagcggttgcaggctagctctcttcccgtgctgtccagcccggcagatctagcccaggccatggggatccccgtggcaacactgagatggctcagttaccaccatcccgcatcgaaaaccacccactatcactcatggcagatagccaagcgaagtgggggcgttcggacaatctccaggccccataagaatctggaggatgcgcagcgctggatcttggaatctatcctcgctaagttaccgacccatgacgcggctcacggctttgtccccggacgttctacactgaccggagccaccccacacgtcggagctaaggtgcttgtgaacgtggacctgcaggactttttccctacgatcgatttcgcacgggtggccggtctgtttcgcggattcgggtacagcccagcggttgctaccatcctggccctgctaactactgagagccctcggagggttataagatccggcagcgagacgctgcacgttgccgtaggaaatagaagcttgccccaaggcgcatgcaccagtcctgcgatatcaaacctgattgctaggcggctggataagaggctcgccggcatggcccgatctattgagtggcagtataccagatatgccgatgacttatctttctcatgtcgcgagagcgaagagaaggtggcttacttgatggcaagggtaaggcatctcacttctgaggagggcttccttgtgaaagaatccaaaactcgcgtgttgagacgccacgcacagcagtccgttactgggattgtagtgaatgatcggccatctatcgatagaaaaacgatccgacagcttcggtctattcttcacaaagccaagtccgaaggcctagaaaggcaaaaccggattggtcatacaaatttcagtggctgggtcactggcatgattgcctacgtggaaatggtgaacccacaacaagggcaaaaactcagggaggcttatgaggctctttga

SEQ ID NO: 13764 - RNA, 1668 nt, unidentified
  source 1..1668: mol_type = other RNA; note = synthetic construct
atgggcctgttcgaaatccttaagcagattttcgcacctggccaaagacggccaggaccacctaggggagctcctagtgaccccagcgctattgatcctggcagcctcacacccccaaggcaagcagagccctctccagccaccagctcagctccactgtcaagtgccactcccgctacaacgcctgcgcctgctgccacaagcaaacctgccggtggactagaagggcttgatgcttccaggtttcaacccctcacaccctcagaggcactggatgccaccgcacagcccggatggcaaaccgcttactgggacccactgaacgtaatcccatctacccacttacctcggattagggttatcgaccagactatggtcggtatgggactgattgatgcagatgaacttgcggagatacacgacatcggccagcgaatgtcgaagtttcgcaccgattaccatgtcatcgccgacgcaggacagcaggccgttgatcaaagccaggctgcccgggatgcacggaaacaggagatgaagaaacgagccgccgagcgcaaacaggctcatcaacaggctgtggcacacaggaaggccacagacatcgtgtttctcgggagaggcgtgtccaaaggtcttgccgatcgccgcagcaatatcgagcgtctcgccgcgtctgacctacccctgctgtctactccggcagacctcgctaatactctggggataagcatcggcaccttgaggtggctgagtttccatcatccggcttctaagaccacccattatcaccactggaaagtccctaagcggagcggcggggagagaactatatcccgaccacagaaaaagctcgagagtgcacaacgctggatactagaatcaatcttagctaagcgacccacccacgacgccgcccatggatttgtcacgcagcgtagtaccttaactggcgccctgccccatgttggatcacaggtcgtggtcaatatggacctggagaacttctttccaacaattgatttcgcccgggtggctggtttgttcagagctatgggctattcacccgcagtagccacgattatgtccctgctgtgcacagagtctccgagaagggtgatcagatccggggacgagacactgcacgtcgccattggtaaccgatccgtgcctcagggagcgtgtacctctcccgcactgagcaatttgatatgcaagcgcttggataaccggttggtgggcatggcggaaagtattgggtggaggtatacgcggtacgcagacgatctctccttttcatgtccaatcgccaaggacggtacagaccagggcgcgcaggcttctgccaagattggctatctgttgagcagggtacgccacttcgccgacgaagaggggttccgagtgaaagaatccaagacacgcgtgctgaagagatccactagacagtccgttactgggatcgtggttaacgacaggccttcgattgatcgtaagaccatccggcggctcagagctattcttcaccgcgccaaacacgaggggcttgaagcccagaatagagaaggacatccaaactttgccgcatggttagccggcatgatcgcatacgtgcagatggtgaatccggcgcaggggcaaaaactccgtaaacagatggatctgctgtga

SEQ ID NO: 13765 - RNA, 1629 nt, unidentified
  source 1..1629: mol_type = other RNA; note = synthetic construct
atggggttatttcgcgtcctcaagcaattctttgctccaggaaggaacccgcctcaggacgcgaccagagcacaagcgacagcccccagcagcatcgatcacagagacttgactccaccaactacaccggtcgttacgaccgggcctgactacgttccactgaactccctgcccgccacaccacccagagagtcatcagggttcgacggcctcgacgctagccagttccagcccctcacccaggacgaagccatggaggcgacagcagaacctgggtggcgcactgcatactgggaccccttgggggtcattccgtccgcagatctgccacgaattcgtgtgattgaccagacgatggtcgggatgggcctaatagacgccgaagaactggctcagatccattccttaggggaagagatgtccagatttcggaccgattactacgccgtacaagatgcgggcaaccaggccgttcagcagacaagagacgcccgcacagcccgtaaagccgagatgaagcagcgagctgctgagcggaaaaaacaacacgacgctgacgtggcccatcgcaaagctactgatatcgtgttcctaggtcgcggcgtctctagaggacttgcagaccgcagatccaatatcgagcgtcttaagagctccgaactgccagtactctcgtcccccgccgatgtggctagtgccttaggaatttcagtgggtaccttgaggtggctagcttttcatcaccctgccagcaagacaactcactatcatacttggacgatcgccaaaaggtccggcggcgatcggacgatttctcgaccccagaagaagcttgcagcggcgcaacagtggattctggatagcttgctgagtcaaattcctgttcatgatgctgcccacggtttcgtcccgggacggtctaccctgactggtgcacagccccacgtgggttcccagatagttgttaatatggacctgcaggatttttttcctactatcgatttcgcaagggtcgctggactcttcagggccttaggctactctcctgccgtcgccaccatctttgctctgctgtgcacagagagccctcgccgggtgatcagaagtggcggagagactctccatgcagccgtgggcaaccgaagtcttccccagggagcatgtacatcaccagccctgtctaacctcatcgcaaagaggctcgataagcgtctggctggaaccgcaaaatctattggatggcagtacaccaggtatgccgacgacctcaccctgagtacaaaggtgaactcgagtaaagtgggatatgtactggctcgcgtacgccacttggccaaagaagagggttttgtggtgaaggaatctaagacaagggtgctgcggcagtgcacccagcaatcagtgaccgggattgtggtgaatgatcggcccagcatcgatagaaaaaccatccgagaaatccgggcaatactgcaccgggccaagttcgagggcttggagaagcagaatagaatcgatcacccaaacttcgctgggtgggtcagcggcatgattgcctatataaatatggtgaatcctcagcagggcggcaaacttaggcggcaacttgacgagctgtcaatgaggtga

SEQ ID NO: 13766 - RNA, 1635 nt, unidentified
  source 1..1635: mol_type = other RNA; note = synthetic construct
atgggcttattcgatttctttaaacagatgttcggcggaaggagtgtccaggagaagtgcgtcagatgtcgccaaccactccggatgggtgccctgttctgcggaaattgcaagcacccacgaggtgcgccttaccccattccacttgcgcagaccaaacgatcagaccagggtgcagccaacgctcccagggttagaccccagaatctggtcgggctcgatgctgacaagttcaaaccaatgacaacgtccgaggcaatggccacaatcgacaacgaagacagctttaaaagtgcctacctggatagcctgaacgccattcctgatgctagccttccacgaatacaggtgattgatcgcactatggtcggcctagggctgatcgctccagaggaactggtgcacatccatgacgttggcaaggccatgggcgagcttcgtggcgactggtcttccatccatgcaagaggccagcaagccgttcaactgtcacgagaagagagagcggccagaaagcaacagaagatcgaagaggccgctcgtaggaggcaggcaagggcagaagcaattgctcggaggaaagccactgatatagtcttcctcggccggggagtatcaagagggctggctgataggcgggccaacgtggaagcactgaagcgtgccggcctccctgtattggcagcacctagcgacgtctccgtcgctatgaacatctccatcccgaggctgaagtttctggcattccattccgacgcgccggagcgcgtgcattacgtgagtttttctgtgccgaagaaatctgggggcatgcggcttctgagcgctccacaccagagcatggatgaggcccaacgctggatactcgacaatgttctgtgtaaaattcctactcactctgctgcgcatggttttgtcactggatgtagtaccgtgaccaatgccgaaccccacgttggcgccagaaccttggtgaacgtggacctcaaggatttttttccctcaattacttttcctagggttatgggcctattccagtcgctgggatattcgcctgcagtggcaaccatcttcgctttgctgtgcacagaggcccctcgccgcgtgatgaagtatgctggtagagtgttccatgctgccacagggcccagatcattgccacaaggagcctgtacctctcccgcaattagcaatttagtggctcgggggattgatcggcgtctggaaggtatagcccggagacttgactggacatacacacgctatgccgacgatctctctttttccaggaaggatgccggcgagcctcacgtagggtacctcttggcccggatccgccatatcgcccaggacgaggggttcgaagtgaatgagaagaagactcgggtacagcgtcccaaccagagacagaccgtgacgggactagtggttaatgataaagtgaacgtgtcccgaaaagacattcgccggatccgcgctattctccacagggcaaaacacgagggattagcgaggcagaaccgggaagaccacccctattttgagtcctggcttagaggaatgatcgcgtacatcagcatggtaaatcccaccgtcgggcagagtatgcgaacgcagttcgacgctctggcctga

SEQ ID NO: 13767 - RNA, 1635 nt, unidentified
  source 1..1635: mol_type = other RNA; note = synthetic construct
atgggcctatggaacgtgctagcacgactctttggcgggggctccgcttccactaatcccacacccccaactcaaccccaggacgctagggccccagtcggaatgccttatggccgggggagtgcagtaaacacacctcctcctccaccgcggacacttgctagaccgggttctccctcacctactcggccagcacctacaaacctgaatctggatccaggccaatttgcccctgtgggggctgccgagctcaaaaagagggcaggagagctcagatggaattgggcaagcgtgaacttcgatcgccgcgatcagatccccagtgccggtgatcctcgcactgccctcatcgaccgtgccctggttgcccaaggccttctgactcccgaacagctggttgaaatacacgagactggtgcccagatggcagagctcaggcccgagctgaggaatctgcagaacattgctgctgacgctgcactcgccgacgaagctgaaagaagagcgcgcaaagaggcaaaaaaggccgaagccgatcggaggcgtgcagaaagggcggaggcaattaaacagcgaagagccacagatatcgtgtttctggggcgtggcgtcagcggtggactagcagatcgccgggctaacatagagagactgcaagcgctcgggctccccgttttggctaccccagccgatgtcgcaaaggccctggggttagaagtctccagactcagatggctggctttccattctgaggcagccgctgtaacccactacgtgcgattccagatccctaaaaaatctggaggaacccgcgaacttgctgccccccatcgcgatcttgcacggtgccaggaatgggtacggatccagatcctcgaccgcgtggatttgcacgacgccgcgcatgggtttgtgactggcaggggaaccttgacgaacgcccgcccacacttaggcagggctgctgttgtgaatgccgatcttaaggacttcttcccaaccattacatttcctcgggtgaagggagtcttccagcagttgggctattctcctgccagcgcgactgtgctggccttgttgtgcacggagtgtccaaggggagtggtgaattatgacggccgggagttacatgtggccaccggtccccggggattaccacaaggggcgtgtaccagtccggcgctctccaacttggtggctcgaggtcttgacaataggttgtcggccttcgctcgaaggctgggctggacttacacccgatacgctgacgacctgaccttctcagctgatggagaagcgatggggcagacagcaagactgctgacaggtctgaggcacattgttggagacgaaagcttcgtggtgaacgagaagaagacgcgggtacagaggcccaagacaagacagacagttacgggcattgtcgtcaatagacacccaaacgtcccccgcgacaccgtacgtcggttacgtgccatcctgcacagagccaaaaccgagggcctgaccgcacagaatcgggaggcccacccccattttgaaggctgggtgcgcgggatgatagcctacgtcgccatggttaacccggagcgagggagagagcttctggccgagtttgaactgagaaagaggtga

SEQ ID NO: 13768 - RNA, 1635 nt, unidentified
  source 1..1635: mol_type = other RNA; note = synthetic construct
atgggactcttcagtaccttgttccgatggctgcgaggtggccccaccttagacgaagcccgaagagccgccgccagaagggttcctgctgatcgggcacctgaaggccagccctacagggctgccgttcctggtgcaggggctagaccaccagtgttgccgtccgcacaacccagttctaggcctgccgccggaaaactaaacctggatgcaggccagttcactcccctcagtcctgaggaagtcaaaaagagggccgcctctctctcctggaactggtcaacagtgaatttcgaccgtcgggatcagattccctctacggccgagcccagaactgccttgattgaccgagctttggtggcccaaggcctgctgacgccagagcagctggtgcagattcatgaagttggcgcccagatggcagctctgaggcctgaactggctaacatacacaccatcgcccacaacgctgtagctgcggacgcagctgaaaggcgcctgcgtaaagagcgcaagcaggcggaagccgcacaacgaagaactgctcgggctactgctgtggcgcatcgcaaggctacagatattgtcttcttagggcggggcgtatcaggcgggttggcagatcgcagagccaacatcgaacgtttacagctgctcggcctgccggttttgggtccaccaggcgatctagctcaagcactggggcttgaggtgagcagactgcggtggctcgcgtttcattctgaggccagcgctgtgtcccactacgtgcggtttcgaatccccaaaaagagcggaggtacccgtgaactagcagccccccatcgagatctagcccgctgccaagactggatcaggcgcaacatccttgacagagtgcctctgcacgaggcagcgcatggatttgtgactaaacggaataccctgtcgaatgcgacacctcacgtccacagggccgtagtcgttaacgccgatctgaaggacttttttccatccatcacgttcccacgcataaagggcgtgttccagcagcttggatactccccggctgctgctactgtgctcgcacttttatgtaccgagtgtcctcggacagccgtaaagtatgaggagagggaactctgggtggccacaggacctagaggactcccccagggagcctgcacttcacccgctctcagcaatctggtagcgaggggcctggacggaagaatcgcaggtctggcccgcaagctcggttggacatatacccgctacgcggacgatctgacctttagtactgacgctgagggcgccccaaaaacagcctggctgctggcaagactcaggcacattgtgggggaggagaacttccttgtgaacgagaagaaaacaagggtccagcggccaaacacccaacagagcgtgaccgggattgtcgtcaatcagcatcccaatgtgccccgggaaaccgttcggcgtctgagagcaatactgcacagggccaagacagagggcttggcagcacagaatagggaagcacacccacattttgccggatgggtcagagggatgattgcctatatccaggtcgttaatccggagcgcgggcgcgaacttttagccgacttcgaggctcttcctcaggggcggtga

SEQ ID NO: 13769 - RNA, 1656 nt, unidentified
  source 1..1656: mol_type = other RNA; note = synthetic construct
atgattcccctgggggctattgccggcgccttagtggttctcctcaggcagctcttcaaagggtctaaaccacagccgaggagatcgtctccccctcctcctgtaccacgtccaggtgaccggccttatacacccggtgcacctccacctattcccccagcggcaggagctgctagacctgcacaacctagtccacctaggtcagcaccaccccgatccaccactctgaatctggacgccggccagtttacacccgtttccgccgaggaagcaaaaaagcaagcccgcgggatcaagtggaactgggcctctgtgaactacgataggagggaccaaatccccgcgcctactcagcctcgcactttgctgatagatcgcgcaatggtggcccagggactgctaactcctgagcagttggtggagatacacgatgtcggcgccaaaatggctgaactgcggccggatctcgccgggatcggtaatgtggccgatcatgccgtggccgctgatcaggaggaacggagacggcgcaaagagcagaagatcgcggagagcgcagagcgccaacgcaagcacgctgaagccgtggcgcaaagaagggccactgacattatcttccttggacgtggcgtatccggcggactcgcagataggcgcgctaatgtggagaagcttcagcagttgaacctacccgtcctcgctacctcaggggatgtagcgaaggttctggacttagaaatcagccgactgaggtggctggccttccatagcgaggcttgtgccgtgacgcattatgtgcgcttcaccatacccaagaagagtgggggaacccgagaactggccgcacctcacagagaaatggcccggtgccagctgtggattaagttaaacatcctggaccgcatcccccttcatgaagctgctcacggctttgttgctcacagaggcacgatgagtaatgcagtgccccatgtgcgtcgggacgtggtcgtgaacgccgacctgaagaattttttccctaccattacctttcccagagttaaggggatcttccaggaactgggctacagccccgccgtagctaccatactggcactcctctgcaccgaatgcccgaggcagcgggtcacttatgctggacgagagttgcacgtggcgacaggaccaagagctcttccacaaggagcctgtacctcaccggccctgagcaaccttgccgcaagagggctggatgcacggctaacaggcttagccaggaagctcggctgggattatacccggtacgctgacgacttgacattttccacgtccggggcacccgcacagaaaacggcgtggattctcgcccggcttaggcacattgcacaggaggaaaatttcactgtgaacgagacaaagacacgggttcagaggccatctgcccagcagaccgtgacaggaatcgtcgtcaataagcgaccaaatgtcccacgtgagactgttagacgcctgcgtgctattttgcacagagcgaaaacagagggcctggccgcacagaaccgagagcagcatccccacttcgctgcctgggtcggtggtatgatcgcctacatgcaaatggtcaacccggagagaggcaaaaaacttaaagctgaatttgacgctctgccaaaatga

SEQ ID NO: 13770 - RNA, 1215 nt, unidentified
  source 1..1215: mol_type = other RNA; note = synthetic construct
ccatcgcgacaggcgatccaggctaaacagcaggcggaagcgcaagccgccgaacaagcgttggccgatgatgacgccgcaagagctgctgctcgggaggctaggaaagccgctgcagctgccagacgagagcagagagctgccgcaattgccgaaaggcgccggaccgatattgtttttctgggtaggggagtctctgggggattggccgaccgacgcgctaacgtggagaggcttaccgccttcggcttgccggttctagcaagccccgccgatattgcccgcgtgttggggatctctgtgccccgtctgagatggctggccttccatagcgaggcctcctcagtgagtcactacattcgttttacaatcgccaagaagtctggaggcatccgcgagctggctgctcctcatagggacatggcagctgcacagcagtggatcctgacaaatattcttaacgtacctcccgtgcgcgattgcgcacacgggttcgttcggggacggaacgtaatgactaatgctgtgccacatgtccggagggacgccgtggtgaatgccgacctcaaggatttttttcctactgtcacctttccgcgcgtcaaaggtatattcgagagcttaggctactctcccgcagcagccacagtcctggcattactgtgcacggatagtccacgaaggctagtcgagtacgaaggcgaaaaacttcacaccgccgctggtcctcgagctctgccacaaggcgcctgcacaagcccagctctgagcaacatggccgccagaaaactcgatgcaaggttagaggggctggccagagctacaggatggacctatacccgctatgccgacgacctgactttttccgcaaacggcgaaactgcgagtcggtgtggtgggctgctccaagcgttgcggaggctttgtgccgaagagggcttcaccgtgaacgagaagaagacgcgggtgcagcgtcccaactcccagcagtcagttacgggggtggtcgttaatcaaagaccaaatgtgcctaggacccttagacggcggctccgtgccatactccaccaggcacgcacaactggactggctgcacagaatactgagaatcaccccaacttccccatgtggctcagaggcatgatcgcgtgggtatcctcaacaaatcctgacgagggccgcagactcctggaagcattcaaggacctgaagtga

SEQ ID NO: 13771 - RNA, 1587 nt, unidentified
  source 1..1587: mol_type = other RNA; note = synthetic construct
atgggctttatcgactggttacgggacctttttctggggccagaattccgcccaaaggataggtcacaaccgcccccgcaaagaccgggtgcagttcctgatcccgtgtttccgccccggaatgtcgctattcctggacagaatcccctagcacaaagacctgcccccgctccaagaacaccccctcctcctccacgaaaactcaatctgaccgcggctgcctttgccccaatttcagacgcagaggccaaaaagcagggggaggccgccaggtccgcatttaacccctggtggggacggcgcgatcttatacctccacccgacgatcccaggaccctcgtgatcgatagatctatggtggcacacggctttattactccgcaggagctgacaggcatccacgatgtggggagacagatggaagaactgcgccctgatttgaaccaggtagaagctcaggcaaaccaagctgtcctcgccgcccaggctgacagagaggagctgaagaagcgcaaaaaggcagaggcagccgaaaaaaagcgccggcatgccgaggacgttcttaggcgccgtagcacggacattgtattcctgggacgaggggtttcaaaaggtctgtctgatcggagagcaaatgtggagaaactccaggcggccggtttaccagtcctggccacacctgctgacgtagcgcgagcactaggcctcacagtgcctcgtctccggtggctggcgttccacacggaagctagccctgtgacccattatgtccggtttgagatacctaaaaagtctgggggaatgcgcgctttggctgctccccacagggacatggctcggtgccagcagtggattctggcgaatatactggggaaggtggcgccacatgccgtagcccatggtttcgtgaagggtcggtccaccttgacaaatgccgctccccactgcaggcgtgacgttgtcgtgaacgccgatctgagggatttctttccaaccatcacgttcccccgggtgttgggaatctttgcccagttagggtacagcccagccgctgcaacagttctcgccctccttgccaccgaaagccccagacgcccagtcgaagtcgacggcaccacataccacgtggcctgtggaccccgtgctctaccacagggggcctgtacttcccctgcactgagtaaccttgcagcacgaggcctggacaggcggttagcagctatcgcaactaagctgggttggatctattcgcgctatgccgacgatctgactttcagtaccagtggcgaggccaagaccggctacttgttggccaggctgagacacatcgcgagggacgagggcttcactgtgaacgaagataagacccgggtgcagagacgatctgacgcccaatccgtcactggcattgtggttaacgagttccccagcacaccacgtaaggagcgcagaagactcagggccgcaatgcataaagcgaagacttccggactggcccctaaagatcttgctagggcccgaggcatggctgcctacgtcgctatggtgaatccagctcagggagccaaattcgctgcactgagatga

SEQ ID NO: 13772 - RNA, 1590 nt, unidentified
  source 1..1590: mol_type = other RNA; note = synthetic construct
atgggtctactgtctttgatccgccgacttctgggcagggatcagccctctcaaccaccacctataccacggccgtcgacttccccacggcacaacgtggtgccgcaggtcagagcaaccagtcagccccctcaacgaaaaactctgagccagctggatagccaggttttcgcagggttgagcggtgccgaaacgaaacaacaggccaaagctatggggcgacccttatggagtaacttattcgcctttggccgccaaagcgtgatccctccagtttccgatgagcgtaccctgatgattgaccgtgccatggtaggggaggggctgatcacacctgaagagctcactgcaatccacgagattggcctgaagatggaggagctcagaccctcctacgaaggtgctaggcatcagggtcaggtagcagtgaacgcggacaaggccgccaaggctgagcttaaaagacagaaaaaggctgaggccgccacacggaaagcagaaagagaggcagccattgctcagcgaaaggccaccgatatcatttttctgggacggggagtgtccggcggtttagcagaccggcgatcccacgtggagaaattgcaggaggccaaactgccggtgttgtccactcctgcggaactcgccaccgctctcgagttgcccgtaaaaagactaaggtggctggctttccacgccgaagtcgctgtggtcacccattatattcgctttcaaatccccaagaagagtgggggcatgagggagatctcgacaccacataccgatctcgctcgggcgcagagctggattctccagaatatactcgaacatgtgcccgtgtctggcgtcgctcacggctttgtgcgggagcgtggcaccctgacaaacgcgagaagccacaccggcaaggatgtcgttctgaacgctgacctcaaggacttcttcccatcaattacgttccctagagttcggggaatattccagcagctggggtacagccctgctgtggccacagtgcttgccttactgtgcactgaatgcccaaggaggactgttacctacgatggccagacctatcacgtagccaatggtctgcgcgctctgccccaaggcgcatgtacatcacctgcactctcaaatctttgcgcccgcaagctcgaccttcgctttgccgccctggctgcgaagcatgggtggacatacacgagatatgcagacgacctgacattctcaacaaggggagagcccgcaaaagccactgccttgatcctctctagattgcataatattgtccaggacgaacactttgaagtgaacaccgcaaagactaggatccaacgccgcaatgctcagcaatctgtcacaggaatcgtcgttaatgatcggtgtaacgtggacaggaagaccagacgtcggctgagggccatacttcatcaggccgaaaaaacggggcttcctgcacagaaccgcatcggacacgacaattttgcgggatgggtgagtggaatgctagggtatgtcaagatgattaatccccagcagggcatgaagcttttcaaagcttgggatctgctgggaggccagaagtga

SEQ ID NO: 13773 - RNA, 1587 nt, unidentified
  source 1..1587: mol_type = other RNA; note = synthetic construct
atggggcttttttcatttattaagagcctctttggcgggtccagtacgccacctccactccctaggagagaaaccaccccggtacggaacgctgtgccgcaagccaaaaccccacctcagccccccaaaaggcagactttagcccatctagactcacaggtgttcgaagccatatcctctgaagccgcaaagaagcaggcaaaagcgatgggtcgccctctatggagcaatctctttgcattcgggagacagagcgtgatccctcccgtaactgacccaagaacactgatgatcgatcgggctatggttggtgagggcttaatcactcccgaggagctgacacagattcatgagataggtgaaaagatggccgaactgcggcccgatttcaactgggcaagacaccagggccaggctgctgtgaatgccgataaagcagccaaagctgagctgaaaaggcagaagaaagccgaagccgctaagcggaaagccgacagagaggcagcaatagcccatcgcaaggcttctgacatcatcttcttaggccgcggggtcagcggaggcttagcagatcgccggtcccacgttgaaaaactgcaggaagcgaagttgccggtcctttccacaccagccgaggtcgctactgcccttgagctccctgtcaaacgccttaggtggctggcattccatgcggaggtcgccgtggtcacacactacatccgttttcagattcctaaaaagtctggcggggtacgagagcttgctgcacctcacgctgacttggcgagggctcaacgttggatactccaaaacattctcgagcgagtgcccgtgtctggagttgcccacggtttcgtgaaaggaaggggaacccttaccaatgcgcgaagccacaccgggaaggacgtcgtgttgaacgccgatttgaaagacttctttccttcaattaccctgccgcgcgtgcggggaatttttcaacagctggggtatagtccatcggttgccacagtgttggctctcatctgcaccgagtgtcccagacgcacggtggagtacgacggccagacgttccatgttgcaacaggcccacgagcactgccccaaggtgcgtgtacatcacccgccctgtctaacctgtgcgctcgcaagctggatctgcgttttgccgcactcgcggctaagcacggctggacatacactcggtatgcagacgatctgaccttctccaccgacgatgaagccgctaaggccactgcactaatcctgagtcgactgcatcacatcgtgaaagacgaacatttcgaggttaacgaggccaagacccggatccagagacggaatgctcagcagagtgtaactggagtcgtggtgaatgatcattgcaacgtgcctagaaagactagaaggcagctgagggccattctgcaccaagccgccaagacgagcattccagctcaaaatcgtattggacacgacaactttacaggatgggtgtccgggatgctgggttatgtcaagatgatcaatccacagcagggcgaaaaactcttcaaggcctgggatatgttgggcgagaagaggccctga

SEQ ID NO: 13774 - RNA, 1599 nt, unidentified
  source 1..1599: mol_type = other RNA; note = synthetic construct
atgtttagatggctcctcaatttcctggggctggctccaaatccacgacccacggccaggcagcggacaatcgctgactcatggacagccgaaaggacgtccgccgctcctcagtctacacccgctcggtccgttagcgcccaaaagaagcaaactagtgctagccccgaggcactgaatgcggcgcagttcacccccattggcgatagagatcttaaagagcaggcaaaaaacttaggctcagcctggtccaacccgtggttcggaagaagagacatcatcccccctgctgatgacccccgcacacagctcatagacagggctatggtcacacacggtttcttgacgcgggaagagctagccgatatacatgccgtgggcgaggagatgagtgagtaccgacccgatacggtgctagtgagtcacagggccaatcaactggtagctgaagccaccgccgatcgggaggaactcaagcgccagaagaaggcagaagcggaggagaggaaacgccagcgagaggaggaaattgctgagcgcaaacggaccgacatcgtttttctgggcagaggggtgagtaaggggctggcagatcgtagagccaacgtggaagagctgcagaaaaacaacctcccagtcctggcaactcctggcgagcttgctaaggcaatggaattccctataccacggctcagatggctggcatttcacactgtggctgcagaacgggtacactacatttccttcactgtgccaaagaagtctggaggagaacgcgtgctttcagctccgcaccgtgacatggcagctgcacagcgatggatactcgagaatattctggaggcggtgcctgtacatgaagccgcgcatgggttcgtcaggaaaagatccacagtaactaacgcagaaccacacgttggacaggaaatgttagtggggtgtgaccttgaggacttttttccctcgatcaccgtgtttcgcgtgatgggcgtgttcgaacagttgggatattctcccgctgtggccacaatcctggcattgctgtgcacagagtgtccccggcggaaaatgatctacgccggccagaccttttatgccgccactgggccgagggccttaccacaaggagcctgcacctctccagcgctgagcaatttggtctgcaggcgactagacagccgcctcaccggtcttgcaaagcaattcggcgcaaattatacccgttacgcggatgacctgacatttagcggttccggggacgttgccaatatggccggctgggtgattgccaaaattaggcatgtcgtcgctgatgagggcttcaccttgaacagaaagaaaacccgggtccagcggcctaatatgaggcagaccgtgaccggtgtcgtcgttaacgaacgacctggtgttccaaggaagttggtacgtcgcctgagagccatcctccataatgcccagactactggactggccgcacagaacagagaaaaccaccctcactttgagtcttgggtggaggggatggttagctatatccagatggtgaacccgtcacaaggagagcctcttcgcgctgccctggctacaattcgcaactga

SEQ ID NO: 13775 - RNA, 1524 nt, unidentified
  source 1..1524: mol_type = other RNA; note = synthetic construct
atgccgattggagttcagccggaaagcagcggagatgaacggtcggctccagcgccgactaggagaagggagaatctggcggcactgaacgccgaacagtttgcccctctcgaacatgacgaggtgcgggagcaggcggaccagttaggcagtctttgggggaacccttggtttggacgccgagacttaattcctcccgcaagcgatccacgcacccagctcatagatcgagcaatggtgggccagggcttgctcacccccgaagacctcgtggacattcacagaattggagatgctatggacgccgtgcggcctgatctagccttggcggttgcagaagcggatagggccgttacgagatcagccgaagagagggccgccctgaaagctgaaaagaaagcagcggccgcagagagacgcagactccatgcagagcaagtaactcatcgtagggccaccgacatagtctttctcggacgcggggtcagtaagggcctggctgagaggacacccaatgtggccgctcttcaacaggccggtctaccaatccttgccacacccgctgatgtggctgcagctttatccatctctatcccacgcctgcgatggctggccttccatagcgtcgctacgaagaggacccactacgtaagctttaccgtccccaaacggtcagggggtgtgaggactctttcttccccacacagatccttggcacagtgccaagaatggatactgcggaacattctggaccgtattccagtgcacgcagcagctcatgggttcgtgaggggccgttctactctgtccggcgccagaccacacgttggagctgaggtggtgctgaatgtcgatttgaaggatttcttccctacaatcacattcccacgcgttaaaggcgtgtttcagcagctcgggtattcacccgccgccgcaacaatcctagctctgctctgcacagagtgtccacgcagaccagtggagtacgccggcgagaagctgtacgtggctactggagagcgcggactgcctcagggcgcatgtacctccccggcacttagtaatctggtcgtgaggcgaatggacgcccgtctgcaggggattgcccagagattaggctggatctacacaaggtatgccgacgatatgacgctgtctactagtggtgacgccgcacagcggttggcctatgtgatggctcgggtacggcacatcgcgggtgatgaggggttcgcccttcacgcagaaaagactagagttcagcgacctaacgtccggcaatgcgtcaccgggatcgtggtaaacgagcgtgccggtgtacctcgagaaaccgtgcggcgcattcgggccatcctccatagagctcggcacgagggcctggctgctcagaatctggacgggatcccccattttgaaggatggctgagaggaatgatagcttatatccgcatggttaacccccgccaaggcgctcctttgcaacacgccttcgacgagctcatgccccccggtaccgtcaggtga

SEQ ID NO: 13776 - RNA, 1290 nt, unidentified
  source 1..1290: mol_type = other RNA; note = synthetic construct
atgagtgtttgggactcattgcggagactgattgctccaccaaagttgccaaaaacaagtgaggccgatagacacgccatggccgagagctttaaccttcacagaaagaggcccctgcccgcggttcgactgaaagaacagctggatctgagctggttggccagaagacgcactgctcccgcagcggagccgtttggttacctcggagacggcgtgagctatgaactgggtcagcgagtgaccgacgtggagagactgagcagtgctgggctcccggtgcttaaaacgccggaacagctggcagaagccattggcttttctgcccggcgccttcgctggttggcttaccatagggatgcccaggctagttgtcactacatacatttcatcgtggagaagaagtccggcggagtacgatccattgccgcgcccaggcctcaaatcgcagcctgttgcagatggatcgaccgcgaaatcctacggcttattcctccacacgatgcagctcatggatttgtgcttggacggtccacgacaactgccgcccagcctcatgtcgggcaagacgtcatagtgaacatggacctgtctgactttttccccacgatcaccttccccagggtacggggttggttcgcatccctcgggtattctcgacagacagcgaccgtcctagccttgctgtgtactgaaagcccacggacccctatcgacatggacacatcaaatgttaatgcctcctctatagacactgtcaatcactcacgtctgtggctcgctaccgggcccagacagctacctcagggggcatgcacttctcctgccatcagcaacctcgtctgccgaagcatggacaggcgcttaaccgggctgtgcgaaaaactcggctggacctatacaaggtacgcagatgatttatcattctccaccagtggcaaagatgattcgcagattgggtacttaatgcaccgcgtcggcggaatcgtgcgggatgagaggtttgctatcaacgattctaaaactcgggtgcaacgccgctccggacgtcaaaccgtgaccggtctggttgtgaacgatcgtataggggtgcctagggagacagtaagacagcttagatcaattctgcatcacgcaaagactgagggcctggaggcccaaaatcgtgaaggccacgctgacttcctcggctgggtcacaggaatgattggatatgttggtttcgtggacccagctaagggcgagaggctgcggagccagctggatcaggtactcaagcaggagacaacctga

SEQ ID NO: 13777 - RNA, 1227 nt, unidentified
  source 1..1227: mol_type = other RNA; note = synthetic construct
atgtgggacagactcaagagactctttagtggcagcgctaagagcccaagacgaagtgccgcccagtttaacacacggcggggtaaccaatccgacgagcgagttcttccttactggtcacagcgtactccactggccgattccgctgaagcccgcttttcttatcttggaaacggggtcagtcacgaggcagcagatctggccaccgacgccgagctgctcaagaaactggagttaccagtggtcgagactggaaatcagctcgctgaggccatcggcttctcgccgaagaggcttaagaggttggcggtacattctgctcagactcgctcttgcaactatttctattttaccgtgcccaagagatctggcggtgagcggctgcttgcagcaccacgacctcagatcgacgcctgttgccggtggatattacgcgaaatcctggacaagatctcaatacaccctgccgcccacggctttgccaaaggaaagtctataaaatccaatgcggaaattcacacccaacagcaggtgatcgttaatctggatctcctggatttcttccccgctattgagttccgccgggttaggggcctgttcgagagcctcggatacaatgggcaaattgccactctgctagctttgctcaccacagaggcatctcgggaacccgtcccgtcaccagccggaacactatgggctgcgaccggccctaggcatttaccccaaggggcatgctccagccccagcatttccaaccttatctgtagggctctggacaggaggctgagcggcctgtgtagatcattgtcctggaactactcccgctatgcggacgatctaacatttagcgcatccgccgtggcaggacagagggtaggctacatgctgcaccgtattcggggcattgtacgagaagagggattccaggtcaacgaatcaaaaacaagagtgcagcgaccttcgcaagctcagacggttacggggctggtcgtgaatgacggtgtttctgtgagccggagtaccgtgagaatgttgcgcgccatcctccacaacgcttcattgcatgggctcgaaagccaaaatcgcgataaccatcctcacttcgcagcctggctggagggtatgatcgggcatgtggtcaatgtggatccccagcacggggtgaaacttcagagacagtttcgtcagctgaaaaagcagcaggtgagtcacaatcatgaatga

SEQ ID NO: 13778 - RNA, 966 nt, unidentified
  source 1..966: mol_type = other RNA; note = synthetic construct
ctcccagtgctggctactcctgccgatgttgcacggtggctggacctctccatcccacgcctgcgatggctggccttccatagcgactccacaaccgttagccattacgtcttctttacagtcccaaaaaagactggcggcgtacggagacttagtgctccccatgctggaatggctgcggcacagagaaagatcttccaggagatactccctcgtcttcgcatacacgatgctgcccacggctttgtcacgggccggagtatcagatcaaacgccactccgcacgtgggagcccatgtggtggtgaaccttgacctcaaggacttctttcccagcatcacttttccgcgtatccgaggtttactcactgctgcgggctactctccttgcgcgtcatcgattctggcgctgctatgctccgaatccccccggcaagtactaggtctggggggtcaaaggctgttcgttgcaaccggaccacgcgctttgccccagggagcatgtacatctcctgggttggccaatttggcagcccgcatactggatgctcgacttgccggcttagtcgccgcctggggatggacatatacaagatacgctgatgatctgactttttctacccagaacgcccaagcagacatcggcaggttgttaaccgctgtgaggaatattgtggcagacgagggtttcacggtgaatgaggagaaaacccaggttcagcgccgaagccaggcacaggaggtgacagggctggtcgtaaaccagcgggccaaagcaccacgtgaactcattaggaggattcgggccatcctgcacagagctgaaagagaagggctcgccgcccaaaatagggagggccaccgggattttgcagcctggctggggggaatgattgcttatattgccatgaccgaccccgctaccgcagccagatatagggcgcagctggaacgcgtgcctaggtga

SEQ ID NO: 13779 - RNA, 1809 nt, unidentified
  source 1..1809: mol_type = other RNA; note = synthetic construct
atgctgttgagtagccggctgttctttcctttagacgtgagctctcagaagtactttttctacttaccagaattcagggagtgggtggtcatgtcatttttcgactggctgcaaaaattgtttggttccgccagtcctgaagagcagcggcccataccaccccgtaagagtccagaagaccctaacccagttgcgacgccggaacctcaacctagccccaccactgaaacattgaagccatctaaggttgccgaccccccagctcgcgtctctaagactgctcgggccgtgaaaatcacagagcaagaagaaccccccaaaccacccgtttcgagcgtgtctggggacgcacttgctatgggggagctggcgccactctccctggatgaagctaaaagcgaggctaaggcgagcaatatttcctggcgtatgtccgggggctgggataggagggatcggatcccctccctggagaaccctcggactagcctgatcgatcgagctatgatcggccacggccttattactgccgaggaactggaggagattcatcgcgtaggggcagagatggatgagctgaggccactcagggaacacgcccttgagctggccagacagcaggtggctgctgaggaacaggacaaacagaagatcaaagaggagaagaaaaaggaagccgctcgcagagctgccgtgagacaagcagaaatagagctcgcaaaaaaaacagatattgtctacctgggtcggggagtctctcaaggcctagcaaacaggcagagcaaccgagagcagcttgaccagttgcagcttcctttcctggatcacccggacgagctcgcaaaaatcctcgaagttgaaatccctcaactgagatggcttacatttcataatgaggccgccgaacggacacactacctgcagtttgaaattcccaagaagtcaggaggctcgagaattctcagcgcccctcaccaggccctctcaaaaactcagcagtgggtattgacaaatatcctccaaaaattacccacccatgaagctgcccatggcttcgtccctggaagatctaccgtgactcacgccaaccttcacgtgggatgtgacctggtcgcccaaatggacctggcggatttctttccctccatcaccttcccgagagtgcgcgggcttttcgagagttttggttattcaccggcaattgctacaatactggctctcctgtgcaccgaggctccaaggcgcaccattgagctatctggcaagaggtattatgtggcggaaggcccccgcagtctaccacaaggggcttgcacctcacctgcactatccaacctgatcgccagaaagctggatgcccgactgaccggtatgtctcagaagattggctggacgtactcccggtatgccgacgacctgaccttctcatggaaaggctccgccggtgagaatggaaaacagcccaactatggatacctgctctcacaggtgctcgcgataatcgatgaggagacattcgccttgaatgaacagaagactagaatacagaggccgagccagcgtcagcaagtcacgggcatcgtggtaaatgaccggccaggagtaccccgcccagttgttcgacgcttacgagccattttgcaccaggcacagaagaccgggttagcagcacagaatagggagaatcatccccattttgccggttgggtgcaaggaatgatcgcatacatcagtatggtgcagcctgagaaggggaagcagctccaggccgcatttgagcaggtccctaaggacgatgctgtgaactga

SEQ ID NO: 13780 - RNA, 1692 nt, unidentified
  source 1..1692: mol_type = other RNA; note = synthetic construct
atgggcctgtgggataaggtgaagactctcctgggactcggcgatggagcacagcaaccaggtgccggagaagatgctggagggggtcaagggtcctctccagcagcccctgctcaacccgcaaggccagctgctgctcaaggcagtgctaagcctgcagcagcccaaccccctgcagcagtgcagcagtttagcgctgctcctgcccctgcagctgcacagaggcctgctaaacagcgccagaagcccacagatccttacgacgctaaaggcattctggggctcagcgcagacgaggtgagaaagagagccctcaaaatcaacccatataagactgcgtggatcggcagggtcgataccattccaccccagtctgacgaaaggactgccctcatcgatcgcggactcatcctgcgcggcctgctgactgaggctcagattgctgaaattcacagggtcggcgacatttggcttaagcaccacgaggctgccagactggcgggaacagtagccgccaagaccgccgagaaggcaattgccgacatcaagcgcgagaaagaggccaggaaagccgagaaaaagcgtctggctgccgagcgtagagagagacgagcggccgaaattgcccggaggagagccgaggacatcatatacctcggccgcggagttagtgccggactagcggacaggagggctcacgtggaggctttagaggaacgggggctccctgttttgtccacacccggggatgtggccagagctcttggtctgactatctcacaactgcggtggctggccttccatggggatgccgtcgaacgcccgcattacgtttattttgaagtgccaaagcggtcagggggcaaacgactcctgagctcccctcatcggtccttagccgcagcccaggcatggatactgcacgacatcctggaaaggcttcccgtggaagcccccgcacatgggttcgtccagggcagatctacggttactaacgcccgaccccacattggacgcgatgtggtagtgaatttggacctgtcagacttttttcccaccatcacattcccaagggtgagaggggtgtttcagcggcttggatacagcccagctgccgcgaccgtgttagccttgctatgcacggagcccccacgtcgggaactagagtatgacgggcagcgctactgggtagcagtcggcgaacgtggcttaccccagggtgcatgcacatctcccgccctgtcgaaccaggtagcgaggaagctcgatcggagacttgccgggatgtgtaaaaaacacgggttcgagtacacccgctatgccgacgatcttaccttcagtgccccgcctggtaagagagcggagataccgatgcttttggcgcgagtgcggcacatcgtcacagaggagggattcgcgatcaatcctaaaaagggccggattcaacgagccgccggtcgacaggaagttaccggcatcgttgtgaatgataagctgggtatgccacgtgaagaagtccgccgactgcgggctatcttgcatgctgccaagaaaaccggattggcagcacagaacagggagggcctgccagactttgaggcccatattcggggcaaactcgcttatctgcagatgatagaccgccagagagcagctccgcttttggccgctctggacgcgctggcaggttga

SEQ ID NO: 13781 - RNA, 1626 nt, unidentified
  source 1..1626: mol_type = other RNA; note = synthetic construct
atgggcttctgggacaagttgaagtccatgctaggcctaggcggcgccgaacaaggggaaagatcccctggtggagtggaagccgaacaggcgcaaggagcccaagcaggacctgctgcagctacacaaccggctgcacgggccggtcaacccagagtagctgcaggggccaaaccaaggccagctgatccttacgatgccggaggcattctcgggctgagcgccgatgaattgcgccggagagctttgaaaattaacccctatcagaccgcctggatcggccgcgtggacacaatccctccccagagcgatgagagaacagcccttatcgaccgcggcctggtcctaagggggcttctgacagaggcccagttggcggagatccaccgggttggggatctgtggctccgccataaagacgccgcagccttagccggaaccgttgctgctcgcagcgccgatgaggccatagagcgacttaagcgcgagaagctggcgcgaaaagaggagaaaaggaggcagtccgccgagagaaagcggcagagagcagaggctgtagccagacgcagggccgaagatatcctgttcctcggcaccgatgtatcagcagggctggccgacagacggtcacatgtcgaatctctggctcagagaggcctgccagtgctgtcaaccccagctgacctggcagctgctctcggtgttgccgtaccccggcttcgttggctgtgctttcatggcgaggccgttgaacggccacactacgtctattttgacgtgcccaagcgatctggcggtaccaggcagttggcagctccccacgcaagtcttgcagcagcccaggcctgggtattgagggaaattctcgagaaactgcccgtggaggctccggcccatgggtttgtcaaggggaggagtaccgttactaacgcccgcccccatactagacgggacgtggtcgtgaatctggacttaagcgacttcttccccacaattacttttccaagagtgaggggcgtcttccaccgactcggctacagccctgcagtggccacgctcctggctctgttatgtacggaggcgcctcggcgacctgtggagtatgacggtcagcgctactgggtcgctgttggagacagggccctgcctcaaggggcatgtacatctccagcactatctaaccagatcgcgcgtaagttggatagacggttagcaggaatgtgcgcgcgcgccggtttcacttatacccggtacgctgacgatctcactttctccgcgcctccaggaaagcgcggagatatcgctatgctgcttgcgcgcgtgcgtcacatcgtcgaagaagagggctttgccattaatccggataaaggacggattcagcgagcgggcggcagacaagtggtcactggggtggtggttaatgacaagcccagtgcaccaagggaggaagtgcggaggctccgagcaatactgcacgctgccaagaaaacgggactcgcagcccagaacaggtcgggtgtgccggactttgaggcccaccttaggggaagaatagcctacgtgcagatgattgatcgtgaacgtgctgcccctctgctggctgctctcgacgcactgaccgggtga

SEQ ID NO: 13782 - RNA, 1704 nt, unidentified
  source 1..1704: mol_type = other RNA; note = synthetic construct
atgtcattttggaacaagattaagtccctgctaggtgtgggagctaatgacgagccagccggcgagaagcagagggatgagcccgcagacggtggcgatggacaaagagcccgtactaaacccgttgtgacggcgtcctcttcagtggctgcgaaattttctggggcaagtacaccgagtccacccgcccgaaaacccgctactacccctacgcggccaaaaactaccgccaccaaacagccagctaaagccgcccctccaaactcacctccgacgacaggggtcttgttggggctctccaaggacgagctgaggcagagagcactgaaaatagacccctaccgcactgcctggataggccgggtcgacactattcccccccagtctgatgaacggacagcgttaatagatcgcgggctgattctgcgcggactgctgtctgaagagcagattcaggaaattcaccgcgtgggagatttgtggctacggcatcacgacgctctgagactggcaaccagcaaggccgctaagaccgtggagctcgccttcgagcaaatgaagcgcgaacgtgctgagcgcaaggtacagaagcaacgtgaggccgccgaacgaagacgacggagggtggaagacgttgctcggagaagagccgaagacatcatctttttaggcagcggagtgagctcccgcctggtagacaggcgatcccatatcgaagctctcaccgagcgagggcttcctctcttgagcacgcccgccgatgtggctagagcactggggatctcagtgcctcgccttaggtggctgtgttaccacggcgacgccgtcgaaaggccccactacgtctacttcgaggtccccaagagatctgggggaaagagattgctcagtgctcctcatgcgagccttgcgcaggcacagacctggattctgcgttccatcctcgataagctgccgaccgagaatcctgcccatggattcgtggcaggcaggagcaccgtcacaaatgcccgggagcacctgggtagggatatcgttgtcaaccttgatctgcgagatttctttcccaccataacattccctcgcgccagaggcgtgttccagcgagttgggtattcaccagcggtagctactatcctcgccttactttgcacagagtgtcctcggagagaagtggactatgacggccaaagatactgggttgccattggcgataggggtctaccgcaaggcgcatgcacatctcccgcgctgagtaatcaggtcgcccggaaattggataggaggctcgccggcatggcagctaaacacggttggacttatactcgctacgctgacgacctcaccttctcggcaccaccaggcaaacggagcgggatcccaatgctgctcgctcgtgtccggcatattgtgacagaggaaggctttacattacacccttccaaagggagaatccagcgcgcagcacggcgacaggaagtgacaggaatcgtggtgaacgataagctcagtgtgcctcgggacgagcttagaaggctgagggcaatcctgcacgccgcaaagactaccggtcttgaggcccagaaccgggagcagaggcctgactttgaggcacatattaggggaaagatcgcctatgtagccatggttgacccagaaaaagccgctccactgcgcgccgctcttgatgctttgccccgttga

SEQ ID NO: 13783 - RNA, 1686 nt, unidentified
  source 1..1686: mol_type = other RNA; note = synthetic construct
atgagcttctgggacagggtgaaagcattctttggtgggggcaaaggggagggcactgaagcgccaccatacgatgcaccaactcagagagcccccgcacagagggctgccactaaaggcacaagtggatcaggcaccaaagccagtcaaggcgccgcgactagtacctcacctgcagctagtggagctcctgctgcgagccgccgtaccttcgtaaagtggataacagaggctttctctacagatcccgctgtgaccacacgggccatcatgagcatgtcggctgccgagatcagacgcagagcattgacaataaatccatttcggaccgcctggattgggagagtggacgttatcccacctcagtctgatgaacggaccgccctgattgacaggagcctgattctgctcgggctcctgacagaggagcaaatcgtcgaaattcatcgcgtcggcgacctttggctgaagcatagggaagcgtcccggctggttgcattgtccgcagcccggaatgctgagcaggcccttgcggacctgaaacgggagcgagctgctaggaaagagcagaagcgaagagatgctgtggagaggcgtcggaagagagccgaagcaatagcccgcaggcgggcagaggatatcgtgtatctgggggcaggagtctccgctggcctagctgaccggcgatcacacattgaagccctggcagccagggggctccctcttttagcttctcccgccgacgttgccaaagccctgggagtcagcatctcccgtctccgctggttatgctttcacagcgacgccgtagagcgcccccactatgtgtacttcgagatccccaaacgctctggtggaaagaggctgctggcggctcctcatgcatcattggagcgagcccaacactggatcttgagagagattctcgacaagctccctgtggaaccgcccgcccatggttttgtgaagggcagatccactgtaaccaacgcacgcccgcacgtgggaagagatttggtagtcaacctggatttgagcgactttttccctacgattacgttccccagagtgaggggcgtgttccgtcgcctgggatacagcccagcagtcgctacagtgctggcccttctgtgtactgaaccgccaaggcggccagttgagtatgaggggcaacgaacctgggtggcagtcggggaaaggggtttaccccagggcgccagtacatctcccgccctatccaatcaggtggcacgaaagttggacaggcggcttaccggaatggcagaaaagcacggttggacctacaccagatatgcggacgatctcactttttccgcccctgagggaagaagaggcgatctcgccatgctgatggcccgcgttcgccacatagttactgaagaaggctttgcactcaacccccgtaaggggagagtacagagagcctctggccgccaggaagtgacaggcattgtggttaacgataagcttggggtccctcgggatgaggtgcggaggcttagggccatcctgcacgctgctaaagctacgggactggaggctcagaatcgggaaaagattccacatttcgaagcctacctccgaggtaaaatcgcctacgtcgccatgatcgacccggcgaaggctgctcctctgcatgctgcgttagaggccctatcacgatga

SEQ ID NO: 13784 - RNA, 1722 nt, unidentified
  source 1..1722: mol_type = other RNA; note = synthetic construct
atgggattttgggacaaagtgaaatctttcataggaacaggcaagcccggcgaaggtgagccaggaaagaacgagccagacgataaaccaaaggcagcctccgccagtacaacaagctcatccagttcgagctctacgaagtccacaacgaccggtgcagctaccggctctgcgaccacagctgttgcaacctttactagcactagccccgcgccagctgccaaaaaaaaagacaagcctaagccgaaagacccatacgatacatctggcatactgggtctgagcgccgacgagatgcgaaagcgggcgttgaagatcaatccttatcagactgcttggatcggcagagtcgatacaatccctcctcagtccgacgagaggacggccttgattgaccgcggactgatcctgcgcggtctgctcaccgaagcacagattgaggagattcacagggtcggggacctttggctgaagcataatgaagcaactagcttagcatctactgtcgcccggaaaaaggctgacgaagctatcgaagagttgcggcgacaaaaggcagagcgcaaggccgaaaaaaaaagactggctgccgaaagaaaaaagaaacacgcggaagccgttgccaagcgtcgtgccgaggacattatattcctgggacggggagtcagtggatccctgggtgaccgcagagccaacgtggaatcattgcagaagcagggcttgcccctgctttcgacccctgccgaagtagccaaggcgctgggactacctatacccaggctccgctggttgtgctatcataacgatgctgtggagaagcctcattatgtgtactttgaggtccccaaacgttctggtgggatgcggcttctgagcgctccgcacgaagcactatccaaagcacaacagtggattctccagaatgtgctggcaaagttaagcatcgaagctgaggcccacgggttcgtcaagggcagatccaccgttacaaatgctcgcgctcatctcggccggggtatcgtggtgaatcttgatctgtcagatttctttcccaccatcaccttcgggagagtccgcgggttgttcgaatcaatcgggtacagtccggctgtggcaactatattcgccctcctctgtacagagtcccccagaagaaaggtcgtgtacgatggcactacttactgggtggccgttggtgagaggggactgccacagggggcatgcacatctcccgcaatctcaaatctcgtagcccgaaaactcgataggaggctgaccggcatgacgcggaaaatgggctggacatacaccaggtatgccgacgaccttacctttagtgctgcaaacgaagtggtggacgatgggaaggggggccaaaaaaaggggcggggcgatctgggcattctactcgcccgagtgagacacattgttcaagaagaggggttcgccatcaacccaaagaagggacgtgttcagcacgccggaggacggcaagaagtaaccggcatcgtggtgaacgataaactcggcatgcctagggaggaggtgaggaagctgcgagccatcttacacgcggctaagaaaactgggcttgcggctcagaatcgcgagaacattccacattttgaggcctacctgcagggcaagattgcctatctgaacatggtagatcctgagagagcaatgcagttagctaaagcctttcttgagattcccaggtga

SEQ ID NO: 13785 - RNA, 1701 nt, unidentified
  source 1..1701: mol_type = other RNA; note = synthetic construct
atgggcttttgggataaggtcaagacctttattggtcctgggaagcctggcgagggagaaccgaagaaagatgatcctgctccagcggcaaaacctgcctccactcctgctaccaccagtacgtctgcatcaggaaaaaccgcttcagcttccagcgccgtaggagccgtgtctacgtttaccgcctctactcctgcaaagaccgccgctgccaaaccgaagaaagacaagcctaaggacccatatgacgcctcaggaatcctcgggctgagcgccgacgaattacgtaagcgagccctgaagattgaccccttcagaactgcatggatcggccgcgtggatactatcccaccccagtctgacgagagaacagctctgattgaccgaggtctgatcttaagaggcctgctgtcggaggagcaaatcgaggaaattcatcgggtgggggacctgtggttgaaacaccatgaggccgctaacctcgcctcgacagttgcccgcaagagagcggatgaggcaattgctgagctgaagaaagagaaggctgccaaaaaagcggagaagaaaaggctggccgctgaacgcaagaagaaaagggccgcagacgtagcacggaggaaagcggaggacattatcttcctggggcggggagtctccggcaaactagctgatcgccgcgctaatgtcgaagcactccagaaaaacggtctgccaatactcagtacccccgccgaagtggccaagacactgggattgccgatagggaaacttcgatggctttgccatcacaatgatgctgttactcggccacactacgtgtacttcgaagtgccaaagagatccggaggaacgagacttttgagcgcaccccacgagaatctcgctaaggcccaggagtggatcttcaacaacatcttgcaaaagcttcccacagaaaaccctgcacacggattcgtgaagggcaggagcacagtcaccaatgctaaagagcacgtgggtcagggcatcgtcattaacctggatctaagcgatttctttcccactattggattcggcagagtgagggggctctttgagtccctcggctattctcccgccgtagccactatcttcgctttgttgtgcaccgaacccccccggagaaaagttacgtacgatggtactctgtattgggttgccgtgggagatagggggcttccacagggcgcttgtacctccccagccataagcaatctggtgagtcgcaagcttgaccgacggctgttgggcatgacacgcaagatgggctggacatataccaggtacgcagacgacctgacattctcagccgagatgcaggaaatcgagggcgggaagaagggaaggaaagacctcgggatgctgctggcacgtataaggcacattgtccaggaggaagggtttgcgataaatccgaagaaaggtcgtctccaacatgccggcggccggcaagaagtcacaggcatcgttgtgaacgataagttaagcatgccccgggaggaggtacgacggcttagagccattctgcatcaggcgaaaaaaaccgggctggaagcccagaataaggagaaacgcccacactttgaaagttacctcaaggggaaaatcgcatacttaaacatggtggatcctgacagggcaatgcagctagcgaaggcatatatggaagctggtggtcgttga

SEQ ID NO: 13786 - RNA, 1707 nt, unidentified
  source 1..1707: mol_type = other RNA; note = synthetic construct
atgggcttttgggacaaagttaagactttcctagggaacgagaagcccggagagggcgagcctaagaaagatgatgcccctcccgcagtgaaaggaccggccactcccgcttcatctggaggcgcaaaacccgctcagagcgccaagaatgcagccgcgcctcctcctgtggctacatttactactactcaaccagtgattacacccgccccagcaccagcaacaggtgccaagaaaggcaagccaaaagacccatatgatgcatccggaatcctcggcctgagcgcggaggaactcagaaagagggcactgaagattaatccctacaaaaccgcttggattggacgagtcgataccatcccaccccaatctgacgaacggacagccatcatcgacaggggcctgatcctcagagggcttctctccgaggcccagatagcagagatccaccgtattggggacctttggttacgccaccgcgaagtgacatcgttagcggagagtgtggcaaaacagaaggcaagcgaggtgatcgaagagctgaggcgtcagaaggcggagaggaaggccgaaaaaaaacgcctcgctgctgaacgaaagcagaaacgtgccgaggaaattgctcgccggagggccgaagacatcatttacctgggtaggggtgtttctgccggcctcggagatagacggtcacatatcgaggccctgggtgagcgcggtctgcctttgcttagcacacccgcagatgtcgctaaagccttgcagatccctgttccccggttaagatggctgtgcttccactctgaagctgtcgagaagccccattacgtatatttcgaggtaccgaagagaagcggaggaactcgcctgttgagcgctccccatgaagccctggcgaaggctcaacagtggattcttcacaatatactggagaagctgcccgtggaggaccctgctcacgggttcgtgaagggccgaagtaccgtaacgaatgccagaccacatctgggccagcaggtggtcgtgaacctggacctctcagatttttttcctacggtcacctttcttagggtgcgaggctttttcgaaaagatcgggtatagtccagccgtggccaccatatttgccctgctctgcacagaacctcccagacggcgcgtagtgtacgatgggcagccgtattgggtggcagttggaacccgcggactgcctcaaggggcctgtaccagtccagcaatttccaatggggtgtctaggaaactagacaggaggctgacgggaatgtccaaaaaaatgggctacacatacaccagatatgccgacgatctgaccttctcagccccagcgcctgcaggtgaagacggtgacaaagcccggaacgacatcggcattctccttgcacgcgttcggcatattgttcaggaggaagggttcgccataaacccgaaaaagggccgagtgcagcatgccggtggtcgtcagtccgtcaccgggatcgtcgtgaacgataagctctccgtaccgagagaggaggttagaaagctgagggctatactacacgctgcgaagactaccgggctggctgcccaaaaccgggaaggcatcccacacttcgaggcttacgtccggggcaaggtcgcttatttgcacatggtggatccagagcgggctgctcccttgcttcgagccttagaagcattgggatga

SEQ ID NO: 13787 - RNA, 1650 nt, unidentified
  source 1..1650: mol_type = other RNA; note = synthetic construct
atgggctcgttttggaatcggctaaaagggctctttacgggtggagatacccccggagatgccgctccagctcaagggacaacagctgcgccacctgctggtacagctgctcccagtaccggagctcccgctagtacagccacaccgccacaagcccaagcccctcaagcccctgctgtcaggaacccctacgaggccaacgaggcaatcctgggcctttcacctgaggagttccggaaacgcgccctgaaaattgtcccttggcgtaccgcgtggattgggagggttgataccataccgccccagagtgatgaacgcacggcactcatcgataaaggactgctcctgcgcgggttcttgacccgcgaacagctcgcggaaattcatcgagtgggagacttatggctgaagcatcacgacgctgatcggcttgcccacgcagctgctgccaagaccgcagaagctgcagtggaagcgaggagggcggagagaaagaagagaaaagaggagaagcaacggcagagcgccgaaaggaagcagcagagagcagaggacattgccagacgaaaaagggaggacataattttcttgggacgtggcgtctctagcggccttgctgaccggaggagcaatatcgaggccctgcaggcatccaagctcccagttctgagcagcccagcggacgtagccaaggcactgggcttgtcgatccctcagctgaggtggttgtgctttcatcaggaggccgcagaaaagactcattatcactacttcgaggtgccgaaaagatcaggcggaaaacgcctgctttccgccccccagccaactttgaagcaggcccaggcctggatcctggaaaacatcctggagccccttcccacggaagctccagcacacgggtttataagagggaggtctaccgttagtaatgccgcagcacatctggacagagacgtggtcgtcaacctggatttaaaggacttttttccgactatcacattccgtagggtccgtggtgtgtttcggcgactcggatattctccctctgtgtccaccgtgttggccctgctctgtacagaatcaccaaggcggcaggttgactacgatggcaaacgctattgggtggcagtcgccgaacgcgggttaccacagggtgcgtgtacttcccccgctctttccaatcaggtggccagaaaactggaccggcgcctgcgaggacgaatggctaagctaggctgggagtacactcgttatgcggatgatctgaccttttctgcccctgccggtaaaagagaacaagtgcctttcctgatggccgccgtacggcacgtagcagaggaggagggcttcgcactgaaccccaacaaggggagagttcagagagtggggggccggcagagcgtaactggcattgttgtgaacgaaaagctctcagtgcctcgcgaggaagtgcggaggctacgagccattctacaccaggcaaagactaccgggttggctgcccaaaatagagagaatcggccagatttcgaggcctggctccacggtaagatcgcatacgtgtgcatggtcgacaagcctaaaggcttaaagctccttgaagctttcgaggccctgcgctctggaaaacaggcctccgctggcagctga

SEQ ID NO: 13788 - RNA, 1605 nt, unidentified
  source 1..1605: mol_type = other RNA; note = synthetic construct
atggcaagcttttgggggagagttagggggttctttgggggcggccaacctcccagcgattttgagacttcagccccatctcctggagcttcccccgttcctagagccgctgctcccgcaagtgccgcttcacctgctaaaaacccatacctggcaaatgaggaggtcttgggcctgtcagccgaggagttgaggaagagagctctgaagatcactccatggagaacagcttggatcggccgcaccgatgtcataccaccccagtccgatgagcgcacagcaatcgtggaccggggactggtgctgagagggctgctcacaaaagagcagctcgccgaaatccataccgtgggtgatcagtggctaaagcaccatgaggcaatgtctatggctggagcgcttgcagccaagtccgccgaccaagccgtggaacagcgacgcaaggagaaagcccagagaaaggccgaaaaacagaagttggcacaagagagggcccaggcaagagcggcagaagtggcacggcgaaagaaagaggaggttgccttcctggggcctggagtatccagcggactgtccgaccgacggtctaatattgaagccttagcagccgccggtctgccggtgttatcgacaccggcagacgttgccaaagcactcgaggtgacagtccctgagctgcgatggctctgctttcactctgaagctgccgaacgtacccattaccggactttcgaggttccgaaacggagtggaggggtcaggctgttggctgcgccaaagaagaagctagccaaagcccagggttgggtgctccgcagtatcctggaaaaactgcctaccgagaagccggcccatgggtttgtcaaaggcaggtctatagtgtcaaatgcagctgctcacctgggcagggatgtagtcgtgaacctggacctgaaagacttcttccccactgtaaccttccccaggattcggggggtgttcaaaaaagcgggatacagccccgccgttgccacagtccttgctctgctctgcactgaaagcccacggagagaggtggaatatgaaggccgtcggtactttgtcgctgtaggacctcgggcccttccccaaggtgcgtgtacgtcccccgctctttcaaatcaggtggccagaaagctggatagacgcttacggggcaggatggctaaactcgggttcgaatatacgaggtatgcagatgacctcaccttcagcgctcccccaggtaagcgcgagaaggtcggctttttgaaggccgccgtgaggcacctcgtggaagaagaaggctttaccgtgcaccctgagaaaggctccgttctgagtagcagtcgacggcagcgcgtcactggcattgtggttaacagaaagctgagcgtgccacgggagcaagtacgccgcctacgtgcgatccttcaccaggcgcgaaagaccggcttggccgcacagaacagggagggcaggccaaacttcgaggcatatttacagggaatgattgcctgggtttctatggtggacagagagaagggtcagaatctagcgcgccagcttgccgaactcgtggtcgctggacgtcgtgctgctgggtga

SEQ ID NO: 13789 - RNA, 1608 nt, unidentified
  source 1..1608: mol_type = other RNA; note = synthetic construct
atggaacgcgatggtcgatacctgtacaacccatatagtggtgactcttctgccactgctctgagaaatgcgcctcctgcgcctgctcctgctcctgtaaggactaccgctgcctctacaccagccccctaccagacaccgccaccaccaaggacaataaatgagaacagctacgcggccaatcccgaaattcttggactcagtgccgatgatctgcgtaagagggcactgaaaatcgttccctggcgcacagcctggattgggcgtgtcgatacaatcccaccacaatccgatgagcggaccgcactcatcgacagggggctgatgcttggcgggtacctaaacgaaaagcagctggcagagattcacacggtgggggacttgtggctgcgacatcaggatgcaacccggttagcagaggctgctgcagccgaggctgcagacgatgctatcgaggccctgaaagccgagaaggcccgcctcaaagccgaaaagaagaaagccgctgcagaacgcagggctgctagggctgctgaagtagctcggaggcgggctgaggatattattttcctgggccggggggtgagcaaaggcttacatgacagaaggtcaaatatcgagcggttaaccgagaaggggttgcccgtcatgagcactccggctgacgtcgcggctcagcttggtctaaccgtccccaagctgcgttggctatgctttcactccgacgcagcccagacggtccattatactgctttcgaaatacttaaacgctccggaggcacgcgactcattgcagccccacgacccactctggccaaagcccagacatgggtgctccgcaacctgctggagaagctgcctgtggaagagaatgcccatggattcgtgaagggaaggtccaccgtgactaatgcgcgggcgcacgttggacgtgacgtcgtagtgaacatcgacttgaaggacttttttcctagcataggcttccgcagagtgagaggcgtatttaagagacttggctacagccccgccgtcgcaacggtactggcacttctctgcaccgaggcgcctaggaggaaggtggaatatgatggacacacctactttgtggccgttggtgagcgagccttaccccagggagcctgtacaagtcccgcattgtctaaccaggtggccagaagactcgataaacgcctgagatctcggtcacaaaaagctgggtggacttatacccggtatgccgatgatctgtcattttcagcgcctgcacaaagacctgcagccgcacaactccaggcaatggttcgacacgtggcccaagaagaaggcttggccgtgaaccccaagaagggtcgcgtgttggttcggggcgggagacagcaggttactggtattgttgtgaatcagaaaacatccgtgccacgggcccaagtcaagagactgcgcgccatccttcaccaggccaagaagaccggcctggctgcccagaacagagagcagcacccggacttcaccgcgtggctcaagggaatgatcgcatatgtcacaatggtggacagcgctaaaggccataaactgaaagcagccttcgacgccctcagtccgtcgtga

SEQ ID NO: 13790 - RNA, 1908 nt, unidentified
  source 1..1908: mol_type = other RNA; note = synthetic construct
atggcctctttttgggacaaactaaaaagctggatcggtggggggccatcttctactccacctgacccttctgaagagacttccgatctggctcgtagagtggaggccatcgtcgtgaggcggatgacccgcaaggagagctttgaggctatcgaaatcgctgatgaagccgcatctgccccggaagatcgcacggtcaagggcattgcagcggcttccgccgtggtagcccgcttatacgatgaaggccgattcgagcccctgggctacaccaggaccaagctcgctgacggcaactggctttatcacctgaagggtgctgacttgagcaaacagtccgcaaccgctcctgccgctcgaactaccccacggtcaacagcacctgctaccaggacagccccccaaactacacccgcccaaacgacagccccagtacctgcggcacctgctcccaaagcaaaagacccttacgcagcttccgaaattcttggattgtctgcggacgagatgcgtaagagagcccttcggattaatccatacaagacagcttggattgggcgggtcgacactataccaccccagtcagacgagcggacagcgctgatcgaccgaggactgatcctgcgaggactactgacagagaagcagattaccgagatacacagagtgggagacttatggttaagacaccatgaagctaccaggctggctgcaagtaccgctgccgtagcagccgccaagcaaatggaggatatcgcacgcgaaagggccgagaagaaggcgcagaaaaaacgggaagccattgagagggaagcccggcgggctgaagacgttgcaaggcgaaagcgtgaggatatagtctatctcggtgtaggggtgtccaagggccttgccgaccgcagatcccatgtggaggcactgctcgacaggggtttaccagtgctgtcaactcccgccgatgtggccagagcaatgggcctgacaatcagtgaattgcggttcctctgctttcacgccgaggcagtagaaaagccacactacatttactttgaggtcccaaaacggtccggcggcaaaagactcttggcaagccctcagccccgactggctaaagcccaggcctgggtgctgcatgaggtgctggagaaactgcctactgaagatcccgcgcacggatttatcaagggaagaagtaccgtcacatgcgccatcccgcacgttgggcgagatgtggtggtgaatctcgacctgagcgacttcttccccactataaccttttcaagggtccggggtgtgttcgagcgtctgggctactcgccagcagtggcaaccatcttcgcactcctttgtactgaggccccccggagccttgtcgagttcgaaggaagaagatatcatgcagccgttggtccgagggccctacctcagggagcttgtacgagccccgccctcagcaatcaggttgcccgcaaattagataggcgactggccggcatggcaaagaagcatggatacacctataccagatatgcggatgatctgactttctcagccgacggcaagagtgccacggaccttgggatgctcctagctcgtgtgcgccatgtggttagtgaggaggggtttgccattaaccccaagaaagggaggttgcagcgcgctgcgcggagacaaatggttacaggcgtggttgtgaacgatagaccttcggtcccccgcgaagaagtccgcaggttgagggccatcctgcaccacgccgagaaaacaggcctggcggcgcagaaccgggaaaatgttccacattttgaagctcatctcagggggcgcctcgcttatctgcacatgatagatccggagcgcgctgcccctatgttggctagattcgaggccattgtggcacgtgcttga

SEQ ID NO: 13791 - RNA, 1527 nt, unidentified
  source 1..1527: mol_type = other RNA; note = synthetic construct
atgccgcctccacgaagtaccaaacccagtgctggccaagcccccccaattcaggctgccgctcctcctccgccaaagcctcagccagaggaccctctggctgccgaaattctcgggctcagcgcccaggaactgcggaagagagccattaagatcaacccctatcagaccgcctggattgggcggacagatacgatccctcctcaaaatgatgagcggacagcaattatagatagggggctgatcttgaggggactcctcacacccgaccagattaccgagatccataggattggcgaccaatggttgactcatagagaggccgcaaaaatggcccaaatcctggcagcccgatccgtcgaagaagctctcgcagctagacgcgcagaacgggaagccaaaaaggcccagaaaaaagccgagtccgaggcgcgcaaagctagaataaaggaggaaatcgcgaggcgtaaagcggaggatatcgtttatctaggcgcaggggttagccatcttctgcacgaccgaagatctcatttggaaaccctggaaagcaggggccttcccatactttccacacccgctgatgtggcccgcgcattgaaccttccaattggtaagctccgctggctatgcttccactctgaagcgactgagaagccacactacagatattttgagatccctaaacggtcgggcggtacccggaagatagcggcaccacagccagaactggccaaggcccaggagtggatcttcactcacatactgcaaaagctgcccacagaggacgccgcgcacggttttattcccaatcgcagcactgtaacttgcgccgccccccacgttggtaaggatgtggtaattaaccttgacgtgaaggactttttcccaacaatcacgttcgtccgtgtacggggcgtctttcagaaactgggctattcacccgctgtcgccaccatctttgccctcttatgtacagaggcaccccgggtggagacgtcattcgaaggccagacactgtgggccgcagtgggacctagagcatgtccgcaaggggcctgcaccagtcccgctttgtctaatcaagtggctcgtaagctggaccgcaggttcgtgggcatgtctaagaaacatggatttgtgtacactagatacgcagacgaccttaccttttcagctcctgaagggaagcgggctgagataggaatgctcatggcaagggtccgccacatcttagctgaggagggattcaccttacatcccgataagggaagggtccagagacgacagcaccagcagctagtgactggcattgttgtgaaccagaagctgggactcgatcgtaaacacatccgaaggttgcgcgctatcctgcatgccgcccagaagaccggtctggaggctcagaacagggagaatatcccgcacttcgaagcccacattagagggcacctggcgtacctgcatatggtggctcctgataaagccgcaccactgttacaggcactgaattccctcccaaaatga

SEQ ID NO: 13792 - RNA, 1887 nt, unidentified
  source 1..1887: mol_type = other RNA; note = synthetic construct
atgtccttttggaaaaaagtgaaaggttttttcggcgggggaggcggtgatgaaccaccagaaggactcacagggcacgacccgaaggttgccgctgaggtgatcgccgtcctgagggtcaggtgcgcagctcaaacttccttcgaggcagtggatattgcggacgaagtcacaagagacgatgctagtaggggcgtagcacagattcgggccgcctgtgctattgtggaagcgctgtacgagtccggttggttttccaccttggattatgtgaggaccggggctatttaccatcacacctcgaaggcaccctcctcttatgccccccctagaggcggcagtacattccctccacctgcacctccagcccctagaccagctgcgccaccaaccacgcctacagcgacaaaccccacagctccagcagctcccgcagtacctgccgtggatcccttagctgcagaagccatcctggggctttcacccgaggagttccgcaaacgcgccctcaccattaaaccgtatcaaactgcttggattggccgggtcgacactatacctccccagtcagacgagaggaccgccttaatcgacagaggactgctcctccgtgggctgcttacgcgggagcagctcgaagagatccaccgtatcggcgatcagtggcttctccatcacgaaagcgtgaagttagccgagatcgctgcccaggcaaacgttgaggcttacttgagggccgcaagggaagagaaggccagactaaaagctcagaaaaaggcggagtcagctgagcgagaggctgtgcgtaaggccttggtcgccaaacgccgcgccgaagatatcatctacctggggagaggggtatctggaggattggccgaccgcagagcgattgttgaggagctagagcgtcgcggactgccgcttcttggcagtccagccgatgtagcccgagctctgggcctgacagtgcctcgactcagatggcttgcattccacgccgaggccccaagcaggacacactacgtgtactttgaagtgcccaagcgaactggcggtctgcgacttctatccgccccgcatgacgatctgaagaaggctcagcattggattttggaaaacatcctggcaaagcttcccgttactgatgcggcccacgggtttgtaagcggccgctcagtcgtgagcaatgccgcagcgcatctgtgtcgggacgtcgttgtgaactgcgacctcgagtctttcttcccctctatcacctttgggcgggtcaggggagtgtttgaagctataggctacagccctgccgtcgctactatactggcactgctctgcacagaagctccgcggaccaaagtcacccatgagggcaaaacctattgggttgccgtcggagcccgaggattgcctcagggagctcccacatcgcccgcactcagcaatcaggtggcccggaagttagaccaacgcttaacgggcctcggtaggaaactgggctggtcttataccagatatgcagacgatctgactttcagcgcgggacccggtaaacgggaacagattggttacctgctggcccgcatcagacacatagctcaagacgagggctttgccatgaacagaaagaagactcgggtgcaaagggcagctcggcgacaggaggttacgggtgtggtggtgaatgacaagctgagtctggccagagaggaactgcgtcgcctacgcgccattgttcacggggctcagaaaaccgggctcgcagcacagaatagggaagggcgggaggatttcgaagcgtggctgagaggaaagatcgcttatgtgtctatgatcgacgccgccaagggcgaaaagttgcgggcagctctggatgcagcccctccatga

SEQ ID NO: 13793 - RNA, 1878 nt, unidentified
  source 1..1878: mol_type = other RNA; note = synthetic construct
atgtctttttggaacaaggtaaaacagttctttggagcaggagaagcacctgagggacccgccaagacgggagacgcattgagcgcccatgatgccgcgctcgtgagggaagtgagtgcaatcattcagatcaaatgccagaatggggagctattccaggccgtggatgtggccgaccaaggtgggtacgctgctaagggcattccccagattagggccgcctgcgcagttgtggaggcgttacacgacactggccgctttgacgcactggggtatactcgcacagacgccgtctatcacccggtgggggcttctcctgactcctacgtaagaccacgcgcagctgccctgggatctcctcctgctcctgctccaaggcccgctcctgttgctcagccagcaccagtgtcagccgtaaggcaggctgacgcgaaggaccctcttgacggcggcgacattctaggcctctccgccgaggactttagaaagagagccctcaagattaatccttacagaaccgcgtggatcggccgggtggataccataccaccgcaaagcgatgagagaaccgccttgatcgaccgcggcctgatccttcgaggcatgctcaagccggaacagatcaccgagattcaccgagtgggagacttgtggcttaagcatcatgatgcgatgcgcatcgcggaaatcgccgcccagaagaatgccgatgcttttttggaggcacggagagcggaaaaagccgccctgaaggaacagaaaaaacgtgaagccgacgagagacgggcaaagcggaaggctgagatagctcagaggcgagccaccgatatcgtgttccttgggagaggcgtttcagccgggcttgccgatcgcaggacacatattgaggagctcgctcgtcggggcctcccaatcctgagcacccctcaggacgtggctaaagctctgggactggacgtcccccggctgagatggctggcattccacgcagaggctcccgcacgtacccattatgtgcacttcgaaatacccaaacgttcaggcggtactcgcctgttgtcggcaccgcacgatgacctgaaaaaagcacaacactggattctggagttcatcctctccaagctgcccgttaccgaagcggcccacggttttgtgccaggcaggtctacggttacaaatgctcggatgcatgtcggacgggatgtggtcgtcaactgtgacctcaaggatttcttcccatccattacattcaagcgagtcagaggtgttttcgaagttataggatacagccctgccgtgagcactattctggcactactctgtactgaggcgccaaggacgaaagtagtgcatgaagggcgggagttttgggtcgcagtcggagaacgtgcccttccccaaggtgcccctacttcccccgctctgagtaaccagattgcccgcaaattagatcagaggctcgagggggtgtgcaaaaaaataggttggagctatacccggtacgctgatgacctgactttttctgctgagagtggccagcgggagcggatcggatggttactggcccgagtcagacacatcgcacagaacgagggttttgccttgaacgcaaagaagacaagagtacaaaggaatgcccgcaggcaagatgtgaccggggtcgtggtgaacgataaacccgctacaccacgagaagagattaggagattacgcgctatcctgcatggcgctaagaggacagggctggagggacagaataggcaggggcaccccgccttcgaagcctatgtgcgcggcaagatcgcctacgttagtatgatcgatcgggaaaaaggcgaaaagcttagacgagagctggatgtcataacagggtcatga

SEQ ID NO: 13794 - RNA, 1617 nt, unidentified
  source 1..1617: mol_type = other RNA; note = synthetic construct
atgggattttgggacaaggtgaaagccttctttgtcggcccacctgcagagccaagcgtggcagatgatgactcagaatccggttcctcacctcctcctgctaaaggcagtaggagcagtacacaggccccaagggctccttctcgggctgcagaatccgcccctccacaatcagctgattcctttgccgcgggggaaatcttgggcctctccgcaaaggacatgcgcgcaagggcattgaagataaatccgtatcacaccgcctggattggtaggattgacactatcccgcctcaaagcgatgaacgcaccgccctgattgacagggggttaatcctgcggggcctcctgagtaaaagccagatcgacgagatccaccgagttggagacatctggctgagacaccacgatgccgcaaaactcgctgaggccgtggcggctgctaaagctcagagggctgtcgacgatatgcgcgccaggaaagccgaggaaaaaagacgtaagaaagaggaagcggcccaacgaaaggccctcagggcagaacaggtccagcggagacgggaggaggacattgtgttcctcgggcgcaacgtaagtgcgtcattagctgaccgccggagtcatgtggaaaagctgagcgaagccggcttgccgttgcttgccaccccaagcgacgttgccaaggccttgggtattaccatcagacagctccgctggctttgtttccatgccgaggctgctctcaagtcacactatgtgtattttgagataccaaaacgcaccggcggaactagacttcttgcagcgccccacaggcatctggcccaagcacagcgctgggttctagacaatatcctgcgccgcatatctcccagcgaacccgcgcacggatttgtcgctcagcggtctacagttaccgcagctgccccccatgtgggaatggatgtggtagtcaatctggatctgaaggattttttccccacaattacgttcccaagggtgcggggactattcaagtccatggggtactctcccgcctcggccactgtactcgctctgctgtgcactgaatgccctcggacccccgtggatcatgagggcttgcgttattgggtcgctgcaggagagcgcgcattacctcagggggcctgtacttcgccagcaatctccaacctcgtgggtcgaaaactggaccggaggctggtgggcatgtctacaaagatggggtggcattacacacggtacgccgatgacctgacattcagcgctccagcagggcacagagaagcgatcggtatactgctggcacgagttaggcacattctacaggaggaaggctttcagttacaccccagaaagcagcatattcaaagagccgccagacgacaacaggtgacgggcatagtcgtgaaccacaagctagctgtgccccgtgaggaggtaagacgactgcgtgcaatcctgcataacgccagacggaccggactggccgctcagaatcgggatgacatcccccacttcgagtcttggctgcagggtaagattgcgtacgttcagatggtcgatgctgagcttgggcgtaaactcgccgagcagtacagagcccttactggctga

SEQ ID NO: 13795 - RNA, 1590 nt, unidentified
  source 1..1590: mol_type = other RNA; note = synthetic construct
atgggcgtgtgggagaagctgaaaggcctgtttagtcggccaccgccacctcctagtggtccaggtgggcctgctacaccatccagcgccagtagcttatctagcccctccaacctgtctggagctggagcaagtggagcgcccgcgtctgacccttatcaggcctcggcaatcctgggcctctcctatgacgaaatgcgaaagcgagcaatgaaaatcgaccctatgagaactgcctggataggccgagtggatacaattcccccacagagcgatgagcgcactgctctgatcgacagaggactcatacttcggggattcctgacaaaagaacagatcggggagatccacagagtcggggatttgtggctccgttttcatgaagctgatagacttgcaaccacggtagcccaacgggaagccggcgaacttatgaagaacctcgccgaagagaaggccaaaaagaaagaagagaaaaagcggttggctgctgaaaggagggctgcccggcagcaggcaatcgaaaagaggagaagagaggatatcatatacctcggcgctggagtctcaagcggactgcgcgaccggagatccaatctggagcggctaaatggtgcggggttgcctgtgctgtcaacaccggccgatgtggctgcagcccttgacgtatccatcggcagactgcggtggctctgctaccacagtgacgcagccgagcgactacattacgtgcgttttaccattccaaaaaggagcggtggccaaagagccattgcggctcccctacctgatttgaagcgggcccaggcctggattctggagtccgtgctcgaaaagctggaggtggagcccgaggcgcatggtttcgttgcaggcagaagcactctgactaatgcaacaccccacctgaagagggaggtcattataaacctggacctggcggatttcttccccagcattgggtttaggcgcgtgcgcggggtctttgaggcaattggctactctcctgccgtagccaccatcttcgcactgttatcaaccgaggctccccggatggaagtcgattacgacggccagaagctgcaggttgctgttggagagagggcactcccccaaggcgcacctacctctccagccctttccaatcgcgtggcccgtaaattggataggcgcctcaggggtatggccactaaacatggctggacatatactcgctacgctgacgacttaaccttctcagccccaacggggcaccaaggtgaggtgcctatcatgcaggcgcgtatccggcatattgtaggggaggaggggttcgctgtgaacctgaaaaagggacgagtccagcgtaggtcagggcgccaggaagtcaccggcgttgtggtgaatgaccggcccggactcccgagaaccgaagttcgcaagttacgagcaatattgcaccaggcaaaaaaaacgggcctggctgcccagaaccgccaatctcacccaagatttgaggcctggctgaggggcaagattgcctatttgatgatgatcgatccggctaggggaaaggctatggccgccgaacttgacgcccttgtggggtga

SEQ ID NO: 13796 - RNA, 1980 nt, unidentified
  source 1..1980: mol_type = other RNA; note = synthetic construct
atggccgggctgtgggaccgcattcgtgccttcttccgttccggccgtggaggagatgctgacgcccagatagaacaggcagtgagagtggccctcgtcaggagagtcagcggtcggtcagtgtttactccgttagagctggcatacgacatcgtaccaagagaggatcgttctgacgaagtgatagaagcaattgcaacagctctggatcggctctacgtacgcgcttactttggacctttcaattatgctcggagcatcgatcccaagtccgcctacagatatgtctatcatcccgccgggacaagagtaccagggacaacccctgataccactagggttagagccgaaccggaaagtgagcccccccctccaccagcaccaacaaggagtacccgcgcctccacagtgtctggcagtacccgagcacctacgagcgtgagctctaggggaggaagcactgcccggggtgcttctacaacaacaagcggtagaggggctccttcttctgccagaggcgcgtatcgcacagccgctgacccctacgctaggcctgagattctgacattgagcgccgaagagttgcgagccagggccgtgaaaatagacccgtacaaaaccgcatggatcggccgcgtggatacgattcccccccagagtgatgaacggactgctatcatcgataggggtctaattcttcgcgggctgttatcagaggcccagattaccgagatccatagagttggcgatctgtggctccgacattccgaagctgcaaggctcgctgccacgactgctgctaagaccgccgaagatgccgtacgccagatgcgagaggaaaaagtgcgtaaaaaggcgcagaaaattaaggaagctgccgaaaagaagagaagatacgctgaaggcgtggcgaaacggagggcgaccgatataatttttctggggcggggcgtttcgtccaaactgggggacagacggagtgatatcgagaagctggacgcgcagggcctgccagttttgtcgacccccaaggacgtcgcagacgcccttcggaccaccatcagcgaactaagatggctggctttccattccgacgcggccgaacgaactcattacgttacttttaccattcctaaaaggtctggagggaccagatcactatccgcaccccacgagaagcttgcaagggcgcaaaagtgggtcctcgagcacgtgctggccaaattaccgaccgagatccctgcgcacggctttatccgcgggcactcaacagtaactaacgccctgccacacgtcaagcgcgacgtggtcgtcaacttggacctgaaggatttcttccctactgtgtcatttgcccgagtaaggggagtcctggagaaggtgggctacagccccgcagtggctaccgttctcggactcctctgcactgagagccctcgacagatcataacgtacgctgacaaaccctatcacgttgcccttggccctagggcattgccccaaggggcctgtacttcccctgccctttcaaatcaagttgcccgccggctcgatcgaaggctgagtggtctgtgcgcaaaaatgggatggacatatacccggtatgcagatgacctgaccctttctgcagacgagggtcaccggggagagctcccagtgttgatcgctaaggtccgtgagattgtggaggacgagggtttcaaaatcaacccaaaaaaggggcgcgtccagcggaaatcagccagacagacggtgacaggagttgtcgtgaatgaccacccaaccgtgccccgcgatgagtataagaggttacgggccatcctgcatagggctaagtttacaggccttgacgcacaaaacaaggaggcgcgcccacacttcgacaagtgggtggaaggcaagattgcttacatttccatggtggatgctactaaaggcgcacggctgaaagccgccttcgacgcaatcccgaagacttga

SEQ ID NO: 13797 - RNA, 1836 nt, unidentified
  source 1..1836: mol_type = other RNA; note = synthetic construct
atgtctttctggaaaaaagtcgtggattttttcaccggcgggcccacatccattgagacatccgcagttggcactagcggttcccctctggaagccgccatctggtctgctataaagtccaggatggccaagggcgagtccttcaccccaatcgacgtggtagatgacgcaacttcttcaacacccggacgcaccgtgaagacaattaccgatgggattgctttcgttgacgctttttttgccagaggcctctttgccccgcacgggtacactcggacactgacctcaacgcccagcggacagaactggctgtaccatccggcatcatcggccccgcttgttgcaatgccggcgattgtcgctcaacccgccttgaaggccagcgctcctgccattgatccttatgatgtgggtagtctcctgacacttacccccgcggaactgcgcactcgagcgcttaaaatcgtgccttggaggacagcctggatcgggagaacggatgtgattccccctgagagtgacgaacgtactgctctgatcgatcgcggactggaactccgcggcctcctaacaagggcccagttggtggagatccaccgcgtgggcgacgaatggctgaaacacaaggatgcccctaggttggctcagtctagggccgccaaaaatgcagaagaggcggttgcacagttaagggcagagcgagcacggactaaagaggagaagcgcgcagcttccgaggctcgtaaaaaagctagagctgagcggattgccaggcggaagcgggaagacattgtctatctaggccgcggggtcagtgcacttcttggcgacagacgtgcccatgtagaaaagctgaacgctctgggactaccagtaatggcgtccccagccgatgtggccaccgctttgggagttactatccctgctttacgattcctgtgcttccatgccgaagccgctagacgggcccactacgtgcagtttgatgtgcccaagcgcagtggaggtgtccgcagactgtcagcccctatgccacgtcttgccgctgcacagcaatgggtgctggagcacgtgctggagaagctgcctgttgaaagaccagctcatggcttcgtgccaggtagaagcacggtaactaacgcaagagagcacgtcggcagagacatagtcatcaatctggacctggagtctttttttcccagcattactttccctcgagtgcgggggctgtttgtcggtgtgggctactctccagccgtggccaccatcctcgccttgctctgtactgagagtgcaaggacccgggctgagtatgacggagctaagtacgacgtggctaccgggccaagagccttaccccagggcgcatgcacaagccccgccattagcaatcaaattgccagaaaactcgatcagcgcctcagaggattggcagttgcgcgggggtggacgtacaccaggtatgccgacgacctgacattttcagcgcccgaaggtaagcgaagcgaaatcgcgcggctgatagcacgcatcaggcatgtcgtggaggaagaggggttcaggatccaggtcaaaaagggcagggtacagcgggcagggggtagacaaaccgtaaccggaatagttgtcaatgagacacacaaactcggcgtgccacgcgaagatgtgcggatgctccgagccatcctacacaacgcgaagaaaaccgggctggctgctcagaaccgggatgcaaagccagacttcgaggcctggttgaggggaaagatcgcatatgtgcagatgatagacagggcccgtggagacgctttactgcgagcacttgatgccctctga

SEQ ID NO: 13798 - RNA, 1596 nt, unidentified
  source 1..1596: mol_type = other RNA; note = synthetic construct
atggggctgtgggattctgtgaagcggctgtttggcggtggtgatgccgccagcccagatgagggtaaggaggaacgggaggaaagaggtggtggctccgctgctagaggaggggtgtatcgcagtgccccggagagaggagagcctgatgcaatcgacccctatggtaaaagccccgtgatgggatactccgaggatgacgtaagagcacggttcttcgctctgcgccgtggcggaatctctccctttttccaccccgaccttctgccggcacctgatgatgagtttacccagttggttgacaggtcactcgtgctggcagggctcctgactcaagaagaactggaggctattcatagaacaggcctggagtggcggaagcataggcatcgagctgaccacgctcgcatcgtgggaaaagccgcagcaggggaagccgtggaaatcctgaaacaggagcgggccgagaacgcaaaacggaaaaaagccgaagctcgcgcacggcgtgaagcacgaagacaggctatagagcagcgcaaacgggaagatattattcatctgggccgcggcgtctctaatcgactcggcgaccgcagatcccacgtggagaagttgcaggctgcggggcttcctgtgttgtctgggcctgcagacatagccgttgcgctcggaattacaatcggccagctaaggtggctttgttttcacgatgaagccagccgtaccagtcactaccaccaatttacggttccaaaaaggtcaggcggagttcgggtcttagcggctccaatgcctcatctgaagcgtgcccagactttcgtgttcgataacattcttagaaagctggaggtcgaagagcctgcccacgggttcatacggggaaggagcaccgtgacaaatgcgcgacctcatgtcggccaggacgtcgtggtaaatttggacttagagggatactttccaagcgttactttccccagagtacggggcgtgttcgaacacctcgggtattcacccgccgctgctactatcttagccctgctgtgtacagagtgtgagagacggccaatgcgatacgctggccagcgttatcatgtagccatcggagacaggggacttccccagggagcgtgcacttcgccagctctggccaaccaggtcactaagaggctcgacaggagactggccggactctgcagagccttcgggtggcagtacacgcgctacgccgacgacttaacattctccgcaccggccgggaagcgagcagaaattcccaaactattgggcgccgtgaaaaggctgatcaccgaggagggctttacccttaatcctaagaaggggcgcatccaaagaagaggcggctgccaggaagtgaccgggatcgtggtcaacgacaagttaggcctcgcccgcaccgaagttcgaaagttgagggctattctgcacaacgctcgcaagacaggtctggaggcgcaaaatcgggagggtcgcccacactttagggcctggctacaagggaagcttgcctatctggcaatgatagatagggataaaggcaccgccatgctgagggaactcgaggaactccccagttga

SEQ ID NO: 13799 - RNA, 1722 nt, unidentified
  source 1..1722: mol_type = other RNA; note = synthetic construct
atgttcgggccacacggctatacccgaactctcctgcaaaccccagcgggcaccaactgggtatatcatcctaagtcttcagcccctgcagctgtggcaccggttccaggagcagctgctgtcgcacccaggcctgcaacagctagtagcgcaggaacagttcgtgggcccctggtccctcaaggatcacggcttcctgcctcagtcacagctcatacggcctctggcggtgcccctgcaaaagatccatatgacctcggagtgtttctgaccctgacgcctgctgaacacagggctaggtccttgaaaatcaacccctatcagacggcctggattggacgtgtcgacgtgatccctccagagtccgacgagcggactgcactcatcgatagaggtctggagctgagagggctgttgactcgccccgagattgttgagatccaccggatcggcgacctttggctaaaacataaagacgcggctaggcttgccgagtctattgcgcacaaaaatgtggaagaactcctcgcgcaggaacggatcgccagacagctggctaagacgaaaaaaaaggaagagtctgccgccaagcggacccgagaagcagaggatgtgcagcggcgcaagcgagaggacatcgtgtacctaggaaggtccggtttagctaggaatgtcagtaaaggcctgtcggatcgtagaagcaacatcgagaagctcgccgccaggggtttacccaggttaagcagcccagccgatgttgcacgtgcactagagctggagattaagaccttgcgctttctggcttttcacgcagacgcccaaagacatgctcactacgtccagttcgaagttcccaaaaagaagggtggcactcgcaccctgtctgccccaaagccgcagcttgcgaaggcccagaagtggatactcgaggaagtgctggagaaactgccggtcgaccccgtcgcccatggttttgtcaaggagcgcagcacagtgactaatgctcggccacacgccggcaaagccatagtgattaatcaggatctggttgacttctttcccacaatcaacttcgccagagtgcgcagcgtgttccaacgggctggatatagtcccgccgttgctaccattttcgcgctgcttacaaccgagtgtccaagaattcaggctacctacgcaggccacacttactacgtagctactggacagcgcggcttgcctcagggagcatgcacctccccggccttgtccaacctggtggctagccgactagatcgccggttaactgggtatacctcaaaacatggctggacatacacacgctacgctgatgatctgaccttttctagcgccgaagaagctgaacccgggtcaccatccggagtggccaagctcctcgccacactccaccatatagcacgcgccgaggggttcactatacatcccgacaaggggaggattcagagaaagagtaaaagacagaccgtaaccgggatcgtggtgaatgaggcacacaagttgggggtacccagggaagacatacggcttgtgcgagccatcttacacaacgccaaaaagactggccttgcggcacaaaatcgggatctgtcccctacatttgaagcctggctgaggggcaagatcgcctacattacaatggtggacagagccagaggcctggcgttcagtgaggaattggagcacctggatctcgggcgatga

SEQ ID NO: 13800 - RNA, 1701 nt, unidentified
  source 1..1701: mol_type = other RNA; note = synthetic construct
atgtttggaccccacggctatacccggacactcttgcagacccccgctggcactaattggatttatcaccctaaggcacaggctccaacggccttggcacccgtggtcaaagctgcagcagcggctccggttcctgtagccgctaagggaccccttgttccccaggggtcgaggctgccttcatctgttacaggacacaccgcaagcgctggccccgttaaagacccttatgacctcggagtgtttctgacattgactcctgccgagcatagagccagagcccttaaaatcaacccctaccaaaccgcctggattggacgaacagatgtgattccaccagaaagtgacgaaagaaccgccctgattgaccgcggactggaattaaggggcttcctctctcgggccgagattgttgagatccatcgcgtgggggacctatggctgaggcataaggatgccgcaaggctaactgagtccatcgctcacaaaaatgtcgaggccctcctggcacaagaaagattggctaagcagctggagaaggcacgtaaaaaagatatggccgcagccgccagggccaaacatgcagatgatgtggcccgcagacgccgggaagacatcgtgtacctcgggagatctggtcttgccccgggcctctcgaaaggcttagccgatcggcggtccaatatcgaaaggctcgctagccaggccctaccacgcctctcatcccctgctgatgtggctcgggcactggagatcgacgtgaaaaagctgaggttcctggctttccatgcagacgcgcaaagacacgtccactatgtgcagttcgaagtaccaaaaaagaagggtgggatgcggaccctgtccgctccaaaggccgagttagcaaaggcccagcaatggatactggacaacgtgttggagagactgagcgtcgagaagcaagcccacggcttcgtgaaagggcgcagcaccgtgacaaacgctcagccacatcagggcaaggcgatagtggttaaccaggaccttgtcgatttttttcccagtatcacgctgcgaagagtcagggccgtgttcgagcgtgctgggtactctcctgccgtggctaccatctttgctctactgactactgagtgtccgcgtacacgcgccacttacgctgggcacgaatatcacgtggccgtaggtccacgcggtcttcctcagggagcctgcacaagtcccgctctctccaatctcgtcgccagccggttagaccgaaggctgcagggctatacacaaaaacacgggtggacctacaccaggtacgcagatgacttgactttttcctgcgatcttgaaccggcggctgacagcggcaatgatatcgcaaaactccttgcgacgctccaccatgtcgcccgctctgaaggtttcacggttcaccccgacaagggacgcatccagcggaagtcaaagagacagactgtaaccggcatcgtagtgaatgaagccagtaagctgggcgtgcctcgagaggagattagattggtccgagcgattctgcataacgcaaagaagacagggctggcggctcagaaccgagagttaagcccaaccttcgaggcatggctgcggggaaagatagcctacattgcgatgatagatcggtctaggggtcttgccctgcagaaagaactggattcactggacctgggacgttga

SEQ ID NO: 13801 - RNA, 1647 nt, unidentified
  source 1..1647: mol_type = other RNA; note = synthetic construct
atgtttaaaaggttgatcgacaagtttcgccaattggtgagccaccccgattctcccgagcctccgatgcccagccatggtccaagttctgcaccccctcctagggaagcagcccctggagctccacctttaccacgcgctgcccctggcgctgaccctaaaccatctaccttagatcagtactcgcctcccgacattctcggactgtccaaagaagagctgcgcaaaagggccttactcgtcaatccgtacagaactgcctggattggccgggtggacacaatcccgccacgttccgatgagcggacagcgctgattgataggggccttgtcctcagaggattactgaacgaggaacagctggctgagatccaccgcgtgggggatttatggctcacctttcatgatgcagagcgtctagcatcggctgctgccggcaagacggctgatgaggctattgaagaggctcgcaaagcgaagcaggcggcaagagaagagaagcgtcggcaagccgccgaaaggagagctaggagagccgaggaaatagccctttttaggaaaacccacctcgcctttagaggtgagggcgtttccgctggcctcagtgacagtcggagcgagatcgaaaaacttgaagccgcgggattgccagtcctcgcatcacccccagacctggcacgggttctcgacgtgtccgtgagtcgcctacgctggctggctttccactctgaagctgtgacacgaccacactacacgtacttccggatcgcaaagaagagtggtggcactaggttgcttgccgctccccacaaagatctggagaaagcccagcgctggatttttgaaaatatcctggccaagattgctgcagaaaagggcgcccatggcttcgttaaagggagatctactgtgaccaatgctgtgccccacaaggggcgagccatagtcgttaacattgacttgagagacttcttcccttccatcaccttcccccgtgtgcgcggtctgtttcagtccctgggatattctcccgccgtggcaaccgttctggcactgctgtgtaccgagtgccccagagtcgaggccgtgctagatgggaagactttctatgtggcagccggtcagaggggactaccacagggagccgctacctctccggctttgagcaacctggtagcaagaaagctggatcgacggctgagtgggcttgctcggaagaggggcttcatatacactcggtatgccgacgatctcacatttagctgcggcagagataaggactcagagctggggaggttcctggccagcgtgaggcatatcttgacggaggaaggatttactatcaaccccaagaagttcagagtgcaacgatcatccgcccgtcagagggtaacaggcattgtcgtgaatcggaaactgtccgtaccacgcgaggaggttcggcgaatcagggccattctccatcaggcgaagtcagcagggctcgcagcccagaaccgagaaaatctgcctaacttcgaatcatggctggaggggaaaatcgcctatataagcatggtcgaccgagccagaggagcggtccttaaggccgagcttgaccgggtacaacggcagcgcccagcggaagacagctcaagcacagcatga

SEQ ID NO: 13802 - RNA, 1677 nt, unidentified
  source 1..1677: mol_type = other RNA; note = synthetic construct
atgggcctctggtcgtggcttgggaaagtctttaggagggttcgcgcatggctagcttacaatcctgaattgcctcctccgccccctgaggcgccaaaagtcgatgaactgcctcctccagccggtggaagtggaggagccggtgttggatatggcacagccaccgctaaaacctggactaccgctaaggcaaaagcacaacagaaaaaacccccacccaaacccaagaaagctgtggacccctgggatactggagaattactgactctgtctcccgaagagctcagggctagagccatgcacatccagccctggaagacacagtggattgggcgggtggatgttatccctccggagtctgatgagcgcactgccttggttgatcggggcctggtcttgcgcggcttcttcaccgaggccgagttagccgagatacacgccattggcgatgcgtggttggaacataaggatgctgcccgattggcaagggcacgtgcagcgaaggatgtggacgccgctcttgcgcaactacgggccgaggaacgcgaacggaaagccaggaagaagcgggaggccgcagaaagacgggagaggagagctcgggagatagctgaaaggaggcgtaccgatattgtgtttctaggacgaggcgtgtcccattcactcgcggacaggcgggcccatgtcgagaaactggaagctcgcgggctgccggttcttgccactccaaaagacgtggccgatgcacttggattacctatcccgcgcctcagattccttgcgcaccacgatgaggcactgcagagggcccactacgtccagttcgaggtgcccaagcgaacgggagggatgcgtacactggctgccccaaagcctgacctcgctaaggcacagacctggatcctcgagcacgtactggccaaagtacccgtgcatgacgctgcccacggctttgtgcccggtaggtccacagcaacatgtgcccgcccccatcgtggtagagctgctgttgtgaacctggacttgaaggactttttccctagtattaccttcccgcgcgtaaggggggtcttcgcagagctgggctatagcccagccgcagccacaatcttagccctgctctgcacggaatgtccacgccgagaagtgcgcttcgcaggggtgacctaccacgttgctgtgggggaaagaggcctgcctcaaggggcctgcacatccccagccctcagcaacctcgtggctagacggttggacgcccgacttgcaggtctggccgagaaaagaggatttgcttatacccggtatgctgatgacctgagcttttcaacgggcgaccccaaagccgtagcgccactgttggccatcgtgcgcaagatagtccgcgaggaaggctttagagaaaacgggaagaagacaagggtgcagcgggcagcaggaagacagactgtgaccggcctcgttgtgaatgagccagaccgtctcggtctgcctcgagaggaggtcagaagactgcgagctattctgcacaacgctaagaagactggtcttgcggcacagaatcggggcggccatccagactttgaagcccatctacgggggaagatcgcgtacctggcaatggtcgacgcccccaaggctgccaggttcagagctgagctggacgccctgaccggatga

SEQ ID NO: 13803 - RNA, 1731 nt, unidentified
  source 1..1731: mol_type = other RNA; note = synthetic construct
atgctggcgagagccaaggcgagaagccatttttccgcgatcaatatcgatgttgtggtggcgagagctctgagcgccggcgaaagagcggagatcgctccctgggttgagcagctgttccgaaggggcgtactgcagggacacgcctacacccgcactctggtgagagcaggcgatcgggtgatctggatttaccatccacaggaccaagctcccgagccagtgtctcccggcagtccagctccttcagctgcggcagcttcccatgctgctcccaggccagctgcacatgcagccggaccactgctggatgcaggttctctgtggaaactatcccctgacgaactgcgtgctcgcgcccttgacgtcaagccgtacctgactgcttggatcggccgcgtggatgttattccgcctgcatcagacgagcggacagccttgatcgaccgcgggttggtacttcgaggccttctgacagaggcccagatcctcgaaatccatagggtcggagatttgtggctcgaacacagcgatgctgcccgcctcgcgcagttaagagcctacaaaaaggccgacgacgctatcctcgctttaagggctcgggatgctgagttgaaagccgagaagcgaaagttggccgccgaaagggctcagcgtaggagggaagagatcgcccgtaggaagaatgaggatattgtgttcctagggcggggggttagtgaacggctgcacgataggcgggccgatgtcgagaagctggagaggctcggactgcccgtgttagcaacaccagcagacctggccaaggcattaggcctgagagcacccgaacttaggttcctcgccttccacgcagaagccaccgaacgccctcactatgtacagtttgacgtgccaaagagatcagggggaactcgacggttgtctgcaccactcccgaaactcgccgctgctcagagatggatactagacaatgttctctgtaaggtcgcccctcatgacgccgcccatgggtttgtaccaggccggagcaccctgacgaacgcaagacctcacctgaaaaagggggtcgtcgtgaacctagatctacaagactttttcccgtctattacgtttcctcgggtgagaggagtgttcgcctctcttgggtactcgcccgctgtcgctactattctcgctctgcttacaaccgagcctccccgcagagcagtgagatatgccgagcgcacactccacgtcgcagttggttccagaggccttccccagggtgcgtgcactagtcctgccataagcaacctcgcctgcaggaaacttgaccgccgactctccggtctggccgcaaagcacgggctgacatatacgcggtatgccgacgacctgaccctgtccggaccaaaggatacccacgttgcccgcttgttggcgagcttacgccacttgattgagagtgagtcatttagggtgaacgacaagaaaggtcgagtccagcgtgccggtggacagcagactgtgaccggcgtagtggtgaacgacaagccctctgtcccccgatcagagaggaaacggctgcgcgccattcttcaccaagcaaaaaaaacaggcctggaaaaacaaaatcgggccggcgtgccttccttcgaggctcatctgcggggaaagatagcatacgtgagcatgatagatgggacccgtggcgcagaactcgccaaagccctggatgcactggattga

SEQ ID NO: 13804 - RNA, 1635 nt, unidentified
  source 1..1635: mol_type = other RNA; note = synthetic construct
atggatgccctgcatgagagaggggttcccggtgcctacgacttcgagagaacccttctctcagtcgcaggaaggagtgtgtggatctaccatcccattggtgcgtctccaaatcaaccctccacaccacctcctccggtagcaactcccgctagcccgaccaggaccaaggccaagcagaaaggcaaggagaaagctttgcctgacccctacgctgccgggcctctcatgacccttacagcagcagaactgcgggcccgggcattgaccatagagccatggagaactgcttggattggacgagtggatgtcatcccacctcagtccgacgagcgtactgccctcgtagataggggattggtcctgcgaggctttttcacggaggaagaaatcgccgagatccacagggtaggggatctgtggctggaacacaaagacgcaacacgcctagccaaagcccgagctcagaaatcagccgatgacgccatccaagccctgagggaggaggctaagcgggaacgggctcggaagaaagccgaagctgctgagaaaaagaagcaaagggctgctgaggtcgcacggagaaaggccgaggacattattttcttaggacggggggtgtcagggaggctgaatgatagaagagccaacgtggagaagctggctgaagctggcctgcctgtcttggccactcccgcagatgtcgccaaggcactcggactcaccgttccacgcctacggtggctggccttccacgcagaagccagtgaacaggggcattatgtgcaattcgaggtgcccaaacggagcggaggtaccaggcgtctgtcctcacctaagaaggctctccgcgccgctcagacgtgggttctgaacaatgtgctggccagatgtggcactgaagatgcggcccatggctttgtgcctggtcgatctaccgtgacgaatgcacgaccacacgttgggcgccgcgtagtggttaaccttgaccttgaagacttcttcggcacaatcacctttccacgcgtccgtgggctgtttgtgtccctcggatactctccggccgcggcaacagtcttagcgcttctgacaacggaagcaccccgacgcgaggtgcggtatgatggcaaaccttaccgcgtggcggtaggcccaagagccttacctcagggtgcgtgcaccagccccgctctatcgaacctggtggcccgcaagcttgacaggcgcctgactggcttggcaaagaaacacggatggacttataccaggtatgctgacgatctgacatttagcagagacgatgacacacaggtcggggccctcatcgctactgtacgtcacgtcgtgaccgaagagggctttcggataaacgagaagaagggcagagttcagaagtctggaggccagcagaccgtgacaggggtggttgtgaatgacaaattaagcgtgccccgggcagaaattcgccgactgagggccatactccacaacgcgaaaaaaacaggcctgagtgcccagaatacttccggtcatccgcacttcgaggctcatgttcgtggaatgattgcgtacgtcagaatggtggatccagagaggggcgccaagttggcagcacagctcgctgccgtgagatga

SEQ ID NO: 13805 - RNA, 1671 nt, unidentified
  source 1..1671: mol_type = other RNA; note = synthetic construct
atggagattgccccatacgtagacggctgggtggaagctggactactggataaacacggatatacgggaactgaacagatagtggcaggccgcgcggtgtggatttatcatagagtgggacaacctgtcgctggggtcaccccctcaaccagggtcaatgcaccagcccccactgcccctaaagctgctccgcagaaggccaagaagaaagagaaaaaaaagcgcaagtggttcgatccctgggacgccggtgacctgatgagcttgaccgccgcagaactgagagcacgcgccatgaaaatcgtgccatggagaaccgcctggattggccgggtcgatgtaatccccccgcagtccgacgaaagaacagcccttgtagacaggggtctgatactcagggggtttttcactgaggaacagattgaggaaattcaccgtattggcgatctctggcttaaacataaggatgccgcgaaactggcaagagcagccgctgctaagtctgccgatgctgccatcctacagctgagagaagaggcgaaacagaagaaggcccgactgaaggaggaagcgaaggcaagggccgagaaacagagggccgacgtagcccacagaaaggccaccgacatcgtgtacctgggtaggggcgtcagtggccagcttcacgatcggcggtcgaacatagaaaggctggagtcacagggtcttccactgttggctgctcccgcggacgttgctgacgctctgggagtgaccgtgagcagacttcggtggctggcgtttcacgatgaagctgccccagccggtcactattctttctttgagatccccaagcggtcaggtggcacacgcctcttgtctgcccctaaggcagagctgcgtgccgctcagtcttggattcacgagaatatcctgaaaaaagtggccctcgaggcccctgcccatggattcgttcctggccggagcacggtgacaaacgccgcaccacatgtggggcgcgatgtcgtcgtgaacttagacctggaagacttctttccaaccataacgtttgcacgtgtccgtgggctgttcacaagtctgggctacagtcctgcggtggcaacagttctcgctctcttgaccactgaggctccccgaagaagattgacttacgctgggcgcccctactttgtcgctgtgggaagacgaggactgccgcaaggcgcgtgtaccagccctgctctgtccaatttagtggcccggaagctcgatcgcagaatggcagggttagcgaagaagctcgggtggacttacacacgttatgcagacgacttaaccttctccgcccccgcaggacaacgcgatactgtcgggaggctctttgcacatgtacggcacatcgttcaggacgagggattcagggttaacgaaaagaaggggcgagttcagaggaagggcggtcgccaaacagtgaccggcgtggtggttaatgagcgactagctgttccacgggaggaagtccgccgacttcgggctatcctgaacaatgcaaaaaaaacaggcctggcagctcagaacagggacgaccatcctcacttcgaggcctggcttcggggcaaaatcgcctatgtgagcatggtggatccagataggggggccaagctcgcagcccaattggctgagttgtcctga

SEQ ID NO: 13806 - RNA, 1623 nt, unidentified
  source 1..1623: mol_type = other RNA; note = synthetic construct
atgggcttttgggataaggtcaagcggttcttcgggggaggtggtgccttgcaacccgatccttccgcaccgacagccgctcctccatcaacgcctacaccatcaacaccggctcctgccccagcacatacagcgccagctccaccagccgctaggactgctccagcacccactagtacagatgatagtgctcgctttcggaacccagccatactgggcttgagcgccgccgaactgcggaaacgagcactgcggataaacccgtaccagaccccctggatagggagggtggacactatccctccccagtctgatgagcggaccgcgattatcgacagggggctgatcctgagaggcctgctcactgccgcccagatcgaagagattcatagggttggggacctctggctggcccaccatgatgcaatgagactggctgctgcagcaggggctgctagcggtgaagcagcagtggccgcagaaagagctcgacgtgctgaggccaagcgggccaaacaagctgctgcagcagcccgagctgccgctagagcagctgctgtcgcggctagaagggccaccgacattattttcgtgggaaggggagtgtccgccggtcttgccgatagacgaagccacgtggagcaactcgcggcggctggattgcccgtgttagctgcacctgcagacctagccgccgcccttggactgacagtccccagactccgctggctgtgtttccatgccgacgcccccgctaagacccactatacatattttacgatccccaagaggtccggagggacacgcaagttggccgcaccacacagacaacttgcggccgcgcagagatggattttcgatcagattttagccaaactgcctatcacagacgcagctcacgggttcgtgccaggtcgctctactgtgaccaacgctcggcctcacgtaggccagcgcatagtcatcaacctggaccttgctgattttttcccttcaattacctttccccgggtacgcggtctgttcgctagcctgggatattcgcccgccatcgccaccctacttgccatgttgaccactgaagccccacgcgttgaggttgagttcgccggcaggactcattacgtcgcaaccggacccagagccttaccgcagggagcctgcacatcccctacccttgccaatctcgtggcccgaaaactggacaggcggttggggggagccactcgtaagctgggctggacctatactaggtacgccgacgatctgaccttctctgcgcccgctgcagggtctgcacaagtggctttaatttttgccagagtgcgcgcgatcgtaacggccgagggctttgctgtgaatgaggcgaaaggtcgcgtgcaaaggggagggcgtcacacagtcacgggactggtcgtaaatgacaggctcgccgttcctagagaacaggttcgtcgagtgcgtgcgatcctccacggcgcacgaaccactggcctagcagcccagaatcgggccggtcaccccgattttcgcgcatggctccagggcaccatcgcgtacattcatatggttgaccctgcccggggcgcagcatttcaagctcagctggacgccctcagttga

SEQ ID NO: 13807 - RNA, 1404 nt, unidentified
  source 1..1404: mol_type = other RNA; note = synthetic construct
atggaggaacttagagcaagagcggccaaagtaaggccctggcttagcccttgggggtggcgtatggacattatccctccagccagcgacgagcgaacttcactcattgaccggggtctggtcctgaatggctattttactgaggcccagatccaggagttccatcggatcggagatctgtggctcgaacacaaggatactgcaaggaccattgccgcacgggcactagagacagctaaggctgatctcgaagagctgaagaggaaaaaactggaagaaaaggccgccaaaaaagtggcggccgaagaacgccggaaagcacaccgcgcggctattgagaagcggcgactggaagacattgtgttcctcggccggggtgttagcggcaagctagccgaccggagatctgatgtcgaagctctccagcgggccggcttaccagttctcagctccccagctgatgttgcaaaggctctggagattacaattcccaccctgaggtggctggcattccatacggaggccgccggagcaatccattacagacagttcgaggtccctaagaagaccggaggggtgcgactgttgagtgcccccagaccaaagctcgctgccgcacagcggtggatactggagtcggtgttggccaagatagctccagaggcagacgctcacggtttcgttgacggcagatcaaccgtgtccaacgcgaagccccacgtggggagagatgtggtggtaaacgtggacctgaaagactttttcccgtcaatccactttcctagggttcgcggttttttcgaaaccttggggtactcccctgccgtggctacagttttcgccctgttgactaccgaggcccctagaaggcgcgtcgaatatgctggcaagccatactgggtcgctgcaggccctaggggtttaccccaaggcgcatgcacctctccagccatcagcaacttggtgagtcgcaggctggacaaacggctgtcctcaatgggcaagaagcacggggctacgtacacacgatatgccgatgatctcacacttagtcttgaccccggacgcagggagcagataggaatgcttctcgcacgtattaggcatatagctgaggatgaggggtttcgggtgcatcccaagaaagtggccatccaacgctctggagggagacagatggtcactggaatcgtggtcaataggggcctttctgtcccgagggaggaagtgcgaaagatccgtgccgtattacacgccgccaaacgctccggcttagcggcacagaatcgagaagggcatgctgattttcgcgcccacctgagaggaaaaatcggctatgtaatgatggtggacagacaaaaaggggaacgtctgttgcgcgagctggaggctctagcgccctga

SEQ ID NO: 13808 - RNA, 1980 nt, unidentified
  source 1..1980: mol_type = other RNA; note = synthetic construct
atgggcttttgggacaaggtaaaatctttttttggaggcgcttccccacctggcggaggtgatggaggtgatgggggcaatggcgactcagatgaagcaccacctttatttaacgagaggggtctgcctaccgatgcttttactcagttcgttgaaagacgcgtccgggtgcgggcgaagaaagaacatctcttcacccgccacgacattgcaagaattgtggtgaagaagctggagtctccccctagtgctgcggagacatttgccgctaacgccgtgctcaaattgaagaaggccgggctcttcgaggaattggggtacgagtgcagttacagttccaccgtgaggggggaggtcttccatcctgaagggacagaccctgacgagtaccccggtgcaggaggaggaccacctagtggcgttagacgggtgcaaccccagccagttgcacccgttgcccctgctgcaccacctccaccaagacccgcaacaccagcagccgctgcaccagctagagcacccactaccccctataggtccaacccgttcgatgccggccagagcctaggaatgtccgctgacgagcttcggcggagggcaatgaaaatcgtgccgtggcgcactccttggataggacgggtcgacgtgattccgccagcctcagatgagcgaaccgcgctcatcgatagaggcctggtgctccgtggctatttcaccgaggagcagattgccgaattccatcgaataggtgacttatggctggaacacaaagatgccgcttcatttgtagctgcacgtgggaaggagcaggctaaactggacctggaagctctcaaacaaaagaagcttcaggagaaagctgagaaaaagcgagcagcagccgaaaggagagaaaggctacgcgaggccattgccaaacgaagggccgaagatatcgtgttcttgggacgcgggtttagcgggaagctggccgacaggagaagcgacgtcgaagccctagaaagggcgggtttgcccgtcctgtcgacacctgccgatgtggcacgtgcgatggaactgtctatcccgaccctccggtggctggcctttcactcagacgcagctgagacaatccactatcggcagttcgaggtgcccaaaaagactggaggcgttcgcttgctgtctagccccctccccaaacttgctcaggcccaacagtggattcttgagaacgtgctcgccaagatccccacaggaggggacgcccacggatttgtccctgggagaagcacagtttccaatgccaagccccacgtcggcagggatgtggtggtcaatgttgacctgcgggatttctttccctctatccatttcccacgggtgcgggggctattcgaatcacttgggtactctccagctgtagcaagcatcctggccctcttgaccacggaggctcccaggaggagagtcgtctacgcgcaaaagccatactgggtggctgctggccctcgaggtttgcctcagggagcgtgtaccagcccagccgtcagcaatctggttgcacgaaagctggatacgcggttggccgccatgtcggctaagcatggggctcgctatacacggtatgccgatgacctgaccctgagtctggaacccggccgtcgagatcagatcggcatgctgctcgcccgtattcggcatatagccgaagacgagggcttcactgtgcaccctgacaaagtgtttgtgcagagggctggcggccgccagttagttactggcatagtagtaaataggggcctttccgtcccgcgcgaggaactcagacgactgagagcggtgctgcacgccgcgaagaaaacgggactggaggcccaaaacagagacggtctgcctgacttccgcgcccaccttagaggtaagatcggctacgtaatgatggtggatcgcgagaaagggtcccagcttctgcgcgccttagaggcaactccaccctga

SEQ ID NO: 13809 - RNA, 1410 nt, unidentified
  source 1..1410: mol_type = other RNA; note = synthetic construct
atgtctgctgaagagctcaggaagagagccatgaaaatcgttccctggcgcactccttggattggacgtgtggacgtgatccctccagcctctgatgagaggacttctctgatagatcgaggcctggttctgtccggttacttcacagaagaacagatcgcggagtttcatcgcattggggatctgtggctggaacacaaagatgccgcaactttcgctgcacagagagcccgggcccaagccaagctggatctggacgccctcaagaggcaaaaactggaggagaaggccgccaaaaagcaggctgctgcagcaaggagggccgctttacgagacgcaatcgcaaaaagacgggccgaggacattgtcttcctgggccggggatttagcgggaaactgggtgatcgaagatccgacgtggaggctctcgaaagagcggggctgccagtgctcagtacaccagcggacgtcgcacgtgcgttaggcgttcccatccccacattgagatggcttgcttttcacagtgaggccgcacagactatacactaccgtcagtttgaagtgcccaagaagaccgggggcgtgaggttactctcagccccaaggcctaaactagccgcggcccagagattcatcttggagtcgatcctggaaaaaattagccccggccccgatgcccatggctttgtctcagaacgcagcacagtcacaaacgctcgccctcacgtagggcgcgatgtcgtggttaacgtggacctgcgggacttcttcccgagcatacatttcccgagggtgaggggcctttttgagcagcttggctattcccctgcagcagccaccgtactcgcgctgttgaccaccgaagctcctaggcggagagtcacctacgctggagtggctcattgggtggccacaggcccaaggggtcttcctcagggagcctgcacgagcccagcaatctcaaatttggtcgctcgcaggttggacaagcggctgggagcaatggctacgaaacacggtggcgtgtatactagatatgccgatgatctgactattagtctcgagtctggccgcagagagcaaattggaatgctcctagcacgtgtacgacacatagctgaggatgagggctttaccgttcacccaaagaaagtggccgtacagcgggctgggggacgacaaaccgtcacaggaatcgtggtgaatcgggggctgtccgttccccgagaggaaattcggagactacgcgctgtgctccatgccgctaagaagaccggactggccgcccagaacagagacgacttgccggacttccgcgcacaccttcgggggaagattgcgtacgtcgcaatgatcgatcgggacaagggtgcccgccttttacaggccctggaacagacgcccccttga

SEQ ID NO: 13810 - RNA, 1653 nt, unidentified
  source 1..1653: mol_type = other RNA; note = synthetic construct
atgctcagggtagccggattttgggactggctcaaaaaagcattttccgaccccgaagctccacctggcccgtctagctctgggtccactccaacaccaccaagtccagctcccagtggagcagcgcccgcaagtgctacttctacacccacatcgtccccgggcaagtcaaacgataaatcagctacgaaagggcgcaattacgatgctaaccctgaaattctgggactctctgaggccgagctgcgaaagcgagccttacgcataactccctggcgaaccgcctggattggacgggttgacacgatccctccccagagcgacgagcgcactgccattatagatcgtggcctgattcttacagggagactcacagaagcagaggtggccgagatccatgaggtgggcgatctctggctgaagtaccatgggagggtggagttggctaggagcgaggcaaaaaaggcgtcccaacgcgccgccgatcaaatcgccgcagacagggaggcactgaagaagcagaagaaagaggaggctgccgcacgtaagaaagccagagctgaagccatcctggaccggaaacagaatgacatcgtgtacctgggtaggagtgtaagcgctagaatgaacgacaggcgcgccaacgtggaaaaattacaccagctgggacttcccgtgttggccacacctaaggatgtggcgcagttgctggagatttccgtccctaagcttagatggctcagctttcacgcagtagccaccgaacgaccccactacatttcatttcacgtgaagaagcggagcggagggttgcgcctactaagcgctccgcataaagagctgaaaaaggcccagaagcggatcgccacacagatcttggataaggtggatcctggcccagtcgctcacggtttcattaaggctcggtcaacagtgactaacgccacccctcatgttggtcaggacgtggtcctcaatctcgacctctctgatttctttcctagcgtcacattcccccgggttcgcggcctgttccagtcctttggctattcacccgcggttgccaccgtccttgccctgttagcaactgaaagtcctcgccgaactgttaagtacgacaacagaacctatcatgtggctgtgggtgagcgtgcccttccgcaaggagcacccacgtcgccagctatagcgaatctggtagctcgaaagctggatagacggctcagtgggttggcgagaagcgccggatggtcttatactagatacgcagacgatttgaccctgtctacccggggcgaagctcgcaagaagaccccctggatgtatcggcaagtccgcgaaataatctcctcagagggcttcgtcgtgcaccctaagaaaggcaggttacagaggaaagggggctgtcagaccgtgaccggtgtggtcgtgaatcataaactgggcctgccaagacgggaagttagaaggctgagagcgatccttcacggtgctaaaaagtccgggctagcatcccagaatagggaaggaagggccgacttcccagcataccttaggggaaagctggcatatcttgccatggtcgaccctcaaaaaggcaaaaaaatgctcgccgaactggataccctggaggggcgtcaccggccagagtga

SEQ ID NO: 13811 - RNA, 1644 nt, unidentified
  source 1..1644: mol_type = other RNA; note = synthetic construct
atggctggtttctgggatcgcctgaagcagctattcggtgacggaccgagtccaaaaggctctgaccctgatgctgggccaccttcatcatctaggagcccatctagggatggggacccagtgcctccagcctcgagcaaggcaggtgcccagagccctgaaaagggtcagaagagtcccgcaagatcctatgacgcaaaccctgagattttagggctgagcgaaagcgacctgcggaagagagccctgcggatcacaccgtggagaactgcctggatcgggcgggtcgacacaattccccctcaaagtgacgaacggacggccatcattgatcgaggtctgatccttaccggcaggttgtccgaggcggagatagccgagattcatgaggtcggcgatctctggctcaagcaccatggaaaagccgacttggccagggccgaggcaaaaaaagccagctccgcggccatcgctgagctgcatgctgaacgcgaggccaagcgcaagcagaagaaagaagaagccgcggaacgcagaagactgagggccgacggcattgccgaacgaaggcgaactgatatcatcttcgcagggagatctgtgtccagccgactggccgatcggagggctaacgtcgaaaaattagtggcactgggcctgcccgttctggcaactcccagggatgtagcagagctgctgggaatttccgtttccaagctgcggtggctcgcctttcacgctgaggcaactgagcgcccccactacgtgacatttcacgtcaagaagagatctggcggattgcggctcctttctgccccacataaagagctcaaacgggcgcagaagaagattgccacgcagatccttgatcgccttgatgtgggccccgctgctcatggcttcgtgaaagggcggagtacagtgtccaatgcaaaaatacacctggggcaggatgtggtcctgaacctagacctttcagacttttttccaacaatctcctttccaagagtaaggggcctatttcaatcgtttggatattctccggccgcagcaacccttctcgcactggttgcgacagaggcacccagacgagtgataaaatacgaagggagagcctaccacgtcgctaccggtccccgagctctacctcaaggtgcgcctacctcacccgctctggccaatctcgccgctcgcaagttagacagacgcttgctcggcctggctaaatcagctggatgggtatactcacgttacgctgacgacctcaccttcagcactaagggggagccccgcaagaaaactccatgggttttcaggcaaatttccgagattgtgagtagcgaaggattcgtggtgcacccccgtaagcggcgtgttcagcataaggggggaaggcagaccgtgaccggagtcgtggtaaacgagaaactcgggttgcctcgggatgaagtgagacgtcttcgcgcaatactccacggagcgaaaaagaatggcttggcttctcagaatcgtgacggccggagtgacttcccagcctatctgcgaggcaagttggcttatctggccatgatcgatcccggcaggggcaagaaaatgttacgcgaactggatgttatcgagggaaggaaacctgccccgacctga

SEQ ID NO: 13812 - RNA, 918 nt, unidentified
  source 1..918: mol_type = other RNA; note = synthetic construct
atggcattccacgccgaggcagctacacgaacacattatgtccgatttaccgtaaagaaacggagtggaggcgagagacagttagccgcgccgcaccagaagcttaaggccgtgcagaggcaaatcctgcagaaaatcctggagcgtttagacccagggccctatgcccacgggttcgtcaaacagcggtcaaccgtgacaaacgcccaggcacacttggcacggcatgacctgataaacctggatatctccgacttcttcccaactatccattggcggagggttcggggattatttaagtcatttggctacagccccgctgttgccacaattctagctctgctcgtgacggaggctcccagaaccctcgccgagtacgatggcaagaaatattgggtggccattggtgaacgcgtcctgcctcagggtgcaccgactagccctgcaatctctaatctggtcagtcggaggttggacctccgcctagccggtttggccaaaaagagagggtggcgctacactcgctacgctgatgatctcacttttagcgctggcgaaaaaaagcgcccagacatcccatggatgatgcgacaagctaaggaaatactggccgctgagggctttgttctccaccccaataaacagagggtacaaaggaagggacgtagacagaccgtgacgggcattgtggtgaatcaaaagctttctgttcccagagaagaggtcaggaagctgagggccattcttcacggggcacagaagaccggacttgccgcccagaacagagagaacctgcctcatttccctgcatggctgcgtggcaagttggcgtatctctccatggtggacccagcgaaaggaaaaaaaatgctggcgcagctggatgctctcgaagggagacgccccacccctgtgtga

SEQ ID NO: 13813 - RNA, 1638 nt, unidentified
  source 1..1638: mol_type = other RNA; note = synthetic construct
atgtggttgtatcatcccgagggagtggaccctcgcggaactggtaaagccccagccgctgttttaccaccgagcccaaaggctgcttccacaactgggacagctggatcgaccacctctgctacaacggcatccaataacagttctagcactgggggttggaagccacctgccgaacgagctaatgacggcgaccccttcgacactgccggaacactgacgctgactcccgagcagctgcacgaacgggccaaaaagatcgttccctggcgcaccgcttggattggccgtgtggatgtgatccctcccgccagcgatgagagaactgcacttatagatcggggcctggtgcttcgcggcttactgacccaggaggatatcgacgagatccatcggattggagatttgtggctcctacacaaggacgccgatagaatggcctcaacacttgcccacaaatcagccgaagcagccattcaggcaaggcggcgggaaagggcagaaaggaaggcacaaaagaaggccgaggctgccaaaaagaaagctgcccgcgatgctgctgttgcggaaagacgggctacagacctcttctttctaggagaaggcgtcagttcccagctgcacgacaggcgcaccgagatagagcgattagagacactggggttgcctatcttggcaactcccgcagatgttgcggcgcatctcggggtggaagttccacgcctgaggtttctggcattccatcaagaggcagcccagactactcactatgtgcagttcgaggtacctaagagatcagggggcacccgtacattagcagcccctaaaccaggcatcgccgcagcacaagagaggattctggagacgatcttagccaaactcccactggatgaggctgcacatgggtttgtcaccggacgaagtactgtaacaaatgcaaggcctcaccagggcagggaccttgtgataaacctagacctgaaagactttttcccgtctgtgacatttccacgggtacgtgggctcttccggagtttcggctatagccccgcggtcgccaccatattggcccttctctgcacggaatccccgcgcagagagctatcttacgacggacgatcctaccaggtggccgtgggtgccagagctcttcctcaaggcgcctgtacttcacccgccattagcaacctcgtcgcgagaaagctcgatagacgactgaggggactggccgccaaacacgggcttgcctataccagatacgcagatgatctcaccttcagcgcggatgccgacaagcgaggcgaactgggtatgaccttggctcgcctgaggcacgtgatcgaggacgagggatttgctctgaatcccaagaaggtcagagtgcagcgcaagggtggtcgccagaccgtcacagggattgtagtcaacgagcctaccaaactggggctgccccgtgaagaagtgagacggctgagggcaatcctccatgccgccaaaacaacgggtctgcaggctcagaacagagcgggccatccggactttcgggcgcacttggccggcaagattgcctacctcgcgatgatcgacccagctcgggctcgtaccctgagggaagctctggcagcttgcaccggctga

SEQ ID NO: 13814 - RNA, 1191 nt, unidentified
  source 1..1191: mol_type = other RNA; note = synthetic construct
cccagcgacaatcccccatctgaacggggactgaaagctgaacagcgtgaagccgcccggcgcaaagaagccagagaagaagcacagcgtgaggcaaggctagcccgtgtggaagccaggcgagagagggaagctgccctcagacaaagactcgcacgcgaggtcttgtatgccggtgagggcgtatctgcgacagtcgcccacgctgcttcagatgtggcacggctggaagccggaggcctaccagttgctcactccgcccttgacctggcccaccttttggggctggacttgcctgcgctcaggtggctgacattccatcgcgaggtggccagaagcacccactacagacagtaccaggtggcaaagaggcgaggagggttcaggaccatttcggccccgaggcctaagctaaaggcggccttacgtgctgtgcgggagcggatactggggaggctggctgtgtctcctcaggcacaggcttttgttccaggacgctccactctgactaacgctcgccctcaccttagggccgctgtggtcgtgaaactcgacgtcgtggacttctttggctccttttccttccctagagttcgcggctggtttcgagctagaggctacagtgggatggtcagtaccctgctcgccctgcttacaactgaggcacccagggtggaagtggagctggacggggctcgatattacgtagcgacagggccacgcgttttaccccaaggtgcgcccacttcaccggagctgacgaacctgctcgcattgcggcttgacagacgcctcgccgcctatggtgccaagcatggatggacgtatacacggtacgcagatgatctaacatttagccgagcggatgaaccagagggttgtgtgagccggctgttgggcaccgcagaggctatccttcgggacgaaggcttgcgactcaaccacgataagcagtgcgtgacccggcgaggacgtcagcaaagggtcaccggcatcgtcgttaatgaggtggcaggcctgcctagaagagatctccggaccttccgggctgccgtgcatagagttactagagacggattcaaggatgtgcatgagcgccagcgcatgctgggctatgccagttacgtacgcatggtaaaacccgccttaggggagagatggctggaggcactgagggaggtcaggtcatga

SEQ ID NO: 13815 - RNA, 1185 nt, unidentified
  source 1..1185: mol_type = other RNA; note = synthetic construct
atgaccgaaggccctcggaagtcggttagggttgaggccgaagaggccgcaaggagggctgaagccagagaggaagcaaggagggctgcaaggttggcccgtgcagctgcagtcagagctcggagagccacgcatgcagctcgcctcacgcgagaggttctgcacgccggtgaaggggtgagtgctaggcttccagccgcgaggagcgatgctgcagctctcgagcggagaggactgcccgtaatgcacgacgccgccgatctggctacactgcttggcatggacatgcgggctctgcggtggctaacctatcaccgcgacgtcgcaactgtgacacactacaggcaattccaagtgcccaaagccaaaggcggtgtgcgcaccattagcgcaccaagaccggccttaagagcggctcagcaggcaatacgacagcacgtgctggcacgcctggaacccactgttcacgcacaggccttcgtgcgggggcgatctactctgaccaacgcccggcctcatttgcgtgctgccgtgctggtcaaagccgatatccgggactttttcggggcaattgactttccccgggtgagaggtctatttgaggctctggggtattctgggatggtggccaccctccttggcctgctcaccacagaggcgaggcgtgtcgaggccgacttggatgggcagccagcttgggtggctgtcggaccacgagctctgcctcagggagctcctacatccccagagctgactaatcaaatcgcgagacgcttagatgcgcgcctcgctggatacgcccgcagacatggttgggtgtacaccagatatgctgacgatctggccttttcatcccaggatggagcccgagagagggtgggtcgactgctaggggtcgtgagggcagcgcttgagggcgaaggcttccaactgaacccggataagctcgtagtcgtaagaagaggacgccagcagcgcgtcacaggcgttgttacaaatgacgtggccggcctccccagagccactttaaggcggttccgggccgcggtgcatagagttacccgtgcaggatttgccgaccccgcagaacgcgcccgtatgttgggctacgccagttatgtcaagatggtaaagcctgcccttggcgagaggtggttgcgagcgctccgcgaagtgcctgcctga

SEQ ID NO: 13816 - RNA, 1287 nt, unidentified
  source 1..1287: mol_type = other RNA; note = synthetic construct
atgtcttggttcgcatctacactagcgtggtttaagcgttggactagagcaaagccagtcactcgggacgtgtcaggactggacgcgccaactggccgggatggaagaccccttgatgtggttagcgaaactgtacgcctaagtgggccgctgaagcccggacatctgaggcagattaagcgggaccccagactcctgcctaaaggcaaacgagtgtatgcacgaaatctgaagcggtggatgggtgccggagaagcaagacgcttcttcagtaggtcaatgctgacccgggataggtccgtgcgggatctcttaccggatgaagcccagttggctcgttacggcttgcctgtctggcgaaccgaggaggatgttgccgctgccttgggcgttactgtgggcaggttgcggcattatgcaagccaccgaccacgagagcgagtgcgccactatgtgacattcacagtgccgaagcgctctgggggcgttagatgggtgcacgcccccaagcgcagactgaaaaccctgcagcggcgtcttctcatgctcctggtcgctaaactccccgtgtccgcccatgctcacgggtttgtgaccgggagaagtgtgcggacaggtgccgctccacacgttggaagacgcgtcgttctcaagctggacctgaaagacttcttcccaagcgtgaccctacctagagtccgtggcctgctcttggctttgggctatgggtaccccgtcgccgccacactggcattgctgatgaccgaggccgagagacagcccgtagaagtggacggtaccgtgtttcacgttcctgtaagcgcgcgtgtctgtgtccagggggcacctactagcccaggggtgtgcaacgcagtccttcttcgccttgacaggaggctcgccggcttagccaaacgatacggctacgcttacacaaggtacgccgacgatctgacgttttccggagacgatctgggagccttagaacgcgtacgcgccctggctgctagatacatccaggacgagggctttacggttaaccgcgacaagaccagggtccaacgcagaggcggagctcaaagggtaacgggtgtgacagtgaatgctgggctcggattatcacgggaggaaaggaggaggctgagagccatgatacatcaggaggggcgggatggtgcagacgcagagaggtcggcgtatatcgatggaatgcttgcctatgtgaaaatgctcaaccctgagcatgcggaaaaactgtctaggggcagaaagcggcggggttcctga

SEQ ID NO: 13817 - RNA, 1287 nt, unidentified
  source 1..1287: mol_type = other RNA; note = synthetic construct
atgtcctggctggactctactttatcatggctgaaggcccgattcacgcgtcccgtgactagatccaccaccggattggatgctcccgtggatgctcaagggcggcgtgtagacgtcgtctcggaaaccgttgtgatgtccggccctctcaagccaggccatctcagacagattcatcgggacgcgaggttactgccgaagccccaaaggagatatacacctggccgggcaaagtggatgccagctgccgaggccagacgcttgttttctggaacgctgaggacgcgcaaccgaaacctgcgcgatctgctcccggatgaggcacagcttgctcggtacgggctacctgtttggcggaccgaagaggacgttgccgccgcattaggcatatctgtcggtatgctccggcattattccatccaccgatcacgggaaagggtccggcactacgtgacttttgctgtccccaaaagaactggcggagtaagactgctgcacgcgcctaaacgcaggttgaaggccctgcagcgcaaactgctggaggtgctcgtctcaaagctgccagtgagtcagcaggctcacggctttgtgtccggccggagcatcaaaacaggtgcccagccccatgttggtaggcgggttgttcttaagctggacctaaaagacttcttcccgagcgtgactagtgctcgagtgcgaggactgttcatcgcattaggctacggatatgccgttgcagcgaccttggccgtgctgttgacagaaagcgagcgccagcctgtagatattgaaggtacagtctttcacgtgcccgtgggcccaagggtttgtgtacagggcgccccaacttcacccgccctttgcaatgccgtgctcatgaggctggaccgacggcttgctggactcgctcgacgctacgggtatacttataccagatacgctgatgatctgaccttctctggcgacgatctgagcgccctggagagagtacgggcactagccgcacgttacgtgcaggaagaagggtttaccgtgaaccgcgacaaaacaagggtcagacgtagggggggagctcaacgtgtgaccggagtcacagtgaatgcaacactgggacttagcagagaggagaggagacggcttcgcgccatgctccaccaagaggggagggatggcgaagacagtacccgcagagcatacctcgacgggatgctcgcgtatgtgaagatgttgaatccagagcaggcagccagacttgtgcgcaagaggaaacctagggccggtgggtga

SEQ ID NO: 13818 - RNA, 1281 nt, unidentified
  source 1..1281: mol_type = other RNA; note = synthetic construct
atgagctggttcgattccactctgggctggtttaagggactgttcacacccaagcccgtaacgcgggacgtgtccagacttgatggatcggcacgagatgcttctggtcgtgcagccgacgtggtgcgcgaaacagtggcaacaagcgggccattgaaacccggtcatcggcgcgagattatccgggatgcacgtctcttaccaaaagggcgccgagtgtacacccctgggcgcaaaccgctcatgacccgaggagaagctcgccggttttttagcacaaccttccggaccaggaacagagacgtccgggacttgctcaccgatgaggcgcagctgactcggtacgggctgcctgtctggaggactgaggaagacgtcgccgccgcactggagctcacagttgggcagctgcggcattatgccacccacagaatccgcgaacgcgtctcccactacgtgacttttagtgtgccaaagaggtctggcggcaccagacttctgcacgctcccaagcgcaagttgaaagcactgcagcgcaggctgcttactctgcttgtagccaagctgccccggtccgagcacgcacatggcttcgtgagtgggcgatctattaaaacaggtgcggctccccacgttggaagaagggtggtcctaaagctggacgtgaaggattttttcccatcagtgactgtaggccgagtacgcgggctcctccttgccttgggatatggataccctgtcgctgctacgctcgccgtcctcatgacggaggcagaaagacagcccgtggaagtggagggcactgttttccacgtcccagttggtccgagggcgtgtgttcagggagcccctaccagccctggcttatgcaacgctgttgtgatgaggttggacaggcggttggccggtctggcgagaaggtatggatacacatatacccgttacgctgacgatctgactttttcaggggatgacgtcggcgctctagagaaggtgagggccctggcggccagatatgtacgtgatgaaggcttcgaggtcaatgcagccaaaacccgagtgcagaggagagggggcagacaaagagtgacaggcgtgaccgttaatgccggattaggcctttcaagggaggagcggcggaaactgagggccatgatacatcaggaggatggtggcgacgctaaacaaagagcacgcatcgacggaatgctagcctacgtgaagatgctgaaccctgaacatgccgcccgactcgctaggcgtagaaagccacgggggtga

SEQ ID NO: 13819 - RNA, 1281 nt, unidentified
  source 1..1281: mol_type = other RNA; note = synthetic construct
atgagctggctggattggttcaagggtctgttcagcccgaagccagttaccagagatgtgtctcgactagacgcccccttcgaaagggatgcttctgacagaccgcctgatgttgtgcgggagacagtggccacaagtggtccacttaagccggggcacctccgacagatcctgcgtgacgcaagactgctgccaaaaggcaagcgcgtatacacaaagaagcggaagcgactcttttccgcactggaggcccggcgtttctttagtaccgcattccggacccgcaatagaaatgtcagagacttactgcctgatgaagctcagctcgccaggtatgggctgccagtgtggcgcactgaggaggatgtcgcgacagcccttgggctgtccgtcggacagttgcggcactactcaactcatcgggcacgcgaaagagtaagccactatgtcacattcactgttcccaagaggtccggcgggcagcggttgttacacgcaccaaagcgcaagctcaaagccattcagcgaagactgttggacgtgttggttagcaagctgcccgtatcagaacaggcacatggatttgtgactgggcgtagcataaaaactggagccgctccacatgtgggcaaaagggtggtgctgaaattggatctaaaagactttttcccctctgtgacagtgtcacgggtaagaggactactccttgcctttgggtatggttaccccgttgcggccacactcgccgtgctgatgacggaggctgagcgccaaagggtcgatgtcgagggaaccgtctttcacgtccccgttggtcctagggtgtgtgtgcaaggtgctcctacgtcgcctggcctctgcaatgctgtcctgaccagattagaccgtcggctggccggattgggcagaaggtatggctatgcttacacgcgctacgccgatgatcttactttttctggggacgacgtgggcgccctggagaaagtcagggcattagcagcgcgctatgtacgcgaagaggggttcgaagtgaacgctgagaaaaccagggtgcagagaaaggggggacggcaacgagtgaccggcgttaccgtgaacgagggtctgggcctcagtcgagaagagcgtcggaaactgcgggccatgattcaccaggaagatcgcgacggcggcgacgctaaaaggtccgctagaatcgacggcatgcttgcgtacgttggaatgctcaaccctgaacatgccaccaggcttgcacgatacaggaagccccgcggcggatga

SEQ ID NO: 13820 - RNA, 1296 nt, unidentified
  source 1..1296: mol_type = other RNA; note = synthetic construct
atgggcagctggctgagacgagtgtttgggcctggagccgaatctccatccggggactcatcaggggctgacagggcagatagagccggaccagccacagctagtgcagcagcagcggcaggaacacgtaggggtggtcctctgcggccaaatcagagacgggaagccgtgcgggatgaacggctcctgccaaaacccgaaccaagacgcccttggcgagctcccaagtcacggcctattattcctgccgacgctggcgcccgtctattcagcgactccctgcgcacacggaatagagaattgcgaacgctggccaccgatcccgcacagttggctaggcacggtctgcccatctgggatacagaacgggacgttgccgacgctctcggcatcagccttggggagcttcgccatcacgccattcatagaagacgggagagggtggaacactatgtcacctacgccatcgctaagcggagtggcggacagcggattatccatgcaccgaagacccgcctaaaagccattttacgcaagttgcatggggccctggtcggcaaactccctgtgtctgagcacgcacacgggtttgtggctggcagatccgtacgaacaggcgccgctatccatgtgggcaagagagtggtcctgcgattggacctcagagagttcttcccaactgttaccgccgcgcgcgtaagggggtatctcatagcgctgggctatggataccccgtggctgccactctcgcactgttgaccacagagcccccccgccaaagggtcgatatcgacgggaccatttttcatgtgccggtgggcccaaggacttgcgtacagggagctcccactagccccggtctgtgtaacgcgatacttcacaaactggatagacggatagcagggctggcacggagagcaggattcgcctacactcgttacgccgacgacctgaccctgtcgggagatgaccttgacaccgctcaccgcctgcgcagacgggtagagagggtgatcagagaggagggctttgaggtcaaccctgccaagacgcgagtcatgacaggacgcggtgcccagcgcgttactggagtcacggtgaatcgagttcttgggttatctaggcgcgaacggaggcagatccgtgcgatggtgcactgcggcgatccagatagggcgaggcaggtggagggtttactcgcctgggttgagatgctcaacccggcccaagctgatgccttgcgtagggctccccgtaaaccacctgctaggccgggcgcacgacctgatagatga

SEQ ID NO: 13821 - RNA, 1323 nt, unidentified
  source 1..1323: mol_type = other RNA; note = synthetic construct
atgtctttcttcagcaccctccgagcctggatgggctcgctcttcggagaaaagcctgtgacaagagaggtgactcgactctcctctgaaccagaaactcctagtgctaaacaggggcccacaaaaacagtcctcggaagagccaaggataccgttgtggagaaggttgtgatgaccggtcccctgaaggaaaagcacagaaggctcttaaagcgggacgcaagactcctgcctaaaccttcacgtaagaggaggtgggagaagcgcgagaaggtgatgtcccaggctgaagcacgtagactgttcgcgggcaccctgaggactagaaatagaaaccatagagatctcctgcccgacgaggagcagttagtacgctatgggctacccgtctggcgcacagaggaagacgtggcccaagctcttggtctgacagtgcgccggctgcgtcacttttctatacatagggaacgcgacccggtcagccattacatcaccttcgcggtgccgaaaaggagtggcgggcaacggctgattcacgcacccaaaagtggacttaaggctgtccagcggaagcttttgtcccttttagtggagaagttgcccgtgagtccacatgcccacggctttgtaaaggggagatctgtccggacgggtgcagagggtcacgtagggaaagcagtggtactccggttagacctgaaagatttctttcctaccgtgacatacgccagggttcgcggcctatttatcgccctggggtatggatttcccgtggcagcgacattggctgttctaatgactgaatccgagaggcagccagttgaggccgagggcaaggtgtattttgtacctgtgggcccacgagtttgtgtgcaaggggccccaaccagccctgctctttgcaacgctgtcgtcttgaaattggatcgtaggctggcaggactggccagaaaacacgggttcacatacagccggtacgccgacgacctgtccttttcaggaccaagcgaggaaactgcagagcgcctgcgggctctggccaaaaagattattgaggaagagggcttccaggtcaacgccgccaagaccagactgcagagaaggggcggaaggcagactgttacgggagtgactgtcaatcaggtgttgggcctgagccgaaaggagcgtcggaaacttcgcgcgatgatccatcaggaaacctcacgaccagcagatgccgaacggagcgctcggatcgatggcaaactggcctatctctcaatgctgaatccccaacaggctgaagccctccgcacccgacgcaaaggtaggacgtcttga

SEQ ID NO: 13822 - RNA, 1302 nt, unidentified
  source 1..1302: mol_type = other RNA; note = synthetic construct
atgtccctattccccaaattgctaacatgggtgaagactgtgttcggacaaggcccacggacacgccaggtgacccgactttcaagcgcaaatggaggccctgtcgacgcctcaggcagacctgttgacgtagtgacagaggaggtggtgctcaaagggccactcaaggaaaaacaccgccggctggtcaagagagatcccaggctgctccctaagcccccacgcaagtcacattgggaaaagcgaaagaaggtgatgagcgcggaggaagcaaatcgtctcttctccgggactcttcgtaccagaaacagaaatttgagggacctacttcccgacgaggctcaacttgagagatatggcctgccggtgtggagatccgagcaagatgtagctactgctttggggatcaccgttcggcagctgcgtcacttttctgttcataggcagcgagatcgggtgagccactatgtcactttcgctctccctaagagatcgggaggccagcgactcatacacgctccgaagaaagggctgaaagccgttcagcggaagttactgagcttactcgtcgaaaagctgccagttagtcctcttgcccatggttttgtcaaaggcagatctgtgcggactggcgctgaaggtcacgtggggaaagctgtggtcttgcgggttgatctcaaggatttttttcccagtgtgagttacgcccgggtgagaggtctgctgattgcacttgggtatggctatcccgtggcagccaccctggcagtcctgatgacagagtctgagaggcagccggtggaggtcgatggccaggtattctttgtgccaataggaccccgcgtgtgtgttcagggcgcacctacctcacctgggctgtgcaacgcggtagttctgcgaatggataggcgcttagctggactggcccgcaagcacggtttcacatactccaggtacgccgacgacctcagcttctccggacccgaacagaagacagctgagaaattgagagccttggcggggaaaatcatcgccgaggagggctttcaggtgaacgcgcctaagacgaggctgcagagacgaggcggacgccaaaccgtcaccggagtaactgtcaaccaggtgctggggctgtctcgcaaagaacggaggaaaatgcgcgccatgattcatcaggaggcttctcggccagcagacgccgaaaatagcgcccggattgacggaaagctggcctacctcagtatgttaaacccaaggcaagcagaagccctgcgcaccaggaggaaaggtcgtacgaggtga

SEQ ID NO: 13823 - RNA, 1311 nt, unidentified
  source 1..1311: mol_type = other RNA; note = synthetic construct
atgtccctgtttgaccgcctctgggggtttttcaaaggcctgacaagtaaaccggtggaacgggatgtaacccggctgcctagccacgacgccaaagacggcagggctgcagacctgacgaaggaagtcgtgaggactagcggagagttgaagccgcaccatcgtcggctcatcaccagggaccaacggttgttgcctgatccctcacggaaggcacattggggccctcttggatacacggccaggaaaaaagtgttcgatgcatctgtggcaggccgactcttcgccggaactctgcgaacccgcaaccgcgaattgcggacactcgccactgatcctgcccagctcgagcgatacgggctgccaagatgggaggacgaggctaccctggcagccgctttaggtctgtctgtcaaccagctacgtcacctgtccacacacaggctccgggaaagggttccacattacgtagcttttgctatcgccaagcgcagtgggggtgagcgggtcatacatgcccccaaaaaaagactgaaggccgtacttcgcgcggtccacgcacaactggtgtccaagctaccagtccacccagccgcccacggtttcgtgaaagggagaagtgtcaaaactaacgccgaaggacatgtgggccgtgccgtcgttgtgaagctcgatctggaggactttttccccactgttacctaccagagggtaaggggactgcttgtaagcttaggctatggatatccggtggcagctacattagctgccttgatgaccgagtcggagagacagcccgttgagctggacggggaagtggttcacgttcccgttgggcccagagtgtgtgtccagggcgctcctacttcccctggcctttgcaacgccgtggtgagacgcatggacgcaaggctgtcaggactggccaagaagctaggtttcacctattcaagatatgctgatgatctggccttttctggcgatgaccctaagcaggtggacgtgcttattcacagagccacgcgcgtgatcgctacagaggggtttcgggttaatggtaagaagactagagtgatgcgacgaggagcggcgcagcgaattgctggcgtgacagtgaatgccaccttagggctgagccggaaggaaagaaggttgctcagggctgccgcccatcgcgaaaaaacctctacagtcgatgcgaaggagcaagcggtcctcaccggccaactagcttgggtgcagatgctgaatccaagccaggcagaggcacttagacggaggcgtgctcgcgcaattggtccacccgcatga

SEQ ID NO: 13824 - RNA, 1296 nt, unidentified
  source 1..1296: mol_type = other RNA; note = synthetic construct
atgaattggctgcgacggttctttgcctggctgtttggcccaaaacaggtcacacgggacgttgcgcgcctaccggaccattctggcggaagggctcccgacgtgctgaaggaagtggtccaaacagggggcccggttaaaccaaactaccgaaggctcgccgttcgagatgccagactgcttccagatcgttcgcgcaagggagggtggactggattggcttggcgcgccccaacctctgtaatgacagggaaggagtcaaggcggctattttctaactccctgcgcacgcgcaaccgcaatttacggaccctggccacagatgaaaaacagcttgcacgctacggcctgcctctgtggaggacagaaacggagctggccgctgctcttaatctgtccattgagcaactccgtcatttcagcatccacagggtgcgtgatagagtccctcattacgtagcgtttgccatacctaagagaagtggcggtgaaagagtcatccacgcacccaaaaagaaactcaaagcagtgctgcggaatgtcaacgatcaacttgtgtcaagacttcccgtgcacgcggcagcccatggatttgtaaagggacgtagcgttaagaccaacgccgagcctcacgtcgggagagctgtggttgtgaagctcgatctggaagacttctttcccaccgtcacttgggctcgcgtgaggggactgttgatcagcctgggttatggctatcccgtcgctgcagccttggccagcttgatgaccgagtccgaaagacagcccgtgactgtagacgggcagacgttccacgtgcccgtgggagatcgggtgtgtgtacagggtgccccaacctctccaggcctctgcaatgccgtgacccggaaaatggacgcacggttgtccgggttgagtaagaagctcggcttcacttactccagatatgccgacgacctcacgttcagcggcgacgacgctaagcagattgaaaccttactgaacagggctactagaattatccacaccgagggcttcgttgtgaatgggaagaaaaccagagtgatgaggagtggaaacagccagaaggttgctggggtcacagtcaatgaaacactgggcctaagtcggaaagagcgacgcaaaataagggctgcactccaccaggcaacccctgagaagagggcccagctggagggtacacttgcctgggtgcatatgttaaaccctgagcaagcagcaaagctcaaagccgatgcggtgcgagcgcctacttcaccaggtcccactactacatga

SEQ ID NO: 13825 - RNA, 1305 nt, unidentified
  source 1..1305: mol_type = other RNA; note = synthetic construct
atgacttggctcatcgcacttatggtcctggccggcgtgttcgtgttgctccgagccttggcccgaaaaaagcaaaacgccattcacacaatcgagcctggcctcacccaggacgagcctacaagcgattccgcatccggagggtcaaagtcacagcttgaacctaaaactacgcagagcctccgtaagcagacaattgatgaaagattactccccaaagccccttctaggggcccccatcatccacgcagcagactcttcgatgcagcctcggcgaggcgccgattctctcacagtatgcgatgtaaaaatcgtgacctgagcgtgctggcagaggatcccgaacagttggctagacacggtctacccctatggcggaatgaggcccagctggccgaagcactggggctttcggtcgggcaactgcgccacctgagcatgcacaggatagcagagcgtaccccccactatatcactttctccattcccaaaagaagcggcggtaacaggctcattcaggctccgaagagaaaactgaaggccgctcagaaaaaggtcctgtcacttctgatccataagcttcccgttcacgaggccgcccacggatttagacagggacggtctatacgcaccggcgccgaaccccacgtacatagacgcgttgtcatccgtctggatatcaaagactttttcccgagtctaacattcgcacgaatacgcggctacctgattgcgatgggttatggttatgaggtggctactaccttggcctgcctttgctccgaaccacagaggcagccagttgaggtgggcggggagatcgttcatgtgccagttggccctagggtagctccacagggggctccaacatcacctggcttgttgaatgctatctgtcataagctggactgccggatgcagggactcgcgagagcacatggatttgcctacactcggtatgcggacgacctcacgtttagtggagactacccggatcgcgtggggaagatcctgtctcgggccagagccataatccggagcgagggatttgaagtgaatccaagtaagaccctcgtgatgaggcgcggcaaagctcaacgggtgactggtgtcaccgtgaacgagacattaggactgtccaggcaacagcggcgcctggtaagggcagcaattcaccaggcttcttttgtgtctcctatggacgggacgtccaaggcccggttactggggaaggtcgcttacattcagatgctgaaccagtcccaagctgagcctttaaggagacaaaccgaaaagctgacctga

SEQ ID NO: 13826 - RNA, 969 nt, unidentified
  source 1..969: mol_type = other RNA; note = synthetic construct
atggggttcgtcgactggttgaaggggcttttccggccgaaacctctcatgcgggatgtttctaggctagaccgcgaaggcgggtcactggacgctgtccaggaggaggtccgtcctgagagtggaccactcaaacccgggcacctgagaaccgtaagaagggacccgcggttgctccctaagcccaaacccaagacacccctgcgggggaagcgcaagaaatggatggcagcctccgagagcaggcgactttttgctggcaccctgcgtacaagaaaccgccacatctcggacctgctgccagacgaagctcagctgcagaggctcggcctgccagtatggcgggatgaaggcgaagttgccgtggccctgggagtgagcgtgaaagagctgagattcttctcaatccacagggaggctgagcgagctccccattatgtctctttcagcatacctaagcgcaacggcggcaggcgcctcattatggcgccaaaacgccgcctgaaggcactgcagcgaaagctccttccacttttagtcgacaaactccctgtgagtggacacgcgcatggatttagagccggtaggtccatccgaaccggcgcagaacctcatgtcgggaaggctgttgtgctgaaaatggatctggctgactttttcccatccgtaacatacgttagagtgcgaggtttattgattgcactgggctatggatacaccgtcgcagccactcttgcagccctaatgactgaagccgagcggcaacccgtggaggtgaatggggtgagactgcatgtgcctgttggtcccagggcgtgtgtgcaaggagccccaacgtcccccggcttgtgcaatgccgtggtgcgtcggttagatctccgcttggccggtctagccaggaagcacggctttagctttactcggtacgctgatgatttgtgcttttctggagcacactggagaagatga

SEQ ID NO: 13827 - RNA, 1290 nt, unidentified
  source 1..1290: mol_type = other RNA; note = synthetic construct
atgtctctgtggaggtggattaaaagttggtttggtgccgctcccacacgggatatcagtcgactagacacgactcgcagcgccagctctgcaaccggtgacgtcgaagaaagaatcgatatttctggcgggcctctgaaagagcatcaccggaggagagcattacgtgacccccgcttgctgcccaaaattaaatcaccagcccgccagcttgggttaactaagaagaaggctgtgatgtcgcagaccgaagcgaagcgcttattcggagggaccttgcgaacgcgaaatcggcagctgagggacctgttgcctgatgaggaacagctaaagaggttgaatctgcctctctggcgaacagaggacgatgtggcacaggctctcgggatcagccggcgtgagttatggttcttctcaatccacagagagcgtgagagaaggccccattacgtgactttctcacttccgaaacgatccggaggccagcggcttatacaagcaccaaaacgccgcctgaagtccatacagcggcgcctggtatctctcctggtaagccacctgcccgtgtccgaacacgcccatgcgtttcggccaggccgtagcatcaggacaggagccgaaccccatgttggccaccgcctgctgcttaaactcgacctgcaggagttctttccgagcgtgacttttgcaagagttcgaggcctcctcatttcctatgggtattcatatccagtggcaaccactctggccgtcctaatgacagaagcggagcgccaacccgtggaggtcgatggagaggtttttttcgtgccagtcgggccaagacattgtgttcagggggcccctacctctcctggcctgtgtaatgccttgctgctgagattagaccgtagattggccggcctggctaggaagcggcagctaacctacacgcgctacgctgacgacctcaccttttccggtgatcttgatcgggcccaggctgagtcacttagggcactcgccacccacttgatcgcttccgaaggattcactgttaacagtaagaagacaagaattatggccagcggagcccggcaatctgtcacaaacgtagtggtgaaccagacactgggtctgtcccggaaggagagaaggcggtggagagccagtgcccaccagctgagcagaaggcctgagagtgaacgcgcaggccttcgagcgcaactcgaaggcaggatcgcattcctccacatgctgaaccctaggcaagccgaggctctcgctagaaggctcccggctctgcagtga

SEQ ID NO: 13828 - RNA, 1275 nt, unidentified
  source 1..1275: mol_type = other RNA; note = synthetic construct
atgggcctcctggattttattcgctccctgttcggacctcctaaaagggatatctcacggttaagcggagagacagtggccggggaggatgaggttgacgagagagtggatgtgtccggcggactgctgaaggaacaccacagacgaagagccctcagggacccacgcttgcttcccaagcgtaagagtgtgggcagacagctgggcctggccaaacggaaacgagtcctttcagcagccgaagctgaacgcctttttagtgggacaatgagaaccagaaacagacggctgcgcgacctcctcgttgatcccgagcagctgaaaaggctcggtctgcctctctggaaaacggaagaggaagtggcagccgcccttgggatctctttgagggaactgtggttttttgcaattcatcgtgagcgggagacacagcctcactatgtgacatttgcgatccccaaaagaagcggcggcaaaagaaccattatggccccaaagcgacgacttaaggctatccagcgcaaactgctgggccttctagtggagaagctccctgtctctgaacatgcacacgccttccggaggggacactctgtcagaactggggcggaaccacatgtgggcaagaggatggtactcaagttagacctgaaggatttcttcccgtcagtgaccatggcccgtgtacgcgggttgctgatagcgtgtggatacagctacccggtagcgaccaccctcgctgtgctcatgaccgaggccgaacggcagctggtttctgtggaggccgaggtcttccatgtgcccgtagggccacggcattgcgtgcaaggagcacccacttcccctggtctgtgcaacgccctggttctgcgcctagacaggcggttggctggtctagctcgcaagcggggcttggcctatactagatatgcagatgacttgacttttagtggagagttcgaccgcgccgcagcacaacaattcaggcaggttgcgtccaggataattagcgaggaaggcttcaccgtgaatacagcaaagacacgtcttatgggtcgaggagctcgccagtcggttaccggggtggtcgtcaatagcgtcctggggttatcccggcagaggcggaggcagttacgcgctatggcacaccgtctcaaactagctcaacgggccggtacggccgagggaactgaactggctcgatttgctggccacatggcctacctggctatgttgaaccccagacaggctgccaggatcccagtggtcgactga

SEQ ID NO: 13829 - RNA, 1266 nt, unidentified
  source 1..1266: mol_type = other RNA; note = synthetic construct
atgagcctcctggcctggctgaagcgcctctttggccgcgaagtgaggagggacgtggcccaacttgaacgcggcgaggtggatgccgttgcagagactgtcgacctgacgggtccccctctgaggccacatggccaacgacgagcatggagggatcggcgcctagtccctaagaggaggtccttagggcgggccctgcgactaaccaaacggcagcccctgttaagcaggacagaagcagatcggctgttttccggaagcgcgagaactcgggacagacagcttcgcgatttagctcccgatgaagaacagctcagaaggtatgggctccccgtatggcggacagagcaggagctggccaacgctctagaactcaccctgggccagttgcggcatttcgctatccatagagagcgggaaagacagccccattacttcacttttgcaatacctaagagatcaggcggcgagcgtcacatcctggctccgaaaaggcgactcaaagccctacagcgccggcttttggagcagctgttcgcaagactccccgttggcgagccagctcacggattccgcagaggcagaagtgtgcgtacagcagccgaaccgcatgtagggcagcgacgcctgctgcaactcgacctgcaggacttttttccatcgctgacctttggaagggtccggggattgctgattgggtatggatatgggttcccagttgccaatgccctcgcccttttggtaacggagtgcgtgcgccagcctgtggagatagacggtgagatctttcacgtgcctgttggtctgagacacgctgtgcaaggggctcctaccagtcccgcgatcgccaacgcgttggtcctccgacttgatcgtcggctggccgggttagctcgcaggttccgttgtcgctacactagatacgctgacgacctgactttctccggagagttagacgctgccgcagctcagcaactgcgtcgcttggccggccacattattaggtctgagggtttcgcggtgaacgccgccaagacaagatcagcaggaccgggcgcacgacacgaagtcaccggtgtgaccgtgaacgaagtcttggggctttctcgggaagagaggcggtgcctcagggcagcagctcacagattgcaccgtgagcctgataatgccgaactggccgcaaggctgcacggacaactggcgtacctgcatatgcttaatccagcccaggctgagcggctccgacagagacttccaacaagatga

SEQ ID NO: 13830 - RNA, 1287 nt, unidentified
  source 1..1287: mol_type = other RNA; note = synthetic construct
atgagtctgttcgattggatccgccagcggctattgggaggagccagaagacgtgacgtcagcagactcgagtcgggggacgacgctctagatagcgtgacagaactggtggctgtcagggggggacccctcaaaccaggtcatcgccgactcgctctccgggatcctcgtcttctgccaaaaccgccgagagcccctgtcaggcttggtaagcgaaagaagaaccctttcctagctaccgctgaggcctctaggctgttctcagagagcctcttaactcgcaaccgcggtctacgcgatcttgcaactgacgaggctcagcttaccagactgggcttgccactctggcggacggagtccgagatagcaaccgccctgggcttgactgtcggccagcttagacacttttccatccaccgcgaaagagagcggaccccccactatgtaacattcgccattcccaagcggggcgggggtgaaagactcataatggccccgaaaaggcgcctcaaggccattcagcggacgctgctggcccagctcgttgacaagctgcctgtgacagaacacgctcacgggtttcggagggggcgatcaatccgaacaggggccgaaccccatgtaggacgtcgcgtggttatgcatttagacctgaaggacttctttccatccgtgacatttgcaagggtgcgcggctacttagtcgcgtgcggatacggctatcctgttgcgactactcttgccttgttaatgactgaggctgcacggcagcctgtgtcaattgagggtgaaatattccacgtgcccaccggactgcggcattgcgttcaaggggcgcccacgtctccagccttgtgtaatgctattgccgccaaactggacaggcgcttggcaggactggcaaggaagtttggcgtcgcttacactaggtatgcggatgacctgaccttctctggggatctggatgccaaaatcaccggccggctgcttcatcatgtgggcgccattatccaggcagaggggtttacaatcaacagtgctaagacccgaatcctgcaccgtggccggcgacaaagcgtaaccggagtcacagtgaacaaagatgcaggactgtcccgtactgagagaagagtgctgagggccacagcccacagactcaccaccctcaggagagaaggtgcgcctgacgcagccgcagaaagggtgttggctggccagctggcatacctggctatgctgaatccagcccaggcagctgccgttcggaataggcaaggccccgtgtga

SEQ ID NO: 13831 - RNA, 1428 nt, unidentified
  source 1..1428: mol_type = other RNA; note = synthetic construct
atgagggtggaatttttcatcttgagaatctggacccgtatagcagctgggctctctagactgccaagatgggcaaaaatccccatctggatcgtcctcgccatattaatggtcctcgtgcttgtgattggtggcctgttggccaccgtttttggactgattagaggcattctgttccggattttcccaccaccccccagtcgcgatgttagccggctggacatggatggggccgagttagatgctattcgtgagactatcgaggacgaaggaaaaccccttcgggagtctcaccggcgtttaatctacagggaccctaggctgttgccaaagccgaagcctcctgccgatgtttggcccaggcctaaacgcaagagagtgatgcaggtagaggaggcatcacggcttttttccggaacactacgcacgaaagaccggaatattcgcgatctcttggcagacgaggagcaactcgagcgtcacaggctgcctagctggcagaccgaaagtgatctggctgacgccctggggctcacaatgggacaactgcgccattacagcatacatagagagtcagagacagctcggcactacgtacagttcgctatacccaagaggaacgggagacaacgcatcatcatggctcccaaaacaagactgaagggcatccagaggcagctcaatgagcagctggtccagcgccttccagtatccccgcacgcgcatggctttaggaagggtaggtccgtcaggactggagctgaaccgcatgttggccgcaaggtgctgttgaaaatggatctcaaggacttctttcccagcgttacatttgggcgagtccggggtctacttattagcctcggctatagttaccctatagccactacattggccgtgctcatgacggaagctgagagacaacctgtgcagcttgaggatcggttagtccatgtgcccgttggccacaggtactgtgtgcagggtgcccctacttccccaggcttgtgcaacgcaatttgtctgcgaatggatcgccgtctagccgggctggcacgcaaatatgggtggtcttatacccggtatgccgacgacctgaccttcagtggcgacgacgaatctgccctgtgcgatatccggcggctggcaagacagatttgccgagacgaaggattcgaagtgcaccccgaaaagacccgagtcatgcggcaaggccgcaagcagactgtgacgggggtgactgtaaatgaagtggccggactcagcagaaaggaaaggcgaagactgagagcggctatccacaggctgaaacacccatcacctgatcgaccagcgtcgatgaccgagtcccaggtgcgaggtcacctggcgtggctacatatgcttaacccagagcaggccgagaggctgcgcgaacagtggacctcatga

SEQ ID NO: 13832 - RNA, 1266 nt, unidentified
  source 1..1266: mol_type = other RNA; note = synthetic construct
atgtcctggtggtctagcctctgggagcgtttgacagcctggtggcggggtgaacccactaggtccgtagcaagaattggcggagatgctgacgtcgatcaggttgtcgagacagtgaggctcagcggaacactgaccgagcatggccgacgccgcgttcttcgagatcccaagctgctgccgaaaccgaaaactgccggatggagcatgggtaagcggcctcgcatcctgactagagacgaagcctataggctgtttggcgggacccttcgtactcgcaaccgagagatcagggatctgctaccagacccagaccagctgcagcggcatggcttgccacatttggcctcagaagttgagctcgccgccctgctggacgtgtcactaactgagctcagatttttcagtattcacagagtagctgagcgccagccccaccacgtggtctttcggataccaaagcggggggggggcttcagaacgattaccgccccaaaacgcagactgcgaaccgttcagagaagactgctggcccgccttgtcgacctccttcctgtctctgacgcagcgcacgggtttcggaaagggaggagcgtggctacccatgctgccccacacgttggcaggaaggtggtggttaaactggatctcgaggatttcttccacacagtgacatggcagcgggtacgaggttacctaatcgcaatgggctatggctaccccgtagcgaccaccatcgcggtgctggtgacggaagctgaaaggcagcctgtggacctgggcgacagagtcgttcacgtgcctgtgggacccaggaggtgtgtgcaaggcgcacctacctcgcctgcactgtgcaatgctatcgcacacaagctcgatcgacgtttattgggcgcagcccgcgcactcggttttacatatactcggtacgccgatgatcttaccttctccggggatgacgccactagagtgtctgctcttttgggattagtgcgtaagattgtggtcggcgaaggtttccggctgaatgacgctaagaccagggtgatgagggcaggagggcgccaacgtgttacgggagtgacagtgaaccaagtcctcggcgtgagtcggcgcgagagaagacgagtccgggctatgatccatcagcatggaggtgatcccgcctggcgcgacaggatagcgggacaattagggtgggtcggggccgtaaaccctgaacaggctggaacattgcgggccaggtggaaaagaggcgggggttga

SEQ ID NO: 13833 - RNA, 1257 nt, unidentified
  source 1..1257: mol_type = other RNA; note = synthetic construct
atggctctgtttcgatggatagcagataaactgtttggacctcctaagcgagatttgagccgccttgaaaataacgatgtggacctggtggacgagagtgttgatctgagcggtggccctctcaaacccggccaccatcggaagtccctgagggacagaagactgctgcccaaacgcaaggcctcgggtctgtcacccctgaagcgggtgaaactcttctcaaaggaacagagcgataggctcttctcacggaccatgcgcacaagcaatcggaacgtccgcgaccttaccgaagacgaggatcaactccatcgatatgggttgccgctctggaagtccgaacatgacctagcgtctgccctctccctctccgtaaaggagttacgccatttcagtattcaccgatttcaggataaggtgtgtcactatgtgctcttcagaatcgccaaggcacgcgggggccatagattaataatggccccaaagactaggctcaaaaaaatccaacgtgaattgttgcgtcaggtattggaaaaactgcccccacctcctcatgctcacggatttgtcaagggaaggagtgtgaaaacaggggcctcccagcacgttggaaaaaaggtggtcgtcaaaatggacttagcagacttcttcccgtcagtaacctttcccagagttaggggcctatttatcgctctgggctacagctttcccgttgctactactctcgcagtcctgtgcaccgaatgcgagcgtcaacgcgttaagcagggagatgaccttttccatgtgccagtgggagagaggcactgcgtgcaaggtgccccaacgtcccctgccttatgtaaccagatcgccagaaagctggacaatcggctgcacgggctcgctctgaaactcggatttacgtacactagatacgccgatgatcttacattctctggcgacaaccccgaaaagctgaagagtctgctgggcctaaccagaaaaattattgaggacgagggcttcaggcttcattctaagaagacacgcatccttcactctggtgggcaccagcacgtgacaggcgtgaccgtcaatcaggctctggggttgtctaagaaagagcggaggcggttgcgggcggagttacaccagctgagcctgaatcagcagccagatccacaacagattgcacgactgaaagggaaactggcataccttgagatgctaaacccggagcaggccgcgagacttagggctaagtatcctctgtga

SEQ ID NO: 13834 - RNA, 1359 nt, unidentified
  source 1..1359: mol_type = other RNA; note = synthetic construct
atgtctggtttcgttactttcatcgccgtaatcctcggggtcattgtgtacacctatttaaagcgcgccaatgctcgaagaaagcacaaaagggtcgtggaggaatttaagaaagcccccgtgcgggatgtgtcaacggtggctggagagggggacgcaggcttgaagacagagactatacagattggcgggcctctcaaaccaaaccacaagcgtctggcgctccgggacgatcgcgttttgccaaagccacccctggggccagattattactcgaaatggcccagaccccctaggccaaagtacttctctgaacgggatgctgaccgcttgttcggcccgtctctccgaacctccgctagagatgtaatggaccttgcgaccgatgaggctcagctcaatcgttacggccttccactgtggcggacagaagctgaagctgcagccgctctggggattcctcacgctcagttcaggtatttttcccagcacagacatagggaacacatctcccactatgtggccttcgctataccgaagaggagcggcggggaacggattattcatgcacctaagactaaactgaaagcagttctgcgtacactggacaagctgctcgttagcaaactgccggtgagtgaccatgcgcatggattcgtgcgaggtaggagtattgccacaaacgccaagcctcacgtgggaaagccaatggtcgctaagtttgatatcaaggactgctttcctacgcttactgtcaaccgcgttcgcgggctgctactggccttaggttattcataccctgtggcagcggccttagccgtcctgatgaccgagcctcccagacaactagtggaggcagagggaaacatctaccataccccaatagggccccgcgtatgcgtccaaggtgcacctacttcccccggtctttgtaatgccatcttgctgcggttggatcgacgtctcgccggattagccaaaaaacgaggcttggcgtacaccagatatgccgacgatatgaccttttctggccccgaggcagagatcaagaaacttctcggaatcgtgcccaaaattgtcagcgaggaggggtttgagctaaacaccgaaaaaacacgcctgatgcggcaaagtggcaggcaggttgtggccggagtcacggtgaataaagacatgggactcagccgcaaagcaagaaggaagctgcgggcagccatccatcacaattcacagggcaagcttgatgtaactgctgccgccagactggaaggcaagctgggatacctccacatgctgaacgtggaccaggcccggagactgagagaaggcagggacggcacagcagctcagcagaggtga

SEQ ID NO: 13835 - RNA, 1344 nt, unidentified
  source 1..1344: mol_type = other RNA; note = synthetic construct
atgacaggcatcttacggctcctggtgttcataggtctttttgtggccgtttactacggatataaggcttatcaacgctggagacataagcagacggtgaaggagtttaaaaaagcccccgtgagagatgtgagcactgtggccggtgagggggtcgcatcactgaagaccgagaagatcaacattggaggcctgctgaagcctaaccataggcgtctggcccttcgcgacgaacggctacttccaaagccgcccttggggcccgattactatagcaaatggcctcgacccccaaaacctaaatacctctcagaaaatgatgccgatcgactgttcagtccttcccttaggactagcgttcgagacgccatggatttagcaactgacgaggcccagctcaagcgctacggtctgcccctgtggaagaacgaggctgatgtagccaacgcactgaggattagtcagggtcagttcagatacttctctcaacacaggcatagggaacagacaccacactacgtagcctttgccataccgaaacgcaacggcgaagagcgaattatccacgcgccaaaaaccaaactgaaagcagttctgcgggcgctcgacaagcagctcgtctctaaactccccgtttcagaacacgctcatggatttgtgaagggccgttccatcgctactaatgctcgccctcacgtggggaaacccatggttgctaaatttgacattaaggattgcttccccacaatcaccatgggcagggtgcggggtttgttgctcgccctcggctatagctaccctgtggctgccgcattagccgtcgtcatgacagaggcgcggcgacaaccggtagaagctgaggggaaattgtaccacacccccacaggacctcgcgtgtgcgtccaaggagctccaacctcgccaggcctgtgtaacgccatcctgctcagaatggaccgccgtttggccggactggcaaagaagcgggggctagcgtatacaagatatgccgatgacttaaccttctctggacctcagggagagatcaagaaacttctggggctggtgcccaaggtagccgcagaggaaggctttgcaattaatcacgacaagaccagactgatgagacagtccggcaggcaggcaattacgggcgtgatagtgaataaagatatggggctctcccggaaggtcaggaggaagctgcgggcagcccttcatcaccagaagctggggaaggccgacccagctaatactgacagactgaagggcaagctcgcttatctaaatatgctgaaccctgctcaggcgaaaagattgaaagacgtctacgcaccactttga

SEQ ID NO: 13836 - RNA, 1359 nt, unidentified
  source 1..1359: mol_type = other RNA; note = synthetic construct
atgcctcacctcacttacctgcagataggagtcttactgctgatcgtgggtctgttattgactcggggggcacgccgatggcttgtattgcggcgatggagcaaagccccacagagggacgtgtctgctctcgccaccacaggggaagcgcagtttaaaggggaggccatcacgactgcaggtccattgcggccaggccatcgcagactcgttctgagagataaaaggctcctccctaagcctcctcccgaccctgccattcttagacgctggcccaggccacctaaaccaaaatacctgacagaacaggaagcggacagactatttagtccgagtttgagaacgagcaatcggaacgtcatggatctagctaccgacgaggcacagctacagcgatatggacttccggtctggaactctgaggatgatgtggcctctgccctgtccttatccctggggcagctccgtcacttatcacagcatagacaccgcgaaacagccccacactatattacctttgccatccctaagcgttctgggggcgagaggctgatctttgcccccaagcggcggctgaaagcagtgctcagaactttggaccgcttgctggtgtgtaagctgcctaagtcggaacacgcccatgggttcgttcggaagaggtccgtcgcaaccaatgctgctccccatgttgggaaggctgtcctcctgcactttgacataaaggactgcttccccaccattcatttcggccgcgtgagaggtctgctgatcgcactgggctatagctaccccgtagccgcaaccctcgctgttctgatgacagaggctccccggcaaccagtagcagctgagggcaagctgtaccacgtacccactggacccagggtgtgcgtgcaaggtgctcccacctcaccaggcctctgtaacgctatcctgctccgcctcgacaggaggctgtcaggactcgcaagtaagtatggatttggctatacgcgatacgccgatgatctggccttcagcggcgatgacgccaccaaagtggcacggttactgaaacttgttcccgcgattgtggccgccgaaggattcgcggtgaacccggtcaaaacaagagtgatgcgtgccggacagagacaagccgtgaccggcgtcattgtgaataaagccatgggcctttcccgtcaggagcgacgcaagttgcgcgctgctctgcatcagcaaggcacagcaggtgcggacccgggagatgagttgcggcttcacggaaagcttgcatacctgttcatgctgaataagcttcaagccgctgctctaggctggaggcaggggatgaggcctactctgacaaacccaccttga

SEQ ID NO: 13837 - RNA, 1344 nt, unidentified
  source 1..1344: mol_type = other RNA; note = synthetic construct
atgactcacctcgccgcgctggtgttagcctacttccttgttgtgggcatacggaccgcttggagaaaccggaaacgcaaacaggcggagaagaagtgggcccaggctccccagagagacgtgtctgccgtcgctgacgtcggccaagctgagttcaagcaggagatcatcaagacctctgggaccctgaagccaaaccacagacggttgatactgcgggacaacagactcttgccaaaggctcctccagacccgaagcaaaggagatggcctcccccccctagaactaaatatcttacggaacatgaagcggaccgactttttgggccctcacttcggacgcgtaatcgcgacgtcatggatctggccattgatgaggcacagctggaacgctatggactcccagtctggaagaccgaggatgaggttgctgccgctctctccctgacccctggtaagctgaggtacttctcccagcacaggttccgtgaaactgctagtcactatgtgacctttgccattcccaaaaggtccggcggggaaaggcttattcatgccccaaaacgtcagttgaaggccgtgttacggcgcctcaatacattgctggtgagcaagctccctgtgagtaaacacgcccacggcttcctccagggacggtcagtggcaacaaacgccgccccgcatgtgggcaaagccgtagtcctgcatttcgatatcaaggattgctttcccagcatccattacgggagagtgaggggtttgttgatagcactggggtattcttacccggtcgcggccgctctagcagtcctaatgacagaatcccccaggcagcctgttgttgcagagggaaagacttatcaggtgccaatcgggccccgcgtgtgcattcaaggagcacccacctctccaggcttatgtaatgccatcctgctccgactcgatcaccggctagcgggtttagcccgaaaacacggctttgcttacacacgatatgcagacgatctaacgtttagcggaaacgacactaaaaagattgctaagctgcttaaactggtgcctcagattatcttcgaagagggatttgcagcaaatactaagaaaacccgcgttatgagagcaggacgccgccaagccgtaacaggcgtggtagttaacaaggatatgggtctgagccggcaagagaggcggaacctgcgtgctgctctccatcgacagaatacatcacctaatacaaatccaagggaaaggatgagactggagggcaagctggcatacctgtacatgctgaaccgcgaccaagcttcggccctggggtggaaaaaacctgccagaagtgtatga

SEQ ID NO: 13838 - RNA, 1341 nt, unidentified
  source 1..1341: mol_type = other RNA; note = synthetic construct
atgagcagctttctgttcgccatcgccgccatagcagccgtcattgtctggcagcgaagaaaagagattgtgcggacactgaggtggaaacaccaacccatccgcaatgtagcagcgctggccgtcaccgacgatgcgagtgttgccgaggaagtcatcacgaccgccggaccccttaaaccacagcaccggcggcttattctgcgcgacaagcgactgttacctaagccccccctcaaattcgatagatacgtatggccacgcccgaagcagcctagggtgttcactaaagcagaggccggcaggctctttagcgccactctgcgaactcgcgacagaaacatccgcgacctggcaacagaccctgaacaactagcaagatatggcctccccatatgggaatccgaggctgacctggccgctgctttgagcatttctgtgggccagctccatcattactccatccatcgtgagcgggagcgggcatcccactatgtgtgtttcgccgttcggaaacgtggagggggcgagaggctcatttacgccccaaaaaggaggctgaaagaattgcagagacgcctgcacgatctcttggtgcgcatgctccccgtgagtgctcacgctcacggatttgtccctggccggtctatcgctaccaatgcagcaccgcacgtagccaaggccgtcgttcttaagtttgacattaaggattgctttccaaccattcattttggcagagtaagaggcctgctattagcttacgggtattcttatcccctggcaacaaccctggccgtgctaatgacagaggcgcctcgacagcccttcgagatcggaggagctctctactacgtgcctgtgggccccagagtgtgtgtgcagggtgctcctacatcacctgggctgtgcaatgctgtcatgttgaagctggaccgtaggcttgcgggtctggctaaggcgaacggattcgcatatactaggtatgccgacgatttgacttttagcggcgataaggaggaagctgtggataggctcttagcctgggttccgaggatcgctgaagccgaggggttcgccctgaatgcctcaaaaacgcggataatgcgccgggggggtaggcaaacagttacaggtgttatcgtgaataagtcagcggggttgtctcggcaagagcgcagacgagtgagagcagaaatacatagattgtcccagagtgctacggctccagaaaacggagccacccagcgcttacggggcaagcttgcctacctgaacatgcttaacccactgaccactgcaccactccttgcagctttcgcccgactgtcggggcgtacctga

SEQ ID NO: 13839 - RNA, 1287 nt, unidentified
  source 1..1287: mol_type = other RNA; note = synthetic construct
atgggactgattgactggctgcgggcactagtgggcaaacccaggcaggttcggcgcaacgtcagcacaatagctgcaacttccggcgctgcccctgctgaacaaacggaggaaatcgtccagactgaaccacagccgatgaaaccactgcatcgcaggcttaccttccgcgacgctaggttgctgccgaagcccaaaagaaagtcaggacagttcacttggccacggcttaagaaaaagagatatatgcaggcggatgaagcatgcagacttttcagcaccgccctgcgcacgagggacagatctatccgggatctcgctacggacaaggcacagctcagtagatatgggttgcctgtatggcataccgagcaggacatcgcagctgcgctggctctgacaccaaagcaactccagcactactcgatccatcgttgcagggagacaagcccccactatgtggcctttgccgtgcctaaaagaggaggcgggcatcggattattcacgctcccaagcgcagacttaaagccatacagcgaaaactcaacgagctcctcgttgagatgctgcctatctcctcttacgcccatgggtttgtcaagggtcggagtattgcaacaaacgctaaatctcacgttggaaaggccgtcgtgctcaagtttgaccttaaggattgctttccttccatacacttcgggagagtgcgcgggctactgattgccttgggttacggttatcccgtagccgcgacacttgcagtgttgatgacagaggcacctagacagcccgtggaggtcgatggccgcctctatcacgtgccgaccggacctcgtgtttgtgttcaaggcgcccccacctcaccaggcctgtgtaatgccgtcctcgtgaggatggaccgacgtttgggcgggctggctaggaagtacggcttcgcctactcccgctacgccgacgatctgaccttcagcggtaacgataccgcagctgtacgccccctgctgggcattgtcccacgaatcgtgcaggaagagggctttactatcaacagcggaaaaactcagatccgacgtcggggacggcgacaaagagtgactggcgtgatcgtgaatgaatgtgccggcctgagtcgccgagagaggaggagattaagggccgcgatacacaatcagcagaggcacggggcggaagggaaatcacggaggcggctaggagggaagttagcctacctgaagatgctgaatcctacccaagcaggtccattaattgccgcctttcggtctgcttga

SEQ ID NO: 13840 - RNA, 1290 nt, unidentified
  source 1..1290: mol_type = other RNA; note = synthetic construct
atgcccggcggcaatcctgtaggcctgctggattggctggccagttggttcggtggacggaggcgctacagggatgtgtcaggcctggccgaagccgatgcagacttgacccgggaaagagttgacacaggaggcggcccactaaagccacagcacctccgccaagcggttcgggatgccagactccttcccaagcctcagcccactgcaggaatgtgggtgccgggccaaaaaaagaaagtcatgtcacagcgggaggcagacaggctgttttccgccacctttcggacctgcaatcgaaacctgcgagatttaaccacagacgaggagcagttgaggagatacggactgcctgtgtggaaatcagaagccgatgtggctcgcgctctgcagatatctgaggggcagctgagacattatagtatccatcgccaaagagagacaagcccacactacgtgacattcgctctcaacaagcggcgtggcggtcaccgcttgattcacgctcctaaacggcgcctgaagcaactccaaagaacgctggacgctcttctggtcaagaagctgcccgtgtctactttcgcccacggctttcgcgcaggcagatctgtcgcatccaacgctaggcagcatgtcgggaaagctatcgtgatcaaactggacctccaggattgtttcccaagcatccattttgggcgtgtacgcgggctgcttgtggcactggggtattcgtatcctgtgtccactactctcgccgtggtgatgaccgagagtccgagacagcctgtagccgccgaagggaaaatttaccacgtgcccgtcgggcctagagtctgtgtacagggagcgccaacgagccccggactttgcaatgcagttctcatgcgattggaccgccgactggccggattagctggcaagcacgggttcaccttcacccgatatgcggacgacttgacatttagcggtgacgatccggccaagatcaagttgctcctgacaattgctgcctgcattgttagggaggaaggatttcggctaaacccacagaaaacccgtgttcttcggcagggcgccaggcaacgcgttactggtgtcgtggtgaacgaccagcccggactttccagaactgagcgtaggaagttaagggcagcaatacatagactggacccagctgatgaggcagcctgtcggcgaatcgaaggtaaactcgcctacttacagatgttgaatcccgatcaggcggcccctctaaggtctgcgttcgtggctgctcggggtagggggtga

SEQ ID NO: 13841 - RNA, 1275 nt, unidentified
  source 1..1275: mol_type = other RNA; note = synthetic construct
atgggcttatggaactggcttaagacttggctgcgaccacaccccatcacacggaatatcgctaacctcgacggcgatcaagcacagtcagtgaccgaggtggtggataccagcggaggcccattgaagcctcatcatcagcgtcttgctgttcgcgatgtgagattcctcccgaagcctcagcgcccatcttccttaccgtcttggagccgtcctgcgaagcccgtcgtgttctccaagtcagacgccgaacgttttttctccgcatctcagcgcacaaaaaaccggcagctgcgagacttagccagcgataccgaccaactgcagcaatacgggttgcccgaatggaactccgaagatgaggtagccgccgccctgggtctgacggttagtcagcttcgccattacagcatccacaggcagagagagactagccctcactacgtgatgtttgccgtgcccaaaaggcaggggggacataggatcattcatgctcctaaaagacgcctgaaaaagatccagaggatgctgctagctgaactcgtcagtaaactgcccgtcagtgagtttgcccacggcttccgcagacagaggtcagtcgcaaccaatgctacccatcatgtgggcaaggccgtggtgatcaaacttgacctggcagactgttttccctctctgcactttgggcgggtgagaggcctcctcattgccttgggatatagctacgtagtggcaacaactctggcgatcgtaatgaccgaagcgattcggcagtcagtcgaggccgagggtaagatctattatgtccctgtgggacatcggttttgcgttcaaggtgcccctacatcgccagggctgtgcaatgcgatattgatgaggctcgaccgcagactggcaggactcgctgctaaacacggtttccagtattccaggtacgcagacgatctgacgttcagtggagatcaccccgcaaaagccccctatctggtcgcccttgccgggaagattattcgagacgagggcttccgggtaaacagaaagaagactcgagtcttgaggccatctcgtcggcagcagataacaggggttgttgtgaatcaacacgttggcctctccagaactgtgagacgccgactgagggccgctatccaccaacttagcgccaatgatgtgcacgctcggaaccagattattggcaaaatagcttacctgcggatgctaaacccagatcaagccgcaccactccaggcggctctagacgcaaagttgcagaattga

SEQ ID NO: 13842 - RNA, 1281 nt, unidentified
  source 1..1281: mol_type = other RNA; note = synthetic construct
atgtcctttctgaactggcttacaagtctgttcaaacccaaacctcctgctcggaacataagcggattagcaggcactgacgccatcgaggtggaggaacacgttgacctgtccgggggacctctcaaaccaaagcagctgcgactggcgacccaagacaaacggctcttgcctaaggctaaaaaggctatcgatccacgcaattgggtgccgaggaaaaagcctaagatcatgccccgggaagaagccgacaggaggttttctgaatccttgcggacatccaataggaaaatttcaactctggcctctgatgtcgaacagttggagagatatggactccccatttggaatagcgaggccgatatcgccgctgcactggaaatgtctacctcccaattaagacacttctcaattcaccgccaacgagagacatcgccccactatgttaccttcgcgattagaaaacgcacaggtggtcatcggctgattcacgccccgaagactagactgaaacgaatccagcgccaacttaacgagctcctggtgtcgcgcctccccgtaagtgacgctgctcatggattccgcgcccagagaagcgtcgccactaatgcagagccacacgtgggaaagcaggttgtcatcaagctcgatcttgctgattgctttccaaccatacattacggtcgggtgcgaggcatgctcatcagtctggggtactcatatgaggtggctgcggtgctcagcctgctctgcactgaggccgagagacagcctgtagctgccgacggcaagacctacttcgttccgatagggccaagggtatgtgtccagggtgcacccacctcacctggcctatgtaatgccgtgctgctgcgtatggaccggagactcgcaggccttgccaagaaatttgactttcagtacacgcgctacgccgacgacctgacacttagcggggacgatgcttctaaggctaaggtcctgattaggcttgccaaggaaatcgtgcaggatgaagggttcagattaaacagcaaaaagacccgtgtcgtccgccatggccagaggcaaagggtggcaggagtggtggtaaacgaccagaaagggttgtctcggacggagcggcgaaagctgcgtgcagcaattcatcagctggatcccgctgatgagaaaagtgcaaggcacttgaggggcaaggttgcctatctggcgatgctatccgaacagcaggcggccccattaagagcagccttggccgtgaagctaagcggcgatgcatga

SEQ ID NO: 13843 - RNA, 1302 nt, unidentified
  source 1..1302: mol_type = other RNA; note = synthetic construct
atgtcctttctggactggctcaagtccctatttaggccgaaaccggcgacacgaatcgttgctgggctcagcgctgcagacacatcagccgacgcagccaaggtgcgagaggtggtggacacctctggcggtcctctcaagcccggacactgccgtagagcactgcgcgatagtaggcttctacccaaaccgaaacctaagtctcaggggtacgtgtggccaaggccacccaagcctaaatatctggaccggtccgaagcggaccgactgttctcaacaaccctcagatgcagggatcggaatttacgggatctcctgcctgatcccgagcagttagatcgctacgggctacccctctggcagaccgaagccgatcttgccgaggccctcggcatctcagtcggcatgcttaggcactactcactgcaccggatcagggagacgacaccccattatgtaacctttgccattcctaaaagatctggaggtgaaaggttgatccacgcaccaaagcggcggctcaaggctattcaacggagactgcatgagcttctcgtctcccgcttacccgtttccgcagccgcacacggattcaggtcgggtcgctcggttgctactaacgcgcacccccatataaacaaggccgtgctgatcaaactggacctgaaggattgcttcccaagcatccatttcggccgagtgcggggcttgcttgtggctctgggatatggctatcaggttgccactgtcctggccgtgctcatgactgagccccctaggcagcccgtagagattgacggaaagcttgtctacgtgcctgttgggcctcgttcttgtgtccagggcgcaccaacatccccagggttgtgtaacgccgtcctgttgaggcttgatcggcgcctggcaggtttggccagaaagtacggatttgcctacaccagatatgcggatgatttgacatttagcggggacgacacggctaaaataaagctgatgattaccctgagtagcaaaattgttagagaagaagggttcagcctgaaccggcaaaaaacccgtgtgctgagacgaagtcgccgccaaactgtagccggtgtggtggtcaattctactgtaggcctcagccgtagagatagacgccgcttaagggccgagatccaccagctgtctcaggctgctaagccaccagacagtcacagagtgcagcgactggcaggcaaactcgcgtacctacatatgctgaatgctgaccaagccgctcctctgctggtgcagttcgctcggttgggagacggcagctga

SEQ ID NO: 13844 - RNA, 1323 nt, unidentified
  source 1..1323: mol_type = other RNA; note = synthetic construct
atgcccctccctgccgtgcgtccagtaacaggcacccccccttcccatagcacattgcctgcccttgagcgtgctcggccagcacagccacagaccctccaacctccacccactcctcagctgcagcgcgctccaacccctcctccacaagctagtgaaccccaggaggccggcgtcgaacagtctcagcacagacgactggctgtgcgagacgagaggctggcccagaaactggtcaccactcagcatgcggtgactgctaggcggcccagtaagcggtctttccacagagatgaggcggccaggatgttttcatccactctgaggacgcagcggagaggaataagagacttggttaccgatgaacagcaactggtgagatacggcctgcccatttggcgaacagaggccgaactggcactggccttacaggtaggactcaaagcactcaggcattatacagtgcaccgcgcgcaggatagggtgctccactacgtgacgtttgctatccccaagcgctcaggcggcgaacggcttatcaccgcaccgaaaacccgccttaaggcgctccagagacgccttaacgctctactggtttcgaagctccccgtgagtgaatacgcccatggtttccggactgggcacagcgtgcttaccaatgcaaagccgcacgtgggaaaacaggtggtcctgcgtctggatatccatgagttctttcccagcatccacttcggacgggtgagaggcctgtttttggccctcggttacgggtacccagtggccacagccctggctgtactgatgacggaggctccccgccagcccgttcagattggagaggtttgcttgtaccctccttgcggcccacgaacatgtccacaaggggcgccgacctcccctggtttatctaatgccctgcttgtccgcctggatcgtaggttggccggcctagccaaacaacgggggttctcctatacccggtatgctgacgacctgactttttcaggagacgacattgcagcagcacacgcgctaagactggctgcagcaagggtcgtcagggaagaaggcttcgagctaaatgttaagaagactcgtgttgccagaagagcaagccgacagctggtgaccggagtcatagtgaaccgcgtattggggctttcccggcagacacggaggaggttaagggccgccgtccaccagtatttacaagcccatgccgctggtgctgccgatccacgaacactggcaagactcgacgggcgcatcgcctatctctctatgctcaacagcgagcaagctagacgcttgactatggactga

SEQ ID NO: 13845 - RNA, 1260 nt, unidentified
  source 1..1260: mol_type = other RNA; note = synthetic construct
atgggattttttagctggatttggcggttactgggattcgccccccggaggaacgtgagcagattggacaccggggacgaagacgtggtacaggaagtcgtggacctcagcggcgatcccttcaaagaacaccaccggagaagggcgttacgcgacggcagactgttgccgaagagacgccagcacacgttctgggggtctaggaagaggtacctgagtaaagaagaagctgataggctgttttccgacacaatgaggacctgcgataggaaaatacgagatctcctgccagatgaagaacaacttgctcgctatgggctgcccccatggcggacagaggaggatctcgcaagagcattgggccttacactgaagcagttgactttctacgcacttcaccgggagcgagagcgtttctgccattacgtttcctacgcacgcccaaagaggaacggtggagagcgtatcattatggcgccgaaacgccgtctgaaagagctgcagcggaagcttgtcgacgacctagtgcggcatctgcccgtgtcggagcatgcccatggctttcgcgagggccgctcagtgaaaactaacgccgagccacacgtgcgcaagactgtggttgtcaagtttgatctaaaggactttttcccctccgtacacgtcgggagagtgcgaggctacttaatatctctgggctatgggtatcctgttgccaccagtatggccgtcctgatgactgaggcagaacggcaaccagtcgaaatcgatggcgaacggtacttcgtgcctgtgacctctcgatattgcgtgcagggtgcccctacgtctcctggcatctgtaatgccatcttgctcaaactcgatagacgactagccggtcttgccaggtccctggagttcgcttatacaagatacgctgatgacctcactttttcaggcaatgacgtgggagcggtcgagcgcctcagaaaatcagtgcagcggatcgtccacgacgagggattcagggtaaatagcgaaaagacccgggttatgaaaagaggtgcctgtcagagagtgacaggagtggttgtaaacgatggagttgggctgagtcgtaaggagcgaaggagactgcgcgctatggcccatcagctgcggcaaagcgcaaacggtgaagagtccaaggccgcaaggctgcgcggaaagattgcttatctcaggatgcttaatcctacccaggctggggctattgagcgacactggtcaaatcgtgggtga

SEQ ID NO: 13846 - RNA, 1260 nt, unidentified
  source 1..1260: mol_type = other RNA; note = synthetic construct
atgtcgctgtgggactggataaaagagagactgttcggtgtcccaccttcccgggatgtgtcacggctcgaacccggatctggacagcgggacgccgttacagaagccgtagacacaggagggggccctctaaagcctggccataggcgcagggcgatcagagacagacggctgttccctaaggcacgcacccctattggcaggaggccacgggtgatgaaacctcacgaggccagacgactctttagcgcttccctccttaccaggaataggagcatccgcgatctggctccggacgaggagcagctaaaaaggtatggcctgccactgtggcggacagaggacgatttggcacgggcgctcgaacttagtctcggccagctccgatggctatcaattcaccgggagcgcgaaagttgcccccactatgtgacattcgcaattcctaaggccacgggcggagagcgactcataatggcaccaaaacggagactgaggagggtgcagcggagactgcacgaacttctggtcagcaggctgcccgtatctcctcaagcccacggtttccgtccccgccgttccgttaagaccggagccgagcagcacctgggtaagccgatcgttcttcatctggacctcgcggatttttttccaactctggcttggcatcgggtgcgaggccttttgatcgcttacggctatagctatccagtggccactgtcctggccttattaatgacggaggccgagagacagccggtcgaggttgatggaaagctgtttcatgtgcccgtttcaccccgatactgtcccccaggagctcccacatctcccgggttggggaacgctctgctgctgagattggatagacggcttatcgggcttgcacgcaagttcggcttcgcatacactcgctacgccgatgacttaaccttttctggggaagccgagcgcaaaattgcttacgggctagtgtgccgtgtccgtgaggtagtcgaagctgaaggtttcagtctgaatgacaggaaaacccgatttatgggaagcggtagacgccagactgtgaccggggtggtcgtgaatcgcgtgctcggcttgtccaggaacgaacgcagaagattgagggcagccctccatcaacaccggggggaacccgatccgcaattgctgggcaagctggcctacctgtggatgctcaaccctcagcaggccatggcgttatggcctgctgactggccacgtccaagacgagcacgctga

SEQ ID NO: 13847 - RNA, 1251 nt, unidentified
  source 1..1251: mol_type = other RNA; note = synthetic construct
atgagcctgtggaaatggctgagttcaaagttgactggcaagccgcccagaagagacgtctctcgtttggaatcggaagacgaagaccaagtatctgaggcagtagatgtgtccggcggaccactgaagccagaccatcggcgccgcgctctaagagatcggaggctattaccaaaagctcagccaccggttcggtttggcaagaagaaacggctgatgagtaaagcagaggcccagagactgtttggagcctcaatgagaacccgcaatagaacactgagggaccttctcccagatgtcgagcaactgacacggtatggtctgccagtgtggaagactgaggaggaactcgccacagccctcgggctgacccagagacagctgtggtttttcgccttacaccgcgagaaggagagggcggcccactatgtgacatttgctatccctaaaaggggtggcggcgagagacacattatggcccccaaacgtcgcctgaaggctttgcagcggaaactgctcggtctacttgtcgaaaaactgcctgtgcatgaggcagcccacggattccgcaaaggacggtccataaaaagcggcgcagcattgcacgttggtaagaagctggtacttaaggtggatctcaaagacttctttcccaccgttaccttccctagggttcgcggcttgctgattgcttacgggtacgggtatcctgtggccaccgctctcgccctgctgatgacagagagcgtgcgacagcctgtggaagtagagggcaagctttaccacgtcccagtcggaccccgacattcagtgcagggagcccctacctctcccggcttgtccaacgcgctcgtccttaggatggaccggcggctgactggacttgctcggaagttcggttttgtgtacacgcgatatgcggatgacttagcattcagcggggatcatgatcacaagaccggttgggggttactgcagagagcccgtcgaatcatcgccgaagaagggttcgccgtgcaccccgacaagactgtgttgatggggagcggcaggagacagtccgttactggcgtggtcgtgaacaggacgctggggagatctcgccaacagaggcgaaggctccgcgcagcactccatcgtcgaagacaggctgaggctcggctcaggggacagctagccttcctctggatgcttaatcccgctcaagcatccgcgctgtggcctgaagagtggaagaaaccccaaagttga

SEQ ID NO: 13848 - RNA, 1221 nt, unidentified
  source 1..1221: mol_type = other RNA; note = synthetic construct
atgtcctggctggattggctcaaacaaaagctgctgggcattccgcctcagcgcgacatctcacggctggaaggctcaagtgaggaggttcgggaacaggtggatgtcagcggcggtcccctcaagcctaaacaccgcaggcgcgcacttcgagacaggagactcctgcccaaggcaagagcccctttgggaaaacgcccaaaacagatgagtcatagccaggctcagcggctattttccgcctctcagagaactcgcaatcgacagcagagggatttgttgtgtgatcccgaacagttgcagaggctcggcttgccagggtggcgcaatgaggatgacctagcccactcccttgggcttacactccggcagctctggtcttacagctattattgtcaggccgagaacgctcctcactatgtggcttttgccgttgctaaacggagcggcggagagagaattatactggctcccaagcgtagactcaaggccttacagcggaagctgcttgatctactggcccagcatctccctgtgtcgccagctgcgcatggcttccgaaagggccgtaacacgcttagtaatgcacgggagcacgtcggccagaaagtcgtggtccgatttgacctgcaagacttcttcccccattgctcctggcagcgtgtaaggggactgttggtggcttatggctatagctttcctgttgcaacctgccttgcgctgcttatgaccgagagcgaaagacagccagtggaaaccccggccggactggtatacgttcctgtcaggcagcgatactgcgtgcaaggggcacccacttctcccgcactggcgaacgccctgacactcaagctggacagaaggctctcaggtctggccaggaaactggggtttcggtacacacgatacgcagacgacctgaccttcagttcatccgggttagcaaggctcggggtacttaagagagccgtgacagccatcgttgaagccgagggtttccggttgaatgattctaagacccgcgtgatgcggcaaggtcgtcggcagacggtgactggggtggtcgtgaaccaggtcgccggcttatccagacaacagcgcagacagctgagagcagctctgcaccaggctgctggacaaccagacgcgcacctgcgcggaatgttagcctacctacatggactgaactctgagcaagccaggaggctgcaaccaccgtga

SEQ ID NO: 13849 - RNA, 1314 nt, unidentified
  source 1..1314: mol_type = other RNA; note = synthetic construct
atgcggcttctgatccttatcgctttaggctttctgttctggcgcctgtggaagctttggaggcagctgcgattgagacaccaggcccgccaccccgttcgagatatagccagactggtagacgatgcggacagtgatgcccgaggcgacactgtcgaacgtattgatatgtccggtggcccattgaagccgggtcataggaggcgtgccctcagagacaggagactgctcccaaagcccaagcgggactggtctgacccgaaacctccgaaagtgatgagccttgacgctgccacgaggctctttgcggggacacttcggacaagagataggcatgcccgagatctcgacactgatgccgagcagctggagagacacggactgcctccttggaggtcagaagctgaagtagccgcggctctaggcattgaggaaaaacgtctccgccattatgcgatccaccgccaaagggagcgcgtggtgcactatatcgcctttgccattgctaagcgcaacggaggggagcgagtgattttggcccctaagaaggaactgaaagcactccagcgcaaactgaacaagctattagttgacaagctgcctgtgagcgatgccgcacacggatttcgccccggaaggagcatcgctagtaacgcggccccacatgcaggcaaagccgtggtcctcaagttggatctggagaacttcttcccttcgctgcatgtgggacgcgtacgggggttgctcatcgcactgggttacgcataccccgtggccgctgggttagcagcgctaatgacagaatccgaaagacagcccgttgtggtggacggcgagactttccacgtccccacttcaagtcgtcacgctgttcagggcgctccaacctctccaggactggccaatgccctggcactgcgtcttgatcgcagattgacggggttggcaagagcgcatgggtttgtctatacccggtacgctgacgacctggccttctcttcagacgacgtcgcaacagcccggcaactgctgaaaagagcagagagcgtcattcgggccgagggctttagggtcaatcgagctaaaacccgggtgatgacccaagcttccgcccagcggatagctggggtgaccgtgaatgccgcaccaggttggagcagggctcagaggagaaaattaagagcagaactgcaccgggccagaacatccggcgctaccgatccctccctctggcagaagcttcgcggcaagctcgcattcgttaggatgctaaatcgggctcaaggagagcggatggcacgagccgattcttga

SEQ ID NO: 13850 - RNA, 1308 nt, unidentified
  source 1..1308: mol_type = other RNA; note = synthetic construct
atgagagtgctgctgctgctgttcgtaatctacgtcttttggcagattttcgtccgcttctggcccaagagggcaaccagagatttatcacgattggagaatgcagacgacgatgcagctgatgaggaggtcctcgaaacagtggcagtggatgggggccccttaaaagaacatcacaggcgccttgcactgcgggatgctcggctcttgcctaaggctaagccccgagctcatacttggccaccaaaaccgaagcctaaggtgatgtccatggatgaagccactagactctttgcgggcacgctccggacaaaaaatcggaaactgcgcgacctcaggtctgacgacgatcagttgagaaggtatgacctgccaagatgggcatccgaggaggatatagccaacgccctcggaatttcagtggcccgaatgcgctactattccatacatcgggaaaaagagagagtgagtcactacgtcagctttgcgattcctaaacgtagcggtggagagcgcatcatcatggctcccaaacgggagctcaagaagttgcagagggacctcgacaggctgcttgtgtctaagcttcccgtgtccgagtacgcccacggctttcgcaaggggcgcagcatcgctagcaatgcaagtgcgcacgtagggcgcaaagtagtggtgaagctggacctcaaggacttcttccccagcttacatgtgggccgtgtaagggggctgctgatcgcccttggctactcatatccagtggccgccaccctagctactttaatgactgaggccgtgcggcaacctgtccaagtcggcgacgaaatttttcacactcctgttggaggacgtcatgccgttcaaggggccccgacaagtccaggactggccaacgctctgaccattgctcttgatcgaagacttgccggggctgcccgggagttgggttttacctacacccgttatgctgacgatctaacattttctggcgacgatgcaggcaaagcaaggcagttgatcaggacctgccagcgaatcgttcacgctgaaggattcgccttgaacgacgccaagacccgggtcatgacgcagagaggggctcagctcgtgacatctgttaccgttaaccgtgaaaagggtctgtccagacggaggaggcgcctgctgagagcagagctgcacagagcccagcgagaaggaggtgacgcgacactgtggcgcaaactgcggggcaagctagccttcgtgtcgatgctgaatgccaggcaggcggatgcacttgccaaaaacgttagattccctggctga

SEQ ID NO: 13851 - RNA, 1311 nt, unidentified
  source 1..1311: mol_type = other RNA; note = synthetic construct
atgccgcgcgccttccgacgaggaggcactatttttaggagtcccagacgcttcagccatactgtcgaagaggctggccccgagcggaggagaagtccaagaagatggctcactccatgtgcttcttccacccggggcgcctctatgtcactttggcagcgcttacgagactggatacagccagcacccccagccgcaaagcctccagagcaggtgagcatctgcgaggaacctgcacatccaagccccgaatttaataggcgctttacaacctcccttagatctgccgatcctagtcagacgcgtcgtagaaccagatccgggcgcttaaggcaacggggtctacccgtatggcggtgtgacgacgacgtcgcccaggcattggggctgtcactgagcgagctctatcacttcgcctgccaccgactagccgaccctcacctgcactacgtgcggttcacaattcctaagcggggtggcgaagagcgccccatactagctccgaagccgaggttaaaagctatccaacgcgatcttctggaactggccctgcatcagctgccagtacaccgggcagctcacgcgtttttgcccgggagatcaatcgcaacacatgcccggccacatctgcagcgggagtttttactgacgctcgacctccataactttttcggggctttgcacgttggcagggtcaggggcttccttatggccatgggttatgggtgggaggtggcatctacgctcgccctgctgtgcactgaggctcccagacaggccgttctggtccacggagagcgcctgtacacccctaccgcttctcgaagcctgcctcagggagcgcctacatcacccatgctggcgaacgctatcgtgtgccgccttgaccgacgcctaagtgggttggcccggtcccttggcctgaactataccaggtacgccgacgatctgacttttagcggagacgatcctacaagaatcgcatcggtgatgcgactcacacaccagatcattgccgaagaaggcttcgaactcgcgaccgcaaaaactcgcattcagcggagaggccaaaggcagcaggtgaccggcgtggtggtcaatcagacacctggagccccgagagctaggcggagaaggctgcgtgccgcaatccatcggtacgctcaggcttgttcccgcggagaggatgatccactcaggaggcgtcaactcgaaggggagctcgcattcattcacatgttgaatccagcgcaagctcgtgctctggccgcaggtttgccagatggaccccccgttgccaacgccagatga

SEQ ID NO: 13852 - RNA, 1164 nt, unidentified
  source 1..1164: mol_type = other RNA; note = synthetic construct
atgaacctgtggcaacgtctaagggactggatgcagcctgcaccatcccctgaacatcccggcgaaatttctatctgtaaagagcgtgaacccccctcccctggattcaatcgcagatttaccacttcgatgcggagcgctcggcacgatgaactcaggcggcgtacaaggagtgggcgactccgaagacttggtctacccgtgtggagatgtgacgacgacctggctagagccttggggctgactacctccgccctttaccacttcgcctgccatcgtctcgctgatcctcacttccactacgtgagcttcactatacctaagcgttctggcgaggagaggcccatcctcgcgccaaaacctcgcctgaaggcaattcagagagatttgcttgaccaggccctgtctcgcctgccagttcatcgcgctgcccatgcgtttgttcccggcaggtcaatagccactaacgccagaccccatctgcggcgcgaattcctcctcacactggatcttcacaacttttttggtgcactacacgtggggcgggtaaggggttttttgatggcgatgggctatgggtgggaggtcgctagcaccctggctctgctctgcaccgaagcaccccggcagacagtcctcgtacacggagagcgcctgtacactcccaccggtagtcgcacgcttccgcagggagctcctacctctcccgtcctcgctaatgccattgcgtatcggttggatagaaggctgagcggcctggcccgcagcttaggattaaattataccaggtacgccgacgacctgtcattctcaggcgacgatccgacacgaatcgccacgctgatgcggttgagtcaccaaatcatcagagaggaaggctttgaggtggccccatccaagacccgcatccaacggaggggcagacgacagcaggtgacaggagtggttgtgaaccagacacctggggcaccaagggctaggaggcggagattgcgcgccgctattcatcattatgcccgagcttgcgcccgaggcgatcacaacccaagacgcagacggcagctggagggagagcttgccttcattcacatgatcaatccggcccaagcaagggccttagcagcagggctgcctgcagcaccaccagcagctaatgcgcggtga

SEQ ID NO: 13853 - RNA, 1170 nt, unidentified
  source 1..1170: mol_type = other RNA; note = synthetic construct
atgtcactgtggcagagacttcgtgattggcttcacactgacactcagccagattccacccccacacctgcccccgatagtgcacctccaagcagccctcctagcgcgactcataaccgacggttcaccgcttctttaaggacccatacccccgcccagtctttgcgacgtacacggtctgctcgcctgaagaggcacgggctccctctctggagaaacgatcaggccctggccgcagatctcgatctgtctactccagagttataccatttcgcctgtcaccgcttagcagacccccatagacattatatttcattcaacataccccgccgtagtggagctagccgcgctatccttgcacccctgcctagacttaaagccttgcagcgacgtctgctggccctcgcacttcataggctgccagtgcacgatgctgcccatgcatttgtgcccggacggagcattgcaactaacgcccgcccgcacctaggtaaggcgtttgtgctgtcacttgacctgaaggactttttcggttcactgcacctgggccgggttagggggtacctcttggctatgggctatggctgggaggtagcatcgacactggccctcctatgcaccgaggcacctcgccaacctgtccaggtgcaaggcgaagtgaggtgggccccagttggcagtcgcacgcttccacaaggagctccgacatcccccgccctcgctaatgctatcgcctacagactggatagacgcctgaatgggctcgcgcgctccctgaacctcacatatacgagatacgccgacgacctgagctttagcggagacgacccacaggtcctcggttcgctgttgcggctaacccaccagatcgtggtcgaggaaggcttcgagctagccagtcacaaaaccagggtccagaggcagggacaacggcagcaagtagccggcgtgatcgtgaatcaggttctcgggcggtccaggcaggagagacgacgattgagggctgccattcaccggtatgcaagggctcaggccagaggtgaatctcacccggcctggcgactggaattggaagggcggttggcgtttctgcatatgctgaatcccgctcaggcgagggcactgtcctctggtttacctgacgagcccccaggagcttccgccagatga

SEQ ID NO: 13854 - RNA, 1365 nt, unidentified
  source 1..1365: mol_type = other RNA; note = synthetic construct
atgtccaggcgcgggggtaagctttgtcggtccctgcttcacgggtcacactcttcagataagcggggcaatagaagcatcaccgagatcgttgcggcctgcctgctctgtggttggctgttcgcgatatctttaccattgccgcatttccgaaaggagaggaccgcaatgaccaacgccgcagacgtgctgcaagcctggagacttaactggcagcccgacgagtttgagtggcgttctctcacatgggagaatagggtcgacctcaatagagaagagcgggagcagaggaaacgcgaacgggccaggagagacaggctatccttcggcgggaggctatggggggtaggtcaagctcatcggtccgccgaactggattcagaacgtctggctaggtatggcctgcccgcatttgcgaacgagcgtgccttagctgaatggctggggattagcctcaagcgcctacgctggtattcttacgatcgaaaggtatcacccatctatcactacactcggtacacactgccaaaacgtggcggagggcagcgcgtcattctggctcctaaacggactcttaaggctatacagcataagatcttgttcgaactgctggcgaaagtgcctaatacagatgctgctcacggatttattaagggcagaagcatagctaccaacgccgctcctcatgtcggaaaggcttgcgtgttgaacctcgacctgaaagacttctttccgagtatcacctaccctcgcgtgcggggactctttgtggcactgggatacggatttacaatcgccagcgtgctggccttgttatgcacggaaagtgaaaggatcagcgtgcagagaggcgacaaaacacgctacgtggccatcaacgcgcggcatctcgttcagggagctcccactagtccagccattgcaaatcttatggctagaaggcttgatgcccgcctgcatggcctcgcagctaaacagggtgccgcttataccagatatgccgacgatctcactttctccgcggagtcggctgaagtggcaacaagactgttgcgtgccgccaagcgaattatagccgatgaggggctcactctgcacatggggaaaattcgctttttcaggcagagtgccagacaggtagtcaccggacttgtggtcaatgataaggtcagcgttccccgggacttgcgcagacgagtgagagcaatcctgcaccgcgccgttcaaacgggcttagcagcccagaacagggagggccgacaacacttccgggcatacctacacggtttgatcggccatattgccctgcagcacccagagcaagccgcacagatgctcgcaaaactgcgggagattcgagactga

SEQ ID NO: 13855 - RNA, 1188 nt, unidentified
  source 1..1188: mol_type = other RNA; note = synthetic construct
atgacatccgacgcgcttagggcctggcgcctgtcttatacagatgaagagttgcagtggaggtccgcagactggaggagcgagcagtcagagtggcgggctgaacgcgaacaacaacgccgcgagaggagacgtagagacagacgctactttggagttggattgaattcacagaatctgagccgaagagccctgaacgaaaagaaactcacagcacagaacctcccaatactaaagaatgagaaagcactcgccgaatggctgaacgtggaattgtcacggctgcgatggtatacttacaatcagactaccagttctgtctatcactacgtgaggtatgtccttcccaaaagatccggcggtcagagggtgattcttgcaccgaagaccgggctgaaagctattcagagaaaaattctggccgagatcttgaataagatagtgctcacagagcccgctcatggcttccggaagggccgtaacatcgtcaccaatgcttcgcctcatgctggtaaacctttcgttctaaacctggacctgaaggaatttttccctagtatcactttccggcgcgtaagagggctcttcactgggttaggatacggctacaccatcgcgtctgtcttagcgttgctctgcactgagagcgaccgggagatgattcagcgaccagacaggccctactacgcaggtctgagccctcgagccctcgtgcaaggtgctccgacctctccagctctggccaatctggctgcaaggcgtctggataagagattggcgggcctagccgttaagcggggggttacatatacacgttatgctgacgatctgacctttagcggggaggaccgcgatgtgctgtttaagctcatgaaaaccgccgggcacatcatcgccgctgaaggcttcactgtgcacccaaagaaaacccgcttttaccagagaggacagaggcagatcgtgacaggccttgtggtgaatgataaggtcaacacgcccaggcaaatgcggcgacaagtgcgggccatactgcacaacgccgcccagaccggactcaatgcccagaacagaatgaaccatcccaactttcggggatatgtacttggcctgattgcacacattgggcagacggcacctgatttagccgccacgttccgcggccagcttgtagcactgagtgattcctga

SEQ ID NO: 13856 - RNA, 1188 nt, unidentified
  source 1..1188: mol_type = other RNA; note = synthetic construct
atgtccgaccagtcagtactgcgggattggagactcaactggcacgacgacgagtttaaatggcgtcccgatcagagctgggcacggagaggccagtggcttgaagagagggaactcgctcggcgagctcgaagaagacgggatcgtggttttttcggcgatgagctctgggggactcccttgttcaaggccctgcacactccagcagctctggaacggttcggtcttcccgccttcgaaaacgaggcagccttggccatctggctcggaatccctctgacccgacttaggtggtatactttcagcaggcttggatctccagtgtggcattacgtccggtacgttatccctaagcgctccggaggcgagcgcgttatcctagcacctaagcgagaactgaagggactgcagcggaaagtgctcagagagattctggaaaagctgccactgagcgagccttcgcatgggtttcgcaagaccagatctattgtcacaaacgcggtgccccacacaggcaagaagtacgttttgaatctcgacctgaaagacttttttcccagtataacgttcagaagggtgagaggactgtttgtgtcacttggttacagcttcgccgtgggcacaaccctggccttgttgtgcaccgaatcagatcgtgcagtgatgcaaagaccggatcagaggtattacgtcagcttaaaccctaggcatattattcagggagctccaacctccccctacctagccaatctaattgcgagagatctggacctgcgcctcaatggccttgctcggaaacaccaggttgattatacacggtatgcggacgacctcacattttctggtgacgacctcgatgcgatcctgcggatcctgtccgtcgctaaagtcatcataaaggaagaggggttcgtattaaaccccaaaaagactcgactgtacaggaggtcagggcgccagagtgtgacgggactggtagtgaatgagaaagtgaataccccaagggagatgcgtcgccttgtgcgcgctattctgcacaatgcccagaaaggcgggctgaactctcaaaatcaggccaagaggccaaacttccgcgcctatgttcaagggttaattggccatataggccaaagtgacccgaaccgagctgcagccttgttacgccagctcgcagccatccctgattga

SEQ ID NO: 13857 - RNA, 1128 nt, unidentified
  source 1..1128: mol_type = other RNA; note = synthetic construct
atgtccactttcagttcattcatcaagaacatcaagaagggctttaccggaaagaacaagaagcccgaaaaggagattcagagccccaagattgccgtggccctttccagcgatgtctcgaaagtgccccagaaacttgatgatgttagtctgccagtgctccggggaaagtatgcgcttgcaaaatggttaggaatatctgccagcaggctgacctggttcacatatgagacaaagtacaattctgtgtggcattatgtccggcatatcatcccaaaacgaaatggtggagagcgggtaatactggctcccaaacgcgagctgaaggccctccaacgacgagttttagacgggatactcaaccaggtgcccacctctccacaagcccacggcttcgtgatgcaacgttccatcactactaatgctagacctcacgtgaataaagcggttgttatcaacctggacctgaagaatttctttccttcagtcaccttgccacgcgtgctggggatttttcggactctggggtataacaaagaggtggcacttgcactcgccagactgtgtaccgaatgcgaccgggaggtaggccctcacttggattctaagtacaaggacaaggaatttttcgtgagcgtaacccccaggcaccttgtgcagggtgctccgacgtcccctgccttaagcaatttggtctgctggaagctcgacaaacgcctgaatgggctcgcacagacctatcaatttacatacacaagatacgcagacgacttgactttcagcggcgatgacatacagtacgtggagctgatcctgaaagtggctaacggaatcgtaagggatgaaggcttcaaagtcaacaaagataagacgcatgtcttttatccttcctcacgccaggtcgtgactgggctggttgtcaacgacaaagttgccaccccgaggcagctgaggcgtcagatgagagcgattattcacaacgctcagtttacaggcctcgaagctcagaattacgagcaacatcctaactttagataccacttgctaggcgtggccgagttcatcggtagtacacatccagataaggccgaacagatgaaacagattattcacgctctaccatcatga

SEQ ID NO: 13858 - RNA, 1134 nt, unidentified
  source 1..1134: mol_type = other RNA; note = synthetic construct
atgatcgattggtatcagcagtggcgcggggaggtggagcaaagaaggcaggaacgggaaagaaggaggttggagcgacctctgcaggatcggcgatacttcggcgaggaaacgtggggggcatccgcagaacatctgaaagccgagacagacgaaccgtgtctgcagcacttgtatctcccactcctacggagtgaaaaggagctggccgcttggttgggaatccccctcacgagactgcgctggtttaccagggaccaaccggcagacacagtatggcattacgtcgcccattctgtccccaagagatcgggcggacaacgccttattctcgctcccaagcgcgacctcaaagcacttcagcgtcatgtgctgcaccacctgttgaaccacgtgtccgtgactgagatggcacacggcttcgtcgctggtaggagtattattagcaacgcgcagcctcatgtgggcaaagaaatcgtcctcaacttcgatctggctgactttttcccttccatcacattcccacgtgtccgcggcctgttcctcagcctgggttacagcttttctgttgcttccgtgttagctctgctgtgcaccgagcacgagagggaggccttcgaccatgatggtactcgatactttatatcagtaggtcccagacacttggttcagggagccccaacctcacccacacttgcgaaccttgctgcggcacgcctagatcggcggcttgctggactggggagggtccaaggattcgcctacaccaggtatgccgacgacctgactttttcaggcgatgaggtggctggggcctattggctattaaagagcgtgccccctatcgttagagaggaaggctttgtgattcacgaggggaagacccggctgtttcgtcaatctgcccggcaggtggttacaggcctggtggtgaatgagcagctcggaactccaagagaactgcgccgaagagtacgggctattttgcacaaagcccaccagaccgggctcgaagcccagaatcacgatgggcatgccgacttccgagcgtacctgcagggattaatcggctttatacatgaagccaatccagcccaggctgcacctcttagggcagccttagccgcactgtga

SEQ ID NO: 13859 - RNA, 1383 nt, unidentified
  source 1..1383: mol_type = other RNA; note = synthetic construct
atggcgaactttttcagacgcctcttcagacgcaacgccttaaaaagcgacattgtggcggacgccccacccgttactccaacaatcgtgccgaccccgcccgaagcattggtcatgccaacagcggctctccctttgcagacgcctatacaggtggaacaagtggcccaagccgccggtgctgtcgcttatgttattctgccatccgcatcagccgagccaaccccaacacctgtagcagtgcccgacgctaccccccttcctactgttacggtgaacggcgtcgcttacgctcaggatgacctcgacgaacgcgcactacgtgaccgggcaaccttcggcgatgaactgtggggaatcgcaaacggtaaggaggcaaatacaactgacgccgagaaactcgcccgcctgggcttaccactcctactgagtgagcaagacgtcgccgatctgctgggaattcctctcaacaggctgaggtggttcacttttgatcgcgctgccgataccacttggcactacgtaaggagggtggtgcctaaacgatctgggggggaacgggtcattctggccccgaagcaagaactcaaagctttgcagcggaaggtgctttccgatattgtgggccgagctcccgttgcacttgccgctcatggcttcgtccctgggaagtccacaattaccaatgcaagacagcacgtcgggaaagcggtggtcctgaaactggatttgcaggatttctttccctctatcacatttgcccgggtgagagggctgctgatcgcgttggggtatgcctatgctgtcgcaagtacgcttgcgctcttgtgcacagagtacgatcgggaggagtacacccgcgacggaacgagatacttcatcagcgtggggccaaggcatctggtacagggtgcccctacttctcccactctggctaatcttgtgagctggcaactggaccgaaggttaaccggcctcgcaggagccttcgactttacttatactcggtacgccgatgacctggtcttttcgggagataaccccgatgtagtgcagaagcttcggttccttaccgaacgcataataagggacgagcactttaccgtgaatcgaaagaagacccgggttgcaagacagtcagcccgacagatcgttaccggcttagtggtgaatgaagccgtggcaacaccccgtgacctgcggagaacactgagagctatcctgcaccacgccgagaaagagggactcgcccagcagaacagagagggaaggaaggactatcctgcctacctgcagggtatgatcgcttatgtaaatgcagctagcccccgccatgccgccgttttgcgtacacagctaggcaagctgaggggccaggcttga

SEQ ID NO: 13860 - RNA, 1263 nt, unidentified
  source 1..1263: mol_type = other RNA; note = synthetic construct
atggaagccgccacagccgcggacgacattgatgaagtgctggaaggtgaagggcaagatgaggatgaagatggcgccgattggtttcaggtcagcaagcatggcttcgaagtatcagaagacgacgacgatgacattactctgcagggtcctgcctacagtggacatactgggcagcgtgcacctcagcacactgcggacagggcctattttggcgaggagacatggggagtgtcggctcgtcaacggagcgcagagatacagcccgcccagttagctcgctaccagctgcctgtcctgcggagcgaggttgacctcgctacatggctgggcatccctctgtccaggctccgttggtatacacacgatagaccagccgagcgaacttggcactatgtcaggtatgctgtgccgaaaaggtcaggccagggagagcgggttatcttggcccctcgccgggagctaaaggccttgcaaagaaaggtcctgaagggtattgtggcaaaggtgccggtagccgcaacgacccacgggtttgtcgccggaaggagtacactgtccaacgctagcgaacacgctgggaaaggggtggttctcaagcttgatctcaaagactttttccccagtgtgacgttccggagggtacgcgggctttttaccgctctcgggtactcttacgcagtggcgtctgtgcttgccctgctctgcactgagtacgacagacagccattcgagaggagcggcgaacagtactacatctccgtcggccccagacatttggttcagggtgcgcccacatcccccgggttagctaatctggttgcatggcggcttgacaggcgcctagctggcttggcttccaaacgtgggtttgtctatacccgctatgccgatgacctcactttctctggagaggacgcagaagctgctgcacgacttggagctgccgccgctagaattatagccgatgagcaattcaccgtaaatgcaggcaaaacccggctgctgagaagaggaggccgccagacggtgaccggactagtggtgaacgcatctccagccaccccaagagaattacgacgcaggttgcgcgccatcctgcataatgccgcgagagacggactggatgcccagaaccgggaggatcgaggccattatgcggcatacctgggtggcctcatcgcatacgtgggctcagccaacccctcacacggtgacgtgctgcgccgacaattccggaggcttgttaccccaagagagtga

SEQ ID NO: 13861 - RNA, 1536 nt, unidentified
  source 1..1536: mol_type = other RNA; note = synthetic construct
atgcagtatgaagtgcgtctggccggttatcccgatctggtatgcctttgcagggctggaggcggtggctccagatcaacaggtttcgccgtcagccggagcgagtgtacatttatgaacctggcctcactgctcctggagctcaaacccttactggctgatccggaagctaattttgaccgcatcacagaactgctggaccggcaccagggactggcagaatacgaagtcgccagattctatgttagacgcgtgtggcaggccccagtggagtcacgattgagatcgatggatgcccgcgagcgattaaaggggattcgtcagctccctctgctgttttcttcagcaaccgcagcaaggctcctgaggcagcgggttaaggatcccgacacccgcgtggcacaagcagcacgtgcaagcgttcgccggcttggcctagctgacgtctctttgccggaccggagagtgaaacccggccgttctgctggctctataggacggtggaatccaacaggctggaatttcgggctgttcgggaacgagctgtacggcttcagtaggaaggcgaagcgaccaccccctagagtgggcgagctacctgaactaagaacgcgggctgatgtggcggaactcgttggggtggaggagaatgcgttggacgccctgatgaggccaggaactgaaagcgggagtggatacgtggagtttgaggtgcccaaacgtaccggaggtgtgagaaggatcagtgcacccaggcagaagcttaaggaggtgcagcgcgctctcttagacaaagtactagctcgcatgactccacatccagcagctcatggtttcattgagggccgcagtacggtgtccaacgccgaaccccacgtaggagcaaccgctgtggtccgggtggacattgaagattttttccccactgttcactaccggcgagttaagggattgttcctcgcttacggctatggagacgaggtcgctggggtacttgccggccttaccactcacagaacaaagcttcctgacggtaccgtcgcctggcctggagtccttccccaaggtgcccctacttccccggcgatcgccaatttggtctgtagacggatggatgccaggctcactgccctggcgaaaaaattttccgccatctacaccaggtatgccgatgatctgagctttagctttagagagcctccagagcggttaggcaggttcttctggtggctgaatgctattctccagcaggaagggtttgccgaaaacggaaagaaacgccgcgtgatgagacaggggtcccgccaacgagttaccgggctgacagtcaaccagaaggtgtctatccctcgtgaagagcgaagaaggtttaaagccatattggccaactgccgacaccatggggtagccgcccaagctagaggcaggcctgacttcgagaggtggctggaggggtacgcggcttatgtgcgcatggtccatccagagttgggcgccaggtggcagcgggaagtgaaggagctgctcgcacggtga

SEQ ID NO: 13862 - RNA, 1428 nt, unidentified
  source 1..1428: mol_type = other RNA; note = synthetic construct
atgaatctcgcgagtttgttacttgagctgaagcctctgctagccgatcctgacgcaaacttcgaccgaattacagatctgctggagcgccatcagggtctggcggagtatgaagtcgcccgattttatgtgtcaaggagctggaaggaaccagtagaaagcagactgagatccgtggatcccagggaacggagcaagggggtgagacagctgcccctgatgttttccgggacggtggccgctaggcacttgagatctcgggtcaaagacgccgattcccgcgttgcttcagctgctagggccgctgtgaggaaactgggccttgcggatgtagctccccccgacagcagagtcgctccctcaaggcaccatggccgacggtccgttggaggatggaaccctactgggtggtactttggcctgtttcgctatgagacacagggctggtccggcagcatgaaacggccaccacctacaagcggcgagcttcctcgtctctctacccgcgcagacgtggccaaattggttggggtcgacgaaagtgagctggacgccttaatgcgccctggtaccgaggccggatccggatacgtggaattcgaagtcccaaagcggagtggaggcgttcgccgcatctctgccccacgacaaaagttaaaagaagtgcagcgtgccctgctggatcaggtgctcgctagaatgaccccccaccccgcagcacacggcttcatagagggccgatctactgtctcaaacgcaggtccgcacgtgggctctactgtggtcttgcgggtggacctcgaggacttcttccccaccgtgcattaccgtcgggtgaaggggctgttccaagtgcatgggtacggggaggaggttgctggtgtgcttgcgggactgacaacccaccgccctaagctgccagatggtacagtcgtttggcccggagctctccctcagggagctccaacaagtccggcaatcgcaaatcttgtgtgtaggagaatggatgccagactcacggcacttgccaccaagttcggcgcaacctatactcggtatgcagacgatctgtctttctcctttagggcgcctcccgagaggttgggtcgatttttctggtggattaatgccatcctacagcaggaaggctttactgagaacgggccgaaaagaagagtgatgcgccagggatcaaggcagcgcgtaaccgggctaactgtgaaccaaaaggtcagcatcccacgggaggagaggaggagatttaaagccattctcgccaattgccgacggcatggtgtcgcctcgcaagctcgtggccgtccagacttcgagcggtggttggaagggtacgccgcatacgtacggatggttcacccggaactcggagccagatggcagcgcgaggtaaaggaactgctcggcaggtga

SEQ ID NO: 13863 - RNA, 1422 nt, unidentified
  source 1..1422: mol_type = other RNA; note = synthetic construct
atgggcatggacctcgtgggactgcttctggagctcaaacctcttatggcggacccagaagctaatttcaagagaatcactgccctgctggagcagcaccagaatcttgccgagtatgaggtggctagattctacgtgtcccggcagtggttggctccagtgggacgtatgttgaggagcgtcgatccccgcgagaggcaccaaggcacacaacagataccactgctattcgcaagagccacggcgagtgcacaactccgtcgtcttgtcaaggatccagacaaacaagtagccggcgccgccagagcagcagttcataaactggggttagccgacgttgcaccgcctgatcgccgattcaagcccccacggcatcctacaccccaatcacgaggcgggtggaacccaaccggttggaactttggactgcccatgcgatggggcggaaggccaaagaaacagcccccgctgaaaggtaagttacccaaactctccactcgcaaagatgttgctgagttggtgggtgtccaggaagaggagttggcagctctaatgaggcctgggaccgaggcaggaagcggatatgtggaattcgaggttccgaagaggtccggtggcgtgcggagaatttcagcgcctcgcgccaagctcaaagaagtgcagagggctattctcgagaagatcctggaacagatgcccacacacgatgcagcacacgggtttgtcaaggggagatcgaccgtatctaatgctgaacctcatacaggcgccaccgtggtagtccgcgtggatctcgaggacttttttcccactgtgcactatagacgggttaagggcctgtttcaggctcacggctacggggacgaagtggctcgaacattggccgggctgagcacccatcggcctaaactgcctgacggtacggtggtatggcctggcgcacttccccagggagctccaacctccccagccatcgcgaatctcgtctgtcgccgaatggatgctcggctcactgccctggccaaaaaagccggggccacctacactaggtacgcagatgacctgtctttcagctttgagaaacctccagaaaagctgggtaggtttctgtggtgggtcaacgccattctgcagcaggaaggattcctagagaatgccccgaagcggagagtgatgaggaagaacagtcgacagcgggtgaccggattgacagtcaacgaacaggttagtatcccccgtgaggagcgcagaaggttcaaggctatattaaacaattgccggaaacacggcgtcgagtctcaatcaaggggccgcaaggacttctctggctggctgagagggtacgccgcgtatgttaagatggtgcatcccgaattgggagagcggtggcagcgcgaggtgaaggaacttctgggggaatga

SEQ ID NO: 13864 - RNA, 1416 nt, unidentified
  source 1..1416: mol_type = other RNA; note = synthetic construct
atggacctggtcggactgctgctcgaactgaaaccacttatggccgaccctgaggccaattttgaacggataactgaactcctcgagcaacaccaaggcctagctgagtatgaggtggcacgcttctacgtttccaggcactggctggaaccggtaggtcggatgttgcgatccgtcgatccaagggagagattgcaaggaacaaaacaggtgcctctcatcttcagccggggaactgccagcggccaattgcgaaggttagtcaaagatcccgatgagagggtttcacgtgccgcacgagcagctgtccataagttgggcctcgcggacgtagctcctcccgataggcgtttcaaaccgcccaggacccctagacctatggccctggggggatggaaccccacaggatggaactttggaattcgaaccgggagatgggctagcccaaagaaagccccacctcttaaaggtaagttacccaagctggccagtagacaggacgtggccaagctagtgggcctagaagagaaagaactggacgcccttatgaggcctggtacagaggcagggtccgggtatgtggagtttgaaatagctaagcggagtggcggtgtaaggcggatctcagccccacgggccagactcaagcaggtccaaagaactattctggaacagatcttgtctcacatgccgacccacgaggctgcccatgggtttgtgaagggccgcagcacagtgtctaacgccgctccacataccggagcaacggtggtagtccgggtggacctggaagacttctttcctacagtccactaccgccgagttaaagggctctttcagtctcatgggtacggcgatgaggtggcgtccactttggcgggcctgacgacgcacaggcccaagttagctgatggtacagtggtttggcctggcgcacttccccagggtgcaccaacctcacccgcgatcgccaacctggtgtgtcggcgaatggatgcccgcctgaccgcacttgctaaaaagtacggcgccacctatacccggtatgctgacgacctctccttcagcttccaggcaccccccgaaaagatggggcgctttatgtggtgggtcaatgctattctccagcaggagggcttcgcagagaacaatccaaaaagacgtgtgatgagacgggcccacaggcagagggttactggccttactgtgaatcagcaggtgagtatcccaagagaggatcggcgccgcttcaaagccattctggcaaattgccgcaagcatggagtggcttcgcaggctcgtggccgcaaggacttcgagtcttggctgagaggatacgcggcctacgtgcgcatggttcacccggaactgggggccagatggcagcaggaggtcaaggaactgctggggggatga

SEQ ID NO: 13865 - RNA, 1443 nt, unidentified
  source 1..1443: mol_type = other RNA; note = synthetic construct
atgtcactcgtaggactactgctcgaactgcgacctctgctcgctgacccagatgctaacttcgaccgcgtgtcggaactgttggaacgtcatcaggggctggcagaatatgaggtagccagattctacgctgggcgagcgtttgttgggcctgtgggcaggctgctcgggtcagaagaccccagggagaggcttcgaggcgtcaggttagtgccccttctgttcgctagagccaacgcagcccagcaccttcgccgaatggtgaaggacgccgataatgcagttgctcacgctgccagagccgctgttagaaccctgggactcgctgacgtgtctccccctgacagacgtgcaccagcaccgaggtttccctccccaacagctaggggcggctggaatccaaccggctggacttttggattattcaggaatcactacgtattccggcggggtgccgcagctactactaacgcccccttaacggctccacctaaggcggacgttcccgagctgaagtcccggaacgatgtcgcaaagctggtcggggtaaaagcgagtgccctgccctcccttatgcgtccaggcacgggtaaagggagcggatacgtggagtttgaaatccccaagcggactggtggcttgcgcaagatctccgcacctcgggtgcggctgaaaaacgtccagcgagccattctgcgcgaggtgctggagaagctgcccacccaccctgctgcacatggattcgttgaagagaggagtacagtgacaaatgctacccctcatgtcggcgcgtcagtggtcgtgagagtggatatcgaggattttttccccaccgtacattacaggcgggttttgggctttttcatgagatactatgacgaaaaggtcgccgctgcactcgccggactaaccactcatcgcagcaagctgccagatgggactgtggtttggccgggtgcgcttcctcaaggagcccctacatctccggctttggccaacctggtctgcaggagactggatgcccgtctggatgcactcgcaagaaaatctggtgccacctatacacgctatgccgacgacttgacatttagctttcgcgatcctccagcccgcctgggtaggttcctctggtgggttaatgggattctccagcaggagggatttgccgagaatgtcaaaaaacggcggattatgcggaagggcggaaggcaacgagtgaccggactcgtggtggccgagaagccagccataccacgtgaggacagacggcgcttcaaggcgatccttgccaactgtagaagacacggcgtggaaagccaggctaggggcaaaccggatttccccgcctggttacgcggctacgcagcatatgtgcggatggtgcacccagaattgggggccaagtggcagagagaggtcgaagagatacttctaaaaaaatga

SEQ ID NO: 13866 - RNA, 1425 nt, unidentified
  source 1..1425: mol_type = other RNA; note = synthetic construct
atgtccctggtgggcctgttatttgagctcaagccattactcgaagaccgggagcgcaattttgataggattgtcgagctgttggagaagcatcgcaatctggccgagtatgaggtggcccgattctatgtgtcgcggaattggctggaccccatatccaagagacttgcatccattgaccctcgagagaggctgaggggggtgagactcatccctttactgttcgccagggccaccgctgcacaacatctgaggcgcatggtgaaggacgccgatatggctgtagcgagtgccgcaagagccgccgtccattcactggggatagccgacgtcgctcccccagatcgtagagcaccaccccccagataccctgggccaagtgccttgggcgggtggaatcccagtggctggactttcggcttgcatcgcgatcattgggctttcagggcgaacagagcgaaggcgaagaccccccctaaagcagatgttcctcccctgaagacaccaaaggatctggccgccttgctaggtgtcaaggtgacagctctgcgctctctcagccgtcctggtaccggacctggtagcggatacgtggaattcgagatccctaaacggactggaggggttagaagaatctcagcaccgcgaatgccgctgaaacgcgtacagcgtacaattcttgaccagattctggcaaaacttcccgcccacccagcagcccacggatttgtggaggagcgctctaccgtttccaacgcttcaccccacgtgggagccgccattgtcgtacgggtggacatcgaaaacttctttccaactgtgcactacagaagagtgttcgggtttttttttcaacactacggagaagaggtcgctaaggccctcagccagctcactacacatcgacccaagttgcccgacggtaccgttgtgtggccaggtgccttgccacaaggggcacctacttctcctgccatcgctaacctcgtatgccgtcggcttgatgccaggctggcagctctagctaaaaaagcaagcgctaattacacacgctacgctgatgatctaacgttctctttccgggacccccctgacagacttggccggttcttatggtgggttaacgcaatactccagcaggaaggctttacggaaaacgtcaaaaaacggaggatcatgcggaaaggcaacaggatggcggtcaccgggctggtggtgaatgacaaggtgggaatcccgcgagaagatcggcgacgcttcaaagccattctgaacaattgtcggcaccacggagttgagagccaggcgaggggcaaaccggactttgctgcatggctgcgcggctatgccgcttatgctaggatggtgcacccaaagcttggcgagaagtggcagagggaagtcgaagaactcctggccaagtga

SEQ ID NO: 13867 - RNA, 1407 nt, unidentified
  source 1..1407: mol_type = other RNA; note = synthetic construct
atgtccctggtcagccttctgttcgaattgcgccccttgcttgccgaccctgaggccaactttgaacgcattgtcctgttgctggagcgaaaccaggatcttgccgaatacgaagtcgcccgcttctatgccagccgaacgtggttaggacccctcggccgtatgatggagagtattgatccaagggagcgtctgagagctgtgcgcctggtcccactgctcttcgctagagcacctgccgcaggacacctgcgaagacttgtgaaggatgcggacagtcgggtcgtcaacgcagctagagccgcagtgcggaaactgggcatcgccgacgttgccccaccggattctaggttcaccgcccctaggtggccaagagcaactgctgtgggcggctggaatcccacagggtggtccttcggcctctacaggtcagggtccgaaaagtccccgccacccgcaacagatttacccgctttaaggtcgcgagcggacgtcgcgagactcgttggagtggacgaggccaggctggtggccctaatgcgtcctggctcaggacctggttctgggtatgtggagtttgagatccctaaacggtccggcggcaagcgcctcatatcagctccgagggcggagctcaaagcagtgcaacgggcgatccttgacaaagtgctcagcaaaatacctgcacaccccgccgcacatgggtttgtggagggtaggagcacagtcagtaatgccgctcctcatgtgggtacccagagggtggtgcgggtagatattgagtcattctttcccactgtacactaccgcagggttaaggggttgttcgaggcttacggatacgacgaggtggtggccgccaccttagctggcctcacaactcaccgggctaagcttcccgatggggcagtcgtgtggcctggagcactaccgcaaggtgccccaacttccccagcaatcgctaacatcgtttgtcggcggttagacggccgactgagcgctctagcgagaaaggtaggtgcaacctatacgagatatgctgatgacctgagcttctctttccgggaacctcccgctcgcgttggtcggtttctctggtgggtgaatgccattctgcagcaggagggatttctggagaatctgcccaagaggagggtaatgcggaaaggggggaagctgagggtcaccggactctctgtggacgaaaaagttagtatcccacgcgaagaacgtcgcagatttaaggccattttggccaactgccggcaccatggcgtagcctctcaggctcgtggccgaccagattttccaagatggttggccggatatgctgcatacgttagaatggtgcatcccgagctgggggaaaagtggcagagagaagttgccgagctgctggcccgctga

SEQ ID NO: 13868 - RNA, 1419 nt, unidentified
  source 1..1419: mol_type = other RNA; note = synthetic construct
atgaatctggtggggctcctgctagagctgaagcctctcatgatggatcccgaggccagctttgacagaatcgtcgaactgctggagcacaaccagggcctggccgaatatgaggtggcacgcttttacgttgcccgcgcgtggaaggacgcgatagaatcgcgggtcagatcacctgacgctagagaaagactacgcgccgctcgcctaattccattgttactggatagaaccagtgcagctcgactcctccgacgtctggtgaaggatcccgataccagggtgtcagcatccgcacgagcagctgtgcgaaagttgggcctggctgacgtttccccccccgatagtcgagaggagcctccaagccatcctcacccatgggctatcggagggtggaaccccacaggctggtcctatggcctcttccccgaaacctctaaagccgtgcggaagcgtcctccacctgtgactgaggcccttccacctctccggacaagggaggacgtggctaagctgctgggtctgggtactgctgatctggacgccttaatgaggcctggtgccgaatctggctcaagctacgtcgagtttgaagtacctaaaaggagcgggggagttcggaggttaagcgctccccgcccaaagctgaaggcagcacaacgggccttgctcgaacaggtgcttgccagaatgccatcccaccctgccgctcatggattcgtcccgggaaggagtactgtcacaaacgctcagccgcacgtaggcgccaccgtagtggttcgggtcgaccttgaagacttctttccatcagtgcacttccgcagagtgaaaggcctgtttgaggcccatgggtatggcgaagaggttgccaccgcgttagcggggcttaccacctatcgcgccaaacttcccgacggcactgtggcctggccaggagttctgccacagggtgcacccacgtctccagcgatcgccaatctggtgtgcagaaggatggatgctcgacttgccgccctggccgccaaagttggagcaacgtacacaagatacgctgacgatctcagcttttctttccgtcagccccctgagcgtttgggaaggttcttctggtgggtcaacgcgattctccagcaagaggggttcgcagaaaacgggcccaagcgcagagtgatgcggcaaggaggcaggcagcgggtaactggtttgacagtgaatgaacgcgtcagtatccccagggacgagaggcggagattcaaagctattctcgctaattgtcggaaacatggggtcgattcccaggcaagaggacggccggattttcgccgttggcttgagggctacgcagcatacgtgcggatggtgcacccggagttgggcgagacatggcagagggaagtaaaggagctgctggccacctga

SEQ ID NO: 13869 - RNA, 1419 nt, unidentified
  source 1..1419: mol_type = other RNA; note = synthetic construct
atggacctcgtgagtttgctacttgagctgaaaccactgatggaggacccagaggcccacttttctcggatcacagagctgctggaaagacatcaggggctggctgaatacgaggtagcgcgcttttatgtgagccggcactggtcagaggtggtgaccaagagactgggatctgtagaccctcgggagcgcattcaagccgtccggttaatccccctcttgttcccacgggtgacagcggctggacaccttaggcgcagagtcaaagatgcggactcacgcgtggcctctgccgcaagagctgctgtccggaagctgggactggcagatgtctccctgccggatagccgtgaagaaccacccagacgaccatcaccccatgccttgggcggatggaaccctactggatggcactttggcctttaccctcgaaggagggaagatctcgtgaagagaaagccctctgtcaccgcaaaactgccaaaactgcagtcgcgggatgacgtggccaagttggtcggggttgacgtggccgagctcgatgctctgatgaggccgggatccggagctggatccggatacgtggaatttgaaacacctaagcgctccgggggcatgcgcagaatatgcgcccctagggccaagctaaaggccgcacaacgcaacctgctggagggccttttgacccatctgcccacacatcctgcagttcacgggttcgttccaggccgtagtaccgtgacgaatgcagaggttcatgtaggcgcccatgtggtcgtccgagttgatttagaggatttctttcctactgtacactaccgcagagtgaaaggctttttcgaggcccacggttacaatgacgaggtgagctctacccttgccggcctcaccacttggaggcccaagctgcctgacgggactgtggtatggcctggcgttttgccccagggtgctccaacctcacccgccatcgctaacctcgtgtgcaggaggatggacgctcgtctgcacgcgctcgcgaagaaagccggggctagttatacacggtacgctgatgacctctccttcagcttcgtgaagccgcccgaaaggctgggcaggttcctttggtgggtgaacgctatcctgcagcaggaaggttttagcgagaatgccgcaaagagaagggtgatgagacaggggggtcggcaacgagtcactggcctgacagttaatcagagagtgagcattcctcgggaagagcgtcgacgtttcaaagccattttagccaattgtcgcaaacatggtgtcgaaagtcaggcaagagggaggcccaacttccccgcatggctcgaagggtatgcagcatatgtccgaatggttcacccggaattaggcacgcggtggcagcgcgaggtgaaagagctcctaaacccatga

SEQ ID NO: 13870 - RNA, 1419 nt, unidentified
  source 1..1419: mol_type = other RNA; note = synthetic construct
atggacctggtgagcctgcttctcgagcttaagccgttaatggaggaccccgaagcgaacttccagcggatcacagagctgctggagcggcatcaggggttagccgagtacgaggtggctcggttctacgtgtctagacactggtcagagactgttagcagacgtttggggagcgtggatcctcgtgaaaggctcgaggcggtgcgactgatccccctactctttccccgagtctcagctgctggacaactgaggaggcgcgtgaaggacccggattccagggtgggaagttgcgccagagccgcagtcaaaaagatggggctcgccgatgtgtcactgcccgactccaggattgctccacctcgccggcctagtccaagagcacagggcggttggaaccctacaggatggaattttgggttgttccccggactcagagcgacgccagtgaagaggaagccagcagatacccccgtcctaccagagctgcgtaccagggaagatgtagctaagttggtgggggtggagccctccgaactggaagcactaatgcggccaggatcaggtcctggtgccggctatgtggagttcgaaacacccaagcggtccgggggggttagaaggatttgcgccccacgggcacgtcttaaagcggctcagcgagcactgctggaaggactcctggcacgcatgcccacgcatgaagccgtgcacggctttgtctctggccgttcgcctgtcaccaatgccagggctcacgtcggcaaccaggtcgttgtgagagttgacgtggaagatttcttcccatctgtgcactacagacgggtgaaagggctcttcgaaagccatggatataacgaagaggtcgccagcactttggccggactgaccacttggaggccccgacttcccgatggtactgtagtttggcctggtgtgctgccccaaggggctccaaccagtccagccatcgcaaacttggtatgtcggcgactggacgcacgcttacatgcccttgccaagaaggctggcgggcaatacacacgctacgctgacgacctgtcctttagttttgccaaaccgcctgaacgcatgggccggttcctctggtgggtaaatgctatcctgcagcaggagggcttcgctgagaatagcgcaaagagaagggtaatgcgccagggcggaagacaacgggttaccggtctgacagtgaatcagcaggtcgccattcctagggacgatcgccgccgctttaaagcaatactggcgaactgtcgaaaacacggcgtggagtctcaggccaggggaagagccgactttccggcttggttggagggctatgccgcctatgtccgaatggttcaccctgagcttggcgagagatggcagcgggaagttaaagagcttctcggccgctga

SEQ ID NO: 13871 - RNA, 1047 nt, unidentified
  source 1..1047: mol_type = other RNA; note = synthetic construct
tctcatccgcatgcgatgggagggtggaaccctactgggtggaattttggtctaagccctgggatggggggcagagtgaagaggaaaccgccctccactggacctttgcccgtactgcatacacgggaggacgtcgctaagcttgtcggcgtggacgctgctgagttagatgcgctgatgaggcccgggtctgagtctggctccgggtatgttgaattcgaagcaccgaaacggtcagggggcgtgcgtcgtctgtgtgcaccaagggccaaactgaaggccgttcagcgcgccatcctggacggcatactggcccatctcccaacccaccctgctgtgcacggctttgtcgctggaagatcaacggtgacaaatgcagagccccacgtgggcagcaccgtagtagtgcgagtggatgttgaggactttttccccactgtgcactatcgaagagtgaagggcctctttgaagcccatggatatggtgatgaagtgtcctcggttttggccggtctgaccacgtggagggcaaggctcaaagacggaacagtcgcctggcctggagtcctaccacaaggcgccccaactagtcctgccattgccaacctggtgtgcaggcggatggatgcgcgccttaccgcgttggcaaaacgggccggagctaaatacacaagatacgcagatgatctgacatttagctttcgcgagccacccgaaaggcttggtcgattcctctggtgggttaacagcatcttacagcaggaggggttcgccgaaaacgccgcaaagcggagagtgatgcggcagggcggacgacaaagagtgaccgggcttaccgtgaatcagcaggtcagtattccccgcgaggaacgcagacggttcaaggccatcctcgctaattgcaggcagcacggcgtagaatcccaggctcgtggtcgcgcagacttcgctgagtggctgcagggatacgcagcttacgttcggatggtccacccagaactcggcgagcgatggcaaagagaggtcaaggagctgttggcccgctga

SEQ ID NO: 13872 - RNA, 1416 nt, unidentified
  source 1..1416: mol_type = other RNA; note = synthetic construct
atggatttagtggggctcctcctcgagcttaagccattgcttgcctcccccgaagagaactttgacagaatcgttgcgctgctggaaagacaccagggactcgccgagtatgaagtcgctcgtttttacgtgtcccgctcttggctggagcccgtagccagacgcctcaagtcagtagatcctagagagcggctacaggccgtgcggttgattcctctgctgtttgctagggcgagcgcagctggtcagttgagacgaagggttaaggatccagatagcagggtcagctcccatgcgcgcgcttcagtgcgaaggctgggtctagctgatgtgagtttacctgacacccgggctgatccccccagattcccttcggcaacagcagtggggggttggaacccaacgggctggtcatttggtctgtacccatcaatgagggccccagtgaagagaaaacctgccgccacgactgctctgccggtgctaaagacaagagcggaagtggcaaaattagtgggcgttcctgtctccgagctggacgccctgatgaggcctggatctgaggccgggagcggctatgtcgagttcgacgtccccaaacgaagtggtggagtgcggagattgtgcgcaccacgagccaaactgaaagctgtgcagcgcgcaatcctggacaacgttctggctcatctcccaacccacccagccgtgcacggctttgttcccggtcggtccactgtgactaatgccaagccccacgtcgggagtaccgtggtggtcagagtagatctggaggacttcttccccaccgtccattaccgccgcgtcaagggattgtttgaagcccacggctatggcgacgaagtgtcttctaccctagcaggattaaccacttggcggcccaggcttcctgacggcacagttgcttggcctggcgtacttccgcaaggggcgcctacaagcccagcaattgcaaatctggtatgccggaggatggacgcccggttgacagctctcgcaaagaaggctgacgcaacctacactaggtacgctgacgatctctcctttagcttccagaaaccgcccgaacgactgggcaggttcctctggtgggtgaatgcaattcttcagcaagaaggcttctctgaaaacgccgccaaaagacacgtaatgaggcaaggaggacgccagcgggttacagggcttaccgtgaatgagcaggttagtatcccgagagaggaacggcggcgcttcaaggccatactcgccaattgtcgtcagcatggggtggaaagccaagctcgtggccgcccagatttcgctaactggctgcaggggtatgccgcctacgtccgcatggtgcatcccgagctgggagagcgatggcagagggaggtcaaagagctgctggcccgttga

SEQ ID NO: 13873 - RNA, 1416 nt, unidentified
  source 1..1416: mol_type = other RNA; note = synthetic construct
atggacctggctggcctgttgctagagctccagccgctgatggccgagcccgaaacgcacttcgaaagaattgtgggcctgctggaacagcatcaggggctcgccgagtatgaggtggcacgcttttatgtctctcggcattggatggactctgcatccaaacggctcggaagcgcggatcctcgcgaaaggttgcgggctgtccgtctcattccattgctgttcccccgtgcgatagctgcaggccaactgcgaaggcgggtgaaggacgccgactccagagttgccgctgctgcaagagccgccgtaaggaagctgggactggccgatattagtccacccgactcaaggatagaaccgccccgacaccccgggccaagaagtttgggcggatggaatccaaccggctggaatttcggcctgttccctgcggatggcgagagggtgaagagaaagcccgaagttgcaacgagattacctgagctgcgcgacagggcagacgtagcccgactcgtgggtcttgatgagcgtgagctggcggctcttatgaggcccggcagtgaacctgggtcgtcttatgttgagtttgacgtgccaaaacgttcaggcggtgtaaggcgactctgtgcaccccgcgctcgtttaaaggccgcacagagggctttactggataatctcctcacacatctgccaactcaccccgccgcccacggttttgtgcctgaacggagcacagtcactaacgcccagccacacaccggggcaaacgtggtggttcgcgtggacgttgaagattttttccccagcgtgcactatcggcgggtcaaaggcctctttgaagcctacgggtacggcgcccaggtagcttctactctcgccggacttacaacctggcgggctaaacttcctgacggaacagtcgcctggccgggcgtattgcctcaaggagctccaacatcacccgctatcgcaaacctggtatgccggcggctggatgcacgcctagatgctcttgccaagaaggcgggggcacgctacactcgctacgctgatgacttaaccttttccttcccgcagcccccagaaagactgggacgattcctttggtgggtcaatgccatcctgcaacaggagggattttccgagaacgccccaaagagaagggtcatgcgcggtgggggaagacagcgagttaccggcttgaccgtgaatcagagagtggcaatccctcgggaggagagacgaagattcaaggcgatcctggctaactgcaggaaacatggtgtggaaagccaagcccgcgggaggcctgatttccctgcttggttggaggggtacgccgcctacgtccggatggttcatcctgagctgggtgccaggtggcagagagaggtgaaagagcttctaggacgctga

SEQ ID NO: 13874 - RNA, 1404 nt, unidentified
  source 1..1404: mol_type = other RNA; note = synthetic construct
atggctctcgccgaactgctgcttgacttgaaagagctcctgcagaaacccgatgaaaacgctgacgctatcgtgaaactcttagagcagcacgccgatctggcggagttcgaagtggctagggccgtggcaggcagagccgttgaagtaggggtggagaggaggctgaagaacgtcgacccaaaagagcgtctcgctgcggtgcgaagcctgtcaggactttttcccagggcacctgctgcccggctgttaagaaagatggtgaaagacccctccagatccgtctcggctgcagctcgggctggagtcagaaggctgaagttggcagatgtggccctgccagattccaggtggacccctgacagagaatcccccttggtgcccggcggatggaaccctagcggatggtgggctggcctgtttggccggtcttcaaagccgcctcccaaggtcagtctgcccaagctgagctctcgtgctgatgtagccaaactcgtcggcgtgacagaagaggagctgaccgcctttatgcgtccgggcagtgcgtcagggtcagggtacgttgagttcgatgtccctaagcggtccggtggaactcgcaggatagccgccccacgtgcgaaacttcgcactgcccaacgcgctctcctagaccaagtgctgagtaaaattccccttcatggcgccgctcacggctttgcgattgaccggagcgttgtgacaaatgcccagttacacgtgggggccagtatcgtcgtgaaggtggacttggaggagttcttcccttctgtccactacagacgggtacgcggcctgttcgaggcctacggttataataccgaagtggcatcaacgctggcagggctcacaacgtggcgagcaaaacttcccgatgggcgagtggcatggccgggttgtttgccacagggcgccccaacttccccagcaattgcaaatatagtttgcaggaggctcgatgccagactcaccgcactttgtgcccggtttggagccacttatacccgctatgcggacgacctggccttcagcttccagaagcaacctgagcgactgggccgcttcctgtggtgggtaaacagcatctgccagcaggagggctttagcgagaacgatggtaagaggagagtaatgagatctgggggaagacgcatggtgaccggactagttgttaatcagaaagtttctatcccacgagaagatcggcggcgctttaaggccatcttacacaatgtgaagaagcatgggctcgagtctcaagctcggggaagagaagacttcaagagttggcttgagggctacgcttcctgggtcaggatggtgcatcctgaactaggtgccaagtggcagcgagaagtcaaagcattgacacgcggtcaggggtga

SEQ ID NO: 13875 - RNA, 1422 nt, unidentified
  source 1..1422: mol_type = other RNA; note = synthetic construct
atgggccttggggagttgctcgtagacctctctagactgctagccgatccagcaaaaaatgctgccagcatctacgccatgttggaagctaatgccggcttagcggagttcgaggtagccaggttttatgtggccgatgcgatgacagccgacgtcgcagagcggctgaaatctgtggatccacgcgaacgagtcgccgctgtggatctggtgaggctcgtctgcccccgtacctcagctgccaagcttttgcggtccgtcattaaggatcccgaccccaccgttagaaaacgcgcccgcgcaacagttcggaggatgatgattacggacgtggcactgaaggaccccagattcaagccttccccttgggcacgcggtccatttgctcctggggcatacaatccgtctggatggagttttggagtgtacgggaggaagcagaccggcagtgcagaccgaggggctctaggagcaaaagggttgccgcttctggagggagccgatgacgtggccaggctagttggccttgccgacggaaaggcgctgaggcgatttatgcgtccaggctcagccagcggctcaggttacgtggaattcgacgtgcctaaagctactggcggggctaggagaattgctgcgcctagggctccgttacgaagggctcagcgggtaatacttgaccagatcctcgccaaggtgccagcacatgatgcggctcacggcttcgtcagagggagaagcacggtgactaatgccgagccgcacgtgggacgcgcaatagttatgaagctggacctcgtggatttcttccctagtgtccattatagacgcgtcgtcggcctgttcgaacaactggggtatcccaccgaagcagcatcggcactggctggactctgcacatggaggccaaagctgggagatggtgccgttgcatggcccggtgtactcccccagggagcacctactagccctgccatcaccaacctggtttgtcgcagattggatgcgcgcctctccgcccttgccaaaaagatggggggtgtctacacacggtatgcggacgatctgaccttttccttccccgctgagccagaacgaatcggccggttcctgtggtgggtcgatcagatcgctctgcaggagggctttgttgagaacacaaagaagcggcgtgtgctgcggcgatctgcacaacaaagggtgactggggtggtcgtgaatgaacacccagcgattccacggaaggaccgccgtagaatcaaagccgtgctggccaacgtgaaaaaaaacggcttagccgccgaagctagaggcaaccccgactttgaggcctggctgcatggctgggtagcctacgccactatggtgcagcccgctctcggtgctcggtttgctgcagccttggctggagttgccccttga

SEQ ID NO: 13876 - RNA, 1452 nt, unidentified
  source 1..1452: mol_type = other RNA; note = synthetic construct
atgcacaccctggtggacctactgattgagttaaagacgttagctacagcaaccggggacgctaatcagctagcccgaattaatgaactcttttccaaccctcgtgcacccgccgaattccaggtgggacggcacttcgtggcccgcttgcttgttccgcaggcagaggccgcaatggcgagttttgacccagctgacagactgtccgccatcgagacttgccgaacagtgttccctcgctctatagcagcccgcctccttcgccgtgtcatcaaagaccccgatcccaaggtgagatcttctgccaaacgggccgccagtgccctgcgtttggacgatgtcgcccctccagacatcaggtatcgcgtagaacgggacagtcccctggggagacacaatcccacgggctgggcattcggcatttttcccacggatgatcatcctcaaagaaagactaaacaggctacaaggcagaccgccctggacgcgcatcaactcccaaaactcgcgaatgtggccgctgtcgctcaactagttgggatcgaccccgacgccctggttcggatgatgaggccaggcactgaggctggtagcgggtatgtggagttcgagatcccgaaggccaaagggggcacaagaaggattgccgcaccaaggacccccctgcggaaggtacagagaaaaatccttgacgacatactcgcaaagctccctttacacgatgcatgccatggctttgtggtcgatagaagcaccgtgacaaacgccactccccatgctagggcagctctggtcataaagattgacttgaaggatttcttccctaccgtacactaccgccgcgttaagggtctgtttcagcacctcggctacaacgaagaggtgtcggctaccctggcagggctgaccacttatcggccgaagctgcctaatggccatgtggtgtggccgggagttcttccacagggagcccctacttcaccagctctagccaatctggtatcccggcgactggaccagaggttatccaaactcgcagaaaagtacggagcctcttacacacgatacgctgacgatctcactttcagcttcaaaacccagccagaactgagaatcggacgatttctgtggtgggtcgatggcatttgtcagcaggaggggttctcagaacgggccgataagcggagaatcctgagagcaaaacaccaacaaagggtcacaggtttggtggtcaaccagaaggttaacgtccctagggaggatcgccgtaggtttcgcgctatcctgcacaactgtgccaaacatggcttggagagccaagctggttcacttccacccggcgcggattttaaggcttatcttgcaggatacgccgcgtatgtgcacatggtggatcctaaattgggaaaacagtacctggcccaggtggctgcgctcattggtaaggattga

SEQ ID NO: 13877 - RNA, 1455 nt, unidentified
  source 1..1455: mol_type = other RNA; note = synthetic construct
atgcagactctcgtcgagctactcctcgagctgaagactctggcagctgaacccgatggccctggaaaactcgagagaatcaacgccatgttcgctaatccgagagctcccgccgaattgcaggtgggacgccactacgtgtccaggttactcgttccgggggttgccgcccagttggcttctcttgaccctgcgcacaggcacatagcgatcaccacagccaggcttgtctttccgcgcgccacggctgcacggttcttaagacgcttagtgaaggaccccgacctgaccgttcgcgttgctgcaagacgagccgtgagcaagcttgggctccatgatgttgcaccccctgacgtgcgttatcagatcacctcagacagtgccatcggcggccataaccccaccggttgggcatttggaatttttccaactgatgatggacctcggcggaagcctaaaccagccacaagggccaccgccttagcacagcacggactgcccgccttggctactcgtgccgatgtcgcagcgcttgtaggtgtggacccccagggtctggccaagctgatgcgtccaggagtaggccctggctccgggtacgtggaattcgaaatcgctaaggctaagggcggtacaagacgaattgccgcaccacggggcccattgcgcaaagtccagcgcgtgctgctggatcggatcctggcaaaggtcccactgcatgacgcctgccatgggttcgtgccaggcagaagtaccgtgactaacgcgggaccgcaccaacgggctgccatagtggtcaaactcgatctcaaagacttcttccctaccttgcactaccgcagagttaagggtttgttccaacatcttggatacaatgatgatgtggcgggaactttggccggcctgacgacataccgaccaaagttggagtcagggctggtagtatggcctgggatgctaccccaaggggctcccacatctcccgctctggcaaatctcgcatgccgcagactggaccataggcttgagcgactggcggcgaaatatggcgccagatatactcgctatgcagatgacctgaccttcagctttgctacaatgccagaagtcaggattggcaggtttctgtggtgggtggacggaatttgtcagcaggaagggtttaccgagcgtgatgacaaacgacggattctgcgggcaaagcaccagcagagggtgacaggcctggttgtgaatgagagagtcaacatccctagggaggaccggaggcgattcagggccatactccacaactgtgccaaacatggggtcgcaagccagacgcgggaacacgaggactttccagcttacctggccgggtacgctgcttatgtgcacatggtggatcccgttctcggcagacgctatctagacgaagtggccagactgcttgcccaagagcctaggcggggttga

SEQ ID NO: 13878 - RNA, 1446 nt, unidentified
  source 1..1446: mol_type = other RNA; note = synthetic construct
atgatcgggacattagtcgagttgctcgtcgagttaaaaacgctagttgcgtccagtgacaagaacaagctggacaaagtgaacaagctcttcagcaaccccaaagcgccagctgagtatcaagtgggtcgccactttgttgccagtaagcttgaaaaggatgtggaggtgcaaatatccgatcttgatcctaggcagcggaaggctgccgttcagaccgtgatgctggcttttcccagaagttctgctgccaaattactgagaagggtcgctaaggatcccgacatgaccgttagaagcgcggcccgccacaccatcaaaaccttggctctgaatgatgtggccccaccagacatccggtatgctcccgacatgggcgtcatcggacatggaaatccaacaggttgggcattcggcatttttgctcatgattggcgaagcgacagaaaacccaaaaaaccgtctaaggtcactgccctggacgcacataaactgccaaagctgaaatctgtggccgatgtggcagctctggtgggaattgaactggatgatctgcctgcccttatgaggcctggcgtcggaccaggttccggttacgtagagttcgagattcctaaggccaaaggaggcacacgcaggattgccgcccctcgagctccattgcgtaaggtccaacgggccatactggaccagatcgtaggcaaggtgccagttcatgaagcatgccacgggttcgtaaagactagaagcacagtcacaaatgctgcaccccaccagggatcagccattgtggtaaagctcgacctcaaggactttttccctactgtccactaccggcgtgtccgcgggttgtttgagttcctcggctacaacgcagaggtggcaaacgtgcttgccggccttaccacctaccgcccgaagctggatgatggtacaatcctgtggcccggcgttttgccacaaggggcacctacgtccccggctattgctaatctggcatgtaggcggttagaccatcgtctcgaccggctcgcggccaagtacgatgctacttatactaggtacgcagatgatttgaccttctcattcaagacgtcggaccttaaactgggccgctttctctggtgggttgacggaatctgccagcaggagggcttcaatgaaaggcctgacaagaggcgagtgctgcggtcaaaacaccagcagagagtaaccggcattgtggtgaacgccggggtccatgtgcccagagtggacaagcggcagttcagagccatgctgcacaactgtaaaaagcacgggctcgaatctcaggcccgcgggaaagaagattttgaagcatatctacgagggtacgccgcgtatgtgaatatggtggacccccctctaggcaaaaagtttatcgcccaggtggaggcagttctgggtggaactcccgggggatga

SEQ ID NO: 13879 - RNA, 1449 nt, unidentified
  source 1..1449: mol_type = other RNA; note = synthetic construct
atgcagacgctggtcgagctcctgatagaactaaagagccttgctgacgcgccacacgacgacggaaagctagaccggattaacaaactgttcgcaaacccaagagctcctgcagagtaccaagttggtcgtcattatgttagtaagttactcgctccctccgttgaagcgaacctggattctatcgatccagctcagaggctcgccggaattgggacagccacggctgtattctctaggaatgttgccgctcgctttctgcgccgcgtggtgaaagatcctgacggcagagtacgtgctgctgccgcaaaagccgtcaaacacctgggcctgacagatgtggctccgcctgacgtgcggtacaagatagacccagattcggagctgggagggcataaccccactggctgggcctttggtatacacccgaatgacaagtcacgccagcggaaacctaagaaacccagccgggtgaacgccttgaaggagcttgaccttccacgccttgcaggagtggctgatgtagcaaagctcgtgggcgttgccgagggcgaattggcctccttgatgcgtccaggttgtggacctggcagtggatatgtggagttcgagattccaaaagcgaaaggtggcgctagacgaatcgcagctccccgaaccccccttcggaaggtccagagggccatcctggataaggtgctggcaaaaatccccctgcacgaggcatgccatggctttgtgcccggacgatctaccgtcacaaatgcccggcctcatcaaggcgctgccatcgtgattaagctggatctaaaagatttcttccccaccgtgcactatagaagggtgagagggttgtttgagagccttgggtacaatgaaaaggtcgccagtactctcgccggcctcaccacatacaggcccaaaatcggcgacaaaactgtggtctggcccggagtattaccgcaaggcgcccctacttccccggccttagccaatctggcttgcaggcgtctggacaagcgcttggaaatgctcgccgcgaagtatgaggctacatatacccgctacgcggatgatctcactttctcattcaagaaggttccagactttagaattggtcgctttctctggtgggtggacggaatctgccagcaggaagggttcaccgaacgagccgagaaacgacggattttacggtccaagcaccagcagagggtgaccggtctggtggtcaacaaaaaggtaaaagtgcctagagcagataggcggagatttcgagccatcctgcataattgtgcaaagcacggactggaatcacaggccagagggcacgcagacttccctgcgtatctggctgggtacgccgcctacgtcaacatggtcgatccagcattggggagaaggctgctcgacgaggttgcacgccttctgggggaaagcaggggctga

SEQ ID NO: 13880 - RNA, 1533 nt, unidentified
  source 1..1533: mol_type = other RNA; note = synthetic construct
atgacgcaggccgccactagcgttctgtcccctattgaactgatactcaccttgcgcacactgctggccgatcgcgcatcgaatgctactctgatcggggagctcctcgagaggcatcaggacatggcggaatatcagattgctcggttttacgtcgctcggcacctgatcccacaggtagaagcactcttgagcgagctggacccccgccaacgtttggcagggatagagctggtccggtttggcttccctaggactctcgctggcaagttgttaaggcgggtagtgaaagacccagatatcgcggtgcgcaaacgcgctcgctccacagtgaagcgactaggccttgatgacgtagctccccccgatacaaggtatgatgcccggcgctcctcacttggaagaggaaaccccgcaggctgggccttcggactgttcagaaaccatgctcgctcagattggggaagacgacccagaccagctaccagggttgcagcgctcggagcacaaggccttcccccattagcctcttccagtgatctgtgcaaattgttaggtgtggaggccagcgcccttgtgagattcatgcgtcctggtacccagaccgggagcgcgtacgtggagtttgagattccgaaggcaaaaggcggcacacgacgaatcgctgcacctcggggtcccctcagacgagtccaacgcgtgctgctggaccagattttatctaaggtgccgcagcatgaggccgcccatggcttcattgcagggcgctccactgttagtaatgccagaccccaccagggagccgctctcgttgtgaagacggacctgaaagatttttttcccagcgtacactacagacgtgtggtcgggatcttcactatgctgggctatggcgagccgatggctagggcattagcggcactgaccacctataggcctcagctaccggccgacgaacctccaccatcagacgctgccccttctcctagtgatgctgcccgaccaccagaacctgcacgtggcagggtgctatggcctggcgttcttccccaaggtgcccccacaagtccagcgctcgccaatcttgcttgccgtcggttggacgttcggcttacacggctcgctgcgcggtatggtgccacctacacaaggtacgccgatgacctcacctttagcttcccccaaccaccccagtttgccatcgggaggtttctgtggtgggtcgacggtatctgtcagcaagaagggttcctggagcacccagctaagaggaagctcctgcggaaaaagactcagcagagagtgaccgggctggtgacgaaccaggaagtccacgtgcctagagcagaccggcgcagattccgagccttgctgcacaactgtaaaaagcatggggtggcttcacaggcaaagggaagggatgacttcgccgcctatctggccggatacgccgcctacgtccagatggtccagcctgaactgggcaaagcttgggcagccgaggtggcaagactgctaggagagtctgcttga

SEQ ID NO: 13881 - RNA, 1440 nt, unidentified
  source 1..1440: mol_type = other RNA; note = synthetic construct
atgaaccctgtggaactcattctcgaactgagagggttactcgccgacgcccaggcgaatggggcaaagatccgggagctgatcgagagccatcaagacatggcagagtaccagatcgcccgcttttatgccgctagacatctggtgccccaggtggaggcgttgatatccgagatagaccccaaacagagacttgccggtgtggagttaatccggtttggattccctcgcacgctggctggcaagctgctacgccgagtcgtgaaagatcccgacatcgaagtgaggaagagggctaggagtacagtcaagcatctagggctggaagagattgccctgcctgacacccggtatgacggagcgcggtcgattcgcggaaaatttaacaccactgggtgggccttcggcctattcgccgaacacgctcgcagagcttggaatcgcgtgccaaagaaggccacacagatagcagctctgggagcacaggggctcccggttcttgccagcattgctgatgtgcaagctctgttaggcgtcgacgcagcaggcctggcacgacttatgcgacctggcacggaatcaggctcagcctatgtcgaatttgagattcccaaagcaaaaggaggcaccagacggatcgctgcgccacgtggacccttacgtcgtgcccagagggctctgcttgatcagatattggcgaaggtaccacagcacccggccgctcatggctttgttgccggtagatccactgtcacaaatgcccgacctcacgtgggagcagccttggtggtgaaaacagaccttaaggatttcttcccaaccgtccattacagacgcgtaatcgggctgttcgagctccttgggtacaacgaggctgtagccggggtgctagccgctttgactacatataggcccaagctgcctgacggacgggttgtttggcccggcgtactgccacaaggtgcgcctactagcccggcgctggcaaaccttgcttgccggagactcgacgccaggctgactaaactggcagctaagtatggcgccgtctacacccggtacgcggatgatctgacctttagtttctctgagtcccctaagattgctattggaaggtttctgtggtgggtggatggaatctgtcagcaggaaggcttcgttgagcacccagggaagcgcaaactcttgagagccaaaacccagcagaggatcacaggtttggtgatcaatcgagccgtgcacgttcccagggcagatcgcaggcggttcagagccctgctccacaattgcgcaaagcacggcgtggcatctcaagctaaagggcgtgaaaactttgccgcttacctcgcaggctatgccgcctacgtccagatggtgcaaccagaactcggtaaggcttgggccgcccaggtcgctaaattgctgggtgaggcaccctga

SEQ ID NO: 13882 - RNA, 1470 nt, unidentified
  source 1..1470: mol_type = other RNA; note = synthetic construct
atgtctctggctgccttacttgtgcagcttaaaccactgctcgccgctcctcaggagaatctggctgcaataacagagctactgcgcagacaccgggatctggcggagtacgaagtcgcccgtttctgggtgtcccgctttctcggcccccagcttgagaaggaactgcgctctcctgacccacgcgtaaggaggcgtggagcagaagccgttcgctatatatgcactcggaagaccgccgggcatctcttacgcccgcttatcaaagaagccgataccagcgttgcagtcagggcgcgggcttccatgcgagtgttgaagctggatgatgttgccctgcccgattcaaggtatcctgccccgaaaagaggcaggggccaactggggggatggaatgtgaccggctggtgttttgggctgtacccccatatgcaccggtggtggcgaaggcgcggaaaacccgaagagcccactaagaagacgctgctggaaaagcacaagctacccaagctcacctcagagtctgagttgcgcgcgtggctcggcatccaaagaaagaaagacttgctacgcttattgcgtcctgggtgtgggacaggggccccttacgtcgaatttactattccaaaggcaagcggtgggtctaggaccattagcgcaccaagactcccactcaaaaagctccagcgacggattttggatgagattctggcaaagctcccagtccatgctgctagccacggattcgttcgcggccggtcagtcgtgagtaatgccaagccccacctgggtgccgctttggtcctcaaaatggacctgcgagattttttcccgacaatacactttagacgggtggtgggactattccagggaattgggtacgcagccgacgtagcgcaaatcctcgccggactctgcacccataggggcaaacttgcagatggatatgtgctctggcctggggttcttccccagggtgcaccaactagtcccgccatcgctaacctgttatgccggaggttggatgctagactgtcgggtttggcaaaacaagccggcggcgtgtatacgagatatgccgacgacctgacattttccttcagtgccgtgccagataagggaatcggtcggttcgcgtggtgggtagaccagatttgtcagcaggagggcttcgtggagaacagtgcaaaacggagagtgctgcaacggcataaccagcagaggatcaccggcatcgttgtcaactcagccctgcacatccctcgaagcgccagacacacattcagggcgctgctgcacaatgtgaggctggacggacttgcagctcatgccagaggtcggaaagactttcgagcttacttattgggcttcgcttcttacgtgagaatggtgcagcctactcttggccgtgccctgctgtccgacgtacgtgctgtcctgaaagctgacagaagcgcccagaagtcctga

SEQ ID NO: 13883 - RNA, 1467 nt, unidentified
  source 1..1467: mol_type = other RNA; note = synthetic construct
atgtcactttccgcactgctcttacagcttaagcctctgttggccgctcccagggagaatcttgccgctattagcgacttactgaggaggcaccgcgatcttgcagaatacgaagtggcccgcttttgggtaagccgagcaatggggccccagctggagcaagagctacggagccctgacccccggacaagaagaaaagctgctgaagcagtgaggtacgcctgcacaaggcggtcagccggaaggctcctacgcccattggtgaaagaggcagacaccggtgttgccgtcagagcgcgaactgccatgcacgcactcagactggacgatgtcgcattgcccgatacgaggtatccaaaaccaaagcacgctggtggattcggtggttataatgtcaccgggtggtgcttcggcctgttcccacacatgcaccgatggtggagaaaaaaggccaaccctaaccaggccgccaagcagaccttgctggagaagcatgggttgccggtactggcaagtgaggcggaactgctcagctggctcgggctgaaaagacggaaagatctgctccggctgctgaggcctgggtgtggaactggcgctccttatgtggaattctctattccgaaagcctcgggaggcacacgtaccatctctgcgccacgtgccagtctcaagaagatacagcgccgaattttagatgaaatcctcgctaagctgcccacacatgccgcatcacacggatttgtccggggacgcagcgtgctgtccaacgctaagccccatgtgggcgcctctttggtcctgaaaatggaccttagagactttttcccgactattcattttagaagggtatgcgggcttttttgtcgcataggttactcctctgaggtggcttccttgcttgccggactgtgtacccataggggcaagttggccgacggatacgtggtgtggcctggagttttgccccaaggggcaccaacttcccccgccatcgcaaatttactctgcaggcggctggatgcgcgactaacaggcctggctcgcggactggggggtaattacacgcggtacgctgacgacctgaccttcagcttcaaggccgttcctgaacgcggcatcggtcgcttcagttggtgggtggatcaagtctgtcagcaggagggctttgtggagaataccgggaagagaagagtgctccgtccacagaaccagcagcggatcactggcattgtagtgaattcaggcctcaacatccctcgtgccgctagacacacattcagggcgctgctacacaacgttaaacatgatggccttgccgcccaagcacgcggcagaaaggacctgcgagcttatctgctgggctttgcgagttatgtgcggatggtgcagccaaaggttgggaaacccttactcgccgaggtccgggcagttctcaaagctgccggccaggctgataagaaatga
